United States Patent 9,107,886 (MODIFIED POLYNUCLEOTIDES ENCODING BASIC HELIX-LOOP-HELIX FAMILY MEMBER E41) - sequence listing, part 9

SEQ ID NO: 13998 - DNA, 330 bp, Artificial Sequence
  Description of Artificial Sequence: Synthetic coding sequence
atggccctgtggatgcgattacttcccctgttggctctcctcgcgctctggggccctgacccggctgctgcattcgtgaaccagcatttgtgcggtagccatctggtagaagccctgtacctcgtctgcggtgagaggggatttttctacacgcccaaaacaaggcgggaagcggaagatctgcaggtcggtcaggttgaacttgggggaggcccaggggctggtagcttgcagcccttagccttggaggggtcactgcaaaaacgaggcatcgtcgagcagtgctgcactagtatctgctctctgtatcagctagaaaactattgcggg

SEQ ID NO: 13999 - DNA, 330 bp, Artificial Sequence
  Description of Artificial Sequence: Synthetic coding sequence
atggcactgtggatgcggctgctcccgttattggcccttctggcactttggggcccagaccctgcagccgcgtttgtcaatcagcacctttgtggatcacatctcgttgaggccctttatctcgtctgcggagaaagaggatttttctatacccctaagacgcgtcgtgaggccgaagacctacaggtcggtcaggtggaactgggaggcggaccaggtgcagggtccctgcagccgttagcgctggagggatctcttcaaaaaaggggtatcgttgaacagtgttgtactagtatttgctcgctgtaccagttggaaaattactgcggt

SEQ ID NO: 14000 - DNA, 330 bp, Artificial Sequence
  Description of Artificial Sequence: Synthetic coding sequence
atggccctctggatgcgactcttgccgctgctggccctgctcgcactttggggaccagatcctgctgcggcctttgtcaatcagcacctctgcgggtcccacctggtcgaagccttgtacctcgtgtgcggggagcgcggtttcttctacaccccaaagactcggcgggaagctgaagatctgcaggttggacaggtggaactgggaggagggccgggtgctgggagcctgcaaccgctcgccctggagggctcgctgcagaagcgcggaatcgtcgaacagtgttgcacctccatttgtagcctgtaccaactcgaaaactactgcggc

SEQ ID NO: 14001 - DNA, 330 bp, Artificial Sequence
  Description of Artificial Sequence: Synthetic coding sequence
atggcgttatggatgcgtttactaccgttattagcgttactagcgctatggggtccggatccggcggcggcgtttgtaaatcaacatttatgtggttcgcatttagtagaagcgctatatttagtatgtggtgaacgtggttttttttatacgccgaaaacgcgtcgagaagcggaagatttacaagtaggtcaagttgaattaggtggtggtccgggtgcgggttcgttacaaccgctagcgttagaaggttcgttacaaaaacgtggtatagtagaacaatgttgtacgtcgatatgttcgctatatcaactagaaaattattgtggt

SEQ ID NO: 14002 - DNA, 330 bp, Artificial Sequence
  Description of Artificial Sequence: Synthetic coding sequence
atggccttgtggatgaggttgttgccattgctggcgcttttggcattgtgggggcccgaccccgccgctgctttcgtcaaccagcatttgtgtggaagtcacctcgtcgaggcgctttacctggtgtgtggagaaagagggtttttttatacacctaaaactaggagggaagcagaggaccttcaagttggccaggtggagcttggcggaggccctggcgctggttctctccagcccctggctctggagggctccctgcagaaacggggaatcgtggaacagtgctgcacatcaatctgtagcctgtatcagctcgagaactactgcgga

SEQ ID NO: 14003 - DNA, 330 bp, Artificial Sequence
  Description of Artificial Sequence: Synthetic coding sequence
atggcattgtggatgcgactcctgccgctgctggcgcttctggcgctttggggccctgacccggctgctgccttcgtcaatcagcacctgtgcgggagccatctggtggaagctctctacctcgtttgcggagagcgcggctttttctacacccccaaaactcggcgcgaggcggaagatttgcaggtgggccaagtggaactggggggaggccctggcgcggggagtctccagccgttggcactcgagggatcgctgcagaagagaggaattgtcgagcaatgctgtacgagcatctgctccctttaccaactcgaaaactactgcggg

SEQ ID NO: 14004 - DNA, 330 bp, Artificial Sequence
  Description of Artificial Sequence: Synthetic coding sequence
atggcgctgtggatgcgactgcttcctttgctggcactgctcgccctgtggggccccgatccagctgctgcttttgtaaatcagcatttgtgtggctctcacttagtggaggctttgtacctggtttgtggagagcgcggcttcttttatacccccaagacgaggagggaggccgaggacttacaggtcggtcaggtggagttgggaggtggacctggggctggcagcctgcagccactggctcttgagggcagcctgcagaagaggggaatcgtggaacagtgctgtaccagcatttgctcgctgtatcagctggagaattactgcgga

SEQ ID NO: 14005 - DNA, 330 bp, Artificial Sequence
  Description of Artificial Sequence: Synthetic coding sequence
atggcactgtggatgaggctccttccgctccttgccctgctggccctttggggtccggatcccgcagcagcatttgtgaatcaacatctctgtggttcccacctcgtggaagcactttaccttgtgtgtggagaaagaggctttttctacacccctaagaccaggcgagaggcagaagatttgcaagtggggcaggtcgaactcggcgggggacctggggccggttcgctgcaaccattggcgctggaaggctcacttcaaaagcgcggaatagtggaacagtgttgtaccagcatctgttctctgtaccagcttgaaaactactgtgga

SEQ ID NO: 14006 - DNA, 330 bp, Artificial Sequence
  Description of Artificial Sequence: Synthetic coding sequence
atggccctgtggatgcgcctgctgccgctgctggcacttctggccttgtggggccctgaccctgccgcagcctttgtgaatcaacacctgtgcggaagtcatctagtggaagccttgtatttagtttgtggggagagaggcttcttctatacccctaagacgagaagggaggccgaagatctgcaggtgggacaggtcgaattaggggggggacctggcgccggaagtctccaaccccttgctctcgagggttcactccagaaacgaggtatcgtggagcaatgttgcacatccatatgctccctgtaccagctggagaactactgcggg

SEQ ID NO: 14007 - DNA, 330 bp, Artificial Sequence
  Description of Artificial Sequence: Synthetic coding sequence
atggcactttggatgcggctgctgcctctgcttgcgctcctcgccctgtggggccccgatccagcggctgcctttgtgaaccagcatctttgtggcagccacctggtcgaggcgctgtacctggtgtgcggagagcggggattcttctacaccccgaaaacccgtagggaggccgaggacctgcaggtgggacaggtcgaattggggggcggaccgggggcaggaagtctgcaaccgctggctcttgaaggctcgctgcaaaagcgcggcatcgttgaacagtgttgcacttccatctgctctctctatcagctcgaaaactactgcgga

SEQ ID NO: 14008 - DNA, 330 bp, Artificial Sequence
  Description of Artificial Sequence: Synthetic coding sequence
atggcgctttggatgcggctgctcccgctgttggctctcctggcactgtggggacctgatcctgccgcggcttttgtgaatcagcatctgtgcggatctcacctcgtcgaagcactgtacctggtctgcggagaacgcggcttcttctacaccccaaagactcgccgcgaggctgaggacctgcaagtggggcaagtcgagctcggaggaggccctggagcaggctcactgcagccgctcgccctggagggatcgcttcagaagcggggaatcgtcgagcagtgctgcacttcaatctgttcgctgtaccaactcgagaattactgtgga

SEQ ID NO: 14009 - DNA, 330 bp, Artificial Sequence
  Description of Artificial Sequence: Synthetic coding sequence
atggcactgtggatgcgactcctccctttgctggccctcctcgctctgtggggccccgacccagccgccgccttcgtgaatcagcatctgtgcggtagtcaccttgtggaggccttgtacctcgtgtgtggtgagcgcggcttcttctacacacccaagaccagacgtgaggcagaggatcttcaggtgggtcaggtcgagctgggtgggggcccgggtgctgggtctttgcaacccctggccctggagggttcactgcagaaacggggaattgtggagcagtgctgcacaagcatctgttccctgtaccagcttgaaaactactgcggc

SEQ ID NO: 14010 - DNA, 330 bp, Artificial Sequence
  Description of Artificial Sequence: Synthetic coding sequence
atggcgctctggatgcggcttctgcccttgctggccttgctagcgctttgggggccggacccggccgcagcattcgtcaaccagcatctctgcggctcccatctggtcgaggctctttacctcgtctgcggggaacgtggctttttctacactcctaagacccgccgcgaggccgaagatttgcaggtgggccaagtcgagctgggcggaggccccggtgcgggatcattacagccgcttgcgctggaggggtcgctccaaaagcgtggtattgtggagcagtgctgcaccagcatctgctccctctaccagctagaaaactactgcgga

SEQ ID NO: 14011 - DNA, 330 bp, Artificial Sequence
  Description of Artificial Sequence: Synthetic coding sequence
atggccttgtggatgcgcctcctccctttattagctctgctcgccctgtgggggccagatcccgcagctgctttcgtgaatcagcacctctgcgggtcccatctcgtggaagccctgtacctcgtgtgcggagaaagggggttcttttatacacccaaaactaggcgggaagccgaagatctccaggtaggacaggtcgaacttggaggaggaccaggagctgggtccctacagcctctagcccttgaaggatccctccagaaaagggggatagtggaacagtgttgtactagtatttgtagtctctatcagctcgaaaattactgcggg

SEQ ID NO: 14012 - DNA, 330 bp, Artificial Sequence
  Description of Artificial Sequence: Synthetic coding sequence
atggcactctggatgaggttgctcccgctccttgctttgcttgccctgtggggcccagatccagctgcggcttttgtgaaccagcacctgtgtggttcccatttggttgaggctctttacttggtctgtggagagagggggtttttctacactccaaaaactcgacgagaggccgaagacctccaggtgggacaggtggaactgggcgggggccctggggccggatctctccagcctctggcgctagagggcagtctgcagaaacgcgggatcgtggagcagtgctgcacttcaatttgctcactgtatcagctggagaactactgtggc

SEQ ID NO: 14013 - DNA, 330 bp, Artificial Sequence
  Description of Artificial Sequence: Synthetic coding sequence
atggcactttggatgcggctcttaccattgctggcgttgctggcattgtggggaccagaccccgcagctgctttcgtgaatcagcatctgtgtgggtcacatctggtcgaagctctgtacctcgtatgtggtgagcggggattcttttacacccccaaaaccagaagagaggccgaggacctacaggtgggtcaggtagaactggggggcgggcccggagcgggctcactccagcccctcgcgctcgaagggtcactgcagaagcggggaatcgtggagcagtgctgtacttctatatgttctctgtaccagctggaaaactattgtgga

SEQ ID NO: 14014 - DNA, 330 bp, Artificial Sequence
  Description of Artificial Sequence: Synthetic coding sequence
atggctctatggatgaggctgctgccactgctggccctcttggcattgtggggcccagaccctgcagccgcgttcgtaaaccagcatctctgcggtagccacctggtggaggccctgtaccttgtatgcggtgaacgaggttttttttacactccaaagacacgacgcgaagccgaggacctgcaggttggccaggtggaactgggcgggggccccggcgctgggtcactgcagcctttggccctcgaaggcagcctgcagaagcgcgggattgtggagcagtgttgtactagcatctgctccctttaccagctagagaactattgcggg

SEQ ID NO: 14015 - DNA, 330 bp, Artificial Sequence
  Description of Artificial Sequence: Synthetic coding sequence
atggccctttggatgcgcctgctgccgctgctcgcgctcctcgcactgtggggcccagacccggcggcagccttcgtcaaccaacatctttgcggaagccacctcgtggaagctctctacctggtctgcggggagcggggatttttctacaccccaaagaccaggagagaggccgaagatctgcaagtgggacaggtggaactcggcggtggccctggggccggatcgctgcagcccctggctttggaaggttcattgcagaaacgcggaatcgtggagcagtgctgtacttcgatctgttccctgtaccaactggagaattactgcgga

SEQ ID NO: 14016 - DNA, 330 bp, Artificial Sequence
  Description of Artificial Sequence: Synthetic coding sequence
atggccctatggatgcgcttactgccactacttgccctgttagcattatggggccccgacccggccgcagcctttgtcaaccagcacctgtgtggctctcacctggtggaggcactgtatctagtgtgcggagaacgaggatttttttatacccccaagacgcggcgcgaggcagaagacctccaagttggccaggtggaacttggaggtggaccgggggctggcagtctgcagccgttggccctggagggtagtcttcagaagcgtggtattgtggagcagtgctgcactagtatatgttctctgtatcaactagagaactactgcggg

SEQ ID NO: 14017 - DNA, 330 bp, Artificial Sequence
  Description of Artificial Sequence: Synthetic coding sequence
atggcactgtggatgcgactgctccccctcctggcattgttggccctatggggtccggacccagcggccgccttcgtgaaccagcacctgtgcgggagtcatctggttgaagctctttatctggtctgcggggagagaggatttttttacacacccaagacaagacgggaggcggaagatctccaagttggacaagtggagttgggagggggacccggggctggatcacttcagcccctcgcgctcgagggctctctgcagaagagaggaatcgtggagcaatgctgcactagcatctgctccctataccaactggagaactactgcggg

SEQ ID NO: 14018 - DNA, 330 bp, Artificial Sequence
  Description of Artificial Sequence: Synthetic coding sequence
atggcattgtggatgcgcctgctgcccctcctggcactgctggccctttggggaccagatccggcagccgcctttgtgaaccaacacctctgcgggtcacatctcgtggaagcactttacctcgtgtgcggagaacgcggattcttctacacgcctaagactagacgcgaggcagaggaccttcaagtgggtcaggtggagctgggtggcggaccaggagcggggtctttgcagccacttgccctcgagggatcgctgcagaaaagaggaatcgttgagcagtgctgcacctccatctgttccctgtaccagctcgagaattactgcggt

SEQ ID NO: 14019 - DNA, 330 bp, Artificial Sequence
  Description of Artificial Sequence: Synthetic coding sequence
atggcattatggatgagattattaccattattagctttattagcattatggggaccagatccagctgctgcttttgttaatcaacatctttgtggatcacatcttgttgaagcactttatttagtttgtggagaaagaggatttttttatactccaaaaactagacgagaagcagaagatcttcaagttggacaagttgaattaggaggaggtccaggagctggatcattgcaaccattagcacttgaaggtagtttgcaaaaaagaggaattgttgagcaatgttgtacctcaatttgttcactatatcagcttgaaaattattgtgga

SEQ ID NO: 14020 - DNA, 330 bp, Artificial Sequence
  Description of Artificial Sequence: Synthetic coding sequence
atggctctctggatgagactgctgcctctcttggctctgcttgccttgtggggcccagaccctgccgccgcgttcgtcaaccaacatctttgtggtagccacctggtcgaggccctgtacttagtgtgcggagagaggggctttttctatacacctaaaacccgcagggaagctgaagaccttcaggtggggcaagtggagcttgggggcgggccgggtgcaggctcgttgcagcccctggcactcgaaggctcgctacagaaacgtggaatagtcgagcagtgttgtactagtatttgcagcctctaccagcttgagaactactgcggg

SEQ ID NO: 14021 - DNA, 330 bp, Artificial Sequence
  Description of Artificial Sequence: Synthetic coding sequence
atggctctgtggatgcgactgttacctctgttagcattgctggccctgtggggccctgatcctgcagccgccttcgtcaatcagcatctctgtggctctcacttggtggaggcactgtatcttgtgtgcggcgagagaggatttttttacactcccaagactagaagagaggctgaagatctgcaagtgggccaagttgagctgggcggtgggcccggggctgggagtttacagccactggcactggaaggcagtctgcaaaaaagaggcattgttgagcagtgttgcacctctatttgcagtctataccaacttgagaattactgcggc

SEQ ID NO: 14022 - DNA, 330 bp, Artificial Sequence
  Description of Artificial Sequence: Synthetic coding sequence
atggctctgtggatgcggcttttgcctcttctcgcgctgctcgccctgtggggaccagatcctgcagccgcgtttgtgaaccagcacctctgtggatcacatctcgttgaggccctttaccttgtgtgcggcgagcggggattcttttacactccgaaaacccgcagggaagcagaagatcttcaagtgggacaagttgagcttggaggaggccctggcgccggttccctccagccacttgcactggaaggatcgctgcagaagaggggaattgtcgaacaatgctgtacgtcgatctgcagcctgtaccaattggaaaactactgtggt

SEQ ID NO: 14023 - DNA, 330 bp, Artificial Sequence
  Description of Artificial Sequence: Synthetic coding sequence
atggccctgtggatgagactgctgccattgctggcgctgctggcattgtggggcccagaccccgcagcagctttcgtgaatcagcatctgtgcgggagtcacttggtggaagccctgtatctcgtctgcggagaacgcggatttttttacacgcctaaaacaagaagggaggccgaggacctccaggtgggacaggtcgaattgggggggggcccgggtgccgggtcactccaaccgcttgcactcgaaggctcactgcagaagagaggcatcgtggagcagtgttgcaccagcatctgctccctgtatcagctggaaaactactgtgga

SEQ ID NO: 14024 - DNA, 330 bp, Artificial Sequence
  Description of Artificial Sequence: Synthetic coding sequence
atggctctgtggatgcgcttgcttcccttgctcgcactgcttgctttgtggggcccagaccccgccgccgctttcgtaaatcagcacctgtgcggttcacacttggtagaggccctctacctggtgtgtggagagcgcggatttttctacacccctaagactagacgcgaagcggaagatctccaggtgggtcaggtcgaattgggcggtggtcccggagctggaagccttcagcctctggccttggagggatccctccagaaaaggggcattgtcgagcaatgctgcacctccatctgttcactctaccagctggagaactattgcggt

SEQ ID NO: 14025 - DNA, 330 bp, Artificial Sequence
  Description of Artificial Sequence: Synthetic coding sequence
atggcactttggatgcggcttctcccacttttggcacttctggcactttggggcccagaccccgcagcagcctttgtgaatcagcatctctgcggctcacacttggtcgaggcgctgtacctggtgtgtggtgaaagaggattcttttacaccccaaaaactcggagagaggcagaagatcttcaagttggtcaagtcgaactgggtggaggccctggggccggatccctccaaccgcttgcacttgaaggatcactgcagaagcgaggaatcgtggaacagtgctgtacttcaatctgtagcctttaccagctggagaactactgtggg

SEQ ID NO: 14026 - DNA, 324 bp, Artificial Sequence
  Description of Artificial Sequence: Synthetic coding sequence
atggcgctatggatgaggctcctgccactgctggccctcctggcactctggggaccagatccagccgccgcgtttgtgaaacagcacctgtgcgggtcacaccttgttgaagccctatacctcgtgtgcggggagcggggattcttctatactcccgaaaccgaggcagaggacttgcaggtggggcaggtggagctgggagggggccctggcgctggttccctgcaaccgctagctctggaaggatctctgcaaaagagagggattgtcgagcagtgttgcacttccatatgctcactttaccagcttgaaaactactgtaat

SEQ ID NO: 14027 - DNA, 324 bp, Artificial Sequence
  Description of Artificial Sequence: Synthetic coding sequence
atggccctctggatgcgactactgccactcttggccctcctcgctctgtggggcccagatcctgcagcagcatttgtgaaacagcacctctgtgggagccacctagtcgaggctctgtacttagtctgcggagagcgtggttttttctacacccctgagacagaagcagaagacttgcaggtgggacaggtcgaactcggaggcgggcccggggccggatcactgcagcctttggcccttgaggggtctctgcagaaacgggggattgtcgagcaatgctgcacttcgatctgcagcctgtaccagctggagaattattgcaat

SEQ ID NO: 14028 - DNA, 324 bp, Artificial Sequence
  Description of Artificial Sequence: Synthetic coding sequence
atggccttgtggatgcggctcctcccactcctggccctgctggctctctggggtccggatcccgcagcagcctttgtgaagcaacatctctgcggatcgcaccttgtcgaagcgttgtacttggtgtgcggcgaaagaggtttcttctatactcctgagacggaagctgaggacttgcaagtgggtcaggtcgaacttggcggaggccctggagctggatcactgcagccgctcgcgctggaaggcagccttcagaaacgggggattgtggagcagtgctgcacctcgatctgctctctttaccaactggagaactactgtaat

SEQ ID NO: 14029 - DNA, 324 bp, Artificial Sequence
  Description of Artificial Sequence: Synthetic coding sequence
atggccctctggatgagactgctcccactcctggcattgcttgcgctgtgggggccggacccggctgctgcctttgtgaagcaacacctctgcgggtcccatctggtggaagcgctgtacctggtgtgcggggaacggggcttcttctacaccccggaaaccgaagccgaagatctgcaggttggacaagtggagctcggcggaggcccgggagccggaagcctgcagccgctcgccctggagggatcgcttcagaagcgcggcatcgttgagcaatgctgcacttccatctgctcactgtaccaattggagaactactgcaac

SEQ ID NO: 14030 - DNA, 324 bp, Artificial Sequence
  Description of Artificial Sequence: Synthetic coding sequence
atggccttgtggatgcggttactccctttgttagctctacttgcgttgtgggggccggaccctgcggcggcgttcgtgaaacaacacctttgcggcagccatctggtggaagctctatacctcgtttgcggagaacgcggatttttctatactccggaaacagaggctgaagacctgcaggtaggtcaggtggaattgggcggaggaccaggagcaggatctctccaaccgctggccttagaaggatctttacagaagagagggattgtagaacaatgctgcacatcgatctgttctttatatcagttagaaaactattgtaac

SEQ ID NO: 14031 - DNA, 324 bp, Artificial Sequence
  Description of Artificial Sequence: Synthetic coding sequence
atggctctctggatgcgcctactaccgctgctggcactcctggccctgtggggacctgatcctgcagcggcatttgtgaagcagcacctctgcgggagccacctggtggaggctctttatctggtgtgcggagaaaggggatttttttataccccagaaactgaggccgaggacctccaggtgggacaggtcgagctcggcggcgggccaggggcaggctccctgcagcctctcgccctggaaggctccctgcagaaaagagggatagttgagcagtgttgtacctctatttgcagtctgtaccaactggagaactattgtaac

SEQ ID NO: 14032 - DNA, 324 bp, Artificial Sequence
  Description of Artificial Sequence: Synthetic coding sequence
atggcactttggatgagactgcttcctctgctggctcttcttgcgctgtgggggcctgaccctgcagcggcgtttgtgaagcagcatctctgtggtagccatctcgtggaagcattgtacctcgtctgtggagaacggggatttttctacaccccagagactgaggcggaagatcttcaggtgggccaagtcgagctggggggaggaccaggagcgggctctcttcagcctcttgcccttgagggatcgctgcagaagaggggaattgtggaacagtgttgcacgtcaatttgttccttgtaccaactggaaaactactgtaac

SEQ ID NO: 14033 - DNA, 324 bp, Artificial Sequence
  Description of Artificial Sequence: Synthetic coding sequence
atggcactgtggatgaggttgctgccactgctcgccctcctggctttgtggggcccagacccagctgcagcctttgtcaaacaacacctgtgcggctcccacctcgtcgaggccttgtacttggtgtgtggtgaaagaggattcttttacacacctgaaactgaagctgaagaccttcaagtgggacaggtcgaactcggtggaggtcccggcgccggaagtttgcagcctttggcactggaaggatccctgcagaagaggggaattgtggaacagtgctgcacttctatttgtagtctgtaccagctcgagaattattgcaac

SEQ ID NO: 14034 - DNA, 324 bp, Artificial Sequence
  Description of Artificial Sequence: Synthetic coding sequence
atggcgttatggatgcgattattaccgctactagcgctattagcgctatggggtccggatccggcggcggcgtttgtaaaacaacatctatgtggttcgcatctagtagaagcgttatatttagtatgtggtgaacgtggttttttttatacgccggaaacggaagcggaagatttacaagtaggtcaagtagaattaggtggtggtccgggtgcgggttcgttacaaccgctagcgttagaaggttcgttacaaaaacgtggtatagttgaacaatgttgtacgtcgatatgttcgttatatcaactagaaaattattgtaat

SEQ ID NO: 14035 - DNA, 324 bp, Artificial Sequence
  Description of Artificial Sequence: Synthetic coding sequence
atggctctgtggatgaggctgttaccgttgctcgcattgctggcgctatgggggcctgatcccgcagccgccttcgtaaagcagcatttatgcggatctcatctggtggaagcgctctatctggtatgcggcgagagaggattcttttatactccagaaactgaggcagaagacttgcaggtgggccaagtggaactgggtggcggcccgggagccggctcccttcaacctctcgccctggaaggaagccttcagaagcgtggtattgttgagcagtgctgcacatcgatctgttctctgtaccaactagaaaactactgcaac

SEQ ID NO: 14036 - DNA, 324 bp, Artificial Sequence
  Description of Artificial Sequence: Synthetic coding sequence
atggcactgtggatgcggctactgcctctgcttgctctcctggcgctctggggtcccgacccggccgcagcttttgtgaaacagcacttgtgcggttcgcaccttgtggaggctctctacctcgtttgtggagagcgggggttcttctacacaccagagactgaagcagaggaccttcaagtggggcaagtggagttaggcggcggaccaggcgctggttctctccagcccctcgcgcttgagggctctctgcagaagcgcggcatcgtcgagcaatgctgcacgagtatttgcagcctctaccaactggagaactattgcaat

SEQ ID NO: 14037 - DNA, 324 bp, Artificial Sequence
  Description of Artificial Sequence: Synthetic coding sequence
atggcgctctggatgcgcctgctgcctcttctggctcttctagcgctctggggacccgatccagcagcagcctttgttaaacagcatctttgtggctcccacttggtggaagcgctatatctggtgtgcggggagcggggctttttttacactccagaaacagaagctgaggatctgcaggtgggacaagtggaacttggtggcgggcccggggccgggtcactgcaacccctcgcgctggaagggagcctgcagaagcgaggcatcgtggagcagtgctgtacgtcaatttgcagcctgtaccagcttgagaactactgcaac

SEQ ID NO: 14038 - DNA, 324 bp, Artificial Sequence
  Description of Artificial Sequence: Synthetic coding sequence
atggcgctatggatgaggttactgcccttgcttgcgctactggcactttggggaccagatccagccgccgccttcgtcaagcagcatctctgtggatcacacttggtcgaggctctctacctggtgtgcggagagaggggattcttttacacacccgaaaccgaggccgaagatctgcaagtagggcaagtggagctggggggtggacctggagccgggagtctgcagcctctggccttagagggttcccttcagaagagggggattgtggaacagtgttgcacttctatatgctctctgtaccagttagagaattactgtaat

SEQ ID NO: 14039 - DNA, 324 bp, Artificial Sequence
  Description of Artificial Sequence: Synthetic coding sequence
atggccttgtggatgaggctgctgccactgcttgccttgctggctctgtggggaccggaccctgccgcagcatttgtcaagcagcacctctgcggaagccacctggtcgaagccttgtatcttgtgtgcggagagaggggctttttttatacacccgagaccgaggctgaagacctgcaggttggtcaggtcgagctgggcgggggccccggggctgggtccctgcagccgctagccctggaaggctccctgcagaagaggggcattgtggagcagtgttgcacatccatctgttctctttaccagctagaaaattattgcaac

SEQ ID NO: 14040 - DNA, 324 bp, Artificial Sequence
  Description of Artificial Sequence: Synthetic coding sequence
atggcactctggatgcgactgttgccattgcttgcgctgctcgccctctggggtcctgacccagctgccgcattcgtgaagcagcacctgtgtgggagccatttggtagaagcactctatctagtatgtggagagaggggtttcttctatacgcctgagaccgaggcggaagacctgcaggtgggacaagttgagcttgggggcggtcccggagccggatcccttcagcccctcgccctcgagggatccctgcagaagcgaggcatcgttgaacagtgttgtacatcaatatgcagtctctatcaactggaaaattactgtaat

SEQ ID NO: 14041 - DNA, 324 bp, Artificial Sequence
  Description of Artificial Sequence: Synthetic coding sequence
atggccttgtggatgcgactcctgcccctcctggctctcttggccctctgggggcctgatccagccgctgcattcgtgaagcagcatttatgtggctctcacctggtcgaggcactttaccttgtttgcggcgagaggggctttttctacaccccggaaactgaagctgaggacctgcaggtgggccaagtggagctggggggtggaccaggagctggtagcctgcaacctctcgcgttggagggttcattgcagaaacgcggcattgtggaacagtgctgtacctctatttgcagcctctatcagctggagaattattgcaac

SEQ ID NO: 14042 - DNA, 324 bp, Artificial Sequence
  Description of Artificial Sequence: Synthetic coding sequence
atggcattatggatgcgactgcttcctctgctcgccctccttgctctatggggacccgatcccgccgcagcattcgtcaagcagcatctgtgcggttctcacctagtcgaagccctatatctggtgtgtggagaacgcgggttcttctatacgcccgaaacagaggccgaggacctgcaagtgggtcaggtggaactgggcggcggtccaggtgcgggctcactccaaccgctcgccctcgaggggtcactgcagaagaggggcattgtggagcagtgttgtacctcgatctgtagcctgtaccagctcgaaaactactgtaat

SEQ ID NO: 14043 - DNA, 324 bp, Artificial Sequence
  Description of Artificial Sequence: Synthetic coding sequence
atggccctctggatgcggctgctcccgctcttggcactgttggccttatggggtccagatccagccgccgcctttgtaaaacaacatctgtgcggatctcacctggttgaagctctttacctggtttgcggagagagaggcttcttttatacaccagagaccgaggcagaggatttacaagtgggacaggtggagctcggaggtggccctggagccggcagtctacagccacttgccttggaaggttcattacagaagagagggattgtggagcaatgttgtacaagcatttgcagcctgtaccagcttgaaaactactgcaac

SEQ ID NO: 14044 - DNA, 324 bp, Artificial Sequence
  Description of Artificial Sequence: Synthetic coding sequence
atggcgctgtggatgcgcctgttgccgctgctagctcttttggcgttgtggggcccagatcctgctgcggctttcgttaagcagcacctgtgtgggtctcatttggttgaagcactgtacctggtatgtggagagcgggggtttttttacactccggagactgaggcggaagacctgcaggttggtcaggtcgagttgggcggcggccctggcgccggtagcctccaacctttggccctcgagggctcgctgcagaaacgcggtattgttgagcagtgctgcacctctatatgcagcctctatcagctggagaactactgcaac

SEQ ID NO: 14045 - DNA, 324 bp, Artificial Sequence
  Description of Artificial Sequence: Synthetic coding sequence
atggcattgtggatgcgcttgctgccactccttgccttgcttgcactgtggggccctgatcccgcagcagcatttgtgaaacaacatctttgtggaagccatctcgtggaggccttgtacctcgtgtgtggagaacggggatttttctacactccagaaactgaagcggaagatctccaagtgggacaagtggagctgggtggcggtcccggagcgggttcgcttcagcctcttgcattggagggatcccttcaaaaaaggggaattgtggagcagtgttgtacctcaatttgctccctgtaccagttggagaactattgtaat

SEQ ID NO: 14046 - DNA, 324 bp, Artificial Sequence
  Description of Artificial Sequence: Synthetic coding sequence
atggccctgtggatgcgcttattgccgctcctcgccctcctagctctgtggggtccagaccccgcggctgccttcgtgaaacagcacctatgcggctcccacctcgtggaggcactgtatttagtgtgtggggaaaggggatttttctataccccggagaccgaggcagaggacctccaggttggacaggtagaactcggcggcggtcccggcgccggtagtcttcagcctttggcattggaaggatccctccagaaacgcggtatagttgagcagtgttgcaccagcatatgtagcctatatcagctcgaaaactattgcaac

SEQ ID NO: 14047 - DNA, 324 bp, Artificial Sequence
  Description of Artificial Sequence: Synthetic coding sequence
atggctctctggatgagactgctccctttgctcgccctgctggccttgtggggccccgatcctgccgcagcgttcgtgaagcagcacctgtgcggttcccatctcgtggaagcactttatctggtctgcggagagcgaggtttcttttacactcccgaaactgaagctgaggaccttcaagtcggacaagttgagctgggaggagggcccggcgcgggctcgcttcagccactggcactggagggttccttgcagaagcggggcatcgttgagcaatgttgtacctcaatctgcagcctctaccaactggaaaactactgcaac

SEQ ID NO: 14048 - DNA, 324 bp, Artificial Sequence
  Description of Artificial Sequence: Synthetic coding sequence
atggcattgtggatgaggctgctgccactgctggctttgctcgccctgtggggcccggatcctgctgccgcattcgtcaaacaacacctgtgtggatcccatcttgtcgaagctctctacctggtgtgtggggagagagggttcttctatactccggagacggaagccgaggacctgcaagtcggccaagtggagttgggaggagggccgggagctggatctctccaaccgctggccctcgaaggttcgctgcagaagaggggcatcgtggaacagtgttgcacctcaatctgctccctgtaccagctggaaaactactgcaac

SEQ ID NO: 14049 - DNA, 324 bp, Artificial Sequence
  Description of Artificial Sequence: Synthetic coding sequence
atggcactttggatgagacttctgcctctgttggcactgcttgcactgtggggaccagatcctgccgctgcatttgtcaagcaacacctctgcggctcccatctggtggaagcactttatctggtttgcggagaacgcggctttttctacacccctgaaactgaggcagaggaccttcaggtgggacaggtggagttggggggaggtccaggagcaggatccctgcaacctctggcactcgagggatcgctgcaaaaacgaggtatcgtggaacagtgttgtacttcgatctgttcgctgtatcagcttgagaattactgcaat

SEQ ID NO: 14050 - DNA, 324 bp, Artificial Sequence
  Description of Artificial Sequence: Synthetic coding sequence
atggcactctggatgcgactcctgcctctgctggcgctgcttgcactctggggacccgaccccgctgcagcattcgtgaaacagcatctgtgtggttctcaccttgtggaagccctgtacctggtgtgtggcgagcgcggattcttttacactcccgagacggaagccgaagatctgcaggtgggtcaagtggaattgggaggcggaccaggtgcaggcagccttcaacctcttgcactggaaggttcacttcaaaagagaggtatcgttgagcagtgttgcactagcatctgctccctgtaccagctggagaattactgtaac

SEQ ID NO: 14051 - DNA, 324 bp, Artificial Sequence
  Description of Artificial Sequence: Synthetic coding sequence
atggccctgtggatgagactcctgcctctgctggcgctgctggctctctggggcccggatcctgcggccgccttcgtcaagcagcacctgtgcggatcccatctcgtggaagcgctgtacctggtgtgcggggaacgcgggttcttttacacccctgaaactgaagcagaggaccttcaggtcggccaggtggagctcgggggcggaccaggagcagggtcgcttcagccccttgcgctggaaggatcgctccaaaaaagaggaatcgtggaacagtgctgtacttccatctgctccctctaccagctggaaaactactgtaac

SEQ ID NO: 14052 - DNA, 324 bp, Artificial Sequence
  Description of Artificial Sequence: Synthetic coding sequence
atggccctgtggatgagactgttgccattactagccttgctagccctatggggacccgatcctgcagccgcatttgtgaaacagcacctctgcgggtcacatctagtggaagccttgtacttggtgtgcggagaacgcgggtttttttatacacctgaaactgaggctgaagacttgcaagtgggacaggttgaactcggaggagggcctggggccgggtccctacagcccttagctctggaggggtccctccagaaaagaggaatcgtcgaacagtgctgtacatctatctgttctctctaccagctggaaaactactgcaat

SEQ ID NO: 14053 - DNA, 324 bp, Artificial Sequence
  Description of Artificial Sequence: Synthetic coding sequence
atggctctttggatgcgtctgttgcccctgctggctctgcttgcgctgtgggggccggatccagcagccgcctttgtgaaacaacatctctgcgggtcacaccttgtggaagccctttacttggtgtgtggtgaaagaggattcttttacaccccagagactgaagcggaggacctccaagttggacaggtggagctgggcggtggacctggagcaggatcgctccaacccttggcactggagggctcactgcaaaagcgcggaatcgtggaacagtgctgtacctctatttgtagcctctaccaacttgaaaactactgtaac

SEQ ID NO: 14054 - DNA, 324 bp, Artificial Sequence
  Description of Artificial Sequence: Synthetic coding sequence
atggctctgtggatgcggttgctgcctttgttggcactcctcgcactatggggtccagaccctgctgctgccttcgtcaagcagcatctttgcggctctcaccttgtcgaggctctctacttggtatgtggtgaacggggtttcttctacaccccagagacggaggccgaggacttgcaagtcggccaagttgaacttggcggcggccccggagcaggatctctacagccactggccttggagggttcgttgcaaaaaagggggatcgtggagcaatgctgcacgtcaatatgttctctgtaccagctggaaaactactgcaac

SEQ ID NO: 14055 - DNA, 324 bp, Artificial Sequence
  Description of Artificial Sequence: Synthetic coding sequence
atggcgttgtggatgagattgcttcctttactcgctcttctcgctctttgggggccagacccggctgccgcttttgtcaagcaacatttgtgtggatcgcatctagttgaagcactctacttggtttgtggagagaggggatttttttatacgccggaaaccgaggcagaggatttgcaggttggacaagtggagctgggtggtgggccaggagcgggatcattacaaccgttggcgcttgaaggatctttgcagaagcggggaattgttgaacaatgttgtacaagtatctgctctttgtatcaacttgagaactattgtaat

SEQ ID NO: 14056 - DNA, 324 bp, Artificial Sequence
  Description of Artificial Sequence: Synthetic coding sequence
atggcactctggatgcggctgcttccgctgctggccctgctggctttatggggacccgaccctgccgctgctttcgtaaagcaacacctttgtggttcgcatctggtagaggcactgtacctagtctgcggggaacgaggttttttctacactcctgagaccgaggccgaggacctccaagtgggccaagttgaacttggtggtgggcctggggccgggtcacttcaaccactggccctggagggatccctgcagaagcgtggtatcgttgaacagtgctgcacatcaatctgttccctgtaccagcttgagaattactgtaac

SEQ ID NO: 14057 - DNA, 324 bp, Artificial Sequence
  Description of Artificial Sequence: Synthetic coding sequence
atggcgctgtggatgagactgctccctttgcttgcgcttcttgccctgtggggaccagacccggcagcggctttcgtgaagcagcacctgtgcggctcacacttggtggaagccctgtacctggtgtgcggagaacggggatttttctacactccagaaacggaggctgaggatttgcaagtcggacaggtcgagctggggggaggacctggcgctggatccctgcaaccgctggctctggaaggctccctgcagaagcgaggtatcgtggaacagtgctgcacctcgatctgctccctgtaccagcttgaaaactactgcaat

SEQ ID NO: 14058 - DNA, 324 bp, Artificial Sequence
  Description of Artificial Sequence: Synthetic coding sequence
atggcactgtggatgcggctgcttccgctcctcgcacttcttgcgctttggggtcctgaccctgcggctgcctttgtgaagcagcatctttgtgggtcgcaccttgtggaggccctctatcttgtctgcggagagagaggtttcttctacactccagagacggaagccgaggatcttcaagtggggcaagtcgagcttggaggcgggcctggggcaggctcacttcagccattggcactggaaggatcgcttcagaaacgaggaatcgtcgaacaatgttgcaccagcatttgctccctctatcagctggaaaactactgtaac

SEQ ID NO: 14059 - DNA, 324 bp, Artificial Sequence
  Description of Artificial Sequence: Synthetic coding sequence
atggcactgtggatgcgtctgctcccactgctggcgttgcttgcactctggggacctgaccctgcagcagcctttgtgaagcagcacttgtgtggatcacaccttgtggaagcgctctacctggtctgcggcgagcgcggtttcttttacacccccgaaactgaagcggaagatttgcaagtgggacaagtggaacttggaggcggaccgggtgcaggaagcctgcagcccctggcactggaaggatcgctgcaaaagaggggcatcgtcgagcaatgttgtacttcaatttgcagcctttaccaactggagaattactgtaat

SEQ ID NO: 14060 - DNA, 324 bp, Artificial Sequence
  Description of Artificial Sequence: Synthetic coding sequence
atggcgctttggatgaggctgctacccctactcgccctcctcgctctgtggggtcctgaccctgctgctgcttttgttaaacaacacttatgcgggtcacacctcgtagaagctttatatttggtatgtggcgaacgaggttttttttacacaccagagacggaagctgaagaccttcaggtgggacaagttgagttgggtgggggaccaggtgcaggctctctgcaacccttggccctggagggatctttgcagaaaaggggcattgtggaacagtgctgcacatctatttgttcgttgtaccagctcgagaattattgtaac

SEQ ID NO: 14061 - DNA, 324 bp, Artificial Sequence
  Description of Artificial Sequence: Synthetic coding sequence
atggccttatggatgcggctgctcccattgctagccctcctggccctgtggggcccagatcctgccgcagccttcgtaaaacagcacctttgcggctctcatctggttgaagctctgtacttagtttgtggagagcgcgggtttttttacaccccagagactgaagcagaggacctacaggtggggcaggtggagctcggggggggtcctggtgctggttcactccagcctcttgctttagaggggtctctccaaaaaaggggaatcgttgagcagtgttgcacgagtatttgtagtctgtatcagttggagaattactgcaac

SEQ ID NO: 14062 - DNA, 324 bp, Artificial Sequence
  Description of Artificial Sequence: Synthetic coding sequence
atggccctgtggatgcgtctgcttcctttactcgctctccttgcgctttgggggccagatccggcagctgcatttgtgaaacagcatctttgcgggtcacacttagtggaggccctttacctcgtgtgcggagagagagggttcttctatacgcccgaaactgaggcggaggatctacaggtgggtcaagttgagctgggaggcgggcctggcgccggatccttacaacctctggctctggagggcagcctgcagaaacgagggatcgtggaacagtgttgcacttccatctgttccctttatcagctggagaactattgtaac

SEQ ID NO: 14063 - DNA, 324 bp, Artificial Sequence
  Description of Artificial Sequence: Synthetic coding sequence
atggccctttggatgaggctgttacctcttctcgccctcctggcactctgggggccggaccccgccgccgcctttgttaaacagcacctgtgcggtagccatttggtggaggctctctacctcgtttgcggagagcggggtttcttctatacgccggaaacggaggccgaagacctgcaggtggggcaggtcgagctgggtggaggcccgggcgcgggatctctccagcccctggcactagaagggtctctacaaaagaggggaatcgtagagcagtgctgtacctctatatgctcattgtaccagttggagaactactgcaac

SEQ ID NO: 14064 - DNA, 324 bp, Artificial Sequence
  Description of Artificial Sequence: Synthetic coding sequence
atggccctttggatgaggctgttacctctgttggctcttctcgcgctgtggggtccagaccctgcagcggcctttgtcaagcaacatttatgtggctctcatttggtggaagccctgtacctggtttgtggagagaggggcttcttctatactcccgagacagaggctgaggaccttcaagttggccaagtggagcttggcggcggaccgggcgctgggtctctacagccactggcgttagaggggtccctccagaagcgggggattgtcgaacagtgttgcacttcaatttgtagcctataccaactcgagaattactgcaac

SEQ ID NO: 14065 - DNA, 324 bp, Artificial Sequence
  Description of Artificial Sequence: Synthetic coding sequence
atggccttgtggatgagactactgcctctgctggctctgctggctctatggggccccgatcctgctgccgccttcgtcaagcagcacctgtgtggcagtcatctggtggaagctctgtatttagtgtgcggcgaacgggggttcttctacactcccgagaccgaggcagaagatctgcaagttgggcaggttgagctgggcgggggcccaggcgctggatctctgcaacctcttgctctggagggctccctgcagaagagagggatagtggaacaatgctgcaccagcatctgcagcctgtaccagctggaaaactactgcaac

SEQ ID NO: 14066 - DNA, 324 bp, Artificial Sequence
  Description of Artificial Sequence: Synthetic coding sequence
atggcgctgtggatgcgcttgctgccactgctcgcgctgctcgccctgtggggtccggatccggctgccgctttcgtaaagcagcacctgtgcggtagtcatttggtggaagctctctacctggtgtgtggggaaagaggattcttctatactccggaaaccgaggcggaggatctccaagtcggccaggtggaacttggtggaggccctggggctggctcgctccaacccctggcattggaaggatccctccaaaaacggggaattgtggagcagtgctgcacgtcgatctgctcattgtaccagctggagaactactgcaat

SEQ ID NO: 14067 - DNA, 324 bp, Artificial Sequence
  Description of Artificial Sequence: Synthetic coding sequence
atggcactttggatgaggcttctgccacttctggcactcctggccctgtggggtcctgatcccgctgcagcattcgtgaagcaacatctgtgcggcagccaccttgttgaagccttgtaccttgtgtgcggagaacgcggttttttctacactcccgaaaccgaagccgaggatcttcaggtcggtcaagtggagcttggtggcggccccggagctgggtcgctccaaccactcgcactcgaaggatcccttcagaaacgtggaattgtggagcaatgctgcacctcaatttgttccctttaccagcttgaaaactactgtaac

SEQ ID NO: 14068 - DNA, 324 bp, Artificial Sequence
  Description of Artificial Sequence: Synthetic coding sequence
atggcgctttggatgcgcctgctgccgcttctggccctgctcgcactctggggcccggacccagcggccgcgtttgtaaagcagcacctgtgcggatcccacttggtcgaagctctgtaccttgtctgcggcgaacggggcttcttttacacccctgaaaccgaagcggaggatcttcaggtgggacaggtggaactggggggaggaccaggtgccggttcgttgcagccgctcgccctcgaggggtccctccaaaagagaggaatcgtggaacagtgctgtaccagcatctgttcattgtatcaactggagaattactgcaat

SEQ ID NO: 14069 - DNA, 324 bp, Artificial Sequence
  Description of Artificial Sequence: Synthetic coding sequence
atggccctgtggatgcgcctgctgccccttttagccctgctggcactgtggggccccgacccagctgccgctttcgtgaaacagcacctctgcggctcccacctcgttgaggctctttatctggtttgcggtgaaaggggatttttctacactccagagacggaagccgaagaccttcaggtgggccaggtggagctgggaggcggcccaggggcagggtctctgcagcctctagcactagaggggagcctccaaaaacgcggaatcgtcgagcagtgttgcacgagtatttgctcactctatcaactcgagaactactgtaac

SEQ ID NO: 14070 - DNA, 324 bp, Artificial Sequence
  Description of Artificial Sequence: Synthetic coding sequence
atggctttatggatgagattattaccattacttgctttattagctctttggggaccagacccagctgctgcatttgtcaaacaacatttatgtggatctcatttagttgaagcattatatttagtttgtggagaaagaggttttttttatacaccagaaacagaagcagaggaccttcaagttggtcaagttgaacttggaggtggtccaggtgcaggatcattacaacctcttgcattagaaggatctttacaaaaacgtggaatagtagaacaatgttgtacttctatttgttcactttatcaacttgaaaattattgtaac

SEQ ID NO: 14071 - DNA, 324 bp, Artificial Sequence
  Description of Artificial Sequence: Synthetic coding sequence
atggctctctggatgaggctcctccccttgctggcactattagctctgtggggacccgatccagccgctgctttcgtcaagcagcacctgtgcgggtctcacctcgtagaggcactctacctggtgtgcggagagcgcgggttcttctacacaccagaaactgaggccgaagacctccaggtagggcaggtggaacttggagggggacccggagcaggatcgctccagcctcttgctctagaagggtccctccaaaaacggggaattgtagaacagtgttgtacttctatctgctccctataccagcttgaaaactattgtaac

SEQ ID NO: 14072 - DNA, 324 bp, Artificial Sequence
  Description of Artificial Sequence: Synthetic coding sequence
atggctctgtggatgcggttgcttcccctacttgcactgttggcgttgtgggggcccgaccccgcagcggcttttgtcaaacagcacctgtgtggatcacaccttgtagaggccctttatttggtctgtggtgagagagggtttttctatacaccagaaacagaggcggaggacctgcaggtgggccaggtggaattaggcgggggacccggggcaggctccctccaaccattagcccttgagggcagtctgcagaagcgcggaatagtcgaacagtgttgtacgagcatatgcagcttataccaactggagaactactgcaat

SEQ ID NO: 14073 - DNA, 324 bp, Artificial Sequence
  Description of Artificial Sequence: Synthetic coding sequence
atggccttgtggatgcgccttcttcctctgctggcgctcctggccctttggggcccagatccagccgcagcttttgtcaagcaacacctgtgtgggtcccatctcgtggaagcactgtacctcgtctgtggtgaacggggtttcttctacactcctgaaaccgaagcagaggacttgcaggtcggtcaggtggaactcggaggaggcccaggggcaggatccctccaaccacttgctcttgaaggtagccttcaaaaacgcggcattgtggaacagtgctgtacctccatttgttccctgtaccagttggaaaactattgcaac

SEQ ID NO: 14074 - DNA, 324 bp, Artificial Sequence
  Description of Artificial Sequence: Synthetic coding sequence
atggcactatggatgagactattgcctttattggcgcttctcgctctatggggtccggaccccgctgccgctttcgtaaagcagcacttatgtggctcacacctcgtggaagcactctatctcgtctgcggcgaacgcggcttcttctatacacccgaaaccgaggccgaggacctgcaggtcggtcaggtggagctgggcggcggtcctggcgctggttctctccaacctctggccttggaagggtctctccagaagcgcggcattgttgaacaatgctgtacatcaatttgctccctctaccaactggaaaactattgcaac

SEQ ID NO: 14075 - DNA, 324 bp, Artificial Sequence
  Description of Artificial Sequence: Synthetic coding sequence
atggccctctggatgaggctcctgcctctgctggcacttctggcactttggggccctgacccggcagctgcatttgtcaagcaacacctgtgtggttctcatctcgtggaggcattgtatctggtgtgtggagaaagaggattcttttacacccctgagactgaagccgaagatctgcaagtgggacaggtcgagctcggcgggggtccgggcgcgggatcgcttcaaccattggccctcgaaggtagcctccagaaacggggaattgtggaacagtgttgcaccagtatctgttccttgtaccaacttgagaattactgcaac

SEQ ID NO: 14076 - DNA, 324 bp, Artificial Sequence
  Description of Artificial Sequence: Synthetic coding sequence
atggcactttggatgcgccttctgcccttattggcattattggccctctggggcccggatcctgcagctgcgtttgtaaaacaacacctgtgcggctcccaccttgtcgaagccttgtatctggtgtgcggagagagggggtttttctacaccccagaaacagaggcagaggaccttcaagttgggcaggtcgaattaggagggggacccggggcaggatcattgcagccactcgctttggaaggatctctccagaaaagaggaatcgtcgagcaatgctgcaccagcatctgcagtctgtatcagttggaaaactattgtaat

SEQ ID NO: 14077 - DNA, 324 bp, Artificial Sequence
  Description of Artificial Sequence: Synthetic coding sequence
atggccctgtggatgaggctgctcccgctgctggcgttgctggcgctgtggggaccagaccccgctgccgctttcgtgaagcagcacctgtgcggatctcatctggtggaggcactctatctggtctgcggggaacggggttttttctacactcctgaaaccgaggcagaggatttgcaagtcggacaagttgagcttggcggcggaccgggcgccggatccctccaaccattggcactcgaaggatctctgcagaaacgcggaatagtcgaacagtgttgcacctcaatctgcagcctgtaccagctcgagaattactgcaat

SEQ ID NO: 14078 - DNA, 324 bp, Artificial Sequence
  Description of Artificial Sequence: Synthetic coding sequence
atggctctgtggatgagacttcttcctttactggccctactggccctttggggcccggacccagctgccgcattcgtcaaacagcacttatgtggctctcacttggttgaagcgctgtacctggtttgcggagagcgagggtttttttatacccctgagacggaagccgaggatctccaggtgggccaggtggagcttgggggaggacccggagctggctctctgcagccacttgctctggagggctcattgcagaagcgcggtattgttgagcagtgctgtacgtctatttgttccctgtatcagctggagaactattgcaat

SEQ ID NO: 14079 - DNA, 324 bp, Artificial Sequence
  Description of Artificial Sequence: Synthetic coding sequence
atggcgttgtggatgaggctgctcccgttgctcgccctgctcgctctgtggggaccggacccggccgcagcctttgtcaagcagcacctgtgcggaagccatctcgtggaagccctctaccttgtgtgcggcgagcgagggtttttctacaccccagagactgaagccgaggatctgcaggttggacaagtggagttgggcggaggcccaggtgccggatcgctccagccgctggcactcgagggatccctgcaaaagcggggcatcgtggagcaatgctgtacctcgatctgcagcctgtaccaattggagaactactgtaac

SEQ ID NO: 14080 - DNA, 324 bp, Artificial Sequence
  Description of Artificial Sequence: Synthetic coding sequence
atggccttgtggatgagactgctgcctcttttagctttgctggccctctggggtccggacccagcagctgcattcgttaaacagcatctgtgtggatctcatttggtcgaggccctgtatctggtgtgcggcgaacgtggctttttttacacccctgaaacagaggctgaagacctccaggtggggcaagtggaactggggggcggtccaggcgcaggctccttacaaccactcgccctcgagggaagcctgcagaagcgcgggatagtggaacagtgttgcacctctatttgttcgctgtaccagctagagaattattgtaac

SEQ ID NO: 14081 - DNA, 324 bp, Artificial Sequence
  Description of Artificial Sequence: Synthetic coding sequence
atggcgctgtggatgaggttactccctctcctggcgttgttggccctgtggggacccgatcctgcagccgcttttgtcaagcaacacttgtgcggctcacacttagttgaggcactgtatcttgtgtgtggtgagcgaggttttttttatacacctgagacggaagctgaagatctccaggttgggcaggtagagttgggcggaggtccaggcgctggtagcctccagcctctagctttggagggttctcttcagaaacgcggcattgtcgagcagtgctgcacatcaatttgctccctgtatcaattggagaactattgtaat

SEQ ID NO: 14082 - DNA, 324 bp, Artificial Sequence
  Description of Artificial Sequence: Synthetic coding sequence
atggccctctggatgagattgctccctcttctcgctctgctggccctgtggggacctgaccctgctgccgcttttgtgaaacaacatctgtgtgggtcccacctcgtggaggcactgtaccttgtctgtggagagagggggtttttctacactcccgagaccgaggccgaagatctgcaggtgggacaggtggagcttggtggagggcctggggcggggagtctgcagcctctggccctggaaggatcactgcagaagcgaggcattgtggagcagtgctgtacaagtatctgttcactttaccagctggaaaactattgcaac

SEQ ID NO: 14083 - DNA, 324 bp, Artificial Sequence
  Description of Artificial Sequence: Synthetic coding sequence
atggcactctggatgcgtctcctgcccctgctggctctactggccctctggggcccagatcccgctgccgcattcgttaagcagcatctctgtggctctcatttggtcgaggcactttacctcgtctgcggcgagcgtggctttttctacacgcccgaaacggaggccgaggatttgcaagtgggccaggtcgagcttggtggtggtccaggcgccggttctctccagcctctggcgctggagggtagtttgcagaagcgtgggatcgtcgagcaatgctgcacctctatctgcagcctctaccaactcgagaattattgcaac

SEQ ID NO: 14084 - DNA, 324 bp, Artificial Sequence
  Description of Artificial Sequence: Synthetic coding sequence
atggcgctgtggatgaggttgctgcccctcctggccttgctggctctgtggggacccgatcctgccgccgctttcgtaaagcagcatttgtgtgggtctcacctggttgaagcactgtatctggtatgcggagaacggggctttttttacactccagagacggaagctgaggacttgcaggtcggtcaggtcgaacttggcggtggtccgggtgccggctccttgcagcccttggccctggaaggttcactgcagaaacgaggcatcgtggagcagtgttgcacttcaatctgctccttgtatcagctggagaattattgcaat

SEQ ID NO: 14085 - DNA, 324 bp, Artificial Sequence
  Description of Artificial Sequence: Synthetic coding sequence
atggccctttggatgcggctccttcccttgctggcacttcttgcattgtggggaccggaccccgcagcagcatttgtgaagcagcacctgtgcggatcccaccttgtggaagctctttaccttgtgtgcggagaacggggattcttttacacgccagaaactgaagcagaggatctccaagtgggccaggtggaactggggggaggtcccggagcaggttcactgcaacctctcgcactggaagggtcacttcagaagagaggaattgtggaacaatgttgtacctctatctgctcgctgtaccaactggagaattactgtaac

SEQ ID NO: 14086 - DNA, 324 bp, Artificial Sequence
  Description of Artificial Sequence: Synthetic coding sequence
atggctctgtggatgcgcttgctgccattgctggcacttctcgcactctggggtcccgatccagctgctgcgttcgtcaagcagcacttgtgcggaagccacctcgtagaagccctttatcttgtgtgtggcgagaggggattcttctacacaccagagaccgaggctgaggatcttcaggtcggtcaggtcgaactgggcggcggcccaggagcaggtagcttgcaacccctcgcattggaaggatccctgcagaaaaggggtatagtggaacagtgttgtacctccatctgttccctgtatcaactcgagaattattgcaac

SEQ ID NO: 14087 - DNA, 324 bp, Artificial Sequence
  Description of Artificial Sequence: Synthetic coding sequence
atggcactgtggatgcgcttgctgcctctgctcgcacttctggcactgtggggacccgacccagcggcagcattcgtcaagcagcatctgtgtggatcgcatctcgtggaagctctctacctcgtctgcggggaacggggtttcttctacaccccagaaactgaggctgaggacctgcaagtggggcaggtggaactgggaggtggcccgggcgccgggtccctccaaccgttggccctggagggatcgctccaaaagaggggaatcgttgagcagtgttgcacgtccatctgctccttgtaccagctcgagaactactgtaac

SEQ ID NO: 14088 - DNA, 324 bp, Artificial Sequence
  Description of Artificial Sequence: Synthetic coding sequence
atggcgttgtggatgcggttgctgccattactcgcactgctcgccctgtgggggcctgatcccgctgcagcttttgtgaaacagcatctgtgtgggagccacttagtggaggcattgtacttagtgtgtggggagagaggtttcttttatactcccgagacggaagccgaggatctgcaggtggggcaggtcgagttaggagggggacccggggccggaagcctacagccattggcccttgagggcagcttacaaaagaggggcatcgtcgagcagtgttgtacctccatttgttccctctaccagctagagaattattgcaac

SEQ ID NO: 14089 - DNA, 324 bp, Artificial Sequence
  Description of Artificial Sequence: Synthetic coding sequence
atggccctgtggatgcggttgctcccgctgctcgctctgttggcgctctggggaccggaccctgccgcggctttcgtgaagcagcatctgtgtggctcgcacctggtggaagcactgtacctggtgtgcggagaaagagggttcttttacaccccagagactgaagccgaggatctgcaagtcggccaggtcgagctcgggggtggtcccggcgcaggatcgcttcagccgctcgccctggagggatcactgcagaaacgcggaatcgtggaacaatgttgcaccagcatctgctccctctaccaacttgaaaactactgcaat

SEQ ID NO: 14090 - DNA, 324 bp, Artificial Sequence
  Description of Artificial Sequence: Synthetic coding sequence
atggcactttggatgaggctccttccccttctggcgctgctcgccttgtggggcccggacccggctgccgcttttgtcaaacagcacctgtgcggctcccatctggtagaagcactttacttggtctgcggtgagcgcgggttcttctacactcctgaaaccgaggcggaagatttgcaagtgggacaagtggaactgggaggcggcccaggggcgggaagtctccagcccctcgccctcgagggaagcctgcagaagcggggaatcgtggaacagtgctgcaccagcatctgctcactctaccagctggagaactactgtaac

SEQ ID NO: 14091 - DNA, 324 bp, Artificial Sequence
  Description of Artificial Sequence: Synthetic coding sequence
atggcactgtggatgagattgctccccctgttggccctgttggcgctttggggcccggaccccgcagccgcatttgtgaagcaacacctctgcggatcgcatcttgtcgaagccctgtacctcgtgtgtggggagcggggattcttctacacgcccgaaactgaggccgaggacttgcaggttggccaagtggagcttggagggggaccgggcgcgggctcgctgcagccgttggctctggagggatcactgcagaaacgcggaatcgtggagcagtgttgcactagcatttgctcgctctatcaactggaaaactactgtaac

SEQ ID NO: 14092 - DNA, 324 bp, Artificial Sequence
  Description of Artificial Sequence: Synthetic coding sequence
atggcgttgtggatgaggttgctgccattgctcgcacttctggcattgtgggggccggatccggccgctgccttcgtgaaacagcacctttgcggttcacatttagtagaggccctatatcttgtgtgtggtgaaagagggttcttctacaccccagagactgaagccgaggacctccaagttggtcaggttgaactcggcggcggccccggtgccggaagcctgcaacccctagccctggagggtagcctgcagaagagaggcattgtggagcagtgttgcacttccatctgcagcctctaccaattggagaattactgtaac

SEQ ID NO: 14093 - DNA, 324 bp, Artificial Sequence
  Description of Artificial Sequence: Synthetic coding sequence
atggctctctggatgagactgctgcccctgctggccctgctcgcactttggggcccggacccagccgccgcatttgtcaagcagcatctgtgcggttcacatctggtggaagccctgtacctggtctgcggtgagcgcggatttttctacaccccagagactgaagccgaagatctccaggtgggccaagtagagctgggaggcgggcctggcgcgggtagccttcagcctcttgctctggaagggtccttgcagaagcgggggatagtcgagcagtgttgcacctccatttgcagtctctatcagctggaaaattactgtaac

SEQ ID NO: 14094 - DNA, 324 bp, Artificial Sequence
  Description of Artificial Sequence: Synthetic coding sequence
atggccctgtggatgcgtctgctcccacttctcgccttgcttgctctgtggggaccggacccggctgcagcgttcgtgaagcaacacctgtgcgggtcccatctggtagaagcactctacctcgtctgcggggaacgcggattcttttacacccctgaaactgaggcggaggatctccaggtgggacaggttgagctgggcggtggacccggggcgggttccctccagcccttggctctcgaaggatcgcttcagaaacggggcatcgtggaacagtgctgcacgtctatctgttcactgtaccaattggagaactattgtaat

SEQ ID NO: 14095 - DNA, 324 bp, Artificial Sequence
  Description of Artificial Sequence: Synthetic coding sequence
atggccttgtggatgcgccttttgcctcttctggcgctgctggcattgtggggccccgaccctgctgccgcttttgtgaagcagcacctctgcggtagccatcttgtcgaagcactctacctggtatgtggagaacgtggtttcttttacaccccggaaactgaggcagaggatttgcaagtggggcaggtggaactcggcggaggccctggagcgggttccctccaaccacttgcactcgagggatcgcttcaaaaacggggtatcgtggagcagtgttgtacctctatttgttcactctatcagttggaaaactactgcaat

SEQ ID NO: 14096 - DNA, 324 bp, Artificial Sequence
  Description of Artificial Sequence: Synthetic coding sequence
atggcgttgtggatgaggcttcttccactcctggcactgctggccctgtggggtccagaccctgccgcagcgtttgtcaagcaacacctctgtggttcacatctcgtcgaagcactttaccttgtgtgtggagaacgggggtttttctatactccagaaaccgaagcagaggacctgcaagtgggtcaggtggaactgggtggaggtccaggtgccggatcccttcaaccgctggcgctggaaggatcgctgcagaaacgcggaattgtcgaacaatgctgtacctcaatttgttctctctaccaacttgagaactactgtaat

SEQ ID NO: 14097 - DNA, 324 bp, Artificial Sequence
  Description of Artificial Sequence: Synthetic coding sequence
atggcactgtggatgcgcctgctgccgctcctggcgttgctggctctgtggggacccgatccggccgcggcttttgtgaaacaacacctgtgcggatcccatttggtggaagccctgtacctggtctgtggtgagagaggcttcttctacacgcccgaaaccgaagctgaagatctgcaagtcggtcaggtggaacttggaggcggaccaggagcgggaagcctgcaaccactggccctcgaagggtcgttgcagaagcggggtatcgtggagcaatgctgcacctcaatttgtagcctctaccagctcgagaactattgtaac

SEQ ID NO: 14098 - DNA, 324 bp, Artificial Sequence; identical to SEQ ID NO: 14080
  Description of Artificial Sequence: Synthetic coding sequence

SEQ ID NO: 14099 - DNA, 324 bp, Artificial Sequence
  Description of Artificial Sequence: Synthetic coding sequence
atggccctttggatgcgactgctgcctctgctggctcttcttgcactttggggccctgatcctgctgcagcgtttgtgaagcagcatctgtgcggatcccacctcgtcgaagcactctacttggtgtgtggagaaagagggttcttttacacgcccgaaaccgaggccgaagatttgcaggtcggccaggtggaactgggaggtggaccgggagcaggttcgctgcaacctctcgcactcgagggctcactgcagaagagaggcattgtggaacagtgttgtacttcgatttgttcgctgtaccaactggagaactactgtaat

SEQ ID NO: 14100 - DNA, 324 bp, Artificial Sequence
  Description of Artificial Sequence: Synthetic coding sequence
atggcactctggatgcggcttctcccgctgctggcactcctcgcactctggggaccggatccggcagcagcgtttgtgaaacaacatctgtgcggctcgcacctggtcgaagccctgtacctggtctgcggcgaacgcggcttcttttacactccagaaaccgaagcggaggacctgcaggtgggacaagtggagctcggcggtgggcctggagcagggtccctgcaacctctcgccctggaaggaagcctgcagaagcggggaatcgtggagcagtgttgtacttccatctgtagcttgtaccaactggaaaactattgtaac

SEQ ID NO: 14101 - DNA, 324 bp, Artificial Sequence
  Description of Artificial Sequence: Synthetic coding sequence
atggctctgtggatgcgcctgttgcctctcctggcactcctcgccttgtggggacccgatcccgccgccgccttcgttaagcaacacctctgcggtagccatttggttgaggccctctacctcgtgtgtggagagcgggggttcttttatacccccgagacagaggcagaagatctgcaagtgggccaagtggaactcggcggcggaccaggagccgggtccctgcagccacttgcccttgagggttccctccagaaacggggtattgtggagcagtgttgcacatccatttgttctctctaccagctggagaactactgcaat

SEQ ID NO: 14102 - DNA, 324 bp, Artificial Sequence
  Description of Artificial Sequence: Synthetic coding sequence
atggctctgtggatgcgactgctgccacttctggccctgctggcgctgtggggaccggacccggctgccgctttcgttaagcagcatttgtgtggttcgcacctcgtggaggccctttacctggtgtgcggcgagcgcggattcttctatacccccgaaacggaggccgaggatctccaagtcggccaggtcgaactgggtggcggccctggtgccgggtccctgcagccactcgccttggaaggatcactccagaagagaggaattgtggagcagtgctgcacttcgatttgttcactctaccaacttgagaactactgcaac

SEQ ID NO: 14103 - DNA, 324 bp, Artificial Sequence
  Description of Artificial Sequence: Synthetic coding sequence
atggctctctggatgcgcctgctcccactgctggcgctacttgcgctgtggggaccagacccagccgccgcatttgttaagcaacacctttgtggctcgcacttggtggaagctctgtatctggtctgcggggagcgcggattcttttacacccctgagaccgaggcggaggatctgcaggtgggccaggtagagctgggaggcggaccaggcgccggctcgctgcagccgctggctctcgaaggttccctgcagaagcgcgggattgttgaacagtgttgtacctccatctgcagcctttaccaactggagaattactgtaat

SEQ ID NO: 14104 - DNA, 324 bp, Artificial Sequence
  Description of Artificial Sequence: Synthetic coding sequence
atggccctgtggatgcgcttgctcccgctgctcgcgctgctggcgctgtggggacccgacccggcggctgccttcgtcaagcagcatttgtgcggctcgcacctggtcgaggccctgtacttggtgtgcggagagcgcggctttttctacactccagaaacggaagcagaagatctccaagtggggcaagtggagctgggtggcgggccgggcgctggatcactccagcctctggctctcgagggctcactgcagaagcgcggaatcgtcgagcagtgctgcaccagcatttgcagtctgtatcaactcgaaaactactgtaat

SEQ ID NO: 14105 - DNA, 324 bp, Artificial Sequence
  Description of Artificial Sequence: Synthetic coding sequence
atggctctatggatgcggttactgcctctcctggccctgctcgccctctgggggccagatcccgccgccgccttcgtaaagcagcacctctgcggttctcacttagttgaagccctgtaccttgtgtgtggcgaaagggggtttttctacacccctgaaactgaggctgaggatttacaagtaggccaggtcgaacttggtgggggtcctggggctgggtctttgcagcccttagcactggaaggatccctgcaaaaaagggggatcgtcgaacagtgctgcacctcaatttgttcattgtatcaactggagaattattgtaac

SEQ ID NO: 14106 - DNA, 324 bp, Artificial Sequence
  Description of Artificial Sequence: Synthetic coding sequence
atggccctttggatgcggcttctgccacttcttgcactgctcgccctttgggggcctgacccggcagccgcatttgtgaaacaacacctttgcggctcgcatcttgtcgaagcactgtaccttgtgtgcggcgaacgtggcttcttttacacccctgaaaccgaagcagaggatcttcaagtgggacaagtggagctgggaggaggtcctggtgcagggtcgcttcaacctctcgcactcgaaggctcactgcagaagcgagggattgtggaacaatgttgtacttcaatttgttctctctaccagttggaaaactactgtaac

SEQ ID NO: 14107 - DNA, 324 bp, Artificial Sequence
  Description of Artificial Sequence: Synthetic coding sequence
atggcactttggatgaggcttctgcccttgttggccctcctggcactctggggtccggatcctgccgcagcatttgtgaagcagcacctttgcggcagccatctcgtggaggcactttacttggtgtgcggcgaaagaggtttcttttacactccagagacggaagctgaggaccttcaagttggacaagtcgagctgggtggcggtccaggtgcaggctcgctccaacctcttgcgctggaaggatctctgcaaaaacgcgggattgtggaacagtgctgtacctctatttgttcactttatcagctggagaattactgtaac

SEQ ID NO: 14108 - DNA, 324 bp, Artificial Sequence
  Description of Artificial Sequence: Synthetic coding sequence
atggcgttgtggatgcgtctcctcccgctcctcgccctgctggcgttgtggggccccgatcccgcagcagcctttgtcaagcagcatctatgcggcagtcacttggtcgaagctctgtacctcgtgtgtggagagcgaggttttttctatacccctgaaaccgaggctgaggatctccaggtagggcaagttgagttaggtggtggacccggagccggatctttacagcctctagcacttgaaggcagtctacagaagagaggcattgttgaacagtgttgcacgtctatctgctctctttaccagctcgaaaactactgcaac

SEQ ID NO: 14109 - DNA, 324 bp, Artificial Sequence
  Description of Artificial Sequence: Synthetic coding sequence
atggctctgtggatgcgcttgcttcctttgctggctcttctggcattatggggcccggatcccgccgcggcgttcgttaagcaacatctctgtggcagtcacttagtcgaagctctgtatctcgtctgcggtgagcgcgggtttttctacacgccggagactgaggcagaggacctgcaggtgggacaggtggaactcggcggggggccaggcgccgggtctctgcaacctctggccctggagggctccctgcagaagagaggtatcgtcgagcagtgttgtacaagtatttgctcactgtatcagctggagaattattgcaac

SEQ ID NO: 14110 - DNA, 324 bp, Artificial Sequence
  Description of Artificial Sequence: Synthetic coding sequence
atggctctctggatgagattgttacctctcctggccttactcgcactgtggggtccggatccggctgctgcttttgttaaacagcatctttgcgggagtcacctggtcgaagctctgtaccttgtgtgtggagagagaggattcttttacacaccggaaacggaagccgaggatctccaggttggtcaggtcgagctgggaggcggccccggagctgggagccttcagccgttggcattggagggctcactgcagaaaagaggtatcgtggagcagtgttgcacgagtatctgttcactgtaccagctggaaaactattgtaac

SEQ ID NO: 14111 - DNA, 324 bp, Artificial Sequence
  Description of Artificial Sequence: Synthetic coding sequence
atggcactctggatgaggttgctccctttgctagcactgctggcgctgtggggtccagaccctgcagctgctttcgtgaaacagcacttatgtggctcccatcttgtggaagctttgtatctggtttgtggagagcgtggattcttctatactccagaaactgaggcggaagatttgcaggtcggtcaggttgagctgggaggcgggccaggagcgggttcgttgcagcccttagctttggaaggaagcttgcagaagcggggcatagtggaacagtgttgtacctcgatctgttcgttatatcaactggaaaactattgtaac

SEQ ID NO: 14112 - DNA, 324 bp, Artificial Sequence
  Description of Artificial Sequence: Synthetic coding sequence
atggcactgtggatgagattgctccccctgttggcactcctggcgctgtggggacccgatccggcagccgcttttgtgaaacaacacctgtgcggcagccatctggtggaagctctttacctcgtctgtggtgaacgcggctttttctacactccggaaacggaagcagaagatctccaagtgggccaagtcgagctcggaggaggtcctggagcagggtcgcttcagcctctggcacttgaggggagcctccagaagagaggtattgtggaacaatgttgtacctcgatctgttcactgtaccaactcgaaaactactgcaat

SEQ ID NO: 14113 - DNA, 324 bp, Artificial Sequence
  Description of Artificial Sequence: Synthetic coding sequence
atggcgttgtggatgcggctgttgccacttctggcgctgcttgcgctttggggccctgaccctgccgctgccttcgtaaatcagcacctgtgcggttcacatcttgtggaggctctgtacttggtgtgtggcgaaagaggatttttctataccaagccgactgaagcagaagatctgcaagtcggtcaagtcgaattgggaggcggaccgggggccggatccctgcagcccctggcactcgaaggaagcctgcagaagcgcggcattgtggagcagtgctgcacttcgatctgttcactctaccagctggagaactactgtaat

SEQ ID NO: 14114 - DNA, 324 bp, Artificial Sequence
  Description of Artificial Sequence: Synthetic coding sequence
atggcactgtggatgcgcctcctgccactcctcgccctgctggcgctctggggaccggaccccgcggctgcttttgtgaatcagcacctctgcggaagccacctggtggaggccctgtacctcgtttgcggggagagagggtttttctacactaagccaaccgaagccgaggatctgcaggtgggccaggtggagctgggaggtggccccggcgcggggtcactccagccgctggccctggagggatcccttcagaagagaggtatcgtcgaacagtgctgcacctccatctgttccctgtaccaactggaaaactactgcaac

SEQ ID NO: 14115 - DNA, 324 bp, Artificial Sequence
  Description of Artificial Sequence: Synthetic coding sequence
atggccttgtggatgcgtctgctcccactcctggcacttctggccctctggggaccagatccggcagcggcgtttgtgaaccaacatctgtgcgggagccacctggttgaagccctgtatttggtctgtggtgagaggggctttttctacactaaacctacggaagcagaggatctccaggtcggtcaagtggaacttggtggaggacccggcgcaggatcactccaacctcttgcgctcgagggaagcctccagaagcgaggtatcgtcgaacaatgctgtacctcaatttgttcactctaccaactggaaaactactgtaac

SEQ ID NO: 14116 - DNA, 324 bp, Artificial Sequence
  Description of Artificial Sequence: Synthetic coding sequence
atggcactgtggatgcgccttctccctctgctcgcactgctcgcattgtgggggccggacccggccgcagcttttgtcaatcagcacctctgtggatcacatctggtcgaagctctttacctggtgtgtggtgaacgcgggttcttctataccaagccaactgaggcggaagatctccaagttggacaagtcgaacttggtggcggtcccggtgctggatccctgcagccactggcactggagggatcccttcaaaaacgtggaattgtggagcagtgttgcacctcgatctgttcgctctaccagctggaaaactactgtaac

SEQ ID NO: 14117 - DNA, 324 bp, Artificial Sequence
  Description of Artificial Sequence: Synthetic coding sequence
atggccctctggatgcgcctcctccctctgctagcattgctcgcgctgtggggtcccgatcccgcagccgcctttgtaaaccaacacctctgtggatcccatctggtggaggctctttacttagtgtgtggcgaaaggggcttcttctacacaaaaccaacggaggctgaagatctccaagtcggacaggtcgagctcgggggtggccctggggctggttccctgcagccactggctttggaggggagccttcagaaacggggaatcgtggaacagtgctgcacttctatctgctcactttatcagctggaaaactattgtaat

SEQ ID NO: 14118 - DNA, 324 bp, Artificial Sequence
  Description of Artificial Sequence: Synthetic coding sequence
atggctctgtggatgcggctcctccccttgctcgccctccttgcactgtggggccctgaccctgctgcggcctttgtgaatcagcacttgtgtggtagccaccttgtagaggcactgtacttggtctgcggtgaaaggggctttttctatactaaaccaacagaggcagaggacctgcaagtggggcaggttgagttgggggggggtccaggcgccggatcattgcagccacttgctttagagggctcactccagaaaagggggatcgttgagcaatgctgcacaagcatatgctccctgtaccaactggagaattactgtaac

SEQ ID NO: 14119 - DNA, 324 bp, Artificial Sequence
  Description of Artificial Sequence: Synthetic coding sequence
atggccttgtggatgcgactgctccctcttctggctcttctcgcgctctggggtccggatccagctgcagctttcgtgaaccagcatctctgcggcagccacctggttgaggcgctgtacctagtatgcggagagagggggtttttctacaccaagccaactgaggctgaagatttgcaggtcggccaggtagaactaggcggggggccaggagctggatccctgcagccattggcgctggaagggagtttgcagaagcggggtattgtggagcagtgttgtacaagcatatgttcactttaccagctggaaaactattgtaat

SEQ ID NO: 14120 - DNA, 324 bp, Artificial Sequence
  Description of Artificial Sequence: Synthetic coding sequence
atggccctctggatgcggctgttgccgctcctcgcactactcgctttgtgggggcccgacccagcagctgccttcgtgaatcagcacttatgcggatcacacctggtggaggcgctctaccttgtctgcggcgaacggggttttttctacacaaaacccaccgaagccgaggatcttcaagttggtcaggtggagctcggcggcgggcccggtgctggatctctacagcctctcgctctagagggatccctgcagaaacgtggcatcgtggaacagtgctgcaccagtatttgttccctttatcagctcgagaactactgtaac

SEQ ID NO: 14121 - DNA, 324 bp, Artificial Sequence
  Description of Artificial Sequence: Synthetic coding sequence
atggcactgtggatgcggcttcttccgcttctcgcgctcctggcgctgtggggccctgatccggccgccgcgttcgtcaaccaacatttgtgtggctcccacctcgtggaggcactctatctggtctgtggggaacgcggattcttttacactaagccaactgaggccgaggaccttcaagttgggcaggtggagctgggaggaggtccgggagcaggatcactccagccactcgcactggaaggatccttgcagaagcgcggcatcgtggagcagtgctgcactagcatttgctcgctctaccaactcgaaaactactgcaat

SEQ ID NO: 14122 - DNA, 324 bp, Artificial Sequence
  Description of Artificial Sequence: Synthetic coding sequence
atggctttgtggatgcggttacttccactgctggcgttacttgcgctgtggggtccagaccctgctgctgcattcgtgaatcagcacttgtgcgggtcccacttagtcgaggccctttacctagtgtgtggagaaagaggcttcttttataccaagcccactgaagcggaggacttgcaggtcggccaggtggagctgggcggtggccccggcgcaggatctctgcagcccctggcacttgagggctctcttcagaagagggggatcgtggagcagtgttgtactagtatctgcagcctctatcaactcgaaaattactgcaat

SEQ ID NO: 14123 - DNA, 324 bp, Artificial Sequence
  Description of Artificial Sequence: Synthetic coding sequence
atggctctttggatgagactgctgccactcctggctttgctggctttgtggggccccgatcctgccgccgccttcgtgaaccagcacctgtgtggctcccatttggtggaggccttgtatctggtctgcggagagagagggtttttttatacgaaacctacagaggcagaggatctgcaggtggggcaggtcgagctgggtggcggtcctggagctggctccctgcagcccctggccttggaaggttctctgcagaaaaggggtatcgtcgagcagtgctgcactagcatatgctccctctatcaacttgagaattattgcaat

SEQ ID NO: 14124 - DNA, 324 bp, Artificial Sequence
  Description of Artificial Sequence: Synthetic coding sequence
atggcattgtggatgcgattgctgccgttgctagcccttcttgccttgtggggccctgaccctgctgccgcctttgtcaaccagcatttgtgtgggtcccatctggtcgaggccctgtatctggtgtgtggtgagagggggttcttctatactaaacccacggaggcagaggacttgcaggtggggcaggtcgaactcgggggaggacccggcgccggaagcttacagccacttgctcttgaaggaagcttacagaaaagagggatcgtggaacagtgctgcacaagtatatgctcactatatcagctagagaactactgcaac

SEQ ID NO: 14125 - DNA, 324 bp, Artificial Sequence
  Description of Artificial Sequence: Synthetic coding sequence
atggcactgtggatgcgcctgttgcccctgctggcgctcctggcactttggggcccagacccggccgcagcttttgtcaaccaacatctttgtggatctcacctggtggaggctttgtaccttgtctgtggagaaagggggtttttctacacgaaacctaccgaagccgaggatctgcaagtgggacaagtggaactgggagggggacctggcgctgggtcgttgcagccgcttgccctcgagggttccctccagaagagaggaattgtggaacaatgttgcactagcatctgtagcttgtaccagctggaaaactactgcaat

SEQ ID NO: 14126 - DNA, 324 bp, Artificial Sequence
  Description of Artificial Sequence: Synthetic coding sequence
atggcactttggatgcggctgcttcctcttctggcactgttggccctgtggggacctgatccagccgcagcgtttgtgaaccaacatctttgtggtagccatctggtggaagcactgtacctggtttgcggcgaaagaggttttttctacactaagccaaccgaagcagaagatcttcaagtcgggcaagtcgagctgggaggagggcccggagctggctccttgcagcctcttgcactcgaaggcagtctccaaaagaggggcattgtcgagcaatgttgtacctccatctgcagcctttaccagctcgagaattactgcaat

SEQ ID NO: 14127 - DNA, 324 bp, Artificial Sequence
  Description of Artificial Sequence: Synthetic coding sequence
atggcactctggatgcgactgctgccactcctggcattgctcgcgctctggggccctgacccagccgccgcgtttgtgaaccaacatctctgtggatctcacctcgtggaggcactgtacctcgtgtgcggagagcggggtttcttttacaccaagcccacggaggcagaggatcttcaagtcggccaggtggaacttggcggtggacctggggcgggtagcctgcaaccgttggcacttgaaggatcattgcagaagcgaggtattgtggaacaatgttgtacttccatttgttccctttaccagctggagaattactgtaac

SEQ ID NO: 14128 - DNA, 324 bp, Artificial Sequence
  Description of Artificial Sequence: Synthetic coding sequence
atggctttgtggatgaggctgctgcccctgctggccttgctggcactgtggggccctgatcccgcagctgctttcgttaaccagcacctgtgtggcagccatctggtggaagccttgtacctggtatgcggcgagcgaggttttttctacacaaaacctaccgaggctgaggacttgcaggtaggacaggttgaacttgggggtgggcccggggcagggagtctgcaacccctcgctctggaggggtcactccaaaagagaggcatcgttgagcaatgctgtacatccatctgcagtctttatcagctggagaattattgtaac

SEQ ID NO: 14129 - DNA, 324 bp, Artificial Sequence
  Description of Artificial Sequence: Synthetic coding sequence
atggccttatggatgcggcttttgccattgctcgcactgttggccctatggggtcctgacccagcagcagcctttgttaaccagcatctctgcggttcccacctcgtggaggcactgtatcttgtgtgtggagagcgagggtttttttacactaagcccacagaggcagaggacttgcaggtggggcaagtcgaactcggcggcgggccaggagccggatctcttcaacccctggctcttgaggggtccttgcagaagaggggcatcgtggagcagtgttgcacctccatctgtagcctgtatcagctagagaactattgcaac

SEQ ID NO: 14130 - DNA, 324 bp, Artificial Sequence
  Description of Artificial Sequence: Synthetic coding sequence
atggctctatggatgaggctgcttccgttactcgccctcctggccctgtggggccccgaccccgctgcggccttcgtcaatcagcatctctgcggaagccatctagttgaggcactgtacctggtgtgcggcgagcgaggattcttctatacaaagccgacggaggccgaagacttacaagtgggacaggtggagctgggggggggacccggagccggctcactgcagcccttggctctagaagggtccctccagaagcgaggtatcgtggaacagtgctgcacaagcatatgcagtttgtaccaattggagaattattgcaat

SEQ ID NO: 14131 - DNA, 324 bp, Artificial Sequence
  Description of Artificial Sequence: Synthetic coding sequence
atggccctgtggatgcgcctcctcccattgcttgcccttctggccctctggggacctgacccggcggctgcgttcgtgaatcaacacctttgtggttcacatttggtggaggcactctaccttgtgtgcggagagcgaggcttcttttacaccaaacccactgaagccgaagatctgcaggtcgggcaggtggagcttgggggcggaccaggagcagggtcgctgcagcctcttgcattggaaggttccctgcagaagcgggggattgtagagcaatgttgcacgtcgatctgctctttgtaccagctggaaaactactgcaac

SEQ ID NO: 14132 - DNA, 324 bp, Artificial Sequence
  Description of Artificial Sequence: Synthetic coding sequence
atggccttgtggatgcgactactgcccctattggccttgctggcgttgtggggacctgatccagccgctgctttcgtcaaccagcatctctgtggctcccatctggttgaagctctgtacctggtgtgcggagaaagaggctttttctatacgaagccaaccgaggcagaggacctgcaagttgggcaggtcgagctcgggggggggcctggagccggctcactgcagcctctggccctcgagggcagcctccagaaacgtggtatcgtggaacagtgttgcacttctatttgttcactgtatcagctcgagaactactgcaac

SEQ ID NO: 14133 - DNA, 324 bp, Artificial Sequence
  Description of Artificial Sequence: Synthetic coding sequence
atggccctctggatgagactgttgccattgttggcgctcttagctctgtgggggccggatcctgcagcagcgttcgtaaatcagcatctgtgtggtagccaccttgtggaggccttgtatttagtgtgcggtgagaggggttttttctatacaaagcccactgaggcagaggatctgcaggtcggacaggtcgaactgggcgggggccctggcgccggttcccttcagccgctggcgctggaggggtcactgcagaagcgtggcatcgtggaacagtgttgtacatccatttgctccctataccagctagagaactattgtaac

SEQ ID NO: 14134 - DNA, 324 bp, Artificial Sequence
  Description of Artificial Sequence: Synthetic coding sequence
atggcgctgtggatgcgcctgcttccactcctggctttgctggcattgtggggaccggatccggcagccgcatttgtgaaccagcacctgtgcgggtcgcatcttgtcgaagcactctacctcgtgtgtggcgaacgcggattcttctacactaagcctacggaggcggaggaccttcaggtcggacaagtggaactcggcggcggaccaggtgccggctccctccaaccgcttgccctggagggctcactgcaaaagcgtggaatcgtggaacaatgttgcaccagcatctgctcgctttatcagttggaaaactactgcaac

SEQ ID NO: 14135 - DNA, 324 bp, Artificial Sequence
  Description of Artificial Sequence: Synthetic coding sequence
atggccctttggatgcggcttctgccattgctcgctctgctggcactctggggaccagacccggcagcggcctttgtgaatcaacacctgtgtggatcccatttggttgaggcactgtaccttgtgtgcggcgaacgtggcttcttctacaccaagcctaccgaagcagaggatcttcaggtcggacaggtggagctcggcggaggacccggtgctggttccctgcaaccccttgcacttgaaggttccttgcaaaaacgtggcattgtcgagcaatgttgcacgtcaatctgttcgttgtaccaactggaaaactactgtaac

SEQ ID NO: 14136 - DNA, 324 bp, Artificial Sequence
  Description of Artificial Sequence: Synthetic coding sequence
atggccctttggatgagactgctcccgctgttggctctgctggcgttgtggggaccggatccggccgcggcgttcgttaaccaacatctgtgcggaagccacctcgtcgaggcgctttacctcgtgtgcggcgaaagggggttcttttacacgaagcctactgaagccgaggaccttcaagtgggccaggtcgaactgggaggaggacccggtgccggttcgttgcagcccctcgctctggagggctcccttcagaaacgggggatcgtggagcagtgttgtacctcaatctgctcgctctatcaattggaaaactactgcaac

SEQ ID NO: 14137 - DNA, 324 bp, Artificial Sequence
  Description of Artificial Sequence: Synthetic coding sequence
atggccctgtggatgcgcctcttacctcttctcgctcttttggcactctgggggccggaccctgccgcagcctttgttaatcagcatctgtgcggctcccatctggtagaagcactctatctagtctgtggcgaaagggggttcttttacacaaagccaaccgaagcggaggatttgcaggtcggccaggtggagttgggaggagggccaggagcgggtagcctacagcccctcgctctggagggatcgctgcaaaagcggggcatcgtcgaacagtgctgcacaagcatttgttcgctgtaccagctcgagaactactgcaat

SEQ ID NO: 14138 - DNA, 324 bp, Artificial Sequence
  Description of Artificial Sequence: Synthetic coding sequence
atggctctttggatgcgactgctgccactgcttgcattgctggcactgtggggcccagaccccgcggcggcatttgtgaaccagcatctgtgtggcagccacctcgtggaagcgctttacctggtgtgtggcgagcgcggtttcttttacactaagccaactgaagccgaagatcttcaggtcgggcaagtggaactgggtggaggtccgggggcaggttcgcttcagccccttgccctcgagggatcgctccagaagagaggaattgtcgaacagtgttgtacttccatatgcagcctgtaccaactggaaaactattgtaac

SEQ ID NO: 14139 - DNA, 324 bp, Artificial Sequence
  Description of Artificial Sequence: Synthetic coding sequence
atggccctttggatgcgcttgctcccactgcttgcccttctcgcactgtggggtcctgacccagcagcagcattcgtgaaccagcacctttgtggcagccatctggtggaggcactgtacctcgtgtgcggcgaacggggattcttttacactaaacccaccgaggcagaagatctgcaagtaggccaagtcgaactgggtggaggccccggcgcgggtagcctgcagccgctggcacttgaaggttcactccagaagagaggtattgtcgaacagtgttgcacctccatctgttccttgtatcaactggagaattactgtaat

SEQ ID NO: 14140 - DNA, 324 bp, Artificial Sequence
  Description of Artificial Sequence: Synthetic coding sequence
atggccctgtggatgagacttctccctctcctggctttgttggccctgtggggaccagatccagccgcagcatttgtaaaccagcacctgtgtggcagccatcttgtggaggctttgtacttggtgtgtggtgagaggggttttttttacactaaacccacagaggccgaagatttgcaggtaggacaagttgaactcggtggaggccctggcgccggcagccttcaaccccttgccctggagggctctctgcaaaaacgcggaatagtggagcaatgttgtacaagcatttgcagtctgtatcagctcgaaaattactgcaat

SEQ ID NO: 14141 - DNA, 324 bp, Artificial Sequence
  Description of Artificial Sequence: Synthetic coding sequence
atggccttgtggatgcgcttgttgcctctgctcgctttgctcgcactttggggacccgaccctgcggctgccttcgtcaaccaacacttatgtggatcccacctggtagaagcactctacctcgtctgtggtgaacgtgggttcttctataccaagcctactgaggccgaggatcttcaggtcgggcaggttgaactaggcggcggccccggcgccggttcattgcagccccttgccctggagggttctttacaaaaacgaggtattgtggagcaatgttgcactagtatctgttcactataccaactggagaattactgcaac

SEQ ID NO: 14142 - DNA, 324 bp, Artificial Sequence
  Description of Artificial Sequence: Synthetic coding sequence
atggctttatggatgcgtctgctaccgttgttggctcttttagctctttggggtccggatcctgctgcagcctttgtgaaccagcatctgtgcggctctcatctggttgaggcattgtaccttgtgtgtggtgaaaggggatttttctacacaaaacctacagaagcggaagatctccaagtgggccaagtcgaactcggcggaggcccgggtgcgggctctttgcagccgctagctcttgaaggatccttgcagaagagggggatcgtcgaacagtgttgtacatcaatctgttctttgtatcagctagagaactactgcaat

SEQ ID NO: 14143 - DNA, 324 bp, Artificial Sequence
  Description of Artificial Sequence: Synthetic coding sequence
atggccctttggatgaggcttcttcctcttcttgcactgcttgcactgtggggaccagatccagcagcagcctttgtgaaccagcacctctgtgggagccacctggtggaagcactctacctggtctgcggtgaacgcggatttttctataccaaacccaccgaagccgaagatcttcaggtcggacaagtggagcttggtggcggtccaggagccggatcactgcagccactggccctcgaaggatcgcttcagaagagaggtattgtggaacaatgctgtacctccatttgtagcctctaccaattggagaactactgcaat

SEQ ID NO: 14144 - DNA, 324 bp, Artificial Sequence
  Description of Artificial Sequence: Synthetic coding sequence
atggccctgtggatgcgtctgctcccgttgctcgcacttcttgcactgtggggtccggatccagcagccgcctttgtgaatcagcatctgtgtggatcgcatctcgtggaggcgctctacctggtgtgcggagagcggggattcttctacaccaagcccaccgaggccgaggacctgcaggtgggtcaggtggaactgggcggaggcccgggtgcaggatccctgcagcctctggctctcgagggttctctgcaaaaacgcggcatcgttgaacaatgctgtaccagcatctgttcactgtaccagctggagaactattgcaac

SEQ ID NO: 14145 - DNA, 324 bp, Artificial Sequence
  Description of Artificial Sequence: Synthetic coding sequence
atggctttgtggatgcgactcttgcccttgcttgcactgttagcactttgggggccagatcccgcagccgcctttgtgaatcagcatctgtgtggatcacatctggtagaggcactgtatcttgtgtgtggagaacgtggatttttttatacaaaaccaacggaagctgaggatttgcaggttggacaagttgaattgggaggaggacccggagctggatcactacaacctttagcactagaggggtcactacaaaagcgagggatagttgagcaatgttgtacttcaatatgctcactctaccaattagagaactattgcaac

SEQ ID NO: 14146 - DNA, 324 bp, Artificial Sequence
  Description of Artificial Sequence: Synthetic coding sequence
atggcactctggatgcggttgttgccgctgctggcgttactagctctgtggggacccgaccccgccgcagcttttgtgaaccagcacctgtgtggctcacacttggtcgaagcactctacctcgtctgtggagaacgcggattcttctatacgaagcccaccgaggctgaagatctgcaggtgggccaagtggaacttggggggggaccaggggcagggagcctgcagcccctggctctcgaaggctccctgcagaagcgggggatagtggaacaatgctgcactagcatctgctctctttaccaactggagaattactgcaac

SEQ ID NO: 14147 - DNA, 324 bp, Artificial Sequence
  Description of Artificial Sequence: Synthetic coding sequence
atggctctgtggatgcgccttttgccccttctggccctgctggctctgtggggtcctgaccccgcagcagcatttgtgaatcagcatctctgcggctcgcaccttgtcgaagccctctatctggtttgcggtgagcggggatttttctacaccaagccaactgaggccgaagatctgcaggtgggacaggtggagctgggcggcggccctggcgccggctcactccagcctctggcactcgagggaagtttacaaaaaagaggtatcgttgagcaatgctgtacctctatctgcagtctttatcagctagagaactattgcaac

SEQ ID NO: 14148 - DNA, 324 bp, Artificial Sequence
  Description of Artificial Sequence: Synthetic coding sequence
atggctctctggatgaggctgctaccacttctggcactgctcgccctgtggggacccgacccggcagctgcattcgttaaccagcacctatgtggatcccacctggttgaagcactgtatttggtctgtggagaacggggcttcttctatacaaagcccactgaggccgaagacctccaagtagggcaggtagaactgggcggtggcccgggggctggttccctacaacctttggctctcgagggcagtttgcaaaagcgcggcattgttgagcagtgttgtaccagcatttgcagcctgtaccagctggagaattattgcaat

SEQ ID NO: 14149 - DNA, 324 bp, Artificial Sequence
  Description of Artificial Sequence: Synthetic coding sequence
atggcactctggatgaggctcttgccattgctcgctctgcttgctttatggggtcctgatccggccgcagccttcgtcaaccagcacctgtgcgggagtcacctggtggaagcactgtaccttgtctgtggcgagcgtggattcttctacacaaagccaactgaagccgaagatctgcaagtagggcaggtggagcttggcggaggccccggggcaggaagcctgcagccgctcgcccttgaaggcagcttacaaaaaagaggaatcgtggaacaatgctgtacctcaatatgctctctctaccagcttgagaattattgcaac

SEQ ID NO: 14150 - DNA, 324 bp, Artificial Sequence
  Description of Artificial Sequence: Synthetic coding sequence
atggcattgtggatgcgtcttctacctttgctggccttattagccttgtgggggcccgatcctgctgcggcttttgttaaccaacacctatgcggctcccacttggtggaagccttatacttggtgtgcggtgaacgtggatttttctatactaaacctacagaagccgaagatttgcaagtgggtcaagttgagcttggcggtgggccaggtgccggttcattacaaccattggccttagagggctccctacagaaacgtgggattgtagaacagtgttgtacgagcatctgtagtttatatcagctagagaactattgcaat

SEQ ID NO: 14151 - DNA, 324 bp, Artificial Sequence
  Description of Artificial Sequence: Synthetic coding sequence
atggcgttgtggatgcgcctcttgccgctgctcgccctgctcgccctctggggcccggatccggccgcagccttcgtgaaccagcacctgtgcggatcgcacctggtggaggccctgtacctcgtgtgcggcgagcgggggttcttttacactaagccaaccgaggctgaagatctgcaggtcggacaagtggaactcggtggaggcccgggcgccggaagcctgcaaccgctggctctggagggatcgctgcagaagcgcggaatcgtcgagcagtgctgtaccagcatctgctcactgtaccagctggagaactactgcaac

SEQ ID NO: 14152 - DNA, 324 bp, Artificial Sequence
  Description of Artificial Sequence: Synthetic coding sequence
atggcgctgtggatgcgcctgctgccgctgctggccctgctcgccctgtggggccctgaccctgctgcggctttcgtgaaccaacatctgtgcggatcccacctggtggaggcgttgtacctcgtgtgcggagaaaggggatttttctacactaagccgaccgaggccgaggacctgcaagtgggacaggtggaactgggcggcgggcctggagccggctctctgcagccgctggctcttgaaggatccctccagaagagaggaatcgtcgaacagtgctgcacctcgatctgctcgctctaccagcttgagaattactgcaat

SEQ ID NO: 14153 - DNA, 324 bp, Artificial Sequence
  Description of Artificial Sequence: Synthetic coding sequence
atggccttatggatgcgactgctgcccttgctggctctgctggcactctggggtcccgatcccgcagcggctttcgtcaaccaacacctttgcggatctcatcttgtggaagctctgtacttggtgtgtggcgaacgcggttttttctataccaagcccactgaggcggaggatctgcaggtcgggcaggtggaactgggaggtggaccaggtgccggaagcctgcagcccctggcattggaaggctcattgcagaagaggggcatcgtagagcagtgttgcacttccatatgctccctctatcaattggagaattactgcaat

SEQ ID NO: 14154 - DNA, 324 bp, Artificial Sequence
  Description of Artificial Sequence: Synthetic coding sequence
atggcgttgtggatgagactgctgccgcttctcgctctgctggcactttggggacccgatcctgccgcggcttttgttaaccagcatctgtgtggatcccacctggtagaagccctttaccttgtctgtggtgagaggggatttttctacactaaacctacggaggcagaggaccttcaggtgggtcaggtggaactcggaggaggcccaggggccggttcactgcaaccactggcactggaaggatcacttcaaaagagagggattgtggaacaatgctgtaccagcatttgcagcctttatcaacttgaaaactactgcaat

SEQ ID NO: 14155 - DNA, 324 bp, Artificial Sequence
  Description of Artificial Sequence: Synthetic coding sequence
atggccctgtggatgagacttcttcctctgctggcattgctggccctgtggggtcctgacccagcagcagcctttgttaaccagcacctttgtggatcacatttggtggaggcactttacctcgtgtgcggcgaaagaggtttcttttacaccaagccaactgaagcagaggaccttcaggtgggtcaagttgaactcggcggtggtcccggagccggatcccttcagccacttgcgctggagggcagcctccaaaaaagaggtattgtggaacaatgttgtacctcaatctgttcgctttaccaacttgaaaactactgtaac

SEQ ID NO: 14156 - DNA, 324 bp, Artificial Sequence
  Description of Artificial Sequence: Synthetic coding sequence
atggctctgtggatgcgcttgctcccgctgctggcacttctggcactgtggggaccagacccagcggcggccttcgtcaaccagcacctgtgcggctcgcacctcgtcgaagcactgtacctcgtgtgtggagaaagaggattcttctacaccaaaccgactgaggccgaggacttgcaggttgggcaggtggaacttggtggaggacccggtgctggatcactgcagccgttggccctcgagggtagcctgcaaaaacggggcatcgtggagcagtgctgcacctccatttgcagcctgtaccagctggagaactactgtaac

SEQ ID NO: 14157 - DNA, 324 bp, Artificial Sequence
  Description of Artificial Sequence: Synthetic coding sequence
atggccttatggatgcgcttactgcccctgctggcactcctcgctctatggggccccgaccctgccgcagcgttcgtgaaccagcacctgtgcggctcacatcttgttgaagccctgtatctggtgtgtggcgaacgaggttttttctacaccaagcctacagaggccgaagacctacaagtagggcaggtagagcttggcggcggtccaggggccgggtctctacaacctctcgcactcgagggttcgcttcagaagagagggatcgtcgagcagtgttgcacatcgatctgcagtctgtatcagcttgagaattattgtaat

SEQ ID NO: 14158 - DNA, 324 bp, Artificial Sequence
  Description of Artificial Sequence: Synthetic coding sequence
atggcgctgtggatgcgactgctgccactcctcgcactgctggctctctggggaccagaccccgctgctgcgtttgtgaaccaacacctttgcggaagccacctcgtggaggccctctacctggtgtgcggtgagagaggattcttctataccaaaccgaccgaggcagaggacttgcaagtgggtcaggtggaattggggggaggccctggagcgggatcactgcagcctttggcactggaaggctcccttcaaaagcgggggatcgtggagcaatgttgcacgtcaatctgctccctgtaccaactcgagaactactgcaat

SEQ ID NO: 14159 - DNA, 324 bp, Artificial Sequence
  Description of Artificial Sequence: Synthetic coding sequence
atggctctctggatgaggctgctgccactgcttgcactcttggcactctggggaccggacccagccgccgcattcgtaaatcagcacctctgcggaagccatcttgtcgaagccctgtacctggtgtgcggcgagcgcgggtttttctataccaagccgactgaagcggaagatcttcaagttggccaagtggaactgggaggtggccctggagccggttccctccagcccctggcgttggagggatctctgcagaagaggggaattgtcgagcagtgctgcactagcatctgtagcctttaccagttggagaactactgtaac

SEQ ID NO: 14160 - DNA, 324 bp, Artificial Sequence
  Description of Artificial Sequence: Synthetic coding sequence
atggctttgtggatgcgcctccttccactattagcactgttggccctttggggtccagaccccgctgccgcattcgtaaaccaacatctgtgcggctctcaccttgtagaggcactgtatttagtgtgtggggaacgtggtttcttctataccaaaccgaccgaggcagaagatctgcaggtgggccaagtggagctcggaggaggacccggagctggtagcctccagccgctggcattggagggtagtctccaaaagagggggattgtcgaacagtgctgtacttcgatatgttctctgtatcagctggaaaattactgtaac

SEQ ID NO: 14161 - DNA, 324 bp, Artificial Sequence
  Description of Artificial Sequence: Synthetic coding sequence
atggccctttggatgcggctgctcccgcttttggctttgttagctctttggggccctgatcccgctgccgcattcgttaatcaacacctgtgcggatcacacttggttgaagcattgtacttggtgtgtggagaaaggggttttttttatacaaagccaaccgaggctgaagacctgcaggtgggtcaggttgaattgggcggtgggccaggagcaggaagtctccagcccctggcgttggaagggagcctgcagaagagaggcatcgtggaacagtgttgcacttcaatctgttccttgtaccaactggagaactattgtaac

SEQ ID NO: 14162 - DNA, 324 bp, Artificial Sequence
  Description of Artificial Sequence: Synthetic coding sequence
atggcactttggatgcgtttgctccctctgctggcgctgctggcactctggggtccagaccccgccgcagcctttgtgaatcagcacctttgcggttcgcatcttgtggaagcactctacctggtctgtggtgaacgtggatttttctacactaagccaaccgaagcagaagatttgcaagtgggacaggtagagctgggcggagggccaggagcaggttcacttcaacctctcgcgttggagggatcacttcagaaacggggaattgtcgaacaatgttgtacctccatctgtagcttgtaccaactcgagaactattgcaac

SEQ ID NO: 14163 - DNA, 324 bp, Artificial Sequence
  Description of Artificial Sequence: Synthetic coding sequence
atggctctttggatgcgactactaccattactcgctttgttagctctttggggtccagaccccgcagccgcgttcgtgaaccagcacttgtgcggatcgcacctcgtggaagcgctgtatctcgtgtgcggtgaacgaggatttttctacacaaagccgacagaggccgaagacctccaggtaggtcaggttgagctgggcggcggccctggcgcaggaagcctccagcccctggctttggaaggatccctgcaaaagcgcggaatcgtggaacagtgctgtacctcaatatgttcgctgtaccagcttgaaaattactgtaat

SEQ ID NO: 14164 - DNA, 324 bp, Artificial Sequence
  Description of Artificial Sequence: Synthetic coding sequence
atggctctgtggatgaggcttctgcccctgctcgccctgcttgccttgtgggggccagaccccgccgctgcgtttgtgaatcagcacctgtgtggtagtcacctggtggaagccctctacctggtttgcggcgagcggggatttttttacacaaaaccaacagaggctgaggaccttcaagttggccaggtggagctaggcggagggcccggagcaggttctctacagcctctggcccttgaaggcagcctgcaaaaaagaggcattgttgagcagtgctgcacgtccatctgtagtttgtaccagttagaaaactactgtaat

SEQ ID NO: 14165 - DNA, 324 bp, Artificial Sequence
  Description of Artificial Sequence: Synthetic coding sequence
atggcgctatggatgcgtttattaccgctattagcgctactagcgctatggggtccggatccggcggcggcgtttgtaaatcaacatttatgtggttcgcatttagttgaagcgctatatctagtttgtggtgaacgtggttttttttatacgaaaccgacggaagcggaagatttacaagtaggtcaagtagaattaggtggtggtccgggtgcgggttcgttacaaccgttagcgctagaaggttcgctacaaaaacgaggtatagtagaacaatgttgtacgtcgatatgttcgctatatcaattagaaaattattgtaat

SEQ ID NO: 14166 - DNA, 324 bp, Artificial Sequence
  Description of Artificial Sequence: Synthetic coding sequence
atggccctttggatgaggttactccccctgctggcactcctggcactttgggggcctgatcctgctgcagcctttgtaaatcagcacttgtgtgggtcacacttagtagaggcactgtacctcgtgtgcggagaacgggggttcttctacacaaaaccaactgaagctgaagatctccaggttggacaggtggaacttggagggggacccggagccgggagtcttcaaccgctggctcttgaagggagtctacaaaaaagaggaatcgtggaacagtgttgtactagtatctgctcactttatcagctagagaattactgtaac

SEQ ID NO: 14167 - DNA, 324 bp, Artificial Sequence
  Description of Artificial Sequence: Synthetic coding sequence
atggccttgtggatgcgtctgttacccttgttggcccttttggcactgtggggaccagatcctgctgccgcattcgtgaatcaacacctatgcggctcacatctcgtggaggccctatatctcgtgtgcggcgaacgcggattcttttacacaaaaccaactgaggcagaagatctgcaagttgggcaggtggagctcggaggcggaccaggcgcagggtctctccaaccactagctttagaaggctccctgcagaagcggggcatcgtggagcagtgttgtacctcaatctgttccctgtatcagcttgaaaattactgtaat

SEQ ID NO: 14168 - DNA, 324 bp, Artificial Sequence
  Description of Artificial Sequence: Synthetic coding sequence
atggccctatggatgcgcctcttgccactacttgctttgctggctctgtgggggcccgatcctgctgctgcgttcgtgaatcagcatctctgcggctcccacctggtggaagccctgtatcttgtgtgtggtgagcggggcttcttttataccaaaccaacggaggcagaagatctgcaggtggggcaggtggaactgggaggaggccccggcgctgggtctctgcagccattggctctcgaaggctccctacagaaaagaggaatcgtggagcagtgttgtacctctatctgctccctttaccagctcgagaattactgcaac

SEQ ID NO: 14169 - DNA, 324 bp, Artificial Sequence
  Description of Artificial Sequence: Synthetic coding sequence
atggccctgtggatgaggctgctgccattgttggcactgctcgccctgtggggcccggatcctgccgctgcattcgtcaatcagcacctctgcggcagccacctcgtcgaagctctctacttggtgtgcggagagcgcggattcttctacaccaagccaaccgaagcggaggacctgcaagtgggacaggtcgagctgggcggcggaccgggcgccgggtcactgcaaccgctggcactggagggttcgctgcagaagcggggcattgtggaacagtgctgcacctccatctgctcgctttaccagctcgagaactactgtaat

SEQ ID NO: 14170 - DNA, 324 bp, Artificial Sequence
  Description of Artificial Sequence: Synthetic coding sequence
atggccctctggatgcgactgctaccgctgctggctctcctcgcactctgggggcccgaccctgcagctgcttttgtcaaccagcatctttgtggatcacacctagtggaagccttgtacctggtatgtggggagcggggattcttttatactaagcccacagaggccgaggatctccaggtaggtcaagttgaactgggaggcggcccaggcgccggctcactgcagccactcgctctggaaggtagtctgcagaaaaggggaatcgtcgaacagtgctgtacaagcatctgctccctctaccaacttgaaaactattgtaat

SEQ ID NO: 14171 - DNA, 324 bp, Artificial Sequence; identical to SEQ ID NO: 14122
  Description of Artificial Sequence: Synthetic coding sequence

SEQ ID NO: 14172 - DNA, 324 bp, Artificial Sequence
  Description of Artificial Sequence: Synthetic coding sequence
atggctctgtggatgaggctcctcccactgctggctttgcttgcactctgggggccagaccctgcagcggcattcgtgaatcagcatctttgtgggtcacatttggtggaggcactctacctcgtgtgtggcgaacggggatttttctacaccaaaccaacggaagcagaggacctgcaagtgggccaagtggaacttggaggaggacctggcgcgggatccctccaacccctggccctggagggctcactccaaaagcgtggtattgtggaacagtgctgtacttcgatctgctccctttaccagcttgagaactactgtaac

SEQ ID NO: 14173 - DNA, 324 bp, Artificial Sequence
  Description of Artificial Sequence: Synthetic coding sequence
atggcgctttggatgcggctgctgccgctgttggcgctcctggccttgtggggaccagaccctgcagctgcctttgtgaaccagcacctttgcggaagccatctggtcgaggctctgtacctcgtttgcggagaaaggggattcttctacactaagcccaccgaagcagaagatctgcaggtgggacaggtcgaactgggaggaggaccgggagcaggctccctgcagccgctggccctggagggaagtctccaaaaaagagggatcgtcgaacaatgttgcacttccatctgttccctgtaccaactggaaaactactgcaat

SEQ ID NO: 14174 - DNA, 324 bp, Artificial Sequence
  Description of Artificial Sequence: Synthetic coding sequence
atggctctgtggatgcggctgttgccacttctggcactcctcgccctctggggtcccgaccccgccgctgcctttgtaaaccagcacctatgtggaagtcatctggtcgaagctttataccttgtgtgtggcgaacgggggttcttttacaccaagcctacagaagctgaagatctacaggtaggtcaggtggaattgggcggcgggcccggcgccgggtctcttcagccactggccttggagggcagcctccagaaacgcgggatcgtagagcagtgttgtacaagcatatgcagtctgtaccagcttgaaaattactgcaac

SEQ ID NO: 14175 - DNA, 324 bp, Artificial Sequence
  Description of Artificial Sequence: Synthetic coding sequence
atggcgctgtggatgcgactgttgccattgctggctctactcgccttgtggggaccggatccggccgccgcgttcgttaaccagcatttatgcggcagccacctggtcgaggccctatacctcgtctgcggtgaacgagggttcttctacaccaaacccactgaggccgaggacctccaggttggccaggtggaactcggcggagggcctggggccggctccctgcagcccctcgccctggagggctcgctacagaagcgtggtatcgtcgagcagtgttgcacttcaatatgttccctttaccagctggagaattattgcaat

SEQ ID NO: 14176 - DNA, 324 bp, Artificial Sequence
  Description of Artificial Sequence: Synthetic coding sequence
atggcactgtggatgaggctccttccattgctagctcttctggccctgtggggcccagacccagccgccgcatttgtgaaccaacacctgtgcggttcccatctggtggaagcgctttaccttgtgtgcggcgagcggggttttttttataccaaacccaccgaggctgaagatttgcaggtggggcaagtggagctggggggtggcccaggagccggatctctccaaccactggctctcgagggcagtcttcagaagcggggaatcgtggaacaatgctgcacatccatctgcagcttataccagctcgagaactattgtaat

SEQ ID NO: 14177 - DNA, 324 bp, Artificial Sequence
  Description of Artificial Sequence: Synthetic coding sequence
atggctctgtggatgcgactcctccctcttctcgccctcttggcactctggggcccagaccctgcagcggccttcgtcaaccagcatctttgcggatcccaccttgtcgaggctctgtacctcgtgtgtggggaacgggggttcttttacaccaagccaactgaagccgaagatctgcaagttggtcaggtggaactcggtggcggcccaggagcaggaagcctgcaacccctggctcttgagggatctttgcaaaaacgcgggatcgtggagcagtgttgtacctcgatttgctccctttaccagctggaaaactactgtaat

SEQ ID NO: 14178 - DNA, 324 bp, Artificial Sequence
  Description of Artificial Sequence: Synthetic coding sequence
atggcattatggatgagattgttacctttacttgcacttttagctttatggggacctgatccagcagccgcttttgttaaccaacacttatgtggttctcatcttgttgaggctttgtatcttgtttgtggagaaagaggatttttttatacaaaaccaactgaagctgaggaccttcaagttggacaagttgaacttggaggagggcctggagctggatcattacaaccacttgcattggaaggatccttacagaaaagaggaattgtggaacaatgttgcacatcaatttgttcattgtaccaacttgaaaattattgtaat

SEQ ID NO: 14179 - DNA, 324 bp, Artificial Sequence
  Description of Artificial Sequence: Synthetic coding sequence
atggccctgtggatgcggttacttccactactcgccctcctggcactctggggcccagaccccgccgcggccttcgtcaaccagcacctatgtggaagtcacctggtagaggcactgtacctagtgtgcggcgagcggggttttttctacaccaagcccaccgaagctgaggacctccaggtcggccaggtcgagctgggagggggccccggcgccggatctttgcagccgctggcacttgagggctcactgcaaaagcgtgggatcgtcgagcagtgctgcacttcgatctgttcactgtaccagcttgaaaattactgtaac

SEQ ID NO: 14180 - DNA, 324 bp, Artificial Sequence
  Description of Artificial Sequence: Synthetic coding sequence
atggctctgtggatgcggctgctgccactgttggccctgctggcactatggggtcctgacccggctgccgcattcgtcaaccaacatctgtgcggtagccatctagttgaggctctttacctggtgtgtggggaacgtgggtttttctacactaagccgaccgaggcggaggacctgcaggtgggtcaggtggagttgggtggtggtccaggagcagggtccctgcagccgttggctctggagggttccctgcaaaaacgcggtattgtcgaacagtgttgtactagcatttgtagcctgtatcagctggaaaattactgtaat

SEQ ID NO: 14181 - DNA, 324 bp, Artificial Sequence
  Description of Artificial Sequence: Synthetic coding sequence
atggcattgtggatgagactgctccctcttctagcactgctggcactgtgggggcccgacccagcagctgcattcgtcaaccagcacctgtgcggcagccacctggttgaggccctgtacctggtttgtggcgagcgtggttttttctatactaaacctaccgaggctgaggatttacaggtgggccaggtagagcttggcggaggaccaggggcaggatctctgcagcccctggctctggagggcagtctgcagaaacgaggcatagtggagcagtgctgcacttctatttgtagcctgtatcagctggaaaactactgcaat

SEQ ID NO: 14182 - DNA, 324 bp, Artificial Sequence
  Description of Artificial Sequence: Synthetic coding sequence
atggcgctgtggatgcgcctgctgccgctgttggccctgctcgccctgtgggggccggacccagctgccgccttcgtgaaccaacatctttgcggatcgcacctggtcgaggcactctacctcgtgtgtggagagcggggatttttctacactaaaccgaccgaagcagaagatctgcaggtcggccaagtggaactgggaggagggcctggagcgggttccttgcagcccctggctcttgagggcagcctccaaaagagaggcatcgtggagcagtgctgcacctcaatctgctcgctctaccagctcgaaaactactgtaat

SEQ ID NO: 14183 - DNA, 324 bp, Artificial Sequence
  Description of Artificial Sequence: Synthetic coding sequence
atggctctgtggatgcgcttgctccccttgctggccctgttggcactatggggtccggatccggcagcagcattcgttaaccaacacctgtgtgggtcacatctggtggaggctctgtacttggtgtgcggagagaggggatttttttacaccaaaccaacagaggccgaagacctccaggtgggacaggtcgagctcggcgggggcccaggagccggatccctgcaacctctggcgctggaaggctctcttcagaaacgcgggatcgtggagcagtgttgcacctccatctgttctttataccagttagaaaactactgcaac

SEQ ID NO: 14184 - DNA, 324 bp, Artificial Sequence
  Description of Artificial Sequence: Synthetic coding sequence
atggcactttggatgaggctacttcccctcctcgcactccttgcactgtggggaccggatccagcagcagcatttgtgaatcagcatctctgtgggtcccatctggtggaggcattatatctcgtgtgcggagaacgtggatttttttacacgaaaccaacagaggcggaggatctacaggtagggcaggtcgaactggggggaggacctggagccgggtcacttcagcctctcgcactagaggggtcacttcagaagcggggaattgttgaacagtgctgcacatcaatctgcagtctttatcagttggaaaactactgtaat

SEQ ID NO: 14185 - DNA, 324 bp, Artificial Sequence
  Description of Artificial Sequence: Synthetic coding sequence
atggcgctttggatgagactgctccctctccttgcgctgctcgcactgtgggggccagatcctgccgcagcattcgtcaaccagcatctgtgtggatcgcatttggtcgaagccctgtaccttgtgtgtggggagcggggttttttctacactaagccgacggaagcagaagatctgcaagtgggacaggtcgagctcggaggaggtcccggtgccggctccctgcaacccctcgcacttgagggaagcctgcaaaagcgcggtatagtcgagcagtgctgtacctccatttgcagcctctaccaactggagaattactgtaac

SEQ ID NO: 14186 - DNA, 324 bp, Artificial Sequence
  Description of Artificial Sequence: Synthetic coding sequence
atggccctatggatgaggttgttaccgcttctggctctcttggctctgtggggccccgacccagcagctgctttcgtcaatcaacacttatgtggctctcacttggtcgaagctctgtacctggtctgtggcgagcgtgggttcttctacaccaagccgacggaagcagaggacctccaagtcggtcaagtcgagctgggagggggtccaggagctggttcactgcaacctcttgctctcgagggatctttgcagaagcgtggtatcgtcgaacaatgctgcaccagtatctgtagtctgtatcaactcgagaattactgcaac

SEQ ID NO: 14187 - DNA, 324 bp, Artificial Sequence
  Description of Artificial Sequence: Synthetic coding sequence
atggccctgtggatgagattgctccctctgttggccctcctggctttgtggggaccagatccggccgctgcctttgtgaatcagcatctctgcggttcacatctggtcgaggccttgtaccttgtgtgcggagaacggggcttcttctacactaaacctacggaagccgaggacctgcaagtgggtcaggtggagctcggcgggggacctggtgcgggatcgctgcagccgctggcactggagggatcgctccagaagcgcggcatcgtggaacaatgttgcaccagcatttgctcgttgtaccaactggagaactactgcaac

SEQ ID NO: 14188 - DNA, 324 bp, Artificial Sequence
  Description of Artificial Sequence: Synthetic coding sequence
atggctctttggatgcggctacttccactgcttgcccttctagctctgtgggggccggaccccgcagccgcattcgtgaatcagcatctctgtggcagccacctggtggaagccctttacctggtgtgcggcgaacggggcttcttctacacaaagcctaccgaggcagaagaccttcaggtgggccaggtagaactgggaggcggccctggcgctgggtctctccaacccctggctctggaaggttcactccagaagaggggtatcgtggaacagtgctgcacaagtatctgttctttgtatcaattggagaattactgcaac

SEQ ID NO: 14189 - DNA, 324 bp, Artificial Sequence
  Description of Artificial Sequence: Synthetic coding sequence
atggcgctttggatgagactcctcccgctgctggcgctcctggcgctctggggaccagaccccgcagcggcattcgtcaatcaacatctctgcggctcacaccttgtggaggcgctctatcttgtgtgcggagaaagaggttttttctacactaagccaaccgaagccgaagatctgcaggtgggacaggtggagctgggtggaggaccgggtgccggctcactgcagccgctggcattggagggatccttgcaaaaacgcggaatcgtcgagcaatgctgtacctcgatctgctccctctaccagctggaaaactactgcaac

SEQ ID NO: 14190 - DNA, 324 bp, Artificial Sequence
  Description of Artificial Sequence: Synthetic coding sequence
atggccctgtggatgcgcctgctcccgctgctggcactcctggccctgtgggggcccgacccggcggctgcattcgtcaatcagcatctgtgcgggtcacacctggtggaagccttgtacctggtctgcggcgagcggggattcttctatactaaaccaactgaggcggaggatctgcaggttggacaggtggagctgggaggcggaccgggagccggctcgctgcaacccctggctcttgagggttcccttcaaaaacgcggaatcgtggaacagtgctgtacctccatctgctcactttaccaacttgaaaattactgcaac

SEQ ID NO: 14191 - DNA, 324 bp, Artificial Sequence
  Description of Artificial Sequence: Synthetic coding sequence
atggccctgtggatgaggctcctaccactgctggctctcctggctctgtggggaccagatcccgccgcggcttttgtgaatcagcatctgtgcgggagccacttggtggaggcactgtaccttgtctgcggagagagaggatttttttacacgaagcctacggaagcagaagacttgcaggtggggcaagttgagctgggcgggggccctggggccggctctctccagccactcgcgctggaggggagtctgcagaaaagaggcatagtggaacagtgctgcacctcaatttgtagcctgtatcagctagagaactattgtaac

SEQ ID NO: 14192 - DNA, 324 bp, Artificial Sequence
  Description of Artificial Sequence: Synthetic coding sequence
atggcgttatggatgaggctgcttcccctgctcgcactgcttgcactctgggggcctgatccggcggctgcttttgtcaatcagcacctgtgcggatcacatctggtggaggcactctacttagtttgcggcgagaggggattcttttatacgaagccaaccgaggctgaagatctgcaggtgggccaggtcgagctgggtgggggaccgggtgccggatctctccagcctctggctctggaaggctccctgcagaagcgcggtatcgtggaacagtgctgcactagcatatgctctctgtatcagctggaaaactattgcaac

SEQ ID NO: 14193 - DNA, 324 bp, Artificial Sequence
  Description of Artificial Sequence: Synthetic coding sequence
atggccctttggatgaggctgctcccactgttggcccttcttgccctgtggggcccagaccccgctgccgccttcgtgaatcagcatctgtgtgggtcccacttagtcgaggccctgtacttggtatgcggagaacgcggatttttttacacgaaacccacggaggccgaggaccttcaggtaggccaggtagagctgggaggtgggcctggagccgggagtttgcaaccacttgccctggaaggatctctacaaaagagaggtattgttgagcagtgctgtacctctatttgctctttataccaactggaaaattactgtaac

SEQ ID NO: 14194 - DNA, 324 bp, Artificial Sequence
  Description of Artificial Sequence: Synthetic coding sequence
atggctttgtggatgcgtctcctgcctctgctcgctttgctggcattgtggggcccagatcccgccgctgcctttgtgaatcagcatctgtgcggcagtcatttggtcgaagccctttacttggtatgtggcgaacgcggctttttctacaccaagcccaccgaggccgaggacctgcaggtgggtcaggtggaactgggaggtggccctggcgctggttcacttcagccactggctctggaaggttcccttcagaaacgtggtattgtggagcagtgctgcacatctatttgttccctgtatcagctggaaaactactgcaac

SEQ ID NO: 14195 - DNA, 324 bp, Artificial Sequence
  Description of Artificial Sequence: Synthetic coding sequence
atggcgctgtggatgaggcttctgccgctcctggccctgctggcgctgtgggggccggatccagctgccgctttcgtcaaccagcatttgtgcggttcacacctggtggaagccctttacctggtttgcggagagcgggggtttttctacactaagcctaccgaagccgaagatttgcaggtgggacaggtggagctggggggaggaccaggggcaggatccctgcagccactcgctctggaaggttccctccagaagagaggaatcgtcgaacagtgctgtactagcatttgctccctgtaccagctggagaactattgcaat

SEQ ID NO: 14196 - DNA, 324 bp, Artificial Sequence
  Description of Artificial Sequence: Synthetic coding sequence
atggcactgtggatgagattgctgcctctactcgcactgctggccttgtggggacccgatccggcggccgctttcgttaaccagcacctttgtggctcacatctggtggaggcgctctatctggtttgcggcgagcggggattcttctatacaaaacccactgaagccgaagaccttcaggttggccaggtggagttaggcggagggccaggcgcgggaagcctccaacccttggccctggaaggcagcctgcagaaaagagggatcgtcgagcaatgctgcacctccatttgctccctttatcagcttgagaattattgcaac

SEQ ID NO: 14197 - DNA, 324 bp, Artificial Sequence
  Description of Artificial Sequence: Synthetic coding sequence
atggctctctggatgcggttgcttcctctgcttgctctgttggcactgtggggccccgatcccgcggcggcctttgtcaaccagcatctctgtgggtcccatctcgtggaggcactctatctcgtgtgcggtgagcgcggttttttctacactaagccaacagaagctgaagacctccaggtgggacaggtggagttggggggtggcccgggggctggcagcctgcagccactggctctcgagggatctctgcagaagcggggtatcgtcgagcaatgttgcactagcatctgttctctgtaccagctggagaactattgcaac

SEQ ID NO: 14198 - DNA, 324 bp, Artificial Sequence
  Description of Artificial Sequence: Synthetic coding sequence
atggcgctctggatgcggcttctgccgctccttgcactgctggcgttgtggggtcctgatccagcagcagcatttgtcaaccagcatctgtgcgggtcccatctggttgaagcattgtacctcgtgtgcggagagagagggtttttctacactaaacctaccgaggccgaagatctgcaggtggggcaagtggagcttggaggtggaccgggcgcaggttctctgcaaccactcgcacttgaaggatcccttcagaaaagaggaattgtcgagcaatgttgtacttcaatttgtagcttgtaccagcttgaaaactactgtaac

SEQ ID NO: 14199 - DNA, 324 bp, Artificial Sequence
  Description of Artificial Sequence: Synthetic coding sequence
atggcactttggatgcggttgcttcctctgctcgcccttctggccctgtggggcccagatcccgccgcagcctttgtcaatcaacatctgtgtggttcgcatcttgtggaggctctttacctcgtgtgtggggaacgcgggttcttctatactaagcccactgaagcagaagatcttcaagtgggacaggtggaattgggcggcggaccaggtgccggatcgcttcaacctctggcactggaagggtcccttcagaagagaggcatcgtggagcaatgttgcacgtcgatctgttcactttaccaactggagaattactgtaac

SEQ ID NO: 14200 - DNA, 324 bp, Artificial Sequence
  Description of Artificial Sequence: Synthetic coding sequence
atggccttgtggatgagacttttgccgctgctggctttattggccctctggggaccggaccctgcagcagcgttcgtcaatcaacatctatgcggtagccatctcgtagaagccctgtacttagtttgtggcgaaagagggtttttctacactgataagactgaggccgaggatctgcaagtgggccaagtcgaactcggagggggcccaggtgccgggtcactgcagccacttgcccttgagggcagtttgcagaaaagaggaatagtcgagcaatgctgtacatccatttgtagcttgtaccagctcgaaaactattgcaat

SEQ ID NO: 14201 - DNA, 324 bp, Artificial Sequence
  Description of Artificial Sequence: Synthetic coding sequence
atggcactctggatgcgcctgcttccccttctagcgcttttggcactctggggtcccgacccagcggccgcctttgtcaatcagcacctatgcggatcccacctggtggaggcattatacttggtgtgtggagaacgcggattcttctacaccgacaagacggaagccgaagacctgcaggtggggcaggtggaacttggtggcggccccggtgccggtagcctacagcccttggcgctcgaaggctctttgcagaagcgcggcatcgtggaacagtgctgcacctccatctgctccttatatcagctggagaactactgcaat

SEQ ID NO: 14202 - DNA, 324 bp, Artificial Sequence
  Description of Artificial Sequence: Synthetic coding sequence
atggcactgtggatgagacttttaccactgttagccttactggctctgtggggcccggatccagccgcagcatttgtcaaccaacacttgtgcggttcccacctcgttgaggcactgtatctggtgtgcggagagagaggcttcttctacacggataagactgaggccgaagacctccaggtggggcaggtggaactggggggggggcctggggcgggatcccttcagccccttgcacttgagggcagcctacaaaagcggggcatcgtggagcagtgttgcacctccatatgctctctctaccaactggaaaattattgtaat

SEQ ID NO: 14203 - DNA, 324 bp, Artificial Sequence
  Description of Artificial Sequence: Synthetic coding sequence
atggctctctggatgagactgttgcccctcctggccctgctggccctgtggggccccgatcctgctgccgccttcgtgaatcaacacctgtgcggaagccaccttgtcgaggcactctatctggtgtgtggagagagaggattcttttacactgacaagaccgaggccgaggacctgcaggtgggccaggtggaactgggaggcggaccaggagcaggatccctccagccacttgcacttgaaggttccctgcagaagcgcggcatcgttgaacaatgctgcacttcaatctgctccctctatcagctggagaactactgcaac

SEQ ID NO: 14204 - DNA, 324 bp, Artificial Sequence
  Description of Artificial Sequence: Synthetic coding sequence
atggccctttggatgcgcttacttcctttgctggcgctgctggccctttggggccctgatccagcggctgcgtttgtgaaccagcatttgtgcggttcacacctggtagaggccctgtaccttgtttgcggtgagcgaggcttcttctacaccgataagactgaggccgaggacctgcaggttggccaagttgagctcggaggcggccccggagcgggctccctccaaccattagctctagagggttcactgcagaaacgggggatcgtagagcagtgttgcacctcgatctgctcactgtatcagctcgagaactattgcaac

SEQ ID NO: 14205 - DNA, 324 bp, Artificial Sequence
  Description of Artificial Sequence: Synthetic coding sequence
atggccctctggatgcgactcctacctttgctcgcactactggctctttggggacccgaccctgcggccgcattcgttaatcagcacctttgtgggtctcacctcgtggaagccctctacctggtgtgcggagaaagggggtttttttatactgataaaactgaagctgaagatttgcaggtggggcaagtcgagttaggagggggaccgggggctggatctttgcagccccttgcactggaaggaagtctccagaaaaggggaattgtggagcagtgttgcacatctatatgttccctctatcagctcgagaactattgtaat

SEQ ID NO: 14206 - DNA, 324 bp, Artificial Sequence
  Description of Artificial Sequence: Synthetic coding sequence
atggccctttggatgcggctcctgccgctgttggccctcctcgccctctggggcccagacccggcagccgcctttgtgaaccagcacctctgtgggtcgcatctcgtggaagcactgtacctcgtctgcggtgagcgcggcttcttctacactgacaagactgaagcggaggatctccaagtgggccaagttgagttgggaggtggaccaggagccggatcactgcagccactggcattggaaggttcgctccagaagaggggaatcgtggagcagtgctgtacttcgatctgctccctgtaccaacttgagaattactgcaac

SEQ ID NO: 14207 - DNA, 324 bp, Artificial Sequence
  Description of Artificial Sequence: Synthetic coding sequence
atggccttatggatgaggctacttccactgctggccttgttggctctctggggtcctgatcctgctgccgctttcgttaaccaacacctgtgcgggagtcacctagtggaggccctgtaccttgtgtgcggcgaacgaggctttttctacactgacaagacggaagcagaggacctgcaggtgggacaagtggagcttggcggtggaccaggggccggatccctgcagcccctcgccctggaagggagcctgcagaagagaggtatcgttgagcagtgttgcacgtctatttgctccctgtaccagttggaaaactactgtaac

SEQ ID NO: 14208 - DNA, 324 bp, Artificial Sequence
  Description of Artificial Sequence: Synthetic coding sequence
atggcactctggatgcgacttctgcctcttctagcactgctggccctctggggaccagatccagctgctgctttcgttaaccaacacctgtgcgggtctcacctggttgaggcactgtacctcgtgtgcggcgagcgtggtttcttctacaccgataagacggaagccgaggacttgcaggtaggacaggtcgaattaggaggtggcccaggagcaggatcattacagccactggccctggagggatccctgcagaagaggggcatagtcgagcagtgttgcacaagcatttgctccttgtaccaactagaaaattattgcaat

SEQ ID NO: 14209 - DNA, 324 bp, Artificial Sequence
  Description of Artificial Sequence: Synthetic coding sequence
atggctctgtggatgcggctgctgccactgttggcattgctggctctctggggacctgatccggcggctgccttcgtcaaccagcatctctgtgggagccacctggtggaggcactgtatcttgtgtgtggagaacggggtttcttctacaccgataagactgaagccgaggatctgcaggtgggacaagtggagctgggaggaggccctggagctggatcgctccagccgcttgccctggaaggctcgctccagaagcgggggatcgtcgagcaatgctgtaccagcatttgctcattgtaccagctcgaaaactactgcaac

SEQ ID NO: 14210 - DNA, 324 bp, Artificial Sequence
  Description of Artificial Sequence: Synthetic coding sequence
atggcactttggatgcggctccttcccctcttggcactgctggccctgtgggggccagacccagccgccgcctttgttaaccagcatctgtgcggctcacacttggttgaggccctgtacttggtgtgtggggagagaggattcttttacaccgataagacagaagctgaagaccttcaagtcgggcaggtcgaactgggaggtggtcccggagctggctccttgcaaccgctcgccctcgagggatcactgcaaaaaaggggtatcgtggagcagtgttgcaccagcatttgcagtctgtaccagctcgagaattattgcaac

SEQ ID NO: 14211 - DNA, 324 bp, Artificial Sequence
  Description of Artificial Sequence: Synthetic coding sequence
atggcgctgtggatgaggttgctgcctctgctggcactgctggccctgtggggaccggatccggccgctgcatttgttaaccagcatctgtgcggatcgcacttggtggaagccctctacctggtgtgcggagaacggggattcttctacactgacaagaccgaggctgaggacctgcaggttggacaggtggagttgggaggagggccaggggcgggcagcctgcaaccgctggcgctggaaggatcgctccagaagcgcggaatcgtggaacaatgctgcacctcgatctgctcattgtaccaacttgagaactactgtaat

SEQ ID NO: 14212 - DNA, 324 bp, Artificial Sequence
  Description of Artificial Sequence: Synthetic coding sequence
atggccctttggatgaggcttctaccattgcttgctcttctagcactgtggggaccagatccggccgcagcgttcgttaatcaacatctttgtggatcccatttagtagaagcgttatacctcgtatgcggcgaacgaggtttcttttacactgataagacagaagcggaagacctccaagttggacaagtggaactcggcggaggtccgggcgctggatctctccaaccccttgctctcgaagggagtttgcagaaacgaggaattgttgagcaatgttgcacttcaatttgtagtctttaccaactcgagaactattgcaac

SEQ ID NO: 14213 - DNA, 324 bp, Artificial Sequence
  Description of Artificial Sequence: Synthetic coding sequence
atggctctgtggatgagattgttaccactgctggcgctactcgccctgtggggccccgatcccgctgctgccttcgtgaatcagcacctgtgtggctcccacctcgtagaggctttgtatctcgtgtgcggggagcggggcttcttctatacagacaagactgaggccgaggatctgcaggtcgggcaagttgaactgggaggcggacctggtgccgggtccctacagccattagccttagaaggctctctgcagaaaagggggatcgtggagcagtgctgcacatcgatctgctcactgtatcagctggaaaactactgtaat

SEQ ID NO: 14214 - DNA, 324 bp, Artificial Sequence
  Description of Artificial Sequence: Synthetic coding sequence
atggctctctggatgaggctcctgcccctgttggcacttctggccctttggggtccagaccccgccgccgctttcgtgaaccagcacctttgcggaagtcacctcgtagaggcactgtacttagtgtgtggggagaggggctttttttataccgacaagaccgaagcggaggacctgcaggttggccaggtggagttgggcgggggcccgggagctggaagtttgcagcccttagctctcgaaggttcgctgcagaagaggggcattgtcgagcagtgctgcacatcgatttgttcgctttatcagctggaaaattattgcaat

SEQ ID NO: 14215 - DNA, 324 bp, Artificial Sequence
  Description of Artificial Sequence: Synthetic coding sequence
atggctctgtggatgcgcctgctgccactgttagccctgctagccctgtggggcccggatccggccgccgcgtttgtcaatcagcacctctgtggctcccacctggtggaggcgctctatctagtttgtggtgaaaggggttttttctatactgacaagacggaggcggaggaccttcaggtcggtcaagtggagctgggcgggggtcctggtgcaggcagcctgcaaccgctcgcgttggagggttccctgcaaaaacgtggcatcgtggagcagtgttgcactagcatatgctctttgtaccagttggaaaactactgtaat

SEQ ID NO: 14216 - DNA, 324 bp, Artificial Sequence
  Description of Artificial Sequence: Synthetic coding sequence
atggcactttggatgcggctgcttcctcttctggccctcctggctctttggggacctgatccggcagcagcatttgtgaatcagcatctttgtgggagccatcttgtcgaggccctttacctggtgtgcggtgaaagaggctttttctacactgacaagacggaggccgaggatcttcaagtcggacaggtggagctcggaggaggtcctggagcaggaagcctgcagccactggctttggagggttctcttcaaaagagaggaatagtggaacaatgctgtacttccatttgttcgctctaccaactcgaaaactactgcaat

SEQ ID NO: 14217 - DNA, 324 bp, Artificial Sequence
  Description of Artificial Sequence: Synthetic coding sequence
atggctctttggatgaggcttcttcccctgttggctcttctcgctttgtggggccctgatcccgcagcagcattcgtgaaccaacatttgtgtggatcacatctcgtggaggccttgtatctggtttgcggtgaacgcggtttcttttacaccgacaagactgaagccgaggatcttcaagttggacaggtcgaacttggaggcggccctggggcgggttcccttcaaccacttgcactggaaggtagccttcagaaaaggggcattgtggagcagtgttgtacctcgatctgttcgctgtaccagctggagaactactgcaat

SEQ ID NO: 14218 - DNA, 324 bp, Artificial Sequence
  Description of Artificial Sequence: Synthetic coding sequence
atggctctgtggatgaggttgcttccactgcttgcccttctggctctttggggaccggatccagcagcggcatttgtgaatcagcacctttgtggttctcatctcgtggaagccctgtacctggtgtgcggtgagagaggcttcttttacaccgacaagaccgaggccgaggatctgcaagtcggccaggtggaactgggtgggggacccggagcagggtcgttgcagcctcttgcacttgaaggtagcctccaaaaacgaggtatcgtcgaacagtgttgcacctcgatttgcagcctctaccaattggaaaactactgtaac

SEQ ID NO: 14219 - DNA, 324 bp, Artificial Sequence
  Description of Artificial Sequence: Synthetic coding sequence
atggcactgtggatgcggcttctgcccctgctggctctgttggccctctggggccccgaccccgctgctgcttttgtcaaccaacatctttgcggatcccacctggtagaggcactttacctggtttgcggtgagcgcggctttttctacacagacaaaaccgaagctgaggatttgcaggtgggacaggtcgagcttggtggagggcctggtgctggaagtctgcaacctcttgctctggaaggatcacttcagaagcggggaatagtggagcagtgctgcactagcatatgctctctatatcagttagagaactattgcaac

SEQ ID NO: 14220 - DNA, 324 bp, Artificial Sequence
  Description of Artificial Sequence: Synthetic coding sequence
atggccctttggatgcgactgctgcctctgcttgcacttctggctctgtggggtccagacccggcagcagcgtttgtgaatcagcatctttgcggttcgcacctggtcgaggcgctttaccttgtgtgtggagaacgtggtttcttttacacggataaaaccgaggcagaggacctgcaggtgggacaggtggagctgggtggtggccctggggcgggatcgcttcaacccctggcgctggaggggtcgcttcagaagagaggtattgtggaacaatgttgtacttccatttgttcactctaccaactggaaaactactgcaac

SEQ ID NO: 14221 - DNA, 324 bp, Artificial Sequence
  Description of Artificial Sequence: Synthetic coding sequence
atggccctgtggatgcggctgctcccactgcttgcactgctggcgctttggggccctgacccggctgccgcctttgtcaaccagcatctgtgcggatcccacctggtcgaggcgctctatctggtgtgcggtgaacggggtttcttctacactgacaagaccgaagcggaggacctgcaggtggggcaggtcgaactcggtgggggaccgggagcaggctcgctgcagccgctcgccttggaagggtcgttgcaaaagcgcgggatcgtggaacagtgctgcacctcgatctgttcgttgtaccagctcgagaattactgcaac

SEQ ID NO: 14222 - DNA, 324 bp, Artificial Sequence
  Description of Artificial Sequence: Synthetic coding sequence
atggcactgtggatgaggctccttcccctgttggctctgctggcgctgtggggccccgacccagctgctgctttcgtaaatcagcacctttgtggttcccatttggtcgaggctctgtacctcgtctgcggcgagcgcggattcttctacactgacaaaacagaagccgaggacctccaggtgggtcaagtagagctcggtggcggtccaggcgcaggctctctccaacccctggctctggaaggtagtctgcagaagagaggtattgtcgagcagtgctgcacgagcatctgttccttgtaccagctggagaattactgcaat

SEQ ID NO: 14223 - DNA, 324 bp, Artificial Sequence
  Description of Artificial Sequence: Synthetic coding sequence
atggcactgtggatgcggctgctccctctgctggccttgctggccctttggggacctgatcctgctgccgcttttgtgaatcagcacctctgtggctcccatttggtcgaggccctgtacctggtgtgtggtgaacggggattcttctacacagataagacagaagccgaagatctgcaggtggggcaggtagagctgggcggcggccctggcgcagggtccctgcagcccctggccctggagggctcactccagaagagaggcatcgtggaacaatgttgcactagcatctgcagtctttaccagcttgagaactattgcaat

SEQ ID NO: 14224 - DNA, 324 bp, Artificial Sequence
  Description of Artificial Sequence: Synthetic coding sequence
atggccctctggatgagactcctacccctgctcgccctgctcgccctgtggggccctgatccagccgccgctttcgttaatcagcatctgtgcgggtctcatctcgtcgaagcgctatatctagtttgcggagaacgtggctttttctatacagataagaccgaggccgaggatcttcaggtgggtcaggttgagctcggagggggccccggagcgggctcattgcagcccctggcgctggagggctccttacagaagcggggaatagtggaacagtgttgtacttctatctgtagcctttaccagctagagaattattgtaac

SEQ ID NO: 14225 - DNA, 324 bp, Artificial Sequence
  Description of Artificial Sequence: Synthetic coding sequence
atggcgctgtggatgcgactgcttcccctgctcgcactcttggcactttggggacctgatcccgcagcggcattcgtgaatcagcacttgtgtggctcacatctggtcgaggcactgtaccttgtgtgtggagaacgcggattcttttacaccgataagaccgaagcagaggacttgcaagtgggacaggtggaactcggagggggcccaggagcaggttcgcttcagcctctcgcccttgaaggatcccttcagaagagaggtattgtcgaacagtgttgcacttccatctgttcactctaccaactggagaattactgcaac

SEQ ID NO: 14226 - DNA, 324 bp, Artificial Sequence
  Description of Artificial Sequence: Synthetic coding sequence
atggccctctggatgcggcttctgcccctgttggcgcttctcgctctgtggggccctgatcctgccgcagctttcgtcaaccagcacctttgcgggtcacatctggtcgaagctctttacctggtctgcggcgaacgaggattcttttacactgataagaccgaagccgaggacctccaagtgggtcaagttgaactgggaggtggcccgggcgcgggatcgctgcagccgctcgcgctcgagggatcactgcaaaagaggggaattgttgagcagtgctgtacctcgatctgttccctctaccagctggagaattactgcaac

SEQ ID NO: 14227 - DNA, 324 bp, Artificial Sequence
  Description of Artificial Sequence: Synthetic coding sequence
atggccctgtggatgcggctgctgcctcttctcgctttactcgccctttggggaccggaccctgctgcggctttcgtaaatcagcacttatgcggaagccacctggtggaggctctgtatctggtgtgtggagaaagaggattcttttacacagacaagacagaagccgaggatctgcaggtgggccaggtggagctgggcgggggacccggagccggatccctccagccactggcgctggagggcagcctccaaaaacggggaatagtcgaacagtgttgcacctccatttgttcactttaccagcttgaaaattactgtaac

SEQ ID NO: 14228 - DNA, 324 bp, Artificial Sequence
  Description of Artificial Sequence: Synthetic coding sequence
atggctctgtggatgagactattgcccctgctggcactattagctctgtggggccctgacccagcagccgctttcgtgaaccaacacctgtgtgggagtcatttggtggaagcattgtacctggtctgcggcgagcggggtttcttttataccgataaaactgaggccgaagacctgcaggtgggacaggtggagttgggcggaggacctggagctggcagcctgcaacccctggcacttgaagggtctctccagaagcggggtattgtagagcagtgttgtaccagcatttgctcattgtatcaactcgagaactactgtaat

SEQ ID NO: 14229 - DNA, 324 bp, Artificial Sequence
  Description of Artificial Sequence: Synthetic coding sequence
atggcactttggatgcggctgctgcccctgcttgcgctgctggcactctggggacctgatccagcagcagcatttgtgaaccaacacctttgtggttcgcatctcgtggaggcactgtacttggtttgtggagaacggggcttcttttacacggataaaactgaggcagaggacctgcaggtggggcaggtggagcttggaggagggcctggggcaggcagccttcaaccactggctctcgaaggctccctgcaaaagaggggtattgtcgaacaatgctgtaccagcatttgtagcttgtaccagcttgaaaactattgtaac

SEQ ID NO: 14230 - DNA, 324 bp, Artificial Sequence
  Description of Artificial Sequence: Synthetic coding sequence
atggccttgtggatgaggctgctgcctcttctggcgctgctggcactttgggggcccgacccggccgcagcttttgtgaatcaacatttgtgtggctcacaccttgtggaggccctttaccttgtctgtggggaaagggggtttttctacactgataaaacggaagcggaagatctccaagtggggcaagttgaactgggtggcgggcctggagcaggaagcctccagcctcttgcactcgagggatcgctccagaagcgcggcattgtggagcagtgctgtacctcaatttgttcgctttaccaactggagaattactgtaat

SEQ ID NO: 14231 - DNA, 324 bp, Artificial Sequence
  Description of Artificial Sequence: Synthetic coding sequence
atggccctttggatgagactgctgccattgttggccctcttggcactctggggacctgatccagccgcggctttcgtcaatcagcatctctgtgggtcacacctcgtcgaggcgctgtacctcgtgtgtggagagcgcggattcttttacaccgacaaaaccgaggccgaagatctgcaagtggggcaagtggaactcgggggcggaccgggtgcaggctccctgcaacctttggcactggaaggttctctccagaagagaggcatcgtggaacagtgctgcacttcgatctgttccctgtaccagctggagaactattgtaac

SEQ ID NO: 14232 - DNA, 324 bp, Artificial Sequence
  Description of Artificial Sequence: Synthetic coding sequence
atggcactctggatgaggctgttgccactgctcgctttgctagcgctgtgggggccggacccagcggctgcatttgttaaccagcatctgtgtggaagtcatctggtggaagctctttaccttgtctgcggcgagcggggatttttttataccgataagacagaggctgaagatctgcaagtaggacaggttgagctgggtgggggtcctggggccggatctctgcagcctcttgctctcgaaggatctctgcagaaaagggggattgtggagcaatgctgtacatctatttgtagcctgtaccagctagaaaattactgcaac

SEQ ID NO: 14233 - DNA, 324 bp, Artificial Sequence
  Description of Artificial Sequence: Synthetic coding sequence
atggctttgtggatgcggttgttgccactgttggccttattggccttgtggggacccgatccagccgcagcattcgtaaatcagcatttatgtggttctcatctagtagaagctttgtatttagtctgcggggaaagggggtttttctacactgataagaccgaggcagaagacttgcaagttggccaggtcgagcttggaggtggcccaggtgcaggcagccttcagccgcttgctctggagggatcattacagaaacgaggaatagtggagcaatgctgtacttcaatatgttctttgtatcagctcgaaaactattgtaac

SEQ ID NO: 14234 - DNA, 324 bp, Artificial Sequence
  Description of Artificial Sequence: Synthetic coding sequence
atggcactttggatgcgactgctgccactgctggccttgctagccctgtggggaccagacccggctgctgccttcgtcaaccagcacctgtgcgggtcccacttggttgaagcgctctatctggtgtgcggagaaagggggtttttctacactgacaagactgaagccgaggacttacaagttggccaggtggagttgggcggcgggccgggcgccggcagcctacagcctcttgctctcgaaggcagtctacagaaacgcggcatcgtggaacaatgttgcacatccatatgctctctgtaccagctcgagaactactgcaac

SEQ ID NO: 14235 - DNA, 324 bp, Artificial Sequence
  Description of Artificial Sequence: Synthetic coding sequence
atggccctatggatgcgcctgctgcctttacttgccctccttgctttgtggggaccggaccccgccgcagctttcgtgaatcaacatctctgtggctctcatctggtcgaagctctctatctggtttgcggggagagaggcttcttttataccgataagactgaagctgaagacttgcaagtagggcaggtagagttgggaggagggcccggcgccgggtctctacagccactcgcactagaggggtccctgcagaaaagaggaattgtcgagcaatgttgtacctcgatttgttcactttaccagctggaaaactactgcaac

SEQ ID NO: 14236 - DNA, 324 bp, Artificial Sequence
  Description of Artificial Sequence: Synthetic coding sequence
atggcgctctggatgcggctgctcccattgctggctcttttggcgttgtggggccctgatccggcagccgcctttgtgaatcagcatctctgcggaagccacctggtggaggcgctgtacctggtgtgcggagaaagaggattcttttacactgacaagaccgaagccgaagatttgcaagtggggcaagtggaacttgggggcggaccgggcgcgggcagcctgcagccattggctctggagggcagcttgcagaagcggggtatcgtggagcagtgttgtacttcgatttgctcgctctatcagctggagaactactgcaac

SEQ ID NO: 14237 - DNA, 324 bp, Artificial Sequence
  Description of Artificial Sequence: Synthetic coding sequence
atggcactgtggatgcggctgttgccgttgctcgcattgttggcgctgtggggacctgacccagccgccgcatttgtcaatcagcacttgtgtggatcgcaccttgtcgaagcactgtacctggtgtgcggtgaacgaggttttttctacaccgataaaactgaagcagaagatctccaggtgggacaagtggagctgggaggaggtcctggagcgggaagcctgcagccactcgccctcgaaggctccctgcagaagagaggtatcgtggaacaatgttgtacttccatttgttccctgtaccaactcgagaactactgtaac

SEQ ID NO: 14238 - DNA, 324 bp, Artificial Sequence
  Description of Artificial Sequence: Synthetic coding sequence
atggccctctggatgaggctgctcccacttttggctctgttggccctgtggggccccgaccccgccgcagccttcgtcaatcaacacctttgcggatctcatctagtagaagcactgtatctggtgtgcggagaaagaggcttcttctatacggataagactgaagctgaggatctgcaagtcggtcaggtagagctgggcggagggcccggtgctggcagcttacagccactcgccctggagggttcactccagaagagaggaattgtggagcagtgttgcactagcatatgctcattgtaccagctcgagaactactgcaac

SEQ ID NO: 14239 - DNA, 324 bp, Artificial Sequence
  Description of Artificial Sequence: Synthetic coding sequence
atggctctgtggatgcgtctgctccctctgctggcactcctggctctctggggccccgaccctgccgctgccttcgtgaatcagcatctgtgcggaagccacctggtcgaagcactctacctggtctgcggtgagagaggcttcttctacacagacaaaactgaagccgaggacttgcaggtgggacaggtagaactcggtggaggccctggcgctggctcccttcagcccctcgctcttgaaggtagtttgcagaagagaggcatcgttgagcagtgctgcacatcaatctgcagcttgtaccagctggaaaattattgtaac

SEQ ID NO: 14240 - DNA, 324 bp, Artificial Sequence
  Description of Artificial Sequence: Synthetic coding sequence
atggctctgtggatgcgtctcttgccgttactggcgctcctcgccttgtggggtcccgaccctgcggccgcgttcgtgaaccagcatctgtgcgggagccaccttgttgaggcgctttacctggtctgcggcgagcgcggtttcttctatactgacaagaccgaggccgaggacttgcaggtcggtcaagtggagctgggtggaggtcccggcgccggttctctccagcctttggcgcttgagggcagcctccagaagcgcggtattgttgaacaatgctgcacgtctatctgcagtctgtaccagctggagaactattgtaac

SEQ ID NO: 14241 - DNA, 324 bp, Artificial Sequence
  Description of Artificial Sequence: Synthetic coding sequence
atggccctgtggatgaggctgttacctctgctggccttgctggcgctgtggggcccagatccagcggcggctttcgttaatcagcatctgtgcgggtcacacctagtggaagccttatacctggtgtgcggagaacgaggatttttttataccgataaaactgaagctgaggatctccaggtcggacaagtggagctcggtggagggccaggagctgggtctctgcaaccactcgccctggaaggcagtttgcagaagagggggatcgtcgagcagtgttgcacatccatttgctcgctctaccaattggaaaattattgcaat

SEQ ID NO: 14242 - DNA, 324 bp, Artificial Sequence
  Description of Artificial Sequence: Synthetic coding sequence
atggccttgtggatgaggctgcttccacttcttgcgctgttggcactctggggtccagatccagccgccgcatttgtcaatcagcatctgtgtggatcacatcttgtggaggcactctacctcgtgtgtggcgagcggggcttcttttacaccgataagaccgaagctgaagatttgcaggtcggtcaagtggagctgggtggagggccgggagcagggtcgcttcaaccactggcactggaaggttccctgcagaagcggggaatagtggaacaatgttgtacttcaatttgttcgctgtaccagcttgagaattactgcaat

SEQ ID NO: 14243 - DNA, 324 bp, Artificial Sequence
  Description of Artificial Sequence: Synthetic coding sequence
atggcactgtggatgcgcctgctgcccctgttagcactcctggctctctggggacccgatcctgccgccgcatttgtcaatcagcacctgtgcggcagccacttggtggaagcactttaccttgtgtgcggtgaacgcggattcttttacacggacaaaactgaggccgaggaccttcaggtcggccaagttgaactgggtggcggaccgggcgctggatccctgcagccccttgccctcgaagggtcccttcagaaacggggaatcgttgagcagtgctgtacatctatttgctccctgtatcagctggagaactattgtaac

SEQ ID NO: 14244 - DNA, 324 bp, Artificial Sequence
  Description of Artificial Sequence: Synthetic coding sequence
atggccctttggatgcgtctattgccattacttgcacttcttgccctttggggcccagaccctgcggcagcatttgtgaaccaacacctgtgcggctcccatttggttgaggcattgtatcttgtgtgtggtgagcgaggctttttttatactgacaaaactgaagctgaggacttacaggtcggacaggttgaacttggaggtggcccaggagctggttcactgcaacctttggccctggaaggctctttacagaaacggggaatcgttgaacagtgctgcacatccatttgctctctgtatcaattagaaaattattgcaac

SEQ ID NO: 14245 - DNA, 324 bp, Artificial Sequence
  Description of Artificial Sequence: Synthetic coding sequence
atggccctgtggatgaggctgcttccattattagcgctgctggccctttggggacccgaccctgccgcagcatttgtaaatcaacacctctgtgggtcgcacctagtggaagccctgtacctggtatgcggtgaaaggggctttttctacacagacaaaacggaagccgaagacctgcaggtcggccaggtcgagctgggaggtggtcccggcgcaggctctctccagcctctggcgctggagggctccctgcagaaaagaggaatagttgaacagtgttgtacctctatttgttcattgtatcagctggagaattactgtaat

SEQ ID NO: 14246 - DNA, 324 bp, Artificial Sequence
  Description of Artificial Sequence: Synthetic coding sequence
atggccctttggatgcggctcttaccactgctcgctttgctggcgctctggggccctgaccccgctgcagcattcgtcaaccagcatctgtgtgggtcccatcttgtggaggctctgtacctagtgtgcggcgaacgggggttcttctatacagataaaacggaggccgaggacctgcaagtcgggcaggtggagctcggcgggggccctggagccggcagcctccagcctctggctctggagggatctctgcagaagcgggggattgtcgagcaatgttgcaccagcatatgttctttgtaccagctggagaactattgcaac

SEQ ID NO: 14247 - DNA, 324 bp, Artificial Sequence
  Description of Artificial Sequence: Synthetic coding sequence
atggctctctggatgaggttgctgccactgctggctctgcttgcgctttggggccccgaccccgctgctgccttcgtgaatcagcacctatgcggatcccacctggttgaagcgctctacctggtctgtggtgagcgtgggttcttctacacagataaaaccgaggccgaggacctccaggtaggccaggtggagctgggtgggggccctggcgccggcagcctgcagccgctggcattggagggttcgttacagaaacgcggcattgtggagcaatgctgtacctccatttgcagtctatatcagttagagaactactgtaac

SEQ ID NO: 14248 - DNA, 324 bp, Artificial Sequence; identical to SEQ ID NO: 14247
  Description of Artificial Sequence: Synthetic coding sequence

SEQ ID NO: 14249 - DNA, 324 bp, Artificial Sequence
  Description of Artificial Sequence: Synthetic coding sequence
atggcactgtggatgcgactgctcccgctgcttgccttgctggcgctttggggcccagaccctgcagcagccttcgtgaaccagcatttgtgtgggtcccacctggtggaagccctttaccttgtttgcggtgaacgcgggtttttctacactgataagacggaggcagaggacctgcaagtcggacaagtggagctgggtggcggacccggtgcgggatccttgcagcctctggcactggaaggatccctgcagaaacgcggcatagtggaacagtgttgcacctctatctgtagcctctaccaactcgaaaactattgtaac

SEQ ID NO: 14250 - DNA, 324 bp, Artificial Sequence
  Description of Artificial Sequence: Synthetic coding sequence
atggctctgtggatgcggcttctgcctcttttggcccttttggcactctggggcccagacccggcagctgcgtttgtgaatcagcacctctgtgggtcccatttggtggaggccctgtaccttgtgtgtggagaaagaggattcttttacactgataagactgaagccgaagatctccaggtgggccaggtagagctgggtggcggaccgggagcgggttcgctgcaacccttggcactcgaagggagccttcaaaagcgcggcatcgtcgagcaatgctgtaccagtatttgctcgctgtaccaacttgaaaactactgcaac

SEQ ID NO: 14251 - DNA, 324 bp, Artificial Sequence
  Description of Artificial Sequence: Synthetic coding sequence
atggctctctggatgagacttctgcccctcttggccctactggcgctatgggggcctgatcccgccgcggcctttgtgaaccagcatctatgtggctcccatctggtggaagcgctgtatctggtttgtggcgagcgtggattcttctataccgataagaccgaggctgaggacctgcaggtcggacaggttgagttgggtggaggacccggcgcaggcagcttgcagccacttgccttagaaggctccctgcagaaacgcggaatagtcgagcagtgctgtacgtccatctgctccttataccagcttgaaaattactgtaat

SEQ ID NO: 14252 - DNA, 324 bp, Artificial Sequence
  Description of Artificial Sequence: Synthetic coding sequence
atggcactctggatgagactgttgcctctgcttgccttgttagccctgtggggccctgacccagccgccgctttcgtgaaccagcatctctgcgggagccatctggtcgaggcactttatctggtgtgcggcgagaggggtttcttctatactgacaagactgaagcggaagatttgcaggtgggacaggtagaacttggtggggggcctggcgcaggctcactacagccactagccttagagggttccctgcagaaaagaggtattgtggaacagtgttgcacatccatctgtagtctgtatcagctcgaaaactattgtaat

SEQ ID NO: 14253 - DNA, 324 bp, Artificial Sequence
  Description of Artificial Sequence: Synthetic coding sequence
atggcgctgtggatgagactgcttcccctgctggcactgcttgccctgtggggccctgacccagcagcagcatttgtgaaccaacatctttgcggtagccatctggtggaggccctgtacctggtctgtggagaaaggggattcttttacaccgataaaacggaggcagaggatctccaagtcgggcaagtcgagcttggaggcgggccgggagcaggctctcttcaacctttggcactggaaggctccctgcaaaagcgagggatcgtggagcaatgctgcacttcgatttgttcactgtaccagctggagaactattgtaat

SEQ ID NO: 14254 - DNA, 324 bp, Artificial Sequence
  Description of Artificial Sequence: Synthetic coding sequence
atggctctgtggatgaggctcctgccgctgctggccctgttggcgctgtgggggccggatcctgcggcagcctttgtcaatcagcatctgtgtgggagccacctggtggaggccctgtacctggtgtgcggtgagcgcggcttcttctacaccgacaaaacggaagcagaggatttgcaagtgggacaggtggaactgggaggcggaccgggagcgggaagcctgcaacctcttgcattggaaggctccctccaaaagcgggggatcgtcgaacagtgttgcacctcaatttgctcactttatcagctggagaactactgcaat

SEQ ID NO: 14255 - DNA, 324 bp, Artificial Sequence
  Description of Artificial Sequence: Synthetic coding sequence
atggcgctttggatgcgcctgcttcccctgcttgcactcctcgcactgtggggaccagacccggcagcagctttcgtcaaccaacacctgtgcggatcgcatcttgtggaggcactgtacctcgtgtgtggcgagcgagggtttttctacacggataaaaccgaggcggaggatctgcaagtcggacaggtggaacttgggggcggtccaggtgcaggatcgcttcaaccacttgcactcgagggatcgctccagaagaggggcatcgtggaacagtgttgcacctcaatctgtagcctgtaccagctcgaaaactattgtaac

SEQ ID NO: 14256 - DNA, 324 bp, Artificial Sequence
  Description of Artificial Sequence: Synthetic coding sequence
atggcactgtggatgcggctgcttcccctcctggcgcttctggcgctctggggccccgatccagcagcggcatttgtcaaccaacacctgtgtggttcacatcttgtggaagccttgtacctcgtgtgtggagaaagaggtttcttttacactgataagacggaagcagaagatctccaagttgggcaggtggaacttggtggaggccctggcgccggtagcctgcagccactggctctggaagggtcactgcaaaagaggggcatagtggagcaatgctgcactagcatctgctcgctgtaccaactcgagaattactgtaac

SEQ ID NO: 14257 - DNA, 324 bp, Artificial Sequence
  Description of Artificial Sequence: Synthetic coding sequence
atggcactttggatgagattgttaccactacttgcattattagcattatggggacctgatcctgctgctgcttttgtaaatcaacatttatgtggaagtcatcttgttgaagcactttatttagtctgtggtgaaagaggatttttctatacagataagactgaagcagaagatcttcaagttggacaagtcgaattaggaggaggaccaggtgcaggttcattacaacctttggcacttgaagggtctttacaaaagagaggtattgtagaacaatgctgtacttcaatttgttcattatatcaattagaaaattattgtaat

SEQ ID NO: 14258 - DNA, 324 bp, Artificial Sequence
  Description of Artificial Sequence: Synthetic coding sequence
atggcgctctggatgaggctgctcccacttcttgctctcctggcactgtgggggcccgatcccgcagcggccttcgtcaaccaacacctctgcggcagccatcttgtcgaagccctgtacctcgtgtgcggagaacgcggattcttttacactgataagacggaggccgaggatttgcaggtgggacaggtggaacttggaggcgggcctggagccggcagcctccagcctctcgctctcgaaggcagtttgcagaagcgtggaattgttgaacagtgctgcaccagcatctgcagcctgtaccagctcgaaaactactgtaac

SEQ ID NO: 14259 - DNA, 324 bp, Artificial Sequence
  Description of Artificial Sequence: Synthetic coding sequence
atggctctctggatgcggctccttccgctgctcgctctcctggccctctggggacccgacccggccgctgcattcgtgaaccaacatttgtgcgggtcccaccttgttgaggcactgtatctcgtgtgtggcgaaagaggatttttctacacggacaaaaccgaagccgaagatctgcaggtggggcaggtggagctcggcggaggcccaggcgccggctcgctccagccgctcgcgcttgaaggctctctgcaaaagcggggtatcgtggagcagtgctgcactagcatctgttccctgtaccaactcgagaactattgcaac

SEQ ID NO: 14260 - DNA, 324 bp, Artificial Sequence
  Description of Artificial Sequence: Synthetic coding sequence
atggctttgtggatgagactccttccgcttctagccctcctggcactgtgggggccagatcctgcagccgcgttcgttaatcagcacctctgcggatctcatctggtggaggcactgtatttggtgtgtggggagcgaggtttcttttacactgacaagacggaagctgaggatttgcaggtggggcaggtggaactcggaggggggcctggcgctggatctttacagcctctagccctcgagggttcactgcagaagagagggatcgtcgagcagtgctgtacatctatctgttcattgtaccagctggaaaactattgcaac

SEQ ID NO: 14261 - DNA, 324 bp, Artificial Sequence
  Description of Artificial Sequence: Synthetic coding sequence
atggccttgtggatgagacttctgccacttctggcactgctggctctgtggggccctgacccagccgcagcattcgtgaaccaacacctgtgcgggtcccatctggtcgaagcgctctaccttgtgtgtggggaaagaggctttttctacactgataagaccgaagcggaggatcttcaagtgggccaagtcgaactggggggaggcccgggcgcaggctcccttcagccactggcgcttgaaggatcgctccagaaacggggaattgtggaacaatgttgtacttcaatttgctcgctgtaccaattggaaaactactgtaac

SEQ ID NO: 14262 - DNA, 324 bp, Artificial Sequence
  Description of Artificial Sequence: Synthetic coding sequence
atggctttgtggatgcgcttgctgcccctcctcgcactcctggcactttggggcccagatccggcggcggccttcgtgaatcaacacctgtgcgggtcccacctggtggaagcgctctacctggtgtgcggagagcggggcttcttttacacggacaaaaccgaggcagaagatctgcaggtgggtcaggtggagttgggaggaggcccgggagccggcagcctccagccgctcgccctcgagggtagcctgcagaagcgcggcattgtcgaacaatgctgcacttcgatctgcagcctctaccagttggagaattactgcaat

SEQ ID NO: 14263 - DNA, 324 bp, Artificial Sequence
  Description of Artificial Sequence: Synthetic coding sequence
atggccctgtggatgcggctgttgcccctcctggcacttttggctctctggggacctgacccggcggcggcctttgtcaaccaacatctctgcggttcgcacctcgtggaagccctgtacctggtgtgtggcgaaagagggttcttctacaccgacaagactgaagctgaggatctgcaggtgggccaagtggagctcggaggaggaccaggcgccggatccctgcagccgctggcactggaagggtcacttcaaaaacgcggaatcgtcgagcagtgctgtaccagcatctgctcgctctaccagctggagaactactgcaat

SEQ ID NO: 14264 - DNA, 324 bp, Artificial Sequence
  Description of Artificial Sequence: Synthetic coding sequence
atggcactgtggatgcggctacttccccttctggcactgctggccctgtgggggcctgatccagctgccgcgttcgtcaatcagcacctctgtggatctcatctggtcgaggccctatatctcgtgtgtggggaacgggggttcttttacacagataaaacagaggcagaagatctccaggtaggacaggttgaattagggggagggcccggggctgggtctctgcagccactggcactggaagggtctctccaaaagaggggaattgtagaacagtgctgtacaagtatttgcagtctgtatcagctcgagaactattgcaac

SEQ ID NO: 14265 - DNA, 324 bp, Artificial Sequence
  Description of Artificial Sequence: Synthetic coding sequence
atggccctgtggatgcggcttttaccactgctcgccctgctcgccctgtggggcccagacccagccgccgcatttgtgaatcagcacctttgcggaagtcacctagtcgaagccctgtacctcgtgtgcggtgaacgcggcttcttctacaccgacaaaactgaagctgaagatctgcaggtcggacaggtggaactcggcggtggacccggcgccggctccctccagcccctcgccctagagggttctctgcagaaacgggggatcgttgagcagtgttgcactagtatctgctcactctaccaactcgagaattattgtaat

SEQ ID NO: 14266 - DNA, 324 bp, Artificial Sequence
  Description of Artificial Sequence: Synthetic coding sequence
atggccctgtggatgcggcttctacctctgctggcgctgttggcgctctggggcccagaccctgctgccgcattcgtgaaccagcatctgtgcggaagtcaccttgtcgaggctctgtacctggtgtgtggcgagagaggcttcttttatactgataagactgaggcagaggacctgcaggtgggacaagtcgaactgggcggtggacccggagcgggaagcctacagcctctagctctggaaggaagtctccagaagaggggcatcgtcgagcagtgctgcaccagcatttgttcgctttatcagctcgaaaactattgtaac

SEQ ID NO: 14267 - DNA, 324 bp, Artificial Sequence
  Description of Artificial Sequence: Synthetic coding sequence
atggcactatggatgagacttctccccctgttagccctgctggccctgtggggtcccgacccagcagccgcattcgttaaccagcacctctgcggcagccacttagtagaagccctgtacctcgtctgcggcgagcggggattcttctataccgataagacagaggcagaagacctacaggtgggccaagtcgaactcggaggcggccctggtgctggatcgctacagccactggcgttggagggtagcttacagaaaagggggatcgttgagcagtgttgcactagcatttgttctttatatcagttggaaaattactgtaac

SEQ ID NO: 14268 - DNA, 324 bp, Artificial Sequence
  Description of Artificial Sequence: Synthetic coding sequence
atggcgttatggatgcgtttattaccgttattagcgctattagcgttatggggtccggatccggcggcggcgtttgttaatcaacatctatgtggttcgcatctagttgaagcgctatatttagtatgtggtgaacgaggttttttttatacggataaaacggaagcggaagatttacaagtaggtcaagttgaactaggtggtggtccgggtgcgggttcgttacaaccgctagcgctagaaggttcgttacaaaaacgtggtatagttgaacaatgttgtacgtcgatatgttcgctatatcaattagaaaattattgtaat

SEQ ID NO: 14269 - DNA, 324 bp, Artificial Sequence
  Description of Artificial Sequence: Synthetic coding sequence
atggcactttggatgcgacttctccctcttctcgcactccttgcactgtggggtcctgaccctgcagcggcatttgtgaatcagcatctttgcggaagccatcttgtcgaagccctctacctggtctgcggggaaagaggattcttttacactgataagaccgaagctgaggaccttcaggtcgggcaagtggaactgggcggtggtccaggtgcgggatcgttgcaaccccttgcgctggagggctcgcttcagaagcggggaattgtggaacaatgctgtacctccatttgttcactgtaccaactcgaaaactactgtaac

SEQ ID NO: 14270 - DNA, 324 bp, Artificial Sequence
  Description of Artificial Sequence: Synthetic coding sequence
atggccttgtggatgcggcttctccccctgcttgctctcctggccctctgggggccggacccagcagcagcgttcgtcaatcagcacttgtgcggatcccatctggtggaagccctttacctggtgtgcggcgaacgtggatttttctacacggacaaaactgaagcggaggatctgcaagtcggacaggtggagttgggcggagggccaggggcaggatcgctgcagccgctcgcgctcgagggtagcttgcagaagagaggaatcgtcgagcaatgttgtacctccatctgctcattgtatcaactggaaaactactgcaac

SEQ ID NO: 14271 - DNA, 324 bp, Artificial Sequence
  Description of Artificial Sequence: Synthetic coding sequence
atggcgctgtggatgagattgctccctctgttggcgctgctggccctttggggaccagacccagcagccgcctttgtgaatcaacatctgtgtggatcgcacttggttgaagcactctatctggtttgcggagaacggggattcttttacactgataagactgaagcggaggacttgcaggtgggacaggtggagctcggcggaggccctggggcggggtcccttcagccgttggctctcgaaggaagtctgcagaagcgaggaatcgtcgagcaatgttgcacctcgatctgctccctttaccaactggagaactactgcaac

SEQ ID NO: 14272 - DNA, 324 bp, Artificial Sequence
  Description of Artificial Sequence: Synthetic coding sequence
atggctctctggatgaggctcctgcctctgctggctcttctggccctctggggacctgacccagctgctgcctttgtcaatcagcatctgtgtggtagtcatctagtggaggccttgtacctggtgtgcggcgagcgcggattcttctataccgataaaaccgaagctgaagacctccaggtgggccaagtggaactgggcggaggtcccggggctggctccctgcagccactggcactggagggaagtcttcaaaagcggggaatcgtggagcagtgctgtacttctatctgttctctgtaccagctcgagaactactgcaac

SEQ ID NO: 14273 - DNA, 324 bp, Artificial Sequence
  Description of Artificial Sequence: Synthetic coding sequence
atggcgttgtggatgcgattgctgcccttgctggccctcctcgccctctggggaccggacccggcagctgcgtttgtgaatcagcacttgtgcggatcccatcttgtggaggcactgtacctggtgtgcggggagcgcggattcttttacaccgataagactgaagccgaggacctgcaggtggggcaggtggaactgggcggaggtccgggggctggctccctccagcctcttgcgctcgaaggttctctgcagaagagaggaattgtggagcagtgttgtacctcgatctgctcgctctaccaattggaaaactactgcaac

SEQ ID NO: 14274 - DNA, 324 bp, Artificial Sequence
  Description of Artificial Sequence: Synthetic coding sequence
atggccctttggatgagactattgcccttgctggccctattagctctctggggccccgaccccgccgccgccttcgtgaatcagcacctgtgcggttcacatctggtggaggccttgtacctggtgtgtggcgagcgtggattcttctacaccgataagacagaagcggaggacctacaggtgggacaggtagaattgggcggtgggccgggcgccggctcactccagcccttggccctggagggtagtctccaaaagaggggaatcgttgagcaatgttgtacatcaatttgtagcctctatcagctggaaaactactgcaac

SEQ ID NO: 14275 - DNA, 324 bp, Artificial Sequence
  Description of Artificial Sequence: Synthetic coding sequence
atggctctttggatgcggctgctgcctctcctcgcactccttgcgctgtggggaccagatccggcggccgcgtttgtcaaccaacatctctgtgggtcccacttggtggaagccctgtacctcgtttgtggcgagagggggttcttctacaccgacaaaactgaggctgaagatctgcaagtcggacaagtggagcttggaggtggaccgggagccggctcgctgcaaccgctcgcgcttgaggggtcccttcagaagcgcgggatcgtggaacagtgctgcaccagcatttgctcgctctaccagctggagaattactgcaac

SEQ ID NO: 14276 - DNA, 324 bp, Artificial Sequence
  Description of Artificial Sequence: Synthetic coding sequence
atggccctctggatgaggctgctgcctctgctggcgctgctggcgctttggggcccggacccggcggccgcatttgtgaaccagcatctctgcggctcacatctggtggaggctctctacctggtctgtggagaaagaggattcttctacaccgacaagaccgaagcagaagatctccaggtcggacaggtggagctggggggaggaccgggagcggggtcgctgcagcccctcgcgcttgaaggatcactgcagaagagaggaatcgtcgaacaatgctgcactagcatttgctccctgtaccaactcgagaattactgcaac

SEQ ID NO: 14277 - DNA, 324 bp, Artificial Sequence
  Description of Artificial Sequence: Synthetic coding sequence
atggcactctggatgaggcttctgcccttactggcactcctggcactttgggggcccgacccagcagccgctttcgtaaaccaacatctgtgtggatcacatctggtagaagctctgtatctcgtttgcggggagcgaggtttcttttatactgataagacagaggctgaagatctccaggtcggccaggtggagctaggaggcggtcctggcgctgggagtctgcagcccctcgcactggagggcagtctccaaaagcgaggcatagtcgagcagtgctgcacctctatatgttctctctaccagttggaaaactattgcaat

SEQ ID NO: 14278 - DNA, 324 bp, Artificial Sequence
  Description of Artificial Sequence: Synthetic coding sequence
atggcattgtggatgcgcctgctgccactccttgctctgctggccctctggggaccagaccccgccgcagcatttgtgaatcagcacttgtgcgggtcccacctcgtggaggcactgtatctggtttgcggggaacgggggttcttctacacggacaagacagaggcggaggacctccaggttggccaggtggaactcggtggagggccaggcgctggaagcctgcaaccactggccttggagggttccctgcagaagcgcggtattgtggagcagtgctgtacctctatatgctccctttaccagctggaaaactactgcaat

SEQ ID NO: 14279 - DNA, 324 bp, Artificial Sequence
  Description of Artificial Sequence: Synthetic coding sequence
atggctctttggatgcgcttgttgcctctgctggctctgttggccctttggggcccagatcctgcggccgcattcgtcaatcagcatctttgcggaagccacctggtcgaagcgttataccttgtgtgtggggagcgtgggttcttttataccgataaaactgaagctgaggacctacaggtaggccaggtcgagttggggggcgggcctggagctgggagcttgcagcccctcgccttggagggctctcttcagaagcgcggaatcgtggaacagtgctgcactagcatttgctcgctgtaccagctggagaattattgcaac

SEQ ID NO: 14280 - DNA, 324 bp, Artificial Sequence
  Description of Artificial Sequence: Synthetic coding sequence
atggctctgtggatgagactgttgcccctgctggccctccttgctctctggggcccggaccctgcggcggccttcgtgaaccagcatctctgcggatcacacctcgtggaggccctgtacctcgtgtgcggagaacgcggattcttctacactgataagacggaagctgaggacctgcaagtgggacaggttgagctcgggggtggacccggcgctggctccttgcagccgctggcgctcgagggctcgctgcagaagcggggaatcgtggaacagtgctgcacgagcatctgcagcctctaccaactcgaaaactactgcaat

SEQ ID NO: 14281 - DNA, 324 bp, Artificial Sequence
  Description of Artificial Sequence: Synthetic coding sequence
atggccctgtggatgcggctgcttccactccttgcgctgctggccctctggggacctgacccggccgcggccttcgttaaccaacatttgtgcggaagtcacctcgtagaagccctctaccttgtgtgcggtgagagaggattcttttacactgacaaaaccgaggcggaagatttgcaggtcggacaagtcgaactgggaggcggcccgggggctgggtccttgcaacccctggccttggaggggtccctgcagaagaggggcatcgtggaacagtgttgcacttcaatctgttcactgtaccagcttgagaattactgtaac

SEQ ID NO: 14282 - DNA, 324 bp, Artificial Sequence
  Description of Artificial Sequence: Synthetic coding sequence
atggccctgtggatgcgactgctgccactactggccctgctggctctgtggggacctgatcctgctgcagcctttgtcaaccagcacttgtgtggcagccacctcgtcgaggcactctatttggtgtgtggcgaaagggggttcttctacacagataaaaccgaagctgaggacctccaggtggggcaggtggagctaggaggtggcccaggagcgggatccttgcagccgctggcactggaagggagtcttcagaaaaggggaatagtggaacagtgttgtacatccatctgctcactgtaccaactggaaaattattgtaac

SEQ ID NO: 14283 - DNA, 324 bp, Artificial Sequence
  Description of Artificial Sequence: Synthetic coding sequence
atggccctatggatgcgactgctacctctcctggccctcctcgccctctggggtccggaccccgccgcagcattcgtcaaccagcatctctgtggatcacatctggttgaagctctctacctggtgtgcggggagcgtggcttcttctatacagataagactgaagcagaggatctacaggtgggacaagtcgagctgggcggcggaccaggcgctggaagcctgcagcccctggccctggagggcagtctgcagaagcgcgggatcgtcgaacagtgttgtaccagcatctgctccctgtatcaactggaaaactattgcaat

SEQ ID NO: 14284 - DNA, 324 bp, Artificial Sequence
  Description of Artificial Sequence: Synthetic coding sequence
atggcattgtggatgcgcctgctgcccttgctggccctgctggcactgtggggtccagatcccgccgctgcatttgtcaaccagcatctgtgcggatcacatctcgtggaggcactctatctcgtatgcggagaacggggcttcttttacacggataaaacagaagccgaagatttgcaggtgggacaggtggagctgggcggaggccctggagccggtagtttgcagccgcttgccctggagggctctcttcagaaacgaggaattgtggagcagtgttgcacttcaatctgtagcttgtaccagttggagaattactgcaac

SEQ ID NO: 14285 - DNA, 324 bp, Artificial Sequence
  Description of Artificial Sequence: Synthetic coding sequence
atggcactctggatgaggctgttgccactcctggcacttctggctctttggggcccggatccagcagcagcctttgtgaaccaacacttgtgtggctcccacctcgttgaagcactctatcttgtctgtggagaacggggcttcttctacactgataagactgaggccgaggacctccaggtggggcaggtcgaacttggcggtggacccggtgcagggtcactgcaaccgctcgcgctggaaggtagcctgcaaaagcgcggaatcgtggagcagtgctgtacttcgatttgttccctgtaccagctcgagaattactgcaac

SEQ ID NO: 14286 - DNA, 324 bp, Artificial Sequence
  Description of Artificial Sequence: Synthetic coding sequence
atggcactgtggatgcgactgcttcctctcctggcattgctcgcactttggggcccggatcccgctgcggcttttgtaaaccagcatttgtgcggatcgcatctcgttgaggctttgtacctcgtgtgtggggagcgcggtttcttttacacggataagaccgaggctgaagaccttcaggtggggcaggtcgagctaggcggtggaccaggagctgggtctctgcagccgctggcgctagaaggtagcctccagaagcgcggcatcgtcgaacaatgctgtactagcatctgctcgttgtaccaacttgagaattattgtaat

SEQ ID NO: 14287 - DNA, 330 bp, Artificial Sequence
  Description of Artificial Sequence: Synthetic coding sequence
atggctctgtggatgaggctgctgccactgctggccctgctcgctctgtggggacccgaccctgcagccgcatttgtgaatcagcacttgtgtggcagtcatctggtggaggccttgtatttggtgtgcggagagagagggtttttctacacacctaagacaagacgtgaggcagaggatctgcaggtggggcaggtggagcttggtggcgggccaggcgcagggagtctccagccgttggcgttagaaggcagcttgcaaaagagaggtatcgtcgaacagtgttgtactagcatctgttctctttatcagctggaaaactattgtaac

SEQ ID NO: 14288 - DNA, 330 bp, Artificial Sequence
  Description of Artificial Sequence: Synthetic coding sequence
atggcgctgtggatgagacttctacccctgctcgccctgcttgcactgtggggcccagatccagccgctgccttcgtgaatcagcacctgtgtgggtctcacttggtggaagccttgtatcttgtgtgtggcgagaggggattcttttacactcccaaaactcgacgcgaagccgaggacctgcaggttggacaggtggagctgggaggggggccaggagctgggagtttacagcctttggcgttagaagggtcgttgcagaagagagggatcgttgagcagtgctgcacatcaatttgctcactgtatcagttagagaactattgtaat

SEQ ID NO: 14289 - DNA, 330 bp, Artificial Sequence
  Description of Artificial Sequence: Synthetic coding sequence
atggcgctctggatgcgcttgctgcccttgcttgcgctgctggcactttggggacctgaccccgccgctgcctttgtgaatcaacacctgtgcgggagccatctggtggaagcactctacttggtctgcggtgaaaggggctttttctacaccccaaagactagaagagaagctgaggaccttcaggtgggacaggtggaactcggcggaggaccaggagccgggagcctgcaaccgctggcccttgaaggatccctccaaaagagaggaatcgtcgaacagtgttgtacttcgatctgctccttgtaccagctggagaattactgcaat

SEQ ID NO: 14290 - DNA, 330 bp, Artificial Sequence
  Description of Artificial Sequence: Synthetic coding sequence
atggcgctctggatgcgcctgctgccgctcctcgcgctgctggcattgtggggcccagacccggcggctgcctttgtcaatcagcatctgtgcggatcccatctggtggaagcactctacctggtttgcggggagcggggcttcttctacactcctaagaccagacgcgaggccgaggatcttcaagtcggacaggtggagctgggcggaggtccaggggcgggaagcctccaacctttggcgctggagggttcactccaaaagcgcggaatcgtcgaacaatgctgtacttctatctgctcgctgtaccagcttgagaattactgcaac

SEQ ID NO: 14291 - DNA, 330 bp, Artificial Sequence
  Description of Artificial Sequence: Synthetic coding sequence
atggccctctggatgagactcctccctttgcttgcacttctggcactgtggggacccgatcccgccgcagcatttgtgaatcaacatctgtgtggctcgcatctggttgaggcactctacttggtgtgcggtgagcggggattcttttacaccccgaaaacgcggagggaagcggaagatctgcaagtcggacaggtggagctcggtggtggccccggagcaggatcacttcagccactggcactggagggctcgctccagaagcgaggcattgtggagcaatgctgtactagcatttgttcactgtatcaactggagaactactgcaac

SEQ ID NO: 14292 - DNA, 330 bp, Artificial Sequence
  Description of Artificial Sequence: Synthetic coding sequence
atggcactttggatgcgactgttgccgctgctggcacttcttgcactgtggggacctgatcccgccgcagcatttgttaaccagcatctgtgcggatcacacctggtggaagccctttacctggtgtgcggcgagcgcggattcttttacacgcctaagactcgccgagaggcagaggatttgcaggtgggtcaagtggaacttggtggaggacctggtgcgggttcgctgcagcccctggcactcgaaggttcgcttcaaaagcgcgggatcgtcgaacaatgttgcaccagcatttgtagcctttatcaacttgagaactactgcaat

SEQ ID NO: 14293 - DNA, 330 bp, Artificial Sequence
  Description of Artificial Sequence: Synthetic coding sequence
atggctctttggatgcggctgctgccgcttctggcgctcctggcactgtggggtcccgaccctgcggcagcgttcgtgaaccaacatctgtgtggatcgcacctcgtggaagcactctacctcgtctgcggcgaaaggggcttcttttacacccccaagactaggcgcgaggccgaggatctgcaggtgggccaggtggagctgggaggaggaccaggagcgggcagtctgcagcctctggccctcgaagggtcattgcagaaacggggaatcgtggaacagtgctgtactagcatctgctccctttaccagctggagaattactgtaac

SEQ ID NO: 14294 - DNA, 330 bp, Artificial Sequence
  Description of Artificial Sequence: Synthetic coding sequence
atggccctgtggatgcggctgctgcctctgctggctctgttggcattgtggggacccgacccagccgctgcgttcgtaaatcagcatctatgcggctcccatctggttgaggcgttgtacctcgtttgtggagaaagaggattcttttacacaccaaaaacgcgacgggaagctgaagacttgcaagtgggacaggtggagctggggggaggcccaggagccgggagtttgcaacctctcgcattggagggcagtctgcaaaagcgtggaatagtggagcagtgctgcaccagcatctgctccctgtaccagctggagaactactgcaat

SEQ ID NO: 14295 - DNA, 330 bp, Artificial Sequence
  Description of Artificial Sequence: Synthetic coding sequence
atggcactctggatgcgcctccttcccctacttgctctacttgcactgtggggccccgatcccgcagcagcctttgtgaatcagcacctttgcggatcccacttggtcgaggccctgtacctggtgtgtggagagagaggctttttctacacacccaaaacaagaagagaagctgaggacctccaggtgggccaggtggaactcggaggcggccctggtgcggggagcctacagcccctggcgttggaaggatcactccagaagagaggaatcgttgaacaatgctgcacgtctatctgctcactgtatcagctcgaaaattattgcaat

SEQ ID NO: 14296 - DNA, 330 bp, Artificial Sequence
  Description of Artificial Sequence: Synthetic coding sequence
atggcactctggatgaggttgttacccctgctagcccttctggctctgtggggcccagatcccgctgcagctttcgtcaaccaacacctctgtggaagtcacttggtggaagccctctatcttgtgtgcggcgagagaggatttttttacaccccaaagacacggcgggaggctgaggacctgcaagtggggcaagtggagcttggcggcggccctggtgctggtagcctgcaaccactagccttagagggctctctgcagaagcggggcatcgttgagcagtgctgcacctctatctgctcgctgtatcagcttgaaaactattgcaat

SEQ ID NO: 14297 - DNA, 330 bp, Artificial Sequence
  Description of Artificial Sequence: Synthetic coding sequence
atggctctctggatgcgactcctgcccctgctagcccttctggccttgtggggccctgaccccgctgcagcgttcgtgaaccagcacctctgcggctcacacctagtggaggctctttacctcgtctgcggtgagcgcggtttcttttatacacctaagactagacgggaggctgaggacctgcaggtgggtcaggttgaactcgggggcggtcccggagccgggtcactccagccactcgcactggagggatccctgcagaaacgcgggatcgtggagcagtgctgtacttccatctgtagtctctatcaactcgaaaattactgcaac

SEQ ID NO: 14298 - DNA, 330 bp, Artificial Sequence
  Description of Artificial Sequence: Synthetic coding sequence
atggctttgtggatgagactgctccccctcctggccctcctggctctgtggggccccgaccccgctgcggcctttgtgaaccagcatctctgcggctcacacttagtcgaggccttgtatctggtttgcggcgagcggggttttttttacactcctaaaactcgccgggaagccgaggacctccaagtgggtcaggtggaactcggtgggggccccggggcgggctccttgcagcctttggctctcgaggggagtctgcagaagcgcggaattgtcgagcagtgctgcacaagcatatgctccctatatcagttagagaattactgcaac

SEQ ID NO: 14299 - DNA, 330 bp, Artificial Sequence
  Description of Artificial Sequence: Synthetic coding sequence
atggccctctggatgcggttgctgccgctcttggcacttctcgccctctggggcccggacccagcagcggccttcgtgaaccagcatctgtgcggatcacatctggtcgaggcgctgtacctggtgtgcggggagcgcggattcttctacacccctaagactcgcagggaagcagaggacctgcaggtgggtcaggtggagctggggggcggacctggagcgggatcactccaacctcttgccttggagggatctcttcagaagcggggaatcgtggaacaatgctgcacttcgatttgctccctttaccaactggaaaactactgcaat

SEQ ID NO: 14300 - DNA, 330 bp, Artificial Sequence
  Description of Artificial Sequence: Synthetic coding sequence
atggccctttggatgcgcctgcttccacttctggcgctcctggcactgtgggggccagaccctgccgccgcatttgtgaaccagcatctctgcgggtcccacctggtcgaagccctttacctggtgtgtggagagcggggtttcttttacacgcccaaaactcgtagggaagcagaggatctgcaagtcggacaggtggaactcggtggaggcccgggtgcaggtagtttgcaacctttggcgctggaaggctccctccagaagcgaggaatcgttgaacaatgctgtacctctatttgcagcctctaccaattggagaactactgtaat

SEQ ID NO: 14301 - DNA, 330 bp, Artificial Sequence
  Description of Artificial Sequence: Synthetic coding sequence
atggccctgtggatgcgcctgctgcccctgttagctctgttagccctctgggggccagaccccgcagccgcatttgtaaaccagcacctgtgcggttcacatcttgtggaagcactctatctggtatgcggagagcgaggcttcttttacactccaaagacgcggcgggaggctgaggacctgcaagtaggccaagtcgaactcggtggcgggcccggggccggtagcttacagccactcgctctagaagggtctctacagaaacgaggcattgtggaacaatgctgtacgtccatctgcagcctctatcaactcgagaattactgtaac

SEQ ID NO: 14302 - DNA, 330 bp, Artificial Sequence
  Description of Artificial Sequence: Synthetic coding sequence
atggctctgtggatgcgccttctccctctcctcgctttgcttgctctctggggccccgatccagccgccgcttttgtcaaccaacacctgtgcggctcccatctggtggaagctttgtatctcgtatgcggcgaacgtgggttcttttatactcccaaaacacggcgtgaggctgaggacttgcaggtcggacaggtcgagctcggtggggggccgggggccggttccctgcagccgctggccctcgaggggtccctgcagaagaggggaatcgtggagcagtgttgtaccagtatatgttcactataccagctggaaaattactgcaac

SEQ ID NO: 14303 - DNA, 330 bp, Artificial Sequence
  Description of Artificial Sequence: Synthetic coding sequence
atggccctgtggatgcgtctgctgccgcttctcgcactcctggcactgtggggtccagaccctgcagcagccttcgttaatcagcatctgtgcgggtcccacctggtggaagcattgtatctcgtgtgtggagaacgaggttttttctacaccccaaagactcggcgcgaggcggaggacctgcaggtgggtcaggtcgaacttgggggtggcccgggagccggttcacttcagcccctggcgttggagggatcccttcaaaagaggggcattgtggagcaatgctgtacttcgatttgcagcctttaccagcttgagaattactgcaat

SEQ ID NO: 14304 - DNA, 330 bp, Artificial Sequence
  Description of Artificial Sequence: Synthetic coding sequence
atggccctttggatgcgtttgcttccgctgctggctctcctcgcattgtggggacccgatccggcggccgcttttgtaaaccaacatctctgtggttctcatctagtggaagcgctgtatcttgtctgtggtgagagaggtttcttttatacacctaagacaagacgagaagcggaagatctccaagtaggtcaggttgaactcggtgggggcccgggagctgggagcttgcaacctttggccctagaaggctcactacaaaaacgcggtatcgtagaacagtgctgtacaagcatttgttcattgtaccaactggaaaactattgtaac

SEQ ID NO: 14305 - DNA, 330 bp, Artificial Sequence
  Description of Artificial Sequence: Synthetic coding sequence
atggccttgtggatgcgactgcttcccctgctggcacttctcgcgctatggggacctgacccggccgccgctttcgttaaccagcatctgtgtggtagtcaccttgttgaagccctttacctcgtgtgtggtgagcgcggttttttctacactcctaagacccgcagggaggccgaggacctgcaggtgggtcaggtcgagctcggcggaggccctggtgccggctccttgcagcccctggcccttgagggttcgctgcagaagcggggtattgttgaacaatgctgcacttcgatctgcagcctgtatcagctcgagaactactgtaac

SEQ ID NO: 14306 - DNA, 330 bp, Artificial Sequence
  Description of Artificial Sequence: Synthetic coding sequence
atggctttgtggatgaggctcttgccgctgctggcgctcttggccctgtggggacccgatccagcggcggccttcgttaaccagcatctgtgcggctcccacctagttgaagcgttgtaccttgtttgtggcgagcgcggcttcttttacacccccaagacccgccgggaagcggaagatctccaggtaggacaggtggaacttggcggaggcccgggagcgggcagccttcagccactggccctggagggctcccttcagaaacggggaatcgtcgagcagtgttgtacgtctatatgtagtctgtaccagctggaaaactactgcaac

SEQ ID NO: 14307 - DNA, 330 bp, Artificial Sequence
  Description of Artificial Sequence: Synthetic coding sequence
atggccctttggatgcgccttctgccgcttttggcacttctggcactgtggggtccagatcccgcagcagcgtttgtgaatcaacacctgtgtggatcacacctcgtggaagcactgtacctcgtgtgtggggaacgaggctttttctatacccctaaaactagaagagaagcagaggacctccaggtcggccaggtggaactcggagggggaccaggagcaggatcccttcagcctctcgccctggaggggtccctgcaaaagagaggcatagtggaacagtgttgtacttcgatctgtagcttgtaccagctcgaaaactactgtaac

SEQ ID NO: 14308 - DNA, 330 bp, Artificial Sequence
  Description of Artificial Sequence: Synthetic coding sequence
atggcactctggatgcggctgttgcctctgctggccctgcttgccttgtgggggcccgacccggcggctgccttcgtgaatcagcatctgtgcggatcccatctggtggaggccctctacctggtgtgcggagaaaggggcttcttttacaccccaaagactagaagagaagcggaggatctccaagtcggacaggttgagctgggcggaggcccgggggccggatcattgcagccgctggctttggaaggttcactccaaaagcggggcatcgtcgaacaatgctgcacttcgatctgctccctttaccaattggaaaactactgcaac

SEQ ID NO: 14309 - DNA, 330 bp, Artificial Sequence
  Description of Artificial Sequence: Synthetic coding sequence
atggccttgtggatgagactgctccccctccttgctcttctggcgctctggggacccgaccctgccgcagcatttgtgaaccagcatctctgtggctctcacttggtggaggccctctatcttgtgtgtggtgaacggggcttcttctacacaccaaagaccaggcgcgaagcagaggatctgcaagtgggccaagttgaacttggtgggggacccggcgccggcagtctgcagcccctcgcgctggagggcagtcttcaaaaacgcgggattgtagagcaatgctgtacgagtatctgcagtctctaccagctggaaaactattgcaat

SEQ ID NO: 14310 - DNA, 330 bp, Artificial Sequence
  Description of Artificial Sequence: Synthetic coding sequence
atggcgctgtggatgaggctgctgccccttctggccctcctcgctctgtggggtccagaccccgcagccgcgttcgttaaccagcatttgtgcggctcccacttggtcgaagcactgtacctggtctgcggggaacgggggttcttctatacacccaaaacaagacgggaagctgaggacctgcaggtggggcaagtggagctgggcggaggaccgggagctggatcactgcaacccctggccctcgaaggaagtctgcaaaaaagaggtattgtggagcagtgctgcacaagtatctgctccctgtaccagctcgaaaactactgcaac

SEQ ID NO: 14311 - DNA, 330 bp, Artificial Sequence
  Description of Artificial Sequence: Synthetic coding sequence
atggccctttggatgagactgctgcctttgctagccttgctggctctctggggccctgacccggccgcagccttcgtaaaccaacacttatgtggatctcatcttgtggaggcactgtacctagtatgtggcgaacgaggattcttctatacacccaagactagacgagaagctgaggacctgcaggtcggccaggtggagctcggggggggacccggagcaggaagtctgcagcccctcgctctagaaggctctctccaaaagcggggcatcgtggagcagtgttgtaccagtatctgttcgttgtaccagttggagaattattgcaac

SEQ ID NO: 14312 - DNA, 330 bp, Artificial Sequence
  Description of Artificial Sequence: Synthetic coding sequence
atggctttgtggatgcggctcttgcccctgctcgcactgctcgccctgtggggacctgacccagctgctgctttcgttaatcagcacctttgtgggtcccacctcgtggaggcactttatctcgtgtgcggggaacgcgggttcttctacacacctaaaactcggagggaggccgaggacctgcaagtgggtcaggtggaacttgggggaggaccgggcgcagggagccttcagcccctcgcattagaaggaagcctgcagaagcggggaatcgtcgagcagtgctgcacctccatctgcagtttatatcagctggaaaattattgcaac

SEQ ID NO: 14313 - DNA, 330 bp, Artificial Sequence
  Description of Artificial Sequence: Synthetic coding sequence
atggcactctggatgcgcctgctgccgctcttggccctgctcgccctctggggtccagatccggcagcagcatttgttaatcaacacctctgcggatcgcatctggtggaagcgctttacctggtctgcggagagaggggattcttttacactcccaagacgcgcagagaggcggaggacctccaggtgggacaagtggaactggggggtggcccgggagcgggctcgcttcagccactggcactggaaggtagcttgcaaaagcgaggaattgtggaacagtgctgcaccagcatctgctcactgtaccagctcgagaattactgcaac

SEQ ID NO: 14314 - DNA, 330 bp, Artificial Sequence
  Description of Artificial Sequence: Synthetic coding sequence
atggccctttggatgcgtctcttgccacttctggcgttgcttgcactgtggggaccggaccctgcagcagccttcgtgaaccagcatttgtgtggttcccacctggtggaggcactctaccttgtgtgcggagaacgcggttttttctacactccaaaaaccaggcgcgaagccgaagatctgcaggtgggacaggtggaactgggtggtgggcccggtgcggggtcactgcaacctctcgccctggaagggtcacttcaaaagaggggtattgtcgaacaatgttgtacttcaatttgctcgctgtaccagctggagaattactgcaac

SEQ ID NO: 14315 - DNA, 330 bp, Artificial Sequence
  Description of Artificial Sequence: Synthetic coding sequence
atggccctgtggatgcgacttctgccactgctggccctgctggccctgtggggtcccgatcccgccgctgccttcgtcaatcagcatctttgcggttcccatctcgtagaagccctctatctggtttgcggagagcgcgggtttttctatacccccaagactcggcgggaggccgaggatctgcaggtggggcaggtagaactcggtggcggaccgggcgccggatccctgcagcctctggcattggaggggagcttgcagaagagggggatcgtggaacaatgctgcacctctatctgcagcttgtatcagctggaaaactattgtaac

SEQ ID NO: 14316 - DNA, 330 bp, Artificial Sequence
  Description of Artificial Sequence: Synthetic coding sequence
atggcactttggatgcgcctgcttcctctgctcgcactccttgccttgtggggtccagacccggcggcagcttttgtgaatcagcatctttgcggttcacacctcgtcgaggcactttatctggtctgtggtgaaagaggatttttctacacccccaagactagaagggaagcagaagatctccaagttggacaagtggaattgggcggagggccaggtgcaggatcgttgcagcctcttgcactggaggggtccttgcaaaaaaggggcatcgtggagcaatgctgtacgtcgatttgtagcctttaccagttggaaaactactgtaac

SEQ ID NO: 14317 - DNA, 330 bp, Artificial Sequence
  Description of Artificial Sequence: Synthetic coding sequence
atggctctgtggatgcggttattgcccctcttagcattgttggctctgtggggacccgatccggccgcggcttttgtaaaccagcacctgtgtgggtcgcacttggtcgaggctctttacctcgtgtgcggcgaaagaggattcttttataccccaaagaccaggagggaagctgaagatctgcaggttggtcaggtggagcttggaggaggtcctggcgccggcagtctgcagcctctcgcattggaagggagcctccagaaacgcgggatcgtggagcagtgttgtaccagtatatgctctttgtaccagctcgaaaattattgcaat

SEQ ID NO: 14318 - DNA, 330 bp, Artificial Sequence
  Description of Artificial Sequence: Synthetic coding sequence
atggcactgtggatgagactgctgcccctattggccctgctggccctctggggaccagaccccgcagccgcttttgtgaaccagcacctgtgtgggtcccatctggtggaagccctgtatctcgtgtgcggcgaaagggggtttttttatacacccaagactaggagagaggcagaggatctgcaagtgggccaggtggagctaggagggggtcctggagccggctccttgcaacctctcgctttggagggtagcctgcagaagcgaggaatcgttgaacagtgttgcacttccatctgcagcctataccagctggagaactattgcaac

SEQ ID NO: 14319 - DNA, 330 bp, Artificial Sequence
  Description of Artificial Sequence: Synthetic coding sequence
atggccctgtggatgagactgctgcctctgctggcgctcctcgctctgtggggtccggaccccgcagctgcctttgttaatcagcacctctgtgggagtcacctggttgaggctctgtacttggtctgcggtgagagggggttcttttacacgcctaaaaccaggcgtgaagccgaggatctacaggtgggtcaggtagagctcggtggtggtccgggggccggtagcctgcagccactggccctggaaggcagcctgcagaagcgtggcattgttgagcagtgctgtaccagcatctgcagcctatatcaactagagaattactgcaac

SEQ ID NO: 14320 - DNA, 330 bp, Artificial Sequence
  Description of Artificial Sequence: Synthetic coding sequence
atggcattatggatgcgacttttaccattacttgctttacttgcattatggggtccagatccagcagcagcatttgttaatcagcatctttgtggtagtcatcttgttgaagcactttatttagtttgtggagaacgaggttttttttacacaccaaaaactagaagagaagctgaagatcttcaagtcggacaagttgaattaggtggtggtcctggagctggttcattacaacctttagctttagaaggatctcttcaaaagcgtggaattgtagaacaatgttgtactagtatttgtagtttatatcaattagaaaattattgcaat

SEQ ID NO: 14321 - DNA, 330 bp, Artificial Sequence
  Description of Artificial Sequence: Synthetic coding sequence
atggccctgtggatgcggttgctgcctctgctggcgctgctggcactctgggggcctgaccctgcagccgcgttcgtaaatcagcacctctgcggcagccatttggttgaagctctttacttggtgtgtggggaacggggcttcttttatacacctaagaccagaagggaggctgaggatctccaggtgggacaggtggagctaggaggcggtccgggtgcaggatcactccaacccctagctctcgagggctccctgcagaaacgaggcattgtcgaacagtgttgcacgtccatctgttcgttatatcagctcgagaattactgtaat

SEQ ID NO: 14322 - DNA, 330 bp, Artificial Sequence
  Description of Artificial Sequence: Synthetic coding sequence
atggctctgtggatgcgactgctgcctttgcttgcgctgctcgcgctctggggaccggatccggcagccgcattcgtgaaccagcatctgtgtgggagccatctcgtggaagcgctctacctggtctgtggagaacgcggatttttctacacgcctaagactagacgggaagctgaagatctccaggtgggacaagtggaactcggaggcgggccaggagctggcagcctccagccgctggcgcttgagggatccttgcagaaacggggtatcgtcgaacagtgctgcacctcgatctgctcgctgtaccaactggagaattactgcaat

SEQ ID NO: 14323 - DNA, 330 bp, Artificial Sequence
  Description of Artificial Sequence: Synthetic coding sequence
atggcgttgtggatgagactgcttccccttctcgcgttgctggcattgtgggggccggatcccgcggccgcgttcgtcaaccagcacctgtgcggttcccacttggtggaagcgctgtacctggtgtgtggcgagcggggcttcttctacaccccaaaaactcgcagagaggctgaggacctgcaggtgggccaggtggagctgggtggagggccaggagcgggatcattgcaacctctggccctggagggctcgcttcaaaagcggggcatcgtcgaacagtgttgcacttcgatctgtagcctgtaccaacttgagaattactgcaat

SEQ ID NO: 14324 - DNA, 330 bp, Artificial Sequence
  Description of Artificial Sequence: Synthetic coding sequence
atggccctttggatgcggctccttcccctcctggccttactcgctctgtggggacctgatccagccgcagccttcgtcaatcaacacctgtgcggctcccatctggtggaggctttatatcttgtatgcggcgaaagaggatttttttacacccctaagacgcggcgcgaagccgaggacctgcaggtcggtcaggtggaattaggcggcggtccaggtgccggctccctgcagcccctcgcactcgaagggtcgctgcagaagagaggcattgtggaacagtgctgcacatcaatttgctctctgtaccagttggaaaattattgtaat

SEQ ID NO: 14325 - DNA, 330 bp, Artificial Sequence
  Description of Artificial Sequence: Synthetic coding sequence
atggcactgtggatgagactacttccacttttggctcttctagccttgtgggggcctgacccagctgctgccttcgtgaaccagcacctctgtggtagccacctggtagaagccctataccttgtttgcggtgagcgggggttcttctatacacccaaaactcggcgcgaggccgaagacctacaagtcggccaggtggaacttggcgggggtccaggggctggctcccttcagccgttagctctggaagggagcttgcagaagcgcggcatcgtcgagcagtgctgtacaagtatttgcagcctgtaccagctcgagaactattgtaac

SEQ ID NO: 14326 - DNA, 330 bp, Artificial Sequence
  Description of Artificial Sequence: Synthetic coding sequence
atggcactctggatgagactgctgcctctcttagccctgttagccctgtgggggcctgaccccgctgccgcctttgttaatcagcacctatgtggctcccatttagtcgaagcgctatatctggtgtgtggtgagagaggctttttttatacccccaagactagacgtgaggccgaagacttgcaggtggggcaggtagagttaggcggaggacctggggccggttctctccagccactcgcactggaggggtccctgcaaaaaagaggcatagttgaacaatgttgcacttcaatatgtagcttgtatcaacttgagaattattgcaat

SEQ ID NO: 14327 - DNA, 330 bp, Artificial Sequence
  Description of Artificial Sequence: Synthetic coding sequence
atggccctttggatgcgcttgctgcccttgctggctctcctggccctgtggggaccagacccggccgcggcgttcgtgaaccagcacctgtgtggaagccacctggtggaggctctttacctcgtgtgcggcgaacggggctttttctacactccaaagactcggcgggaagccgaggatctgcaggtgggccaagtggagctgggaggaggaccgggcgcaggctcactgcagccgctcgccctggagggctcgcttcagaagaggggcatcgtggaacagtgttgcacttcaatctgctccctttaccaactggagaactactgcaac

SEQ ID NO: 14328 - DNA, 330 bp, Artificial Sequence
  Description of Artificial Sequence: Synthetic coding sequence
atggctctctggatgcgtcttctgccattgctggcattgttggccctgtggggacccgatcccgccgcagcatttgtaaaccaacatttgtgcggctctcacctggtcgaagccctgtatttggtgtgtggggaaaggggttttttctatacgcccaagactcgcagagaggccgaggatctgcaagtgggccaggtcgagctgggcggggggccgggagctggcagtctgcagccactggcattggaggggtccctccagaagaggggcatcgtcgaacagtgttgcactagtatttgcagcctttatcagttggagaattactgcaac

SEQ ID NO: 14329 - DNA, 330 bp, Artificial Sequence
  Description of Artificial Sequence: Synthetic coding sequence
atggcactgtggatgcggctactcccattgctcgctctcctagcactgtggggacccgaccccgcagccgcgtttgtgaaccagcacctatgtggatcccatctcgtagaggctctataccttgtatgcggcgaaagaggatttttctacacccccaaaactaggcgcgaggcagaggacctgcaggtcggccaggtggaactcggaggtgggccgggggcaggttccctgcagccgttagctctggaaggctcactccagaagcggggcatcgttgaacagtgctgcacctcaatctgtagcctctaccagttagagaactactgcaat

SEQ ID NO: 14330 - DNA, 330 bp, Artificial Sequence
  Description of Artificial Sequence: Synthetic coding sequence
atggccctctggatgcggctcctgccgctgctggccctgctcgcactgtggggaccggaccccgcggcggcgttcgtgaaccaacacctctgcggatcacatctggtggaagctctttacctcgtctgtggagaacggggatttttctacaccccaaaaacccggagagaagccgaagatctccaggtcggccaagtggaactgggcggcggaccgggggcggggtccctccagccacttgcgcttgaaggatcgctgcagaaacgcgggatcgtggaacagtgttgcacctcgatctgctcgttgtaccaacttgaaaactactgtaat

SEQ ID NO: 14331 - DNA, 330 bp, Artificial Sequence
  Description of Artificial Sequence: Synthetic coding sequence
atggccttatggatgcggctcctgcccctgctggcattattggccctttggggccctgacccagcggctgctttcgtgaaccagcacctgtgcgggagtcacttggtggaagcactttacctggtgtgtggagaacgcgggttcttctacactccaaagaccagacgcgaagccgaggaccttcaggtgggacaggttgagctcgggggtggccccggcgccgggtcacttcagcccctggccctggagggctctcttcagaaaaggggcatagtagagcagtgctgtacatctatctgctcgctgtaccagctggagaactactgcaac

SEQ ID NO: 14332 - DNA, 330 bp, Artificial Sequence
  Description of Artificial Sequence: Synthetic coding sequence
atggcgctctggatgaggctgctgccccttctggctctgctggccctttgggggcccgaccccgccgcagcatttgtgaaccagcacctgtgtggatcccacctggtggaggctctatacctggtttgtggagagcgggggtttttttacacccccaaaactcgccgcgaggcagaggatctacaagttggccaggtggaactcggtgggggccccggcgccgggtcactgcagcctctggcgctggagggctccctgcaaaagagagggatcgtcgagcagtgctgcacctctatctgtagcctgtatcagttggaaaactattgtaat

SEQ ID NO: 14333 - DNA, 330 bp, Artificial Sequence
  Description of Artificial Sequence: Synthetic coding sequence
atggcgttgtggatgcgcctcctgccactgctggccctgctcgcgctctggggacccgatccggctgcagcctttgtgaatcaacacctgtgcggatcacaccttgtcgaagccctctatctggtctgcggtgagcggggattcttctacactcccaagactcgccgcgaagccgaggatctccaggtgggacaggtggaactggggggaggcccgggcgcaggatccctgcagcccctggcgttggaagggtccctgcagaaaagaggaatcgtggagcaatgttgcacctcaatctgctccttgtaccaactggagaattactgcaac

SEQ ID NO: 14334 - DNA, 330 bp, Artificial Sequence
  Description of Artificial Sequence: Synthetic coding sequence
atggcactgtggatgcggctgttgccgctcctcgctctcctggctctgtggggaccagatccggctgcggcgttcgtgaaccaacacttgtgcggctcacacctggtggaggccctgtatctggtgtgcggggaacgcggattcttttacactccaaaaacccgacgggaagccgaggaccttcaggtcgggcaggtggaactgggcgggggcccaggagccggatcgttgcagccacttgcgctggagggatcactccagaagaggggtatcgtggagcaatgttgtacctccatctgttccctttaccaactggaaaactattgcaat

SEQ ID NO: 14335 - DNA, 330 bp, Artificial Sequence
  Description of Artificial Sequence: Synthetic coding sequence
atggcgctttggatgagacttctgcctctgcttgcccttcttgcactttggggccctgatcccgcagcagcatttgtgaaccaacatctttgtgggtcgcatcttgtcgaagcactttaccttgtgtgtggagaacggggcttcttttacacccccaagacccgacgcgaagcagaagatcttcaggtggggcaggtcgaactcggcgggggtccaggagcagggtccctgcagcctctggccctcgaaggctccctgcaaaagagaggtattgtggagcagtgctgtacctccatctgtagcctctaccaactggaaaactactgtaat

SEQ ID NO: 14336 - DNA, 330 bp, Artificial Sequence
  Description of Artificial Sequence: Synthetic coding sequence
atggctctgtggatgaggctgttgcccctgttggcactactggcgctctggggtcctgatccagccgctgcatttgtaaaccagcacctctgtgggtcccacctcgtggaagccttgtacctggtctgcggggagcgcgggttcttttatacccctaaaacccggagggaagctgaagatttacaggtgggccaggtggagctgggaggtgggccaggcgctggcagcttgcagcctttagccttggagggatctctgcagaagcgcggtatcgtcgagcagtgctgcacctctatctgcagtctataccagctggaaaattactgtaac

SEQ ID NO: 14337 - DNA, 330 bp, Artificial Sequence; identical to SEQ ID NO: 14288
  Description of Artificial Sequence: Synthetic coding sequence

SEQ ID NO: 14338 - DNA, 330 bp, Artificial Sequence
  Description of Artificial Sequence: Synthetic coding sequence
atggcactgtggatgagactgcttcctctgctggcactccttgcactgtggggaccagatccggcagcggcgttcgttaaccagcatctctgcgggtcccatctcgtcgaggcactgtaccttgtgtgcggagagaggggctttttctacactcctaaaaccagaagagaggcagaagatctgcaagtggggcaagtcgagcttggcggcggtcctggtgctggcagcctgcagccccttgcactcgaaggatcgctgcagaaacgtggaattgtcgaacaatgttgtacctccatttgttcgctttaccagctggaaaactattgtaac

SEQ ID NO: 14339 - DNA, 330 bp, Artificial Sequence
  Description of Artificial Sequence: Synthetic coding sequence
atggccttgtggatgaggctgcttcctttgctagcattgctcgcactctggggccccgatccagccgcagcctttgtgaaccaacacctgtgcgggagccacctcgtcgaggcactttacctggtctgtggtgagagggggtttttctatactccaaaaacaagacgtgaggccgaggatctgcaggtgggccaagtcgaactggggggaggtccaggcgctgggtcccttcagcctctggcacttgagggctcactgcagaaaagaggtattgtggagcaatgctgtacttcaatctgtagtctatatcagctcgagaactactgtaat

SEQ ID NO: 14340 - DNA, 330 bp, Artificial Sequence
  Description of Artificial Sequence: Synthetic coding sequence
atggctctgtggatgagactgctgccgcttcttgcattgcttgccctgtggggaccagaccctgccgcagcgttcgtcaaccagcatctgtgcggatcgcatctggtggaggccctgtacttggtttgtggagaacggggattcttttacaccccgaaaacccgcagagaagcggaggacctgcaagtgggacaagtggagctgggaggcggacctggtgctggctcactccagcccctcgctctggagggttccctgcagaagagaggaatcgtcgaacagtgctgtactagcatctgctcgctttaccaactggagaattactgcaac

SEQ ID NO: 14341 - DNA, 330 bp, Artificial Sequence
  Description of Artificial Sequence: Synthetic coding sequence
atggccttatggatgcggctccttccccttttggcccttctagccctatggggacctgatcctgctgctgcttttgtaaatcagcatctctgtgggtctcatcttgttgaagctctgtaccttgtatgtggagaaagagggtttttctatacacctaagacacggcgggaagcagaagatttacaggtcggacaggtagagcttggaggaggaccgggggccggatctttgcagccactggcccttgaagggtccctccaaaaaagaggaatagttgagcagtgttgtacttcaatctgctctctctatcagttggaaaattattgcaac

SEQ ID NO: 14342 - DNA, 330 bp, Artificial Sequence
  Description of Artificial Sequence: Synthetic coding sequence
atggcactctggatgaggttgttgccactgctcgcgctgctagcattgtggggcccggaccctgccgcagcatttgtgaatcagcatctgtgtggcagccatctggttgaagctttatatttggtttgtggggagagaggattcttctatacaccgaagacccgccgcgaggctgaggatttgcaagtgggccaggtagaactgggagggggccctggagcgggaagtctgcagcctctcgctctcgaaggatccctgcagaagagggggattgtagaacagtgctgcaccagtatctgttcactctaccagttggagaactattgcaat

SEQ ID NO: 14343 - DNA, 330 bp, Artificial Sequence
  Description of Artificial Sequence: Synthetic coding sequence
atggccctatggatgcgtttgttgcctctgctggccctcttggcactttggggtccggaccctgctgctgccttcgtgaaccagcatctgtgtggctcacatctagttgaagctctctacttagtgtgtggcgaaaggggtttcttttataccccgaagacaaggcgagaggcagaggatctgcaggtgggtcaggtcgagctcggtggtggccccggcgcaggttcgttacagccgctggctcttgaaggtagcttgcagaaacgaggaatagtagaacagtgttgtacaagcatttgtagtctttaccagttggaaaactattgcaac

SEQ ID NO: 14344 - DNA, 330 bp, Artificial Sequence
  Description of Artificial Sequence: Synthetic coding sequence
atggctctgtggatgcggctgcttcctctgctcgccctgctggcgctctgggggccagatccggccgcggcattcgtgaaccaacacctttgcgggtcacatcttgtggaagcactctacctcgtgtgtggagagcgcggatttttctacactcccaagacgaggcgggaggcggaggacctgcaggttggtcaagtggagttgggaggagggcctggcgccggaagcctgcaaccgctcgctctggaaggcagcttgcaaaagcggggcatcgtagaacaatgctgcacctccatctgctctctctaccagttggagaactactgtaat

SEQ ID NO: 14345 - DNA, 330 bp, Artificial Sequence
  Description of Artificial Sequence: Synthetic coding sequence
atggccctttggatgcgcctgcttcccttgctggctctactggccctgtgggggcctgaccccgctgccgccttcgtgaatcagcacttgtgcggtagtcatctggtggaagcactatatctggtctgcggcgagagaggcttcttctacacccctaagacacggagggaggcagaggacttgcaggtgggacaggtggagctaggcggtgggccaggggctggttctcttcagcccctcgcccttgagggaagcctccagaagcgcgggatcgtggagcagtgctgtacctcaatatgctccctgtatcaactcgagaattactgcaac

SEQ ID NO: 14346 - DNA, 330 bp, Artificial Sequence
  Description of Artificial Sequence: Synthetic coding sequence
atggcgctatggatgcgactattaccgctattagcgctactagcgttatggggtccggatccggcggcggcgtttgttaatcaacatttatgtggttcgcatttagttgaagcgctatatctagtttgtggtgaacgtggttttttttatacgccgaaaacgcgacgagaagcggaagatttacaagtaggtcaagtagaattaggtggtggtccgggtgcgggttcgttacaaccgctagcgctagaaggttcgctacaaaaacgaggtatagttgaacaatgttgtacgtcgatatgttcgctatatcaattagaaaattattgtaat

SEQ ID NO: 14347 - DNA, 330 bp, Artificial Sequence
  Description of Artificial Sequence: Synthetic coding sequence
atggctctgtggatgaggcttctgccgctgttggccttactggctctgtggggccccgaccccgctgccgcattcgtgaatcagcatttatgcggctctcacctggtggaggccctgtatcttgtgtgtggtgagcggggcttcttctacacccccaagactcggcgtgaggcagaagacctgcaagtgggccaggtggaactgggtggaggccccggagctggatccctacagcccctggccttagagggcagccttcagaagcgcggcatcgtggagcagtgttgtaccagtatttgctccctataccaattggagaactactgcaac

SEQ ID NO: 14348 - DNA, 330 bp, Artificial Sequence
  Description of Artificial Sequence: Synthetic coding sequence
atggctctttggatgaggctgcttccactcctggctcttttggcgttgtggggacccgacccagccgcagcctttgtaaaccagcacctatgtgggtcccacctggtggaggctctgtatctggtgtgtggtgaaagaggctttttttacacccccaagacacggcgtgaagcagaagatctccaggttggccaagtcgagctgggcggtggaccaggagccggatcgctccagccactagccctggaaggcagtctccagaaacgtggaatcgttgagcaatgttgcacttcgatctgctccctgtaccaattagaaaactattgcaac

SEQ ID NO: 14349 - DNA, 330 bp, Artificial Sequence
  Description of Artificial Sequence: Synthetic coding sequence
atggcactgtggatgcggctgctgccgctgctggcgttgcttgcgctttggggccctgatcctgccgcagcttttgtgaatcagcatctctgcggttcgcacttggtggaagctctttacctcgtctgcggcgaaagaggattcttctacactcctaagaccaggcgcgaagcagaggacctccaagtcggccaagtggaactcggtgggggaccaggggccggatcgctgcagccactggcccttgagggttccctgcaaaaacgcggtatcgtagagcagtgctgtaccagcatctgttccctctaccagctggaaaactattgtaac

SEQ ID NO: 14350 - DNA, 330 bp, Artificial Sequence
  Description of Artificial Sequence: Synthetic coding sequence
atggctctgtggatgagacttctgccgctgctggcactgctcgcgctgtggggtcccgatcctgcagcagccttcgtgaatcaacacttgtgtggttcacatctggttgaggccttgtacctggtgtgcggagagaggggctttttctacacgcctaaaaccaggcgtgaagcagaagatttgcaggtcggtcaagtggaacttggtggtggaccaggtgcaggcagccttcaacctcttgcactggagggctcccttcagaagaggggcatagtggagcaatgttgtacttcaatttgctcgctttaccaactcgagaactactgtaac

SEQ ID NO: 14351 - DNA, 330 bp, Artificial Sequence
  Description of Artificial Sequence: Synthetic coding sequence
atggccctgtggatgcgtctgctgccactgctggccctcctggccttatggggacccgatcctgcagccgcctttgtgaaccaacatttgtgcgggtcacacctcgtggaggctctataccttgtgtgtggcgagagagggttcttctatacgccgaaaaccaggagagaggctgaggatcttcaggtgggacaggtggaacttggtggaggcccaggcgccgggagtctccagccactagctctggaaggctctctgcagaaacggggcatcgtcgagcagtgctgtacctcaatttgttccctttatcaattagagaactattgtaat

SEQ ID NO: 14352 - DNA, 330 bp, Artificial Sequence
  Description of Artificial Sequence: Synthetic coding sequence
atggctctgtggatgagactgctgcctctgctcgcactgctcgccctttgggggccggacccagcggcggcattcgtgaaccagcatctctgcgggtcccatttggtcgaggccctgtacttggtgtgcggagaacgaggcttcttttacaccccgaaaaccaggcgggaagcagaagatttgcaagtcggacaggtggaactcggaggcggcccgggagcaggatcgctccagcccctggctttggagggatctctccaaaagcgcggcatcgtggaacagtgctgcacgagcatctgttcactgtaccaactggagaactactgcaat

SEQ ID NO: 14353 - DNA, 330 bp, Artificial Sequence
  Description of Artificial Sequence: Synthetic coding sequence
atggctttgtggatgagacttctccccctcttggctctgctggcattgtggggacccgaccccgctgcagcttttgtcaaccaacatctgtgcggctcacacctcgttgaggccctgtatcttgtgtgcggtgagcgtggttttttttatactcccaaaacccgtagagaggccgaggatttgcaggtgggtcaagtggaactgggtggcggacctggtgctggctctttgcagccactggcactggagggtagtctgcaaaaaagaggcatcgttgagcagtgttgcacaagcatttgcagtttgtatcagcttgagaattattgcaac

SEQ ID NO: 14354 - DNA, 330 bp, Artificial Sequence
  Description of Artificial Sequence: Synthetic coding sequence
atggccctctggatgcgcttgcttcccctcctggcacttcttgccctgtggggacccgatcctgctgccgcatttgtaaaccaacacctctgtggatcgcatctcgtcgaagcgctgtaccttgtttgcggagaaagaggtttcttttacactccaaaaaccagacgcgaagcggaagatcttcaagtcggacaggtggagctcgggggtggacccggtgcaggttcattgcaacctctggcacttgaaggatccctgcagaagcggggcatcgtggagcaatgttgcacgagcatttgttctctctaccagctcgaaaactactgtaat

SEQ ID NO: 14355 - DNA, 330 bp, Artificial Sequence
  Description of Artificial Sequence: Synthetic coding sequence
atggccctgtggatgagactcctccctctgttggcacttctggccctctggggccctgatcccgcagctgcttttgttaaccagcacctgtgcgggtcccacctggtcgaggctctttatctcgtttgcggggaacggggcttcttttatacacccaagaccagacgggaagccgaagacctccaagtcggtcaggtcgagctaggcggcggccccggcgctggcagtctgcaaccacttgctctggaaggctcacttcagaagcgcggaatcgtggagcagtgctgtaccagcatctgttcgctgtaccagctcgaaaactattgtaac

SEQ ID NO: 14356 - DNA, 330 bp, Artificial Sequence
  Description of Artificial Sequence: Synthetic coding sequence
atggcgctgtggatgaggctgcttccgttgcttgcacttttggcattgtgggggcctgatcctgcggccgcatttgtcaatcagcatctctgtggctctcacctcgtcgaagcactttacctggtgtgtggagaacgcgggttcttctatactcccaagaccaggagagaggccgaggatcttcaggtgggacaagtggaactcggaggcggtccaggagcggggtcgcttcaaccactcgcactcgaaggatcactgcaaaaacggggtatcgtcgagcagtgctgcacttctatttgctccctttaccaacttgaaaactactgtaac

SEQ ID NO: 14357 - DNA, 330 bp, Artificial Sequence
  Description of Artificial Sequence: Synthetic coding sequence
atggccctttggatgaggctactgccgctcctagcactcctggctttgtggggacctgaccccgcagccgcgtttgtcaaccaacacctttgcggcagccacctcgttgaggcgctgtatttggtgtgtggagagagagggttcttctatactccaaagaccaggagagaggcagaagacctgcaggtaggacaggtggagcttgggggaggcccgggcgcagggtcactacagcctttggcactggagggcagcctgcagaaaagggggattgtcgagcagtgctgcacgagcatttgtagtctgtatcagctggagaattattgcaac

SEQ ID NO: 14358 - DNA, 330 bp, Artificial Sequence
  Description of Artificial Sequence: Synthetic coding sequence
atggcgctgtggatgaggcttctcccgctgctggcattgctggccctctggggaccggacccagcagccgcattcgtgaatcaacatctctgcggttcccacttggttgaggccctttaccttgtctgtggagaacgtggctttttctatacccctaaaactaggcgtgaggccgaggatttgcaggtaggccaagtcgaactcggaggtggtcccggagcaggctccctgcagcctctggccctcgagggatcgctccaaaagagaggtattgtggaacagtgttgcacctcgatctgtagcctgtaccagcttgaaaactactgtaac

SEQ ID NO: 14359 - DNA, 330 bp, Artificial Sequence
  Description of Artificial Sequence: Synthetic coding sequence
atggcgctgtggatgagactgctgccactgctcgccctgctggcgctgtggggaccagacccagcagccgcattcgtgaaccagcatttgtgcggatcgcacctcgtggaagcactttatctggtgtgcggggagcggggattcttctacactccgaaaactaggagagaagccgaagacctccaagtcggacaggtggagttgggaggcggccctggggccggttcactccaaccactcgcgctggagggttctttgcagaagagaggcatcgtcgagcaatgctgcacttcaatttgctccttgtaccagctcgagaactactgtaat

SEQ ID NO: 14360 - DNA, 330 bp, Artificial Sequence
  Description of Artificial Sequence: Synthetic coding sequence
atggcattatggatgcggctgttaccgctgttggccctgctggctctgtggggaccagacccagccgctgctttcgtgaatcaacacctctgcggctctcacttagtagaagcactgtatttagtttgcggagaaaggggattcttctacacaccaaagactcgtagagaggccgaagatctgcaggtgggtcaggtggagttaggaggtggcccaggtgctggttccctccagccattggctctggaggggtccctacagaagcgtgggattgtagaacagtgctgcacctcaatttgttctctgtatcagctagagaactactgcaat

SEQ ID NO: 14361 - DNA, 330 bp, Artificial Sequence
  Description of Artificial Sequence: Synthetic coding sequence
atggcgctctggatgcgccttctcccgctgcttgcgttgctcgcattgtggggacctgacccggccgcagcttttgtcaaccaacatctttgcggatctcacctcgtggaggccttgtacctggtgtgtggcgaaagaggttttttctataccccaaagactagaagggaagcagaagatctccaagtgggtcaagtggaactgggaggcgggccgggagcaggatccctgcagccacttgccctcgaaggctcgcttcagaagcggggaattgtcgagcagtgctgtacctcgatctgttccttgtaccaactcgagaattactgcaac

SEQ ID NO: 14362 - DNA, 330 bp, Artificial Sequence
  Description of Artificial Sequence: Synthetic coding sequence
atggcgctgtggatgcggctactgccactcctggcccttcttgcactgtggggtcccgacccagcggcagcattcgtgaaccaacacctatgcgggtcgcacttagttgaagcactatatctggtgtgcggcgaacggggcttcttctatactcctaaaacaaggcgagaggcggaagaccttcaggtgggacaagtggaacttggaggtggtccaggcgccggtagtcttcagccattagcgctagaaggttcacttcagaagcgtgggatcgtcgaacagtgctgcaccagtatctgctcactgtatcagttggagaattactgcaat

SEQ ID NO: 14363 - DNA, 330 bp, Artificial Sequence
  Description of Artificial Sequence: Synthetic coding sequence
atggcgctctggatgcggctgcttcctcttctcgcactcctcgcgctttggggaccggacccagcagctgccttcgtcaaccagcatctgtgtggttcccacctggtggaagctctctatctggtgtgtggggaacgggggtttttctacactcccaagacccgaagggaagctgaggatttgcaagtgggccaagtcgagctgggaggtggtcctggagcaggttcgcttcaacccctcgcactggagggatctttgcagaaacgcgggatcgtggaacaatgctgtacgagcatttgctcactttaccagcttgaaaactactgtaac

SEQ ID NO: 14364 - DNA, 330 bp, Artificial Sequence
  Description of Artificial Sequence: Synthetic coding sequence
atggcactgtggatgaggctgctgcctcttctcgccctcctggctctctggggtccggaccccgcagccgcctttgtgaaccagcatctttgtggctctcatttggtcgaggcgctttacctcgtgtgtggcgaacgaggattcttctatacccccaaaacaaggagggaagctgaggacctccaggtcggtcaagtagagcttgggggtgggccaggcgccgggagcttacagccactggctttagagggatccctgcaaaaaagaggaatcgtggaacagtgttgcacgtccatatgttcactgtatcagttagaaaattactgtaac

SEQ ID NO: 14365 - DNA, 330 bp, Artificial Sequence
  Description of Artificial Sequence: Synthetic coding sequence
atggcactgtggatgcgcctcctgccgcttctcgcactgctggcactttggggacccgatcctgcagcagcctttgtgaaccaacacctctgtggatcacaccttgtggaggcgctctaccttgtctgtggtgaacggggattcttctacacccctaagacccgacgggaagcggaagatttgcaagtcggacaagtggaacttgggggcggtccaggcgctggaagcctgcaacctcttgcattggagggatcactccagaagagaggtatcgtcgaacaatgctgtaccagcatctgctccctgtaccaacttgaaaactactgtaac

SEQ ID NO: 14366 - DNA, 330 bp, Artificial Sequence
  Description of Artificial Sequence: Synthetic coding sequence
atggcattgtggatgaggcttttgcctctgctcgccctcttagcgctctggggccctgatcctgctgctgctttcgttaatcagcacttgtgcggctcccatctcgtcgaggctctgtaccttgtgtgtggggagcggggcttcttttatacgccaaaaacaagacgggaggcagaggacttacaagttggccaggtagagctcggaggcggacccggggccggtagtctacagcctctggccctggagggctccctccagaaacgcgggatcgttgagcagtgttgcacatcgatatgctcactctatcagctagagaattactgcaac

SEQ ID NO: 14367 - DNA, 330 bp, Artificial Sequence
  Description of Artificial Sequence: Synthetic coding sequence
atggcactgtggatgcgtttactaccacttcttgcgcttttggcgctctggggaccagatccagctgctgcctttgtaaaccagcatctctgtggatcacatctagtcgaagctctttatttagtctgtggagagagaggatttttttatacaccgaaaacacgtagagaagcagaagatttacaggttggacaagttgagttaggagggggaccgggagctggaagtttgcaaccgcttgccttagaaggatctcttcagaaacgcggaattgttgaacagtgctgcacgtcaatttgttcgttgtaccagctcgagaattattgcaac

SEQ ID NO: 14368 - DNA, 330 bp, Artificial Sequence
  Description of Artificial Sequence: Synthetic coding sequence
atggcactgtggatgcgtctccttccgttgcttgcactgctggcgctctgggggccagacccagcagctgcattcgttaaccagcatctctgcggcagtcatctcgttgaggctctctatttggtgtgtggcgaaagaggattcttctatactccaaaaactcgtagagaagcggaggatctgcaggtggggcaggtcgagcttggaggcggtcccggagctggatcacttcagccattggcgttggaaggttcgctacaaaagaggggaattgtggagcaatgctgtacttctatatgttcactttaccaattggagaattactgcaat

SEQ ID NO: 14369 - DNA, 330 bp, Artificial Sequence
  Description of Artificial Sequence: Synthetic coding sequence
atggccctgtggatgagacttctccctcttctggctctgctggctttgtggggacccgaccctgcagctgcttttgtaaaccaacacctgtgtggatctcacctcgtcgaggcactgtatcttgtttgcggagagagaggcttcttttacacccctaagacgaggagagaggctgaggatttgcaggtgggtcaagtagaattgggaggcggtcccggcgccggctccctgcagccactggcattggaaggttctctccagaaacgcggcattgtggagcagtgctgtacttctatctgttctttgtaccagcttgaaaattactgcaac

SEQ ID NO: 14370 - DNA, 330 bp, Artificial Sequence
  Description of Artificial Sequence: Synthetic coding sequence
atggccttgtggatgaggttgcttcccctgctggctctcctggcactctgggggcctgatccggccgcggcatttgtgaaccagcacctgtgtggatcccatctggtggaagccctctacctggtctgcggcgagagagggttcttctacaccccaaaaacccgccgcgaggccgaggaccttcaggtgggacaggtggagctgggaggtggaccgggcgcgggaagcctccaaccgctggctctggaaggttcgctccaaaagcggggcatcgtcgaacaatgctgcacttcgatctgttcactgtaccagctcgaaaattactgcaac

SEQ ID NO: 14371 - DNA, 330 bp, Artificial Sequence
  Description of Artificial Sequence: Synthetic coding sequence
atggccctctggatgcggctgctccccctcctggcactgttggctctctggggcccggatcctgcagcagcgttcgtgaatcaacacctgtgtggatcacatcttgtggaagccctttacctggtctgcggcgaacggggattcttctacactcctaaaacccggcgcgaggccgaggatctgcaagtcggacaggtggagttggggggtggtccgggcgccggatcccttcagccattggccctcgaaggaagccttcaaaagcgcggaatcgttgaacagtgctgcacctcgatctgcagcctgtaccagcttgagaactactgcaac

SEQ ID NO: 14372 - DNA, 330 bp, Artificial Sequence
  Description of Artificial Sequence: Synthetic coding sequence
atggcgctgtggatgcgacttctcccactgctcgcacttttggctctttggggtcctgatcctgcggctgcatttgtcaaccaacacctgtgcggctcccatctggtggaagcactctacctcgtctgtggagaaaggggctttttctacacgcctaagactaggagagaagccgaggatctgcaggtgggtcaggtggaactggggggagggccgggggcaggaagcctccaacctttggcactggaagggtcactgcaaaagcggggaattgtcgaacaatgctgtacttcgatatgctccctttaccaactggaaaactactgtaat

SEQ ID NO: 14373 - DNA, 330 bp, Artificial Sequence
  Description of Artificial Sequence: Synthetic coding sequence
atggcactgtggatgaggctgcttcccttgcttgcactccttgccctctggggacccgacccagccgcagctttcgtgaaccagcatctatgtggatcacatttagtagaggctctgtatctagtatgtggagagcgagggtttttctatacgcccaaaactaggagggaggccgaagatctgcaggtcgggcaggtagagctgggggggggaccaggggccggatctctccagcccctcgcactggaaggaagtctccagaaaagaggaattgtggaacagtgctgcacatcaatctgttctctctatcagttggaaaactattgtaac

SEQ ID NO: 14374 - DNA, 564 bp, Artificial Sequence
  Description of Artificial Sequence: Synthetic coding sequence
atggccctgacctttgccctgctcgttgctctgcttgtcttgtcatgtaagtcatcttgctctgttggctgcgacctccctcagacacactctctgggatcacgccgcactcttatgttgttggcgcaaatgagaagaatatcactcttcagctgcctgaaagacagacacgattttggcttcccacaggaggagtttggaaatcagttccagaaagcagaaacgatccccgtcctccatgagatgattcagcagatatttaatctgttttctacgaaagatagctccgccgcatgggacgaaaccctgctcgataaattctacaccgagctctaccagcagctgaacgacttggaggcctgtgttatccagggcgttggggtcactgaaacccccctgatgaaggaggattcaattctggcagtcagaaagtattttcagcggatcactctttaccttaaggaaaagaaatatagcccctgcgcatgggaagtcgtgagggcagaaattatgaggtctttctccctgtccactaatctgcaggagtccctcagatcaaaagag

SEQ ID NO: 14375 - DNA, 564 bp, Artificial Sequence
  Description of Artificial Sequence: Synthetic coding sequence
atggcgctgacctttgcacttcttgtcgcactgctggtcctctcatgcaagtcctcgtgttccgtgggatgcgatctgccacaaactcatagccttgggagcagaagaactctgatgctcctggctcagatgcggcggatcagcctgttctcgtgtctgaaggacagacacgattttggtttcccgcaagaggaatttggcaaccaatttcagaaggcagaaaccatcccagtgctccacgaaatgatccaacaaatctttaacctgttctccaccaaggattcatccgccgcctgggacgaaaccctgctggacaagttctatactgaattgtaccagcagctgaatgatctggaggcctgtgtgatacaaggagtgggagtgactgaaacccctcttatgaaggaagattcgattcttgcagtccggaagtactttcagaggataaccctgtacctgaaggagaagaagtattcgccttgcgcgtgggaagtggtgcgggcagaaatcatgcgttccttctccctttcaactaacctgcaagagagcctgcgatcaaaagaa

SEQ ID NO: 14376 - DNA, 564 bp, Artificial Sequence
  Description of Artificial Sequence: Synthetic coding sequence
atggcccttacctttgcccttcttgtggcgcttcttgtgctgtcctgcaaatcgagctgcagcgttggctgcgacctgccccagactcactcactgggaagcagaagaacccttatgcttcttgcacaaatgcgccgaatttcactgttctcctgcctgaaggataggcatgactttggtttccctcaggaagaattcggcaatcagtttcaaaaggcagaaactatcccagtcctgcacgagatgatccagcaaatctttaatctcttctcgactaaggattcctcggcagcatgggacgagactcttcttgataagttctacaccgaactctaccaacagcttaatgatctggaagcatgtgtgatccagggtgtgggggtcactgaaaccccattgatgaaggaggattcgatcctcgcggtccgcaagtactttcaaagaataaccctgtaccttaaggagaagaagtattcgccctgtgcctgggaagtcgtgagagcagagattatgagatcattttccctttccacgaatcttcaggaatccctcaggtcgaaagaa

SEQ ID NO: 14377 - DNA, 564 bp, Artificial Sequence
  Description of Artificial Sequence: Synthetic coding sequence
atggcccttacattcgctctgctcgtcgcgctactagtccttagttgtaaaagtagctgcagcgtgggttgtgatttgcctcagacgcactctctgggctcgcgccggactctcatgctcctggcacagatgcggcgaatcagcctcttttcctgtctgaaggataggcatgatttcggatttccccaggaggaatttggaaaccagttccagaaggctgagactataccggtgttgcacgagatgattcagcagatcttcaacttgttcagcacaaaggactcatccgccgcttgggatgagactctcctagataaattctatactgaactgtaccagcagttgaacgatttggaagcctgtgttatccagggggtcggggtgaccgaaaccccactaatgaaggaggattccatcctggctgtgcggaaatacttccagagaattaccctttacctgaaagaaaagaaatacagcccctgcgcatgggaagttgtgcgcgcggaaattatgaggtccttctcgctgagtacgaatctccaggaaagcttgcggagcaaggaa

SEQ ID NO: 14378 - DNA, 564 bp, Artificial Sequence
  Description of Artificial Sequence: Synthetic coding sequence
atggccttgacctttgcgttgttggtcgctctgctcgtactctcctgcaaatcttcatgctccgtgggctgcgatcttccgcaaactcactcgcttggatcgcggcgcaccctgatgctgctggcgcagatgagaagaatcagcctgttcagctgtctcaaagatcgccatgacttcggcttcccccaagaggagttcggtaaccaattccaaaaagcagagactatcccggttttgcatgaaatgatccagcaaatcttcaatctcttttcgaccaaggactcttcggcagcgtgggacgagactctgctcgacaaattctacactgaactgtaccaacagctcaacgacttggaggcctgcgtgatccagggcgtgggagtgaccgaaaccccgcttatgaaggaagatagcatcctggcggtccgcaagtactttcagcgaatcactctctaccttaaagaaaagaagtactcaccatgtgcttgggaagtggtgcgggccgaaatcatgcggtcgttctcgctctcgactaatcttcaggaatccctgagatcgaaggaa

SEQ ID NO: 14379 - DNA, 564 bp, Artificial Sequence
  Description of Artificial Sequence: Synthetic coding sequence
atggctctgacttttgcattacttgttgctcttctcgtgttgtcttgtaaatccagttgttccgtcgggtgtgatcttccccagactcactcccttgggtccagacgcactcttatgctcctggctcagatgaggcggatctctttattctcctgtctgaaagataggcacgatttcggattcccccaagaagaatttgggaaccagttccagaaagccgaaacaatcccagttttacacgaaatgatacagcagatatttaacctgttttccacgaaggatagtagtgccgcctgggatgaaacacttctagataagttctatacagaactgtatcagcagttaaatgacctggaagcttgtgttatacagggggtgggagtaacagaaacacctctcatgaaagaagattccatccttgccgtgagaaaatattttcagcggataactctttatctaaaagaaaaaaaatattcaccatgtgcttgggaagtggtgcgcgcagaaataatgcggtcgttttcgctctctactaacctgcaggaaagtctacggtccaaagag

SEQ ID NO: 14380 - DNA, 564 bp, Artificial Sequence
  Description of Artificial Sequence: Synthetic coding sequence
atggctctgacttttgcgctgctcgtggccctgctggtcctgtcatgcaaaagctcatgcagcgtggggtgcgatctgccacaaactcactccctgggctcaagacgcaccctcatgctccttgcccagatgagacgcattagtcttttctcctgcctcaaggatcggcacgactttggcttcccgcaagaggaatttggaaaccagttccaaaaggccgaaactattccggtgctgcacgagatgatccaacaaatcttcaacctcttctccaccaaagactcgagcgccgcgtgggacgaaaccctgctggacaagttctacaccgaactgtaccagcaacttaacgacctcgaagcgtgtgtgatccagggagttggggtgactgaaactcctcttatgaaagaggactccatcctggcagttcggaagtatttccagcggatcacgctctacctgaaagaaaagaagtactcgccgtgtgcgtgggaagtcgtgagggcagaaattatgaggagcttttcgctgtccaccaacctgcaggagagcctcagatcaaaggaa

SEQ ID NO: 14381 - DNA, 564 bp, Artificial Sequence
  Description of Artificial Sequence: Synthetic coding sequence
atggcgttgaccttcgctcttctggtggccttgttggtgttgagttgcaagtccagttgttctgttggttgtgaccttccgcaaacccatagcctgggctcccgcagaactcttatgctgctggcgcaaatgcgccgaatcagccttttcagttgcctaaaggaccggcatgatttcggtttcccacaggaggagttcggcaatcagttccaaaaagctgaaacaatcccagttctccacgagatgatccaacagatttttaatctcttctcgactaaagacagctctgcggcctgggacgaaaccctactggacaaattttacactgagctgtaccaacaactgaatgatctcgaggcttgtgtcatccaaggcgtcggagtaaccgagactcctttgatgaaagaggattcgattctagccgttcggaaatacttccaacggattaccttgtatctaaaggagaaaaagtattctccgtgtgcctgggaagtggtccgtgcggagatcatgcgatcctttagtctaagcactaacctgcaggaatcgttgcgttcaaaggag

SEQ ID NO: 14382 - DNA, 564 bp, Artificial Sequence
  Description of Artificial Sequence: Synthetic coding sequence
atggccctcacgtttgcattgctcgtcgcactgctcgtccttagctgtaagtcgtcatgctcggtgggctgtgatcttcctcaaactcattctcttggtagcagacggactttgatgctgctggcacagatgcggagaatttctcttttctcatgtctgaaggaccgtcacgattttggatttcctcaagaagagtttgggaaccagtttcaaaaggccgagactattcccgtgctgcatgaaatgattcaacagattttcaacctcttcagcaccaaggattcatcggcggcctgggacgaaacgctgcttgacaagttttacactgaactttatcagcaactgaacgatcttgaggcctgcgtgattcaaggagtcggagttactgaaacccctctgatgaaggaggactccatactcgcagtgcgcaaatacttccaacggattaccctttaccttaaagagaagaagtacagcccatgtgcatgggaagtggtcagagcagagattatgcgttcgttcagccttagcaccaatttgcaagaatcgctcaggtccaaagag

SEQ ID NO: 14383 - DNA, 564 bp, Artificial Sequence
  Description of Artificial Sequence: Synthetic coding sequence
atggcgcttactttcgcgttgctggtggcactgctggtgctgtcgtgcaagtctagctgctccgtgggatgcgatctgccccaaacgcactcgctgggctcgcgcagaactctgatgctgcttgcgcaaatgagacggatcagcctgttctcatgtctgaaagacaggcacgacttcggattcccgcaggaagagtttggaaatcagtttcaaaaagccgagactattccggttttgcatgagatgattcaacagatctttaatcttttcagcactaaggattcttccgcagcttgggatgaaaccctgctcgacaagttctacaccgagctttaccagcagctgaacgatcttgaagcctgtgtcatccagggagtgggcgtcaccgaaacccctctcatgaaagaagattcgatcctggctgtgcgcaagtactttcagcgcatcaccctgtacctgaaggagaaaaagtactccccgtgtgcttgggaggtggtgcgggcagaaatcatgcggtcatttagccttagcacgaaccttcaagaatccctcagatcgaaggaa

SEQ ID NO: 14384 - DNA, 564 bp, Artificial Sequence
  Description of Artificial Sequence: Synthetic coding sequence
atggcactcacttttgcgttgcttgtggccttgctcgtgctctcatgcaagtcgtcctgttcggtaggttgtgatctgcctcagactcactccttgggctcgagacggactcttatgctgctggcccagatgcgcaggattagccttttctcttgtctcaaggatagacatgacttcggatttcctcaggaagaatttgggaatcaatttcaaaaagcagaaaccattcccgtgctgcatgaaatgattcaacagatattcaacctgtttagtacgaaagactcctcagccgcgtgggatgagacgttgctggacaagttttacaccgaactctaccagcaactgaacgatctggaagcgtgtgtgatccaaggggtgggggtgacggaaaccccccttatgaaggaggatagcatccttgcagtccgtaagtatttccaacgaattaccctctacctcaaggaaaagaaatactcgccatgtgcatgggaagtggttagggcagagataatgaggagctttagcttgtcaaccaatctgcaagagtcccttcgttccaaggag

SEQ ID NO: 14385 - DNA, 564 bp, Artificial Sequence
  Description of Artificial Sequence: Synthetic coding sequence
atggcattgacctttgcattgttggtcgccctgctcgtgctgtcgtgtaagtcatcgtgttcagtgggctgcgacctgcctcaaacccatagccttggatcccgccggacccttatgctgctggcacaaatgcggagaattagcttgttttcgtgcctgaaggacaggcacgactttggctttcctcaggaggaatttggaaaccaatttcaaaaagcagaaactattccagtccttcatgagatgatccagcagatattcaacctgttttcgaccaaggactcctcggcagcgtgggacgaaactctgctcgacaagttttacaccgagctctaccaacaactcaacgacctggaagcctgcgtcattcagggtgtgggggtcactgaaaccccccttatgaaggaggacagcattctggcggtgagaaagtacttccagaggatcactctttaccttaaggagaaaaagtacagcccatgtgcgtgggaagtggtgagggcggagataatgcgatcgttctccctgtccacgaatcttcaagagagcctgcgtagtaaagaa

SEQ ID NO: 14386 - DNA, 564 bp, Artificial Sequence
  Description of Artificial Sequence: Synthetic coding sequence
atggcccttacctttgcgttgcttgtagctctgctcgtgctgtcatgcaaatcatcctgcagcgtgggttgcgacctgcctcagactcactccctcggctcccgcaggactctcatgctcctggcccaaatgaggcgcatctccctgttctcgtgccttaaggaccggcacgatttcgggttcccgcaggaagagtttggaaatcagttccagaaggcagaaactatccctgtcctgcatgaaatgatccagcagatcttcaacctgttcagtaccaaggacagcagcgcagcctgggatgagactctcctggacaagttctacacggagctgtaccagcagctcaatgacctggaagcatgtgtcatccaaggagtgggagtgaccgagactccactcatgaaggaggattccattctggccgtgcggaagtatttccagcggatcactctgtacctgaaggagaaaaagtactccccatgtgcctgggaggtggttcgcgctgagatcatgagatccttctccctcagcaccaatcttcaggaaagcctgcgctctaaggag

SEQ ID NO: 14387 - DNA, 564 bp, Artificial Sequence
  Description of Artificial Sequence: Synthetic coding sequence
atggcgctgaccttcgcgctcctggtggcccttctggtgctttcatgcaagtcgtcttgcagcgtgggatgcgacctgccgcagacccactccttgggatcaagacgcaccttgatgctgctggctcagatgagacgaatcagcctgttctcctgcctgaaggaccgccatgacttcggtttcccacaagaggaattcggaaaccagttccaaaaggcagaaaccatcccggtgctgcacgaaatgatccaacagatctttaacttgttttcaactaaagatagctcagccgcgtgggatgaaaccctccttgacaaattctacactgaactgtaccagcagctgaatgaccttgaggcatgcgtgatccagggagtcggggtgaccgagactcctctgatgaaggaagattccatcttggcggtccgcaagtacttccagagaatcaccttgtacctcaaagagaagaagtatagcccctgtgcgtgggaagtggtgcgcgccgaaatcatgagatcattcagcctgtccacgaatttgcaggagtcgctccgctctaaggag

SEQ ID NO: 14388 - DNA, 564 bp, Artificial Sequence
  Description of Artificial Sequence: Synthetic coding sequence
atggcgctgaccttcgccttgctcgtggcactgctggtgctgtcctgcaagagctcctgcagcgtggggtgcgatctgcctcagactcattccctcggaagccgacggactctcatgctgctcgctcagatgcggcggatttcgttgttctcctgccttaaggaccggcacgactttgggttcccgcaggaagagtttggaaatcagttccagaaggcggagactatcccggtcttgcacgaaatgatccagcagattttcaatttgttctcgaccaaggattcgtcggctgcctgggacgaaaccctgctcgacaagttctacacggaactctaccagcaactcaacgatctggaggcatgtgtgatccagggagtgggggtcaccgaaacccccctgatgaaggaggactcgatcctggcagtgaggaaatacttccagcggatcaccctttacctgaaggaaaagaagtactccccatgtgcttgggaagtggtcagagccgagatcatgaggagcttctccctctctactaaccttcaggaatctctcagatcgaaggag

SEQ ID NO: 14389 - DNA, 564 bp, Artificial Sequence
  Description of Artificial Sequence: Synthetic coding sequence
atggctctcacctttgcgctcctggtggcactgctggttttgtcatgtaaatcttcgtgctctgtgggttgtgatctgccacagactcattcccttggttctcgccgaacgctgatgcttcttgcccagatgagaagaatctcgctcttctcctgtcttaaggataggcatgacttcgggttccctcaagaagaatttggtaaccaatttcagaaagccgaaactattccagtgctccatgagatgatccaacagatcttcaacctgttttcgacgaaggattccagcgcagcatgggatgagactctcctcgataagttttacactgagctttaccagcaacttaacgaccttgaagcatgtgtcattcaaggggtgggagttaccgaaactcctctgatgaaggaggattccattctcgcggtgcggaagtactttcagagaattactctgtacttgaaggagaaaaagtattcgccttgcgcatgggaggtggtgcgggcagagattatgagatccttttcactgtcaaccaatctccaagagtcgcttagatcgaaagaa

SEQ ID NO: 14390 - DNA, 564 bp, Artificial Sequence
  Description of Artificial Sequence: Synthetic coding sequence
atggcccttacctttgctctgctggtggcgctgctcgtgctttcttgtaagtcatcatgctccgtggggtgcgatcttccacaaacacattcactcggctcacggcggactttgatgttgcttgcccagatgaggcgcattagcctgttttcctgtctgaaagacaggcacgacttcggatttccacaagaggagtttggaaatcagttccagaaagccgaaaccattcccgtgctccacgagatgatacagcagatcttcaacctgttctcaacgaaggattcttctgctgcctgggacgagacactgctggataaattctatacagaactttatcagcaactgaatgacctcgaggcgtgcgtgatacagggggtcggggtgacagaaacccctctgatgaaggaagacagcatccttgccgtgcgaaaatactttcagaggattaccctctacctcaaggaaaaaaaatacagcccctgtgcatgggaggtggtcagggccgagattatgcggagttttagtctctcaacgaacctgcaggaaagcctcagaagtaaagag

SEQ ID NO: 14391 - DNA, 564 bp, Artificial Sequence
  Description of Artificial Sequence: Synthetic coding sequence
atggcgcttaccttcgcactgctggtggcccttcttgtgctctcctgtaaaagctcctgttcggtggggtgtgatctgccgcagacccattcacttggatcgaggagaactctgatgctgctggcacaaatgaggcggatttctctgttttcatgtctgaaggacagacatgactttggattccctcaggaagagttcggaaatcagttccaaaaggctgaaaccataccagtgctccacgagatgattcagcagatcttcaacctgttttccaccaaggatagtagcgcggcctgggatgaaactcttctggacaagttttacaccgaactgtatcaacaactgaacgatctggaagcatgcgtgatccaaggtgtcggcgtgaccgaaacgccccttatgaaggaggactcgatacttgccgtccgcaagtacttccagaggatcactctgtacctcaaggaaaagaagtatagcccatgtgcatgggaagtggtccgtgcagaaatcatgagatctttttcactgtcaaccaacctgcaggagtcgcttaggtcaaaggaa

SEQ ID NO: 14392 - DNA, 564 bp, Artificial Sequence
  Description of Artificial Sequence: Synthetic coding sequence
atggccctaaccttcgctctgctggtcgcactgcttgtgctgtcttgtaagtctagctgctcagtaggatgcgatctgcctcaaacacattccctgggatctcggcgaactcttatgctactggcccagatgcgccgcatcagtctgttctcctgtctgaaagatcgtcacgacttcggctttccccaggaggaatttggtaatcagtttcaaaaagccgagacaatccctgtcctgcacgagatgatacaacagatattcaatctcttctccacgaaggacagctcagccgcctgggacgagactctgctggacaagttctacacagaactgtaccagcaactgaatgacctggaggcatgcgtaatacaaggagtaggcgtaaccgaaacacctctgatgaaggaggatagtattctcgccgtcaggaagtattttcagcgcataactttgtacctcaaagaaaaaaaatactcaccatgcgcgtgggaagttgtacgtgccgaaatcatgcggtctttctccctgtcgacaaatctgcaggagagtttaagaagtaaggaa

SEQ ID NO: 14393 - DNA, 564 bp, Artificial Sequence
  Description of Artificial Sequence: Synthetic coding sequence
atggcattgacctttgcgctgcttgtggctctcctggttctttcatgtaagtcatcgtgttccgtgggttgcgatctccctcagactcacagtctgggctcccgccggactctgatgctgctggcgcaaatgaggcgcatctcactgtttagctgtctgaaggacagacatgattttggattccctcaggaagaattcgggaaccagttccaaaaggccgaaactattcctgtgctgcacgaaatgattcagcagattttcaacctcttttcgaccaaggattcgtccgcagcatgggatgaaactttgctcgataagttttacaccgaactctaccaacagcttaacgaccttgaggcctgtgtcattcaaggtgtcggagtcaccgaaactccactgatgaaggaagattcgattctcgcagtgagaaagtattttcagcgcataactctttacctcaaagaaaagaagtacagcccatgtgcgtgggaagtggtgagggcagaaatcatgcggtcattctcgctttcgactaacctccaggaaagcctgaggtcgaaggag

SEQ ID NO: 14394 - DNA, 564 bp, Artificial Sequence
  Description of Artificial Sequence: Synthetic coding sequence
atggccctgaccttcgctctcctggtcgcgttgttagtgcttagctgtaaatcttcgtgctcagtcggttgtgatttacctcagacacactcactcggcagcaggaggaccctaatgcttctggctcaaatgagaagaatctctttattttcctgcttgaaagaccggcacgactttggattcccacaggaagagttcgggaaccagtttcaaaaggcagagaccataccagtcctgcacgagatgatccagcagatctttaatctgttcagcacgaaagactctagcgctgcatgggacgaaaccttgctcgataagttttataccgaactttaccagcagctgaacgatctggaagcctgtgtcatccagggtgtcggtgtgaccgagacacccctgatgaaggaagacagcattttggctgtccggaaatacttccagagaatcacgttatatctcaaagaaaagaagtacagcccgtgcgcctgggaagttgttagggccgaaatcatgcggtccttcagtctgtcgaccaatctgcaggaaagccttcggagcaaggaa

SEQ ID NO: 14395 - DNA, 564 bp, Artificial Sequence
  Description of Artificial Sequence: Synthetic coding sequence
atggcactaactttcgcactacttgttgcactcctggtcctcagctgtaaaagctcctgtagcgtgggctgcgaccttcctcaaactcacagtctcggaagccggagaactctgatgctgctggcccagatgcgtcgaatttctctgttctcctgcctaaaggatagacacgatttcggattcccacaggaggagtttggcaatcagtttcaaaaagctgagaccatccccgtcctgcatgaaatgatccagcagatcttcaatttattttccacaaaagactctagcgccgcttgggatgagactttattagacaaattctatacagaactttaccagcagctcaatgaccttgaggcctgcgtgatccaaggcgttggagttaccgagacccccctcatgaaagaggattctatattagctgtccgcaagtattttcagcggatcacactgtacctcaaggagaagaagtactcaccgtgcgcgtgggaggtggtgcgggctgaaatcatgcgctccttcagcctttcaactaaccttcaggaatcattacggtctaaagag

SEQ ID NO: 14396 - DNA, 564 bp, Artificial Sequence
  Description of Artificial Sequence: Synthetic coding sequence
atggccctgacttttgcactcctggtggctctcctcgtactcagctgcaaatcctcttgttcagtgggctgtgatcttcctcaaacccattcacttggatcccgaagaaccctgatgcttctggcacagatgcgaagaatttcgctcttctcgtgcctcaaggatcggcacgacttcggattcccacaagaggaatttggcaatcaatttcaaaaggcggagactatccctgtcctgcatgagatgattcaacagatctttaatctctttagcaccaaagattcgagcgcagcctgggatgaaactctgctggataagttttacactgagctttatcagcaacttaacgacctggaggcctgtgtgatccaaggggttggtgtgactgaaacccctctgatgaaagaggacagcatccttgccgtgcggaagtactttcaaagaattaccttgtaccttaaagaaaagaagtactcgccgtgcgcatgggaggtggtgcgagctgagattatgaggtccttttccctgtcgaccaacctccaagaatcactccgctcgaaggag

SEQ ID NO: 14397 - DNA, 564 bp, Artificial Sequence
  Description of Artificial Sequence: Synthetic coding sequence
atggccctgaccttcgccttgctggtagccctactggtgctctcctgtaagagttcatgctcagtgggatgtgatctgccacagactcactcacttggcagccgcagaacactaatgctattagcgcagatgaggcggataagtctgttttcttgcctgaaggatcggcatgacttcggtttcccccaggaagagtttggcaaccagttccagaaagctgagaccattcctgtgctgcatgaaatgatccagcagatcttcaatctattctctacaaaagatagctccgcagcatgggacgaaaccctgctggataagttttacacagagctgtatcaacagcttaacgacctggaagcatgcgtgatacaaggggttggggtgacagaaacaccactgatgaaagaggactctattctggctgtccgtaaatacttccagcgtattactctgtacttaaaggagaagaagtacagtccttgtgcctgggaagtggtgcgagctgagatcatgcgtagtttctccttgtccacaaacctccaggagagcctaagatccaaagag

SEQ ID NO: 14398 - DNA, 564 bp, Artificial Sequence
  Description of Artificial Sequence: Synthetic coding sequence
atggccctgacgtttgccttgctcgtagcactgctggtgctgtcgtgcaagagcagctgttccgttggatgcgacctccctcagacccactcactgggctcccggcgaaccctcatgcttctagcccaaatgcgtagaatctccctgttctcttgtctgaaggatcgccatgatttcggttttccacaagaagaatttgggaaccagtttcaaaaggccgaaacgatccctgtccttcatgagatgatccagcaaatcttcaacttgttctccactaaggatagttccgcggcttgggatgagactctgctggacaagttctataccgaactgtaccaacagctcaacgacttggaggcatgcgtcattcagggggtgggagtgaccgaaactcccctgatgaaagaagattccatattagccgtcaggaaatacttccagaggatcacgctctacctaaaggagaaaaagtactcaccttgcgcatgggaggtggtgcgcgccgaaatcatgaggagcttttctctgtccacaaatctgcaggagtccctgcgctcaaaggag

SEQ ID NO: 14399 - DNA, 564 bp, Artificial Sequence
  Description of Artificial Sequence: Synthetic coding sequence
atggcacttaccttcgctcttctcgtggccctgctggtcctgtcctgtaagagctcctgcagcgtagggtgcgacctgcctcaaacacacagtctggggtctcggagaaccctcatgctgttagcccagatgagacggatcagcctgtttagttgcctgaaggacagacacgatttcgggtttcctcaagaggagtttggtaaccagtttcaaaaggctgaaaccattcctgtgcttcacgaaatgatccagcagatatttaacctgttcagcaccaaggattcatctgctgcctgggacgagacgctccttgataagttttatacggagctctatcagcaactcaacgatctggaggcctgtgtaatccaaggcgtcggcgtgactgaaactcccttgatgaaagaagactctatactggcggtgcggaaatatttccaaaggattaccctgtatttgaaagaaaaaaagtactctccctgcgcttgggaggtggtgagggcggaaattatgagatccttttccctatctacaaacctgcaggagtctttacggtctaaagag

SEQ ID NO: 14400 - DNA, 564 bp, Artificial Sequence
  Description of Artificial Sequence: Synthetic coding sequence
atggcgctgaccttcgccttgctcgtggcgctgctggtgctcagctgcaagagttcttgctccgtcggatgcgacttgccgcaaactcactcacttggctccaggagaaccctgatgctgctcgctcaaatgagacggatcagcttgttctcttgcctgaaggaccgccacgatttcgggttcccgcaagaagagtttggaaaccagtttcaaaaggcggaaactatcccggtgctgcatgagatgatccaacagatcttcaacctgttctcgaccaaggattcgtccgccgcttgggacgagactttgttggataagttctacaccgaactgtaccaacaactcaatgacctggaagcgtgcgtgatccagggagtcggagtgactgaaacccctctgatgaaggaggactcaattctggctgtgcgcaaatactttcagcgcatcacgctgtacctgaaagagaaaaagtacagcccatgcgcgtgggaagtggtgcgggccgaaatcatgcggtcgttctcactgtccaccaacctgcaggaatccctgcggtcgaaagag

SEQ ID NO: 14401 - DNA, 564 bp, Artificial Sequence
  Description of Artificial Sequence: Synthetic coding sequence
atggcactgacttttgcacttttagttgctcttttggtactttcatgtaagtcaagctgctctgtgggctgcgacctcccacagacccattccttaggctccagacgcactcttatgctgctagcccagatgagaaggatatctctcttctcctgcctgaaggaccggcacgatttcgggttccctcaggaggagttcggaaaccagtttcagaaagcggaaacaattcctgttctgcacgagatgatccaacagatcttcaatctgtttagcaccaaagacagcagtgcagcctgggacgaaaccttactggacaagttctataccgaactgtaccaacagttgaatgaccttgaagcttgcgtcatccaaggggtgggggtgactgaaactccactaatgaaggaggattccatactcgcagtgagaaagtactttcagaggataacactgtaccttaaagagaaaaaatactctccctgtgcatgggaagtggtccgcgccgagatcatgcgcagctttagcctgagtaccaatttgcaggagagcttgaggagtaaggag

SEQ ID NO: 14402 - DNA, 564 bp, Artificial Sequence
  Description of Artificial Sequence: Synthetic coding sequence
atggcactgacctttgctctgctcgttgctctgctggtgttgtcctgcaaaagctcctgttcagtgggatgcgatctccctcagacccattccctgggctcaagacgaacactgatgctgctcgcccagatgcggagaattagcctatttagttgtctcaaagaccggcacgactttggtttcccacaagaagaatttgggaaccagttccagaaagcagaaacaattcctgtgctccatgagatgatccagcagatcttcaatctgttctcaaccaaggatagttctgctgcctgggacgagaccttgctggataagttttataccgaactctatcagcagttgaatgacctggaagcctgcgtgatccagggggtgggggtgacagaaacaccactgatgaaggaggactctatcttggctgtcaggaagtattttcaaaggatcacactctatctgaaggagaagaagtactcaccttgtgcgtgggaagtggtgagagctgaaatcatgaggtccttttcactgtccaccaacctccaggaaagtctgcgctccaaggag

SEQ ID NO: 14403 - DNA, 564 bp, Artificial Sequence
  Description of Artificial Sequence: Synthetic coding sequence
atggccctgactttcgcgttgctcgtggcgttactcgttctgtcctgcaaatcctcttgttctgtagggtgtgatttgcctcagacgcattctctaggctctcgtaggacgctgatgctgttggcccagatgagaagaatctccctcttttcttgcctgaaagaccgtcacgattttggcttcccacaggaggaatttggcaatcagttccagaaagctgaaaccatcccggtactccatgaaatgatacagcagatcttcaacttgttcagcactaaagattcttctgctgcgtgggacgaaacgctattggacaagttttacacagaactttaccaacagcttaatgacctggaagcctgcgtcatccagggagtgggtgtgacagaaactcctctgatgaaggaggattctattctggccgttcgtaaatatttccaacgcatcaccctctatttgaaagagaagaagtatagcccctgtgcctgggaagtggttcgtgctgaaattatgcggagtttttctctctctaccaacctccaagagtcactgaggtcaaaagag

SEQ ID NO: 14404 - DNA, 564 bp, Artificial Sequence
  Description of Artificial Sequence: Synthetic coding sequence
atggctctgacttttgcacttctcgttgccctcttggtcctcagctgtaagtccagctgttctgtcggatgcgacctgccccaaactcactcactcggcagcagaagaactcttatgctgcttgctcagatgcgccgtattagcctgttctcctgtctgaaggaccgtcacgatttcggcttccctcaagaagagtttggcaaccagttccagaaggcagagaccattcctgtgctgcatgaaatgatccagcaaatcttcaacctgttcagcaccaaggatagcagcgcagcctgggacgagactctcctggacaagttctacacagagctctaccagcaactaaatgacctggaagcttgtgtgattcagggcgttggagttacggaaacgcctctgatgaaagaagattcaatcttagcggtgcgcaaatacttccaaagaatcactctttacctcaaagaaaagaaatatagtccatgcgcctgggaagtcgtgagggctgagatcatgcggagtttcagccttagtaccaacctgcaggaaagcctcaggtcaaaggag

SEQ ID NO: 14405 - DNA, 564 bp, Artificial Sequence
  Description of Artificial Sequence: Synthetic coding sequence
atggcactgactttcgcactcctggtcgcccttctggtgctctcctgcaagtcctcctgttctgtcggttgtgatcttccccagactcattcacttggatcgcgtcgcacccttatgctcctcgcccagatgagaagaatttcacttttctcctgccttaaggatcggcacgactttggattccctcaagaagagtttggcaaccaatttcaaaaagcggaaaccatacctgtgcttcatgagatgattcaacagatctttaacctcttttcgaccaaggactcgtcagcggcgtgggatgaaacgctcctggacaagttttacactgaactgtaccaacaactgaatgatctggaggcctgtgtcatccagggagttggagttactgaaaccccgctcatgaaagaagattccattcttgcagtcagaaagtatttccagcgaataacgctttaccttaaggagaagaagtacagcccatgtgcttgggaagtggtgagagcagagattatgagatccttctcgctgtcgactaatcttcaggagagcctgagatcgaaggaa

SEQ ID NO: 14406 - DNA, 564 bp, Artificial Sequence
  Description of Artificial Sequence: Synthetic coding sequence
atggctctgacctttgccttgctggtggccctgcttgtcctgtcgtgtaagtcgtcatgctcagtaggatgtgatctgccacagactcattcgctcggtagtcgtagaactctgatgctgctggcacaaatgagacgcattagcctctttagctgtctcaaggatcgccatgacttcgggtttcctcaggaagaatttggaaaccagttccagaaggcagagactatacccgtgttgcacgaaatgattcaacagattttcaacctttttagcaccaaggactcatctgcagcatgggatgaaactctgcttgataagttttacaccgagctgtaccaacaactgaacgacctcgaggcgtgcgtaattcaaggcgtgggcgtgacggagactccactgatgaaagaagattccatcctggccgtccgcaagtactttcaaaggatcacgctttatctgaaagaaaagaaatactcgccgtgtgcttgggaagtggtgagagctgagatcatgcgatcattctcgctttcaaccaatctgcaagagtcgcttcggtcaaaagaa

SEQ ID NO: 14407 - DNA, 564 bp, Artificial Sequence
  Description of Artificial Sequence: Synthetic coding sequence
atggcgttaacgtttgcgttactagttgcgctattagttctatcgtgtaaatcgtcgtgttcggtaggttgtgatttaccgcaaacgcattcgctaggttcgcgacgtacgttaatgctactagcgcaaatgcgacgtatatcgctattttcgtgtttaaaagatcgtcatgattttggttttccgcaagaagaatttggtaatcaatttcaaaaagcggaaacgataccggttctacatgaaatgatacaacaaatatttaatttattttcgacgaaagattcgtcggcggcgtgggatgaaacgctactagataaattttatacggaattatatcaacaactaaatgatttagaagcgtgtgtaatacaaggtgtaggtgttacggaaacgccgttaatgaaagaagattcgatattagcggttcgaaaatattttcaacgaataacgctatatctaaaagaaaaaaaatattcgccgtgtgcgtgggaagtagtacgtgcggaaataatgcgatcgttttcgttatcgacgaatttacaagaatcgctacgatcgaaagaa

SEQ ID NO: 14408 - DNA, 564 bp, Artificial Sequence; identical to SEQ ID NO: 14401
  Description of Artificial Sequence: Synthetic coding sequence

SEQ ID NO: 14409 - DNA, 564 bp, Artificial Sequence
  Description of Artificial Sequence: Synthetic coding sequence
atggccctgacctttgccctccttgtggcactgctcgtgttatcctgcaagagctcctgctctgtgggctgcgatctgccgcaaacacacagtcttggttcacgccgcactttgatgctgctggcacagatgagacgcatctctctgttcagctgtcttaaggaccgccatgattttggctttcctcaagaggagttcggcaaccaattccagaaagccgagacaatcccagtgctccatgagatgatccagcaaattttcaacctatttagtactaaagatagcagcgcagcttgggacgagactctgctagacaaattttacactgaactgtatcagcagctgaacgacctcgaagcctgtgtaatacagggtgtgggcgtgactgagacaccgctgatgaaggaggatagtattcttgctgtaaggaagtacttccaacggattacactgtacttaaaagagaagaagtattcaccatgcgcatgggaggtcgtaagggctgagatcatgagaagtttttccttatcgaccaacctgcaggagtctctgcggagcaaagag

SEQ ID NO: 14410 - DNA, 564 bp, Artificial Sequence
  Description of Artificial Sequence: Synthetic coding sequence
atggcactaacattcgcccttctggtggcgttactggttctgtcatgcaagagttcttgctcagtgggctgcgacctgccccaaacacactctctggggagtagacgtacacttatgctgctggcgcaaatgcgtcgaatcagcctgtttagctgtctgaaggataggcacgactttgggtttcctcaagaagagttcggcaaccagtttcagaaagcagaaacgatacctgtgcttcacgagatgattcagcagattttcaacctattctccacaaaggactcatccgcagcctgggatgaaacactcttggataagttctatacggagctgtatcagcagctgaacgacctggaagcttgcgttattcagggcgtcggagtaacagagacacccctgatgaaggaagattcgattttggccgtgcgaaagtatttccagcggattaccctatacctcaaggagaagaagtattctccttgtgcctgggaggtggtccgcgcagagatcatgcggagttttagtttgtcgactaatttgcaagaatccctgcggagcaaggag

SEQ ID NO: 14411 - DNA, 564 bp, Artificial Sequence
  Description of Artificial Sequence: Synthetic coding sequence
atggcattgactttcgcactgcttgttgctctcctggtccttagctgtaagagtagctgtagcgtgggctgtgatcttccacagacccactcccttggcagcagaagaacactgatgttgttggcacagatgagaagaatcagcctgttctcatgtcttaaggataggcacgattttggttttccacaggaagagttcgggaaccagtttcagaaggcagagacaatacctgttcttcacgagatgatccagcagatcttcaacctgttcagcaccaaagattccagcgctgcttgggatgagaccttgcttgataagttctacactgagctgtaccagcagctcaacgacctggaggcctgtgtgattcaaggagtgggtgtgaccgaaactccactgatgaaagaggactcaatactggcggtacgaaagtacttccaaagaatcacactctatctgaaggaaaagaagtacagtccttgtgcctgggaggttgtacgtgctgaaataatgagaagcttctccttgtccactaaccttcaggaaagccttcggagcaaggag

SEQ ID NO: 14412 - DNA, 564 bp, Artificial Sequence
  Description of Artificial Sequence: Synthetic coding sequence
atggccctgacgtttgctctcctcgttgcgctgttggtgttgtcctgcaagagctcctgctctgtgggatgtgatctccctcagacgcatagcctgggatcccgccgcacactcatgctgctggcccagatgcgacggatctcactcttctcatgcctgaaagacagacatgactttggattcccccaggaggaatttgggaaccagtttcagaaggccgagacaattccagtgctgcacgaaatgatccaacagatctttaacctgttctccactaaggattccagcgccgcgtgggacgaaaccctcctggataagttttatacagagctttaccagcaactgaatgatttagaggcgtgcgtcatccaaggggtgggtgtgactgaaacccctctcatgaaggaagactctattttggccgtgcgcaaatactttcagcgtattaccctctacctgaaggagaagaagtacagtccctgcgcatgggaggttgtgcgcgctgagatcatgaggagtttttcactgtcgacaaatctccaggagtcattgaggtctaaagag

SEQ ID NO: 14413 - DNA, 564 bp, Artificial Sequence
  Description of Artificial Sequence: Synthetic coding sequence
atggcactgacctttgccctcctagtggccttgctggtactttcctgtaagtcctcttgctctgtaggatgcgacctgccacagacccacagccttggaagtcgtcgcaccttgatgttgctggcgcagatgaggaggatttctctgttttcatgcctgaaggacagacacgacttcgggttcccgcaggaggagttcggcaatcagttccagaaggccgaaaccattcccgtgctccatgagatgattcaacagatattcaatctcttctcaaccaaagactcgtcagctgcctgggacgagacactgctcgataagttctacacagagctgtaccagcagctgaatgacctggaggcctgtgtaatccagggagtgggagtgacggaaaccccgctgatgaaggaagattcgatcctggccgtcaggaagtacttccagcgcatcacactatatctgaaggaaaagaagtatagtccatgcgcctgggaggtcgtgcgcgctgaaattatgagatcttttagcctttccacgaacctccaggagtccctgcgctcaaaagaa

SEQ ID NO: 14414 - DNA, 564 bp, Artificial Sequence
  Description of Artificial Sequence: Synthetic coding sequence
atggcactcacttttgcacttctggtggcactgcttgtgctgagctgcaagtcaagctgtagcgtgggttgcgatctcccccagactcattcgctggggtcgcggcgcaccctcatgcttctggcccagatgagaaggatttcacttttttcctgtcttaaagatcgccatgactttgggttcccacaagaagaatttggtaatcaatttcaaaaggcagaaacgattccggtgctccacgaaatgatccagcagattttcaacctgttctcgaccaaagattcttccgcggcgtgggatgagactctgcttgacaaattctacaccgaactgtaccaacaactcaatgatctggaggcctgtgtcatccaaggcgtcggagtgacggagactccactgatgaaggaggacagcattttggcagtgagaaagtacttccaacgtatcaccctgtacctcaaggaaaagaagtactccccgtgtgcttgggaagttgttcgggcggagataatgcggagcttctcactcagcactaacttgcaagaatcccttcgtagcaaagag

SEQ ID NO: 14415 - DNA, 564 bp, Artificial Sequence
  Description of Artificial Sequence: Synthetic coding sequence
atggccctcaccttcgccctcctggttgccctgcttgtgctctcatgcaaatcttcctgcagcgtgggatgcgatcttccacaaactcacagcttgggatcgcgccggacccttatgctccttgcccagatgcggcgcatctcgctgttcagctgcctgaaggacagacacgatttcggcttcccgcaggaagaattcggcaatcagttccagaaggcagaaaccattccagtgctgcacgagatgatccagcagatctttaacctcttctccactaaagactcctcagcggcgtgggacgaaaccctcctggacaaattctatactgaactgtaccagcaactgaatgatctggaggcttgcgtgatccaaggagtcggcgttactgagactccgttgatgaaagaggactcgatcttggcagtccgcaagtactttcagcgaatcaccctttacttgaaagaaaagaaatactcgccttgtgcctgggaggtggtcagagctgagatcatgagatcatttagcttgtcgacgaatctccaggaatcgctgcgatctaaagaa

SEQ ID NO: 14416 - DNA, 564 bp, Artificial Sequence
  Description of Artificial Sequence: Synthetic coding sequence
atggcattgacctttgcccttcttgtcgcactgctcgtgctgagttgtaaatcgtcatgttcagtagggtgtgatctgccccaaacccattcccttggtagccgaagaactctcatgctcctggcccagatgagaaggatatcgctcttcagctgtctcaaggacagacatgactttgggtttccacaggaggagttcggaaaccagtttcaaaaagcagaaaccatccctgtgcttcatgagatgatccaacagattttcaacctgttttcgaccaaggattcgtccgcagcctgggatgaaactcttcttgataagttctacactgaactttaccaacagctgaatgacctcgaggcatgtgtgattcaaggtgtgggagtgaccgaaacgccccttatgaaggaagattcgattctcgcagttcgaaaatacttccagagaataactctttacctcaaggaaaagaagtattcaccttgcgcatgggaggtggtgagggcggagattatgaggtccttttcgctgtcgactaacctgcaagaatcccttcgttcaaaggaa

SEQ ID NO: 14417 - DNA, 564 bp, Artificial Sequence
  Description of Artificial Sequence: Synthetic coding sequence
atggcactgaccttcgcacttcttgtggcactcctggtcctctcctgtaaatcatcttgtagcgtgggatgtgatctgccacaaactcactccctgggttcaaggcggactcttatgctgctggcgcaaatgagacggattagcttgtttagctgtctgaaggatagacatgactttggttttccacaagaagaatttgggaaccagtttcagaaagctgaaactattcccgtgctgcatgagatgatccaacagatcttcaatttgttttccaccaaggatagctcagcggcctgggatgaaacccttctggataagttctacaccgaactctaccagcagcttaatgatcttgaggcgtgtgtgatacagggcgtgggagtgaccgaaacccctttgatgaaagaggacagcatcctggccgtgcgcaagtactttcaaaggataactctttacctgaaggagaagaaatactcaccctgcgcctgggaagtggtgagagcagagataatgagatctttctccttgagtaccaacctccaggaaagcctccgatcaaaagag

SEQ ID NO: 14418 - DNA, 564 bp, Artificial Sequence
  Description of Artificial Sequence: Synthetic coding sequence
atggcactgacattcgccctgttggtggccttgctcgtgctgagctgcaagtcctcctgcagtgtaggatgcgacctgccacaaactcactctttgggttcaagaagaacactcatgcttcttgctcagatgcgtcgcattagtctcttctcttgtctgaaggatcgtcatgacttcggatttccacaggaggagtttggcaaccagttccaaaaggccgagactataccagtgctgcacgaaatgattcaacagatcttcaaccttttttccacaaaagactctagtgctgcttgggacgagactttgttggataagttctacactgagctctaccaacagctgaatgatctggaagcctgcgtgatccagggcgtcggagtaacagagactccactcatgaaggaggattctatcctggccgtgcgtaagtacttccagagaatcacactctacctcaaggagaagaagtatagcccctgtgcctgggaggtggtaagagccgagatcatgagatccttcagcctgtccacaaaccttcaggagagtctgcgtagtaaggag

SEQ ID NO: 14419 - DNA, 564 bp, Artificial Sequence
  Description of Artificial Sequence: Synthetic coding sequence
atggcgctgacatttgctttgctggtcgcactgttggttttgtcttgtaaaagcagttgcagtgttggctgcgatcttccacaaacccactctctaggatcgcggaggacactcatgctactcgcacagatgaggcgcatcagcctgttttcttgtttaaaggaccggcacgatttcggcttcccacaggaagagttcgggaaccagttccagaaagctgagactatacccgtcctgcacgagatgattcagcagatcttcaacttattctctaccaaagacagctcggccgcttgggacgagacgctactagataaattctacacagaactgtatcagcaactgaacgacctcgaagcctgcgtaatccagggggtgggcgtcaccgagacccccttaatgaaagaggacagcatcttggccgtcagaaaatatttccagcgcataaccctctatcttaaggaaaaaaagtactcaccctgtgcatgggaagtagtgcgcgcagagatcatgaggagcttttccttgtcaacaaacctgcaggagtcccttaggtcaaaagag

SEQ ID NO: 14420 - DNA, 564 bp, Artificial Sequence
  Description of Artificial Sequence: Synthetic coding sequence
atggctctgacattcgcgctgttggtcgcgctcctggttctctcatgcaaatcttcatgcagcgtgggatgcgacctcccgcagacacattcattagggtcccggcgaacattgatgctgctggcccagatgaggagaatcagtctattctcatgtctcaaggatcgccacgatttcggttttccccaggaggagtttgggaatcaatttcagaaggccgaaaccatccccgtcttacatgagatgatccagcagatttttaacctgttctccactaaggattccagtgccgcctgggacgaaactctgctcgataaattctataccgaactgtatcaacagctgaacgatctcgaggcatgcgtcattcaaggagtcggggttaccgaaaccccactcatgaaggaggactctattctcgccgtgagaaagtatttccagcgaatcactctctatttgaaggagaagaagtactcaccctgcgcttgggaggtggttagagcggagatcatgaggagcttctccctgtcaactaacctgcaagaaagcctacgatcaaaggag

SEQ ID NO: 14421 - DNA, 564 bp, Artificial Sequence
  Description of Artificial Sequence: Synthetic coding sequence
atggcgctcaccttcgccctcctggtagctctgctcgtgctttcgtgcaagagctcgtgctccgttggctgcgacctgccacagacccactcacttggctccagacggacccttatgctcttggcccaaatgcggcgtatctcacttttcagctgtttgaaagaccgacatgactttggtttccctcaggaagagttcggaaaccagtttcaaaaggcagagactatcccggtgctgcacgaaatgattcagcagatcttcaatctcttctcaaccaaggacagctctgctgcgtgggatgaaaccttgcttgataagttttacactgagctgtaccagcaattgaacgacctggaagcctgcgtgattcagggggtgggagtcaccgaaaccccgcttatgaaggaggattccatcctggccgtccggaagtactttcagagaattactctctatctgaaagagaagaaatactcgccctgcgcatgggaggtggttagggccgagatcatgcgctcgttctctctttccaccaacctccaagaatcgctgcggtcgaaggaa

SEQ ID NO: 14422 - DNA, 564 bp, Artificial Sequence
  Description of Artificial Sequence: Synthetic coding sequence
atggctctcacgtttgccctcctcgtcgcattgctggtcctgagctgcaaaagtagctgctcagtgggatgcgatctgccacaaactcactctctgggaagccgcagaacgttgatgctcctcgcccaaatgcggcgcatctccctgttctcttgtctcaaggaccgccatgacttcggcttccctcaggaagagttcggcaatcaattccagaaggcggaaacgatccccgtgttgcatgaaatgatccagcagatcttcaatttgtttagcactaaggattcgtccgccgcgtgggacgaaaccctcctcgacaaattctacaccgaactgtaccaacaactcaacgacctggaggcgtgtgtgattcagggggtcggagtcacggaaaccccgcttatgaaagaagattcgattctggctgtacgcaagtatttccagcgcatcactctgtaccttaaagagaagaaatactcaccatgtgcatgggaagtggtgcgagctgagatcatgcgctcgttttcgctttccaccaacctgcaggagtctctgcggtcaaaggag

SEQ ID NO: 14423 - DNA, 564 bp, Artificial Sequence
  Description of Artificial Sequence: Synthetic coding sequence
atggctctcacttttgctctccttgtagcactgttagtccttagctgcaaaagtagctgcagtgtcggttgcgacctcccccaaactcactcattgggcagccgacgcacgctcatgcttctcgctcagatgagacggatttcactgttcagctgtcttaaggacaggcatgattttggctttccccaggaggagttcggaaatcagttccagaaggccgaaactatacctgtattgcatgagatgatccagcaaatattcaatctcttttccacaaaagattcgtcagccgcttgggatgaaaccttgctcgacaagttctatactgagctgtatcaacagcttaacgatctggaggcctgtgtaatacagggtgtaggggtcaccgaaacacccctgatgaaggaggatagcattttagcagtaagaaaatatttccagcgtataaccctgtatctgaaggagaagaagtactctccctgtgcatgggaggtagtacgtgcagagattatgcggtccttcagcttgtcaaccaatttgcaagagagcctccggagcaaggaa

SEQ ID NO: 14424 - DNA, 564 bp, Artificial Sequence
  Description of Artificial Sequence: Synthetic coding sequence
atggccctaaccttcgcccttttagtggccctgctggttctgtcctgtaagtcatcttgcagcgtcggatgtgatctcccacagacccactcactgggttctcgccgtaccctgatgttgctcgcccagatgaggagaatttcattgttttcctgtctgaaagaccggcacgattttggattcccccaagaggaattcggcaatcaattccagaaagcggaaacaataccagtgctccatgaaatgatccagcaaatctttaacctcttctcaaccaaggactcaagcgccgcctgggacgagacactcttggacaaattttacacagaactctatcagcagctcaacgatctggaggcctgtgtgattcagggtgtaggcgtgacagagaccccgctgatgaaggaagacagcatcttggctgtcagaaaatattttcaacggattactctgtatctcaaagagaaaaagtatagtccatgcgcctgggaggttgtacgagcagaaatcatgcgctctttttccctgagtaccaacttgcaggaaagtctgcgttctaaggaa

SEQ ID NO: 14425 - DNA, 564 bp, Artificial Sequence
  Description of Artificial Sequence: Synthetic coding sequence
atggcactgaccttcgcattgttggtcgccctgctcgtgctgtcgtgcaaatcctcgtgctcggtggggtgtgacctcccgcaaactcactccctcggaagccggcggactctcatgctgctcgcgcagatgagacgcatctccctcttctcgtgcttgaaggaccggcacgatttcggattcccacaagaggaattcgggaatcagttccaaaaagcagaaactatcccggtcctgcacgaaatgatccagcagatcttcaatctgtttagcaccaaagactcctccgcagcatgggacgaaaccctgctggacaaattctacaccgaactctaccagcagcttaacgatttggaggcctgcgtgattcagggagtcggggtcactgagactccgcttatgaaagaagattcaatcctggccgtgaggaagtactttcaacgcatcactctctacctgaaggaaaagaagtactcgccttgcgcgtgggaagtcgtgagggcggaaatcatgcggtccttttccctgtccaccaacttgcaggagtcgcttcgctcaaaggaa

SEQ ID NO: 14426 - DNA, 564 bp, Artificial Sequence
  Description of Artificial Sequence: Synthetic coding sequence
atggcactgactttcgctctcttggtcgctctcctggtgttgtcatgtaaaagcagctgcagcgtcggatgcgatctgccccagactcacagcctcgggtcgaggcgaaccctgatgttgctagcgcaaatgagaagaatttctcttttctcctgtctcaaggataggcacgattttggtttcccacaggaagagtttggtaaccaatttcagaaggcagagactatccccgtcttacacgagatgattcaacagatttttaatttattttccaccaaggattctagcgctgcatgggacgagacacttctggacaaattttacactgagctttaccaacaacttaatgatttagaggcctgtgtgattcaaggtgttggagtgactgaaactcccctgatgaaggaggactccatccttgcagttcgcaagtactttcagcgaatcacactgtacctaaaggagaagaagtactctccttgtgcgtgggaagtcgtgcgggcggagattatgcgttcattttctctctctaccaatctccaggagagcctgaggtcgaaagaa

SEQ ID NO: 14427 - DNA, 564 bp, Artificial Sequence
  Description of Artificial Sequence: Synthetic coding sequence
atggccctgaccttcgccctgcttgtggccctcctcgtgctgtcctgcaagtcgagctgttccgtgggatgcgatctgccacaaacgcacagcctcggatcccggcgtacccttatgctgctcgcgcagatgaggagaatctcactcttctcatgcctgaaagatagacacgacttcggctttccgcaagaggagttcggaaatcagtttcagaaggcggaaacgatcccagtgttgcatgagatgattcagcaaatcttcaacctgttctcgactaaggactcgtcagcggcgtgggatgaaacccttctggacaagttctatactgagctgtaccaacagcttaatgacctcgaagcctgtgtcatccaaggcgtgggcgtgaccgaaactccactcatgaaggaggatagcattctggcggtccgcaaatactttcagcggatcaccctgtacctcaaggaaaagaaatacagcccatgtgcttgggaggtcgtcagagcggaaatcatgaggtcattctcgctttccaccaacctgcaggagtcactgcgctccaaagaa

SEQ ID NO: 14428 - DNA, 564 bp, Artificial Sequence
  Description of Artificial Sequence: Synthetic coding sequence
atggctctcacttttgcgcttcttgtggcattgctggtgctttcctgtaagtcgtcatgcagcgtcggatgtgatctgccgcaaacccactccttgggatcgagaaggactctgatgctgctggcacagatgcggaggatttccctgttttcctgtcttaaggaccggcacgacttcggcttccctcaagaagaattcggcaaccaatttcaaaaagctgaaaccattcctgtcctgcatgagatgatacagcaaatctttaacctgtttagcacgaaggacagcagcgctgcatgggacgagacgctgcttgacaaattctacactgaactgtaccagcagctcaacgacctggaggcatgtgtgattcaaggagtcggggttaccgaaactccacttatgaaagaggactccattctggcagtgcgtaaatactttcagcgcatcaccctgtacctgaaggaaaagaagtactcgccatgcgcctgggaggtcgtgcgggcggaaatcatgagatcattctctctcagcacgaatctgcaagagtcgcttagaagcaaggaa

SEQ ID NO: 14429 - DNA, 564 bp, Artificial Sequence
  Description of Artificial Sequence: Synthetic coding sequence
atggctcttacctttgctttgcttgttgcactcttggttttgtcgtgcaagtcaagctgtagtgttggatgtgaccttcctcagacccactccctaggatcacggagaacattgatgttattggctcaaatgcggaggatttcacttttttcttgtcttaaggataggcatgatttcgggttccctcaagaggaatttggtaaccaattccaaaaggctgagactattcccgtgctacacgaaatgatacagcagatcttcaacttgttctcaaccaaggactcgagtgcagcatgggacgaaactttgctggataagttttacacagaactctatcagcaactcaatgatttagaggcttgtgtgattcagggagttggggttaccgagacaccgctcatgaaagaagactcaatcctagctgtccggaagtattttcagcgaataactctttatctcaaggagaagaaatacagtccatgcgcatgggaagttgtgagagctgagattatgcgttctttttccctttcaacaaatcttcaggagtcacttcgttccaaagag

SEQ ID NO: 14430 - DNA, 564 bp, Artificial Sequence
  Description of Artificial Sequence: Synthetic coding sequence
atggccctgacgttcgcgctgcttgtggctctgctggtcctctcgtgcaagtcatcctgctcggtgggttgcgacctgccacagacccattctctgggatccagacggacccttatgcttctcgcgcagatgcgccgcatcagcctcttctcatgtcttaaagaccggcatgactttggattccctcaggaagaattcgggaatcagtttcagaaggccgaaactatccccgtgctccacgagatgatccaacagattttcaaccttttcagcaccaaggattcatccgcggcgtgggacgaaactcttctcgataagttctacaccgagctttaccagcagcttaacgacctggaggcttgcgtcattcaaggggtcggagttacggagactccgctcatgaaggaggattcgattctggcggtgcgtaagtacttccaaaggatcactttgtacctgaaggagaaaaagtattcgccgtgcgcgtgggaagtggtgcgcgccgagatcatgcggagcttttcgctcagcaccaacctccaagaatccctgcgctcaaaggaa

SEQ ID NO: 14431 - DNA, 564 bp, Artificial Sequence
  Description of Artificial Sequence: Synthetic coding sequence
atggcacttacgttcgcactgcttgtcgcactcctggtgctctcctgtaaatcaagctgttccgtcggatgtgacttgccgcaaacccactccctcggttcgaggcgcaccctgatgcttctggcccaaatgcggagaataagcctgttctcgtgtctgaaagacaggcatgactttggatttccccaggaagagtttggtaatcagtttcaaaaggcggagactattcccgtgctgcacgaaatgatccagcagatattcaacctcttttctactaaggattcatccgcagcatgggatgaaaccctgctggacaagttctacactgaactttaccaacaactgaacgatttggaggcatgcgtgattcaaggcgtgggggttaccgaaacgccactgatgaaggaagatagcatcctggcagtgcgtaagtactttcagaggatcactctctacttgaaagaaaagaagtactcgccgtgtgcttgggaggtggtgagggccgagataatgcggagcttcagcctgtccacgaaccttcaggaatcactgagatcgaaagaa

SEQ ID NO: 14432 - DNA, 564 bp, Artificial Sequence
  Description of Artificial Sequence: Synthetic coding sequence
atggcgctgacttttgctctccttgtcgccctcctggtattgtcttgcaagtcatcttgctccgtgggatgcgatcttccccaaacccacagcctggggtccaggaggaccctcatgctgctcgctcagatgaggagaatttctctgtttagctgtctgaaagaccgccacgacttcgggttccctcaagaagagttcggcaatcagttccagaaagctgaaacaattcccgtactccatgagatgatacagcaaatcttcaatctgttcagcacaaaagacagcagtgccgcctgggatgagactcttttggacaagttttatacggagctgtatcagcagttaaatgatttagaggcatgcgtcatccagggggtgggcgtgacagaaacaccactgatgaaagaagactctatactggctgtccggaagtatttccagaggatcaccctctacctcaaagagaagaagtactctccctgcgcatgggaggtggtacgggctgaaattatgcgtagtttttctttgagcacaaacctgcaggagagcctacgaagtaaggaa

SEQ ID NO: 14433 - DNA, 564 bp, Artificial Sequence
  Description of Artificial Sequence: Synthetic coding sequence
atggccctgaccttcgcccttctagtcgccttgcttgttctctcatgcaagagttcttgcagtgtgggatgtgatcttccacagacgcattccttggggtctagacgcacgttgatgctgctggcccagatgcggagaatttccttgttttcctgcctgaaggatagacacgattttgggttccctcaggaggagttcgggaaccagtttcagaaagcagagactattcctgtgttacacgaaatgattcagcaaatttttaacttgttttctaccaaggactcctcagcggcttgggacgagaccctcctggacaagttctacacagagctctatcagcagctcaatgatcttgaagcctgtgttattcagggggtgggggttacagagacccctctgatgaaagaggattctattctggctgtccgcaaatacttccagagaattacactctacctcaaagaaaaaaaatattccccatgtgcgtgggaggtggtgagggccgagatcatgcgatccttttccctgtccactaacctgcaggagagcctcaggagtaaagag

SEQ ID NO: 14434 - DNA, 564 bp, Artificial Sequence
  Description of Artificial Sequence: Synthetic coding sequence
atggccctgaccttcgccttgttggtggccctgctcgtgctgagctgtaagtcgtcctgctcggtgggctgcgacctgccacaaactcattcgctgggcagccgaagaaccctcatgctgctggctcagatgcggagaatctccctcttctcgtgtttgaaagataggcatgattttggattcccgcaggaggagttcggaaaccagtttcagaaggccgaaaccatccctgtgctgcatgaaatgatccagcagatcttcaacctcttctctaccaaagattcatccgccgcgtgggacgagactttgcttgacaaattctacaccgagctgtaccagcaattgaacgatctggaagcgtgcgtgatccagggcgtgggagtcactgaaacgccgctgatgaaggaggactccattttggcggtccgaaaatactttcaaagaatcaccctgtatctcaaagaaaagaagtactcgccttgcgcctgggaagtggtgcgggcggagatcatgcgctcgttctccctgagcactaacctgcaggagtcgctccgctcaaaggag

SEQ ID NO: 14435 - DNA, 564 bp, Artificial Sequence
  Description of Artificial Sequence: Synthetic coding sequence
atggcgctgactttcgccctgttggtcgccttgctggtgctgtcgtgtaagagctcatgttcggtgggatgcgatctgccacaaacccattcgctcggatccagaagaaccctcatgttgttggctcaaatgcggaggatcagcctcttcagctgccttaaggaccgccacgactttggcttccctcaggaggaattcggaaaccaattccagaaggcggagactataccagtactgcacgagatgattcaacagatcttcaatctgttcagcaccaaggattcatcggccgcttgggacgagactcttttggacaagttctatacggaactctaccagcaactgaatgatctggaggcctgcgtgatccagggggttggcgtgaccgaaacccccctgatgaaggaggactccatcctcgcagtccggaagtattttcagcgcataactctctacctgaaagaaaagaaatactccccgtgcgcatgggaagtcgtgcgcgccgagatcatgcgctcgtttagtctgtccacgaacctgcaggaatccctccggtcaaaagaa

SEQ ID NO: 14436 - DNA, 564 bp, Artificial Sequence
  Description of Artificial Sequence: Synthetic coding sequence
atggctcttaccttcgccttgttggtggctctgcttgtactgagctgcaagtcaagctgctccgtgggctgtgacctcccccagacccactcgttggggagccggagaaccctgatgcttctggcacaaatgagaagaatctccctcttttcttgtctgaaggaccggcacgattttggatttcctcaggaggaattcggcaaccagtttcagaaagcagaaacaataccggtgcttcatgaaatgatccagcagatttttaacttgttcagtacaaaagactctagtgcagcgtgggatgagactctcctcgataagttctataccgaactctatcaacagttgaatgacctagaagcctgtgtcatccagggcgtcggtgtgacagagacccctctaatgaaggaggattcgatcctagcagtgcgcaagtacttccaacggatcactttgtatcttaaggagaagaaatactcaccttgcgcatgggaagtggtcagggcagaaatcatgcggagtttcagcctgtctactaacctgcaggaaagtctcagatctaaggaa

SEQ ID NO: 14437 - DNA, 564 bp, Artificial Sequence
  Description of Artificial Sequence: Synthetic coding sequence
atggccctgaccttcgctctgctggtcgccctgctcgttctgagctgcaaaagcagttgcagtgtggggtgcgaccttcctcagacccacagcttaggctcgcgtaggacattgatgcttttggcacaaatgagacgcattagtctattttcttgtctgaaggatcgtcacgactttggttttccacaggaagaattcggtaatcagttccaaaaggccgagactatccctgttctgcacgaaatgatccagcaaatatttaatctgttcagtaccaaggacagcagcgccgcctgggacgagaccctgctggacaagttttatacggagctctatcagcagctgaatgatttggaagcatgtgtgatccagggtgtgggtgtcactgagactcccctcatgaaagaggacagcattctggcggtgcgcaaatactttcagcgtattaccctgtacctgaaagagaagaaatacagcccttgtgcctgggaggtggtgagggcggagattatgcgcagcttctccctgagcacgaatctgcaggagagcctgcgttcgaaagag

SEQ ID NO: 14438 - DNA, 564 bp, Artificial Sequence
  Description of Artificial Sequence: Synthetic coding sequence
atggctttaacttttgcactattggtggcattattagttttatcatgtaaaagttcatgttcagtaggatgtgatcttccacaaacacactcacttggatcaagacgtactcttatgcttcttgcacaaatgagaagaattagtttattctcatgtcttaaagatagacatgattttggatttccacaagaagaattcggaaatcaatttcaaaaggcagaaactatcccagtgcttcatgaaatgattcaacaaattttcaatcttttttcaactaaagatagttctgcagcatgggacgaaacattattagataaattttatactgagttatatcaacaattaaacgatttagaagcatgtgtaattcaaggagttggagtaacagaaacaccattaatgaaagaagattcgattttagctgtaagaaaatattttcagagaattactctttatttaaaagaaaagaaatattctccttgtgcatgggaagttgttagagcagaaattatgagatcattttctttaagtactaatttacaagagtctttaagatcaaaagaa

SEQ ID NO: 14439 - DNA, 564 bp, Artificial Sequence
  Description of Artificial Sequence: Synthetic coding sequence
atggcactcacgtttgctctattggttgctcttctggtcctcagctgcaaatcttcatgtagtgtgggatgcgacttgccccagacccattccctgggttcccgtcggaccttgatgcttctggcccagatgagaagaataagtctgttttcttgcctgaaagacagacacgattttggcttcccgcaggaggagttcgggaatcaatttcagaaagcagagacgattccggttttgcacgaaatgattcaacagatattcaatctgttcagcacaaaggattcgtctgcagcctgggacgagaccctgctggacaaattttataccgaactatatcagcaattgaatgacctcgaagcatgcgtgattcagggggttggtgtgacagagacccctttgatgaaggaggactctatcctagccgtacggaagtatttccagaggatcaccctctaccttaaagaaaagaagtacagcccctgcgcatgggaggtagtccgagccgagatcatgcggtcattctctttaagtaccaaccttcaggagtctttgagatctaaagaa

SEQ ID NO: 14440 - DNA, 564 bp, Artificial Sequence
  Description of Artificial Sequence: Synthetic coding sequence
atggccctgacgtttgccctactggtcgctcttttggtcttgagttgcaagtccagctgctctgtaggctgcgatttacctcaaacccacagcctgggatccaggagaaccctgatgctactagcccagatgagacgaattagcctatttagctgtctgaaagacagacatgattttggcttccctcaggaggagttcggcaaccagttccaaaaagccgagaccattccagtgctgcacgaaatgatccaacagatcttcaatctgttcagtacgaaggactcttcagccgcctgggacgagacgttacttgataagttttacactgagctgtaccagcagctgaatgatctggaggcctgcgtcatacagggagtaggagtgactgagacccccctgatgaaagaagactcaatcttggcggtaaggaagtactttcagcgtattactctgtacttgaaagagaaaaagtattctccttgcgcctgggaagtggtccgagccgagattatgcgcagttttagcttgagcaccaatctccaggaatctctgcgatccaaagag

SEQ ID NO: 14441 - DNA, 564 bp, Artificial Sequence
  Description of Artificial Sequence: Synthetic coding sequence
atggccttgacttttgctttgctggttgccttgctcgtgctgtcatgtaaaagttcgtgctctgtgggatgcgacctcccgcaaacccactctttaggttcccgacgtacattgatgcttctggcccaaatgcgcagaataagtctatttagctgtctaaaagaccgacacgatttcggttttccacaagaagaattcggcaaccagttccaaaaggctgaaacgattccagttctgcatgaaatgatccaacaaatttttaatctatttagcactaaagactcgtcagcggcttgggatgaaactcttcttgacaaattctatacagagctttatcaacaactgaacgacctcgaggcttgcgtaattcaaggcgttggggttacggagacgccattgatgaaggaagactctattctggctgtacgaaaatattttcaacgcattacactttacttaaaagagaaaaaatattcgccatgtgcatgggaagtcgtccgagctgaaattatgcgcagtttcagccttagcacgaacctacaagaatcactcagatccaaagaa

SEQ ID NO: 14442 - DNA, 564 bp, Artificial Sequence
  Description of Artificial Sequence: Synthetic coding sequence
atggcccttacattcgctctcctggtggcgctgttggtactgagttgtaaatcatcttgtagtgttggatgtgatctgccacagactcattctctagggagtcggaggacactgatgcttctcgcccagatgagacgcatatctctattttcttgcctaaaagatagacacgacttcggattcccgcaggaagagtttggaaaccagttccagaaagcggaaacaatcccagtgctccatgaaatgatccaacagatatttaacctattttccactaaagattcctccgcggcatgggatgagactttgctagataaattctatacagaattgtaccagcagctgaatgatcttgaagcatgtgtcatccaaggagtgggagtcacagaaactccccttatgaaggaggattccatcctggctgtcagaaaatatttccaaagaatcactctgtatcttaaagagaaaaaatactcaccctgcgcttgggaagtcgtgcgggcggaaatcatgagatctttttcactctctacaaatctccaggaatccttaagatccaaagag

SEQ ID NO: 14443 - DNA, 564 bp, Artificial Sequence
  Description of Artificial Sequence: Synthetic coding sequence
atggccttaactttcgcccttctggtagctctgctggtgctgtcttgtaaaagcagctgcagcgtgggctgcgatcttcctcaaacccatagtctgggctccagacggacattaatgttactggcacaaatgcggcgcatcagcctgttttcatgtctgaaggatagacacgattttggattcccacaggaggaatttggcaaccagtttcagaaggccgagacaatccctgtgctgcacgagatgatccagcaaatttttaacttattcagcacaaaggatagcagtgcagcttgggatgaaactcttttagataaattttacaccgagctgtaccagcaactcaatgacttagaggcttgtgttatccagggggtgggtgtgaccgagacacctcttatgaaggaggactcaatcctcgccgttcgaaagtacttccaacggatcaccctgtacctgaaagaaaaaaaatatagcccatgtgcctgggaggtggtacgagcagagataatgaggtctttttctctctccaccaacttacaggaatcactgaggtcaaaagaa

SEQ ID NO: 14444 - DNA, 564 bp, Artificial Sequence
  Description of Artificial Sequence: Synthetic coding sequence
atggctctaacttttgcactgctggtcgccctcctcgtactgagttgcaagtcatcttgtagcgtagggtgtgacctgccacaaacccattctcttggttcaaggcgaaccctgatgctattggcgcagatgcgaagaatctccttgttttcgtgcctcaaggacaggcatgactttggttttcctcaggaggagtttggcaatcagttccagaaggccgagacaattcccgtgttgcacgaaatgattcaacaaatctttaacttgttctccacaaaggacagtagcgctgcctgggatgagacactactggataagttttacaccgaattataccaacagctaaatgatctcgaagcatgtgtgattcaaggcgtgggggtgacagaaactccgttgatgaaggaagactccattcttgccgtccgcaagtattttcagagaataacactgtaccttaaagaaaagaagtactccccttgcgcatgggaagttgtacgtgctgagatcatgagatccttcagccttagcaccaacctgcaggagtcactgcgcagcaaggaa

SEQ ID NO: 14445 - DNA, 564 bp, Artificial Sequence
  Description of Artificial Sequence: Synthetic coding sequence
atggccctgactttcgcactcctcgtcgccctccttgtgctgagctgtaaatcttcgtgctccgtcggatgcgatctgccgcagacccactccttgggatcaagacgaaccttgatgctcctcgcccaaatgcggaggatttcgcttttctcctgtctgaaggaccgccacgactttggttttccccaggaggaattcgggaaccaattccagaaggctgaaactattccggtgctgcatgagatgatccagcaaatcttcaacctgttctccaccaaggactcatcggcggcttgggacgaaactctgctggataagttttataccgagctttaccaacagctgaatgacctggaagcgtgcgtgatccagggagtgggcgtgaccgaaactccactgatgaaggaagattcgatcctggccgtgcgcaagtacttccagcggatcactctctacttgaaggagaaaaagtacagcccttgcgcgtgggaggttgtccgcgcagagatcatgcggagcttctccctctcgacgaacctgcaggaatcactgagaagcaaagaa

SEQ ID NO: 14446 - DNA, 564 bp, Artificial Sequence
  Description of Artificial Sequence: Synthetic coding sequence
atggcacttacatttgcactcctcgtggctctgttggtcctcagttgcaagtcaagctgtagcgttggttgcgatcttccccagactcattcattgggttcccggcgaaccctgatgttgcttgcacagatgcgccggatctccctgtttagttgcttgaaggacagacatgattttggcttcccccaagaagaatttggcaaccagtttcagaaggcggaaaccatcccggtgcttcatgaaatgatacaacagatatttaatttgttttcaacaaaggatagctccgccgcatgggacgagacacttctcgacaagttttacacggaactgtatcagcagctgaacgacctggaagcctgtgtcattcagggagtgggtgtgacagaaactccccttatgaaagaagattctattctcgcagtgcggaagtacttccagcgcatcactctttatctcaaggaaaaaaaatattctccgtgtgcatgggaggtggtgagagctgaaatcatgcgaagcttcagcttgtcaacaaaccttcaagagtcactgcggtccaaggag

SEQ ID NO: 14447 - DNA, 564 bp, Artificial Sequence
  Description of Artificial Sequence: Synthetic coding sequence
atggccctgacgttcgctctcttggtcgcgctcctggtgctgagctgtaagtctagctgctctgtcggttgtgatcttcctcaaacccacagtctaggttcgcgaaggaccctgatgttgctcgctcagatgcgccgaatatctttgtttagctgtttaaaggaccgtcacgacttcggcttcccacaggaggaatttggcaatcagtttcaaaaggccgagacgattcccgtgttgcatgagatgattcaacagatctttaatctcttcagtacgaaggactcctccgcagcctgggatgagaccctgttagacaagttctatacggaactgtatcagcagctgaacgacctggaggcgtgcgtcattcagggcgtaggtgtcacggaaaccccccttatgaaggaggattccatcctagcggtgcgcaaatatttccagcgcataactctgtatctgaaggagaagaagtactccccgtgtgcctgggaagtggtgcgcgcagagataatgcgcagtttctccttgagtactaacctgcaagagtcccttcgtagcaaggag

SEQ ID NO: 14448 - DNA, 564 bp, Artificial Sequence
  Description of Artificial Sequence: Synthetic coding sequence
atggccttgaccttcgcattgctggtcgctctccttgttctttcctgtaaatcttcatgctctgtgggctgcgatctgcctcagactcacagcctgggttctagacgcactctcatgttgctcgcccagatgaggcgcataagcctgttttcctgtttgaaggacaggcacgatttcggtttcccacaagaggaattcggaaaccagtttcaaaaggctgagaccatccccgtgctgcacgagatgatccaacaaattttcaacctgttctcaacgaaggacagctcagctgcctgggacgagacactgctggataagttctatacggaattgtatcagcaacttaatgacttggaagcttgtgttattcaaggcgtgggagtgacggagacccctctgatgaaggaggactcaatcctggctgtgaggaaatacttccaacgcataaccctgtacctgaaggagaaaaagtacagcccgtgcgcttgggaggtcgtacgcgcagagatcatgagatcattctctctttctacgaacctgcaagaatcccttaggtccaaggag

SEQ ID NO: 14449 - DNA, 564 bp, Artificial Sequence
  Description of Artificial Sequence: Synthetic coding sequence
atggccctgaccttcgcgctgttggtcgccctcctggtgttgagctgcaaatcctcctgctccgtggggtgcgacctcccccaaactcactcactgggctcccgtcggactttgatgctactggcacaaatgcgacgaataagtctgttctcttgcctgaaggataggcatgacttcggcttccctcaggaggagttcggaaaccagttccagaaagccgaaacgatcccagtgctgcacgagatgatacagcaaatcttcaacctgttcagtactaaggatagttccgcagcatgggacgagacccttcttgacaagttttataccgaactgtaccagcagctgaatgatttggaagcttgcgtgattcagggcgtgggggtcacggaaactcctttgatgaaggaggacagcatactggctgtcaggaagtattttcagagaatcaccctctatctgaaggaaaaaaagtatagcccgtgcgcttgggaggtcgttcgtgccgaaattatgcgcagctttagtctttcaactaatcttcaggaaagcctgcggtccaaagag

SEQ ID NO: 14450 - DNA, 564 bp, Artificial Sequence
  Description of Artificial Sequence: Synthetic coding sequence
atggccctgacatttgctctgctagtggccctgctggttttgtcttgtaagagttcttgctcggtcgggtgtgacctgccacagacccactccctgggaagccgaagaacactcatgctgctcgcacagatgcgtcgcatcagtttgttctcgtgcttaaaagataggcacgactttggcttcccccaggaagaatttggcaatcaatttcaaaaggccgagactataccagtgctgcacgaaatgatccagcagatatttaatctcttcagcacaaaggattccagtgccgcttgggatgaaacactactagataagttctacaccgagctgtaccaacaattaaatgatttggaagcctgcgttatccagggtgtcggggtcactgagacccctttaatgaaggaagatagtatcctggccgttaggaaatattttcagcgaattacgttgtatctcaaggagaagaagtattcaccatgcgcttgggaggtggtgagggctgaaatcatgcggtcattttcactctctactaacttgcaggaaagtttgcgatctaaggag

SEQ ID NO: 14451 - DNA, 564 bp, Artificial Sequence
  Description of Artificial Sequence: Synthetic coding sequence
atggccctgacgtttgccctgttggtcgccttgttagtcttatcgtgtaaatcctcgtgttccgtgggctgcgatcttccgcagactcattctttaggaagtcgacgaacattaatgcttctggcccagatgcggcgtatctcactgttctcttgcctgaaggatcgtcatgactttggtttccctcaagaagagtttggcaaccagtttcaaaaagctgaaacaatccccgtgttacatgaaatgattcaacagatttttaacttattctcaaccaaagactcgtctgccgcttgggatgaaacactgcttgacaaattttatacagaactgtatcagcagctgaacgatttggaagcttgcgtgatccaaggtgtcggcgttacagaaacacctctgatgaaagaggattcaattctggcggtgagaaaatactttcagcggattacgctgtatctgaaagaaaaaaaatatagtccgtgcgcgtgggaggttgtaagagcggagattatgcgctcttttagtttaagcaccaatttgcaagaatcacttcgctcgaaagaa

SEQ ID NO: 14452 - DNA, 564 bp, Artificial Sequence
  Description of Artificial Sequence: Synthetic coding sequence
atggcgctgacgttcgctctgcttgtcgcacttctcgtcctgtcatgtaagagctcttgctcagtgggctgcgacttgccccagactcactccctgggatcgcggagaaccttgatgctcctggcccagatgagaagaattagccttttctcatgccttaaggaccggcatgactttggtttcccgcaagaagaatttgggaaccagtttcagaaggccgagactatcccagtcctccacgaaatgatccaacagatcttcaacctgttcagcaccaaggactcatcggccgcgtgggatgaaactttgctggacaagttctacactgaactctaccagcaactgaacgatctggaggcctgcgtgatccagggagtgggagtgaccgaaaccccactgatgaaagaggactctatcctcgcggtgcgaaaatacttccagcgcattacgctgtatctgaaagaaaagaaatactctccgtgtgcatgggaggttgtgcgggccgagatcatgaggtcgttttccctgtctaccaatctgcaagagtccctccgctcgaaggag

SEQ ID NO: 14453 - DNA, 564 bp, Artificial Sequence
  Description of Artificial Sequence: Synthetic coding sequence
atggcgcttacctttgcgctgctggtggcactgctggtccttagttgtaaaagctcctgttcggtcggctgcgatcttcctcaaacccattcccttggctcacgccgcactctgatgcttcttgcacagatgcgccgaatcagcctttttagctgcctgaaggacaggcatgactttggtttcccgcaggaagaatttgggaaccagtttcagaaggcagaaaccatccccgtccttcacgaaatgatccaacagatattcaatttgttttccaccaaggactcgtcagcagcatgggatgagacgctgcttgataagttctacactgaactttaccaacagcttaacgacttggaagcgtgcgttattcaaggtgtgggagtcactgaaaccccccttatgaaggaagattccattctcgcagtcaggaaatactttcaacgtattactctgtacttgaaggaaaagaaatactcaccctgtgcatgggaggtggtgagagccgagattatgcggtccttcagcctgagcactaaccttcaggagagccttaggtcgaaggaa

SEQ ID NO: 14454 - DNA, 564 bp, Artificial Sequence
  Description of Artificial Sequence: Synthetic coding sequence
atggccctgacctttgcactgctggtggccttgttggtgctctcatgtaagtcttcttgttcggtgggttgcgatttgcctcagacgcactctctgggcagccgccggacactgatgttgctggcccagatgaggcggatctccctgttttcttgtttgaaggatcgtcacgattttggttttccacaggaagaattcggtaatcaattccagaaggctgaaacaattccggtcttgcatgaaatgattcagcaaattttcaatttgttcagtaccaaagactccagtgccgcatgggatgaaaccctcctggataagttttacaccgagttgtatcagcagctgaatgacctggaagcatgcgtgatccagggagttggcgtgacggaaacacctctgatgaaagaggatagtatccttgctgtcaggaagtacttccaacgtatcactctctatctgaaggaaaaaaaatattctccttgcgcttgggaggtcgttcgggctgagataatgaggagtttttccttaagcaccaatctgcaggaaagtctccgcagcaaagaa

SEQ ID NO: 14455 - DNA, 564 bp, Artificial Sequence
  Description of Artificial Sequence: Synthetic coding sequence
atggctcttaccttcgccctccttgtagctcttctggtgttatcttgtaagagtagctgttccgtgggatgcgacctcccacaaacgcactcacttggttccaggaggacattgatgcttctggcacaaatgcgtagaatctctctgttcagctgcctaaaggaccggcatgatttcggatttccacaggaggagttcgggaatcagttccagaaagcagaaacaatacccgtactgcatgagatgatccagcagatcttcaacctgttcagcacgaaggacagctcagcagcgtgggacgagacactgctggataagttctacaccgagttgtaccaacagctcaacgacctagaagcttgcgtgatccagggagtgggggtgactgagactcctctcatgaaggaggactctattctggccgttcggaaatactttcagcgcattaccctgtacctgaaggagaaaaagtactcaccatgcgcctgggaagttgtccgcgctgagattatgcgcagtttttccctgagtaccaatctccaggagagtttaaggtctaaggag

SEQ ID NO: 14456 - DNA, 564 bp, Artificial Sequence
  Description of Artificial Sequence: Synthetic coding sequence
atggcactgactttcgctctgctcgtggctctgctggtcttgtcgtgcaagagcagctgttcggtgggctgtgatctccctcaaactcactcgctgggatccaggcgtactctcatgctgcttgcccagatgcgccgcatctcgctgttttcgtgtctgaaggacagacacgacttcggtttcccccaagaggaattcggaaaccagttccagaaggcagaaaccatcccagttctgcacgaaatgatccagcagattttcaatctcttctcgaccaaagacagctccgcagcgtgggacgaaaccctgctggacaagttctacaccgagttgtaccagcagctgaacgatctggaggcctgtgtcatccagggagtgggagtgaccgaaaccccgctgatgaaggaggactcaatcctggctgtgcgaaaatacttccagcggatcacgctctacctcaaggagaagaagtactccccgtgcgcgtgggaagttgtccgggccgaaatcatgcggtccttctccctctctactaacttgcaagaaagcctcaggtcaaaggaa

SEQ ID NO: 14457 - DNA, 564 bp, Artificial Sequence
  Description of Artificial Sequence: Synthetic coding sequence
atggcactgacttttgccctcctcgtcgctctgctggtactgagttgtaaatctagttgttctgtgggctgcgacttgccccaaacccattctctgggctcccgccgcaccctcatgctcctggcccaaatgcggagaatctccctcttcagctgtctcaaggatcgtcatgatttcggttttccccaggaggagttcgggaatcaatttcagaaggccgagactatccccgtcctgcacgagatgatccaacagatctttaatctgttcagcactaaggactctagcgccgcttgggacgagaccctgctggataagttttacacggagctctaccagcagctaaacgatttggaggcttgcgttatccagggtgttggggtcacggaaacgcctctcatgaaggaagactcaatcctggcagtgagaaagtactttcaacgtatcaccctgtacttgaaggagaagaagtactccccatgcgcctgggaggtggtgagagctgagattatgcgctcttttagcctgagcaccaacctccaagagagcttgcgttccaaggag

SEQ ID NO: 14458 - DNA, 564 bp, Artificial Sequence
  Description of Artificial Sequence: Synthetic coding sequence
atggcgctcacattcgccctcctggttgccctgctagtcctctcatgcaagagcagttgctctgtcgggtgtgacctgccacagacacacagcctaggatcccgtcgtacccttatgcttctggcgcagatgcgcagaatctccctcttttcttgtttaaaggatcggcatgacttcgggtttcctcaggaggagttcgggaaccagttccagaaggcggagaccatcccagtccttcatgaaatgatacaacaaatattcaacttattctctactaaggatagtagtgcggcatgggacgagaccctgctggacaaattttatactgagctgtatcagcaacttaatgatttagaggcatgcgtgatccagggcgtgggcgttacggagacccccttaatgaaagaggattctattctcgctgtacgtaagtatttccagcgcatcaccctgtatctcaaagaaaagaagtatagcccctgtgcttgggaggtcgtgagagctgagattatgcgatccttttcactgagcaccaatctgcaagagagcctgaggagtaaggag

SEQ ID NO: 14459 - DNA, 564 bp, Artificial Sequence
  Description of Artificial Sequence: Synthetic coding sequence
atggcgctgacctttgcgctcctcgttgcattgttggtcctgtcgtgcaaatcgtcctgctcagtgggctgcgacctcccccagacccatagcctggggagccgccgcaccttgatgctcctggcccaaatgcggcggatctccttgttctcgtgcctgaaagatagacacgactttggattcccgcaggaagaattcggaaatcaattccagaaggcggaaactataccggtgctccatgagatgatccagcagatcttcaacttgttttcgacgaaggactcgtcggctgcttgggatgagactttgctcgacaaattctacactgaattgtaccagcaattgaacgatctcgaagcctgtgtgattcagggtgtcggagtgaccgaaacccctctgatgaaggaagatagcattctggcagtgcgtaagtacttccaaagaatcactctctacctgaaggagaagaagtactccccttgtgcctgggaagtggtgcgggcagaaatcatgcggagcttttcgctgtcaaccaatcttcaggagtcactgaggagcaaggaa

SEQ ID NO: 14460 - DNA, 564 bp, Artificial Sequence
  Description of Artificial Sequence: Synthetic coding sequence
atggctctaactttcgccctattggtggctctgctggtcctctcctgtaagtccagctgctccgtggggtgtgatctcccgcagacccatagcctgggtagccgcaggacacttatgctcttggctcagatgagacgaataagtttgttctcttgccttaaagaccggcatgactttgggttccctcaggaagaatttggcaaccagtttcagaaagctgaaacaattcctgtcctgcacgagatgatccagcagatcttcaacttattttccacaaaagatagcagtgctgcgtgggacgagactctgttggataaattctacacggagctctaccaacagctgaatgacttggaagcctgtgtgatacagggtgtgggggtgacagagactcccctgatgaaggaggattcgatcctggctgtgcgcaagtatttccagagaatcaccctctacctgaaagagaagaaatatagcccttgcgcgtgggaggtggttagagctgagattatgcgttcattttccttgtccacaaatcttcaggaaagtctaagatccaaggag

SEQ ID NO: 14461 - DNA, 561 bp, Artificial Sequence
  Description of Artificial Sequence: Synthetic coding sequence
atgaccaataagtgcttgctccagatcgccctcctgctctgcttttccactactgcactgagcatgtcgtacaatctcctgggcttcctccagcgttcatcgaacttccagtgtcagaagctgctgtggcaactgaatggtcgacttgaatactgccttaaagatcgcatgaacttcgacatcccggaggagatcaagcaattgcagcagttccaaaaggaggatgcggccttgacgatctatgaaatgttgcaaaacatctttgcaatcttccgccaggactcatctagcaccggatggaacgagactatagtcgaaaatcttctggctaacgtgtaccatcagatcaatcatctgaaaactgtccttgaggaaaagctggagaaggaagatttcactcgcggaaaactcatgtccagcttgcacctcaaacggtactacgggcgcattttgcactacctcaaggccaaggaatactcgcactgcgcgtggaccatcgtgcgggtggaaatcctgcgtaacttctactttatcaataggttgaccggttatctgcgcaac

SEQ ID NO: 14462 - DNA, 561 bp, Artificial Sequence
  Description of Artificial Sequence: Synthetic coding sequence
atgaccaataagtgccttctacagattgcactcttactgtgcttttccacaacagccctgtcaatgtcctataatctgctggggtttctacagcggagcagcaatttccagtgccagaaattgctgtggcagctcaatggccgcttggaatattgtttaaaggataggatgaactttgacattccagaggagataaagcagctgcaacagttccagaaagaagacgccgccttaacaatatacgaaatgcttcagaatatttttgctatattcaggcaggactcaagctccacgggttggaacgagacgatcgtggaaaacctacttgccaacgtatatcatcaaatcaatcacctgaagaccgtacttgaggaaaagctggagaaggaggattttactcggggaaaactcatgagttcactgcatctgaaacggtactatggacggatcctgcattacctgaaggctaaggagtacagccattgcgcttggactatcgttcgggtggagatccttagaaacttctacttcattaatcgcctgaccgggtacttgcggaat

SEQ ID NO: 14463 - DNA, 561 bp, Artificial Sequence
  Description of Artificial Sequence: Synthetic coding sequence
atgactaacaagtgccttcttcaaattgcactcttgctgtgcttctcaaccaccgcgctgtccatgtcctacaaccttcttggatttctccagaggtcgagcaactttcaatgtcagaaattgctttggcaactcaatggacggctggaatactgtcttaaggatcgtatgaactttgatatcccggaagagattaaacaactgcaacagtttcagaaggaggacgcagcacttactatctacgaaatgcttcagaatatcttcgcaatctttcggcaggacagcagctcaacggggtggaacgagactatagttgagaacctcctggccaatgtgtaccaccagattaaccacctcaagacggtgcttgaagagaagctggaaaaggaggactttactcgaggtaaacttatgtcatcgctgcatcttaagcggtattacggaagaatccttcactaccttaaggctaaagaatacagccactgtgcatggactatcgtgagagtggaaatactgcggaatttctacttcatcaaccgcctcactggctacctgcgtaat

SEQ ID NO: 14464 - DNA, 561 bp, Artificial Sequence
  Description of Artificial Sequence: Synthetic coding sequence
atgaccaacaaatgcctgctgcagattgccttactcttatgtttcagcacaaccgctctatccatgtcctataacctcctgggcttcctacagcgctcaagcaatttccagtgccagaagttactctggcagctcaatggaagattggaatactgtctgaaagaccgaatgaactttgacatcccagaggagatcaagcagttacagcagttccagaaggaggacgctgcactcactatctatgaaatgctccagaacattttcgccatctttcgccaggacagctctagcaccgggtggaatgagacaatcgtagaaaatttgctggcgaatgtgtaccaccagattaaccacctgaagaccgtgctcgaagaaaaactggaaaaggaggacttcacacgcggtaagttgatgagttccctgcatctgaagaggtactacggccgcattttgcactatctgaaggcaaaagagtattctcattgcgcttggaccatcgtgcgagttgaaatactgcgaaatttttatttcataaaccggctgactggttatctgcgcaat

SEQ ID NO: 14465 - DNA, 561 bp, Artificial Sequence
  Description of Artificial Sequence: Synthetic coding sequence
atgaccaacaagtgtctgcttcagatcgccttgcttttgtgtttttcaaccactgcgctgtccatgtcatacaatctcctgggttttctgcagagatcttcgaactttcaatgccaaaaacttctctggcagctgaacggtagacttgagtactgccttaaggataggatgaatttcgatatccccgaggagataaagcaacttcagcagttccaaaaggaagatgcagctctgaccatatacgagatgctccaaaacatctttgccatttttcgccaggactcgtcatccactggatggaatgaaaccattgtcgaaaacctgcttgctaatgtctaccatcagataaaccatcttaaaaccgttcttgaagaaaaactcgaaaaggaggatttcacccgcggaaagttgatgtcctccctgcatcttaagcggtactatggaaggattttgcactaccttaaggccaaggaatactcccactgtgcatggactatcgtgcgcgtcgaaatactgcggaacttctacttcatcaacagacttaccggatatcttcggaac

SEQ ID NO: 14466 - DNA, 561 bp, Artificial Sequence
  Description of Artificial Sequence: Synthetic coding sequence
atgacgaacaagtgccttcttcagattgctctgcttctgtgcttttcaaccactgccctctcgatgtcctacaatctccttgggtttctgcaacggtcaagtaactttcaatgtcagaaacttctctggcaactgaatggccggcttgaatactgtctgaaggatcggatgaatttcgacattcccgaagagattaagcagctccagcagtttcagaaggaagatgcggcactgactatttacgagatgcttcagaacatcttcgccatttttcgccaagatagctcctctactgggtggaacgaaaccattgtcgagaacctgcttgcaaacgtgtaccatcagattaaccatcttaagactgtgttggaagagaagctggagaaagaagatttcaccagaggaaagctcatgtcatcgttgcaccttaagaggtactacggcagaattcttcattaccttaaggcaaaagaatactcgcactgtgcctggacgattgtgagagtggagattcttaggaacttttacttcataaaccgactgaccgggtatctccgcaac

SEQ ID NO: 14467 - DNA, 561 bp, Artificial Sequence
  Description of Artificial Sequence: Synthetic coding sequence
atgaccaacaaatgtctgctccaaattgcactgctgctgtgtttcagcactaccgcactgtccatgtcctacaacttgcttggattccttcaacgctcgagcaacttccaatgtcagaaactgctctggcaacttaatggtcgactggagtactgcctgaaagaccgaatgaacttcgatattccagaggagattaagcaactgcagcaatttcagaaggaggacgcagcactcaccatttacgagatgctgcagaacatattcgcaatctttcggcaagattcgtcatccactggatggaacgaaaccatcgtggaaaaccttctcgcaaacgtctaccatcagattaaccaccttaagacggtgctggaggaaaagctggaaaaagaggattttacgcgcggaaagttgatgtcgagcctgcacctgaagcgatactacggccgcatcctccattacctcaaggcaaaggagtactcacattgcgcatggactatcgtgagggtggaaattctgagaaatttctatttcattaatcgcctgactggataccttaggaac

SEQ ID NO: 14468 - DNA, 561 bp, Artificial Sequence
  Description of Artificial Sequence: Synthetic coding sequence
atgaccaacaagtgtcttctccagattgctctgttgctctgcttctctacaaccgcattaagcatgtcctataatctcctgggcttccttcagcggtcttctaactttcagtgccaaaaactgctctggcaattgaacgggcgacttgagtactgtctcaaggataggatgaatttcgacattcccgaagagattaaacaattgcaacagtttcagaaagaagatgctgctctgaccatatacgagatgttgcagaacatcttcgctatctttcgccaagacagtagctccaccggctggaatgagaccattgtggagaatctgttggccaacgtctaccaccagatcaaccacttgaaaactgtgctcgaagagaagctggaaaaggaggactttacacggggcaagctcatgagttcactgcacctgaaaagatactacgggcggatccttcattacctgaaagccaaagagtactctcactgtgcttggaccattgtccgcgtagaaattttgagaaacttctacttcatcaatcgcctcacaggctaccttagaaac

SEQ ID NO: 14469 - DNA, 561 bp, Artificial Sequence
  Description of Artificial Sequence: Synthetic coding sequence
atgacgaataagtgcctgcttcagattgcactgctgctttgcttttccaccactgcactttcgatgagctacaacttgttggggtttctgcagaggagttctaacttccagtgccagaaactgctttggcagcttaacggacgcctcgaatactgcttgaaggacagaatgaacttcgatattccagaggagattaagcaactccagcagttccaaaaagaagatgccgccctcactatctatgagatgctgcaaaacattttcgcgatctttcggcaagacagctcctcgacgggctggaacgaaaccatcgtggaaaatctgctcgccaacgtgtatcaccagatcaatcatcttaagaccgtcctcgaagaaaagctggagaaggaggatttcaccagaggtaaattgatgtcctcgctgcatctgaaacgctattacggacgcatcctgcactaccttaaagctaaggagtacagccactgtgcatggaccatagtgcgcgtggaaatcctgcggaacttctactttatcaataggttgaccggatacctgcgcaat

SEQ ID NO: 14470 - DNA, 561 bp, Artificial Sequence
  Description of Artificial Sequence: Synthetic coding sequence
atgaccaacaaatgcctgctgcaaatcgccctgctgctgtgcttctccactaccgcactttcgatgtcgtacaatttgctggggttcctgcagcgcagcagcaacttccagtgccagaagttgttgtggcagctgaatggtcggctggagtactgcctcaaggacaggatgaacttcgatatccctgaagaaatcaaacagctgcaacagttccagaaggaggacgccgctctgaccatctacgaaatgctgcagaacatctttgcgatctttcgacaggactcgtcctcgacgggctggaacgaaaccatcgtggaaaacctcctcgccaatgtttaccaccaaatcaatcacctcaaaaccgtgctcgaagagaagctcgagaaagaagatttcacgcggggaaaactgatgtcctcgctccacctgaagcgatactacggacgcatcttgcactaccttaaggccaaggagtacagccattgcgcctggactatcgtccgggtggagattctgcgcaacttctacttcatcaaccgtctgaccggatacctgaggaac

SEQ ID NO: 14471 - DNA, 561 bp, Artificial Sequence
  Description of Artificial Sequence: Synthetic coding sequence
atgacaaataaatgcttgttgcaaattgctttattactgtgtttttcaacaacggctttgagtatgagttacaatttgctaggatttctacaacgatcctctaatttccaatgtcaaaagttactctggcagctcaatggacgactggaatattgtctaaaagaccggatgaattttgacattcccgaagaaatcaagcagttacaacagtttcaaaaagaggacgctgccctcacaatttatgaaatgttacagaatatctttgccatttttcggcaggactcatcttcaaccggatggaatgagactattgtcgagaatcttttggctaatgtctaccatcaaattaatcatcttaaaactgttcttgaagaaaaattggagaaagaggattttacaagaggaaaactgatgtcaagcttacatttgaagagatactacggccgtatcttacattacctcaaagccaaagaatattctcattgtgcatggactatagtgagagtagagatcctccgcaacttctattttataaaccgactgacggggtacttacgcaat

SEQ ID NO: 14472 - DNA, 561 bp, Artificial Sequence
  Description of Artificial Sequence: Synthetic coding sequence
atgaccaacaaatgtctcctccagatcgccctgctgctgtgcttcagcactaccgcactttccatgtcatataaccttcttggattcctgcaacgttcatcaaacttccagtgccagaagttgctctggcagctgaatggacgactggaatactgcctgaaggaccgcatgaacttcgatataccagaagaaatcaagcagctccaacagtttcagaaggaggacgccgctttgaccatttacgagatgctccaaaacatctttgcaatctttaggcaagactcgtcgtcgacgggctggaacgagactattgtggaaaaccttttggcaaacgtctaccatcagattaatcatttgaaaaccgtcttggaggaaaaacttgaaaaggaggattttacccgtggaaaacttatgtcgtccctgcacctcaaacggtactacggcagaatcctgcactaccttaaagccaaagaatactctcattgcgcttggaccatcgtgcgcgtggagattcttcgcaacttttacttcattaaccgccttacggggtacctccgtaat

SEQ ID NO: 14473 - DNA, 561 bp, Artificial Sequence
  Description of Artificial Sequence: Synthetic coding sequence
atgactaacaagtgtctactgcagatagctcttctgctctgtttcagcaccaccgccttgagcatgagctacaatttactgggcttcctgcaacgtagctccaattttcagtgccagaagctgctttggcagctgaacggccggctggagtattgtctgaaggacagaatgaatttcgatattcctgaagaaatcaagcagttacagcagttccagaaagaagacgcagctctgaccatctatgagatgctccaaaacatttttgcaattttccggcaggactcttctagcactgggtggaacgagactattgtggaaaacctgctggccaacgtatatcaccaaataaaccatctgaaaacagtgctagaggaaaaacttgaaaaagaggacttcacaaggggcaaattaatgtcttccctccacctgaagcgctactacggccgaattctccactatctgaaggctaaggagtactctcactgcgcctggacaattgtgcgggtggagatcctgagaaacttctattttatcaaccgcttaacagggtacctgagaaac

SEQ ID NO: 14474 - DNA, 561 bp, Artificial Sequence
  Description of Artificial Sequence: Synthetic coding sequence
atgaccaacaagtgtctcctccagatcgccctgctgttatgcttctccacgaccgcactctccatgtcctacaacctgttggggtttttgcagagatcctccaatttccagtgtcagaagctgctgtggcagctgaacgggcgcctcgaatactgtctgaaagacagaatgaatttcgatatacccgaagagattaagcagttgcagcaattccagaaggaggacgcagctttgacgatctatgagatgctgcagaacatcttcgctatcttccgacaggatagctccagcaccgggtggaatgaaacaatcgtggaaaatctcctggcaaatgtctaccatcagataaaccacctaaagacggtgctcgaagagaagctggaaaaggaggactttacgaggggcaaactgatgagctcccttcacctgaaacggtactacgggagaattctgcactacctgaaggccaaggagtactcccattgcgcctggacgattgtgcgcgtggaaatcctgcgaaatttttatttcatcaatcgcctgactggctacctgaggaat

SEQ ID NO: 14475 - DNA, 561 bp, Artificial Sequence
  Description of Artificial Sequence: Synthetic coding sequence
atgactaataagtgtctcctacagattgccttgcttctttgtttcagtactactgccctgtcaatgtcgtataatctcctaggctttcttcaaaggagttccaacttccagtgccagaagctgttgtggcagctgaatggtaggctggaatactgcctgaaggaccggatgaattttgacattccagaggagatcaagcagctgcagcaattccagaaggaggacgccgccctgactatctacgagatgctacagaacatcttcgctatattcaggcaggactcctcaagcaccggctggaatgaaacaatcgtggaaaacctgctggcaaatgtataccatcagatcaaccatctgaagacagtccttgaggagaaacttgagaaggaggacttcacgcgcggtaagctgatgtcctcccttcacctgaagagatattatggccggattctgcattacttgaaggctaaggagtactcacactgcgcctggacaatcgtgagagtggagatattgcgcaatttttacttcatcaatcgcctgaccggttacctccgtaac

SEQ ID NO: 14476 - DNA, 561 bp, Artificial Sequence
  Description of Artificial Sequence: Synthetic coding sequence
atgactaataaatgtctcctccagatagctttgctcttatgcttctctactacagcactcagtatgagttacaatctcctcgggttcctccagagatcatctaatttccaatgtcagaaactgctctggcagctcaatggacggctcgaatactgtcttaaagatcggatgaattttgatattcctgaagaaataaaacagctccagcagttccagaaagaagatgctgctctcactatttacgaaatgttacagaacattttcgctattttcaggcaggactcttctagtacgggatggaatgagacgatcgtggaaaaccttttggccaacgtgtatcaccagataaatcatctcaaaacagtgctcgaggaaaaacttgaaaaagaagattttacacgagggaaactcatgtcttcactccacctaaagaggtattatgggcgaatattgcactacctcaaagctaaagaatattctcattgcgcctggactatagtgagagtagaaattctccgaaatttttattttataaataggttaactgggtatctccgaaat

SEQ ID NO: 14477 - DNA, 561 bp, Artificial Sequence
  Description of Artificial Sequence: Synthetic coding sequence
atgacgaacaagtgcttgctgcagatcgccctcctcctgtgcttctctaccactgccctgagcatgtcctataatttgctgggttttctgcagagatcttctaatttccagtgccagaagttgctgtggcaattgaacggacggttggagtattgcttgaaggaccgcatgaactttgatattcctgaggagatcaaacagctccagcagtttcagaaggaggatgccgcattgacaatctatgagatgctacaaaatatttttgctatttttcgacaggactctagctccactggatggaacgagacgatagttgagaacctgctggccaatgtataccaccaaatcaaccacctgaaaacggttttagaagagaaactagagaaggaagatttcacccgtggcaaactcatgtcgtccctgcacctgaagcggtactatgggcgaatccttcattacctcaaagcgaaggagtattcgcactgcgcctggacaatcgttcgagtggaaatcctgagaaacttctactttatcaaccggctcactggctatttacgcaat

SEQ ID NO: 14478 - DNA, 561 bp, Artificial Sequence
  Description of Artificial Sequence: Synthetic coding sequence
atgacaaataaatgtcttttacagatcgctctgttgctttgcttctcgacaacagcactgtccatgtcgtacaacctgttggggttcctccagagatctagtaattttcagtgtcaaaaactattatggcagctgaatgggcggcttgaatattgtttgaaagatagaatgaatttcgatatacctgaagaaatcaaacagttacagcagtttcagaaggaagatgccgccctgactatctatgagatgttgcagaacatctttgcgattttccgccaggattcctcttctacagggtggaatgagacaatagtagaaaatctcttagccaacgtgtatcaccagataaaccacttaaaaacagtgctggaagaaaaacttgaaaaagaagatttcacacgaggaaaactcatgtcctctctccatctgaaaaggtattatggacgcatacttcactatcttaaagcaaaggaatattcgcattgtgcctggacgatcgtgagagtagaaatactcaggaatttctattttatcaatcgactaacagggtatcttcgcaac

SEQ ID NO: 14479 - DNA, 561 bp, Artificial Sequence
  Description of Artificial Sequence: Synthetic coding sequence
atgactaataagtgtctgctgcaaatcgcactcctgctgtgcttctcgaccacggcgctgtccatgtcctacaatctgcttggcttcttgcagcgcagctccaattttcagtgccagaagttgttgtggcagctcaacggacgcctggagtactgtctgaaagaccgcatgaattttgatatcccagaagagattaagcagttgcagcaattccagaaggaggacgctgctctcacgatctacgagatgcttcaaaacatcttcgcaatcttccgccaagactccagcagcactggttggaacgagactatcgtggagaatctcctcgccaacgtgtatcaccaaatcaaccatctgaaaaccgtgcttgaggaaaaactggaaaaggaggatttcacccggggaaaactcatgtcaagcctccacctgaagagatactacggccggattctccactacttgaaggcgaaggaatactcccactgcgcatggactattgtgagagtcgaaatcctgcggaacttctacttcattaatcgcctgaccggatacctccgcaat

SEQ ID NO: 14480 - DNA, 561 bp, Artificial Sequence
  Description of Artificial Sequence: Synthetic coding sequence
atgactaacaaatgccttctgcagatcgcactgctcctttgtttttctaccaccgcactctcaatgagctacaatctgctgggctttcttcaaagatcctccaatttccagtgtcaaaaacttctttggcagcttaacggacgcctggaatactgcctcaaggatcgcatgaacttcgacattcctgaagagatcaagcagctccagcaattccaaaaggaggacgcggcactcaccatctacgaaatgctgcaaaacatcttcgcaatcttcaggcaagattcgtccagcacgggatggaatgaaaccatcgtcgagaaccttcttgctaacgtgtatcaccagattaatcatcttaagacggtgcttgaggaaaagctcgaaaaggaagatttcacccgtggtaagctgatgtcatcccttcacctgaagaggtactacggccgcattttgcactatcttaaggcaaaggaatactcgcactgcgcctggactattgtgcgggtggaaatcctccgcaacttctacttcatcaatagactgaccggataccttagaaac

SEQ ID NO: 14481 - DNA, 561 bp, Artificial Sequence
  Description of Artificial Sequence: Synthetic coding sequence
atgaccaacaagtgtctgctccaaatcgcactcctcctgtgtttttccactaccgcgctgtccatgtcgtacaacctcttgggctttttgcaacggtcgagcaatttccaatgccagaaactgctgtggcagcttaacgggcgactcgaatactgtctcaaggatagaatgaactttgatattcctgaagagattaagcaactgcagcaatttcagaaggaggacgcagcactcacgatttacgaaatgcttcaaaacatatttgccatcttccgccaagactcctcatcgactggttggaacgaaaccattgtcgagaaccttttggcaaatgtttaccatcagattaatcatctcaaaactgtgctggaagaaaagctggagaaggaagattttaccaggggaaaattgatgtcaagcctgcaccttaaacgttactacggacgaattttgcattatcttaaggccaaggaatacagtcactgcgcctggaccatcgtaagagtggagatactgaggaatttctacttcattaatcggcttactggttacctgaggaac

SEQ ID NO: 14482 - DNA, 561 bp, Artificial Sequence
  Description of Artificial Sequence: Synthetic coding sequence
atgaccaataagtgcctcttgcagatcgcccttctgctctgtttctcaacgaccgccttgtcgatgtcttataacctcctgggatttctgcaaaggagctcaaatttccagtgtcagaagctgctgtggcagttgaacggcagattggaatactgcctcaaagacaggatgaatttcgacatcccagaggaaatcaagcagctgcaacaattccaaaaggaggacgctgcactgaccatttacgaaatgctgcagaacatctttgcgatcttccgccaggactcctcctccaccggttggaatgaaactatcgtggaaaacctgcttgccaatgtctaccaccagatcaaccatctcaagaccgtcctcgaggaaaagctggagaaggaggacttcactcgcggcaaattgatgtcctcgctgcaccttaagaggtactacggacgtatcctgcattacctgaaggcgaaggaatattcccattgtgcgtggactatcgtgcgggtcgagatcctgcggaacttttacttcatcaatcgcctgaccgggtacctccggaac

SEQ ID NO: 14483 - DNA, 561 bp, Artificial Sequence
  Description of Artificial Sequence: Synthetic coding sequence
atgactaataaatgtcttcttcaaattgctttattattatgtttttcaactacagcacttagtatgtcatataatcttttaggttttttacaaagatcatctaattttcaatgtcaaaagttattatggcaattaaatggaagacttgaatattgccttaaggatagaatgaattttgatatacctgaagaaataaaacaacttcaacaattccaaaaagaagatgcagctttaacaatttatgaaatgttacaaaatatttttgctattttcagacaagatagttctagtacaggatggaatgaaactattgtagaaaacttactagcaaatgtatatcatcaaattaatcatcttaaaactgttcttgaagaaaaattagaaaaagaagatttcactagaggtaaattaatgtcttcattacatttaaaaagatattacggaagaatcttacattatttaaaggcaaaagagtattcacattgtgcctggactatcgtaagagttgaaattctaagaaatttttattttattaatagattgacaggatatttaaggaat

SEQ ID NO: 14484 - DNA, 561 bp, Artificial Sequence
  Description of Artificial Sequence: Synthetic coding sequence
atgacgaataagtgcttattgcagattgccttgcttctctgcttttctacgaccgccttatcgatgtcatataatctgttgggctttctccagcgttccagcaactttcagtgccagaagctcttgtggcagcttaacgggagactggaatactgtctgaaagatagaatgaattttgacatcccagaggagattaagcagctgcaacagttccagaaggaggatgccgcattaacaatttacgaaatgttacagaatatttttgctatttttaggcaggactcctcaagtactggatggaatgaaaccattgtggagaatctcttagccaacgtctatcatcagattaaccacctaaagacggtactcgaggaaaaattggagaaagaggacttcacacgtggaaaactgatgagctctttacaccttaaaaggtattacggaaggatactgcactacctcaaggcaaaagaatatagccactgcgcctggaccatcgtgagagtggaaatcctgcgcaacttttattttataaatcgcctgacaggctatttgcgcaat

SEQ ID NO: 14485 - DNA, 561 bp, Artificial Sequence
  Description of Artificial Sequence: Synthetic coding sequence
atgaccaataaatgccttcttcagatcgcccttctgctctgttttagcacaaccgcactgagcatgtcctacaatctgctgggtttcttacaaaggagcagcaacttccaatgccagaagctgctctggcaactcaatggtagacttgaatactgcctgaaggataggatgaattttgatattcccgaggaaattaagcaattgcagcagttccaaaaagaagatgcagcacttaccatctacgagatgctgcaaaacatatttgcgatctttagacaagattcctccagtacaggatggaatgaaactatcgttgaaaatcttcttgcaaacgtctaccaccaaattaaccatctcaagacagtgctggaggagaaactggagaaagaggattttactcgggggaagctgatgagttcactccatctgaaaagatactatgggcggatcttgcactatctgaaggcaaaggaatatagccattgtgcctggaccattgtccgcgtggaaatcctcagaaacttctacttcatcaacaggctgacagggtacctgcgcaac

SEQ ID NO: 14486 - DNA, 561 bp, Artificial Sequence
  Description of Artificial Sequence: Synthetic coding sequence
atgaccaataagtgcctgctgcagatcgccctgcttctgtgcttttctaccactgctctctcaatgtcctataatctgctcggattcctgcaacggtcgtccaatttccagtgccagaaactgctttggcaacttaacgggcgcctggaatactgcctcaaggataggatgaactttgacattccagaggagatcaaacagttgcagcagtttcaaaaggaggacgcggctcttaccatctacgaaatgctccagaacatcttcgcgatcttccggcaagactcgagctccaccggatggaacgagactatagtggagaatctgttggcaaacgtgtaccaccagattaaccatctgaaaaccgtcttggaagaaaagctcgagaaggaagatttcactagaggcaagctcatgtcatcgctccaccttaaacgctactacggtagaatcttgcattacctcaaggccaaggaatacagccactgtgcctggactatcgtgagagtcgaaatccttcgcaatttctacttcataaaccgactgacgggatacctccgaaac

SEQ ID NO: 14487 - DNA, 561 bp, Artificial Sequence
  Description of Artificial Sequence: Synthetic coding sequence
atgacgaataagtgccttttgcaaatcgccctgttgctatgctttagtaccacggccctgagtatgagctacaacctgctcgggttcctgcagcgcagttcgaacttccagtgccagaagctgctgtggcaactaaatggccgattggaatactgtctgaaggatagaatgaattttgatatccccgaagagatcaaacaactgcagcaattccagaaggaggacgctgctttaaccatctacgagatgctgcaaaatatctttgcaattttcaggcaggatagttccagcaccggatggaatgagacaattgtggagaatctgctcgcgaacgtgtaccaccagatcaaccaccttaagacagtactggaggagaaactagagaaggaggactttacacggggcaaactgatgtcgtcccttcatcttaaacggtactacggacgcatactccactatttgaaggctaaggaatacagtcactgcgcctggaccatcgtgcgtgtggaaatccttcgtaatttttactttataaacaggcttacaggatacctccggaac

SEQ ID NO: 14488 - DNA, 561 bp, Artificial Sequence
  Description of Artificial Sequence: Synthetic coding sequence
atgacaaacaagtgtctgctgcagattgccctcttgctgtgcttcagcactacggccttgtccatgtcttataatcttctggggtttctgcaaaggtcaagtaatttccagtgtcagaagctgctctggcagctgaatggaagactcgagtactgtctcaaagacagaatgaatttcgatattccagaagaaatcaagcagttgcagcaattccagaaggaggacgccgcacttaccatttatgaaatgcttcagaatatcttcgctatctttaggcaggactcttcctctaccggatggaacgaaacaattgtcgaaaatctgctggctaacgtctaccaccagatcaatcacctgaaaaccgtgcttgaggagaaactcgagaaggaggacttcacgagggggaaactgatgtcttcactccacctgaagcggtactacggccgcatactgcattacctcaaggctaaagagtactcacactgtgcttggacaattgtgcgggtagaaatactcaggaacttctacttcatcaaccggcttacaggatacctgcgcaac

SEQ ID NO: 14489 - DNA, 561 bp, Artificial Sequence
  Description of Artificial Sequence: Synthetic coding sequence
atgaccaataagtgtctgctccagatcgcactcctcctgtgcttttccactactgcactgtctatgagctacaacttgctgggattcctgcagcgctcgagcaattttcaatgtcagaagctcctttggcagctgaatggacgcctggaatattgtctgaaggaccgcatgaacttcgatatcccggaagaaatcaagcaattgcaacagtttcaaaaggaagatgctgccctgactatctacgagatgctgcaaaacatctttgctatctttcgacaggactcctcctccacggggtggaacgaaactattgtggaaaatctgctggccaatgtgtaccatcaaatcaaccacctcaagacggtgctggaagaaaaactggaaaaggaggatttcaccaggggaaaacttatgagctcactccatctgaaacggtactacggacggatcctgcattacctcaaagctaaagaatactcccattgcgcctggactatcgtccgcgtcgagatcctccgcaacttctacttcatcaacagactgaccggatacctccgcaac

SEQ ID NO: 14490 - DNA, 561 bp, Artificial Sequence
  Description of Artificial Sequence: Synthetic coding sequence
atgactaacaagtgtctgctgcagatagcacttctcctctgcttctctactacagcactcagtatgtcatacaatctgcttggctttctgcagcgatctagtaattttcagtgccagaaactgctctggcagttgaacggtcggctcgagtactgtctcaaagacagaatgaatttcgacatacccgaagagataaagcagttgcagcagtttcagaaggaagacgccgccctcaccatctacgaaatgctgcagaatatctttgcaatcttcagacaagattcttccagcaccggatggaatgagacaatagtggagaaccttctcgccaacgtctatcatcagataaaccacctcaaaaccgtgctggaggaaaaacttgagaaagaagacttcaccaggggtaaactcatgagcagtctgcatcttaaaagatattatggacggatactgcactatctgaaagcaaaagaatatagtcattgcgcatggaccattgttagagttgagattctgcgcaatttttattttattaatagactgaccggctacttgcgaaat

SEQ ID NO: 14491 - DNA, 561 bp, Artificial Sequence
  Description of Artificial Sequence: Synthetic coding sequence
atgacaaacaaatgcctgttgcagatcgctctgctgctatgttttagtactacagctttatccatgtcctacaatctcctcggcttcttacagcggtcttcaaattttcagtgccagaaactcctttggcaactgaatgggagacttgagtactgtcttaaagatcggatgaattttgatattccggaggagattaagcagctgcagcagttccaaaaagaggacgccgctcttacaatctacgaaatgctccaaaacatctttgccatcttccggcaggacagttccagcaccggttggaatgagacgatcgtagagaatttacttgccaatgtgtatcaccagattaatcacttgaaaaccgttttagaggaaaaactcgaaaaggaggacttcacgaggggcaagctcatgtcgagcctccacctcaagcgatattacggaagaatcctgcactacctgaaagccaaggagtatagccattgtgcgtggaccatcgtgcgggtggagattctcaggaacttttactttatcaaccggctcactggctatctgcgcaat

SEQ ID NO: 14492 - DNA, 561 bp, Artificial Sequence
  Description of Artificial Sequence: Synthetic coding sequence
atgactaataaatgtctattacagattgcgctgctgctatgcttttctaccacagcattgagtatgtcctataatctcttagggttcctacagcggtcctctaatttccagtgtcagaagctgctctggcagctgaacggccgccttgagtactgcctgaaagaccggatgaactttgacatacccgaagaaatcaagcagttacagcaattccagaaggaggacgctgccctgaccatctatgaaatgctacaaaatattttcgcgatcttccgccaggattctagctccaccggctggaatgaaaccatcgtggaaaaccttttggcaaacgtgtatcatcagatcaaccatctaaagactgtccttgaagaaaagcttgagaaggaggacttcactcggggaaaactaatgtcatcgctgcatctgaaacgatactacggtaggatcctgcattacctgaaagctaaggagtactcccactgtgcgtggacaattgttcgggtcgagatacttcgaaatttttactttatcaaccgtttgacaggctacctaagaaac

SEQ ID NO: 14493 - DNA, 561 bp, Artificial Sequence
  Description of Artificial Sequence: Synthetic coding sequence
atgacgaacaagtgtctgctccagatcgccctgctgctttgcttctccactacggcactcagcatgtcgtacaacttgctgggcttccttcagaggagctccaactttcaatgtcagaagctcctctggcaactcaacggtcggctggagtactgtctcaaggatcggatgaattttgacatccctgaagagataaaacagcttcagcagttccagaaggaagatgcggcccttaccatctacgaaatgcttcagaacatctttgcaattttccgacaggactcgtcatccaccggttggaatgaaactattgtggaaaaccttcttgcaaacgtgtaccatcaaatcaatcacctcaaaactgtgctcgaggaaaagttggaaaaagaagattttaccagagggaaactgatgagctcgctccatcttaaaaggtactacggaagaatccttcattacctgaaggccaaagaatacagccattgtgcatggactattgtgcgcgtggagattctccgaaacttctactttatcaataggctgaccggttacctgaggaac

SEQ ID NO: 14494 - DNA, 561 bp, Artificial Sequence
  Description of Artificial Sequence: Synthetic coding sequence
atgactaataagtgtctgctgcagatcgccttgctgctgtgcttctcgaccaccgccctcagcatgagctacaacctgctggggttcctgcaacgctcgtcgaatttccagtgtcaaaagttgctttggcagctcaatggccgcctcgaatactgcctgaaggatcggatgaactttgatatcccggaggaaatcaaacagctgcagcaatttcaaaaggaggatgccgcacttactatctatgagatgcttcagaacatcttcgctatcttcagacaggattcgtcgtcgactggatggaacgaaaccattgtggagaacctgcttgccaatgtctaccatcagatcaaccacctcaaaaccgtgctggaagagaaactggagaaggaagattttacgcgcggtaagctgatgtcgtccctgcacctcaagcggtactacggccgcatcctgcattacctgaaggccaaggagtactctcactgcgcctggaccattgtgagggtcgaaattctcagaaacttctacttcatcaatcgcctcacgggatacctgcgcaac

SEQ ID NO: 14495 - DNA, 561 bp, Artificial Sequence
  Description of Artificial Sequence: Synthetic coding sequence
atgactaataagtgcctgctccagatcgcgctcctgctgtgtttctcaaccactgcgctgtccatgtcctacaatctgctcggattcctgcagcgcagctcgaattttcaatgccagaagctgttgtggcaactgaacgggcgcctggaatactgcctgaaggacagaatgaattttgatattccggaagagattaagcaattgcagcaattccaaaaggaggatgccgccctgaccatctacgagatgctgcagaacatcttcgccatcttccgccaggatagctcctccacgggatggaacgaaactatcgtcgaaaatctcctcgccaatgtgtaccaccagatcaaccatctcaagactgtgctcgaggagaaactcgagaaggaagatttcacccggggcaaactgatgagcagtctccatctcaagcggtactacggacgcatcctgcactatctcaaggcgaaggaatactcgcactgcgcatggactatcgtgcgcgtggaaatcctgagaaatttctacttcatcaaccggctgaccggctacctgcggaac

SEQ ID NO: 14496 - DNA, 561 bp, Artificial Sequence
  Description of Artificial Sequence: Synthetic coding sequence
atgaccaataagtgcctgcttcagattgcgctgctcctctgtttctccactaccgcgctctcaatgagctacaacctgcttggatttctgcagcggtcatccaactttcagtgccaaaagctgctgtggcagctgaacgggcgcctcgagtactgcctgaaagatcggatgaatttcgacattcccgaagagataaagcaactccagcaatttcaaaaagaggacgccgccctgaccatttacgaaatgctccagaacatttttgcaatctttaggcaagattcgagctcaactggatggaacgaaactatcgtggaaaaccttctcgcaaatgtgtaccaccagataaatcatcttaagactgttcttgaagaaaagctggaaaaggaggacttcacgcggggtaagctgatgtcgtcccttcatctgaagcggtactacggacgcattttgcactacctgaaggcaaaagaatactcccattgtgcgtggactattgtgcgggtcgagattctgcgaaacttttacttcatcaacagacttaccggatatctgcggaac

SEQ ID NO: 14497 - DNA, 561 bp, Artificial Sequence
  Description of Artificial Sequence: Synthetic coding sequence
atgaccaataagtgcctactacagatcgccttgctgctatgtttttctacaacggcactgagcatgtcttataacctactcggtttcctgcaacgaagttctaatttccaatgccagaagttactgtggcagctgaacggacgcttggaatactgccttaaagacagaatgaattttgacatccctgaggagatcaaacagctgcagcagtttcagaaagaagatgcggcgttgacaatctacgagatgctgcagaatatttttgccatctttcgacaggattcttcctccaccggttggaatgaaaccatcgtggagaacttgttggctaatgtgtaccaccaaattaatcacctaaagacagtgttagaggaaaagctggagaaggaagattttacgcggggtaagttaatgtcaagcctgcatctcaagcgatattacggccgcattctgcattacctcaaagcgaaagagtactcccattgtgcttggacaattgtcagagttgagatcttgcgaaatttttacttcattaacagactgacaggatatctccgcaat

SEQ ID NO: 14498 - DNA, 561 bp, Artificial Sequence
  Description of Artificial Sequence: Synthetic coding sequence
atgaccaataaatgtcttctgcaaatcgcgctgctgctgtgtttcagcactactgcattgagtatgagctacaatttattaggcttccttcagaggtcttccaattttcagtgccagaaactgctttggcagctcaatggtcggctcgagtactgtctcaaggatcgtatgaactttgacatccccgaggagatcaagcaattacagcagtttcaaaaggaggatgccgcgctcaccatctatgagatgttgcagaatatcttcgccattttccgccaggactcgagttccacaggctggaatgagacaattgttgagaatcttctggcgaacgtgtaccaccaaatcaatcatcttaaaactgtgctggaggagaagctggagaaggaggacttcacgcgcggcaagctgatgagctcattgcacctgaaaagatactacggaaggatactgcactacctaaaggctaaagagtatagccactgtgcatggaccatagttcgcgtggagatcctgagaaatttctattttatcaaccggctgaccgggtatctgaggaat

SEQ ID NO: 14499 - DNA, 561 bp, Artificial Sequence
  Description of Artificial Sequence: Synthetic coding sequence
atgacaaacaagtgcctgctccaaattgccttactgttgtgctttagtaccacagccttgagcatgagttacaatctgctcggattcctgcagagatcttctaacttccagtgtcagaaactgctgtggcagttgaacggcagactggagtactgtcttaaggatcgtatgaactttgatatccccgaagaaattaaacagcttcaacaattccagaaagaagacgccgcccttacaatatatgagatgctgcagaatattttcgctatcttcaggcaggattcctcttctaccggctggaatgagaccatcgtcgaaaacctgcttgctaatgtctaccaccagatcaatcatctcaaaacggtcttagaggaaaagctggagaaagaagatttcaccaggggcaaactgatgagcagcctccacctgaagcgctactacgggagaattcttcactatctcaaagctaaagagtattcccattgcgcctggaccattgttagggtggaaatcttgagaaacttctactttattaaccgactaactggataccttcgaaat

SEQ ID NO: 14500 - DNA, 561 bp, Artificial Sequence
  Description of Artificial Sequence: Synthetic coding sequence
atgactaacaagtgcttgctgcaaattgcccttcttctctgcttttcaacaacggcactgtctatgagctataacctgctgggatttttacaaaggtccagcaacttccagtgccaaaaattactttggcagcttaatggaagattagaatactgcttgaaagacagaatgaattttgacattccagaggaaataaaacagctgcaacagttccaaaaggaggatgcggctttaacgatatacgaaatgcttcagaatatcttcgcgatcttcagacaggatagttcatcgacaggctggaacgagacaatcgttgaaaatctcttagcaaacgtttatcatcagattaatcaccttaaaacggtccttgaggagaaattagaaaaagaagatttcacccgtggcaaactgatgagctcgttgcatcttaaacgctattatggccggattcttcattatttgaaagctaaagaatattcacattgcgcatggacaattgttcgagttgagatcttacgcaacttttattttataaatcgtctgacaggctatttaagaaat

SEQ ID NO: 14501 - DNA, 561 bp, Artificial Sequence
  Description of Artificial Sequence: Synthetic coding sequence
atgacaaataaatgtctgctgcagattgcattgctgctgtgtttctctactaccgctttatcaatgtcctacaacttactcgggtttctgcagcggtcgtccaacttccagtgtcagaagttgctctggcagctgaacggaagattggagtactgtctgaaagatcgcatgaacttcgacattcctgaggaaattaagcagctgcagcagtttcagaaagaggacgcagctctgactatctacgaaatgttacagaacattttcgcgatcttccgtcaggactcaagctccactggttggaatgaaaccatcgtcgagaacctgctggctaacgtttatcaccagatcaatcacctgaagactgtactcgaggagaaactggagaaagaggattttaccagaggcaaactgatgtcatcactgcatctgaagcggtattacgggcggatattgcactatctcaaggcaaaggagtatagtcactgcgcttggacaattgtacgggttgagattctcagaaatttctatttcattaacaggctgaccggatatcttagaaat

SEQ ID NO: 14502 - DNA, 561 bp, Artificial Sequence
  Description of Artificial Sequence: Synthetic coding sequence
atgactaataagtgtctgctccagatcgccctgctactctgtttttccactacagcactcagcatgtcatacaatctcttaggattcctgcagagatctagcaatttccagtgtcaaaagctcttgtggcagttgaatgggcgactggagtattgcctgaaagacagaatgaacttcgatatcccagaagagatcaagcagctgcagcagtttcaaaaagaagacgctgccctgaccatttacgaaatgctgcagaacatctttgccatattcaggcaagactcctcatcaaccggttggaacgagaccattgttgaaaatcttctggccaatgtctatcaccagattaaccaccttaaaacagtgttggaagaaaagctggagaaggaggactttacacgaggcaagctcatgagctctctgcatctgaagagatattatggcaggatcttgcattatctgaaagctaaagagtattcacactgcgcatggacaattgtgagagtggaaatcctgcggaacttctacttcatcaatagactgaccggttatttgcgaaat

SEQ ID NO: 14503 - DNA, 561 bp, Artificial Sequence
  Description of Artificial Sequence: Synthetic coding sequence
atgactaacaagtgtctgctacaaatcgccctgctgctctgtttttccacaaccgcgctgagcatgagctacaacctcctggggtttctgcagcggagttccaatttccagtgtcaaaagttgctatggcaattgaatggcagactggagtattgtttgaaggacagaatgaacttcgatatcccagaggaaataaagcaactccagcagttccagaaagaagatgcagcccttacgatctacgagatgctgcagaacatctttgccatttttaggcaagactcctcctcaactgggtggaacgagaccattgttgagaacctgctggcaaacgtttaccaccagatcaatcacctaaaaactgtattggaggaaaagctagagaaggaagatttcacaaggggtaagctgatgtctagcctacatctcaaacgatattacggcaggatccttcattatcttaaggcaaaggaatacagccactgtgcgtggaccattgtgagagtggagatcctgcggaatttttacttcataaacaggctgactggttaccttaggaac

SEQ ID NO: 14504 - DNA, 561 bp, Artificial Sequence
  Description of Artificial Sequence: Synthetic coding sequence
atgactaataagtgccttcttcagattgctctcctgctttgtttttcgactactgcgctctcaatgtcttataacctgctggggtttttgcagcgcagcagcaattttcaatgccaaaaactgctttggcagcttaatggacgattggaatactgtctcaaggatcggatgaactttgacattccagaggaaatcaagcagttgcagcagtttcagaaagaggatgcagcattgaccatatacgagatgctgcaaaacatatttgcgattttccgacaagattcctcttcgaccggctggaacgagacgatcgtcgaaaaccttctcgctaatgtctaccaccaaatcaatcatcttaagaccgttcttgaagagaagctggaaaaggaggacttcacccggggcaaactgatgtcaagcctgcatcttaaacgctactatggtcgcatcttgcactacctcaaagccaaggaatactcgcattgtgcatggaccattgtgagggtggagattctgagaaatttctacttcataaacagactgacgggatacctccgtaac

SEQ ID NO: 14505 - DNA, 561 bp, Artificial Sequence
  Description of Artificial Sequence: Synthetic coding sequence
atgaccaacaaatgtctgctgcagatagccctcctgctgtgcttctctactactgcactgagcatgtcttacaaccttctgggtttcttgcagaggtccagtaacttccaatgccaaaagctgttgtggcagctgaatgggaggctcgagtattgtttgaaagataggatgaacttcgacatcccagaggagataaagcagcttcagcagtttcagaaagaggacgctgccctgacaatttacgagatgctgcagaatatcttcgctatcttccggcaagactcctcaagtacaggatggaacgagacaattgtggagaatctgctggcaaatgtgtatcaccaaattaatcatctgaaaacggtgctggaggagaagctggagaaggaggattttactcgcggtaaactcatgtccagtctccatttgaagcggtactacggccgcattctgcactacctcaaagctaaggagtactcccactgtgcctggacaatcgtgcgagtggagatactgaggaatttttattttataaaccggctgacagggtacctgagaaac

SEQ ID NO: 14506 - DNA, 561 bp, Artificial Sequence
  Description of Artificial Sequence: Synthetic coding sequence
atgacgaataaatgcctcctgcagattgctctcctgctgtgtttctcaacaactgccctgtcaatgagctacaatctgttggggttcctccagagatctagcaacttccagtgccagaagctgctttggcagctgaacggccgcctggagtattgtcttaaggatagaatgaatttcgacatccccgaggagatcaagcagctgcagcagttccaaaaagaggacgctgccctcaccatatatgagatgctgcaaaatatctttgcaatctttagacaggactcatcttctacggggtggaatgaaactatcgtggaaaatctgctcgccaatgtctatcaccagatcaatcatctcaaaactgtgttggaagagaagctcgaaaaggaggactttaccaggggcaagctgatgtcatctcttcacctcaagagatactacggccgtatcctgcactatctgaaggctaaagaatacagtcattgtgcttggactatcgtgcgagtggaaatcctgaggaatttctactttatcaatcgcctgaccggctacttgcggaac

SEQ ID NO: 14507 - DNA, 561 bp, Artificial Sequence
  Description of Artificial Sequence: Synthetic coding sequence
atgactaacaaatgtttgcttcaaatcgccctccttctttgtttcagcaccaccgccctttcgatgtcgtacaatctgctgggctttctgcaaaggagcagcaactttcagtgccagaagttgctttggcagctgaacggacgactcgagtactgcctgaaagaccggatgaacttcgacatccccgaagagattaaacaactgcaacaatttcaaaaggaggatgcggcactgactatttacgaaatgcttcagaacatttttgccatcttcagacaggactcctcctcaactgggtggaacgagactattgtcgaaaacctgctggcaaatgtgtatcatcagatcaaccacctcaagacggtgctcgaggaaaagctggaaaaggaagattttactcggggaaaactgatgagctccctgcatcttaagagatactacggtcgtatcttgcactacctcaaagcgaaggaatactcacattgtgcatggaccattgttcgcgtggagatactccggaacttttacttcataaatcgactgaccggttacctgcgcaac

SEQ ID NO: 14508 - DNA, 561 bp, Artificial Sequence
  Description of Artificial Sequence: Synthetic coding sequence
atgactaacaagtgtctcctgcagatcgccctgctgttgtgcttctcgactacggcactctccatgtcgtacaatctgctgggctttctgcagaggtcgagcaacttccagtgccagaagctcttgtggcaactgaatggacgcctggagtactgcctgaaggatcgcatgaactttgatatccctgaagaaatcaagcagctgcagcaatttcaaaaggaagatgctgcgctgaccatctacgaaatgctgcagaatatcttcgcgattttccgccaggactcttcatcaaccggatggaacgagactatagttgaaaatctcctcgcgaatgtctaccaccaaatcaaccatcttaaaaccgtgctcgaagaaaaacttgaaaaggaggattttactcgcggcaaactgatgagctcgctgcacctcaaacgctactacggccggatcctccactacctgaaagccaaggagtactcacactgcgcatggaccatcgtgcgcgtcgagattctgaggaacttctacttcatcaacaggctcaccggataccttcggaac

SEQ ID NO: 14509 - DNA, 561 bp, Artificial Sequence
  Description of Artificial Sequence: Synthetic coding sequence
atgacgaataagtgcctcctgcagattgctctgctgttgtgcttcagtaccaccgctctgtccatgtcctacaacttgctgggattcctccagaggtcctcgaacttccaatgtcaaaagttgctgtggcaactcaacggacgtttggagtactgccttaaggacaggatgaactttgatataccggaggaaatcaagcagcttcaacagttccagaaagaagatgcagccctcacgatctatgaaatgctccagaatatcttcgcaatcttccggcaggactcctcatcaactggctggaatgaaactattgtcgagaacctcctggcgaatgtttatcaccaaatcaaccatctgaaaactgtgctcgaagaaaagttggaaaaagaggactttacccggggcaaattgatgagtagccttcacctgaagcgctactacgggagaattctgcactaccttaaagcgaaggagtactcgcattgcgcctggactatcgtgcgggtggagatcctgagaaacttctactttatcaatcggctgaccggatacctgagaaac

SEQ ID NO: 14510 - DNA, 561 bp, Artificial Sequence
  Description of Artificial Sequence: Synthetic coding sequence
atgaccaataaatgtctactgcagatcgccttgctcctgtgtttctctacaactgccctctccatgtcttacaacctcttgggattcttgcaaaggagtagcaacttccagtgtcagaaactgctgtggcagctgaatggaaggctggagtactgtctgaaagatcgaatgaactttgatatacctgaggagatcaaacaattgcaacagtttcagaaggaggatgcagcacttacaatctacgagatgttacagaacatcttcgctatatttcggcaggactcctcctccacaggatggaacgaaacgattgtcgagaacctactcgctaacgtgtaccaccagatcaaccatctgaagaccgtccttgaagagaagttggagaaggaggactttacgcgcggtaaactgatgtctagccttcacttgaagcggtattatgggagaatcctgcactatctcaaggctaaagaatacagccactgtgcctggaccatagtgcgggtggaaattctccggaatttctatttcattaacagactcacaggctacttgagaaat

SEQ ID NO: 14511 - DNA, 561 bp, Artificial Sequence
  Description of Artificial Sequence: Synthetic coding sequence
atgacgaacaagtgcctgttgcaaatcgcccttttgctctgcttctccaccaccgcgctttcgatgtcctataacctgctgggattcctccagcggagcagcaacttccaatgccagaagctgctttggcagcttaatggacggctggaatactgtctcaaagatcggatgaattttgacatccctgaagagatcaagcagctccaacagttccagaaggaggacgcagctctgaccatctacgagatgttgcagaacatctttgccatctttcggcaggactcctcaagcaccggatggaacgaaacgatcgtggagaatttgctggcaaatgtgtatcaccaaatcaaccacctgaaaaccgtgctggaagagaagctggaaaaggaagattttactcgcggcaagctgatgagctcccttcatctcaaacggtactacggacgcatcctgcattacctcaaggctaaggaatacagccactgcgcctggaccatcgtcagagtggaaatcctgaggaacttctacttcatcaacagactgaccggctaccttcggaac

SEQ ID NO: 14512 - DNA, 561 bp, Artificial Sequence
  Description of Artificial Sequence: Synthetic coding sequence
atgacaaacaaatgcctgcttcaaatcgctctgctgctctgcttttccacaactgcactgagtatgtcatataacctcctggggttccttcagcgaagctccaacttccaatgccagaagctgctttggcagctcaacgggcggctggagtactgcctcaaagataggatgaacttcgacatccctgaggaaataaaacagctccagcagtttcaaaaggaggacgccgccttgactatctacgagatgctccagaacatcttcgctatatttcgccaggactcctccagcaccggctggaacgagactattgtcgaaaatctgcttgcaaatgtgtaccatcagattaaccacctgaagacagtgctcgaagaaaaactggagaaggaggattttaccagggggaaacttatgtcctctctacatctcaagaggtattacggtcggatcctgcattaccttaaggctaaagaatacagccactgtgcttggactatagtgcgcgtcgaaattctccgtaatttctacttcatcaaccgactgacaggatacctgaggaat

SEQ ID NO: 14513 - DNA, 561 bp, Artificial Sequence
  Description of Artificial Sequence: Synthetic coding sequence
atgactaataagtgcctattacaaatagcattactgctgtgcttttcgaccacagcgctgtccatgagctacaacctgctcggattccttcaacgctcctcaaatttccagtgccagaagctcctctggcagttgaacggacgactggagtattgtcttaaggatcgcatgaacttcgatatccccgaagagattaaacaacttcagcagtttcagaaagaggacgccgcactgacgatttacgagatgctgcagaacatctttgcgatatttagacaagatagttcatctactggatggaacgaaacgatcgtcgagaaccttctggcgaacgtgtatcatcagatcaatcacctcaagacagtcctggaggagaagctagagaaggaagatttcactaggggaaagctcatgtcctcgctacaccttaaaagatattacggacgaatcctccactacctgaaggctaaagaatacagtcactgtgcctggaccatcgtccgagtagagattctaaggaatttctacttcattaacaggctgacagggtatctgcggaat

SEQ ID NO: 14514 - DNA, 561 bp, Artificial Sequence
  Description of Artificial Sequence: Synthetic coding sequence
atgactaacaaatgtctgctccaaattgcgctcctcttgtgtttctcgactaccgcactgtcgatgagctacaacctgctgggattcctgcaacgatcaagcaatttccagtgccaaaagctgctttggcagcttaacggcagacttgaatactgtcttaaggacaggatgaactttgatattccagaggaaatcaagcagttgcagcagtttcaaaaggaagatgcggcattgacgatctatgaaatgttgcagaacatctttgccatattcagacaagattcctcctccaccggctggaacgaaaccatcgtggaaaacctgctggcaaatgtgtatcaccagattaatcatctgaaaaccgtcttggaggaaaagttggagaaggaagatttcactcgtggtaaactcatgtcctcgcttcatctcaaacgttactacggaagaatcctccactaccttaaagccaaagagtacagccattgcgcatggactattgtgcgagtcgaaattctgagaaacttttactttatcaatcggcttaccgggtacctccggaac

SEQ ID NO: 14515 - DNA, 561 bp, Artificial Sequence
  Description of Artificial Sequence: Synthetic coding sequence
atgacgaacaagtgcctgctacagattgccttgctcctgtgctttagcaccacagctctcagtatgtcttacaatttgctgggattcctgcagcggagtagcaactttcagtgccagaaacttctttggcagctgaatggccggcttgaatattgtttgaaggacagaatgaactttgatatacccgaggagatcaaacagctgcagcaatttcagaaggaggatgcggctctgaccatatacgagatgctgcagaatatttttgccatctttcgacaggatagttcctcaaccggctggaatgaaaccatcgtcgagaatctactggctaatgtatatcatcagatcaaccatctcaaaacagtgctggaggagaaattagaaaaggaggatttcacaagaggcaagcttatgtcttctctacacttaaagagatactacggtcgcatcctgcactatctcaaggccaaagagtactcgcactgtgcttggactatagtgcgagtggagatcctgcgaaatttctacttcattaataggctgacagggtacttacggaat

SEQ ID NO: 14516 - DNA, 561 bp, Artificial Sequence
  Description of Artificial Sequence: Synthetic coding sequence
atgaccaacaagtgcttgctgcaaattgccctgctgctctgcttctcgactaccgctctctcgatgtcctacaaccttttgggctttctgcagcggtcctccaacttccagtgccagaagctgctgtggcagctgaatggaagattggagtactgcctgaaagatcgcatgaacttcgacatcccagaagagatcaagcagctgcagcagtttcagaaggaggacgcggccctcactatctacgaaatgctccaaaacatcttcgccatcttccggcaagactcgtcgagcaccgggtggaacgaaactatcgtggaaaatctgctggccaatgtctaccaccagattaaccacctgaaaaccgtcttggaagaaaaactggaaaaagaggacttcactagaggaaaactcatgtcgagcctgcatctgaagcggtactacgggaggattcttcactacctcaaggcgaaggaatactcccattgcgcatggaccattgtcagggtggagatactgcgcaatttctatttcatcaaccgcctcactgggtacctgcgcaac

SEQ ID NO: 14517 - DNA, 561 bp, Artificial Sequence
  Description of Artificial Sequence: Synthetic coding sequence
atgaccaacaaatgtctactgcagatcgcccttctgctctgcttcagcaccactgctctaagcatgtcttataatcttctcggctttctgcagagatcttccaacttccagtgtcagaagctgctttggcaattaaatggcagattagaatattgtcttaaggatagaatgaatttcgatattcctgaggagattaagcagctgcagcagttccagaaagaggatgccgccctgacaatttatgagatgctacagaacatcttcgctatatttcggcaggactcttctagtaccggatggaatgaaaccatcgtggagaatctcctagccaacgtgtaccaccagattaaccacctgaagacagtactcgaagaaaaactggagaaagaggacttcacgcgcggcaaactcatgtcatccctacatttgaaaagatattacggtaggatccttcactatctcaaagcgaaggagtatagccattgcgcctggactattgtcagagttgaaattctcaggaacttctacttcatcaatcgcttgaccgggtatctccggaat

SEQ ID NO: 14518 - DNA, 561 bp, Artificial Sequence
  Description of Artificial Sequence: Synthetic coding sequence
atgactaataaatgtcttctgcagattgcgctcctgctttgtttctctactactgcactgagtatgagctacaatcttcttgggttcctgcagagatccagcaatttccagtgtcagaaacttttgtggcagctcaatggcagactggaatattgcttgaaagatcgcatgaactttgatattccagaggagattaagcaactccagcagtttcagaaagaagatgcagctctgacaatatatgagatgcttcaaaatatcttcgccatctttcgtcaggatagctccagtactggatggaatgagactatcgttgaaaatctcctggcaaatgtttaccaccagatcaatcatctgaaaaccgttttagaggaaaaacttgagaaggaggatttcactcgcggaaagctgatgtctagcctgcacctcaagaggtattatggcaggatcctgcactaccttaaagcgaaagagtactcccattgcgcttggaccatcgtcagagtggaaatcttacggaatttttacttcatcaatagacttacaggttacctgagaaat

SEQ ID NO: 14519 - DNA, 561 bp, Artificial Sequence
  Description of Artificial Sequence: Synthetic coding sequence
atgacaaataaatgcctcctccagatagctcttttgctatgtttcagcactactgccctcagcatgtcctataatctcctcgggtttttacagagatcaagcaatttccaatgtcagaaactgctgtggcagctgaatggccgcctcgagtattgtcttaaggatcgaatgaactttgacatcccagaagagataaagcagctgcagcagttccagaaagaagatgctgcactgacaatctatgagatgctgcagaacattttcgctatcttcagacaggattccagctcaactggctggaatgagacaatcgtggaaaacctgctcgctaacgtctaccaccagataaaccatctaaagactgttttggaggagaagttggagaaggaggactttacccgaggaaagctgatgagcagtttacacctgaaaaggtactacgggcggatcctgcattatttgaaggcgaaggagtacagccattgtgcatggactatagtccgcgtcgagattctgcggaacttttacttcatcaaccgacttactggctacctgcggaac

SEQ ID NO: 14520 - DNA, 561 bp, Artificial Sequence
  Description of Artificial Sequence: Synthetic coding sequence
atgacgaacaagtgtctcctgcagatcgccctcctcttgtgcttctcaactaccgcgctgagcatgtcgtacaatctgctgggattcctccagagatccagcaactttcaatgccaaaaactcctgtggcagttgaatgggcgcctcgagtactgcctcaaggaccggatgaacttcgatatcccggaggaaatcaagcaactgcaacagttccagaaagaggacgcggctcttactatctacgaaatgctgcagaatatttttgcaatcttccggcaggattcgtccagcaccggttggaacgagactatcgtggaaaacctcctggcaaacgtctaccaccagattaaccatctgaaaactgttcttgaggaaaagctcgaaaaggaggactttacccgaggaaagctgatgtcatccctgcatctgaagcgctactacggaaggattcttcactacctgaaggccaaagaatactcgcactgcgcctggaccatcgtgagagtggaaatcttgcggaatttctatttcatcaatcgcctgaccggctacctgcgtaac

SEQ ID NO: 14521 - DNA, 561 bp, Artificial Sequence
  Description of Artificial Sequence: Synthetic coding sequence
atgaccaacaaatgcttactccagatagcgctcttactgtgttttagcaccacggcgcttagcatgagctataacttactgggtttcctgcagaggtcttccaacttccagtgtcagaaactgctctggcagctgaatggtcgcctcgagtactgcctgaaggaccgcatgaactttgatatccccgaggaaattaaacagcttcaacagttccagaaagaagatgccgcactgactatctacgaaatgctgcaaaacatcttcgcaatcttcaggcaagacagcagctctaccggttggaacgagaccatagtggaaaatttgctggcaaatgtttaccatcaaatcaatcatctaaagacagtcctggaggaaaaactggagaaagaggattttacccgtggtaagctgatgagcagccttcatctgaagcgctactatgggcgcatcctgcactatctgaaagcaaaagagtacagccattgtgcatggactattgtcagagttgagatcctgcgaaacttttacttcattaatcgtctgaccgggtacctgcgcaat

SEQ ID NO: 14522 - DNA, 561 bp, Artificial Sequence
  Description of Artificial Sequence: Synthetic coding sequence
atgacgaacaaatgtctcctccagatcgccctgctgctctgttttagtacaactgccttgtccatgagctataatctgttgggttttcttcagagaagcagtaatttccagtgccaaaagttactgtggcagctgaacggccggctggaatactgcctgaaggacaggatgaacttcgatattccggaagagattaaacagctccaacaattccagaaagaagacgcagccctgactatctacgagatgctgcagaatattttcgccatttttagacaggacagtagctccactggctggaacgagacaattgtggagaacctgctggccaacgtctaccaccagattaaccacctcaaaacagtactggaggagaaattggaaaaagaggattttacacgaggtaagctgatgtcatcattacaccttaagcgctattatggccgcattctgcactatttgaaggccaaggaatattcacattgcgcatggaccatcgtgagagtcgaaatcctgcgaaatttctactttattaataggttgactggctaccttcgtaat

SEQ ID NO: 14523 - DNA, 561 bp, Artificial Sequence
  Description of Artificial Sequence: Synthetic coding sequence
atgactaataaatgtctgcttcagattgcgttgctgctgtgcttctcaacaaccgcgctgagtatgtcctataacctactcggttttcttcagcgctcctccaattttcagtgtcagaagctgctttggcagttgaacggaagattagagtattgcctgaaggaccgcatgaatttcgatattccggaggaaatcaagcagttgcagcagtttcaaaaggaggatgccgccctgaccatctacgaaatgcttcagaatatatttgctatcttccgacaagatagcagctccacagggtggaatgaaacgattgttgagaacctgctcgcaaatgtctatcatcaaatcaaccacctgaaaaccgttttggaggagaagctggagaaagaagacttcacacgtggaaagctcatgagcagtctccatctgaaacgttactatggccggattcttcattacctcaaggcaaaggagtacagtcactgcgcctggacaattgttcgggtagaaatcctacggaacttttacttcattaacaggttgacagggtacttacggaat

SEQ ID NO: 14524 - DNA, 561 bp, Artificial Sequence
  Description of Artificial Sequence: Synthetic coding sequence
atgactaataagtgtctccttcagattgcgctgctcctgtgcttttcaactactgcgctttcgatgtcttataacctgctgggatttctccaaagatcgtccaactttcagtgtcaaaagctgctctggcaactgaacggcagactggagtactgcctgaaggacaggatgaactttgatattccggaggaaatcaagcagcttcagcaattccagaaggaggacgcagcccttacgatctacgaaatgcttcaaaacatttttgcaatctttagacaagattcctcctcaaccggctggaatgaaaccatcgtggaaaatctgctggcaaacgtctaccatcaaatcaaccatctgaaaaccgtgcttgaagaaaagctggaaaaagaggattttacgcgcggtaaactgatgagctcactgcacctcaaaagatactacggtcgcatcctgcattacctcaaggccaaggagtattcgcattgcgcatggaccattgtcagagttgagattcttagaaacttttacttcataaacagactcaccgggtacctgcggaat

SEQ ID NO: 14525 - DNA, 561 bp, Artificial Sequence
  Description of Artificial Sequence: Synthetic coding sequence
atgactaacaagtgtctgcttcagatcgcactccttctgtgtttttccaccactgcactgtccatgtcatacaacctgcttggttttctccagcggagctctaactttcagtgtcagaaactcctttggcagttgaacgggagactcgaatactgtctcaaagatcgcatgaactttgacattccagaggagataaagcaattgcagcaatttcaaaaggaagatgcggcgcttacgatttacgaaatgcttcagaatatcttcgcaatattccgccaggattccagctcgacgggctggaatgaaaccatcgtggagaatctgcttgcaaacgtgtatcatcagattaatcatcttaaaactgtccttgaagaaaagctcgaaaaggaagattttaccagaggcaagttgatgtcgtcgcttcatctgaaacggtattacgggagaatcctccattacctcaaggcaaaggagtactcgcactgcgcctggaccattgtgagagtggaaatcctccggaacttctacttcatcaatcggcttactggttacttgagaaac

SEQ ID NO: 14526 - DNA, 561 bp, Artificial Sequence
  Description of Artificial Sequence: Synthetic coding sequence
atgactaacaaatgcctgctgcaaattgcactgctcttgtgcttttccacgaccgccctttctatgagctacaatctgctcggctttttgcaacgcagctcaaatttccagtgccaaaaactgctgtggcagttgaacggcagactggagtactgcttgaaggacaggatgaacttcgatattcccgaggagatcaagcagctgcaacagttccagaaggaagatgccgcgcttaccatatatgagatgttgcagaacatcttcgctatctttaggcaggacagctctagtacaggatggaacgaaaccatcgttgagaacctgctggcaaatgtgtaccaccagatcaaccatttgaagacagtgctggaggagaaactcgagaaagaggacttcactcgcggaaagctgatgagctcacttcaccttaagcgctattatggcagaatcttgcattatcttaaggccaaggaatacagccactgcgcatggactatcgtgcgcgttgaaatcctcaggaacttctacttcattaatcgcttgacaggatatctgagaaac

SEQ ID NO: 14527 - DNA, 561 bp, Artificial Sequence
  Description of Artificial Sequence: Synthetic coding sequence
atgaccaacaaatgtctcctgcagatagcactcctcctgtgcttctcaactactgccctgagcatgtcgtacaacttgctgggatttttgcaacggtcatcgaatttccagtgccagaaactgctctggcagctgaatggcagactggaatactgcctcaaggaccggatgaactttgacatcccggaagagatcaagcaactgcagcaattccagaaggaggacgccgccctgactatctatgaaatgctccagaatatcttcgccatcttccgccaggacagctcgtccactggatggaacgaaaccatcgtcgagaacctcctggccaacgtgtaccaccagatcaaccacctcaagaccgtcctggaggagaaactcgagaaggaggacttcactcgcggcaaacttatgagctcgttgcacctgaaacgctactacggcagaatccttcattacctgaaagcgaaggaatactcccactgcgcgtggaccatcgtgcgcgttgaaattctccggaatttctacttcatcaaccggctgaccgggtacctgcggaac

SEQ ID NO: 14528 - DNA, 561 bp, Artificial Sequence
  Description of Artificial Sequence: Synthetic coding sequence
atgaccaacaagtgcctgctccagattgctcttttgctgtgcttctctactacggctctttcgatgagctacaacttgctcggattcttgcaaagaagctctaacttccagtgccaaaagctcctctggcaattgaacggacgccttgaatactgcctcaaggatcgtatgaactttgatatccctgaggaaattaagcagctgcagcagttccagaaggaggatgcagccctgaccatctatgagatgctccaaaacatctttgccatcttccgccaggacagctcctcgacggggtggaatgaaactatcgtcgagaacctcttggcgaacgtataccatcagatcaaccacctgaaaactgtgctcgaagagaagcttgagaaggaagacttcactcgaggcaaactcatgagctccctccacctcaagcggtactacggccgcatcttgcactatctgaaggccaaggagtactcgcactgtgcgtggactattgtccgtgtcgagatcctcagaaatttctacttcatcaatcgtctgacaggctaccttcgcaac

SEQ ID NO: 14529 - DNA, 561 bp, Artificial Sequence
  Description of Artificial Sequence: Synthetic coding sequence
atgaccaacaagtgccttctccagatcgccctgctcctgtgcttctccaccaccgctctgtcgatgtcgtacaatctgttgggcttcctccaaagatcttcaaacttccagtgtcagaaactgctgtggcagcttaatggaaggctggagtactgcctgaaggatcgcatgaattttgacatcccagaagagatcaagcagctccaacagttccaaaaggaggacgcagcactcacgatctacgagatgctgcagaacatctttgccatcttccggcaggactcatccagcaccggctggaacgagactatcgtcgaaaatctcctggcgaatgtgtatcatcagatcaatcatctgaaaacggtgttggaggaaaagctggagaaagaagatttcactagaggaaagctgatgtcatcgctgcacctcaaaagatactacggtcggatcctgcattaccttaaggcgaaggagtactcgcactgcgcttggaccattgttagagtggaaattctgcggaatttctatttcattaaccggctcactggctacctgagaaac

SEQ ID NO: 14530 - DNA, 561 bp, Artificial Sequence
  Description of Artificial Sequence: Synthetic coding sequence
atgaccaataagtgcttgcttcaaatcgccctgctgctctgcttttcaactactgccctctccatgtcgtacaatctgctcggcttcctgcaaagatcatcgaactttcagtgtcagaagctgctgtggcagctcaacggccgcctggagtactgcttgaaggatagaatgaacttcgacatcccagaggagatcaagcagctgcagcagtttcaaaaagaggacgccgccctgaccatctacgaaatgctgcagaatatcttcgcgatcttcaggcaggattcctcatcgactggctggaacgaaactattgtggagaacttgctcgctaacgtgtaccatcaaatcaatcaccttaagacggttcttgaggaaaagctggaaaaggaggactttaccagaggaaaactgatgagtagcctgcatctgaagagatactacggacgcatactccattacctgaaggcgaaagagtactcacactgcgcctggaccatcgtgcgtgtggaaattctgcgcaacttttacttcatcaatagactgacgggttacctgcgcaac

SEQ ID NO: 14531 - DNA, 561 bp, Artificial Sequence
  Description of Artificial Sequence: Synthetic coding sequence
atgaccaacaagtgcctgctgcagattgcccttctgctgtgcttcagcacgactgccctctcgatgtcctacaacctgctgggattcctccaacgctcctcgaatttccagtgtcaaaagctgctgtggcaacttaacggcagactggaatactgcctcaaggaccggatgaacttcgacatcccggaggaaatcaaacaactgcagcagttccagaaggaagatgccgccctgactatctatgaaatgctgcagaatatcttcgcgatcttccgccaggactcgtcgtccacgggatggaacgaaaccatcgtggagaatctgctggcgaacgtctaccaccagatcaaccacctcaaaaccgtccttgaggagaagttggaaaaggaagattttactaggggaaaactcatgtcctctctgcacctgaaacggtactacggccgcatcctgcattacctgaaggccaaagaatactcgcactgcgcttggacgatcgtgcgcgttgaaatcctccgcaacttttacttcatcaaccggctgaccggttacctccggaac

SEQ ID NO: 14532 - DNA, 561 bp, Artificial Sequence
  Description of Artificial Sequence: Synthetic coding sequence
atgaccaacaagtgccttctgcaaatcgcccttctcctttgtttttcaaccactgcgctctcaatgtcctacaatctgctgggctttctccagaggagcagcaatttccagtgtcagaaattgctttggcaactcaacggacgcctcgaatactgtctcaaagataggatgaatttcgacatccccgaggagattaagcagctccaacagtttcaaaaggaggacgcagcactgaccatctacgaaatgctgcagaatatctttgcaatctttcgtcaagattcgtcgtcaaccggctggaacgaaaccattgtggagaatctgttggccaacgtgtatcaccaaatcaaccatctcaagactgtcctggaagaaaaacttgagaaggaggattttacccgtggtaaacttatgtcatctcttcatctgaaacggtactacggtagaatccttcattacctgaaggcaaaagagtactcccattgtgcatggactatcgtgagagtggaaattctgagaaacttctactttatcaacagattgaccggttatctccggaat

SEQ ID NO: 14533 - DNA, 561 bp, Artificial Sequence
  Description of Artificial Sequence: Synthetic coding sequence
atgactaacaagtgcctccttcaaattgcactgcttctctgtttttccaccacggccctctcgatgtcctacaaccttcttggttttttgcagcggagctcgaattttcaatgccagaagctgttgtggcagttgaatggacgccttgaatattgcttgaaggatcggatgaactttgatattcccgaggagatcaagcagctgcaacagttccagaaggaggacgcagcgctcactatctatgagatgctgcagaatatcttcgcgatctttcggcaggactctagctcgaccggttggaacgagactatcgtcgaaaatctcttggctaatgtgtaccatcaaatcaaccacctcaagacggtcctcgaagaaaaacttgaaaaggaagattttactagaggcaaacttatgtcgtccctccatctgaaacgttactacgggcgcattctgcattacctgaaggctaaggagtattcccattgtgcctggaccattgttagggtggaaatacttaggaatttctacttcataaaccgacttactggataccttcgtaat

SEQ ID NO: 14534 - DNA, 561 bp, Artificial Sequence
  Description of Artificial Sequence: Synthetic coding sequence
atgaccaacaagtgtctgctccagattgctctgctgctctgcttctctactacagcactctcgatgtcatacaacctgttggggttcctgcagaggtcctcaaactttcaatgccaaaagctgctgtggcagctcaacggcagactcgagtactgccttaaagatagaatgaacttcgatatcccagaggaaatcaagcaattacagcaattccagaaagaggacgctgccctgactatctacgaaatgctgcaaaacatttttgccatcttccgccaagacagctcctcaactggatggaacgagactattgtcgaaaatctgcttgcaaacgtgtaccatcaaatcaatcatctcaaaacagttctggaggagaagctggagaaggaggattttacgagaggtaagctaatgagttctctccacttaaaacgctactacggaagaatcctgcattacctcaaggccaaagagtacagtcactgtgcctggacgatcgtcagagtcgaaatcttgcggaacttctattttatcaaccgtctgacaggctacctaagaaac

SEQ ID NO: 14535 - DNA, 561 bp, Artificial Sequence
  Description of Artificial Sequence: Synthetic coding sequence
atgactaataagtgtcttctgcagatcgctttgctgttgtgcttcagcaccaccgcgctgtccatgtcctacaatctgcttggtttcctgcagcgaagttctaatttccagtgtcaaaaacttctgtggcagcttaatggtcggctagagtactgcctgaaagacagaatgaactttgatatcccagaggagatcaagcagctgcagcagttccagaaagaggatgccgccctgaccatctacgaaatgctgcagaacatctttgcaatctttagacaggatagctcttccacagggtggaacgagacaattgtggagaatctcctggccaatgtgtatcaccagatcaatcatttaaagaccgtcttggaggaaaagctcgagaaagaagactttacaaggggcaagctcatgtccagcctgcacctgaaaaggtattatggccggattctgcactacctaaaagcgaaggagtactctcattgtgcatggacgatcgtgagggtggaaatacttcgcaatttctacttcatcaacagactcacaggttacttacggaat

SEQ ID NO: 14536 - DNA, 561 bp, Artificial Sequence
  Description of Artificial Sequence: Synthetic coding sequence
atgaccaacaaatgccttttgcagatcgccctgctcctttgcttctccaccaccgcactaagtatgtcttataaccttcttggctttctgcaacggagttcgaactttcagtgtcagaagctgctgtggcagctgaatgggagactggagtactgtttgaaggatcgcatgaatttcgacattcccgaggagatcaagcagctccagcagttccagaaagaggatgctgccctgacaatctacgagatgctccagaacatctttgcaatttttcgccaggacagctctagcacgggctggaatgagacaatcgtggagaacttgctcgccaatgtctatcaccagatcaatcacctgaagacagtgctggaggagaaactggaaaaggaggatttcactcgtggaaagctgatgagctctctccacttaaaaaggtactacgggagaatcctgcattacctcaaagccaaggaatacagccattgcgcgtggacaatcgtccgtgtggagatccttcgaaacttttactttatcaatcgactcaccggctacctcaggaat

SEQ ID NO: 14537 - DNA, 561 bp, Artificial Sequence
  Description of Artificial Sequence: Synthetic coding sequence
atgacgaataaatgtctcctgcaaattgccttgcttttgtgtttctccacgacagccctatcaatgtcctataatttgctggggttcctgcaacgtagctccaattttcagtgtcagaaattgctttggcagctcaatggtcggctggagtattgcttaaaggacaggatgaattttgatatacctgaggaaatcaagcaattgcagcaatttcagaaagaagatgccgccctcaccatctacgaaatgttgcaaaacatctttgctatttttcgacaagatagctcgtctactgggtggaatgaaactatcgtcgagaacctgctcgcgaatgtgtaccatcagataaaccaccttaagacggtattggaagagaagctcgaaaaggaggactttacgcgggggaagcttatgtcgtctctgcatctaaagcgatactatggacggattctccactacttgaaggctaaagaatactctcactgtgcctggacaattgtacgagtggagatacttcgtaatttctactttataaaccggttaactggctatctcaggaac

SEQ ID NO: 14538 - DNA, 561 bp, Artificial Sequence
  Description of Artificial Sequence: Synthetic coding sequence
atgactaacaaatgtctgctgcagatagcactgttgctgtgcttttcgacaaccgcgctgtccatgtcatacaacttactcgggttcttgcagcgctcatctaacttccaatgtcagaagcttctgtggcagctaaacgggaggctggagtactgcctaaaagaccggatgaacttcgatataccggaggagatcaaacagttacaacaattccaaaaggaagatgctgcccttactatctacgaaatgctccagaatatctttgcaatattcagacaggatagcagttccaccggctggaacgagaccatcgtggaaaatttgttagcgaacgtgtaccatcagatcaatcacctgaaaactgtgctggaggagaaactggagaaggaagattttaccagggggaagctgatgagctcccttcacttgaaaagatattacggcagaatcctgcattatctaaaagctaaagaatatagccactgcgcttggacgatcgtaagggtggagatcctaagaaatttttacttcattaacaggctgaccggctatctgagaaac

SEQ ID NO: 14539 - DNA, 561 bp, Artificial Sequence
  Description of Artificial Sequence: Synthetic coding sequence
atgacaaataaatgtctcctgcagatcgcactgctgctgtgtttttccacgactgcacttagcatgtcctataatctgctcggcttccttcaacgttcttcgaatttccagtgccagaaactgctgtggcagctcaatgggaggctggagtactgcctcaaggatcggatgaattttgatatcccagaagagattaagcagttgcagcaatttcagaaggaggacgctgcgcttacaatttacgagatgttgcagaacatattcgccatctttaggcaggactcttcctccaccggatggaatgaaaccattgtagagaatcttctggccaatgtctaccatcagatcaatcatctgaaaactgtcctggaggagaagctcgaaaaggaagactttacgcggggaaagcttatgtcctcccttcatctgaagcgatactatggtaggattttgcattatctaaaagcgaaagagtactctcactgtgcatggacgattgtgcgggtcgagatcttgaggaacttttacttcattaataggttgacaggctacttgcggaat

SEQ ID NO: 14540 - DNA, 561 bp, Artificial Sequence
  Description of Artificial Sequence: Synthetic coding sequence
atgacgaacaagtgcctcctgcaaatcgcgctgctgctgtgcttcagcaccaccgccctgagcatgagctacaacctcctgggcttcctccagaggtccagcaactttcaatgtcaaaaactgttgtggcagctgaatggaaggctcgagtactgtctgaaggacagaatgaatttcgacatcccagaggagatcaagcagcttcagcagttccagaaagaagacgccgcgctcaccatttacgagatgcttcagaatatcttcgccatctttagacaggattcctcgtccaccgggtggaatgaaaccatcgtcgaaaacctgctcgccaacgtctaccatcagatcaaccacctcaaaactgtgctcgaagaaaaactcgagaaggaggacttcactcgcggaaagctgatgtcgtctctgcatttgaagcggtactacggaaggatcctgcactacctgaaagccaaggagtacagccattgcgcctggactatcgtgagagtggagatcctgcggaacttctacttcatcaatcggctgaccgggtatctgcgaaac

SEQ ID NO: 14541 - DNA, 561 bp, Artificial Sequence
  Description of Artificial Sequence: Synthetic coding sequence
atgaccaataaatgcctgcttcagattgccctgctgctctgcttctccacgaccgctttgtctatgtcttataatcttcttgggttcttgcaacggagtagtaatttccagtgccagaagctactttggcagctgaatggcaggctggaatactgcctgaaggacagaatgaatttcgatatacccgaggagatcaaacagttgcaacagttccagaaagaggacgccgccctgacaatttacgagatgctgcagaatatttttgcaattttcagacaggactcttcttctacgggctggaatgagaccatcgtggagaaccttctcgcaaatgtttaccaccagattaatcacctgaagaccgtgttggaggagaagctggaaaaggaggacttcaccagggggaagctgatgtcgagtttgcacttgaaacggtactacggaagaattctgcactatctgaaggccaaagagtactcacattgtgcatggacaattgtgagagtggaaatactgaggaacttctacttcattaatcgcttaactggctatctgaggaac

SEQ ID NO: 14542 - DNA, 561 bp, Artificial Sequence
  Description of Artificial Sequence: Synthetic coding sequence
atgacgaataaatgtttactacaaatagcgttactattatgtttttcgacgacggcgttatcgatgtcgtataatttattaggttttctacaacgttcgtcgaattttcaatgtcaaaaattattatggcaactaaatggtcgtttagaatattgtctaaaagatcgaatgaattttgatataccggaagaaataaaacaattacaacaatttcaaaaagaagatgcggcgttaacgatatatgaaatgttacaaaatatatttgcgatatttcgtcaagattcgtcgtcgacgggttggaatgaaacgatagtagaaaatctattagcgaatgtatatcatcaaataaatcatctaaaaacggtattagaagaaaaactagaaaaagaagattttacgcgtggtaaattaatgtcgtcgctacatctaaaacgttattatggtcgaatattacattatctaaaagcgaaagaatattcgcattgtgcgtggacgatagtacgtgtagaaatactacgtaatttttattttataaatcgtctaacgggttatttacgtaat

SEQ ID NO: 14543 - DNA, 561 bp, Artificial Sequence
  Description of Artificial Sequence: Synthetic coding sequence
atgactaacaagtgtctccttcagattgctctgctcctgtgttttagcactaccgctctctctatgagttacaatctgctgggtttcctccaaagatcttcaaactttcaatgtcagaagctgctttggcagctgaacggcagactggagtactgccttaaggacaggatgaacttcgacatcccagaagagattaagcagttgcagcaattccagaaagaagatgcagcccttacaatttatgaaatgttgcagaatatttttgccatctttaggcaagactcctcatcaaccggttggaacgaaactattgtcgaaaacttgctggccaacgtatatcaccagattaaccacctcaagaccgttctggaggagaaactggagaaagaagacttcacccgcggaaaactgatgagttccctccatcttaaacgttactacggtcgtatactgcattatcttaaagccaaggagtattctcattgcgcatggaccattgtcagggtggagattttgcgcaacttctactttattaacaggcttactggctacttgcgtaac

SEQ ID NO: 14544 - DNA, 561 bp, Artificial Sequence
  Description of Artificial Sequence: Synthetic coding sequence
atgacaaataagtgcctactacagatagctttgctcctttgctttagtacaaccgcactttctatgtcatataatttgttgggctttttgcagagaagttctaacttccaatgccaaaagttgttgtggcagttgaacggacgactcgaatattgtttgaaagatagaatgaactttgacataccagaagaaatcaaacaattgcaacagttccagaaagaggatgcagctttaactatctatgaaatgcttcagaatatctttgcaatattcagacaggattcttcttctaccggctggaatgaaacaattgtcgaaaaccttttggctaatgtttatcaccaaattaaccacttaaaaactgtgttagaagagaaactcgaaaaagaagatttcactagaggaaaattgatgtcttcacttcaccttaaacgttattacggacgtattttgcactacttgaaggcgaaggaatattcccattgcgcctggaccatagtcagagtagagattcttagaaatttctatttcatcaataggttgactgggtacctaagaaac

SEQ ID NO: 14545 - DNA, 561 bp, Artificial Sequence
  Description of Artificial Sequence: Synthetic coding sequence
atgacaaacaagtgcctccttcagatcgcactcctgttgtgcttctccacaaccgccctctccatgtcatacaacctgctgggcttcctgcagcgcagtagtaactttcagtgccagaagcttctgtggcagctgaatggacgtctcgagtattgcctgaaggaccgaatgaattttgatatcccagaggagatcaagcagctgcagcagttccagaaggaggacgcggccctgactatctatgagatgttacaaaatatttttgctatcttccgccaggactcctccagcaccggatggaatgaaaccattgttgaaaaccttctggccaacgtgtatcaccagatcaatcatctgaagaccgtcctcgaggaaaaacttgagaaggaggacttcacacgaggaaagctgatgagtagcctgcatttgaaaagatattacggacgtatcctccactatctgaaagcaaaggagtatagtcattgcgcatggactatcgtgagagtggaaattctaaggaatttctactttattaatcgcttgaccggctacctgcgcaat

SEQ ID NO: 14546 - DNA, 561 bp, Artificial Sequence
  Description of Artificial Sequence: Synthetic coding sequence
atgaccaacaagtgtttgctgcaaatcgcccttctgctgtgtttcagcaccactgccctgtcaatgtcatacaacctccttggatttctgcaacgatcgtcgaattttcagtgtcagaaactcctttggcagctcaacggtcgcctggaatactgcctgaaggaccgtatgaattttgatattcccgaagagattaagcaactgcaacaattccaaaaagaggatgcagccctgacgatttacgagatgcttcagaatatctttgccatttttcggcaagattccagctcgactggttggaacgagacgattgtggaaaatctccttgccaatgtgtaccatcagattaaccacctcaaaactgtgcttgaggaaaagctcgagaaggaagattttactagaggtaaacttatgagctcactgcacctgaagcgctactacggacggattctgcattaccttaaggcgaaggaatactcacattgtgcatggaccatcgtgcgagtggaaattctgagaaacttttactttatcaatcggttgactgggtacctgagaaac

SEQ ID NO: 14547 - DNA, 561 bp, Artificial Sequence; identical to SEQ ID NO: 14515
  Description of Artificial Sequence: Synthetic coding sequence

SEQ ID NO: 14548 - DNA, 534 bp, Artificial Sequence
  Description of Artificial Sequence: Synthetic coding sequence
atgcattcctccgctctcctgtgctgcctagtacttctcaccggagtccgggctagcccaggtcagggcactcagtctgagaattcatgtacacacttccctggcaatctccctaacatgcttcgtgacttgagagacgccttctcccgggtcaagacattctttcagatgaaggaccagttagacaaccttctcttaaaggaatcgctgctcgaggacttcaaagggtacctgggatgtcaggcgcttagtgaaatgatacagttttatcttgaagaggtcatgccacaggccgaaaaccaggaccccgacattaaagctcacgtcaattcactgggcgaaaatctgaaaacccttcggctgagacttcggaggtgccacagatttctgccatgcgagaataagtccaaggctgtggagcaagttaagaatgccttcaataagctgcaggagaagggcatctacaaggccatgtctgaatttgatattttcatcaactacatagaagcctatatgacgatgaagatccggaac

SEQ ID NO: 14549 - DNA, 534 bp, Artificial Sequence
  Description of Artificial Sequence: Synthetic coding sequence
atgcatagtagcgcactattgtgctgcctcgtcctgttgacaggagttcgcgctagccctggccaaggcactcagtcagaaaattcttgtacgcactttccggggaatctaccgaacatgttacgcgaccttcgagatgcgttctcgagggttaaaacgttctttcaaatgaaggatcaattggacaacctacttcttaaagaaagtcttttagaagactttaagggttacttagggtgtcaggcgctgtctgaaatgatccaattttatttggaggaagtaatgccacaagcggaaaatcaggatcctgacataaaagctcatgttaactctctgggcgagaatctaaaaacattgcgtttaaggttgagacgttgccaccgttttctaccctgcgagaataaaagcaaagctgttgaacaagtaaagaacgccttcaacaagttgcaagaaaagggaatttataaagcaatgtcagagtttgatattttcattaactacattgaagcgtacatgacgatgaagataagaaat

SEQ ID NO: 14550 - DNA, 534 bp, Artificial Sequence
  Description of Artificial Sequence: Synthetic coding sequence
atgcactcatcggcgctcctttgctgcttagttcttcttacgggtgttcgcgcctcgcccggtcagggaactcaatcagagaactcttgcacacattttccgggtaatcttcctaatatgttgagagatcttcgcgatgcattctcgcgggtcaaaacctttttccaaatgaaagaccagctagacaaccttctgttgaaagaatcgctgctcgaagatttcaagggctacctgggttgccaggccctatcagagatgatccaattttatctcgaagaagtgatgccgcaggctgaaaatcaggatccggatatcaaagcccatgtaaactccctgggggaaaacctgaaaacactgcgtctgcgtctgcgaagatgccatcgatttctgccctgtgagaacaaatctaaagccgttgaacaggtgaagaatgcattcaacaaattgcaggagaaaggcatctacaaagcgatgtcggaattcgatatctttattaattacatagaagcttacatgacaatgaaaatccgcaac

SEQ ID NO: 14551 - DNA, 534 bp, Artificial Sequence
  Description of Artificial Sequence: Synthetic coding sequence
atgcactcaagtgccctattatgttgtcttgtccttcttacaggagtacgggccagtcccgggcagggaactcaatctgaaaattcatgcacacattttcctgggaacctccccaatatgttgagagatctccgggatgccttctctagagtgaaaacatttttccagatgaaggatcagcttgataacctactactgaaagaatcccttctggaggattttaaaggatacttagggtgccaggctctatctgaaatgatacagttttacctggaagaagtgatgcctcaggcggaaaatcaggatcccgatatcaaagcccatgtcaatagtctaggggaaaacctgaaaacgttgaggctgcgactccgccgttgccatcggttcctaccctgtgaaaataagtctaaggcagtcgaacaggtgaaaaatgccttcaataaattgcaggagaaagggatttataaggctatgagtgaatttgatatattcatcaattatatcgaagcttatatgacaatgaaaattcggaat

SEQ ID NO: 14552 - DNA, 534 bp, Artificial Sequence
  Description of Artificial Sequence: Synthetic coding sequence
atgcattcgtcggcgttattatgttgtttagtattactaacgggtgttcgtgcgtcgccgggtcaaggtacgcaatcggaaaattcgtgtacgcattttccgggtaatctaccgaatatgctacgagatctacgagatgcgttttcgcgagtaaaaacgttttttcaaatgaaagatcaattagataatctattactaaaagaatcgttactagaagattttaaaggttatttaggttgtcaagcgctatcggaaatgatacaattttatttagaagaagttatgccgcaagcggaaaatcaagatccggatataaaagcgcatgttaattcgctaggtgaaaatctaaaaacgctacgattacgtctacgacgttgtcatcgatttctaccgtgtgaaaataaatcgaaagcggtagaacaagtaaaaaatgcgtttaataaattacaagaaaaaggtatatataaagcgatgtcggaatttgatatatttataaattatatagaagcgtatatgacgatgaaaatacgtaat

SEQ ID NO: 14553 - DNA, 534 bp, Artificial Sequence
  Description of Artificial Sequence: Synthetic coding sequence
atgcatagcagtgcgctgctgtgttgcttagtgttgctgactggggtcagagcatctcctggacagggaactcagtcagaaaactcctgtactcacttccctgggaatctgccaaatatgctcagggacctacgcgacgctttttcccgagtgaagaccttctttcagatgaaggaccagttagacaatctgctgttgaaggagagtctccttgaggacttcaagggctatctggggtgtcaggcactgtctgaaatgatacagttctatcttgaagaagtgatgccgcaggccgagaatcaggacccagacataaaggcccatgtcaacagtctcggagagaatctcaagacactgagattgcggctgcgccgatgccaccgctttctgccatgcgagaacaaatctaaggctgtagagcaggtgaagaatgcattcaacaagcttcaggaaaaaggtatatacaaagctatgtccgaattcgatatcttcataaactacatcgaggcatacatgacgatgaagatcaggaac

SEQ ID NO: 14554 - DNA, 534 bp, Artificial Sequence
  Description of Artificial Sequence: Synthetic coding sequence
atgcattcatcggcacttctctgttgccttgtccttcttaccggagtgcgggcatcgcctggacaaggaacccagtccgagaacagctgtactcattttcctggtaacctgcctaacatgctcagggatctgcgcgacgcgttctcgcgggtgaaaacgttctttcaaatgaaggatcagctggacaatctgctgctgaaggagtcactgctggaggactttaaaggctacctggggtgccaggctcttagcgagatgatacagttttacttggaagaagttatgccccaagccgaaaatcaagacccggacattaaggcacacgttaattcccttggcgagaacctcaagactcttcgcttgagacttcgacgttgtcaccgattcctgccgtgtgaaaacaagtcgaaggcagtagaacaagtgaaaaacgcattcaataagctccaagaaaaaggtatctacaaggccatgtccgagtttgacattttcatcaactacattgaggcttatatgaccatgaagattagaaac

SEQ ID NO: 14555 - DNA, 534 bp, Artificial Sequence
  Description of Artificial Sequence: Synthetic coding sequence
atgcatagcagtgccctcctgtgttgcctcgtcctcttgaccggtgtgcgagctagccctggtcaaggtacgcaatctgagaactcatgcacccatttccccggcaaccttcctaatatgctgcgcgaccttagggatgcgttttcccgtgtcaagactttctttcagatgaaggatcaactcgacaacctccttttgaaggaatcactgctggaagatttcaaaggataccttggctgtcaggcactgtcggaaatgattcagttttacctggaagaagtcatgccccaagcagaaaatcaagatcctgacatcaaggcacacgtgaactcactgggagagaacctcaagacccttcggctgagacttagacgatgtcaccggtttctcccatgtgagaacaaaagtaaggccgtggagcaagtgaaaaatgcattcaataagctccaggaaaagggtatttacaaagctatgtcggaatttgacatcttcataaactacattgaggcatacatgactatgaagattcgaaac

SEQ ID NO: 14556 - DNA, 534 bp, Artificial Sequence
  Description of Artificial Sequence: Synthetic coding sequence
atgcattcgagtgccttactttgttgcctcgtactactcacgggagttagggcatcgccaggccagggaacccagagcgagaacagttgtacacactttcccggtaacttgcccaatatgttgagggatcttcgggacgctttcagcagagtcaagactttcttccagatgaaagaccagttggacaatctgctgctgaaagaatctttgctggaggatttcaaaggatacttgggctgccaagcattaagcgaaatgatccagttctatttagaggaagtgatgccccaggcagagaaccaagacccagatataaaggcccatgtgaactccctgggcgaaaacctgaagacacttaggcttcggctgcgtcgctgccaccggtttcttccctgtgaaaacaagagtaaagccgtcgagcaggtcaagaatgcatttaataaacttcaggagaagggtatttacaaagccatgagtgagttcgatatctttataaattatatagaagcatatatgaccatgaaaatcagaaat

SEQ ID NO: 14557 - DNA, 534 bp, Artificial Sequence
  Description of Artificial Sequence: Synthetic coding sequence
atgcactcttcagcgcttttgtgctgtctcgtgttactcacgggcgtgcgtgccagcccgggacagggaacccaatccgaaaactcatgtactcatttcccgggaaacctgcccaacatgctcagggacctcagagacgcttttagtcgggtgaagaccttttttcagatgaaagatcagctggacaatctattactaaaagagagcttactggaggattttaagggatatctcgggtgccaagccctctccgagatgattcagttttatctcgaggaggtaatgccacaggcggaaaaccaggacccggacattaaggcgcacgtcaactcgctgggagagaatttgaaaacactacggctgcgactcaggaggtgccatcggttcctcccatgcgagaacaaaagcaaggccgtggagcaggtgaagaacgcgttcaataagttgcaagaaaaggggatttacaaggccatgtctgaatttgacattttcataaactatatagaggcctatatgactatgaagatccgtaat

SEQ ID NO: 14558 - DNA, 534 bp, Artificial Sequence
  Description of Artificial Sequence: Synthetic coding sequence
atgcactcgtctgctcttctctgttgccttgtgctgttgacgggggtgcgagcttcgccaggtcaaggaacgcaatcggagaacagctgtacacacttcccaggtaatttaccaaacatgttaagagatctacgtgacgcattttcaagggtcaaaacgttttttcagatgaaagatcagctagacaacctgcttcttaaggagtccttactggaagatttcaagggatacttaggatgtcaagcactatcagaaatgatccaattctacctggaggaagtcatgccacaagctgaaaatcaagatcctgatataaaagctcatgtcaacagccttggagaaaatctgaaaacgctcagattacggcttagaagatgtcaccgatttctgccatgtgaaaataagtctaaagcagtagaacaggtcaaaaatgcctttaataagttgcaagaaaaaggaatttataaagcgatgtcagaatttgacatttttattaattacattgaggcctacatgacaatgaagatccgaaat

SEQ ID NO: 14559 - DNA, 534 bp, Artificial Sequence
  Description of Artificial Sequence: Synthetic coding sequence
atgcatagtagcgctctcctttgctgtcttgtgctgctcaccggagtgcgagccagccccggtcagggcactcagtcggagaattcctgcactcacttcccggggaacctgccgaacatgctgagggacctcagagacgcattttcacgcgtcaaaacgttcttccagatgaaagaccaactcgataacctgctccttaaggaatcgctgctggaagatttcaagggatacctggggtgtcaagcgctcagtgaaatgatccagttctacctcgaagaggttatgccacaggcggagaaccaggatccagacatcaaggcccacgtcaattcacttggtgaaaatctgaaaaccctgcggctccgcttgcgccgctgccaccgctttctcccgtgcgaaaacaagtctaaggctgtggaacaagtgaagaacgctttcaacaagctccaggagaagggaatctataaggccatgtcggagtttgatatctttatcaactacattgaagcatacatgaccatgaagatccggaac

SEQ ID NO: 14560 - DNA, 534 bp, Artificial Sequence
  Description of Artificial Sequence: Synthetic coding sequence
atgcattcaagcgctctcctttgttgtctggtgctcctcactggagtgagagcaagccctggtcagggaacgcaatcagagaacagctgtactcatttccctggaaacctgcccaatatgctgagagacttgcgcgatgccttctcgcgagtcaagaccttcttccaaatgaaggaccaacttgacaacctgctgctgaaggaatcgctgcttgaggactttaaaggctacctgggttgccaagctctgtcggagatgattcaattctaccttgaagaggtcatgccacaggcggaaaatcaagatcctgacataaaggcacatgtcaacagccttggagaaaatcttaagaccctgcgccttcgcctccgccgctgtcatcgttttctcccctgcgaaaacaagtccaaagcggtggaacaagtgaagaacgcatttaacaaacttcaggagaagggaatttacaaggccatgtcagagtttgacatattcattaactacattgaagcatacatgactatgaagatccggaac

SEQ ID NO: 14561 - DNA, 534 bp, Artificial Sequence
  Description of Artificial Sequence: Synthetic coding sequence
atgcactcctccgcgctgctgtgctgcctggttctcctgaccggagtccgggcctcgccgggccaggggacccagtcagagaattcgtgtactcacttcccaggaaatctccctaacatgctgagagatctccgcgacgccttctcaagagtgaaaacttttttccaaatgaaggaccagctcgacaatctgctgctgaaggaatcgctgctcgaggacttcaagggatacctgggctgccaggcactgtctgagatgatccagttttatctcgaggaggtcatgcctcaagctgaaaatcaggacccggatatcaaggcacatgtcaactccctgggagagaatctgaaaacgctgcgcctcagactccggcgctgtcatcgctttttgccgtgcgagaacaagagcaaggccgtggagcaagttaagaatgcgttcaacaaacttcaggaaaagggcatatacaaggccatgtctgaattcgacatcttcatcaactacattgaagcctacatgaccatgaagatcagaaac

SEQ ID NO: 14562 - DNA, 534 bp, Artificial Sequence
  Description of Artificial Sequence: Synthetic coding sequence
atgcactcctcggcactgctctgttgcttggtcctccttaccggagtcagggcgtcaccaggccaaggtacgcagtccgaaaactcatgcacccacttcccagggaatttgcctaatatgctgcgggacctgagggacgcgttttcgcgcgtgaaaacgttttttcagatgaaggatcaactggacaaccttctgcttaaggaatcactgctggaagatttcaagggttacctcggatgtcaagctctttccgaaatgattcaattctaccttgaggaagtgatgcctcaggccgaaaaccaagatcccgatatcaaagcacatgtgaattccctcggcgaaaacttgaaaacgttgcggttgcgattgaggagatgccatcgttttctcccatgtgaaaacaagagcaaggcagtcgagcaagtcaagaacgcattcaataaactccaggagaaaggcatttacaaggcaatgtcggagtttgacatctttatcaactatattgaagcctacatgaccatgaagatccgcaac

SEQ ID NO: 14563 - DNA, 534 bp, Artificial Sequence
  Description of Artificial Sequence: Synthetic coding sequence
atgcattcctccgccttgctctgttgcctggtgttgctgacaggtgtgcgcgcttccccaggacagggaacccagagtgagaacagctgcacgcatttccctggtaacctccctaatatgttgagagatctccgcgacgctttcagccgggtgaagactttcttccagatgaaagaccagttggacaacctcctgctgaaagaaagtttgctggaggacttcaagggttacctgggatgtcaggccctgtctgagatgattcagttctacctggaagaggtgatgccacaagcagagaaccaggacccagacatcaaagcccatgtgaacagcctcggcgagaatctcaagactttgcggctgcggctgagacgatgccaccggtttctgccttgcgagaataaatccaaagccgtggagcaggttaaaaatgccttcaataagctccaagagaagggaatttataaggctatgagcgaatttgatattttcataaattatatagaggcctacatgaccatgaagatcaggaac

SEQ ID NO: 14564 - DNA, 534 bp, Artificial Sequence
  Description of Artificial Sequence: Synthetic coding sequence
atgcacagctcggccttgctgtgctgcctggtgctgcttaccggagtcagagcatcccccggtcaaggcactcaatcggagaactcttgtacccacttccccgggaatctgccaaacatgctgcgtgacttacgagatgccttttctcgcgtgaaaacgttctttcagatgaaagatcagctggacaatctgttgctgaaagagtctttgcttgaggactttaaggggtacctggggtgccaggcccttagtgaaatgatccagttttatcttgaagaggtgatgccgcaggccgaaaatcaggacccggatataaaggcccatgtgaattcacttggggaaaatttgaaaacactgaggttgcgccttcgccgctgtcatagattcctgccttgtgaaaataagagtaaagctgttgagcaggtaaaaaacgcgtttaacaagttgcaggagaaggggatctacaaggcaatgagtgagttcgatatcttcatcaattatattgaggcatatatgactatgaagatacgcaat

SEQ ID NO: 14565 - DNA, 534 bp, Artificial Sequence
  Description of Artificial Sequence: Synthetic coding sequence
atgcactcctctgccctcttgtgttgtctggtgcttctgactggggttagggctagccctggacagggtacccagagtgagaattcttgcacacacttcccgggaaatctccccaacatgttgagagacctgcgggatgccttcagtcgagtgaaaacatttttccaaatgaaggatcagctggacaacctgctgctgaaagagtcactgttagaagactttaaaggatacctgggttgccaggccctttctgagatgatccagttctaccttgaggaggtgatgccccaggccgagaaccaggaccccgatatcaaggcgcatgttaactcactcggggagaatctaaagaccctgcgtctgcggctacgtcgctgccatcgtttcctgccctgcgagaataaatccaaggcagtggaacaggttaaaaacgcattcaacaagctgcaggagaagggaatatacaaagccatgtccgagtttgatatttttatcaattatatcgaggcttatatgactatgaaaatccggaat

SEQ ID NO: 14566 - DNA, 534 bp, Artificial Sequence
  Description of Artificial Sequence: Synthetic coding sequence
atgcactcctcggccttgttgtgttgtctggtgctccttactggtgtgcgggcgtcacccggacagggaactcaatccgaaaatagctgtactcattttccaggaaatctccctaacatgctgcgggacctgcgtgatgcattttctagggtcaaaacgttctttcaaatgaaggatcagctcgacaacctccttctgaaggaaagccttcttgaagatttcaaaggctacttgggctgccaagcgcttagcgagatgattcagttttaccttgaggaagtaatgcctcaggccgagaaccaagatccagacattaaggcacacgtcaattctctcggggaaaatctgaaaactctgagacttcgactgaggcgctgccatagatttcttccttgtgaaaacaagtccaaagcagtggaacaagtgaagaacgccttcaataagttgcaagagaaaggaatctacaaggcaatgtcggaatttgacatattcatcaactacatagaggcttatatgacgatgaaaattcgaaac

SEQ ID NO: 14567 - DNA, 534 bp, Artificial Sequence
  Description of Artificial Sequence: Synthetic coding sequence
atgcatagcagcgccctgctgtgttgtctggtgctcctgaccggggtgagagcctccccgggccagggtactcaatccgaaaattcctgcacacatttccccggcaaccttccgaacatgttgcgcgatctcagagatgcctttagcagggtgaagacattcttccagatgaaggatcagcttgacaacttgctgctgaaagagtctctgcttgaggatttcaagggatacctgggatgtcaagcactgagtgagatgatccagttttacctcgaggaggtgatgccccaagcagagaatcaggaccctgacataaaagctcatgtaaattccctgggcgagaacttgaagacactgaggttgcgcctgcgaaggtgtcacagattccttccatgcgagaataaaagcaaggccgtggaacaagtgaaaaacgcatttaacaagctgcaggagaaggggatctacaaagccatgtctgagtttgatattttcatcaattatattgaggcctatatgaccatgaaaattaggaac

SEQ ID NO: 14568 - DNA, 534 bp, Artificial Sequence
  Description of Artificial Sequence: Synthetic coding sequence
atgcatagcagtgctttgttgtgctgtctggtgttgctgacgggcgtgcgtgcctctcccggtcagggcacccaatcagaaaactcttgtacacattttccaggcaacctgccaaacatgctgcgcgacctacgcgatgcattctcgcgcgtaaagacttttttccagatgaaagaccagctagataacctgctcttgaaggagtcgcttctggaggacttcaagggatatctggggtgccaggctcttagcgaaatgatacaattttacctggaggaggttatgccccaggcggagaaccaggatcccgacattaaagctcatgtgaatagccttggcgagaaccttaagaccctgaggttaaggttgagacgttgccaccgctttctaccatgcgagaacaagtccaaggccgtggaacaggtgaagaacgcgttcaacaagctccaggaaaaaggaatctacaaggccatgagcgaatttgatatttttattaactatatcgaggcttacatgactatgaaaatacgcaat

SEQ ID NO: 14569 - DNA, 534 bp, Artificial Sequence
  Description of Artificial Sequence: Synthetic coding sequence
atgcattccagcgcactcttgtgttgcctggtgctgctcaccggtgtccgggcctccccggggcagggaacccagagcgaaaactcgtgcactcacttcccaggaaatctgcccaatatgctccgcgacctgagggacgcgttctcccgggtgaaaaccttcttccaaatgaaggaccaacttgataaccttctgctcaaggagtcgctgctggaggatttcaagggatacctcggctgtcaggctttgtctgaaatgatccagttctacttggaggaagtgatgccgcaagccgagaaccaggacccggatatcaaggcacacgtcaactcgctcggcgaaaacctgaaaacgctgcgcctgagactgagacgatgccatcggtttctcccttgcgaaaacaagtcaaaggctgtggaacaagttaaaaacgcctttaataagctgcaggagaagggaatctataaggccatgtcagagttcgacatttttatcaattacatcgaagcgtacatgactatgaaaatccgcaac

SEQ ID NO: 14570 - DNA, 534 bp, Artificial Sequence
  Description of Artificial Sequence: Synthetic coding sequence
atgcattcttccgcgctgctgtgctgtttggttctgttgacaggagtgcgggcgtcccctggccagggcacccaatctgaaaactcatgtacacattttcccgggaacttgccaaatatgctccgagacctgcgggacgccttttcccgggttaagaccttcttccagatgaaagatcagctagacaaccttctactgaaggagtctctactcgaggacttcaagggctacttgggctgtcaggccctgtcagagatgattcagttttacctggaggaggttatgccccaggcagaaaatcaggaccccgacatcaaagctcatgttaattcgttgggagagaacctgaagactttaaggctcaggctacggcgctgtcatcggttcctgccatgcgagaacaagtcgaaggccgtggagcaggtgaaaaatgcattcaataagctgcaggagaagggcatctacaaggctatgagcgagtttgacatcttcatcaactacatagaagcatacatgactatgaaaattcggaac

SEQ ID NO: 14571 - DNA, 534 bp, Artificial Sequence; identical to SEQ ID NO: 14556
  Description of Artificial Sequence: Synthetic coding sequence

SEQ ID NO: 14572 - DNA, 534 bp, Artificial Sequence
  Description of Artificial Sequence: Synthetic coding sequence
atgcattcctccgctctgctgtgctgcctagtactcttgactggagttcgggcctccccaggacagggaacacagagtgaaaattcatgcacacacttccccgggaatctccctaatatgctgagggacctgcgggatgccttcagtcgcgtcaagactttctttcagatgaaagatcagctagataacctccttctaaaagaaagtctactagaagattttaaaggatacctggggtgccaggctctgtctgagatgatacagttttatctagaagaggtgatgccacaagctgaaaatcaggatccagatataaaagctcacgttaatagtctgggagaaaatcttaagactcttagactgcgcctcaggagatgccaccggttcctgccttgtgaaaacaaatccaaagccgtggagcaggttaagaatgccttcaacaaactgcaggaaaaagggatttataaagctatgtctgagtttgatatattcattaattacatcgaagcatatatgacaatgaagattcgaaac

SEQ ID NO: 14573 - DNA, 534 bp, Artificial Sequence
  Description of Artificial Sequence: Synthetic coding sequence
atgcattcgtccgcactgctttgttgtcttgtgctgcttactggcgtccgggcgagccctgggcaaggaacccaatcggaaaatagctgcacccattttcctggtaacttgccaaatatgcttcgcgatcttagggatgctttcagtcgagtcaagacttttttccaaatgaaggatcagctcgataatctgcttcttaaagagtcgctccttgaagatttcaagggttacctgggttgtcaggcactcagcgaaatgatacagttttatcttgaggaagtcatgcctcaggcggaaaaccaagatccagacattaaggcccatgtgaactcgctcggcgaaaacctgaaaaccctcagacttaggctgcggcgctgtcaccgatttctgccctgcgagaacaagtctaaggctgtggagcaagtgaaaaatgccttcaataaacttcaggaaaagggtatctacaaagctatgagcgaatttgacattttcattaactacatcgaagcatacatgacgatgaagattcggaat

SEQ ID NO: 14574 - DNA, 534 bp, Artificial Sequence
  Description of Artificial Sequence: Synthetic coding sequence
atgcactcatcagccctcctgtgctgcctcgtgctgctcaccggtgtgcgggcatctcctgggcagggaactcagagcgaaaactcctgtacccacttcccaggcaatctgccgaatatgctgcgcgatctgcgcgatgccttctcgcgggtgaaaaccttcttccagatgaaggaccaactggacaacctgttgctcaaggaatctctcctcgaagatttcaaaggttacctgggatgtcaggcactttcggaaatgatccagttttacctggaggaggtgatgccacaagccgaaaaccaagacccagatatcaaagcccatgtcaattccctcggggagaaccttaagaccctgcggctgcgattgcgcagatgccacaggttcctgccgtgcgagaacaagagcaaagcagtggaacaggtgaaaaatgccttcaacaagctccaggagaaaggaatctacaaggcgatgtccgagtttgatatcttcattaactatatcgaagcctacatgactatgaaaatcagaaac

SEQ ID NO: 14575 - DNA, 534 bp, Artificial Sequence
  Description of Artificial Sequence: Synthetic coding sequence
atgcatagttctgcccttctgtgctgtctggtgctgctgactggggtccgcgcaagtcctggccagggcactcagtcggaaaattcttgtacccatttccccgggaacttgccaaacatgctgagggacctccgggatgctttctcccgggtcaagacttttttccagatgaaggaccagctggacaacctgctacttaaggaatctctccttgaggactttaagggctatctcggatgtcaagcactgtctgaaatgattcaattctatctagaggaagttatgccacaagcagaaaaccaggatcccgatattaaggctcacgtgaactccttgggagagaatctgaaaacattgaggttgagactgagaaggtgtcatcgatttctcccatgcgagaacaaatcaaaggcggtggagcaggtgaagaatgctttcaataaactgcaggaaaaaggcatttataaggccatgagtgaattcgatatcttcattaattacatcgaggcctacatgacgatgaagatcaggaat

SEQ ID NO: 14576 - DNA, 534 bp, Artificial Sequence
  Description of Artificial Sequence: Synthetic coding sequence
atgcactcgtcagcactgctttgctgtctcgtgcttttgacgggagttcgtgcatccccaggccaagggactcaatccgagaattcctgtactcattttcctggaaacctgccaaacatgctccgggatctgcgggatgcgttcagcagggtcaagaccttctttcaaatgaaggatcagctggacaatcttctgcttaaggaatcgctgctcgaagatttcaaaggttacttgggatgtcaggcacttagcgaaatgatccaattctaccttgaagaagtgatgccccaagccgaaaaccaagatccagacattaaggcccacgtcaacagccttggcgagaatctgaaaaccttgcgtctcagacttcgcagatgtcatcgcttcctgccttgcgaaaacaagagcaaggcagtggagcaggtgaaaaatgcctttaacaaactccaagagaagggtatttacaaggcgatgtccgaatttgacatcttcataaactatattgaggcttatatgaccatgaagatccgcaat

SEQ ID NO: 14577 - DNA, 534 bp, Artificial Sequence
  Description of Artificial Sequence: Synthetic coding sequence
atgcacagttccgccctgctgtgctgtctcgtcctcctgacgggggtgagggcctctcctggccagggcacacagagcgagaattcctgcacgcacttccccgggaatctgcccaacatgttacgggatctgagagacgcattctcccgagtcaaaacatttttccagatgaaagaccagctcgacaacttactgctgaaggaaagcttgctggaggacttcaaggggtacctaggctgccaagctcttagtgagatgatccagttttatctggaggaggttatgccgcaggcggaaaaccaagatcccgacattaaagcacatgtaaattctttgggcgagaacttaaaaactctcagactgcgtttacgaagatgtcacagattcttgccgtgcgagaataaatccaaggcagttgagcaggtgaaaaacgcttttaataagttacaggagaaggggatctacaaggctatgagtgaattcgacatcttcatcaattacatcgaggcctatatgaccatgaagatcaggaac

SEQ ID NO: 14578 - DNA, 534 bp, Artificial Sequence
  Description of Artificial Sequence: Synthetic coding sequence
atgcatagctctgcgctcctgtgctgcttggtgctgctgaccggagttcgcgcctcccccggacagggtacccagtcagagaatagctgtactcacttcccgggcaaccttccaaacatgctccgtgacctgcgggatgccttctcgcgcgtcaaaacctttttccaaatgaaggaccaactcgacaacctgcttctgaaggaatctcttctggaggatttcaagggttacttggggtgccaagccttgagcgaaatgatccagttttacctggaagaagtgatgcctcaggcagaaaaccaagacccagacatcaaagctcatgtgaactcacttggagagaatctgaaaactctgcgcctgcggttgcgaaggtgtcacagattcttgccgtgcgagaacaaatcgaaagcagtcgagcaggtgaagaatgctttcaataagttgcaggaaaagggaatatacaaggctatgtccgagttcgatatcttcatcaactatatcgaagcctacatgacgatgaagattcgcaac

SEQ ID NO: 14579 - DNA, 534 bp, Artificial Sequence
  Description of Artificial Sequence: Synthetic coding sequence
atgcatagttccgccctcttgtgctgcctggtgctcctgaccggcgtgcgagcttcgccgggccaagggacccagagcgagaattcgtgcacgcacttccctggcaatcttcccaatatgcttagggacctccgagatgccttctcgcgcgtcaagaccttctttcagatgaaggatcaactggataatctgctgctgaaggagagcttgctcgaggacttcaaagggtacctcggttgtcaagcgctgagtgaaatgattcagttttacctggaggaggtcatgccacaagcagaaaatcaggaccccgatatcaaagcgcacgtcaacagtctgggagagaatcttaagacgctgcgcctgcgcttacgccgatgtcacagattccttccgtgcgaaaacaagtcgaaagctgtagaacaggtgaagaacgcattcaataagctgcaggaaaagggaatctataaggctatgtctgagtttgacattttcatcaactacatagaggcctatatgactatgaaaatccggaac

SEQ ID NO: 14580 - DNA, 534 bp, Artificial Sequence
  Description of Artificial Sequence: Synthetic coding sequence
atgcactcttcagccctcctgtgctgtctcgtgctcctcactggagttcgcgcgagcccaggacaaggtacacagtctgaaaattcttgtacccattttccagggaaccttcccaacatgctcagagacctgagagatgcatttagccgcgtgaagacctttttccaaatgaaggatcaactcgataacctgctgctgaaagaatccctcctcgaagattttaaaggttacctcggttgccaggcattgtccgaaatgatccaattctacctggaagaagtgatgccccaggctgagaaccaagatcctgatatcaaggcacatgttaactcgctgggcgagaacctaaagacattgaggctgcgcctgagacgctgccatcgttttctcccttgcgaaaacaagagcaaggccgtggagcaggtaaagaatgcttttaacaagctccaggaaaaaggtatttacaaagccatgagtgagttcgacatttttatcaattatatagaggcgtacatgactatgaaaatccggaac

SEQ ID NO: 14581 - DNA, 534 bp, Artificial Sequence
  Description of Artificial Sequence: Synthetic coding sequence
atgcattcctccgctctcctgtgctgccttgtgctgctgacaggagttcgggcatctccaggccagggaacacaaagtgaaaactcttgcacacacttcccaggcaaccttccaaacatgctgcgcgacttgcgggacgccttttcgcgggtgaagaccttcttccaaatgaaggaccagctcgacaacctgcttctaaaggagtccttgctcgaagactttaaggggtacctcgggtgtcaggctctttccgagatgatccagttctacttagaggaggttatgcctcaggctgaaaaccaggaccctgacattaaagctcatgtcaattcactgggagaaaatctcaagacactgcgactgcgtttgagaagatgtcaccggttcctgccttgtgaaaacaagagcaaagctgttgagcaggtcaagaatgcttttaacaaactgcaggagaaaggaatatacaaagcaatgtcagagttcgacatttttattaactatattgaagcgtatatgacaatgaagatacggaat

SEQ ID NO: 14582 - DNA, 534 bp, Artificial Sequence
  Description of Artificial Sequence: Synthetic coding sequence
atgcactccagtgctctgctgtgttgtttggtgctactaaccggcgttcgggcttctccagggcagggcacccaaagtgagaactcctgcacccatttccctggcaacctgcctaacatgctgagagacttgagagatgccttcagtagagtcaagactttcttccagatgaaggaccagctggacaatctgctgctcaaggaatcactgctcgaagatttcaagggctacttaggatgccaagctctgtccgagatgattcagttttatctcgaggaggtgatgccacaggccgaaaaccaagaccccgacataaaggcccacgtaaactctctaggtgaaaacttgaaaaccctgcgactccgccttcgccggtgccataggtttctgccttgcgaaaacaagagcaaggcagtggaacaagtcaagaacgcctttaacaaattgcaggagaagggaatttataaggccatgagcgagtttgacatctttatcaactacatcgaagcttacatgaccatgaaaattagaaat

SEQ ID NO: 14583 - DNA, 534 bp, Artificial Sequence
  Description of Artificial Sequence: Synthetic coding sequence
atgcacagcagcgcattgctgtgttgtctggtgctgctgaccggcgtcagggcgagcccaggtcaaggtactcagagcgagaacagctgtacccattttccgggcaacttgccaaatatgttgcgcgatctacgggacgcattttcacgtgttaaaactttttttcaaatgaaagaccaactcgacaacctgttgctcaaagagtctctgcttgaagactttaagggctatctgggttgccaagcgctgagcgagatgatccagttctatcttgaggaggtgatgccgcaagcagaaaaccaggacccggacatcaaagcccatgtgaatagcttaggtgagaacctgaagaccctgcgcttgcgcctgcgtcgctgccatcgattcctcccttgtgagaataagtctaaagcggtagagcaagtgaaaaacgcgtttaacaagctgcaggagaaaggtatttacaaagcgatgagtgaattcgatatcttcatcaactatattgaagcgtacatgaccatgaagatacgcaat

SEQ ID NO: 14584 - DNA, 534 bp, Artificial Sequence
  Description of Artificial Sequence: Synthetic coding sequence
atgcattcatcggcacttctttgttgtttggtgcttcttactggagtccgggccagccctggtcaaggaactcaaagtgagaactcgtgtacccattttccaggcaacctgccaaacatgctccgggatctgcgtgatgcattttcgcgcgtcaagacctttttccagatgaaggaccagcttgacaatcttctcctgaaggaatcgctgttggaggatttcaaaggctacttgggttgtcaggcactcagcgagatgatccaattctacctggaagaagtgatgccccaggcagagaatcaggatccagacattaaagcacacgttaactcgttgggggaaaatctcaagactcttcgccttcgtcttagaagatgccacagattccttccatgcgagaacaaatctaaagccgtggaacaagtgaagaatgcgttcaataagttgcaagaaaagggaatctacaaggcgatgtccgaatttgacatattcatcaactatatcgaagcatacatgactatgaagattcgcaat

SEQ ID NO: 14585 - DNA, 534 bp, Artificial Sequence
  Description of Artificial Sequence: Synthetic coding sequence
atgcattcttccgcccttctgtgctgtcttgtgctgctgaccggagttcgtgctagccctggccaggggacccagagcgagaactcatgcacccacttccctggcaatttgcctaatatgctccgagacctgcgtgatgcttttagtcgcgtgaaaactttttttcaaatgaaggaccagcttgacaacctgcttctcaaggaaagcctgctggaggacttcaagggatacctggggtgtcaggcgcttagcgaaatgattcaattctacctcgaggaagtaatgccgcaggcagagaaccaggatccagatattaaagctcacgtgaacagtctgggggagaatctgaagaccctacgcctgcgcctgcggagatgccaccgttttttgccctgtgagaacaagtccaaagctgtggagcaggtgaagaatgcctttaacaagcttcaggagaagggcatctataaggcaatgtcagaattcgacatcttcatcaattacatcgaggcctacatgaccatgaaaatcaggaac

SEQ ID NO: 14586 - DNA, 534 bp, Artificial Sequence
  Description of Artificial Sequence: Synthetic coding sequence
atgcattccagcgctttgttgtgctgcctcgttctcctgaccggagtccgtgcgagccccgggcaggggacccaaagtgagaattcctgtacccactttcctggcaacctccctaacatgctccgagacttacgcgatgccttctctcgggtaaagactttttttcaaatgaaagaccagctagacaatttacttcttaaggaaagcctgctcgaggacttcaaaggttaccttgggtgtcaggcgctatctgaaatgatccaattttacttggaggaagtcatgccccaggcggagaatcaggacccagatatcaaggctcacgtgaattccttgggggagaatcttaagaccctgcggctgcgcttgagaagatgtcatcggttcctgccttgcgagaacaagagtaaagctgtggagcaagtgaaaaatgccttcaacaaacttcaggagaagggaatctacaaagccatgagtgaattcgatatctttataaactatattgaggcatacatgacaatgaaaatcaggaat

SEQ ID NO: 14587 - DNA, 534 bp, Artificial Sequence
  Description of Artificial Sequence: Synthetic coding sequence
atgcatagcagcgctctgctctgctgcctggtgttgctgaccggcgtgagggcatctccggggcaagggacacagagcgagaattcttgtactcattttcccggcaatctgccaaacatgctccgagacctgcgcgatgcgttctctcgtgtcaagacttttttccaaatgaaagatcagttggacaatctccttttaaaagaatccctgctggaagattttaagggctacctggggtgccaagccctgtctgaaatgattcaattctatctggaagaggtaatgccacaggcggagaatcaggaccccgatatcaaagctcacgtgaactcccttggggaaaatctcaaaactctgcggctaaggttgcgacgttgccatcgcttcctgccctgcgaaaacaaaagtaaagccgtcgaacaggttaaaaacgcgtttaataagctgcaggagaagggtatctataaagccatgagcgaattcgacatttttattaactatatcgaggcgtatatgacgatgaaaatccgcaat

SEQ ID NO: 14588 - DNA, 534 bp, Artificial Sequence
  Description of Artificial Sequence: Synthetic coding sequence
atgcattctagcgctctcctctgttgcctagtgctgcttacgggagtgagagcgtctcctgggcagggcactcagtctgaaaatagctgtacccactttcccgggaaccttcctaatatgttgagggacctgcgggatgcattctctagggtgaagaccttcttccaaatgaaggaccagttagacaacttgctcttgaaagaatcccttcttgaagactttaaaggttaccttggctgccaggccctctccgagatgatacagttctatctggaagaagtgatgccccaggccgaaaatcaggatcccgacatcaaagctcacgttaacagcctgggtgaaaacttgaaaaccctgcgcctcaggctcagacgatgtcacagatttctgccctgtgagaacaagtctaaagccgttgagcaggtcaaaaatgcatttaacaaactccaggagaaaggaatttacaaggcaatgagcgaattcgacatttttatcaattacatcgaggcctatatgaccatgaagatacgcaac

SEQ ID NO: 14589 - DNA, 534 bp, Artificial Sequence
  Description of Artificial Sequence: Synthetic coding sequence
atgcattcaagcgcactcctgtgttgccttgtcctgctgacgggggtgagggcatcccccggtcagggcactcaatcggagaactcttgtacgcatttccccgggaatctcccaaacatgctgcgggacctcagagatgctttctcccgggtcaagaccttttttcaaatgaaggatcaactggataatctgctgttgaaagagtccctgcttgaggactttaagggatatcttggttgtcaggcactttcggagatgatccaattctaccttgaagaagtcatgccccaggcagagaaccaagatcctgacatcaaggcccatgtgaactcgcttggagagaatctcaagactctgcgcttgcgtctgagacgatgtcatcggttcctcccatgtgagaataagtcaaaggcagtggaacaagtgaagaacgcgtttaacaaacttcaggaaaagggaatttacaaggcaatgtcggagttcgacatcttcatcaactatattgaagcatacatgaccatgaagattagaaac

SEQ ID NO: 14590 - DNA, 534 bp, Artificial Sequence
  Description of Artificial Sequence: Synthetic coding sequence
atgcactcgtctgcacttctctgctgtttggtattactgaccggggttcgagcatcccccggacaggggacccagtccgagaactcatgcacacattttcctggtaacctgcccaacatgttacgcgacctgcgcgatgcgttttcaagggtgaagaccttcttccagatgaaggatcagttagacaacctgctcttgaaagaaagtttgctcgaagattttaagggatacctcggctgccaggccttgtcagaaatgattcagttttacctcgaagaggttatgccacaggccgagaaccaagatcccgacataaaagctcacgtaaactcgttaggggaaaacctgaaaacattgcggcttagactaaggagatgccatcggttcctgccatgcgagaacaagagcaaagcggtcgagcaagtcaagaacgcctttaataaacttcaagagaagggtatttataaagctatgagtgagtttgacatattcatcaattacatagaagcgtatatgacaatgaaaatcagaaac

SEQ ID NO: 14591 - DNA, 534 bp, Artificial Sequence
  Description of Artificial Sequence: Synthetic coding sequence
atgcactcaagcgcactcctttgttgcctcgtcctgctgacaggcgtgcgggcttctcccgggcaaggaacacagtctgaaaattcttgtacacactttccaggcaaccttccaaacatgttgagagatctgcgtgacgcttttagcagggtcaaaacttttttccagatgaaagatcagctggataaccttttgctaaaggagtccctactggaagactttaagggctatttaggatgtcaggcactgagtgagatgattcagttttacctggaggaagtgatgcctcaggctgagaatcaagatcccgatataaaggcacatgtaaacagtctcggcgagaacctgaagacactgcgtctgcggctgcggaggtgccatcggttcctaccatgcgaaaataagagtaaggctgtggagcaggtgaagaacgccttcaacaaattgcaggagaagggcatctataaagcgatgtctgaatttgatatctttatcaattatattgaagcttatatgacaatgaaaatacgcaat

SEQ ID NO: 14592 - DNA, 534 bp, Artificial Sequence
  Description of Artificial Sequence: Synthetic coding sequence
atgcattcttctgctttattatgttgtcttgttcttttgacgggagttcgagcatctccaggacaaggaactcaatctgaaaattcatgtacacattttccaggaaatctaccaaacatgttaagggaccttagagatgcatttagtcgagttaaaacattttttcaaatgaaagatcaattagataatttattattgaaagaatcattacttgaagactttaagggatatcttggttgtcaggctttatctgaaatgatacaattttatttagaagaagttatgccacaagctgaaaatcaggatccagatattaaagcacatgttaatagtttaggagagaatttaaaaacacttagattaagattaagaagatgtcatagatttttaccatgtgaaaataaatctaaagctgttgaacaagttaaaaatgcttttaataaattacaagaaaaaggaatttataaagctatgagtgaattcgatatctttatcaattatatagaagcatatatgacaatgaaaattagaaat

SEQ ID NO: 14593 - DNA, 534 bp, Artificial Sequence
  Description of Artificial Sequence: Synthetic coding sequence
atgcattcctcggcactgctttgttgtctcgtgctgctgactggggtccgcgcatcgccaggacagggaacgcagtccgaaaacagctgcacccattttcccggaaatctgccgaatatgcttagagatctgcgagatgctttttcccgcgttaagacttttttccagatgaaggaccaattggacaatcttttgcttaaagagtcgcttctggaggactttaaaggctacctgggatgtcaagccctttcagaaatgattcagttctatctggaagaggtgatgccccaggcagaaaaccaagatcctgatatcaaggcacatgtcaattccctgggtgaaaatctgaaaaccttgaggcttcggcttcggcggtgccacagatttcttccttgcgaaaacaagtcgaaggcggtggaacaggtgaaaaacgcgttcaataagctgcaggagaagggcatctacaaggcaatgtctgaattcgacattttcatcaattacatcgaggcctacatgaccatgaagattagaaac

SEQ ID NO: 14594 - DNA, 534 bp, Artificial Sequence
  Description of Artificial Sequence: Synthetic coding sequence
atgcattcatctgcccttctttgttgcctcgtgctactaacaggtgtgagagcctcgccaggtcaggggacacagtcagagaactcatgtacgcacttccctggtaacctgcctaacatgctgcgtgatctgcgggacgcttttagtagagttaaaacctttttccaaatgaaagatcagctggacaatttgctgctaaaagagagtctgttggaagactttaaaggctatctgggctgccaggcattgtccgagatgattcagttctatctggaggaagtgatgccgcaggccgaaaaccaggatccagatattaaagctcacgtgaatagtctgggtgagaatttaaaaaccctgcggctgagattgaggaggtgtcatcgatttcttccttgcgaaaataaatctaaggctgtggagcaggtcaagaatgcctttaacaagctgcaagaaaaggggatttacaaagctatgagcgagtttgacatttttatcaactacattgaggcctatatgactatgaaaattcgcaat

SEQ ID NO: 14595 - DNA, 534 bp, Artificial Sequence
  Description of Artificial Sequence: Synthetic coding sequence
atgcactcgagcgccctgctttgctgcctcgtgttgctcacaggggtgagagccagccctgggcaggggacccagagtgaaaattcctgtacgcacttccccgggaatctgcccaacatgctgcgggacttaagagatgcctttagtcgcgtcaagaccttcttccaaatgaaagatcagctggacaacctgctgcttaaagaatcactcctcgaagatttcaaagggtatctaggctgccaagccctgtcagagatgattcagttttatctcgaggaagtaatgcctcaggccgagaatcaggacccagatataaaagcgcacgtcaacagcctgggggagaacttgaaaactctgcgcttacgcctaagacgttgtcatcgcttccttccgtgcgagaacaaaagcaaagcagttgagcaggtaaagaacgcattcaacaagttgcaggagaagggcatctataaggcaatgtctgagtttgacatatttatcaactacatcgaggcatatatgaccatgaaaattcgcaac

SEQ ID NO: 14596 - DNA, 534 bp, Artificial Sequence
  Description of Artificial Sequence: Synthetic coding sequence
atgcattcatccgccctgctgtgctgcctggtccttctcacgggagtgcgggcttctcccggccaggggactcagtcagagaattcgtgcacccatttccctggaaacctgccgaacatgctgagggacttgcgcgacgccttttcaagagtgaaaacttttttccaaatgaaagaccaactggacaatctgttgctcaaagaatccctgttggaggacttcaagggatacttgggatgccaggcgctgtcagagatgatccagttttacctcgaagaggtgatgccacaggcggaaaaccaagacccagacatcaaggcacacgtcaatagcctgggggaaaatcttaagaccctgcgcctccgcctgcggcgctgccaccgctttctgccgtgcgaaaacaaatcaaaagctgtggagcaggtgaagaacgcctttaacaagctccaggaaaagggaatctacaaggccatgtcggaattcgacattttcatcaactatattgaggcgtatatgacgatgaaaatccggaac

SEQ ID NO: 14597 - DNA, 534 bp, Artificial Sequence
  Description of Artificial Sequence: Synthetic coding sequence
atgcactcaagtgccctgctgtgctgccttgtgctgctgaccggggtgcgcgctagccctggacaaggcacacaatccgagaacagctgcacacactttcccggtaatctgcccaacatgttaagagaccttagggatgctttttctcgcgtgaagaccttctttcagatgaaagaccagcttgacaatctgctgctgaaagagtctctcttggaagattttaaagggtaccttggttgccaggctctgtctgaaatgatccaattctacctggaggaggtgatgccccaggcggaaaatcaggatcccgacatcaaggcccacgtcaacagtttgggcgagaacctgaagacactgcggcttcgacttcgcagatgtcacagatttctgccgtgtgaaaacaagtcaaaagctgtggaacaggtcaagaacgcatttaacaagctgcaggagaagggtatttataaagctatgagtgagtttgacatctttataaactacatagaggcatacatgactatgaagattcgtaac

SEQ ID NO: 14598 - DNA, 534 bp, Artificial Sequence
  Description of Artificial Sequence: Synthetic coding sequence
atgcactcatctgcactgctgtgctgtctcgtcctgttgacaggcgttagagcgagcccaggacagggaactcagagcgagaattcatgcacacatttcccgggcaacctgccaaacatgctaagagacctgcgggatgccttctctagagttaagactttctttcagatgaaagatcagctggacaaccttttgcttaaggagagtttgctggaggacttcaaaggttatctaggctgtcaagccctctccgaaatgatccagttctatctggaagaggtgatgccacaggcagagaatcaggaccctgatattaaagcgcacgtcaactccttaggagaaaatctgaaaacactccgattgaggctgcgccggtgtcaccggtttctcccatgtgagaacaaatccaaggctgtggaacaagtgaaaaatgcctttaacaagctgcaagagaagggaatctacaaggccatgagcgagtttgacatttttattaattatatcgaggcgtatatgactatgaaaatccgtaat

SEQ ID NO: 14599 - DNA, 534 bp, Artificial Sequence
  Description of Artificial Sequence: Synthetic coding sequence
atgcattcctccgcccttctctgttgcttggtgctcctgactggagtcagggcatcgcctggtcagggcacccaatccgagaattcctgcactcattttcccggcaacctccctaacatgctgcgagatcttcgcgatgcattttcaagagtcaagaccttttttcagatgaaggatcagctcgataaccttctccttaaagaatccctgctggaggactttaagggttacctgggttgtcaggccctctcggaaatgatccagttttatctggaagaagtgatgcctcaagcagaaaaccaggatccagacataaaggcacacgtgaactctctgggcgagaatctgaaaacccttagattgcgccttagaaggtgtcatagattcctgccttgtgagaacaagtccaaagccgtggaacaggtcaagaacgcattcaacaaacttcaagaaaaaggaatctacaaggccatgtcggagtttgacattttcattaactacattgaagcatacatgaccatgaagatccgtaac

SEQ ID NO: 14600 - DNA, 534 bp, Artificial Sequence
  Description of Artificial Sequence: Synthetic coding sequence
atgcactcttccgctctgctgtgctgcctggtcttgctaacgggcgtacgggcctccccgggtcagggcacgcaatctgaaaattcgtgcacccatttccccggcaacctgcccaacatgctccgtgacctgcgtgacgctttttctcgggtgaagaccttcttccagatgaaggaccaattggacaacctcctgcttaaggaaagtctgttggaagatttcaaggggtatctgggatgccaggcactatctgagatgatacagttctacctcgaggaggttatgccgcaggcagagaaccaagaccccgacattaaagcccacgtcaactcgctgggagagaatctaaagacgctgcgcctccgcctgcgcaggtgccaccgattcctgccatgcgagaacaagtccaaggcggttgaacaggtgaaaaacgccttcaataaattgcaggagaaaggcatttacaaggccatgtccgagttcgatattttcatcaattatatcgaggcctatatgaccatgaagatcagaaat

SEQ ID NO: 14601 - DNA, 534 bp, Artificial Sequence
  Description of Artificial Sequence: Synthetic coding sequence
atgcactcttccgccttgctgtgctgccttgtgttactcacaggagtgcgggcatctcccgggcagggcactcagtccgagaacagctgtactcacttccctggcaatctccccaacatgctgagagacctgagggacgctttctcaagggtaaagaccttctttcagatgaaggatcagctggacaacctcctgctgaaggagagcctgctcgaggactttaaaggctacctgggctgccaggctctgtccgagatgattcagttctatttagaagaggttatgcctcaagcggagaatcaggacccagacatcaaagctcacgtcaacagtcttggcgagaatctgaagactctgagactccgcctgcgacggtgtcatcgcttcctgccatgcgaaaataagtcaaaggccgtcgaacaagtaaagaatgcctttaacaagctgcaggagaaaggcatctataaggcaatgtctgaattcgacatatttataaattatattgaggcctacatgacaatgaagatacgcaat

SEQ ID NO: 14602 - DNA, 534 bp, Artificial Sequence
  Description of Artificial Sequence: Synthetic coding sequence
atgcatagctcggcattgctctgttgcctcgtgctgctgaccggggtccgcgcgtcccctggtcaaggaactcaatccgaaaactcctgcactcattttcctggtaacctcccaaacatgctgagggatctgcgcgacgcattttccagggttaagacctttttccagatgaaggatcagctggataatctcctgctgaaggaatcgcttctggaggacttcaagggatacttgggttgccaggcactcagcgaaatgatccagttttacctcgaagaagtcatgccccaagctgagaaccaagaccccgatatcaaggcccatgtcaactcacttggagaaaacctcaagacccttagacttaggttgaggagatgtcacagatttctcccttgtgagaacaagtcaaaggcagtggagcaagtgaaaaatgcttttaacaaactccaagaaaaggggatttacaaagccatgagcgaatttgacattttcatcaattacatcgaagcctacatgactatgaaaatcaggaac

SEQ ID NO: 14603 - DNA, 534 bp, Artificial Sequence
  Description of Artificial Sequence: Synthetic coding sequence
atgcattccagtgccctgctctgctgccttgtcctcctgaccggtgtgcgggcgtcgccgggtcaagggacgcagagcgaaaactcctgtactcactttccgggtaatctgcctaatatgcttcgggacttgagggatgcgttctcccgtgtgaaaaccttctttcaaatgaaagatcaactcgataaccttctcctgaaggaatcattgctggaggatttcaagggatacctgggatgccaggcgctctccgaaatgattcagttctaccttgaagaggttatgccacaggcagaaaatcaagaccccgacatcaaggcccacgtgaattcgctgggagagaatttgaaaaccctgcgcctgcgactgagacgctgccatagattcctgccgtgtgagaacaaatcgaaggccgtggaacaggtgaaaaacgctttcaacaagctgcaggagaaagggatctataaggcgatgtcggaattcgacattttcatcaactacatcgaggcttacatgactatgaaaatccggaac

SEQ ID NO: 14604 - DNA, 534 bp, Artificial Sequence
  Description of Artificial Sequence: Synthetic coding sequence
atgcactcgtcggcgctcctttgctgtctcgttctgctgaccggagtgagagcgtcaccaggacagggcacccaatctgagaactcatgcactcacttcccgggaaatctccccaatatgctgcgcgatctgcgcgacgccttttcgcgcgtcaaaaccttcttccagatgaaggaccaactggataacctgcttttgaaggagtcgctgttggaggacttcaagggctacctgggatgtcaggccctcagcgagatgattcagttttatcttgaagaagtgatgcctcaggccgaaaaccaagaccccgatatcaaggcacatgtgaattcactgggcgaaaatctgaaaaccctcagactgcgactgcggcgctgccatcgctttcttccgtgcgagaacaagtcaaaggccgtggagcaagtcaagaacgccttcaataagctccaggaaaaaggaatttacaaagctatgtccgaattcgacatcttcataaactacatcgaagcatacatgactatgaaaatccggaac

SEQ ID NO: 14605 - DNA, 534 bp, Artificial Sequence
  Description of Artificial Sequence: Synthetic coding sequence
atgcatagttctgccctgctgtgttgtctagtgttgctgacaggagtgcgcgcttctcctggtcaaggcactcaatccgagaattcctgtactcattttcccggcaatctgcctaatatgcttcgggatctacgagacgctttctcgcgggttaagacgttcttccaaatgaaagatcaactagacaatctgctcctcaaggagtcgctgctggaagatttcaaggggtatctgggctgtcaggcacttagtgagatgatccagttctacctggaggaagtaatgccccaagcggaaaatcaggatcccgatatcaaggcacatgtgaacagcctaggagaaaacctcaaaaccctgcggttaagattgcgtcgctgtcacaggtttctaccgtgcgagaataagagtaaggccgtcgagcaagtgaaaaatgcctttaacaagctgcaggaaaaaggaatctataaagccatgtccgagtttgacatcttcatcaactacatcgaggcttatatgaccatgaagattcggaat

SEQ ID NO: 14606 - DNA, 534 bp, Artificial Sequence
  Description of Artificial Sequence: Synthetic coding sequence
atgcacagcagcgctctcctgtgctgtctggttctgctgaccggagtccgcgcatcgccaggtcaaggtactcaaagcgaaaactcttgcacccactttccgggaaacctgcctaacatgctgcgggatctgcgggatgctttctcccgagtaaagacgttcttccaaatgaaagatcagctggacaacctgctcctgaaagagtcgctgctggaggactttaagggatacctgggctgtcaggccctctccgaaatgatccagttctacctcgaagaggtgatgccgcaggccgaaaatcaagacccggacatcaaggcccacgtcaactcactgggagaaaacttgaaaactctgcggctccgcttgaggagatgccaccggtttctcccctgcgaaaacaagtccaaagcggtggagcaggtgaaaaacgccttcaacaagctccaggagaagggaatctacaaagcgatgtcggaattcgacatcttcatcaattacattgaggcctacatgactatgaaaatcaggaat

SEQ ID NO: 14607 - DNA, 534 bp, Artificial Sequence
  Description of Artificial Sequence: Synthetic coding sequence
atgcattcgtctgctttgttgtgttgtctcgtgttgctaaccggggtgagggcatcccctggacagggtacacagtcagagaattcctgcacacatttcccaggaaacctccctaatatgttaagggacctccgagatgctttcagtcgagtgaagaccttttttcaaatgaaagatcagcttgataatctgcttcttaaagaatctctcttggaagatttcaagggatacttgggatgtcaagctctttcagagatgattcagttctatttagaagaggtgatgccacaagcggagaatcaagatccagacattaaggcgcatgtaaactccttgggtgaaaatttaaagactctcaggcttagacttcgaaggtgtcatcgattccttccttgcgagaacaaatccaaagctgttgaacaggtcaagaatgctttcaacaagctccaagagaagggcatttataaggctatgtctgaattcgatatctttatcaactatatcgaagcttatatgacgatgaagattcggaat

SEQ ID NO: 14608 - DNA, 534 bp, Artificial Sequence
  Description of Artificial Sequence: Synthetic coding sequence
atgcattcgtcagctcttctttgttgcctggtgttgttgactggcgtgcgcgcatctccaggacaaggaactcagagcgagaactcatgtacccatttccccggtaatcttccaaatatgctgagagatctgcgtgacgcgttctcaagagtcaagaccttttttcaaatgaaggatcaacttgataacctcttgctgaaggaaagccttttggaagatttcaagggttacctggggtgccaggccttgtcagaaatgatccaattctacctggaggaagtcatgccacaagcggagaaccaggatccggacattaaggctcatgtcaactccctgggagaaaatcttaagactctcagactgcgcctgcggcgttgccacagatttctgccctgtgagaacaagtccaaggccgtggaacaagtgaaaaacgcgttcaataagctgcaggagaaggggatatacaaggcaatgtccgaatttgacattttcattaactacatagaagcatacatgactatgaagatccggaac

SEQ ID NO: 14609 - DNA, 534 bp, Artificial Sequence
  Description of Artificial Sequence: Synthetic coding sequence
atgcattctagcgctctgctctgctgtctcgtgctgttgactggagtccgcgcatccccaggacagggtacccagagcgaaaacagctgcacccacttcccaggaaatcttcccaacatgctgcgtgatctgcgcgatgctttttcccgcgtgaagacttttttccagatgaaggaccaactggataatttgctgcttaaggagtccctcctcgaggactttaagggttatctgggatgtcaagccctgagcgagatgattcagttttacctggaggaggttatgcctcaggctgagaatcaggacccagatatcaaggctcacgtaaattctcttggcgagaatctgaagactctgaggctcaggctcagaagatgtcaccgctttctcccttgcgagaacaaaagtaaggctgtagagcaagtcaaaaatgctttcaacaagttgcaggagaagggaatctacaaagccatgtctgaatttgatatttttattaactacattgaagcttacatgactatgaagataaggaat

SEQ ID NO: 14610 - DNA, 534 bp, Artificial Sequence
  Description of Artificial Sequence: Synthetic coding sequence
atgcattcttcagcgctgctgtgctgccttgtgctgctgaccggtgtgagagcctcccctggacagggaacacaaagtgagaattcatgtactcactttccaggaaatctgccgaacatgctgcgtgacttgcgcgatgcgttttctagagttaaaacctttttccagatgaaagatcaattggacaatctgctcctgaaggaatcacttctggaggactttaaagggtacctgggttgtcaagctttgtccgagatgatccagttttacctcgaggaagtgatgccacaagcagagaaccaggaccccgatattaaggctcacgttaacagtctgggggagaaccttaagaccctgcgtctgcgcctccggaggtgccaccggtttctgccatgcgagaacaaatcaaaggccgttgaacaggttaaaaacgcattcaataaactacaagaaaaggggatttacaaggccatgtccgaattcgacattttcatcaactatattgaggcatacatgactatgaagattcgcaat

SEQ ID NO: 14611 - DNA, 534 bp, Artificial Sequence
  Description of Artificial Sequence: Synthetic coding sequence
atgcattcctccgcgttgctgtgctgcctcgtgttgctcactggcgtgcgcgcgtcgcctggccagggtactcaaagcgaaaattcctgtactcactttccggggaacctcccgaacatgctgcgtgacctccgggacgccttcagccgcgtgaaaaccttcttccagatgaaggatcagttggacaacttgcttttgaaggagtcacttctggaagatttcaagggatacctgggatgccaagccctgtcagaaatgatccagttttacttggaggaagtgatgccacaggcggaaaatcaggatccggacatcaaagcccatgttaactcgctgggggagaatctcaaaactctgagacttcgcctgcggcggtgtcacagattcctgccatgcgagaacaagtcaaaggctgtcgagcaggtgaaaaacgcctttaacaagctgcaagaaaaggggatctacaaggcaatgtcggaattcgatatctttatcaattacatcgaagcatacatgaccatgaagattcggaac

SEQ ID NO: 14612 - DNA, 534 bp, Artificial Sequence
  Description of Artificial Sequence: Synthetic coding sequence
atgcactcatctgccctcctatgttgcttggtgcttcttactggagtacgagcaagccctgggcagggtactcagtccgagaactcatgcacccacttcccaggaaacctccctaacatgctgagagacctccgcgacgcattttcgagagtgaagactttttttcagatgaaggaccagctggacaacctcctactgaaggagtccctactggaagactttaagggctacctaggatgtcaggccctaagcgagatgatccagttctacctggaggaagttatgccacaggcagagaaccaagatccagacatcaaagcacacgtgaacagcctgggggaaaatcttaagaccctacggttgagactgcgcagatgtcaccgattcctcccttgtgaaaataagagcaaggccgtcgagcaggtcaagaacgcattcaataaactgcaggagaaagggatatataaagccatgagtgaattcgacatattcatcaactacatcgaggcttatatgaccatgaaaattagaaat

SEQ ID NO: 14613 - DNA, 534 bp, Artificial Sequence
  Description of Artificial Sequence: Synthetic coding sequence
atgcatagctcggccctgctgtgttgtctcgtcttgctcacgggcgtccgcgctagtcctggacaaggtactcaatctgagaattcgtgcacgcatttccccggtaatttgcctaacatgcttagggacctccgggatgcctttagcagggtgaagactttcttccagatgaaagaccaactcgacaatcttctgctaaaagaatctctgttggaagattttaaaggttacctgggttgccaggctttgtccgaaatgatacagttttacttagaggaagtcatgccccaggccgaaaaccaggaccccgatatcaaggcccacgtgaattcacttggcgagaacctgaagacgcttcgactgcgactgaggcgttgccatcgattccttccttgcgaaaacaagtcaaaggccgtggaacaggtcaagaatgcgtttaacaaactccaagagaaaggtatatataaagctatgtcggaatttgatattttcataaactacattgaagcttacatgacaatgaaaataagaaat

SEQ ID NO: 14614 - DNA, 534 bp, Artificial Sequence
  Description of Artificial Sequence: Synthetic coding sequence
atgcattcgtccgcactcctctgctgcctggtgctcctcactggtgtacgcgcaagccctggccaaggtacccagagcgagaactcctgcactcacttcccgggaaacctcccaaacatgttgcgcgatctgcgggacgctttctccagggtcaagacgttcttccaaatgaaggatcagctcgacaatttgctgctgaaggaatcactgctcgaggactttaagggctacttgggatgccaggctttgtcagagatgatacaattctatcttgaagaagtgatgccccaagcggagaatcaggacccagatatcaaggcccacgtcaacagcctgggagaaaatctgaaaaccctgcggctccgtttgcgcagatgtcatagattcctgccgtgtgaaaacaaatcgaaagcagttgaacaggtgaagaacgccttcaacaagttgcaggagaagggaatttacaaagcgatgtcagaatttgatatctttatcaactacatcgaggcatacatgactatgaaaatccggaat

SEQ ID NO: 14615 - DNA, 534 bp, Artificial Sequence
  Description of Artificial Sequence: Synthetic coding sequence
atgcattcatccgcactgctttgttgtcttgtgctgctcaccggtgtgagagcatcgccagggcagggtacccagtcggaaaactcatgcacccattttcctggaaaccttccaaacatgcttagagatttgcgggacgcattttcgagagttaagactttctttcagatgaaggaccagctggataaccttctgcttaaggaaagcctgctggaggatttcaagggttacctcggatgccaggccctctcggagatgattcagttctacctcgaagaagtcatgccgcaagccgaaaaccaagatcctgatatcaaggctcacgtgaattcgcttggagagaacctgaaaacgctgcggttgcgtttgcgccgctgtcatcggtttcttccatgcgagaataagtccaaggctgtcgaacaggtgaagaatgcattcaacaaactccaggagaaaggaatttacaaagcaatgtcggaatttgatatctttatcaactacattgaggcatacatgactatgaagatacggaac

SEQ ID NO: 14616 - DNA, 534 bp, Artificial Sequence
  Description of Artificial Sequence: Synthetic coding sequence
atgcactcctcggcactcctgtgctgcctggtcctgctcactggtgtccgcgcctcccctggtcaaggaactcagtcggagaattcctgcacccacttcccgggcaatctgccaaatatgctgcgcgacctgcgggatgccttcagcagagtcaagactttcttccagatgaaggaccagctggacaacctgcttctgaaggaatcactcctcgaagatttcaagggatacctcgggtgccaggccctgagcgagatgatccagttctacctggaagaagtcatgccgcaagctgagaaccaggacccagacattaaggctcatgtcaattcgcttggagagaacctcaagacgttgagactgcgtctgagacggtgccatcgcttcctgccgtgcgaaaacaagtcaaaggcggtggaacaggtgaagaacgctttcaacaagctgcaggagaaaggaatctacaaagcgatgagcgagtttgacattttcattaactacatcgaggcatacatgaccatgaagatccgcaac

SEQ ID NO: 14617 - DNA, 534 bp, Artificial Sequence
  Description of Artificial Sequence: Synthetic coding sequence
atgcattcctccgctctgctctgctgtcttgtgcttctgaccggagtgcgtgcctcacctgggcagggcacccaatccgagaactcttgcactcactttccgggaaacctgccaaacatgctgcgcgatctgcgggacgcgttctcgagagttaagactttctttcagatgaaggaccagcttgataatctgctcttgaaagagtcgctgctcgaagatttcaaaggatacctggggtgccaggcactgtcggaaatgatacagttctatttggaagaggtgatgccacaagccgagaaccaagatcctgacatcaaggcccatgtaaactcactgggtgaaaacctcaagacgctgcggctgcgattgcgccggtgtcacagattcctgccctgtgaaaacaaatcgaaggcagtcgaacaggtgaaaaatgctttcaataagctccaagagaaaggaatctacaaggctatgtcagaattcgacatcttcatcaattacattgaggcctacatgaccatgaagattcgcaac

SEQ ID NO: 14618 - DNA, 534 bp, Artificial Sequence
  Description of Artificial Sequence: Synthetic coding sequence
atgcatagctcggcattgctctgctgcctcgtgctcctcaccggagtcagagcatcaccgggacaaggtactcaatcggaaaactcatgtacccattttccaggcaatctgccaaatatgcttagggacctgagagatgccttttcccgcgtcaaaacgtttttccaaatgaaggatcaactggacaatctgctccttaaagagtccctcctcgaagatttcaagggttacctgggatgccaggccctctcggaaatgattcaattctacttggaagaagtgatgcctcaggcggaaaaccaggatccggatatcaaagcacacgtcaacagcctgggggaaaatcttaaaactttgcgcctgcgcctgcgtaggtgccatcggtttctgccgtgtgagaataagtccaaggcggttgaacaggtcaagaatgccttcaacaagctccaagaaaaaggcatctacaaggcaatgtcggagtttgacatcttcattaactacattgaagcgtacatgaccatgaagatccggaac

SEQ ID NO: 14619 - DNA, 534 bp, Artificial Sequence
  Description of Artificial Sequence: Synthetic coding sequence
atgcatagctccgctttgctgtgctgcctggttctgttgactggcgtgcgagccagccctgggcaaggaactcagtctgaaaacagctgtacccattttcctgggaacctgcccaatatgttaagggatctgcgtgacgccttcagccgcgttaagaccttttttcagatgaaggaccagctggacaatctcctgctgaaagagagtctgctggaagactttaaaggctacctgggctgccaggccctgtccgaaatgattcagttctacctggaggaagtgatgccccaagccgagaatcaggatcctgatatcaaggcgcacgtgaattccctaggcgaaaacctcaaaacgttgcggcttcgtttaagacgttgccaccggttcctgccctgtgagaataagtccaaagccgttgaacaggttaaaaacgccttcaacaagctgcaagagaaggggatctacaaagcaatgagtgaattcgatatctttataaattatatcgaagcatacatgaccatgaaaatcagaaat

SEQ ID NO: 14620 - DNA, 534 bp, Artificial Sequence
  Description of Artificial Sequence: Synthetic coding sequence
atgcattcctccgccctgctttgctgtctggtgttgctgacgggagtgagggcaagccctggccaagggacgcagtcggagaactcatgtactcattttcctggaaaccttcctaatatgctcagagatctgcgtgatgcattttcccgggtcaagaccttctttcaaatgaaagatcagctggataaccttctgcttaaggagtctttgctcgaagatttcaagggatatctcggttgtcaagcactcagcgaaatgattcaattctaccttgaagaagttatgccacaagcagaaaaccaggacccagatatcaaagcacatgttaactcgctgggtgaaaatctgaaaaccttgcgccttaggctccggcggtgtcatcggtttctcccttgcgaaaacaaatcaaaggccgtggagcaagtcaagaacgcgttcaataaactgcaggagaagggtatttacaaagccatgtccgagttcgacatcttcatcaattacattgaagcgtacatgaccatgaagatcaggaac

SEQ ID NO: 14621 - DNA, 534 bp, Artificial Sequence
  Description of Artificial Sequence: Synthetic coding sequence
atgcatagctccgctctgctttgttgtcttgtgctgttgacaggggtgagggcttcaccaggccagggtacacaaagtgagaacagttgcacgcatttccctggcaatttgcctaatatgctgagagatctgagagacgcattttctagagtgaagacattctttcagatgaaggatcagctcgacaacttgctgcttaaggagtcccttttagaagacttcaaaggttatctcgggtgccaggcccttagcgagatgattcagttttatttggaggaagtcatgccccaggccgagaatcaggatcctgatatcaaagcacatgtgaatagcctcggcgaaaatttgaaaacactaagactgcgactgagaagatgtcaccgatttcttccatgtgagaacaagtccaaagccgtggaacaagttaagaatgcattcaataagttgcaggaaaaggggatctacaaggccatgtcggaattcgacattttcatcaactatatagaagcctatatgacaatgaagatcagaaac

SEQ ID NO: 14622 - DNA, 534 bp, Artificial Sequence
  Description of Artificial Sequence: Synthetic coding sequence
atgcattcgtctgctctgctgtgctgccttgtccttctgacgggcgtccgagcttccccggggcagggcacccaaagcgagaattcctgcacgcactttccaggtaatcttcccaacatgttaagagatcttcgggatgcttttagcagggtgaaaacctttttccaaatgaaggatcagctggacaatttgctccttaaagaaagccttctcgaggacttcaaaggctatctggggtgtcaggccctgtcagaaatgatacagttctacctggaagaggtgatgccacaggccgagaaccaggaccctgacatcaaagctcatgtgaattccctgggcgagaacctgaagactctccgcttgcggctgaggcggtgccaccggtttctgccttgcgagaataagagtaaagctgtcgagcaagtcaaaaacgcattcaacaagctgcaggagaaaggcatttataaggccatgagtgaattcgacatttttattaactacatcgaagcttacatgacaatgaaaatacgaaac

SEQ ID NO: 14623 - DNA, 534 bp, Artificial Sequence
  Description of Artificial Sequence: Synthetic coding sequence
atgcactcctctgctctcttgtgctgcttagtcctcttaactggggtgcgagctagtccaggacagggaacacaatccgagaactcctgcacacacttcccaggcaatcttcccaacatgctcagggacttgcgggacgccttcagccgggtgaagaccttctttcagatgaaggaccagttagacaatttattactcaaggagtcactccttgaagatttcaaaggctacttaggctgccaggccctgagtgaaatgatccaattttacctggaggaggtaatgccacaggcagaaaaccaagacccggacattaaagcacatgtaaactcccttggcgagaatctgaagacactgcgattacggctgaggaggtgtcacaggttcctgccctgcgagaacaaaagcaaggccgtggagcaggtcaaaaacgcatttaataaacttcaggagaagggaatttataaggcaatgtccgaattcgacatttttattaattacatcgaagcttacatgaccatgaaaatccgcaac

SEQ ID NO: 14624 - DNA, 534 bp, Artificial Sequence
  Description of Artificial Sequence: Synthetic coding sequence
atgcactcttcagctctgctgtgctgccttgtactgctgactggagtacgcgctagccctggccaaggaacacaatccgagaattcttgcacacacttcccaggcaaccttccaaacatgcttcgcgatctgcgcgacgcctttagtcgcgtgaaaaccttcttccaaatgaaggaccagctcgacaacctgcttttgaaggagtccctgctcgaggattttaagggatatctgggatgtcaagccctctcagagatgatccaattttacttggaggaagtaatgccccaagccgaaaaccaagacccggacatcaaagcccacgtcaattcactcggcgaaaatctcaagacattgagactgcgcctgcgcagatgccaccgctttctgccctgcgaaaataagtcaaaagcggtagaacaggtaaagaacgccttcaacaagctgcaggagaaaggcatatacaaggccatgtctgagttcgatatcttcattaactacatcgaagcctacatgactatgaagatccgcaac

SEQ ID NO: 14625 - DNA, 534 bp, Artificial Sequence
  Description of Artificial Sequence: Synthetic coding sequence
atgcattcgtcagcccttctttgttgtctcgttcttctcacgggagtgagagcttcgccaggccaaggtacgcaaagcgaaaattcctgcactcactttcctggtaaccttcctaatatgttgcgtgaccttagggacgccttctcgcgggtgaaaacttttttccagatgaaagaccaactggacaaccttctgttgaaggaatcgctgcttgaggatttcaagggatatcttgggtgtcaggccctgagcgaaatgatccagttttacctcgaagaggtgatgcctcaagcagaaaatcaagatccagacattaaggcacacgtcaactcactcggtgaaaaccttaagaccttgcgccttcggctgcgacgctgtcatagatttcttccttgtgagaataagtccaaggcagtcgagcaggtgaagaacgcgtttaacaaactccaggagaaaggaatctacaaagccatgagcgaatttgatatcttcatcaattacattgaggcatacatgaccatgaaaatcagaaac

SEQ ID NO: 14626 - DNA, 534 bp, Artificial Sequence
  Description of Artificial Sequence: Synthetic coding sequence
atgcactcgagcgcactgctgtgttgcctggtccttctcacgggcgtcagggcctccccgggacagggtacccagtcagagaattcctgcactcatttcccgggtaatctgcctaacatgctgcgggacctcagagatgcgtttagccgcgtcaagaccttcttccaaatgaaggaccaattggataacctgctgttgaaggaatccctcctggaggacttcaaaggttacctgggatgccaggctctctcggagatgatccagttttacctggaggaagtgatgccacaagcagaaaatcaagatccagacatcaaagcccacgtgaatagtctgggagagaacctgaaaacgctgcggctcagattgagacgctgccaccggttcctgccgtgtgaaaacaagtcgaaggcagttgagcaggttaagaacgccttcaacaagctgcaggaaaaaggcatatacaaggcgatgtctgaattcgatatctttatcaactatatcgaggcgtacatgaccatgaagattcggaat

SEQ ID NO: 14627 - DNA, 534 bp, Artificial Sequence
  Description of Artificial Sequence: Synthetic coding sequence
atgcattcctccgccctcctgtgctgcctcgtcttgctcaccggcgtgcgggcatcacctggtcaaggaacgcagtccgaaaacagctgtacccactttcccgggaatctcccgaacatgttgagggacctgagagacgccttctctcgggttaagacgttcttccagatgaaggaccagctggataatctgctgctcaaggagtcgctgctcgaagatttcaaagggtacttggggtgccaggcactgtccgaaatgattcagttctacttggaagaggtgatgcctcaagcggaaaaccaggacccagatatcaaggcgcatgtgaactcgctgggagaaaacctgaaaaccctcagactcaggctgagacggtgccatcggttcctcccgtgcgaaaacaagtcgaaagccgtggaacaggtgaagaatgccttcaacaaacttcaggaaaagggtatctacaaagccatgtcggagttcgatatctttatcaattacatcgaggcctacatgaccatgaaaatccgcaat

SEQ ID NO: 14628 - DNA, 534 bp, Artificial Sequence
  Description of Artificial Sequence: Synthetic coding sequence
atgcactcctccgcactcttgtgctgtctggtgctgcttacgggcgtcagagcatcgcctgggcaaggtactcagtccgagaattcgtgtacgcattttcccggcaatctgcccaacatgcttcgtgacctgcgcgatgcattctcaagggtgaaaaccttttttcaaatgaaggatcaactcgacaatctgctgctgaaggagtccctccttgaggacttcaagggatacttgggctgtcaagcccttagcgaaatgatccagttctacctcgaagaggtgatgcctcaagcagagaatcaggatccagacataaaggctcatgtgaattcgcttggagaaaatctcaaaaccctgaggcttagattgcggaggtgtcatcgatttttgccatgcgaaaacaagagcaaggctgtggagcaagtgaagaatgcatttaacaagctgcaggaaaagggtatctacaaggcaatgtccgaattcgatatcttcatcaattacatcgaagcgtacatgactatgaagattaggaac

SEQ ID NO: 14629 - DNA, 534 bp, Artificial Sequence
  Description of Artificial Sequence: Synthetic coding sequence
atgcattcatccgctctcctgtgttgcttggtgctgctgaccggagtgagggcgtccccgggtcagggaacccaatcagaaaacagttgcacccacttcccgggcaatctgccaaatatgctgcgggatctgagagacgcattctcacgtgtcaagactttcttccaaatgaaagatcagttggataacctgctccttaaagaatcactgctcgaggacttcaagggatacttgggatgccaagcgctgtcagagatgatccagttttacctggaggaggtcatgccgcaggcggagaaccaggaccccgatatcaaggcccacgtgaacagcctgggtgagaatttgaaaactctgcggctccgcctgagaagatgccatcgatttctcccatgcgaaaacaagtcgaaggcagtggagcaggtcaaaaatgcctttaacaagctgcaagaaaagggaatctacaaggccatgagcgagttcgatatcttcatcaattacattgaagcgtacatgactatgaagatccgcaac

SEQ ID NO: 14630 - DNA, 534 bp, Artificial Sequence
  Description of Artificial Sequence: Synthetic coding sequence
atgcacagttcagcccttctgtgctgtctggtactcctgactggcgtccgggccagcccaggccaagggactcagagcgagaattcctgtacccattttcctggtaacctgcctaatatgttgcgggacctccgagacgcattcagtcgggttaagacattcttccagatgaaagatcagctggacaacctactgctgaaggaatccttactagaggactttaaaggctacctcggctgtcaggccctctcagagatgatccagttttatctcgaggaggtgatgccacaggccgaaaatcaggacccagatattaaggcacacgtgaactccctgggggagaatctgaagacactgcgactacgtctgaggagatgtcaccgctttctgccttgtgaaaataagtctaaagcagtggaacaagtgaaaaacgcttttaacaagctgcaggagaagggcatttataaagctatgagcgagtttgacattttcatcaactatattgaagcttacatgactatgaagattcggaat

SEQ ID NO: 14631 - DNA, 534 bp, Artificial Sequence
  Description of Artificial Sequence: Synthetic coding sequence
atgcactcgtcggcactcctgtgttgccttgtgctgctgactggcgtgagagcctctccaggacagggaactcaatcggagaactcgtgtacccacttcccggggaacctcccgaacatgttgcgcgacctccgggacgctttctcccgcgtcaagacgttcttccaaatgaaggatcagctggacaacctcctgctcaaggagagccttcttgaagatttcaagggttacctcggatgccaggccctgtcggagatgatccagttctacctggaggaagtgatgccgcaagccgagaatcaggatccagatatcaaggcccatgtgaactcacttggagagaatctgaaaactctgaggcttcggctgaggagatgccaccgcttcctcccgtgcgagaataagtcaaaggccgtggagcaggtcaaaaatgccttcaataagctccaagaaaagggaatctataaggctatgtccgaattcgacatcttcatcaactacattgaggcttacatgactatgaagatccgaaat

SEQ ID NO: 14632 - DNA, 534 bp, Artificial Sequence
  Description of Artificial Sequence: Synthetic coding sequence
atgcacagctccgccctgctgtgttgcctcgtgctgttgaccggagttagggcctcaccaggccaagggacccaatctgaaaatagctgcactcattttcccggcaatctgcccaacatgctaagggacctaagagatgccttctctcgggtgaaaacctttttccagatgaaggaccaactggacaatttgctgcttaaagaatctctcctcgaagactttaaggggtacctggggtgtcaagccctgtctgaaatgatccagttttatcttgaggaggttatgccacaggctgagaaccaagatcctgatatcaaggcccatgtgaacagcctgggagaaaacctgaaaaccctcaggcttcgattacgacgctgccaccgcttcctgccatgtgaaaacaagagtaaggctgtggagcaagttaagaatgccttcaacaaattacaggagaagggcatctacaaggcgatgtccgagtttgatatttttatcaattacatcgaggcctatatgacaatgaagattcggaac

SEQ ID NO: 14633 - DNA, 534 bp, Artificial Sequence
  Description of Artificial Sequence: Synthetic coding sequence
atgcacagctccgctctgctgtgctgcctcgttctcctgactggagtgagggcgagtcccggccaggggacgcagtcagaaaactcctgcactcacttcccaggtaatctgccaaacatgctgagagatcttagagacgctttctccagggtcaaaacctttttccagatgaaggatcaactcgataatctgcttctgaaagaatctctccttgaggacttcaaaggataccttggctgccaggcactgtctgagatgatacaattttatctggaggaagtgatgcctcaggctgagaatcaggatcccgacatcaaggcgcacgtgaactccttgggcgaaaatctgaaaacactgagactcaggcttcgaagatgccacagattcttgccctgtgagaataaaagtaaagctgtggagcaagtgaagaacgcctttaataagcttcaagaaaaggggatttacaaggctatgagcgaattcgatatcttcattaattacatcgaggcctatatgactatgaagatccggaat

SEQ ID NO: 14634 - DNA, 534 bp, Artificial Sequence
  Description of Artificial Sequence: Synthetic coding sequence
atgcactcgtcggcgctgctgtgctgcctggtgctccttactggagtgcgcgcatcccccggccaaggaactcagagtgagaactcctgcactcacttcccgggcaacctcccgaacatgctgcgggatctgcgggacgccttctcacgcgtaaagaccttcttccaaatgaaggaccagctggacaatctgctcctcaaggaatcactcctggaagatttcaaggggtacctgggctgccaggcgctttcggagatgatccagttctacctcgaggaggtcatgccgcaggcggaaaaccaggatcctgacataaaagctcacgtcaatagcctcggagaaaacctcaagacgctccgactgcggctgcgaagatgtcaccgcttcctgccgtgtgagaacaaatcgaaggcagtggaacaagtcaagaatgccttcaacaagctccaagagaaaggcatttacaaagccatgagcgaatttgatatctttatcaactatatcgaggcttacatgaccatgaagatccgcaat

SEQ ID NO: 14635 - DNA, 486 bp, Artificial Sequence
  Description of Artificial Sequence: Synthetic coding sequence
atgcgatcctcacctggcaacatggagaggatcgtgatctgccttatggtgatttttctggggacactggtccacaaaagcagctctcagggtcaagaccgccatatgattcgaatgaggcagcttattgacatagttgatcaacttaagaattatgtcaatgacctcgtccccgaattcctgcctgctcctgaggacgtggagacaaattgcgagtggagtgctttttcttgctttcaaaaggcacagctgaagtccgccaataccggcaacaacgaacggatcataaacgtctcaatcaaaaaactgaagcgaaaaccgccgtcaaccaatgcgggtcggcgacagaagcatcggctcacatgccctagctgcgactcctacgagaagaagccgccaaaggagttcctggaacggttcaagtcccttctgcagaaaatgatccatcaacacctgagttccaggactcacggctccgaagatagt

SEQ ID NO: 14636 - DNA, 486 bp, Artificial Sequence
  Description of Artificial Sequence: Synthetic coding sequence
atgcgaagctcgccaggcaacatggaacgaattgtgatttgtctgatggtgatctttctggggactttggtccataaatcgtcctcgcagggtcaagataggcatatgatccgcatgcggcaacttatcgacatcgtggatcaactgaagaactacgtgaacgatcttgtgcctgaattcctgccggccccagaggacgtcgaaaccaactgtgaatggtcagccttttcgtgctttcagaaggcacaactgaagtcggcgaatactggtaacaacgagagaatcatcaacgtgtcaataaagaaacttaagaggaagcccccatccaccaacgcaggacgtagacaaaaacatcgactcacttgtccctcgtgcgattcgtacgagaagaaacctcccaaagaatttctggagcggttcaagtcgctgctgcaaaagatgatacatcagcacttgtcctccaggacccatggttccgaagattcc

SEQ ID NO: 14637 - DNA, 486 bp, Artificial Sequence
  Description of Artificial Sequence: Synthetic coding sequence
atgaggagttcacccggtaacatggaacgcattgtgatttgtctgatggtcatattcttgggcacactggttcacaaatccagctcccaaggccaggatcggcatatgataaggatgagacagttaatcgacattgttgaccagttgaaaaattacgtaaacgatctggtgcccgagtttctgcctgcacctgaagacgtagagaccaactgcgaatggtctgcgttctcatgtttccagaaggcccagctaaaatcagctaacacaggcaacaatgaacgaatcatcaacgtcagcatcaagaagctgaaaagaaagcctccctctacaaatgctgggcgaagacagaaacatcgtctcacttgtccctcctgcgattcgtacgaaaaaaagccaccaaaagagttcctagaacgatttaaatcgctcctgcagaagatgatccaccagcatctaagctcccgcacccacggttccgaggattct

SEQ ID NO: 14638 - DNA, 486 bp, Artificial Sequence
  Description of Artificial Sequence: Synthetic coding sequence
atgcggagcagcccgggtaacatggagagaatcgtgatctgcctgatggtgatctttctggggactctggtgcacaagtcctcgtcgcagggacaagatcggcacatgatccggatgcggcaattgatcgatatcgtggatcaattgaagaattacgtcaacgatttggtgccagaattcctgccagcccccgaggacgttgaaaccaactgcgaatggtccgcattctcctgttttcaaaaggcccaacttaagtcagcaaacaccggcaacaacgaacgaatcatcaatgtgtcgatcaaaaaactgaagcgcaagcctccatctactaacgcgggacggaggcagaagcaccgccttacttgcccgtcctgcgactcatacgagaagaagccgcctaaagagttcctcgagcgatttaagagcctcctccagaagatgattcatcagcacctgtcgtcgcgcactcatgggtccgaagattcg

SEQ ID NO: 14639 - DNA, 486 bp, Artificial Sequence
  Description of Artificial Sequence: Synthetic coding sequence
atgcgttcaagtccgggcaatatggaacgcatcgtaatatgcctgatggtgatcttcctggggactctggttcacaaaagctcctcgcaggggcaagaccggcacatgatccggatgcggcagctgatagatatcgtggaccaactgaagaattatgtaaacgacctggtgcccgaattcctaccagctcccgaggacgttgaaactaactgcgagtggagcgcttttagttgctttcagaaggctcagcttaagtctgctaacacggggaataacgaacgtattattaacgtgtccataaagaaactcaaaagaaagcccccatcaactaacgccggaaggcggcaaaaacacaggctcacatgccccagttgcgattcttacgaaaagaaaccaccaaaggagtttctggagcggtttaagtccctgcttcagaaaatgatccaccagcacctgtcgtcccgcactcacggcagcgaggactca

SEQ ID NO: 14640 - DNA, 486 bp, Artificial Sequence
  Description of Artificial Sequence: Synthetic coding sequence
atgcgctcgtcaccgggaaatatggaacggatcgtgatctgtctcatggttatcttcttgggtaccctggtccacaagtccagcagccagggacaagaccggcatatgattcggatgaggcaacttatcgatatcgttgatcagctgaagaactacgtcaacgacctcgtgccggaattcctgccagcgccggaagatgtggaaacgaattgcgaatggagcgcattctcatgcttccaaaaggcccaacttaaaagcgccaacaccggcaacaacgaacgcatcattaacgtgtcaatcaaaaagctcaagcgcaagccaccttcgaccaatgcagggcgtcgccagaaacaccgactgacctgcccgtcctgcgactcgtacgaaaagaagccccccaaggagttcctggagcggttcaagtccctgctccaaaagatgattcatcagcacctctcaagcaggactcatggctcggaggattcc

SEQ ID NO: 14641 - DNA, 486 bp, Artificial Sequence
  Description of Artificial Sequence: Synthetic coding sequence
atgaggagtagtcccggtaacatggagaggattgtaatttgtttgatggtcatttttctggggacactggtccacaaaagtagttctcagggacaggacaggcacatgatccggatgcgccagctaatagatattgtagaccagttgaagaactacgtgaatgacttagtgcctgaatttttgcccgctcccgaagacgttgagacaaactgcgaatggagcgccttctcctgttttcaaaaggctcagctgaagagtgccaacactggcaacaatgaaaggattataaatgtgagtattaagaagctgaaacggaagccaccctccactaatgctggacgccggcagaaacacaggcttacatgtccttcctgcgactcctacgagaagaaacctcccaaagaatttctggagcgatttaagtcgctgctccagaagatgatccaccagcacctgagtagcaggactcatggctccgaggacagt

SEQ ID NO: 14642 - DNA, 486 bp, Artificial Sequence
  Description of Artificial Sequence: Synthetic coding sequence
atgcgatcttctccgggaaatatggaaaggatcgtaatttgtcttatggttatttttctaggtacgctagtgcataagtcatctagccagggtcaggaccgtcatatgatcagaatgcgtcagctgatcgatatcgtagaccaactgaagaactacgtgaatgatcttgtgcctgagtttctcccagcgccagaagatgtcgagacgaactgtgaatggtcagcattctcctgcttccagaaagcgcaactcaagtccgccaacaccgggaacaacgagcgtataattaacgtgagtatcaagaagttgaagcgcaagccaccgtcaactaacgcaggccggagacaaaagcaccgccttacatgcccttcatgtgactcgtacgagaagaagccacctaaagaattcctcgaacggttcaagtccctactgcagaaaatgattcaccagcatcttagctctcggacccatggatctgaggattca

SEQ ID NO: 14643 - DNA, 486 bp, Artificial Sequence
  Description of Artificial Sequence: Synthetic coding sequence
atgcggtcgagccctgggaatatggaaagaattgtgatctgtctcatggtgatcttcttgggcactcttgtgcataaatcttcgtcccaaggacaagataggcacatgattagaatgaggcagctgattgatatagtggatcaactgaagaactacgtcaatgatctggtgccggagtttcttcctgcacccgaggacgtggaaaccaattgtgaatggagcgcattttcgtgcttccaaaaggctcaactcaagtcggctaacaccggaaataacgaaagaatcattaacgtgtcgattaagaagctcaagagaaagcctccatccaccaacgcaggtagacggcagaagcaccgtctcacctgtccttcgtgcgatagctacgagaaaaagccacctaaggaatttctcgaaagatttaagtcacttctccagaagatgattcaccaacatctttcgtcgagaactcatgggtccgaagatagc

SEQ ID NO: 14644 - DNA, 486 bp, Artificial Sequence
  Description of Artificial Sequence: Synthetic coding sequence
atgagatcgtcgccagggaatatggaaaggatcgtgatatgtcttatggtcatctttctcggcactctggtgcacaagtcatcatcacaaggtcaggatagacacatgattagaatgcgacaacttattgacatcgttgatcaacttaagaattacgtgaacgatctggtgcctgaattcctgccggccccagaagatgtggagactaactgtgaatggagcgcgttctcttgctttcaaaaggcacagctgaagagcgcaaataccggcaacaatgagcggatcataaacgtgtcgatcaagaagctgaaaagaaagcccccgtcgactaacgcagggagaaggcagaaacaccgactgacctgtccttcgtgcgattcatacgagaagaagccacctaaggaattcttggagcgtttcaaaagccttctccagaagatgattcatcaacatctgtcatccagaacccacggttcggaggactcc

SEQ ID NO: 14645 - DNA, 486 bp, Artificial Sequence
  Description of Artificial Sequence: Synthetic coding sequence
atgcgctcgtcaccgggcaacatggaacggatcgtgatctgcctgatggtcattttcctcggcacgttggtgcataagtcgtcttcccagggtcaggaccggcacatgatccgcatgcgccaactgatcgatatcgttgaccagctcaaaaactacgtgaacgaccttgtgccggaattccttccggcacctgaggacgtcgagactaattgcgagtggtctgccttctcgtgcttccagaaggctcaactcaagtcagcgaacactggaaataacgagcggatcatcaacgtgagcataaagaagctgaagcgcaagccaccctcgactaatgcagggcgtaggcagaagcaccggttgacttgtccatcctgtgattcgtacgagaaaaagcctccaaaggaattcttggaacgctttaagtcgctcttgcagaaaatgatccaccagcacctgtcgtcgaggacccatggctcggaagatagc

SEQ ID NO: 14646 - DNA, 486 bp, Artificial Sequence
  Description of Artificial Sequence: Synthetic coding sequence
atgcgctccagcccaggaaacatggagcgcattgtaatttgcctgatggtaatcttcctgggcactctcgtacacaagagttcctctcagggccaagacagacatatgatccgaatgcgccagctgattgatatagtcgaccagctcaaaaattacgtaaatgatctggtgccggaatttctgccagcgccggaggacgtggaaacgaactgcgagtggtccgcgttcagttgttttcaaaaagctcagctgaaatccgcaaacaccggaaacaacgaacgtataataaacgtctctatcaagaagctgaagagaaagcccccatccaccaatgctgggcgacgccagaagcacaggctgacctgcccctcgtgtgattcttatgagaagaaaccacccaaagaatttttggaacgcttcaagtccttgctgcaaaaaatgattcatcaacacctgagcagtagaacacacggatctgaggactca

SEQ ID NO: 14647 - DNA, 486 bp, Artificial Sequence
  Description of Artificial Sequence: Synthetic coding sequence
atgcgctctagtcccgggaacatggaacggatcgtgatctgcctgatggtgatctttcttgggacacttgtacacaaaagttcttctcaaggacaggatagacatatgatacgaatgcgccagttgatagatatcgttgatcaactcaagaactatgtcaacgatctagttcctgagttcctgcccgcccccgaagatgtggaaacaaactgtgagtggtcagcattctcgtgctttcaaaaagcgcagttaaaatccgccaacacagggaacaatgaaaggatcataaacgtctctataaaaaagcttaaaagaaagcccccttcgactaacgccggacggcggcaaaaacacagactcacatgcccttcttgtgactcttatgaaaagaaaccacctaaagagttcctagaaagatttaaaagtcttctgcagaaaatgatccaccagcacctttcatcgaggacacatgggtcagaagattcc

SEQ ID NO: 14648 - DNA, 486 bp, Artificial Sequence
  Description of Artificial Sequence: Synthetic coding sequence
atgcggtcaagcccggggaacatggagcgcatcgttatctgcctgatggtgattttcttgggtaccctcgtgcacaagtcctcgtcacagggacaggataggcacatgattcgcatgcgccagctgatcgatatcgtggaccaacttaagaattatgtgaatgacctcgtccctgagtttctgccagcgccagaagatgtggaaaccaactgcgaatggtcagccttcagctgcttccagaaggcgcagctgaaatcggccaataccggaaataacgaacggatcattaacgtctccatcaagaagctgaagcggaagcctccaagcactaacgccggacgcagacagaagcaccgtcttacttgcccaagctgtgattcgtacgagaagaagccgccgaaggagttcctcgaaaggtttaagtccctgctgcagaaaatgatccaccagcatctgagctcaagaacccacggatcagaggactca

SEQ ID NO: 14649 - DNA, 486 bp, Artificial Sequence
  Description of Artificial Sequence: Synthetic coding sequence
atgcggagcagtcccggaaatatggagagaattgtaatctgcctgatggtgatatttttaggcaccctcgtgcataaatcctccagccaggggcaagataggcatatgattagaatgagacagctaatcgatatcgtggaccagcttaaaaactatgtgaacgatctcgtcccggaattcttaccagcccctgaggacgttgaaaccaattgcgaatggtccgcattttcatgcttccagaaggcccagctgaagtctgctaatactgggaacaacgaacggatcatcaatgtatctattaagaagttaaagcggaaaccgccttccaccaatgcaggacggagacaaaagcatcgtctgacctgcccctcttgcgacagctacgaaaaaaagccacctaaggagtttctggaacgattcaaatccctattgcagaaaatgatccatcagcacctgagttcccgcacgcacgggtcggaagatagt

SEQ ID NO: 14650 - DNA, 486 bp, Artificial Sequence
  Description of Artificial Sequence: Synthetic coding sequence
atgagatcctcacctggcaacatggagaggatcgtcatttgcttgatggtgatcttcctgggtaccctggtccacaagagctcctcccaggggcaagaccgtcatatgatccgaatgcggcagcttatagatatcgtggaccaacttaagaactatgtgaacgacctggtgccagaatttcttcccgctccagaggacgtcgaaaccaactgtgaatggtccgcgtttagttgctttcagaaggcacaactgaaatccgcaaacaccggcaataatgagaggattatcaacgtgtcgattaagaagctcaaacggaaacctccttccactaatgcaggtcggagacaaaagcatcgcctgacctgtccctcgtgtgactcgtacgagaagaagcctcctaaagagttccttgaacgctttaagtcactgctccagaagatgatccaccagcatttgtctagtcgaactcatggatcggaagatagc

SEQ ID NO: 14651 - DNA, 486 bp, Artificial Sequence
  Description of Artificial Sequence: Synthetic coding sequence
atgcggtcgtcgcctggtaatatggaaagaattgtgatttgtctgatggtgattttccttggcactcttgtgcataagtcatcatcgcaaggtcaagatcggcacatgatcaggatgcgacaacttatcgatatcgtggatcaactcaagaactacgtcaatgatcttgtcccagagtttttgcctgctccagaagatgtcgagactaactgtgagtggtcagcatttagctgttttcagaaggcacagctgaagtctgcaaacacgggaaataacgaacgtattatcaacgtgagcatcaagaaattgaaaagaaagccaccctcgaccaacgccgggcggcgccagaagcatagactgacttgtccatcgtgcgattcatatgagaaaaagccccctaaggaatttcttgagagatttaagtcccttctccaaaagatgattcatcaacacctctcatcgcggacccatggatcggaggactca

SEQ ID NO: 14652 - DNA, 486 bp, Artificial Sequence
  Description of Artificial Sequence: Synthetic coding sequence
atgcgctcctctccaggcaatatggaaaggatcgtaatatgtttgatggtaatcttcctaggaacattagtgcacaaatcatcgtcccagggtcaggatcgtcatatgattcgaatgcgacagctgatcgatattgtagatcagttgaagaattatgtgaacgatctggtccccgaattcttacccgcgcctgaagacgtcgaaaccaactgtgaatggtctgcattctcttgcttccagaaggcgcagctaaaatcagcaaataccggcaataatgaaaggattatcaatgtgagcattaagaagctgaaaagaaaaccccccagtacaaacgccggacggagacaaaaacacaggctcacctgtccctcctgcgacagctacgaaaaaaagccaccaaaggaattcctggaacgttttaaaagcctcctgcagaagatgatccaccagcatctctcctccaggacgcacggatcagaggacagt

SEQ ID NO: 14653 - DNA, 486 bp, Artificial Sequence
  Description of Artificial Sequence: Synthetic coding sequence
atgaggtcatctccgggcaatatggagcggatcgtcatttgcttgatggtcattttcctgggaacattggttcataaatcttccagtcaggggcaggaccgtcacatgatcaggatgaggcagctgattgatatcgttgatcaactgaagaattacgtgaatgacctcgtacctgagttcttgccggccccggaggatgtggagaccaactgcgagtggtctgcgttttcatgcttccagaaggctcaactgaagtccgccaacaccgggaacaacgagcggatcatcaatgtctcgatcaaaaagctgaagcggaaacctccatcaactaacgctgggaggaggcaaaaacaccgactaacatgcccttcgtgcgacagctatgagaagaaacccccaaaagaatttttggaaagatttaagtctttacttcaaaaaatgattcaccaacatctatccagtaggactcacggtagtgaagacagc

SEQ ID NO: 14654 - DNA, 486 bp, Artificial Sequence
  Description of Artificial Sequence: Synthetic coding sequence
atgcgctcgagtcctggtaatatggagcgcatcgtgatttgcctgatggtcattttcttaggaactttagttcataaaagcagcagccaggggcaggatcggcacatgatccgcatgaggcagctcatagatattgtcgaccaattgaaaaattacgtgaatgacctagtgcccgagttcctccctgctcccgaagatgtagagacaaattgcgagtggtcagctttctcttgtttccagaaggcacagctcaagagtgcaaatacagggaacaatgagaggatcataaatgtatccatcaaaaagctaaagcgtaaacctccatcaactaatgctggcagaagacagaagcacagacttacttgtccaagttgtgactcgtatgaaaagaagccgcccaaggagttcctagagcgctttaagtccttactgcaaaagatgatccaccagcacctatcatcaaggacacatggatcagaggattct

SEQ ID NO: 14655 - DNA, 486 bp, Artificial Sequence
  Description of Artificial Sequence: Synthetic coding sequence
atgcgcagcagcccgggcaatatggagagaatcgttatctgcctgatggttatcttcctgggcacactggttcataaatctagcagtcagggccaggatagacacatgataagaatgcgccagctgatcgacattgttgaccagctgaagaattatgttaacgatctggtgcctgaatttctgccagcgccagaagacgtggaaacaaactgtgagtggagcgccttttcatgctttcagaaagcccagcttaagagtgcaaatacaggtaataatgagcgaatcatcaacgtgagcatcaaaaaactgaaacgaaagcccccatccacaaacgccggcaggcgccagaaacacagattgacatgcccttcctgtgactcctacgagaagaaacctcccaaggagtttcttgagcgattcaaatctctgctccagaaaatgatacatcagcacctgagttctagaacccatgggagcgaagatagc

SEQ ID NO: 14656 - DNA, 486 bp, Artificial Sequence
  Description of Artificial Sequence: Synthetic coding sequence
atgaggagctccccagggaacatggaaagaattgtcatttgcctgatggtcatcttccttggaacgctggtgcacaaatccagtagtcaaggccaagatcgccatatgatcaggatgcgtcagttaattgatatcgttgaccagctcaaaaattatgttaatgatctggtcccagagttccttcctgcccccgaagatgtagagacgaactgcgaatggagcgctttcagctgcttccagaaggctcagctgaaatccgccaacaccgggaacaacgaaaggattattaacgtgagcatcaaaaagttgaagaggaaacctccatcaaccaatgctggtagacgccagaagcaccgactcacatgcccctcgtgcgatagctacgaaaaaaaaccccccaaagagtttctagaacgttttaagtctctgctccagaagatgatacaccagcatttgagctcgagaacacatggtagcgaggattcc

SEQ ID NO: 14657 - DNA, 486 bp, Artificial Sequence
  Description of Artificial Sequence: Synthetic coding sequence
atgcgctcgagccccggtaacatggaacgtatagtcatatgcctgatggtaatctttctaggcacgctggtccacaagagcagttcgcaaggacaggatcgccacatgatccggatgcgccagttgatcgatattgtcgatcagctcaagaattatgtgaatgatttggtaccggaattcctgccggccccggaagatgtggagaccaactgcgagtggtcggccttctcatgcttccaaaaagcccaactcaagtctgcgaacactggcaataacgagcgcatcattaacgtgagcatcaagaagctcaagcgcaagccgccgtccacaaatgcaggccgccgccagaagcataggttaacatgcccatcctgcgacagttacgagaagaagccgccgaaagagttcttggagcggtttaagagcttgctccagaagatgatccaccagcatttgagcagcagaactcatggatcggaggattcc

SEQ ID NO: 14658 - DNA, 486 bp, Artificial Sequence
  Description of Artificial Sequence: Synthetic coding sequence
atgaggtcatcaccaggcaatatggaaagaatagtaatatgtctcatggttatattcctcggcactttggtgcataagtcttcttcccagggccaggaccgacatatgatcagaatgagacagttgatagacatagtggaccagctcaagaactatgtcaacgacctggtgccggagttcctgcctgctccagaggacgtggagaccaattgtgaatggagtgccttttcctgttttcagaaggcccagctgaaaagtgccaacaccggcaacaatgagaggatcattaacgtgtctataaagaaattaaagcgtaagcctccaagcacgaatgctgggagaagacagaaacaccgattaacatgcccttcttgtgattcatatgagaagaagccccctaaggagttcctggaaagatttaagtcactgctgcaaaaaatgatccatcagcatctctcgtctcggacacatggttccgaagattcc

SEQ ID NO: 14659 - DNA, 486 bp, Artificial Sequence
  Description of Artificial Sequence: Synthetic coding sequence
atgagatcaagtcccggcaacatggagcgcatcgtcatttgcctcatggtcatatttctcgggaccctggttcacaaatcgtcatctcagggccaggaccgccacatgatacgaatgcgccagctcatcgatattgtggatcagctgaaaaactatgtgaatgaccttgtccctgagttcttgcctgctccagaggatgtggagacaaattgtgaatggagcgcgttttcctgtttccagaaggcccagctgaaatccgcaaataccggaaacaatgagaggataataaacgtgtccatcaaaaagctgaaacgcaagcccccaagtacaaacgcaggaagaaggcaaaaacacagactcacgtgtccaagctgcgatagctacgagaaaaaaccaccaaaggagttcctggagagattcaaatctctgctgcagaaaatgattcaccagcatctgtccagtagaacccacgggtcagaggattcc

SEQ ID NO: 14660 - DNA, 486 bp, Artificial Sequence
  Description of Artificial Sequence: Synthetic coding sequence
atgcgatcgtccccgggtaatatggagaggattgtgatatgtctgatggtgatatttcttggtaccctggtgcataaatcctcaagccagggacaagatcggcatatgatccggatgagacaactgatagatatcgtcgaccaactcaagaattacgtgaacgacctcgtgcctgagtttttgccagcgcccgaggacgtggaaaccaactgcgaatggtccgcattctcgtgtttccagaaggcacagcttaagtccgcgaacacgggcaacaacgagcggatcatcaatgtctccataaagaagctgaaaagaaagcccccatcaactaatgctggaaggagacaaaagcatcgtctgacttgtccatcctgcgattcctacgagaagaagcctcctaaagagtttctcgaacgattcaagtccctgctccagaagatgatccatcaacacttgagcagtcgaacccacggaagcgaagatagc

SEQ ID NO: 14661 - DNA, 486 bp, Artificial Sequence
  Description of Artificial Sequence: Synthetic coding sequence
atgaggtcctcacctgggaacatggaaaggatcgtgatatgtcttatggtcatctttctaggcactctggtccacaagtcttcttctcagggacaagatagacacatgattagaatgcggcagcttatagacatcgtggatcaactcaagaactacgttaatgatctggtgccagagtttcttcccgccccagaggatgttgaaacgaattgcgagtggagcgcatttagctgttttcagaaggcccagttaaagagcgcgaatacaggtaacaatgagcggataatcaacgtgtctatcaagaaactaaaaaggaagccgccctctacaaatgctggacgaaggcagaagcatagactgacctgtcctagctgcgattcctatgagaagaagcctccgaaggaattcctggagagattcaagtcactgctccagaaaatgatccatcagcacctctccagtcggacccacggttctgaagattct

SEQ ID NO: 14662 - DNA, 486 bp, Artificial Sequence
  Description of Artificial Sequence: Synthetic coding sequence
atgcggagctcccctggtaatatggagaggatcgtgatatgccttatggtgatatttctgggaaccttggtgcataagtcctcatcccaagggcaggatcggcatatgatacgaatgaggcaactgattgatatcgtggaccaactcaagaattatgttaatgatctggtcccagaatttcttccagctccagaagatgtggaaaccaattgtgaatggtccgcattttcctgttttcagaaagcacaacttaaatcagcaaacaccggcaataacgagcgaatcatcaacgtgtcaattaagaagctgaaacggaagccaccctcaaccaacgccggaagaaggcagaagcaccggctcacctgtccctcatgtgatagctacgagaagaagccaccaaaggaattcctggaaagattcaagtcgctgctgcagaagatgattcatcagcacctctcgtcgcggactcatggatcggaagattcg

SEQ ID NO: 14663 - DNA, 486 bp, Artificial Sequence
  Description of Artificial Sequence: Synthetic coding sequence
atgcgctcatccccgggtaacatggaacggatagtcatctgccttatggtcatctttctcggaaccctggtgcacaaaagcagctcccaaggccaggaccgccatatgattcggatgagacaactcatagacattgtcgaccagctcaagaattacgtgaacgacctggtcccggaattcctgccggcaccggaagatgtggagactaactgcgagtggtcggcgttcagctgttttcagaaggcccaacttaaaagcgccaataccggaaacaacgagcggatcatcaatgtgtcgatcaagaagctcaagcgcaagcccccaagtaccaacgcgggccgtcggcagaagcacaggctgacttgcccatcttgcgattcctacgagaagaaaccgcccaaagagttccttgaaaggttcaagagcctgttgcagaaaatgatccatcagcacctgagcagccgaactcatgggagcgaagattcc

SEQ ID NO: 14664 - DNA, 486 bp, Artificial Sequence
  Description of Artificial Sequence: Synthetic coding sequence
atgcgctcaagccctggaaacatggaacggattgtgatatgcttgatggtcatctttctgggaactctggtccataaatcctcgagccagggacaagacaggcacatgattcggatgcggcaactcattgatattgtggaccaactgaaaaactacgtgaacgatctggtgcctgaatttctgccagcccctgaagatgtcgagactaattgcgaatggtccgccttcagctgttttcagaaagcccaactgaaatcggcaaatacggggaacaacgaacgtatcattaacgtgtcgataaagaagctgaagcgtaaacccccttccactaatgcagggagaaggcaaaagcaccgcctcacttgcccttcctgcgattcctacgagaaaaaaccacctaaggaatttcttgaacgattcaaatcactgcttcaaaagatgattcatcagcacctttcatcccggacccatggtagcgaagattcg

SEQ ID NO: 14665 - DNA, 486 bp, Artificial Sequence
  Description of Artificial Sequence: Synthetic coding sequence
atgcggtcctctcccggaaacatggaacgaatagtgatatgccttatggtgatttttctcggcaccctcgtgcataagagcagcagccagggtcaagatcggcatatgatcagaatgagacagctgatagacatagtggaccagctgaaaaactacgtcaacgaccttgtgccagaattccttcctgcacccgaggacgtggaaactaattgcgagtggagcgccttcagctgtttccaaaaggcacaattgaagtcagcaaatactggaaataacgaacggattatcaacgtctctattaagaagctgaaaagaaagccaccgagcaccaacgctggacgtcgtcaaaagcatcggcttacttgcccttcctgtgactcgtacgagaagaagcctcctaaagaatttcttgaaaggttcaagtcccttctgcaaaagatgattcatcagcacttgtcgtcgagaactcatggtagcgaagattca

SEQ ID NO: 14666 - DNA, 486 bp, Artificial Sequence
  Description of Artificial Sequence: Synthetic coding sequence
atgagaagcagtcctggtaatatggaaagaattgtgatttgtcttatggttatctttctgggcacactggttcacaagtctagttctcaggggcaggatcggcacatgatccgaatgaggcagttgattgacattgttgatcagctaaagaactatgtgaatgacctggtgcccgagtttctgccagccccggaggatgtggagaccaactgtgaatggtctgcttttagttgctttcaaaaggctcagctgaagtctgctaacaccggcaataacgagcgtatcatcaatgtctcaatcaagaaacttaagcgtaagcccccaagtacaaatgccgggcgccgccagaaacaccggctgacatgtccctcttgcgactcttacgagaagaaacctccaaaagagttcttggagcgcttcaagtccttgctgcaaaagatgatccaccaacatctctccagccgaactcacggctccgaagattcc

SEQ ID NO: 14667 - DNA, 486 bp, Artificial Sequence
  Description of Artificial Sequence: Synthetic coding sequence
atgcgctcatcgccgggcaacatggagcgcattgtgatctgccttatggtgattttcctagggacactggtccacaaaagctctagtcagggccaggatcgccatatgatcaggatgaggcagctgatcgatattgttgaccagctcaagaactacgtgaacgatttggtgcccgagttcctccctgcccctgaggatgtggagacaaactgtgaatggagcgctttttcatgcttccagaaagcacagctcaaatccgcgaacaccggcaataatgagagaattatcaacgtcagcatcaagaagctgaaacgcaagcctcctagcacaaacgccggacgaagacaaaaacaccgcctaacatgcccgtcgtgtgattcgtacgaaaagaagcctccaaaagagtttctggagcgcttcaagtcacttcttcagaagatgattcatcaacatctttcaagtcggacccacggcagcgaggacagt

SEQ ID NO: 14668 - DNA, 486 bp, Artificial Sequence
  Description of Artificial Sequence: Synthetic coding sequence
atgcgctcttccccaggaaacatggaaaggatcgtgatttgcttgatggtaatcttcctcggaaccctggtgcataagtcctccagccagggccaagataggcatatgattcgcatgaggcaattgattgacattgtggaccagctgaaaaactacgttaatgaccttgttcccgaattccttcctgcgccggaagatgtggagacaaactgtgaatggtccgcgttttcatgcttccagaaagcccagttgaagagtgctaacacaggtaacaacgaaagaataattaacgtgtctatcaagaaattgaagcgcaagcctccaagtacaaatgcgggaagaaggcaaaaacacagattgacctgtccgtcctgcgactcatacgagaagaaaccccctaaggagttcctggagagatttaaatccttgctccagaagatgatccaccagcacttgtcctccaggacacatggctctgaagacagt

SEQ ID NO: 14669 - DNA, 486 bp, Artificial Sequence
  Description of Artificial Sequence: Synthetic coding sequence
atgagatcatctcctggtaatatggaacgcattgtcatctgcctcatggtgattttcctcggtacactggtacataagtcaagctcccaagggcaggatagacatatgataaggatgcgccagctcatcgacatcgtcgaccagctaaagaattacgtgaacgatctcgttccagagttcctccccgctccagaggatgttgagaccaattgtgagtggagcgccttcagctgtttccagaaggcccaactcaagtctgccaacacaggcaacaacgagaggataattaatgttagcatcaagaagttgaagcgcaagccaccgtcgactaatgccggtaggaggcaaaaacaccgattgacctgtccctcttgcgatagctatgaaaaaaagcctcctaaagagtttctcgagcggttcaagagtctacttcaaaaaatgatccaccagcacctgtctagcaggactcacgggagcgaagattca

SEQ ID NO: 14670 - DNA, 486 bp, Artificial Sequence
  Description of Artificial Sequence: Synthetic coding sequence
atgcgcagctcacccggaaatatggaaagaatcgtgatctgtctgatggtcattttcctgggtactctcgtgcacaagagctcgtcccaaggacaagatcgccatatgatcagaatgcgccagctgatcgacatcgtggatcagctgaaaaactacgtcaatgaccttgtgcccgagtttctgccagctcctgaagatgtagaaaccaactgcgagtggtcggctttttcctgctttcagaaagcccagctcaaatcagcaaataccggaaacaacgagcgcatcatcaatgtctcgatcaagaaactgaagcggaagccaccgtccaccaatgccggcagacgccaaaagcacaggctcacttgcccaagctgtgattcgtacgagaagaagcctccaaaggagttcctggaacgcttcaaatccctgctgcagaaaatgatccaccagcatctctcgtcgcggactcatggctcggaagatagc

SEQ ID NO: 14671 - DNA, 486 bp, Artificial Sequence
  Description of Artificial Sequence: Synthetic coding sequence
atgcgctctagtcccgggaatatggagcggatcgtgatatgcctgatggtaattttcctagggacactggtacacaagtccagctcacaaggtcaggaccgtcacatgattaggatgagacagctgatcgacattgtcgatcagttaaagaactacgtgaacgatttagtccccgaattcttaccagctcctgaagacgtggaaaccaattgcgagtggagtgccttttcctgctttcaaaaggctcagctgaagtctgccaacaccggtaacaacgagagaattatcaatgtgtctattaaaaaactgaagagaaaaccccccagcacaaacgccgggcgcaggcagaagcacaggcttacctgcccatcttgtgattcatatgagaaaaagcccccgaaggaatttctggagagattcaaaagcttactccagaagatgatacaccagcaccttagctcgcgaacccatgggtctgaggactct

SEQ ID NO: 14672 - DNA, 486 bp, Artificial Sequence
  Description of Artificial Sequence: Synthetic coding sequence
atgagaagctctcctggaaacatggagagaatagtgatctgcctaatggtgatctttcttggaacccttgtccacaaatcttcatcacagggccaggaccgccatatgattaggatgcgacaactaattgacattgtggaccagctgaaaaattacgtgaacgatctggtgccggagtttcttccagcccctgaagacgtcgaaaccaattgtgaatggtctgcattcagttgcttccagaaggcacagcttaagagcgcaaacacagggaacaatgagagaataataaatgtgtccattaagaaactcaagcggaagcctcccagtacaaatgctgggaggaggcaaaaacataggttgacgtgccccagttgcgatagttatgagaagaaaccgcctaaggaattcctcgagagattcaaatcattactacaaaagatgattcatcagcatctgagttccagaacacacggatccgaggattca

SEQ ID NO: 14673 - DNA, 486 bp, Artificial Sequence
  Description of Artificial Sequence: Synthetic coding sequence
atgcgctctagtcccggaaacatggagcggatcgtgatctgtctgatggttatttttcttggtacattagtacataaaagtagcagccagggccaggatcgccacatgatccgtatgaggcaactcatagacattgtcgatcagctcaaaaattacgttaacgatttagtgcctgaattcctacctgctcccgaggatgttgagactaactgcgagtggtcagcattttcttgctttcagaaagcccagctgaaatctgccaacacaggcaacaatgagcggataattaacgtgtcaatcaagaaactgaaaaggaagccaccaagcacaaatgctggccgccggcagaagcatcgtctaacctgccccagctgtgactcctatgagaagaagccacctaaggagttcttagagagatttaagtccctgctgcagaaaatgatccatcagcacctgtcttcccggacccacggaagcgaggattca

SEQ ID NO: 14674 - DNA, 486 bp, Artificial Sequence
  Description of Artificial Sequence: Synthetic coding sequence
atgaggtcttcccctggaaacatggaacgcattgtcatttgcctcatggtgatcttcttggggacacttgtccacaaatcctctagtcaaggacaggaccgccacatgattcggatgaggcaactcatcgacatcgtagatcagctcaagaactacgttaacgatctggttcctgagtttctgccagcccctgaagacgtggagaccaactgtgagtggagcgcttttagctgtttccagaaggctcagcttaagagtgcaaataccgggaacaacgaaaggatcatcaatgtctctatcaagaaactcaaacggaagccgcccagcacaaacgcaggaaggaggcaaaaacatagacttacctgtccctcctgcgacagctacgagaaaaagccccccaaagaattcctggaaaggtttaaaagcctgctgcagaaaatgatccatcagcacctttccagcaggacccacgggtctgaagattcg

SEQ ID NO: 14675 - DNA, 486 bp, Artificial Sequence
  Description of Artificial Sequence: Synthetic coding sequence
atgagaagcagtccaggaaacatggagagaattgtaatctgtctgatggtcattttcttgggcacacttgtgcacaaatcgtcatctcaggggcaggataggcatatgattcggatgcgacagctaattgatatagttgatcagttgaaaaactatgtgaatgatttggttcccgaattcttgccagcaccggaagacgtcgaaacgaattgcgagtggtccgcattctcatgcttccaaaaagctcaactgaagtccgccaatacaggaaacaatgaacgaatcattaacgtaagcatcaaaaagttaaaaaggaaacctccaagcacaaacgcaggtcggcgccaaaagcacagactgacatgtccttcatgcgactcttatgagaagaaacccccgaaagaatttctagaacgctttaaatccctacttcagaaaatgattcaccagcacctcagctctcgcacacatggatcagaggactct

SEQ ID NO: 14676 - DNA, 486 bp, Artificial Sequence
  Description of Artificial Sequence: Synthetic coding sequence
atgcgaagctcgcctggcaacatggagagaatcgtgatctgcctgatggtgatcttcctgggaactttggtccacaagtcctcgtcgcaaggccaggaccggcacatgattcgcatgcgccagctcattgacattgtggatcagttgaagaactacgttaacgatctggtgcctgaatttctgccagcaccggaggatgtggagactaactgcgagtggtcggcgttctcatgtttccagaaggctcaactgaaatctgcgaataccggcaacaacgaaagaatcattaatgtgtcaatcaaaaagctcaaaagaaaacctccttcaactaacgcaggcaggaggcaaaagcatcggctcacctgcccgtcgtgcgattcgtatgagaagaaacccccaaaagaattcctggaaagattcaagagcctcctccaaaagatgatccaccagcatttgagctcccgcacccacggaagcgaggatagc

SEQ ID NO: 14677 - DNA, 486 bp, Artificial Sequence
  Description of Artificial Sequence: Synthetic coding sequence
atgcgttcttcaccagggaacatggagcgaatcgttatttgccttatggtaatcttcctcggcacattggttcacaaatcatcaagccagggccaagacagacacatgattaggatgagacagctgattgatatcgtggaccagctcaagaattacgtcaatgacctcgtgccagagtttctgccagcgccagaggatgtggagactaattgtgaatggtcggccttttcatgctttcagaaagcacagttgaaatccgctaataccgggaataacgaaagaattattaacgtttccataaagaaactgaaacgaaaaccaccttcgacaaatgccgggagaagacagaagcaccggctaacctgcccatcctgcgacagctacgagaagaaaccccccaaggaatttcttgagagatttaaatcactgttacagaagatgatacatcagcacctctcctctcgcactcacggatccgaggattct

SEQ ID NO: 14678 - DNA, 486 bp, Artificial Sequence
  Description of Artificial Sequence: Synthetic coding sequence
atgcgtagctctcctggcaacatggagcgcatcgtcatttgtttaatggttattttcctgggaacactcgtccacaagagctctagccagggtcaagaccgtcacatgattcgcatgaggcaactgattgacatcgtcgaccagctcaagaattatgtcaacgaccttgtcccggagttcctccctgctcctgaggacgtggaaactaactgtgagtggagcgctttctcatgtttccagaaggctcaattgaaatccgctaacacgggtaacaacgagaggatcatcaacgtttcaatcaagaagctgaagcggaagcctccgtcgaccaacgccggtcgtcgccagaagcaccgtctcacttgcccctcatgcgacagttatgaaaaaaagccccccaaagagttcctcgagcgtttcaagtcgcttctgcagaagatgatccaccagcacctgagctcacgaacccacggttcagaagactcg

SEQ ID NO: 14679 - DNA, 486 bp, Artificial Sequence
  Description of Artificial Sequence: Synthetic coding sequence
atgcgctcttctccaggtaacatggagagaatcgtcatttgtcttatggtcatcttcttgggtaccttggtccacaaatctagttcccagggtcaagacaggcacatgatccgcatgcgccaactgatcgacatcgtagaccagttgaaaaattacgtgaatgacctggttccagagttcctgcccgccccagaggacgtcgagacaaactgtgaatggtccgccttttcttgcttccagaaggctcagcttaaatctgcaaataccggtaacaacgaacgtataataaatgtctctataaagaagttgaagcgtaagcccccctctacaaacgccggaagaagacagaagcacagacttacttgtcctagctgcgattcttacgagaaaaagcctcccaaggaatttcttgagcgtttcaaaagtctgcttcagaagatgatccatcagcacctgtcatcccgcacccacggatccgaggacagc

SEQ ID NO: 14680 - DNA, 486 bp, Artificial Sequence
  Description of Artificial Sequence: Synthetic coding sequence
atgcgctcctctcctggaaacatggagagaatagtgatttgcctcatggtcatctttttggggactctcgtccacaaatctagttcccaggggcaggatcggcatatgatccgaatgagacagttaattgacatcgtggatcagctgaagaactatgttaatgacttggtccccgaatttttaccggcgcccgaagacgttgagacgaactgcgaatggagcgcattctcgtgttttcagaaggctcagctgaagtccgcaaatacaggaaacaatgagcggattattaacgtgagcatcaagaaactgaagaggaaaccaccttctacaaacgcggggagacggcagaagcaccgactgacatgccctagttgcgattcttatgagaagaagccccctaaggaattccttgagaggtttaagagtctcttacagaaaatgatccaccaacacctgtcctccagaacccacgggtcagaggactcg

SEQ ID NO: 14681 - DNA, 486 bp, Artificial Sequence
  Description of Artificial Sequence: Synthetic coding sequence
atgcgttcatctccgggcaacatggagcgcattgtgatctgcctgatggtcatattcttaggtaccctggttcacaagtcgtcctcacagggacaggaccgtcatatgattcgtatgaggcaactaattgacatagtcgatcaacttaagaattatgtaaacgatttggttcctgagttcctgccagctccagaggacgtggagactaattgcgagtggtctgctttttcctgtttccagaaagctcaacttaaatccgccaacaccggtaataacgaaagaatcatcaacgtttcaatcaagaaactgaagagaaaaccaccaagcaccaatgctggcagaaggcagaaacacaggctcacttgcccttcttgtgactcctacgagaagaagcccccgaaggagttcctggaaaggttcaaatctctcttacagaaaatgatccatcaacatctgtcttcaaggacccatggcagcgaggactct

SEQ ID NO: 14682 - DNA, 486 bp, Artificial Sequence
  Description of Artificial Sequence: Synthetic coding sequence
atgaggagctcgccgggaaacatggagcggatcgtgatttgcctcatggtgatttttctgggaactctggtgcacaagtcatcatcccaaggacaggacagacatatgatccggatgaggcaactgatcgatatcgtcgatcagctgaagaactacgtgaacgacctcgtgcctgaattcctcccggccccagaggatgtcgagactaattgcgaatggtcggcgttctcctgcttccagaaggctcagctgaagagcgccaacacgggcaacaacgagaggattatcaacgtgtctattaagaaactgaagcggaaaccgccctcaactaacgctggtcggcgccaaaagcaccgcctcacttgcccgtcgtgtgattcgtacgaaaagaagccgccgaaggaatttctcgaaagattcaagtccttgctccaaaagatgatccaccaacatctctcctcgcgcacgcacggttcggaagattcg

SEQ ID NO: 14683 - DNA, 486 bp, Artificial Sequence
  Description of Artificial Sequence: Synthetic coding sequence
atgcgctcttcccccggtaatatggagcggatcgtgatttgcttgatggttatcttcctgggaactctggtccacaagagctcctcccagggccaagaccgccacatgataaggatgaggcagttgatcgacatcgtggaccagcttaaaaactatgtgaacgatcttgtgccagaatttttgcccgctccagaggacgtcgagacgaattgcgagtggagcgcatttagctgcttccagaaggcgcaactgaagtccgctaataccgggaataatgaacggatcatcaatgtttcaataaagaaactgaagaggaaacctcctagcactaacgctggacggcgacagaagcaccgcttgacttgcccttcatgcgattcctacgagaagaagcctccaaaagagttcctggaacggttcaagagtctcctccagaagatgatccaccagcacctatctagcagaacacatggcagcgaagattcc

SEQ ID NO: 14684 - DNA, 486 bp, Artificial Sequence
  Description of Artificial Sequence: Synthetic coding sequence
atgagatcctctccagggaacatggagcggatcgttatctgtctcatggtgatcttcctgggcactttggtgcacaagtcaagctcacagggacaggaccgtcacatgatacggatgaggcagctaatcgatatcgtggaccaactgaaaaactacgtaaacgatctcgtcccagaatttctgccagcaccagaggatgtggagacgaactgcgaatggtctgccttctcatgctttcaaaaagcgcagctgaagtctgccaacacaggcaataacgaacgcatcatcaacgttagtattaagaagcttaagcgtaagccgccgtcaacaaatgcgggccgaagacagaaacaccggctgacgtgtccatcttgcgacagttacgagaaaaagccacctaaggagtttttggagcggtttaaatccctacttcaaaaaatgatacatcagcacctttcgagccgtacacacgggtctgaagactcg

SEQ ID NO: 14685 - DNA, 486 bp, Artificial Sequence
  Description of Artificial Sequence: Synthetic coding sequence
atgagatcgagccctgggaacatggagaggattgtgatctgtcttatggtcattttcttgggaactctggtacataagtcctcatcacagggtcaagatcgccatatgattcggatgagacagcttatagacattgtggatcaactgaagaattacgtgaacgatctcgtgcccgaattcctgccagcaccggaagatgtcgaaaccaattgcgaatggtcagccttttcgtgtttccagaaggcacaattgaagtcagccaacactgggaataacgagcgaattatcaatgtttccattaagaagctgaaacggaagccgcctagcactaacgctggacgccgacagaagcatagactgacttgtccatcgtgtgactcctacgagaaaaaacctccaaaggaatttcttgagaggtttaagtcccttctccaaaagatgatacatcagcatctttcgagcagaactcatggctcggaagattca

SEQ ID NO: 14686 - DNA, 486 bp, Artificial Sequence
  Description of Artificial Sequence: Synthetic coding sequence
atgcgtagttctcctgggaacatggaaagaattgttatttgcttaatggtgattttcctgggaacgctagtacataagtcctcttctcaggggcaagatcgtcacatgataagaatgcgacagcttattgatattgtcgatcaattgaaaaattatgttaatgatctggttccagagtttttaccagccccagaggacgtggaaaccaattgtgagtggagtgctttttcatgcttccaaaaagcccaactgaaatctgctaacaccggtaacaatgagcgaattattaatgtatctattaaaaaactcaaacgtaaaccaccttcgacgaatgccggtcgacgccaaaagcaccggcttacttgcccatcgtgtgattcttatgaaaaaaagcctccaaaagagtttctcgagcgttttaagtccctcttacaaaaaatgatacatcagcatctctcgtcgcgaacgcacggtagtgaagacagt

SEQ ID NO: 14687 - DNA, 486 bp, Artificial Sequence
  Description of Artificial Sequence: Synthetic coding sequence
atgagatcatcaccaggtaatatggaacgaattgttatttgtttgatggttattttcttaggtacacttgtacataaatcttcttcacaaggacaagatagacatatgattagaatgcgacaattaattgatatagtcgatcaacttaaaaattatgtaaatgatttagtacctgaatttttaccagcacctgaggacgttgagactaattgtgaatggtcagcattttcttgttttcaaaaagctcaattaaagtcagctaatactggaaataatgagagaattattaatgtttcaataaagaagcttaaaagaaaacctccatcaacaaatgctggacgaagacaaaaacatagacttacttgtccatcatgtgattcttatgaaaaaaaaccaccaaaagaattcttggaaagattcaaatcacttttacaaaaaatgattcatcaacatctttcaagtagaacacatggatcagaagattca

SEQ ID NO: 14688 - DNA, 486 bp, Artificial Sequence
  Description of Artificial Sequence: Synthetic coding sequence
atgcgctcttccccgggcaatatggagcgcattgtgatctgccttatggtgatcttcctgggaaccctggttcataaatcaagctcgcaggggcaggacagacacatgattcgcatgcgccagctgatcgatattgtggaccaactgaagaattacgtcaacgacctggtccccgaattccttccggcaccggaggacgtcgagactaactgcgagtggtccgcttttagctgcttccagaaagctcaactcaagtccgcaaacacgggaaacaacgaacgcatcatcaacgtgtccatcaagaaactgaaacgaaagcctccgtccactaatgccgggcgccgccaaaagcatcgcttgacttgtccctcgtgtgattcttacgagaagaaaccacctaaggaatttctggaacggttcaagtcattgctgcaaaagatgatccaccagcacctctcttcgcgcacccatggttcggaagattcg

SEQ ID NO: 14689 - DNA, 486 bp, Artificial Sequence
  Description of Artificial Sequence: Synthetic coding sequence
atgaggtcatctcctggcaacatggagcggattgttatctgcttgatggtgatttttttgggtacacttgtgcacaaaagcagcagtcagggccaggatcgacacatgatccgtatgcggcaactcatcgacattgtggaccagctcaagaactacgtgaacgacttggttcctgagtttctcccggcaccagaggatgtggagacaaactgtgaatggagtgctttttcctgtttccagaaggcacagctgaagtcagctaacacgggcaataacgaacgaatcataaacgtgagtattaagaaactcaagcggaaaccaccttctacgaacgcaggcaggagacaaaaacacaggctgacctgcccatcatgcgacagctatgagaagaagccgcctaaggaatttctcgagcgtttcaagagccttttgcagaaaatgatacaccaacatctgtcaagtaggacacatggaagtgaggactcc

SEQ ID NO: 14690 - DNA, 486 bp, Artificial Sequence
  Description of Artificial Sequence: Synthetic coding sequence
atgcgctcttctcctggcaatatggagcggatcgttatttgcttgatggttatctttctgggcaccctggttcacaagagcagctcgcaggggcaggacagacacatgatcaggatgcgtcagctcatagacattgtggatcagctgaagaattacgtcaacgatctcgtgccagaattcctgcctgcacccgaggatgtagaaacgaactgtgaatggtctgctttcagctgcttccagaaagctcagctgaagtctgccaatacaggcaacaatgaacgtatcattaacgtctccattaagaaactcaaaagaaagcccccctcgacgaacgcgggcagaaggcagaaacaccgcctgacgtgtcctagctgcgacagttatgaaaagaaaccacctaaagaattcctcgagagattcaagtccctcctgcaaaaaatgatccaccagcacttgtcatcacggacccatggtagcgaggactcc

SEQ ID NO: 14691 - DNA, 486 bp, Artificial Sequence
  Description of Artificial Sequence: Synthetic coding sequence
atgcgctcctcgccgggcaacatggaacgaattgtgatatgtctgatggtcatcttcctgggaaccctggtccacaagtcgtccagccaaggacaggacagacacatgatccggatgaggcagctcatcgacatcgtggaccagctgaagaactacgtgaatgacctggtgcccgagttcctccccgctccggaggatgtggaaacgaactgcgaatggtcggctttctcgtgctttcagaaggcgcaacttaagagcgccaacactggcaacaatgaaagaatcatcaatgtatcgattaagaaactgaagcgcaagccgccttccaccaatgccgggcggaggcagaagcatcgtctgacttgccctagctgtgattcatacgagaaaaagccgccaaaggaatttctggaacgattcaaatcgctgttgcaaaagatgatccaccaacatctctcctcgagaactcacggatcagaggattcc

SEQ ID NO: 14692 - DNA, 486 bp, Artificial Sequence
  Description of Artificial Sequence: Synthetic coding sequence
atgaggtctagcccagggaacatggaaagaattgtgatctgtttgatggtgatattcctgggaaccctggtacataaatcctcttcccagggccaggaccgccatatgatccggatgcggcagttgatcgacatagtggaccagctgaaaaactatgtcaacgacctggttccagaatttctgcctgctccagaagacgttgaaacaaactgcgagtggtccgccttcagctgcttccagaaggcccaactgaagagtgcgaacacaggaaataatgagcgcatcatcaacgtcagtatcaagaagttaaaacggaaacctccgtccaccaatgcggggaggaggcaaaaacaccgtctgacttgccccagctgcgactcctatgagaagaagccccccaaagagtttctcgaaaggtttaagagcctcctgcaaaaaatgatccatcaacatctgagtagtagaacacatggctcagaggacagt

SEQ ID NO: 14693 - DNA, 486 bp, Artificial Sequence
  Description of Artificial Sequence: Synthetic coding sequence
atgaggtcctcaccaggcaatatggagcggattgttatttgcctaatggtaattttcttggggaccctggttcataagtcatcaagccaggggcaggaccgccacatgatacgaatgcgacaactaattgacatcgtggaccagctgaaaaactacgtgaatgacctagttccggagttcctgcccgcccccgaggacgttgagacgaattgtgagtggtccgctttctcctgttttcaaaaagctcaacttaagtctgcaaacacggggaacaacgaaaggattatcaacgtctcgatcaagaagctcaaacggaagccgccgagcacgaacgcaggacgacgacagaaacaccggctgacttgtccctcatgcgattcgtacgaaaaaaaacctcccaaggagtttctcgaacgtttcaagtccctgctgcaaaagatgattcaccagcatctctcctcccgaacacacggatccgaagactcc

SEQ ID NO: 14694 - DNA, 486 bp, Artificial Sequence
  Description of Artificial Sequence: Synthetic coding sequence
atgcgatcgtcccccggaaatatggagcgcatcgtcatttgccttatggtgatatttcttggcacgcttgtccataagtcgtccagccagggtcaagacagacatatgattcggatgaggcaattgatcgatattgtggatcagctgaagaactacgtcaatgatctcgtgcctgaattcctcccggcacctgaggatgttgaaaccaactgcgaatggtcggcattctcgtgttttcaaaaggcacagcttaagtcggcaaataccggaaacaatgagcggataatcaatgtctccataaagaagctcaaaagaaagccacctagcaccaacgcaggcagacgacagaagcaccgcctgacttgtccctcctgcgattcctacgaaaagaaaccaccgaaggagttcctcgagcgcttcaagagcctgctgcagaaaatgattcatcagcatttgagctcacgtacgcacggctcggaggactcc

SEQ ID NO: 14695 - DNA, 486 bp, Artificial Sequence
  Description of Artificial Sequence: Synthetic coding sequence
atgcggtcttccccaggcaacatggaacgcattgtcatttgcctgatggtgatttttctgggtactctggttcacaaaagcagcagccagggccaggaccggcacatgatcagaatgcgccaactgatagatattgtggatcagctgaaaaactacgtgaacgatctggttcctgagtttctacctgcgccagaagatgtggagaccaattgcgagtggagcgccttcagctgctttcagaaggcacaactcaagtccgccaacactggtaataacgagcgtatcattaatgtctccattaagaaactaaagcgtaagccgccctctacgaatgccggtaggcgccagaaacaccgcttgacatgccccagctgtgattcttacgagaaaaagccgcccaaggagtttctcgagcggtttaaaagcctgctgcaaaaaatgatccaccagcacttgtcttcacgcacccatggctctgaggatagc

SEQ ID NO: 14696 - DNA, 486 bp, Artificial Sequence
  Description of Artificial Sequence: Synthetic coding sequence
atgagatccagcccaggtaacatggaaagaattgtgatttgccttatggtgattttcctgggcactcttgttcacaaatcatcctcccagggacaagaccgtcacatgatcagaatgcggcagcttatagacattgtcgatcaactcaagaactacgtcaatgatttggtgccggaatttcttcctgcaccagaagatgtggagactaattgtgagtggtcggcattttcgtgtttccagaaggcgcaattgaagtcggctaacaccggaaacaacgaaagaatcatcaacgtatcgatcaagaaactcaagagaaagcctccttcaactaatgcaggacgccgtcaaaagcatcgactgacttgtccctcgtgtgattcgtatgaaaagaagccgccaaaagagtttcttgaaaggtttaagtcacttctgcaaaagatgatccatcagcatctctcctcacgaacccatggatctgaggactcg

SEQ ID NO: 14697 - DNA, 486 bp, Artificial Sequence
  Description of Artificial Sequence: Synthetic coding sequence
atgcgatcttcaccgggaaacatggagcggatcgtcatttgcctgatggtgatcttcctcggaaccctcgtgcacaaatcgtcatcccagggccaggatagacacatgatcagaatgcggcagctcatcgacatcgtggaccagctgaaaaactacgtgaacgatttggtcccggagttcctcccagccccggaagatgttgaaaccaactgcgagtggagcgcgttttcgtgtttccaaaaagctcagctgaagagcgccaataccgggaataatgaacggatcattaacgtgtccatcaagaagctgaaaaggaagcctcccagcactaacgcaggtcgccgccaaaagcatcgcttgacttgcccttcgtgcgactcgtacgaaaagaagccgccaaaggagtttcttgaacgcttcaagagcctgctgcagaagatgatccaccaacacctgtcatccagaacgcatggatccgaggactcg

SEQ ID NO: 14698 - DNA, 486 bp, Artificial Sequence
  Description of Artificial Sequence: Synthetic coding sequence
atgcggagctcacccggaaatatggaacgaatagtgatctgccttatggtcatcttcttggggaccttggtgcacaaaagctcctcgcagggccaggatcgccacatgattcggatgaggcagctcatcgacatagtggaccagctcaaaaactacgtcaacgacctggtgccagaattccttccggcaccggaggatgtggaaaccaactgtgagtggtcggccttctcgtgcttccaaaaggcccagctgaagagcgcaaacactggaaacaatgaacgcatcattaatgtctcgatcaagaaactcaagcgcaagccaccgtccactaatgcgggcagacggcaaaagcataggctgacctgcccttcctgcgacagctacgaaaagaagccgccaaaggaatttcttgaaaggttcaagtcacttctccagaaaatgatccatcaacatctctcgtcaagaactcacgggtccgaggactcc

SEQ ID NO: 14699 - DNA, 486 bp, Artificial Sequence
  Description of Artificial Sequence: Synthetic coding sequence
atgaggtcctcgccaggaaacatggaacggatcgttatctgcctgatggtgatcttcctcggaactctggtgcacaagtcgtcgtcgcaggggcaggaccgccacatgattcggatgcggcaactcatcgacatcgtggaccaactgaagaactatgtgaatgacctggttccggagttcctcccggcacccgaggatgtggagacgaactgtgagtggtccgccttttcatgcttccaaaaagctcagttgaaatcggcgaacactggaaacaatgagcggattatcaacgtgagcatcaaaaagctgaagagaaaaccaccgtcaactaacgctggtcgccggcagaaacaccgcctcacttgcccgtcatgcgattcatacgaaaagaagcccccgaaggaattcttggagcgttttaagagcctcctgcagaagatgatccaccagcatctgtcctcaaggactcatggatccgaagatagc

SEQ ID NO: 14700 - DNA, 486 bp, Artificial Sequence
  Description of Artificial Sequence: Synthetic coding sequence
atgcgatcctcacccggtaacatggaacgcattgtgatctgtctgatggtcattttcttgggtactctcgttcacaagtcatcatcccagggacaggatcggcatatgattcgcatgcgccagctgatcgatatagtggatcaactcaagaactacgtgaacgatctggtgcctgaatttctgcccgcgccagaggacgtggagactaactgtgaatggtccgcattttcctgcttccaaaaggctcaactcaagtcggcaaatactgggaacaacgagaggatcataaacgtgagcatcaagaaactcaagcgtaagccaccttccaccaacgcaggtcggaggcaaaaacatcgcctgacttgcccaagctgtgattcctacgagaaaaagcctcctaaagagttcctggaaagattcaagagcttgctgcaaaagatgattcaccagcacttgtcgtcgcggacccatggatcagaggactct

SEQ ID NO: 14701 - DNA, 486 bp, Artificial Sequence
  Description of Artificial Sequence: Synthetic coding sequence
atgcggagctccccgggcaatatggagcgcatcgtcatttgcctcatggtgatttttctcggcacattggtgcacaagtcctcttcacagggccaggaccggcatatgatacgcatgcgccagcttattgatatcgtggatcagctgaaaaattacgtgaacgatctggtgcccgagttcctgcctgctccggaggatgtggagacaaactgtgagtggtccgcttttagttgcttccagaaggcgcagctaaaaagcgcgaatactgggaacaacgaacgcatcataaacgtctccatcaaaaaactgaagcggaaaccaccatccaccaacgctggcaggagacagaagcacagattgacgtgcccttcgtgtgacagttatgaaaaaaagccccctaaggaatttctggagcgctttaaatcattattacagaaaatgatccaccagcatctcagttctcgtactcacggcagtgaggacagt

SEQ ID NO: 14702 - DNA, 486 bp, Artificial Sequence
  Description of Artificial Sequence: Synthetic coding sequence
atgcgatcctcccctggcaatatggagcgtattgtgatatgcttgatggttatcttcctgggcaccttggtacacaagtcatcaagccaggggcaggatcgacacatgatacgtatgcggcagcttatcgacattgtggaccaattgaagaattacgtcaatgacctggtccctgaatttctgccagctccagaggacgtcgaaacgaattgcgagtggagcgcatttagctgttttcagaaggcgcagctgaagtctgccaatactgggaacaacgagaggatcattaacgtgtctataaaaaagctgaaacgcaagccaccatctaccaacgctgggcgacgacagaaacatcggctgacttgccccagttgcgattcttacgaaaagaagccgcccaaggaattcctggaacgatttaagagcctactacagaagatgatccatcagcacctgtcgagtcgcacacacggatccgaggactcg

SEQ ID NO: 14703 - DNA, 486 bp, Artificial Sequence
  Description of Artificial Sequence: Synthetic coding sequence
atgcgttcgtcgccgggtaatatggaacgtatagtaatatgtctaatggtaatatttctaggtacgttagtacataaatcgtcgtcgcaaggtcaagatcgacatatgatacgtatgcgtcaactaatagatatagtagatcaattaaaaaattatgtaaatgatttagtaccggaatttttaccggcgccggaagatgtagaaacgaattgtgaatggtcggcgttttcgtgttttcaaaaagcgcaattaaaatcggcgaatacgggtaataatgaacgaataataaatgtttcgataaaaaaactaaaacgaaaaccgccgtcgacgaatgcgggtcgacgtcaaaaacatcgattaacgtgtccgtcgtgtgattcgtatgaaaaaaaaccgccgaaagaatttttagaacgatttaaatcgttactacaaaaaatgatacatcaacatttatcgtcgcgtacgcatggttcggaagattcg

SEQ ID NO: 14704 - DNA, 486 bp, Artificial Sequence
  Description of Artificial Sequence: Synthetic coding sequence
atgcggtccagtccaggcaacatggagcggatcgtgatctgcctgatggtgatcttcctgggcaccctcgtccacaagtcgtcctcgcagggccaagaccgccacatgatcagaatgcggcagttgatcgatatcgtggatcaattgaaaaactacgtgaatgaccttgtcccagaatttctgcctgcaccggaggacgtcgaaaccaactgcgaatggagcgccttctcgtgttttcagaaggctcaactcaagtctgccaatacggggaataacgaacgcatcatcaacgtctcaatcaaaaagttgaaacggaagccgccatccactaacgcgggccggaggcagaagcaccggctgacctgtccgtcgtgcgattcgtatgagaaaaagccaccaaaggaatttctcgaacggttcaaatccctcctgcagaagatgattcatcaacacctgtcctcaaggactcacggatccgaggactca

SEQ ID NO: 14705 - DNA, 486 bp, Artificial Sequence
  Description of Artificial Sequence: Synthetic coding sequence
atgcgaagttcacctggaaacatggaacgcattgtgatttgcctgatggtaatcttcctgggaactctggtccataagtcctcttcccagggccaggaccgacatatgatcaggatgcggcagctcatcgacatcgtggaccagctgaagaactatgttaatgatctcgtcccagaattcttgcccgcaccagaagatgtggagaccaattgtgagtggtccgcgttctcatgcttccagaaagcgcagctcaaatccgccaacaccggaaataacgagagaatcattaacgtcagcatcaaaaagctgaaacggaaacccccttccaccaacgcggggagaagacaaaagcacagacttacctgcccttcctgcgactcctacgaaaaaaagcctcctaaagagtttctcgaaaggtttaagtcccttttgcagaagatgatccaccaacacctcagctctcgcacgcatggaagcgaggatagc

SEQ ID NO: 14706 - DNA, 486 bp, Artificial Sequence
  Description of Artificial Sequence: Synthetic coding sequence
atgaggtcctcccctggaaacatggaacggattgtgatctgtcttatggtgatcttcctgggcaccctggtgcacaagagctcatcgcaaggacaagataggcacatgatcaggatgcggcagcttatcgacattgtggatcagttgaaaaactacgtgaacgatcttgtgcctgaattcctgccagcacctgaagatgtggagactaactgtgaatggtcggccttctcgtgcttccagaaggcccagcttaagtcggcaaacactgggaataatgaacgtatcataaacgtctctatcaaaaagctgaagagaaagcctccctccactaatgcaggtaggcgacagaagcacagacttacttgcccgtcctgcgacagctacgagaagaagccacctaaggagtttctcgaacggtttaagtccttgctccaaaagatgattcatcagcatctctcgagcagaacccatggctccgaggattcc

SEQ ID NO: 14707 - DNA, 486 bp, Artificial Sequence
  Description of Artificial Sequence: Synthetic coding sequence
atgaggtcaagtcccgggaacatggaaaggatagtgatctgcctcatggttatctttctcgggactcttgtccataaatctagttcacagggacaagataggcacatgatcaggatgcggcagctgatagatattgtggatcagctgaaaaactacgttaatgatcttgtgcccgaattcctcccagctcctgaagatgttgaaacaaactgcgaatggtctgcattctcatgttttcagaaagcgcagcttaagtctgctaacacaggaaacaacgaaaggatcatcaatgtgtctataaaaaagctgaagcgaaagccaccctcaacaaatgctgggaggcggcagaaacaccggctcacttgcccctcgtgtgattcttatgaaaaaaaacccccaaaagaattcctagaaagatttaaatctttgctacagaaaatgatacatcagcacctttcttctcgcacacacgggagtgaagatagt

SEQ ID NO: 14708 - DNA, 486 bp, Artificial Sequence
  Description of Artificial Sequence: Synthetic coding sequence
atgcgttcatcccccggcaacatggagcgcatagtaatttgcttgatggtaatcttcctggggacccttgtgcacaaaagttcatctcagggacaggatcgacatatgatccggatgcggcagctaatcgacattgtcgatcagctgaagaattacgtgaatgacctcgtgcccgagttcttacctgcgccggaggacgtcgaaaccaactgtgagtggtctgccttcagttgtttccagaaagcccagttgaaaagcgcaaatacgggaaacaatgagcgcatcataaatgtttctatcaaaaaactaaagaggaagccaccctcaactaacgctggccgcagacagaagcataggctgacctgcccctcatgcgattcatacgaaaagaaaccgcctaaggagtttttggagcgctttaagagccttcttcaaaagatgatacaccagcacttatcttccagaacacacggtagtgaagacagt

SEQ ID NO: 14709 - DNA, 486 bp, Artificial Sequence
  Description of Artificial Sequence: Synthetic coding sequence
atgaggtcctcaccggggaacatggaaagaattgtgatttgcctgatggtcatctttctgggaacccttgtccataagtcatccagccagggccaagatagacatatgatcagaatgcgtcaacttattgatatcgtggatcagttgaagaactacgtcaatgaccttgtgcctgaatttcttcctgcgcccgaggacgtggaaacgaactgcgaatggagcgcctttagctgttttcaaaaggcgcaactgaagtccgcaaatactggtaacaacgaacggattatcaatgtttcgatcaaaaagctgaagaggaagcccccatcgaccaatgcaggacgtagacagaagcaccgactgacctgtccttcttgtgactcctacgagaagaaaccacccaaagagttcctcgaacgtttcaaaagcctgctccagaagatgattcatcagcatctgagctcccgtacccacggctcggaggattcc

SEQ ID NO: 14710 - DNA, 486 bp, Artificial Sequence; identical to SEQ ID NO: 14641
  Description of Artificial Sequence: Synthetic coding sequence

SEQ ID NO: 14711 - DNA, 486 bp, Artificial Sequence
  Description of Artificial Sequence: Synthetic coding sequence
atgagaagcagcccaggaaacatggagcggattgtgatctgcctcatggttatttttttaggtactctggtccacaagtcctcttcccagggccaggacagacacatgattaggatgaggcagctgatagatatcgtggaccagttgaaaaactacgtgaatgacctcgtgccggagttcctgcccgcccctgaagacgtggagacaaattgtgagtggtctgctttctcatgttttcagaaggcacagcttaaatctgccaatacggggaacaacgagcgaattattaatgtctcaatcaaaaagctgaagcggaagcctccctcaaccaatgccggccggcgtcagaagcacagactaacctgcccaagttgcgactcatatgaaaagaaaccaccaaaggagttcctggagagatttaaaagcctgttgcagaaaatgatccaccaacatctgtctagccgcacacacggatctgaggactcc

SEQ ID NO: 14712 - DNA, 486 bp, Artificial Sequence
  Description of Artificial Sequence: Synthetic coding sequence
atgcggagcagccccggcaacatggagcggatcgttatatgtttgatggtcattttcctggggacattagtccacaaatcatcctctcaagggcaggataggcatatgatcagaatgaggcagcttattgacatagtggatcagctcaaaaactacgtgaacgacctggtgcctgaattcctgcccgcccctgaggatgtggaaacgaattgcgaatggtcagcgttttcctgctttcagaaagcacagttgaaatctgcaaatacaggaaataacgaaaggatcatcaacgtgtccattaaaaaactgaagcggaaaccaccctccacaaatgccgggaggcggcagaaacaccgtttgacctgcccgtcttgtgactcatacgaaaagaagcctcctaaggaattcctagagaggttcaaatcattacttcagaagatgatccatcagcaccttagttccagaacacatggtagcgaagatagt

SEQ ID NO: 14713 - DNA, 486 bp, Artificial Sequence
  Description of Artificial Sequence: Synthetic coding sequence
atgagatctagccctggtaatatggagcgtattgtgatatgtctgatggtcatatttctaggaacactagttcataagtcatcaagccaaggtcaggatcgtcacatgatcaggatgaggcagttaattgatattgtggatcaactcaagaactacgtcaacgacttagtgcccgagttccttcctgctccagaagatgtggaaactaactgtgagtggtcagcattctcctgtttccagaaagctcagcttaagagtgccaacacaggtaataacgagaggataattaacgttagcattaagaagcttaagcgaaagccaccttccacaaatgcggggcgacgtcaaaaacataggttaacgtgccctagttgtgattcgtatgaaaagaagccaccgaaggaattcttggagagatttaagtctttgttacagaagatgatacatcagcacctctcatcgaggacccatggatctgaagatagc

SEQ ID NO: 14714 - DNA, 486 bp, Artificial Sequence
  Description of Artificial Sequence: Synthetic coding sequence
atgcgctccagccctggtaacatggaacggatcgtcatctgcttgatggtgatctttctgggcactctggtgcataagtcgtctagccaaggacaggaccgccacatgatcagaatgcgtcaactcatagatatcgtggaccagttgaagaattacgtgaacgatctggtgccggagttcctgcccgctccggaggatgtcgaaaccaactgtgaatggtccgcattcagttgctttcagaaggcccagctcaagtccgcgaatactggaaataacgaaagaattatcaacgtcagcataaagaaactgaaaagaaaaccgccgtcgaccaacgccggccgacgccaaaagcatcgcctgacttgcccgagctgcgacagctacgaaaagaaacccccgaaagagttccttgagcggttcaagtctctcctgcagaagatgatccatcaacacctctcctcacggacgcacggaagcgaggactcg

SEQ ID NO: 14715 - DNA, 486 bp, Artificial Sequence
  Description of Artificial Sequence: Synthetic coding sequence
atgcgctcaagccccggcaatatggaaaggatcgtgatttgtctgatggtcatcttcctgggcacccttgtccataagtcgtctagccaaggccaggatcggcatatgattagaatgcgtcagctgattgatatagtggatcagctgaagaactacgtgaacgatctggtcccagaattcctccctgcaccggaggatgtcgaaaccaactgtgaatggtcggcattttcgtgctttcaaaaagcgcaactgaagtcagccaatactgggaacaatgaaagaattatcaatgtgtcgatcaagaaactgaagagaaagccgccttcgactaatgcaggacgcagacaaaaacatagactgacttgtccatcgtgcgactcgtatgagaaaaaacctcctaaagaatttcttgagcgtttcaaaagcctcctgcaaaagatgatacaccaacatctgagctcgcggacccatggaagcgaggactcc

SEQ ID NO: 14716 - DNA, 486 bp, Artificial Sequence
  Description of Artificial Sequence: Synthetic coding sequence
atgagatcatcgccgggaaacatggagcggatcgtgatctgtctgatggtgatcttcttgggaaccctcgtccacaagagctcgtcgcaaggacaggatcgccacatgattcggatgcggcaactcatcgatatcgttgatcagctgaagaactacgtcaatgaccttgtgcccgagttcttgcccgcaccggaggacgtggaaactaactgcgaatggtcggcattttcatgtttccagaaggcgcaacttaagtcagccaacacggggaataatgaacggatcatcaacgtgagcatcaaaaagctcaagagaaagcctccttctaccaacgctggacggcgccaaaagcacaggcttacctgcccatcttgcgactcatacgaaaagaaaccaccaaaggagtttctcgagcggttcaaaagcctcttgcagaagatgatccatcagcacctgagctccaggactcatggctcggaggactcg

SEQ ID NO: 14717 - DNA, 486 bp, Artificial Sequence
  Description of Artificial Sequence: Synthetic coding sequence
atgaggagcagccccggaaacatggagcgaattgtgatatgtctcatggttatttttctgggcaccctggtgcataaaagttcatcccaaggccaggatcggcacatgattcgcatgcggcaactcattgacatcgtcgaccagctcaagaactatgtaaacgacctagtgccagagttcttgccggcccctgaggacgtcgagacaaattgcgaatggagtgctttctcctgttttcagaaggcccagctgaagtctgccaataccggcaataatgaaaggatcattaacgtctccatcaagaaattaaagcgcaagcctccttcgaccaacgcagggcgacgccagaagcacagactcacatgcccctcctgcgactcttacgaaaagaaacctcctaaggagttcttagaacgctttaagtcactgttgcagaagatgattcaccagcacctatcctctagaacccacggttcagaggacagc

SEQ ID NO: 14718 - DNA, 486 bp, Artificial Sequence
  Description of Artificial Sequence: Synthetic coding sequence
atgcggtcgtccccaggcaacatggagcgcatcgtgatctgcctcatggtgatcttcctgggaactttggtgcataaaagcagcagccaggggcaagaccgccacatgattcgcatgcgccaactgatcgacatcgtcgatcagctgaagaactacgtcaatgacctggtcccggaatttctcccggcgccggaggatgtcgaaactaactgtgaatggtcggccttctcatgctttcaaaaggcgcagctgaaaagcgcaaacaccggcaataatgaaagaattatcaatgtgtcgattaagaaacttaaaaggaagccaccgtcgacgaacgcaggtagacgccagaagcaccgactgacttgcccaagctgcgattcatacgagaagaagcctccaaaagaatttctcgagcgcttcaaatcacttctccagaagatgattcaccagcatctgtcgtcacgcacccacggcagcgaggactcg

SEQ ID NO: 14719 - DNA, 486 bp, Artificial Sequence
  Description of Artificial Sequence: Synthetic coding sequence
atgcggtcctcccctggtaatatggaaaggattgtgatttgtctgatggtcatctttctcggcactctggtgcataagtcgtccagccaaggtcaggatcgtcacatgatcagaatgcgtcaactgattgacattgtggaccaactgaagaattacgtgaacgacctggtgcccgagttccttcctgcacctgaggatgtcgaaactaattgtgagtggtcggcgttcagctgctttcaaaaggcgcaacttaagagcgcaaacactggcaacaacgaacggatcatcaacgtgtccataaagaagttgaagcgtaagcctcctagcaccaacgctggacgacgccagaaacatcgccttacttgcccgtcatgtgactcctacgagaaaaagcctccgaaagaatttctcgaaagatttaagtcgctgctgcagaaaatgatccatcagcacctttcgtcaagaactcatggatccgaggacagc

SEQ ID NO: 14720 - DNA, 486 bp, Artificial Sequence
  Description of Artificial Sequence: Synthetic coding sequence
atgcgctcctcaccggggaacatggaacggatcgtgatttgcctgatggtaatcttcctgggtacccttgtgcataaatccagcagccagggccaggaccgccatatgatccgcatgcgccaactgatagacatcgtggaccagctgaagaattacgtgaacgacctcgtccctgagtttctcccggcaccggaagatgtggaaactaactgcgagtggtccgccttttcatgtttccaaaaggctcagttgaaatcagctaataccggaaacaatgagagaatcatcaacgtctcgataaagaagctcaagagaaaaccacccagcacgaacgccggacggcggcagaaacaccgcctgacttgcccaagctgcgactcgtacgagaagaagccccctaaagaattcctggagagattcaagtctctgcttcaaaagatgatccaccaacatctcagctcacgtacccacggatcagaagattcc

SEQ ID NO: 14721 - DNA, 486 bp, Artificial Sequence
  Description of Artificial Sequence: Synthetic coding sequence
atgcggagctcgcctgggaacatggagcggatcgtgatctgcctgatggtcatcttcctgggcaccctggtccataagtcgtcgagccaaggtcaagaccgccacatgatccggatgcggcaactcattgatatcgttgaccagcttaagaactacgtgaatgacctggtgccggaattcctcccggccccagaagatgttgaaactaactgcgagtggtcagctttctcgtgcttccagaaggcccaactcaagtcggctaatactgggaataacgagcggatcattaacgtctcaattaagaagctgaaacgcaagcccccttcaactaatgccggcagacgacagaagcataggcttacctgcccgtcgtgtgactcctacgagaaaaagccgccgaaggaattcttggaaaggttcaagtcgctgctgcagaaaatgatccaccagcacctgagctcaagaacccatggatccgaagatagc

SEQ ID NO: 14722 - DNA, 531 bp, Artificial Sequence
  Description of Artificial Sequence: Synthetic coding sequence
atgttccacgtttcctttcgttatattttcgggctgcccccgttaatcctggtgcttttgcccgtggcaagctcagattgtgacatagaaggtaaagatggaaagcagtacgaatccgtcctaatggtcagcattgaccagctcctggacagtatgaaggagattgggtcaaactgcctcaacaacgaattcaactttttcaagcggcacatttgtgatgctaacaaggagggcatgtttctgttccgcgctgctaggaagctcagacaattcctcaagatgaatagcacgggggacttcgacctgcacctcctgaaagtttctgaaggaaccacaatcctactaaattgtacggggcaagtgaagggacggaaacctgcggcactcggcgaagcacagccaacaaagagtcttgaagaaaacaagtccctcaaggagcagaaaaagcttaacgacctgtgtttccttaaaagacttttgcaggagataaagacctgttggaacaaaattctcatgggtacaaaggaacac

SEQ ID NO: 14723 - DNA, 531 bp, Artificial Sequence
  Description of Artificial Sequence: Synthetic coding sequence
atgttccacgtctctttccgctacattttcggactgccgcctctcatcctcgtcctgctgccggtcgcgagcagcgattgcgacatagagggcaaagatggtaagcagtatgagagcgtgctgatggtttctattgaccaacttctcgactcgatgaaggagatcgggtctaactgcttgaacaacgagttcaacttcttcaaacggcatatttgcgatgcgaataaagaaggcatgttcctctttcgcgcggctcgaaagctgcggcagtttcttaagatgaattcaacaggtgatttcgacctgcacctactgaaggtgtccgaaggtacgaccattctcctgaactgcactggccaagtgaagggacggaagcctgccgctctgggtgaggctcagcctacgaagtccctcgaagagaataaatcattgaaagagcagaaaaaactgaatgatctgtgtttcctgaagaggctgttgcaagagatcaagacctgctggaacaaaattctcatggggacgaaggagcac

SEQ ID NO: 14724 - DNA, 531 bp, Artificial Sequence
  Description of Artificial Sequence: Synthetic coding sequence
atgtttcacgtgagctttcgctacatcttcgggctgcccccgctgatcttggtgcttctcccagttgcatcatccgactgtgatatcgaaggcaaggacggcaagcagtacgagtccgttttgatggtgtcgatcgaccaactgctggactcgatgaaggaaatcggatcgaactgtctgaacaacgaattcaacttcttcaagaggcacatctgcgacgctaataaggaaggtatgtttctgttcagggcggcgcggaagctccgccagtttctcaagatgaattcaactggagacttcgatctccaccttctcaaggtgagcgagggaacgactattctgctgaattgcaccggacaggtgaaagggcggaagccagctgcacttggcgaagcccaaccgaccaagtcgctcgaagaaaacaagtcgctgaaggagcagaagaaactgaatgatctttgcttcctgaaacggctcctgcaagaaatcaagacctgctggaacaaaatcctcatgggaactaaagaacac

SEQ ID NO: 14725 - DNA, 531 bp, Artificial Sequence
  Description of Artificial Sequence: Synthetic coding sequence
atgtttcacgtgagcttccggtacattttcggtctaccgccacttatcctggtgcttctgccagttgcctctagtgactgtgatattgagggcaaggacggcaaacaatacgagagcgttctcatggtttcaattgaccaactcctggactcaatgaaggaaattgggtccaactgtttgaacaatgaatttaatttttttaagcgccacatttgcgacgcgaataaagaagggatgtttctctttcgcgccgctcgcaaactgcgacagttcctgaaaatgaactccactggggactttgacctccatcttctgaaggtgagcgaaggcactactatcctgctgaactgcacaggccaagtaaagggacgcaagcccgccgccttaggagaggcccaaccaaccaagtcgttggaagagaataagagtctcaaggagcaaaagaagctgaatgacctgtgcttcctgaaaagacttctccaagaaatcaaaacgtgctggaacaaaatactcatgggaaccaaggagcat

SEQ ID NO: 14726 - DNA, 531 bp, Artificial Sequence
  Description of Artificial Sequence: Synthetic coding sequence
atgttccatgtctcattcaggtatattttcggtctgcctcccttgatcctcgtcttgctgccagtagcttcttcggattgtgatattgaggggaaagatggcaagcagtacgagtcagttcttatggtgagcatagaccagctgttagactccatgaaagagatagggtccaactgtctcaacaacgaatttaatttttttaaaaggcacatatgtgacgcaaataaggaaggcatgttcttgtttcgcgctgcacggaaactccgccagtttctgaaaatgaactcgactggcgacttcgacctccacttgctgaaggtatccgaaggaaccactattttgcttaattgtaccggacaagtcaaaggcaggaagcccgcagccttgggagaggctcagcccacaaagtctctggaagagaataaatcattaaaagaacagaagaaactcaatgatctgtgctttctgaagaggctgctgcaggaaataaagacttgttggaacaagattcttatgggtacaaaagaacac

SEQ ID NO: 14727 - DNA, 531 bp, Artificial Sequence
  Description of Artificial Sequence: Synthetic coding sequence
atgttccacgtttcctttcggtacatctttggactgccaccattaatactggtccttctgcccgtagcgtcatccgattgtgacatcgagggtaaggacgggaaacagtacgagtcagtgcttatggtgagcatcgatcagctccttgatagcatgaaggagatcgggagtaattgcctgaataacgagttcaactttttcaaacgccacatctgcgacgccaacaaagagggtatgtttcttttcagggccgcgcggaagctgagacagtttcttaaaatgaactcgactggtgattttgatctgcacctgctgaaagtgagtgaaggcacaacaattctgctgaattgcaccggacaagttaagggccggaagccagccgcactgggtgaggcccagccgacaaaatccttggaggagaataaatcgctgaaagagcaaaagaaattgaatgatctttgtttcctgaagcgccttctgcaggaaatcaaaacttgctggaataaaatcctgatgggcacaaaagagcac

SEQ ID NO: 14728 - DNA, 531 bp, Artificial Sequence
  Description of Artificial Sequence: Synthetic coding sequence
atgtttcacgtgtcattccggtacatctttggactgcctcctcttattctcgttctgcttccagtcgcgtcctcggattgtgacattgagggtaaagatgggaagcaatacgagagcgtccttatggtgtctatcgaccagctccttgattccatgaaggagatcggttctaactgcctcaataacgagtttaactttttcaaacgtcatatttgtgatgccaacaaggagggcatgttcctgtttagagctgcacgaaagttgaggcagtttctgaagatgaacagcactggtgatttcgatcttcacttgctcaaggtgtcggaaggtactaccatcctgctcaattgtactggtcaggtgaagggacgcaagcctgctgcacttggcgaagcacagccaaccaaatcactggaagagaacaaaagccttaaagaacagaagaaacttaatgatctttgctttcttaaaagactgctccaagagattaagacctgctggaataagatactgatgggaactaaggaacat

SEQ ID NO: 14729 - DNA, 531 bp, Artificial Sequence
  Description of Artificial Sequence: Synthetic coding sequence
atgtttcatgtgagcttcagatatatctttggtcttccaccactgattcttgtactgttgcctgtggcctcctccgactgtgatattgaggggaaagatggaaagcaatacgagtctgtgctaatggttagtatcgatcagctcctcgactcaatgaaggagattggatctaattgcctcaacaatgagttcaatttctttaagcgacacatatgtgacgccaacaaggaggggatgttcctgtttcgtgcggctagaaaattgagacagtttctaaagatgaacagtacaggcgactttgacctgcaccttctgaaagtgagtgaagggacaaccatcctgctcaactgcaccgggcaggttaaaggccgcaaacccgccgccctcggagaagctcagcccaccaagagccttgaggagaataagtcattgaaggaacagaagaagctgaacgacctttgctttctgaagaggctgctccaagaaatcaagacttgctggaataaaattttaatgggaactaaggagcat

SEQ ID NO: 14730 - DNA, 531 bp, Artificial Sequence
  Description of Artificial Sequence: Synthetic coding sequence
atgtttcatgtgagcttcagatatatctttgggctccctccactgattcttgtgctgcttcctgtggcgtccagcgattgcgacatagagggcaaggacggtaagcaatatgagagcgtgcttatggtcagcatcgaccagctcctggacagtatgaaggaaatcggctccaactgtctcaataacgaatttaatttctttaagaggcatatatgcgacgccaacaaagagggtatgttcctgtttcgagcagcaagaaaactgagacagttcctaaaaatgaattcaaccggcgacttcgacctacatcttctcaaggtgagcgaggggacaaccattctgctgaattgtactgggcaggtgaagggaagaaaaccagcagcactcggggaagcacagcccaccaaaagcctggaagagaataagtcgctgaaggagcagaaaaaactgaacgatctgtgttttctcaagcgactactgcaagaaattaagacctgctggaacaaaatcctgatgggaacaaaagaacac

SEQ ID NO: 14731 - DNA, 531 bp, Artificial Sequence
  Description of Artificial Sequence: Synthetic coding sequence
atgtttcacgtctcattccgatacattttcggtctgcctccactgattctcgttcttctgcccgtcgcatcgtcggattgcgatattgaaggcaaagatggtaagcaatacgaatcggtcctgatggtgtccatcgaccaactcctggatagcatgaaagaaatcggttcaaattgcctgaacaacgagtttaacttctttaagcgtcatatttgtgatgcgaacaaggaggggatgtttctctttcgcgcagcccggaagctgaggcaatttcttaagatgaactcaaccggcgatttcgatcttcacctgcttaaagtgtcagaaggcacgactatactgctgaactgtaccggtcaggtgaagggaagaaagccagcagcactgggagaagcccaacccactaagtccttggaggagaacaagtcactcaaagagcagaaaaagctgaacgatctgtgtttccttaaacggcttctgcaggaaatcaaaacctgctggaataagatcctcatgggcactaaagaacac

SEQ ID NO: 14732 - DNA, 531 bp, Artificial Sequence
  Description of Artificial Sequence: Synthetic coding sequence
atgttccacgtctcatttcggtacatctttggacttccgcccctcattttggtgctcctcccagtggcctcctcagactgcgatattgaaggaaaggacggaaaacagtacgaatccgtgctgatggtgtcaatagatcagttgctcgactccatgaaggagattggctcaaactgtctgaacaatgaattcaacttctttaaacgccatatttgtgatgcaaacaaagaaggtatgtttctttttagggcagcaagaaagttgagacaattcttgaaaatgaactccactggagatttcgatctgcacctgttgaaggtgagcgaagggaccaccatccttttgaattgcacgggccaggtcaagggacgaaagcctgctgcccttggtgaagcccaaccaaccaagtccctggaggagaacaagagtctgaaggagcagaagaagttgaacgatctgtgttttttgaaaaggctgctgcaagaaatcaagacttgttggaataagatcctcatgggaactaaggaacat

SEQ ID NO: 14733 - DNA, 531 bp, Artificial Sequence
  Description of Artificial Sequence: Synthetic coding sequence
atgtttcatgtttcgttcaggtacatttttggactgcctcccctcatacttgtgctgctgccggtcgcctcatccgactgtgatattgagggcaaggacgggaagcaatacgaatcagtcctgatggtgagcattgatcaacttttggactcgatgaaggagatcgggagcaactgtctgaataacgagtttaacttctttaagaggcatatatgtgatgctaataaggaggggatgtttctgttcagggccgcacggaagttgcgacaatttctgaagatgaactccaccggtgactttgatctccacctgctgaaggtgtccgaaggaaccaccattctgctcaattgtacgggtcaggtgaagggtcgcaaacctgcagcactgggggaagcacagcctactaaaagcctggaagaaaacaagtccctgaaagaacagaagaagctcaatgatctgtgtttccttaaaagactcctgcaagagataaagacttgttggaataagattctgatgggcacgaaggaacat

SEQ ID NO: 14734 - DNA, 531 bp, Artificial Sequence
  Description of Artificial Sequence: Synthetic coding sequence
atgtttcacgtgagctttagatacatttttggcctgcccccactgatcctcgtcctgttgcctgtggcctccagcgattgtgatattgaaggtaaggacggaaagcagtacgaatcggtgcttatggtgtccatcgatcagttgcttgattccatgaaggaaattggaagcaattgtctgaataacgagtttaactttttcaagcgtcatatctgtgacgctaacaaagagggtatgtttctgtttagggcggcaagaaagctgcggcagtttctgaagatgaattctacgggtgattttgacctgcaccttctgaaggtgtccgaagggaccactatactgctcaactgcacggggcaagtgaaagggcgaaagcctgcagcactgggcgaagcgcagcccaccaagagccttgaagaaaacaaatctctgaaagaacagaagaaacttaatgatctgtgcttccttaagcggctccttcaagaaatcaagacttgttggaacaagattctcatgggaacgaaggagcac

SEQ ID NO: 14735 - DNA, 531 bp, Artificial Sequence
  Description of Artificial Sequence: Synthetic coding sequence
atgttccacgtgagcttcagatacatcttcggcctgccaccgctgatcttggtgctgttgcctgtcgcttcctccgactgcgatatagaaggcaaggatggaaagcaatacgagtcggtcctgatggtgtcaatcgaccaactgcttgattccatgaaagagatcggctcgaattgcctgaacaacgaattcaacttctttaagagacacatctgcgatgcgaataaggaaggaatgtttctcttccgggctgctcggaaactgcggcagttcctcaagatgaactccaccggagacttcgacctgcatctcttgaaagtcagcgagggaactaccatcctgctgaactgtactgggcaggtgaagggtcgcaagccggcagcgttgggagaggcgcagcccaccaagtcgctggaggaaaacaaatctttgaaggaacagaaaaaactgaatgacctgtgttttctgaagaggctgctgcaagagattaagacctgctggaacaagatcctgatgggaactaaggaacac

SEQ ID NO: 14736 - DNA, 531 bp, Artificial Sequence
  Description of Artificial Sequence: Synthetic coding sequence
atgtttcacgtgtcgttccgctacatatttggccttcctccactcatccttgtgctgctgcctgtggctagctcggactgtgacattgaaggcaaggatgggaagcagtacgagtcggtgcttatggtgtcgattgaccagctgctggatagcatgaaggagattggttcaaattgtctgaacaatgagtttaacttctttaagaggcacatttgcgatgctaacaaagagggcatgtttttgttccgcgcggcgcggaagctgcggcagttcctgaaaatgaactcaaccggagattttgatctgcatctgttgaaagtctccgagggaacgactatcttgctgaattgcaccggacaggtgaaagggagaaagccagcagcccttggagaagcacagccaactaagtcacttgaagaaaacaaatcgcttaaggaacaaaagaaactgaacgatctgtgttttttgaagcgcttgcttcaagagatcaagacctgttggaataagattctgatggggacgaaggagcat

SEQ ID NO: 14737 - DNA, 531 bp, Artificial Sequence
  Description of Artificial Sequence: Synthetic coding sequence
atgttccatgtatcctttcgctatattttcggcctgccgcccctgatcctcgttctgctacctgtggcatccagcgactgcgacatcgagggaaaagacggcaagcaatatgagtcggtcctaatggtgtcaattgatcagttgcttgactcgatgaaggagattggctcgaactgccttaacaatgaatttaacttctttaaacggcacatttgcgacgccaacaaggaaggcatgttcttatttcgggccgcgcgaaagctgaggcagttcctcaagatgaactccactggcgactttgatcttcatctactgaaagtctccgagggtacgaccattctacttaactgcacgggccaggtcaagggcagaaagccggcagctctgggcgaagcacagccaacaaaatctctggaagagaataagagtttgaaggagcagaaaaaactaaatgacctatgttttctgaagcgcttgcttcaagagataaagacctgctggaacaagatcttaatgggaacgaaggagcat

SEQ ID NO: 14738 - DNA, 531 bp, Artificial Sequence
  Description of Artificial Sequence: Synthetic coding sequence
atgtttcatgtgagctttcgctatatatttggactgccccctctgatactcgttctcctaccagtcgcttcctccgactgtgacatcgagggaaaagatggcaagcagtacgaaagtgtgctgatggtctcaatcgaccaactgctggatagcatgaaggagatcggatccaactgccttaataacgagtttaacttctttaaaagacacatatgtgacgcaaacaaggaaggaatgtttcttttccgggccgcaagaaaactgaggcagttcttgaagatgaatagtacaggggactttgatctgcacctcttgaaagtctctgaagggaccaccattctgctgaactgtaccggacaggtcaagggtaggaagcccgccgccttgggcgaggcccagcctacaaagagtctggaagagaataaatccctgaaggaacagaagaaacttaatgacctgtgctttttgaagcggcttctccaggagatcaagacatgttggaataagattttaatgggcacaaaggagcat

SEQ ID NO: 14739 - DNA, 531 bp, Artificial Sequence
  Description of Artificial Sequence: Synthetic coding sequence
atgtttcacgtgtcattcaggtacatcttcgggctcccaccacttatcctggtcctgctcccggtggcttcgtccgattgtgatattgaggggaaggacggtaaacagtacgagtcagtgttgatggtgagcatcgaccaactcctggactcaatgaaggaaataggatcaaactgcctgaataacgaattcaacttctttaagagacatatctgcgatgccaataaggaaggcatgttccttttccgggccgcacgtaaactccgacagttcctgaagatgaactccactggcgattttgacctccacctgcttaaagtctcggagggcacgaccattctgctcaactgtactggacaagtgaagggacgcaagcctgctgccttgggagaggcgcagccgaccaaatccctcgaagagaataagtccctcaaggaacagaagaagttgaacgatctgtgcttcctgaagcggctcctccaggaaatcaaaacttgctggaacaagattctcatgggtaccaaagagcac

SEQ ID NO: 14740 - DNA, 531 bp, Artificial Sequence
  Description of Artificial Sequence: Synthetic coding sequence
atgttccacgtgagtttcaggtacatcttcggcctcccccccctgatcctggtgttgttaccggttgcttcttctgattgtgatattgaaggcaaggacggcaagcagtatgaaagcgtgctgatggtgtcaattgaccagttgctggattccatgaaagaaatcggctcaaactgtctgaacaacgaattcaacttctttaaaagacatatctgcgacgcgaacaaggagggaatgtttctctttagagccgccagaaagcttagacagtttttaaaaatgaactccacgggtgacttcgatcttcaccttctcaaagtgtccgagggtactactattctgctgaattgtacaggccaggtcaaaggaagaaaacccgcagctttgggggaggcccaaccgaccaaaagtttggaggagaataagagcctaaaggagcaaaaaaaattgaatgatctgtgttttctgaaacgtcttctgcaggagataaagacctgctggaacaagattctgatgggcacaaaggagcac

SEQ ID NO: 14741 - DNA, 531 bp, Artificial Sequence
  Description of Artificial Sequence: Synthetic coding sequence
atgtttcatgtgtccttcagatacatctttggccttccgccattgattctggtgcttcttcccgtggcatccagcgattgcgatatcgagggtaaggatggaaagcaatacgaatcggtcctgatggtgtccattgaccagctgcttgattcgatgaaagaaattggatccaactgcctgaataacgagtttaacttctttaagcgccacatttgcgatgccaataaagagggaatgttcctctttagagccgcacggaaactgcggcagtttcttaagatgaactcgactggcgatttcgatctgcacctgctgaaggtgtcggagggtaccaccatccttctgaactgtaccggacaagtcaaggggcgcaagcccgcagcgctgggggaagcacagccgactaagagcctcgaagaaaacaagtcacttaaagaacagaaaaaactcaacgatctttgttttctgaagagattgcttcaagaaatcaaaacgtgttggaacaagattctgatggggactaaagaacat

SEQ ID NO: 14742 - DNA, 531 bp, Artificial Sequence
  Description of Artificial Sequence: Synthetic coding sequence
atgttccacgtgtcattcagatacatttttggcttgccacctctgatcctggtacttcttccagtagcctcatcggactgtgatatcgagggaaaggatggaaagcaatacgagagcgttctgatggttagcattgatcaattgttagattctatgaaggagattggaagtaattgtcttaataatgagttcaatttttttaagcgtcacatttgtgatgcgaataaagagggcatgttcttgttccgagctgcccgaaaactccgtcaattcttgaaaatgaactcaacgggtgattttgatctccatcttctgaaagtgtcagaaggaaccactatacttctcaactgcactggacaggtgaagggacgaaagccggcggcacttggtgaagcacagccaactaaatctttagaagaaaataagagtcttaaagaacaaaagaaacttaatgatttgtgttttttaaaacgacttcttcaggaaatcaaaacatgctggaataagattttgatggggacgaaggagcat

SEQ ID NO: 14743 - DNA, 531 bp, Artificial Sequence
  Description of Artificial Sequence: Synthetic coding sequence
atgtttcacgtgtcatttcggtacatcttcggactgccacctctcatcctggtgctgctgcccgtcgcgtcgtccgactgtgacatcgaaggtaaggatggtaaacagtacgaatcagtgcttatggtttcgattgatcaactgcttgatagcatgaaggagatcggatcgaattgtctcaataacgagtttaacttctttaaacgacacatctgtgatgcgaacaaagaaggaatgttcctctttagggcggctaggaagctgcgccaattcctcaaaatgaacagcaccggagatttcgatctgcacctgctgaaggtgtcagagggtaccactattctgctgaactgcaccggccaagtgaaggggcggaagccagccgcacttggggaggcacagccgaccaagagcctcgaagaaaacaagagccttaaagagcaaaagaagctcaacgacttgtgcttcctcaaaagattgttgcaggagatcaaaacgtgttggaataagatcctgatgggaactaaggagcat

SEQ ID NO: 14744 - DNA, 531 bp, Artificial Sequence
  Description of Artificial Sequence: Synthetic coding sequence
atgttccatgtcagctttagatacatttttgggctgcctcccctgattctcgtcctgcttcccgtggcatcgagcgattgtgacatcgagggtaaggatggaaagcagtatgaatccgtgttgatggtttcgattgaccagctcctggattcgatgaaagagatcggttcgaactgcttgaacaacgaattcaacttctttaagcgtcatatttgcgatgcaaataaggaaggtatgttcctcttcagagccgcacgaaagctgcggcaattccttaagatgaactccactggcgattttgatctccatctgctgaaggtgtcagaaggcactactattctcctgaattgtactggacaagtgaagggccgaaagccagccgcacttggagaagcccaacccactaagtctcttgaagaaaacaagagcctgaaggagcagaaaaagctcaacgacctctgttttctgaagcgcctgctccaagagattaagacttgttggaataagatactgatgggaaccaaagaacac

SEQ ID NO: 14745 - DNA, 531 bp, Artificial Sequence
  Description of Artificial Sequence: Synthetic coding sequence
atgtttcacgttagcttcaggtacatctttggactgccccctctgatcctggttctgctgccggttgcgtcctctgactgcgatattgaaggaaaagacgggaagcaatacgaatcagtgctcatggttagcatagaccaacttctcgattcgatgaaagagattggtagcaattgtttgaataacgagttcaatttctttaagagacacatttgtgatgcaaacaaggaaggcatgtttctcttcagggccgccagaaaactgcggcagttcctcaaaatgaattccaccggcgactttgatctacatctactgaaagtgagcgaaggcactactatcctgctgaactgcacaggccaggtgaagggaaggaagcccgccgcactgggcgaagcccagcctaccaaatcactggaggagaataagtcgctcaaggagcagaaaaagctaaacgacttgtgcttcctgaagcggttactgcaggagattaaaacctgctggaacaagattctcatggggacaaaggagcat

SEQ ID NO: 14746 - DNA, 531 bp, Artificial Sequence
  Description of Artificial Sequence: Synthetic coding sequence
atgtttcatgtctcgttccgctacatctttggcctcccacctctgatcctcgtgctgttgccagtggcttcctcggattgtgacattgagggcaaggacgggaaacaatacgaaagcgtccttatggtatcaatcgatcagcttctcgacagcatgaaggaaattggtagtaactgcctcaataacgaattcaatttctttaagaggcacatttgtgatgcaaacaaggaaggaatgtttctttttcgcgccgcacgaaaactgcgacagtttctcaaaatgaactcaactggggattttgacttgcacctcctcaaggtgtcagaaggaaccactatacttctgaactgcaccggacaagtgaagggtcgtaagccggccgcacttggagaagctcagccaacgaaatcccttgaagagaataagtcgcttaaagagcaaaagaaactgaatgatctgtgttttcttaagcggctgctccaagagataaagacttgctggaacaaaatcctcatgggaaccaaggagcat

SEQ ID NO: 14747 - DNA, 531 bp, Artificial Sequence
  Description of Artificial Sequence: Synthetic coding sequence
atgtttcatgtatcgtttcgatatatatttggtctaccgccgctaatactagttttactaccggttgcgtcgtcggattgtgatatagaaggtaaagatggtaaacaatatgaatcggtattaatggtatcgatagatcaactactagattcgatgaaagaaataggttcgaattgtttaaataatgaatttaatttttttaaacgtcatatatgtgatgcgaataaagaaggtatgtttttatttcgagcggcgcgtaaattacgacaatttctaaaaatgaattcgacgggtgattttgatctacatctactaaaagtatcggaaggtacgacgatattattaaattgtacgggtcaagttaaaggtcgaaaaccggcggcgttaggtgaagcgcaaccgacgaaatcgctagaagaaaataaatcgttaaaagaacaaaaaaaactaaatgatttatgttttttaaaacgtctactacaagaaataaaaacgtgttggaataaaatactaatgggtacgaaagaacat

SEQ ID NO: 14748 - DNA, 531 bp, Artificial Sequence
  Description of Artificial Sequence: Synthetic coding sequence
atgtttcatgtgtcatttagatatatcttcggtctcccaccgctgattctggtgttgctgcctgttgcctccagtgattgtgacatcgagggtaaggacgggaagcagtacgagtcagtgttgatggtttcaatcgaccagttgctggatagcatgaaggagattgggagtaattgtctgaacaatgagtttaattttttcaaaagacatatatgcgacgccaataaggagggcatgttcctgtttcgagctgcaagaaaactgagacaattcctgaagatgaattctacaggcgactttgacctgcatttgctgaaagtgtccgaggggaccacaatactgctcaactgtaccgggcaggtgaaggggaggaagcccgccgcactgggagaagctcagccaaccaaatccctcgaagagaataagagcctcaaggagcagaaaaaattgaacgatttgtgtttcctgaaaagactgctccaggaaattaagacttgttggaataagatcctgatgggcactaaagagcat

SEQ ID NO: 14749 - DNA, 531 bp, Artificial Sequence
  Description of Artificial Sequence: Synthetic coding sequence
atgtttcatgttagtttccggtatatttttggccttcctccccttatcttagttcttctgccggtggcgtcaagtgactgtgatattgaaggaaaagatggcaaacaatacgagtcagttctgatggtttcgattgatcaactgttagactccatgaaagagattggcagtaattgcctgaataacgaattcaactttttcaaaaggcatatttgtgatgcaaataaagaggggatgtttttgtttagagcggcaagaaagcttcgacaatttttgaaaatgaactcaacaggcgactttgatcttcaccttctgaaggtctccgaaggaacaacaattttattaaactgtacaggccaggttaagggaaggaaaccagccgcactgggagaagcacagccgactaagagcctggaagaaaacaagtcactcaaggaacaaaaaaaattgaatgacttatgttttcttaaacgcctgctgcaagaaatcaaaacatgttggaataagattctcatggggacaaaggaacac

SEQ ID NO: 14750 - DNA, 531 bp, Artificial Sequence
  Description of Artificial Sequence: Synthetic coding sequence
atgttccacgtatcctttaggtacatctttggactgccaccgctgatcttagtcctgctgcccgtggctagcagcgactgtgatattgagggtaaggatggcaaacagtatgaaagcgtgctgatggtgtccatcgaccagctgctcgacagcatgaaggagattgggagtaattgtctgaacaacgagtttaacttcttcaagcggcatatctgcgacgccaacaaggagggaatgttcctttttcgggccgccagaaaactgcgacagttcctgaaaatgaatagtaccggagactttgacttacacctcctgaaggtctcagagggaacaacaattctgttgaactgcactgggcaggttaaaggacgcaagccagccgcattgggggaggcccagccgaccaagagcttggaggaaaacaaaagcctgaaggagcagaagaagcttaacgacctgtgtttcctcaaacggctactccaagagatcaaaacttgttggaacaagattctcatggggactaaagaacac

SEQ ID NO: 14751 - DNA, 531 bp, Artificial Sequence
  Description of Artificial Sequence: Synthetic coding sequence
atgtttcatgtcagctttcgctacatttttggcctcccaccgctgattttggtgcttcttcctgtggcctcgagcgattgtgacattgaaggtaaggatggcaagcaatatgagtccgtccttatggtgtccattgatcagctgttggattcgatgaaggaaattggcagcaattgtctgaataacgaattcaactttttcaagcggcatatttgcgatgcgaataaggaaggtatgtttctttttcgcgcagcacgaaaactgagacaattcttgaaaatgaactccaccggggactttgacctgcaccttcttaaagtctccgaaggtaccaccattcttcttaactgtaccggacaggtgaagggccgtaaacctgccgctcttggggaagcacagccaaccaagagcctcgaggagaacaagtcgctgaaagaacagaagaagctcaatgatctgtgtttccttaagagactgcttcaggagataaagacttgttggaacaagattcttatgggtaccaaagagcac

SEQ ID NO: 14752 - DNA, 531 bp, Artificial Sequence
  Description of Artificial Sequence: Synthetic coding sequence
atgttccacgtgtccttccgctacatcttcgggttgccgccgctgattttggtgctccttccagtggcctcctctgactgcgacattgaaggaaaggatggaaagcagtacgagtcggtcttgatggtatccatagaccaactgctcgatagcatgaaggaaatcgggagcaactgtttgaataacgaattcaacttcttcaaacggcacatttgcgacgcgaacaaggaaggtatgttcctgtttagagcggccaggaaactcagacagttcctcaagatgaactcgactggtgacttcgacctgcacctcctcaaggtttctgagggtactaccatcctccttaactgtaccgggcaggtgaaaggacgcaagcctgcagcactgggcgaagctcaaccaaccaagtcgctcgaggagaacaagtcacttaaagagcagaaaaagctgaatgatctgtgctttctcaaacgactgctgcaagaaatcaagacctgctggaataagatcctgatgggcacgaaggagcat

SEQ ID NO: 14753 - DNA, 531 bp, Artificial Sequence
  Description of Artificial Sequence: Synthetic coding sequence
atgttccatgtctcgttccgctacatcttcgggctcccgccgctcatcctggtcctgttgccagtcgcgtcctccgattgcgacatcgaagggaaagatgggaagcagtacgaatcagtgctgatggtgtcaatcgaccagctgctggattcgatgaaggaaatcggctcgaactgtctgaacaacgagtttaacttctttaaacggcatatctgcgacgccaacaaggagggaatgtttttgttccgggcggcacgcaagctgagacaattcctgaagatgaactcgactggtgacttcgacctgcatctcctgaaagtctccgaagggactaccatcctgcttaactgcacggggcaggtcaagggccgcaaaccggccgctctgggagaggcccaaccgactaagtcccttgaggagaataagtctctgaaggagcaaaagaagttgaatgatttgtgcttcctcaaacgcctgttgcaggaaatcaagacttgctggaataagatcctgatgggaaccaaggaacac

SEQ ID NO: 14754 - DNA, 531 bp, Artificial Sequence
  Description of Artificial Sequence: Synthetic coding sequence
atgttccatgtaagcttcagatacattttcgggctgccaccgctgattctggtcctgcttccagtggccagctccgattgcgatattgagggcaaagacggcaagcagtatgagtccgtgctaatggtcagcatcgatcaactgctggattcgatgaaagagatcggcagcaattgcctgaacaatgaattcaacttctttaaaaggcatatatgtgatgccaataaggagggaatgtttctgtttcgagcagcacgaaagctaaggcagtttctaaagatgaatagcacaggtgactttgacctgcaccttttaaaggtgagcgaaggcaccactatcctgttaaactgtactgggcaagtcaagggccgcaagcctgccgcgctgggagaggcacagcctactaagtccctggaggaaaataaatccctgaaggagcagaagaaactcaacgatctatgttttcttaagaggttgctccaagaaattaaaacctgttggaacaaaatacttatgggtactaaggagcac

SEQ ID NO: 14755 - DNA, 531 bp, Artificial Sequence
  Description of Artificial Sequence: Synthetic coding sequence
atgtttcacgtgagcttccgttacatttttgggctcccccctctaattttggtcctgctcccagtcgcctccagtgattgcgatatagaggggaaggacgggaaacagtacgagagcgttttgatggtgagcatagaccagctgctagacagtatgaaggaaattggtagtaactgtctgaacaatgaatttaacttctttaagagacatatctgcgatgctaacaaggaaggaatgttcctgttccgggccgcgaggaaactccgtcagttcttgaagatgaattctacaggcgattttgatctgcacctactaaaagtgagcgagggtactacaatcttgctaaactgtaccggccaggtcaaaggacgaaaacccgccgccctgggggaggcacagccaactaaatctctggaggagaacaagtcactaaaagaacagaagaagcttaatgatctctgtttcctaaaacgcttgctccaagagatcaaaacctgctggaataagattctgatgggcaccaaagaacat

SEQ ID NO: 14756 - DNA, 531 bp, Artificial Sequence
  Description of Artificial Sequence: Synthetic coding sequence
atgtttcacgtttcgtttagatacatttttggattgcctccacttattctcgtccttttgccggtggccagctcggactgcgacatcgagggtaaagatggcaagcagtacgagtcagtgcttatggtgtcaatagatcaactgctggatagtatgaaggaaattggatcgaactgccttaacaacgagtttaacttcttcaaaagacacatttgtgatgcaaacaaggaaggaatgtttctctttcgcgcagcccggaaacttcggcagttcctgaagatgaattcaaccggggattttgatctgcatctccttaaggtgtccgaaggaacgactattcttctgaactgcaccggtcaagtgaagggtcgcaaacctgctgccctgggcgaggcccaaccaaccaagtcgctcgaagagaacaagtcgctgaaagaacaaaagaagctgaacgatctctgttttctcaaaagactccttcaggagattaagacctgttggaacaaaattctcatgggtaccaaagagcat

SEQ ID NO: 14757 - DNA, 531 bp, Artificial Sequence
  Description of Artificial Sequence: Synthetic coding sequence
atgttccacgttagtttcagatacatctttggacttcctccactaatcctcgtcttgttgcctgtggcaagttccgattgtgatatagaaggaaaggacggaaaacagtatgagtcagttcttatggtttctattgatcaacttttggactcaatgaaagaaataggaagtaattgcctaaacaatgagtttaattttttcaagagacatatatgcgatgctaataaagaaggaatgttcttgttcagggctgcacgtaaattaagacaattcctcaagatgaacagcaccggggactttgatttgcacctcttgaaggttagcgaaggtaccacgattcttctcaattgcaccgggcaggtgaagggtaggaaacctgccgctctgggagaagctcagccaactaaatcccttgaggagaacaagagcttgaaggaacaaaagaaattgaatgacctttgctttttgaagcggcttttgcaagaaatcaaaacatgttggaataaaatacttatgggtactaaggagcac

SEQ ID NO: 14758 - DNA, 531 bp, Artificial Sequence
  Description of Artificial Sequence: Synthetic coding sequence
atgtttcacgttagtttcagatatatatttgggctacctcctctgatcctggtcctgctgcccgtcgcaagctccgattgcgatatagaaggtaaggacgggaaacagtacgagtctgtactgatggtcagcattgatcagctgctggattccatgaaggaaatcggaagtaactgtctcaacaacgaattcaactttttcaagcggcacatttgtgacgccaataaggaaggcatgtttctgttcagggccgctcgaaaactccgacagtttctgaagatgaactctaccggagatttcgacctccacctcctcaaagtgagtgagggcactaccatactccttaactgcactggccaggtgaaggggaggaaacctgccgctctgggagaggcccaaccaactaagagcctggaggaaaacaagtccctgaaagaacagaaaaaactgaacgacctgtgtttcctgaagcgcctgctgcaggagattaagacttgttggaataaaattctaatgggaacaaaggaacac

SEQ ID NO: 14759 - DNA, 531 bp, Artificial Sequence
  Description of Artificial Sequence: Synthetic coding sequence
atgttccacgtgagttttagatacatctttggcctcccacccctgattctggtgttgctgcctgtggcatcatctgactgcgatatcgaaggcaaagacggaaaacagtatgaaagtgtcctgatggtgagcattgaccaattgctcgatagtatgaaagaaataggtagcaactgcctcaataatgaatttaatttttttaagaggcatatttgtgatgctaataaggagggcatgttccttttccgggctgccaggaagctgcggcaattcttgaagatgaatagcactggcgattttgaccttcacctgctcaaagtgagcgagggcaccactatcctgctcaactgcacagggcaggtgaagggtcgcaaaccagcagccttaggggaagcccaacctacaaagagcctcgaagagaataaatcccttaaggaacaaaaaaagcttaacgatctgtgttttctcaagaggcttttgcaggaaattaagacatgttggaacaaaatactgatgggaactaaagaacat

SEQ ID NO: 14760 - DNA, 531 bp, Artificial Sequence
  Description of Artificial Sequence: Synthetic coding sequence
atgttccacgtgtccttccggtatattttcgggctgccccctttgatccttgtgttgctcccagtggcttccagtgactgcgacatcgagggtaaggacgggaagcagtatgagagcgtgcttatggtctctatcgatcagctgcttgactccatgaaagaaatcggttccaactgtcttaacaacgaatttaactttttcaagcgccatatttgtgatgcgaataaggagggcatgttcctgttccgcgcagcgagaaaactgcgtcagttcctgaagatgaactccacaggagacttcgacctgcacctgctcaaggtctctgaggggacgaccatcttgttgaattgcaccggtcaggtcaagggacgcaagcccgcggccctcggagaggcccagcccaccaagagcctggaagaaaataaatctttgaaggagcagaagaagttgaatgatttgtgctttctcaagcgcttgcttcaggagatcaagacctgttggaacaaaatcctgatgggcaccaaggaacat

SEQ ID NO: 14761 - DNA, 531 bp, Artificial Sequence
  Description of Artificial Sequence: Synthetic coding sequence
atgttccatgtctcgttccgctacatcttcggcctgccaccgctgatcctcgtgctcctgccggtggcttcttcggattgcgatatagaagggaaagacgggaaacagtacgagtcagtcctcatggtaagcatcgaccaattgttggactctatgaaagaaattggatccaactgtcttaacaacgaattcaactttttcaaaagacacatctgcgatgctaataaggagggtatgtttctgttccgggctgcgaggaagttgaggcagtttctgaaaatgaatagcaccggcgatttcgatctccatcttctcaaggtttcggagggcactaccatcctgctcaactgcactggacaagtgaagggccggaagcccgcagccttgggggaggcccagccaactaagtccctggaagagaataagtcactcaaggaacagaagaagctgaacgacttgtgcttcctgaagagactgctccaagagatcaagacctgttggaacaagatcctgatgggaacgaaagagcac

SEQ ID NO: 14762 - DNA, 531 bp, Artificial Sequence
  Description of Artificial Sequence: Synthetic coding sequence
atgttccacgtcagcttccgttacatattcggcctgccccctttgatcctcgtcttgcttccggtggcatcgtcagattgtgacatcgaaggaaaggatgggaagcagtacgagagcgtgctgatggtttctatagatcagttgctcgacagcatgaaggaaattggcagcaactgtctgaacaatgaattcaacttctttaaacgccacatctgtgatgctaacaaggaaggcatgtttttatttcgggccgcaaggaagttgaggcagttcctgaaaatgaacagcacgggggacttcgatttgcatctgttgaaagtcagtgagggcaccaccatcctgctaaactgtacagggcaggtaaaggggcgcaagcctgcagccttaggtgaggcccaaccaaccaaatccctcgaggaaaacaaatccttaaaagagcaaaagaagctcaatgatttgtgctttttaaagcggctgctccaagagatcaagacctgctggaacaagatactcatggggaccaaggagcac

SEQ ID NO: 14763 - DNA, 531 bp, Artificial Sequence
  Description of Artificial Sequence: Synthetic coding sequence
atgttccacgtctcatttagatacatattcgggctgccccccctcatcttggtgctcctgcctgtagcttcttccgactgcgatattgaggggaaggatggcaagcagtacgaatcagtgctcatggtgtccatcgaccagttgctggatagtatgaaagaaattggttctaattgcctcaataacgaattcaacttctttaagagacatatttgtgacgccaacaaagaggggatgttcttatttcgcgctgcacgcaaactgcgacagttcctcaagatgaatagcacaggcgactttgatcttcacctcttaaaggtctcggaaggaacaaccatcctgttgaattgcaccggccaggtgaaggggagaaaacctgctgccctcggcgaggctcagcctacaaagtctcttgaagaaaataaatctctcaaggaacaaaagaagctgaacgatctttgcttcctgaaacgccttctgcaggagatcaaaacatgctggaacaaaatcctgatggggacaaaagagcac

SEQ ID NO: 14764 - DNA, 531 bp, Artificial Sequence
  Description of Artificial Sequence: Synthetic coding sequence
atgtttcatgtttcattccgatatattttcggtcttcctcctttaattttagttcttttgcctgtagcatcatctgattgtgatattgagggtaaagatggtaagcaatatgaaagtgttttaatggtaagtatcgatcaattacttgattcaatgaaagaaattggttctaattgtcttaataatgaatttaatttttttaagagacatatctgtgacgctaataaagaaggtatgtttttatttcgagcagcaagaaaacttagacaattcttaaaaatgaattcaacgggagatttcgatttgcatttattaaaagtttcagaaggaacaacaatacttttaaattgtacaggacaagttaaaggaagaaaaccagcagctcttggagaagcacaacctacaaagagtcttgaagaaaataaatcacttaaagagcaaaaaaagcttaatgatttgtgttttcttaaaagactattacaagaaattaagacatgttggaataaaattcttatgggtactaaggagcat

SEQ ID NO: 14765 - DNA, 531 bp, Artificial Sequence
  Description of Artificial Sequence: Synthetic coding sequence
atgtttcatgttagtttccgctacatttttggcctgccgcccctgatcctagttctccttccagttgctagtagcgattgtgacatcgaaggaaaagatggcaaacaatacgagagtgttcttatggtatcaattgaccaacttctggattcaatgaaggagatcgggtcgaattgcctgaacaacgaattcaacttcttcaagcgacatatctgcgatgctaataaagaaggcatgttcttgtttcgtgctgcccgaaagctacgtcaattcttgaagatgaattccaccggcgatttcgatcttcatttgctcaaggtcagcgaagggaccaccattctactaaactgtacaggtcaggtcaaaggtcgaaagcccgctgcattgggcgaggcccagcctacaaagtctctcgaagaaaacaaaagtctaaaagagcaaaaaaagttgaacgatctctgtttcttgaagcgactgctccaagaaattaaaacttgctggaacaagatcctgatgggaacgaaggaacat

SEQ ID NO: 14766 - DNA, 531 bp, Artificial Sequence
  Description of Artificial Sequence: Synthetic coding sequence
atgtttcacgtgagctttagatacatttttggactccccccacttatccttgtccttctgccagtggcctcgtcggactgtgatattgaaggaaaagatggcaagcagtacgaatcagtgcttatggtcagcattgatcagctgctggattcgatgaaggaaattggctccaattgtctgaataacgagtttaacttctttaaacggcatatctgcgatgccaataaggagggaatgtttctgtttcgcgcagcacggaagctccgccagttcctgaagatgaattcgactggtgattttgacctgcatctgttgaaggtgtccgagggaacgacgatccttctcaactgtactgggcaagttaaaggtcgcaaaccagcagccctgggcgaagcgcaacctactaagtcacttgaagagaacaaatcactgaaagaacagaaaaagttgaacgacctgtgttttctgaaacgacttcttcaggagattaagacttgttggaacaagatcttgatgggaaccaaggagcac

SEQ ID NO: 14767 - DNA, 531 bp, Artificial Sequence
  Description of Artificial Sequence: Synthetic coding sequence
atgtttcatgtgtcgtttcggtacattttcggactgccaccactcattctggtgctgcttcctgtggcatcgtcagactgtgacatagaagggaaggatggaaagcaatacgaatccgtgctgatggtgtcaattgatcaactgctggacagcatgaaggagatcggatccaactgtcttaacaatgagtttaactttttcaagagacatatatgtgatgctaacaaggaagggatgttcctctttagggctgcgcgtaaactgagacaatttctcaaaatgaactcaactggggactttgatcttcatcttctcaaggtgtcggaaggcaccacgattcttctgaactgcaccggacaggtgaaaggacggaaacctgcagcactgggagaagcacaaccaactaagtcacttgaagagaacaagtccctgaaagaacagaagaaacttaatgacctttgttttctgaagcgactcttgcaggaaatcaagacctgttggaacaagatccttatgggaaccaaggaacac

SEQ ID NO: 14768 - DNA, 531 bp, Artificial Sequence
  Description of Artificial Sequence: Synthetic coding sequence
atgtttcatgtctccttccggtacattttcgggctgccgccactcatcctcgttcttctgccagtggcatcttccgattgcgacatcgaaggaaaggacgggaagcagtacgaatcagtccttatggtgagcattgaccagctcctggattcgatgaaggagattggttccaactgcctgaataacgaattcaacttctttaagaggcatatttgtgatgcaaataaggagggaatgtttcttttcagagccgcgcggaaactgagacagtttctgaagatgaactccacgggagactttgacctgcatttgctgaaagtgagcgaaggaaccaccatcctccttaattgtactggacaagtgaaagggcggaagcctgccgcattgggggaggctcaaccaactaagagccttgaggaaaacaagtcgctgaaagaacaaaagaagctcaacgatctttgtttcttgaagagacttctgcaagagattaagacttgttggaacaagatacttatgggtaccaaggaacat

SEQ ID NO: 14769 - DNA, 531 bp, Artificial Sequence
  Description of Artificial Sequence: Synthetic coding sequence
atgttccacgtgagtttccgctacatctttggcctgccaccactgattctggtcttactgccagtggccagttcggactgcgatatagaaggtaaggacgggaagcagtacgaatctgtgctgatggtgtcaattgaccaattgctcgattctatgaaagagatcgggagtaactgcctgaataatgagttcaactttttcaagcgacacatttgcgacgctaacaaggaaggaatgtttctgttccgggccgcccggaagttaagacagtttttgaaaatgaactctactggagatttcgatctccatctattgaaggtgagtgagggcacaacaatcctcctaaactgcaccgggcaagtcaagggccggaagccggctgccttgggagaggcgcagcccaccaagtcgttagaagagaacaaaagcctaaaggagcaaaagaaacttaacgacctctgctttctaaagcgcttactgcaagaaattaagacttgctggaataagattctgatgggaacaaaggagcac

SEQ ID NO: 14770 - DNA, 531 bp, Artificial Sequence
  Description of Artificial Sequence: Synthetic coding sequence
atgttccatgtgagctttaggtacattttcggcctgccccccctcatactcgtgcttctgcccgtcgctagttctgattgtgacatcgagggtaaagacgggaaacagtatgaatccgtgttgatggtatcaatcgaccagctgcttgactcaatgaaggagatcggttcaaattgtctgaataatgagttcaacttcttcaaacgacatatttgcgacgcaaataaggaagggatgttcctgtttagagccgcaaggaagttgaggcagttcttgaaaatgaacagtacgggcgatttcgatctgcacttgctgaaagtctctgaaggcacaacgattctcctcaactgcaccgggcaggtgaagggccgcaaacccgcagccctcggcgaggcgcaaccgactaaatcacttgaagagaataaatctttgaaggaacaaaagaaactcaacgacctctgttttctgaagaggttgctgcaggagataaaaacttgttggaataagattctcatgggcacaaaagaacat

SEQ ID NO: 14771 - DNA, 531 bp, Artificial Sequence
  Description of Artificial Sequence: Synthetic coding sequence
atgttccatgtctcgttccgttacattttcggcctgccaccgctcattctggtgctcttgccagtggcctcgagcgattgtgacatcgaaggcaaggatgggaagcagtacgaaagcgtgctgatggtgtcgatcgaccagttgctggattcgatgaaggaaatcggatctaattgcctcaacaacgagttcaatttcttcaaacggcatatctgcgatgccaataaggaaggaatgttcctcttcagagccgcgagaaagctgcggcaatttctcaagatgaattcgaccggagacttcgacctgcacctgcttaaagtgtcggagggtaccaccatcttgcttaactgcaccggacaggtgaagggacgcaaaccagctgcgctgggcgaagcgcagccgaccaagtcacttgaggaaaacaagtccctcaaggaacagaaaaaactgaacgacctgtgcttcctgaagcggctgctgcaggaaatcaagacgtgctggaacaagattctgatggggaccaaggagcac

SEQ ID NO: 14772 - DNA, 531 bp, Artificial Sequence
  Description of Artificial Sequence: Synthetic coding sequence
atgtttcacgttagcttccgttacatctttggcctgcccccgctcatcctggtccttttgcctgtcgcgtcctcagattgtgacatcgagggcaaggatggcaagcagtacgagagtgtgctgatggtgagcatcgaccaactgctagactctatgaaggaaataggcagtaactgtcttaataatgagttcaacttctttaaaaggcacatctgtgatgctaataaggaaggtatgttcttatttagggccgccaggaaactccggcagttcctgaagatgaactccaccggagattttgacctgcacctcttgaaagttagcgaaggcaccacaattctcctgaactgtaccgggcaggttaaggggcgcaagcccgctgccctcggagaggctcagccaaccaagtccctagaagagaacaaatcgttgaaggagcaaaagaagcttaacgacttgtgctttctcaagagactgctccaggaaattaagacctgctggaataagattttaatgggcactaaagagcac

SEQ ID NO: 14773 - DNA, 531 bp, Artificial Sequence
  Description of Artificial Sequence: Synthetic coding sequence
atgttccacgtaagtttcagatatatattcgggcttccacctctcatcttagtgctgctccctgtggcatcctctgattgcgacattgaagggaaagatgggaaacagtatgaatcagtgctgatggtttccatcgatcagctcctcgattcaatgaaagagatcggatccaattgtctgaacaacgaattcaacttcttcaaaaggcacatatgtgatgccaataaagaagggatgttcctctttcgagcggcacgcaaactgagacaattcctcaaaatgaattctactggggattttgacctgcatttactcaaggtgtctgaagggactacaatcctgctcaattgcacaggacaggttaaaggaagaaaacccgctgctctgggggaagcccagcctactaaatccctagaagagaacaaatcacttaaagagcagaaaaaactgaacgatctttgttttctgaaacggctgctgcaagaaattaaaacatgctggaataaaatcttgatgggaacaaaagaacac

SEQ ID NO: 14774 - DNA, 531 bp, Artificial Sequence
  Description of Artificial Sequence: Synthetic coding sequence
atgtttcatgtcagtttcaggtacatattcggactgcctcccctcatactggtcttgcttccggttgctagttccgactgtgacatcgagggcaaggacgggaaacagtatgagtcggtgctcatggtgtcaatcgaccagctcctcgacagcatgaaggagatcggctctaactgtctgaacaacgagtttaacttcttcaaaaggcacatctgcgacgctaataaggaaggtatgtttctcttcagggccgcccgcaaactgaggcagtttctgaagatgaactcgactggagacttcgatctgcatctgctcaaagtgtcagaaggtactacaatcttactgaactgcacaggccaggtgaagggccgcaagcccgcagcgcttggagaggctcagcccacaaagagcctagaggagaataaatccctgaaagagcagaaaaaactcaatgacttgtgcttcctcaaacgtctgctccaagaaataaaaacatgttggaacaaaatacttatggggaccaaggaacac

SEQ ID NO: 14775 - DNA, 531 bp, Artificial Sequence
  Description of Artificial Sequence: Synthetic coding sequence
atgtttcatgtgtctttcagatatatcttcggtctcccaccacttatcctggttctgctccccgtagcttccagcgattgcgatattgaaggaaaagacggtaaacaatacgagagcgtcctgatggtcagcattgatcagcttcttgatagtatgaaggagataggtagcaactgcttgaacaatgagttcaacttcttcaaaaggcatatctgtgatgccaacaaagagggtatgttcttgttccgtgctgccaggaagctgagacaattcctgaaaatgaatagtactggcgacttcgacttgcatcttctcaaggtaagcgaaggtaccacaatactgctgaattgtaccggccaggtaaaaggtcgcaaacccgccgccctgggagaagctcaacccaccaagtctttggaggagaataagtctctcaaggagcagaagaagctgaacgacctgtgctttttgaagaggttgttgcaggaaattaagacctgttggaataaaattctgatgggaactaaagagcac

SEQ ID NO: 14776 - DNA, 531 bp, Artificial Sequence
  Description of Artificial Sequence: Synthetic coding sequence
atgttccatgtctcgtttagatatatatttggattacctcctctgatcctggtgctcttacctgtggcatcaagcgactgtgatattgaaggcaaggatgggaagcagtacgaatctgtcttaatggttagtattgatcaattgttagatagtatgaaagagataggttctaattgtctcaacaacgagttcaacttcttcaagcgtcatatctgcgacgctaacaaggaaggtatgttcctattccgtgccgcgcgtaaactgaggcaattcctcaaaatgaactctactggcgattttgacctccacctcctaaaggttagtgagggcactacaattcttctgaactgtacaggccaggtgaaggggcgtaagcccgcagcgctcggagaagcccagcctactaagtctttggaggagaacaagtcattaaaggagcagaagaaactgaacgacctttgttttctgaagaggctccttcaggagattaaaacgtgctggaataagattctgatgggaacaaaggagcac

SEQ ID NO: 14777 - DNA, 531 bp, Artificial Sequence
  Description of Artificial Sequence: Synthetic coding sequence
atgttccatgtcagttttaggtacattttcggattgccacccctcatcctggtccttttaccagtggcaagctcagactgtgacatcgaaggtaaggatggcaaacaatatgagtccgtactcatggtgtctattgaccagttactggattcaatgaaagagataggtagcaactgtctgaacaacgagttcaacttcttcaaaaggcatatctgcgatgctaataaggagggcatgttcctgtttagagctgcccgcaagctcaggcaattcttaaaaatgaactctaccggcgacttcgatctgcacctgttgaaagtgtcagagggcaccactatactgctgaattgcactgggcaggtcaaagggcgcaagcccgcggctctgggcgaggctcagccaacaaagagtctcgaggaaaacaaatctcttaaagaacagaaaaagttgaatgacctgtgctttctaaaacggcttctccaggaaattaaaacatgttggaacaagatcctgatgggtacaaaggagcat

SEQ ID NO: 14778 - DNA, 531 bp, Artificial Sequence
  Description of Artificial Sequence: Synthetic coding sequence
atgttccatgtgtcctttcgctacatcttcggtctgcctccgcttatcctggtgttgctgcctgtcgcctcctcggattgcgatatcgaaggcaaggacggaaagcaatacgaatcggtgctgatggtgtccattgatcagctgttggactccatgaaggagatcgggtcgaactgcctgaacaatgagttcaacttcttcaagaggcacatttgcgacgcgaataaggagggcatgttcctgtttcgcgccgcccggaagctgcgacaattcctgaaaatgaacagcacgggagacttcgaccttcaccttctgaaggtgtcggagggaaccacgatcctgctcaactgcactggacaagtcaagggccggaagccggcggcactcggggaggcccagccgaccaaatcattggaggaaaataagtcgcttaaggagcagaagaaactgaacgacctgtgcttcctcaagaggctgctgcaagaaattaagacttgctggaacaagatcctgatgggtaccaaagagcac

SEQ ID NO: 14779 - DNA, 531 bp, Artificial Sequence
  Description of Artificial Sequence: Synthetic coding sequence
atgttccacgtttcctttcggtacatcttcgggctgccaccgctgattcttgtgctcctccctgtggcttcatcggactgcgacatcgagggaaaggacgggaagcagtacgaatcggtcctcatggtcagcatcgatcagctgctggacagcatgaaggaaatcggatccaattgcctgaacaacgagttcaacttttttaaaaggcatatctgtgatgccaataaggaaggaatgttcttgttccgcgccgcaagaaagctgcggcaattccttaagatgaactctacgggtgacttcgatctccacctgttgaaagtgtcagaaggaactaccatcctgcttaattgtaccggccaggtgaagggccgcaagccggccgcgctgggcgaggcgcaacccactaagtcgctggaggaaaacaagtccctcaaagagcagaagaagctgaacgatctgtgcttcctcaaaagactgttgcaagaaattaaaacctgctggaataagatcctcatgggaactaaagaacat

SEQ ID NO: 14780 - DNA, 531 bp, Artificial Sequence
  Description of Artificial Sequence: Synthetic coding sequence
atgtttcatgtgagcttccgttacatatttggattgccgcctcttatccttgtgctcctcccagtggcatcgtcagactgtgatatcgaaggtaaggatggtaagcaatacgaatcagttctgatggtgagcattgatcagcttctggattccatgaaagaaattggttcgaattgtcttaacaacgaattcaacttcttcaagagacacatttgcgacgcaaacaaggaaggaatgttcctgtttagagctgccaggaagttgcggcaatttctgaagatgaactccaccggagattttgatttgcatcttcttaaggtgtccgaaggtacgaccattctgctgaactgtaccggtcaggtgaaaggaagaaagccagccgcacttggagaagcacagcctaccaagtcgctggaagagaataagtcccttaaagaacagaagaaactgaacgatctgtgttttcttaaaagattgcttcaagaaatcaagacctgttggaacaagattttgatgggtaccaaggagcat

SEQ ID NO: 14781 - DNA, 531 bp, Artificial Sequence
  Description of Artificial Sequence: Synthetic coding sequence
atgttccatgtttccttcagatacattttcggtcttccccctcttattctggtcctgctgcccgtggcatctagtgactgcgatatcgaaggcaaagacggtaagcagtatgagtctgtattgatggtgtcaattgatcagctcctggattccatgaaagagataggttctaattgcctcaacaatgagtttaattttttcaaacgccatatttgtgacgcaaataaagaaggtatgttcttgttcagggccgcacggaagttgcggcaatttctgaagatgaacagtactggagactttgacttgcacttgctgaaagttagtgaaggcacaaccatcctgctgaactgcacggggcaagtgaaggggaggaaacccgctgctttgggagaggcccagcctacgaaatctttggaagagaacaagtctctcaaggagcagaagaagctgaatgacctgtgttttctcaagagattgcttcaggagatcaagacctgttggaacaagatccttatgggtacgaaggaacac

SEQ ID NO: 14782 - DNA, 531 bp, Artificial Sequence
  Description of Artificial Sequence: Synthetic coding sequence
atgtttcatgtgagtttcagatatatttttggattaccacctctgatattggtgcttctcccagtagcttctagtgattgcgatatcgaagggaaggatggaaagcagtatgaatcagtgctcatggtctccatcgatcagttactagattctatgaaagaaatcgggtctaactgtctcaataatgaatttaatttcttcaaaagacatatctgtgatgccaataaagaagggatgtttttgtttagagcagcccggaaactccggcagtttctcaaaatgaatagtactggggatttcgatttacatctcctcaaagtgtcagaaggaactacaatcctgctgaactgcacagggcaggtgaaaggaaggaagccagctgccctgggggaagcacagcccactaaatccctcgaagagaacaaaagtcttaaagaacagaaaaaattgaatgatttatgtttcctgaaacggctccttcaggagattaaaacttgctggaataaaatacttatgggaacaaaagagcac

SEQ ID NO: 14783 - DNA, 531 bp, Artificial Sequence
  Description of Artificial Sequence: Synthetic coding sequence
atgttccacgtgtcgttcagatatatttttggcctgccacccctgattctagtgttgctaccagtagcatcctcagactgtgatattgagggaaaggatggcaagcagtacgagagcgtgctgatggtgtcaatcgaccagttactggattctatgaaggaaatcggcagcaactgcctcaataatgaatttaactttttcaaacgtcacatctgcgacgcaaacaaggaaggaatgttccttttccgtgctgcacgaaaactcagacagttcctgaagatgaattccactggcgattttgatctgcacttgctgaaggtctctgagggaacaactatacttctgaattgcacgggtcaggtcaagggccggaaaccggctgcactcggggaggctcagcccactaagtccctggaagagaacaagtctctcaaggaacagaaaaaattgaatgatctttgtttcctcaaacgtctgctccaagaaatcaaaacgtgttggaacaagatactcatgggaacgaaagaacac

SEQ ID NO: 14784 - DNA, 531 bp, Artificial Sequence
  Description of Artificial Sequence: Synthetic coding sequence
atgttccacgtgagttttaggtatatttttggattaccgcctctgattctggtcttactccccgtggcttctagcgattgtgacatcgagggtaaagacgggaaacagtacgaatcggtgctgatggttagtatcgatcaacttctagactcgatgaaggaaatcggcagcaactgtctgaacaatgagtttaacttcttcaaacgccacatatgtgacgcgaacaaagaaggaatgtttcttttcagggcagcccgaaagctccgccaatttctgaaaatgaactccaccggagactttgacctgcacttactgaaggtgtccgagggaacaactatcctactgaattgcactggccaagttaaaggacgcaaaccggctgcgctcggcgaggcccagcctacaaagtctttggaagaaaacaagagcttgaaggagcaaaaaaaactcaacgatctttgcttcctgaaacggctccttcaggagatcaagacatgctggaacaaaattctcatgggcactaaggagcac

SEQ ID NO: 14785 - DNA, 531 bp, Artificial Sequence
  Description of Artificial Sequence: Synthetic coding sequence
atgtttcacgtcagcttcaggtatattttcggtttaccacccttgattctggtactgctgcctgttgcctcaagcgattgcgacatcgagggtaaagatggaaaacagtacgaaagcgtgctcatggtcagcatcgaccaattactggatagtatgaaagagatcggctctaactgcctgaacaatgagtttaactttttcaagaggcatatttgcgacgcaaacaaggaagggatgttccttttccgggccgcccgcaagttgcgacaatttctcaaaatgaactcaactggggattttgatctgcacctccttaaggtgagtgagggaactaccattcttttaaactgtacaggacaggtaaaagggcggaagccagccgcactcggggaagcccaaccgactaagagcctagaagagaataagagcctcaaagaacaaaagaagctgaacgatctgtgcttcctgaaacgcttgcttcaggagattaagacttgttggaacaagatactcatgggcacaaaggagcat

SEQ ID NO: 14786 - DNA, 531 bp, Artificial Sequence
  Description of Artificial Sequence: Synthetic coding sequence
atgtttcatgtgagcttcaggtacatattcgggttgcctccactcatcctagtgctgctccctgtggcatctagtgactgcgatatagaaggtaaggatgggaagcagtacgaatccgtcctgatggtgtccatagaccagttgctagactctatgaaggaaattggctctaattgcttgaacaatgaatttaatttcttcaagagacacatatgcgatgcgaacaaagaagggatgtttctcttcagggcagcccgcaagctgcggcaattcttgaagatgaactccacaggcgatttcgacttgcacctcctgaaggtttccgagggcacaactatattactgaactgtaccggccaggttaaggggaggaaaccggctgccctgggcgaagcccagccaactaaatctctggaagagaacaagagcttgaaagaacagaaaaagctgaatgatctgtgcttcttaaagcgtcttttgcaagagataaagacatgttggaacaagatcttaatgggcacaaaggagcac

SEQ ID NO: 14787 - DNA, 531 bp, Artificial Sequence
  Description of Artificial Sequence: Synthetic coding sequence
atgttccatgtgagcttccgctacatcttcggactcccaccactcatcttggtcctcctgccggtcgcgagctcagattgcgacatcgaaggcaaggacggaaaacagtacgagtcagtgctcatggtgtccatcgaccagctgctggactccatgaaagaaatcggatccaattgcttgaataacgagttcaacttcttcaagcgccacatctgcgacgccaacaaggaggggatgtttctgttcagggctgctagaaagctgcgccaattcctgaagatgaactcaactggagatttcgacctgcaccttctcaaagtgtctgaaggaaccactatcctgctcaactgcacgggccaggttaagggacggaaaccagccgccctgggtgaggctcagccgaccaagtcgctggaggagaacaagtcactgaaggaacagaaaaaacttaacgatctgtgtttcttgaagagacttcttcaagagatcaagacttgctggaataagatcctcatgggaaccaaagaacac

SEQ ID NO: 14788 - DNA, 531 bp, Artificial Sequence
  Description of Artificial Sequence: Synthetic coding sequence
atgttccatgtgagctttcgctacatctttggactccccccactgatcctggtcctccttccggtcgcgtcatcggactgcgatatcgagggtaaagacggaaagcagtacgagtccgtgctcatggtcagtatcgaccaactgttggactctatgaaggagatcggttccaactgcctgaacaacgagttcaatttcttcaagcggcatatctgtgacgctaacaaagaaggcatgttcctcttccgcgcagcaagaaaattgcggcaatttctgaagatgaactcgactggagacttcgacctgcatctcctcaaggtgagcgaggggacgactatcctgctcaactgcaccgggcaggtgaagggacggaaacccgctgccctcggagaagcccaaccgaccaaatccctggaagaaaacaaatcactgaaggaacagaagaagttgaatgacctctgtttccttaagagactgctgcaagaaatcaagacctgctggaacaagatcctcatgggaaccaaggaacat

SEQ ID NO: 14789 - DNA, 531 bp, Artificial Sequence
  Description of Artificial Sequence: Synthetic coding sequence
atgttccacgtgagcttcaggtacatctttggcctgcccccgctgatcctggtgcttctccctgtagcctccagcgactgcgacatcgaaggcaaggatggaaaacagtacgaatcagtgctgatggtttcgatcgaccagctgctcgacagcatgaaggagattggctccaactgtctgaacaatgagtttaactttttcaaacggcatatatgtgatgcgaacaaagagggtatgttcctgttccgggctgctagaaagctgcgacaattcctgaagatgaatagcactggcgatttcgacctgcatttgcttaaggtgtccgaaggaactacgatcctgctgaattgcaccgggcaggtgaagggcagaaaaccagccgcactcggagaagctcagccgactaagagcctggaggagaacaagtctctcaaggaacagaagaaactgaatgacttgtgcttcctgaagcgccttctgcaagaaatcaagacctgttggaacaagatcctcatgggtaccaaagaacac

SEQ ID NO: 14790 - DNA, 531 bp, Artificial Sequence
  Description of Artificial Sequence: Synthetic coding sequence
atgttccatgtgagcttccgctacattttcggactgccacctcttatcctcgtgctgctgcctgtggcctctagcgattgtgatatcgagggcaaggatggcaaacagtacgaaagcgtattgatggttagcatcgaccaacttcttgacagcatgaaggagatcgggagcaactgcttgaacaacgaatttaacttcttcaaaaggcacatttgcgatgctaacaaagaaggaatgtttctttttagagctgctagaaagctgcggcagtttctgaaaatgaactcaacaggcgacttcgaccttcacctgctgaaggtgagcgagggcaccactatcctgctgaattgcactggacaggtgaaggggagaaaacctgcagctctgggagaagcccagcccaccaagtctctcgaggagaacaagtcgctcaaggaacagaagaagctgaatgacctctgctttctgaagaggctgctgcaggaaatcaagacctgctggaataaaatccttatgggaacaaaagaacat

SEQ ID NO: 14791 - DNA, 531 bp, Artificial Sequence
  Description of Artificial Sequence: Synthetic coding sequence
atgttccatgtctcctttagatacatctttggactcccacctcttatacttgtcctgctgcccgtagccagtagcgactgtgatattgaaggtaaagacggcaagcaatacgagagcgttctgatggtctcaattgaccagctcctcgactctatgaaggagatcggaagtaactgtctcaacaatgaatttaactttttcaaaaggcacatctgcgatgccaacaaggaaggaatgtttttgttcagggctgctaggaaactgagacaattcttgaaaatgaacagtaccggagacttcgacctccacctgcttaaagtcagcgagggcacaacaatcctgctgaattgtaccggacaagttaaaggacgcaaacccgctgcgctgggcgaggcgcagcccactaagtccctggaagagaacaagtcccttaaggagcaaaagaagctcaacgacctctgttttcttaagagactcctgcaagagatcaagacatgctggaacaaaatcctcatgggcactaaggagcat

SEQ ID NO: 14792 - DNA, 531 bp, Artificial Sequence
  Description of Artificial Sequence: Synthetic coding sequence
atgtttcacgtgtcttttagatatatatttgggctcccaccacttattctagtccttctgcctgtcgccagttccgattgcgatatcgagggcaaggatggaaaacaatatgagtcagtgctaatggtgagcatcgatcagctgctggacagcatgaaggagatagggtcaaactgcctgaacaatgagtttaacttttttaaaaggcacatctgtgatgccaacaaagagggaatgtttctttttagggcggctcgtaagcttagacaatttctaaagatgaatagcacaggggatttcgatctgcaccttctgaaggtgtccgaaggtacgacaatactgctgaactgtactggacaggtgaagggccgcaagccagctgctctgggagaggcccagcccaccaagagtctcgaggaaaataaaagtttaaaagagcagaaaaaactgaatgatttgtgcttcttaaagcgcctccttcaagaaatcaaaacctgttggaacaaaattttgatggggaccaaggagcac

SEQ ID NO: 14793 - DNA, 531 bp, Artificial Sequence
  Description of Artificial Sequence: Synthetic coding sequence
atgtttcacgtctcctttaggtacatcttcgggttgcccccattgatccttgtgcttttaccggttgcaagctcggactgcgacatagagggtaaggacggaaaacagtacgaatctgtactaatggtgagtatagatcaattgttagacagtatgaaagaaatcgggagtaattgcctcaacaacgaattcaactttttcaaacgacatatctgcgacgccaataaggagggaatgtttctgtttagggcagcacgcaaattaagacagtttctaaagatgaattccacgggtgatttcgatctccacctgctgaaggtatcagaagggacaaccatcctcctcaattgtaccgggcaggttaaagggcgtaagcccgccgcccttggggaggcacagccaacaaagtcattggaggagaacaaaagtttgaaggaacagaaaaaactcaacgatctatgctttctgaaacgactgctacaggagataaaaacctgttggaacaagatccttatgggcactaaggaacat

SEQ ID NO: 14794 - DNA, 531 bp, Artificial Sequence
  Description of Artificial Sequence: Synthetic coding sequence
atgttccacgtctcctttaggtatatctttggactgccgccactaattctggttctgttgccagttgcaagttccgactgcgacattgaggggaaggatggcaaacagtacgaaagcgttttgatggtgtcgatcgatcaattgctcgattccatgaaggagatcgggagcaattgccttaataatgagtttaacttcttcaagaggcacatctgtgatgccaataaagagggcatgttcctgttcagagccgctcgtaaattgcggcagttcctcaagatgaactctactggggacttcgacttacaccttctgaaggtgagcgagggaacgaccatcttgctgaattgtacaggccaggtaaaaggtcgtaaacctgcagccttgggtgaggcacaacctactaaatccctggaggagaataagagcctgaaggaacagaagaagcttaacgatttatgtttcctgaagcggctactacaggagattaagacatgctggaacaaaatcctaatgggaactaaggagcac

SEQ ID NO: 14795 - DNA, 531 bp, Artificial Sequence
  Description of Artificial Sequence: Synthetic coding sequence
atgttccacgtttcctttcggtacatcttcggcctgccccctctcatcctagtacttctcccagttgcctccagcgactgcgacatcgagggaaaagatggcaaacagtatgaatctgtgctcatggtgtccatcgaccagctgctagattccatgaaggaaatcggcagtaactgtctcaacaacgaattcaacttttttaagcggcatatttgcgacgccaataaagaagggatgtttttatttagggcggcaagaaaactgcgacagtttcttaagatgaatagcactggcgatttcgacttgcacttgttgaaggtgagcgaagggacgacaatcctcctaaattgcaccggtcaggtcaagggtcgtaaacccgcggcacttggcgaggcccagccaacaaagtccctggaggagaataagagcttaaaggagcagaaaaaactgaatgatctttgtttccttaagcggctgctgcaggagattaaaacttgttggaacaagatcctcatgggcaccaaagagcac

SEQ ID NO: 14796 - DNA, 531 bp, Artificial Sequence
  Description of Artificial Sequence: Synthetic coding sequence
atgttccacgtgtcattccgttacatatttggacttcctcctctcattctcgtccttctcccagtggcatccagcgattgtgacattgagggaaaggacggaaaacaatacgaaagcgtgctgatggtgtcgattgatcagctgctggattccatgaaggagattggatcgaactgtttgaataatgagttcaatttctttaagcgtcatatatgtgatgcaaacaaagaaggtatgtttctgtttagagcagctagaaagttgcgacagttcctgaagatgaacagcaccggtgacttcgacctccatcttttgaaagtgtccgaaggaactactatcctgctgaactgtacgggtcaagtgaaaggacgtaagcctgccgcgctcggggaggcacaacctaccaagtcgcttgaggagaacaagtcactgaaggagcagaagaagctgaacgatctgtgttttctcaagaggcttctgcaagaaatcaaaacctgctggaacaaaatccttatgggaactaaagaacat

SEQ ID NO: 14797 - DNA, 531 bp, Artificial Sequence
  Description of Artificial Sequence: Synthetic coding sequence
atgtttcatgtgtccttcaggtacatttttgggcttcctccgctcattttggtgctgcttcccgtcgcatcgtccgattgtgacatagaaggaaaagatggcaagcaatacgaatctgtgctgatggtttcaattgatcagcttctggactccatgaaggagataggttccaattgtctgaacaacgagtttaacttcttcaagagacacatttgtgacgctaacaaagaagggatgtttctttttagggcagcaaggaaacttcgccagtttcttaagatgaattcgactggcgattttgatcttcacctgctgaaggtgtccgagggaaccactattctgctgaactgtaccggtcaagtgaaaggcagaaagccagctgcccttggagaagcacaacccaccaagtcccttgaggagaacaagagcctcaaggaacaaaagaagctgaacgacctctgttttctgaagcgtttgctccaagaaatcaagacttgttggaacaaaattctgatgggcactaaagaacac

SEQ ID NO: 14798 - DNA, 531 bp, Artificial Sequence
  Description of Artificial Sequence: Synthetic coding sequence
atgttccatgtgtcgtttaggtacatctttgggctcccaccgctcattctcgtcctgcttccagtggcgtcctcagattgcgacattgaagggaaagacggcaagcagtacgaatcggttctcatggtcagtatcgatcaactgctggatagcatgaaggagatcgggtcaaactgcctgaataatgaattcaatttctttaagcgacacatctgtgatgcgaacaaagaggggatgttcttgttccgcgccgcacggaaactgaggcaattcttgaagatgaactcgactggagactttgatctgcacctcctgaaggtcagcgaaggaaccaccatcctgctgaattgtaccggtcaagtgaagggaaggaagccggcagcactgggagaagctcagcctaccaagtctctggaagagaataagagcttgaaggagcagaagaaactcaatgatctctgcttcctcaagcgccttctccaggagatcaaaacgtgctggaacaagatcctgatgggtaccaaggaacat

SEQ ID NO: 14799 - DNA, 531 bp, Artificial Sequence; identical to SEQ ID NO: 14793
  Description of Artificial Sequence: Synthetic coding sequence

SEQ ID NO: 14800 - DNA, 531 bp, Artificial Sequence
  Description of Artificial Sequence: Synthetic coding sequence
atgttccatgtcagctttaggtacatttttgggctcccacctctgattttagttctgttaccagttgccagcagcgactgcgatatcgaaggcaaggatggaaagcaatatgaatcagtgctgatggtgtcaattgaccagttgttggatagcatgaaagaaatcggcagcaattgtctgaacaacgaatttaacttctttaaacgacacatctgtgatgctaacaaagaaggcatgttcctgtttagggccgcacgcaagctccggcaattcctgaagatgaactcaacgggagacttcgatttacacttgttgaaagtctcagaaggcacaactatccttctgaattgcacagggcaagtgaaaggtagaaaaccagccgcactgggagaggctcagccaaccaagtccctggaagaaaacaaatcactgaaggagcagaaaaaattgaacgacttatgctttctcaagcgcctgcttcaagagataaagacctgttggaacaaaattctgatggggacaaaggaacat

SEQ ID NO: 14801 - DNA, 531 bp, Artificial Sequence
  Description of Artificial Sequence: Synthetic coding sequence
atgttccacgtgagcttccggtacatctttggactgccgccactgattctggtcctgctccctgtggcaagctcagactgtgacatcgaggggaaggatgggaaacagtacgaatcggtgctcatggtcagcatagatcagttgctggactccatgaaagaaattggatcaaattgcctgaacaacgagtttaacttcttcaaacgccacatttgcgacgccaataaggaaggcatgttcttgttcagagccgcaaggaagctcagacagttccttaagatgaatagcactggggactttgatctccaccttctgaaagtgtcggaaggaacgaccatcttgcttaattgtactggccaggtgaagggacggaagccggcggccctcggagaagctcaacccaccaagtccctcgaagagaataagagcctcaaagagcaaaagaagttgaacgacctgtgcttccttaagcggctgctgcaggaaatcaagacctgctggaataagatcctcatgggaactaaagagcac

SEQ ID NO: 14802 - DNA, 531 bp, Artificial Sequence
  Description of Artificial Sequence: Synthetic coding sequence
atgtttcatgtctcattccgatatatcttcggattacctcccttgattctggttctgctgcctgtggctagctctgattgtgacatcgagggcaaggatggcaagcaatacgaatccgtactcatggtctctatcgatcaactgctcgactctatgaaggagataggcagcaactgcctgaataacgagttcaacttttttaagcggcacatttgcgacgcaaataaagaaggtatgttcctcttcagagcagcacggaaactgcggcagtttctgaaaatgaatagcacaggcgacttcgacttgcatttgctgaaggtcagcgagggaaccaccattctcttgaattgcaccggccaagttaagggccgtaaacccgccgccctgggagaggcccaaccaaccaagtccctagaggagaacaagtcgctcaaggagcagaaaaagctaaatgacctatgcttcctcaaaaggctgcttcaggagataaagacatgctggaataagatcctgatgggcacgaaggaacac

SEQ ID NO: 14803 - DNA, 531 bp, Artificial Sequence
  Description of Artificial Sequence: Synthetic coding sequence
atgtttcacgtatcattcagatatatattcggtctccccccactgatcctagtgctgctacccgtagcaagctccgactgtgatatagagggcaaggacggaaagcaatatgaaagtgtcctcatggtgagcatcgaccagctgttggactccatgaaggagattggtagcaattgtctcaataatgagtttaatttttttaagaggcatatatgcgacgcgaacaaggaaggaatgttccttttcagggctgcaaggaaactgcggcagtttctgaagatgaattccacaggtgacttcgatctccatttactgaaagtttccgaggggaccaccattctgctgaattgcaccgggcaggtgaagggccgcaaaccagcagctctgggcgaagcccagccaactaagtcgttggaagaaaacaaatcattaaaagaacagaagaagctgaacgacttatgttttctcaaaagactgctccaagagatcaagacatgctggaacaaaatcttgatgggaaccaaagagcat

SEQ ID NO: 14804 - DNA, 531 bp, Artificial Sequence
  Description of Artificial Sequence: Synthetic coding sequence
atgtttcacgtctcgttccgttacatctttggacttccgccattgatccttgtgctcctcccggtcgcttcgagcgactgtgacattgaaggcaaggacggaaagcagtacgaatcagtgctgatggtgtcgattgatcaactgctggactcgatgaaagaaatagggtccaattgccttaacaacgaattcaatttcttcaagcggcacatctgtgatgccaataaagagggaatgttcctcttccgcgcagcacggaaattgcggcagtttctgaagatgaacagcaccggagacttcgaccttcatctccttaaggtgagcgagggtactactattctcctcaattgcaccggacaggtgaaaggaagaaagccagccgctctgggtgaagcccagccgaccaaatccctcgaggaaaacaagagcctgaaggaacagaagaaactgaatgacttgtgtttcctgaagcggcttctccaagagatcaagacttgctggaacaaaatcctgatgggaaccaaggaacac

SEQ ID NO: 14805 - DNA, 531 bp, Artificial Sequence
  Description of Artificial Sequence: Synthetic coding sequence
atgtttcacgtgtcctttagatacatcttcggactgccacctctcatcctggtgctcctgccggtggcctcgtcggactgcgacatcgagggcaaggatggaaaacaatacgaatccgtcctgatggtgagcatcgaccagctcctggattcgatgaaggagatcggtagcaattgtctgaacaatgagttcaatttcttcaagagacatatctgtgacgccaataaggagggtatgttcctcttccgagcagctcggaagttgcgccagttcctgaagatgaactcgaccggcgacttcgacttgcaccttctgaaagtctcagagggaaccaccattctgctgaactgcaccggacaagtgaagggtcgaaaaccagccgccctgggcgaggcacaacctactaagtccctcgaagaaaacaagagcctgaaggagcaaaagaagttgaatgacctgtgctttctgaagcgcctgctgcaggagatcaaaacctgctggaacaagatcctcatgggaacgaaagagcac

SEQ ID NO: 14806 - DNA, 531 bp, Artificial Sequence
  Description of Artificial Sequence: Synthetic coding sequence
atgttccacgtgtcgttccgctacattttcgggctcccgccactcatccttgtgctgctgccggtggcgagcagcgattgcgacattgaagggaaagacggcaagcagtacgaatcggtcttgatggtgtcaatcgaccaactcctcgattctatgaaggaaatcggctcaaactgcctgaacaacgagtttaacttctttaagaggcacatctgcgacgctaacaaagagggaatgttccttttcagggccgctcggaaacttcggcaatttctcaaaatgaactcgactggcgatttcgatctgcacctgctcaaggtgagcgagggaactaccatcctgctgaactgtacgggacaggtgaaaggtcggaaacctgccgccctcggagaggcgcaacccactaaaagtttggaagaaaacaaatcgttgaaggagcaaaagaaactcaacgatctgtgcttcctgaagcgcctcctgcaggaaatcaagacctgctggaataagatcctgatgggtaccaaggaacat

SEQ ID NO: 14807 - DNA, 531 bp, Artificial Sequence
  Description of Artificial Sequence: Synthetic coding sequence
atgttccatgtgagtttccgatacatcttcggtttacctcctcttattttggttctgttgcccgtggcatcaagcgactgtgatatagaggggaaagatggcaagcagtacgaatccgtcctaatggtgtctatcgaccagctcctcgattccatgaaggagatcggctctaactgtctgaacaatgagtttaacttctttaaacgacatatatgcgatgcaaacaaggaaggaatgttcttgttccgagctgccaggaagttacgacaattcctgaagatgaactccactggcgacttcgacctgcatctgttgaaagtgtccgagggaacaactatccttttaaattgcacggggcaggtaaaaggcagaaagcctgcggccctgggagaggcccagcctacaaaaagtctagaggaaaacaaatccctgaaggagcagaagaagctcaacgacctgtgttttttgaaaaggctcctgcaggagatcaagacgtgttggaataaaatcctgatgggcacgaaagagcat

SEQ ID NO: 14808 - DNA, 531 bp, Artificial Sequence
  Description of Artificial Sequence: Synthetic coding sequence
atgttccacgtgtcctttcgctacatctttggactgcctccactcattctggtgctgctcccggtcgcctcctcggactgcgatatcgaggggaaagacggaaaacagtacgaatcggtcctgatggtatcgatcgaccagctcctggacagcatgaaggaaatcggttcaaattgcctcaataacgagttcaactttttcaagaggcacatttgcgatgcaaacaaggaaggaatgttcctcttccgtgctgcgagaaagctccggcagttcctcaagatgaattccaccggcgacttcgatctgcatcttcttaaagtctctgagggaaccactatcttgctgaactgcactggccaggtcaagggccggaaaccggcggcgctgggcgaagcccaaccaaccaaaagcctggaggaaaacaaatcacttaaagaacaaaagaagctgaacgacctctgtttcttgaaacggctcctgcaggaaatcaaaacctgctggaacaaaatcctcatgggtaccaaggagcat

SEQ ID NO: 14809 - DNA, 531 bp, Artificial Sequence
  Description of Artificial Sequence: Synthetic coding sequence
atgtttcacgtaagttttcggtatatcttcggattgcccccactgatcctcgttttgctgcctgtggccagcagcgactgtgacatcgaaggtaaggacggcaagcaatacgagtctgtcctcatggtttccattgaccaacttctggattctatgaaggagattggatctaattgcttgaacaacgaatttaacttctttaaacgacatatctgtgacgccaacaaagagggcatgttcctgttccgcgccgccaggaagttgagacagttcctgaaaatgaactcaactggcgatttcgatttgcacctcctgaaggtctctgaaggcactacaattcttctgaactgcaccggtcaggtgaaaggacggaagcccgccgcactgggcgaagcccagccgaccaagagtctggaggagaacaaaagcctgaaagagcagaaaaagctgaacgatctgtgctttcttaagaggttgctgcaagagattaagacctgttggaataagatcctgatggggactaaagagcac

SEQ ID NO: 14810 - DNA, 531 bp, Artificial Sequence
  Description of Artificial Sequence: Synthetic coding sequence
atgtttcacgtgagcttcagatatatctttggtctgcctcctctgatcttagtccttttacctgtggcatcatccgactgtgacatagaagggaaggacggcaaacaatacgaatccgtactgatggtgagcattgaccagctgctcgactcgatgaaagagatcgggtcaaactgccttaacaacgaattcaacttttttaagcgccacatttgcgatgccaataaggagggcatgttcctatttcgggctgcacgaaagttgcggcagtttttgaaaatgaactcaactggtgattttgatctgcatctcttgaaggtgtctgagggcacgacaatcctactgaattgtacaggacaggtgaagggccggaagccggcagcactgggggaggcacaacccaccaagtccctggaagagaacaagtccctcaaggagcagaagaagctcaacgatttgtgtttccttaaaagactacttcaggagatcaaaacctgctggaacaaaattctgatgggtaccaaagagcat

SEQ ID NO: 14811 - DNA, 531 bp, Artificial Sequence
  Description of Artificial Sequence: Synthetic coding sequence
atgttccatgtttcctttaggtatattttcggactacctccgttgatacttgtgttgctaccagtcgcttcctcagattgtgacatcgaaggaaaagatgggaaacagtatgagagtgtccttatggtgagtatagatcaactgttggatagtatgaaggagatcggatccaactgtctaaataacgagtttaatttctttaagagacatatatgcgacgcaaacaaggagggaatgtttctattcagagccgctcgtaagctaagacaatttcttaaaatgaactcaactggcgactttgatttgcatctccttaaggtgtctgagggcacaacaattcttcttaactgtacaggacaagtaaagggacgtaaaccagctgcattaggtgaggcccaaccaacaaaaagcctagaggaaaacaaatcacttaaagagcagaagaagcttaatgacttgtgcttcctaaagagactgttgcaagaaatcaagacgtgttggaacaagattcttatgggaactaaggagcac

SEQ ID NO: 14812 - DNA, 531 bp, Artificial Sequence
  Description of Artificial Sequence: Synthetic coding sequence
atgtttcatgtgagtttcaggtacatattcggactgccgcccctgatcctggtgttactgcctgtcgcatcctccgactgcgatatagaaggcaaggatgggaaacagtacgagagcgtgctcatggtgagcatcgaccagctcctcgattcgatgaaggaaataggctccaactgcctcaacaatgaatttaatttcttcaagcgccacatctgcgatgccaacaaggaaggtatgttcctttttcgggccgcgagaaagctgaggcagtttctgaaaatgaactcaaccggggacttcgatctccatctgttaaaggtttccgaggggacaactatcctcttaaactgtacgggacaagtgaaagggcgaaaacctgcagccctgggggaggcccagcctacaaaatccttagaagagaacaaaagtctaaaagaacagaagaagttgaatgatctgtgtttcctgaagagactcctgcaggagataaaaacttgctggaataagattctgatgggaaccaaagagcat

SEQ ID NO: 14813 - DNA, 531 bp, Artificial Sequence
  Description of Artificial Sequence: Synthetic coding sequence
atgttccacgtctctttccggtatatcttcggactcccaccacttatcctggtccttttgcctgtggcttctagcgattgcgatatcgaagggaaggatggaaagcagtatgaatcagttctgatggtttcaattgatcaactcctcgatagcatgaaggagatcggctccaattgcttaaacaatgaatttaacttcttcaaacgccatatctgtgatgctaacaaagaaggcatgttcttgttcagagcggccaggaagttgaggcaattccttaaaatgaacagcacaggtgattttgatcttcatttgctgaaggtgtcggagggcacgactatcctgctcaactgtaccggacaggttaagggacgtaagcctgcagctctcggcgaagcccaaccaactaagagcctggaggagaacaaatcactgaaggagcaaaaaaaattgaacgacttgtgcttcctcaagcggctcctccaggagataaagacatgctggaacaagatcctgatgggcactaaagaacac

SEQ ID NO: 14814 - DNA, 531 bp, Artificial Sequence
  Description of Artificial Sequence: Synthetic coding sequence
atgttccatgtgtccttcagatacatcttcggccttccgccactgatcctggtcttgctccctgtggccagctcggactgtgacatcgaagggaaggatggtaagcagtacgaatcagtgctcatggtgtccattgatcaacttctggattctatgaaggagatcggatcaaactgtctgaacaacgaattcaattttttcaagcgccatatctgcgatgcgaacaaggaggggatgtttctgttccgcgcggcccggaaactgaggcagtttctcaaaatgaattccactggcgacttcgacctccacctgttgaaggtttcggagggaaccaccatcctgttgaactgcacgggacaggtcaagggacggaagcccgccgctctgggcgaggcacaaccgactaaaagcctcgaagaaaataaatcgctcaaagaacagaagaagctgaatgacctgtgcttccttaagagactgctgcaagaaattaagacttgctggaacaagatcctcatgggaaccaaagagcac

SEQ ID NO: 14815 - DNA, 531 bp, Artificial Sequence
  Description of Artificial Sequence: Synthetic coding sequence
atgtttcatgttagctttagatacatatttggcctgcccccgctgattttggtgttgttaccagttgctagtagcgactgtgacatcgaaggtaaagacggcaagcaatatgagagcgtcttaatggtatcaatcgatcagttgctggattctatgaaagagatcggatctaactgcttgaacaacgagtttaattttttcaaaagacatatctgcgatgccaataaagagggaatgttcctatttcgggcagcaagaaagctgcgacagttcctgaagatgaattccactggcgatttcgatctgcacttgttgaaggtgtccgagggcaccacaatcctgctgaactgcacagggcaggtgaaaggccggaagccagctgccctgggagaagcccagcccacaaagtcacttgaggaaaacaagtcgctgaaggagcagaaaaagctcaacgacctatgcttcttgaaacgtctcctgcaggagatcaagacatgctggaataaaattcttatggggacgaaggagcac

SEQ ID NO: 14816 - DNA, 531 bp, Artificial Sequence
  Description of Artificial Sequence: Synthetic coding sequence
atgttccatgtgtcatttagatacatcttcgggcttccgcccctgatcctcgtcctgcttcctgtcgctagttcagactgtgatattgaggggaaggacggaaaacaatacgaatccgtcctgatggtctccatcgaccagctcctggatagcatgaaagaaatcgggtccaattgcctcaacaatgagtttaatttctttaagaggcatatatgcgatgctaataaagaggggatgttcctgtttagggcagctagaaaattgaggcagttccttaagatgaattccacgggggactttgatttgcatctcttaaaagtttccgagggcacaacaattcttttaaattgtacagggcaagttaaagggcgaaagccggccgctttgggcgaggcacagcccacaaagtctctggaagaaaataagtccttaaaggagcaaaaaaagctgaacgacctgtgtttcctgaagcgactcctacaggagataaaaacatgctggaacaagatcctcatggggactaaagagcac

SEQ ID NO: 14817 - DNA, 531 bp, Artificial Sequence
  Description of Artificial Sequence: Synthetic coding sequence
atgtttcacgtttccttccgatatatctttggccttcctccactcattctggttctgcttcctgtggcaagctctgactgcgatattgaaggaaaggacggcaaacagtacgaatcggtgcttatggtgtccattgatcaactgctggattcaatgaaagagattggctccaactgcctgaataatgagttcaacttcttcaagcgccatatttgcgacgctaacaaagagggcatgtttttgtttagagccgctaggaaattaagacagtttctaaaaatgaacagcactggtgatttcgatctgcacctcctgaaggtatcggaaggcactaccattctactgaattgtacaggtcaggtaaaagggcggaagccagctgcgttgggagaggctcagccaactaagtctcttgaggagaataagtcactgaaagaacaaaagaagcttaatgacctgtgtttcctgaagagacttctccaggagatcaagacctgctggaacaaaatcctgatgggtactaaggagcac

SEQ ID NO: 14818 - DNA, 531 bp, Artificial Sequence
  Description of Artificial Sequence: Synthetic coding sequence
atgttccatgtgtctttccgctatatattcgggctgcctccgttgattctggttctgctccccgttgcgtcatctgattgtgacatagaggggaaagacgggaagcagtacgagtcagtgctgatggtatcgattgatcagctcctggactccatgaaggagataggctccaactgcctcaacaatgaattcaacttttttaaaagacacatctgtgatgccaacaaagagggaatgttcttgttcagggccgcgagaaagttgagacagttcctgaagatgaactctaccggggatttcgaccttcacctgctcaaagtttccgagggcaccacgatcctgctgaattgcaccggacaggttaaaggccgtaagcccgccgcactgggggaagcgcaacctacgaagagcctggaggagaataagtcattgaaggaacagaagaagctgaacgatctgtgtttcttaaagcgactgttgcaggaaattaagacttgctggaacaaaatcctaatgggcacgaaagaacac

SEQ ID NO: 14819 - DNA, 531 bp, Artificial Sequence
  Description of Artificial Sequence: Synthetic coding sequence
atgttccacgtgtctttcaggtacatttttggattgcctccattgatcctggtactccttccagttgcatcttcagactgcgacattgaaggcaaggacggcaagcagtacgaaagcgtgctgatggtctctattgatcagttgcttgacagcatgaaagagataggctccaattgtttgaacaacgaatttaatttcttcaagcgtcacatatgcgacgctaacaaagagggcatgttcttgttcagggctgctcgtaagctgaggcagttccttaagatgaactcaactggagactttgatctccatcttctgaaagttagtgaaggtaccactatcttgctgaattgtactggtcaggttaagggacgcaagcctgcagcactcggagaggcccaaccaacaaagagtctcgaggaaaacaaaagccttaaagaacaaaagaaactcaacgatttgtgctttctgaaacgccttctgcaggaaatcaaaacctgctggaataaaatcctgatgggaactaaggagcat

SEQ ID NO: 14820 - DNA, 531 bp, Artificial Sequence
  Description of Artificial Sequence: Synthetic coding sequence
atgttccatgtcagttttaggtacatttttgggctcccgcctctgatactggtccttctgccagttgcttcttctgattgcgatattgagggcaaagacggcaaacagtatgaatccgtgctcatggtcagtatagatcagctgctggattcgatgaaggaaatcggctcaaactgcctcaataacgagttcaatttcttcaaaaggcacatttgcgacgccaataaagaaggaatgtttttattcagggccgcaaggaagcttcgccagttcttgaagatgaatagtaccggtgacttcgatcttcacctcctgaaggtctccgagggcacaacaattttactgaattgcaccgggcaggttaagggtagaaaacctgcggccctgggggaagctcagcctacaaagagccttgaagaaaacaaatctctgaaggagcagaagaagttgaacgatttatgcttccttaagaggttgctgcaggaaatcaagacatgttggaacaaaattctgatgggaaccaaagaacat

SEQ ID NO: 14821 - DNA, 531 bp, Artificial Sequence
  Description of Artificial Sequence: Synthetic coding sequence
atgttccacgtctcgttccgctacatttttggtttgcccccccttatcctggtccttttgcccgtcgcatccagtgattgcgatatcgagggcaaggacggcaagcagtacgaaagcgtgttgatggtaagcattgaccagctcctcgatagcatgaaggagatcggctccaactgtctgaacaacgagtttaacttcttcaaacgccatatctgcgacgcaaacaaggagggcatgttccttttccgtgcggcccgcaagctccgccagttccttaaaatgaattccaccggcgactttgacctgcacctgctcaaggtcagtgagggtacaacaattctacttaattgcactggacaggtgaagggccgcaagccagctgccctgggcgaagcccagccgacgaagagcctagaagagaacaagtccttgaaagagcagaaaaagctcaacgatttgtgtttcctcaagcggttgctgcaggagatcaagacttgctggaacaagatccttatgggcacaaaggagcac

SEQ ID NO: 14822 - DNA, 531 bp, Artificial Sequence
  Description of Artificial Sequence: Synthetic coding sequence
atgtttcatgtatcgtttcgttatatatttggtttaccgccgctaatattagtattattaccggttgcgtcgtcggattgtgatatagaaggtaaagatggtaaacaatatgaatcggttttaatggtatcgatagatcaactactagattcgatgaaagaaataggttcgaattgtctaaataatgaatttaatttttttaaacgacatatatgtgatgcgaataaagaaggtatgtttttatttcgagcggcgcgaaaattacgacaatttctaaaaatgaattcgacgggtgattttgatttacatctactaaaagtatcggaaggtacgacgatactattaaattgtacgggtcaagttaaaggtcgtaaaccggcggcgctaggtgaagcgcaaccgacgaaatcgttagaagaaaataaatcgctaaaagaacaaaaaaaattaaatgatttatgttttctaaaacgattactacaagaaataaaaacgtgttggaataaaatactaatgggtacgaaagaacat

SEQ ID NO: 14823 - DNA, 531 bp, Artificial Sequence
  Description of Artificial Sequence: Synthetic coding sequence
atgtttcatgtgtccttcagatacatcttcggtctacctccacttatcttggtgcttctccctgtcgcatcgagcgattgcgatatagagggcaaagatggcaagcaatacgagtcagtattgatggtttcaatcgatcaactattagactccatgaaagaaattggatccaactgtttgaacaacgaatttaacttcttcaaaaggcacatctgcgacgccaacaaggaggggatgttcttgtttagggctgcccgcaagctacgccagtttctgaaaatgaactccactggagatttcgatctacacctcctcaaggtaagcgagggcactactatcctgctcaattgtaccggccaggtcaagggccgaaagccagccgcactcggcgaggcccaaccaaccaagtcccttgaagagaataagtctctcaaggaacaaaagaaactgaacgatttgtgcttccttaagcgtctcctgcaggagattaagacctgttggaacaaaatattgatgggcacgaaagaacat

SEQ ID NO: 14824 - DNA, 531 bp, Artificial Sequence
  Description of Artificial Sequence: Synthetic coding sequence
atgtttcatgtttcatttagatatatttttggtttacctccattaattcttgttttgcttccagttgcatcttcagattgtgatattgagggaaaagatggaaagcaatatgaatcagttcttatggtttcaattgatcaacttttagattcaatgaaggaaattggaagtaattgtttaaataatgaattcaattttttcaaaagacatatttgtgatgcaaataaagaaggaatgttcctttttagagctgcaaggaaacttcgtcaatttcttaaaatgaattctactggagattttgatttacatcttttaaaagtttctgaaggaactacaattttacttaactgtacaggacaagtaaaaggaagaaaacctgctgctttaggagaagcacaaccaacaaaatctttagaagagaataagagtttaaaggaacaaaagaagttaaatgatttatgttttttaaaaagattacttcaagaaattaaaacctgttggaataaaattcttatgggaacaaaggaacat

SEQ ID NO: 14825 - DNA, 531 bp, Artificial Sequence
  Description of Artificial Sequence: Synthetic coding sequence
atgtttcacgttagctttcgttacatttttgggttgcctcctctgatattagtgctgttacccgtcgcctccagcgattgtgacattgagggtaaggatggaaaacagtacgaaagtgtgctgatggtgtcaattgatcagctcctggatagcatgaaggagatcgggtccaattgtctgaacaatgaattcaacttcttcaaaaggcacatttgtgatgccaataaagaaggaatgttcctctttcgggccgcacgaaaactccgccagtttctgaagatgaactccaccggcgactttgatctccaccttttgaaggtcagcgagggcaccacaatcctcctcaactgtacagggcaggtgaaggggcgcaagcccgctgccttaggtgaagcacagcccactaaaagtttagaagagaataagagcctgaaagaacagaaaaaactcaatgatttgtgctttctcaagaggctcttgcaggaaatcaaaacatgttggaacaagatcctgatggggaccaaagagcac

SEQ ID NO: 14826 - DNA, 531 bp, Artificial Sequence
  Description of Artificial Sequence: Synthetic coding sequence
atgttccacgtttccttccggtacatctttggcctccctcccctcattctggtgttactgccagttgccagttctgattgcgatattgaaggaaaagacggcaaacaatacgagagtgtgcttatggtaagtattgatcaactcttggacagcatgaaggagatcggaagcaactgtttaaacaatgagttcaacttcttcaaacgccatatctgcgacgcaaacaaggaaggcatgtttctgtttagagcggctcgaaaactccggcagtttctgaagatgaattccacaggcgacttcgatctgcacctgcttaaggtgagtgaagggactaccattctgctgaactgcacaggccaggttaaggggcggaaaccagctgctctcggcgaagctcagccaacaaagagccttgaggagaataagtccttgaaagaacagaagaagctcaatgacttgtgcttcctcaaacggctgttgcaagagattaagacatgttggaataagattctgatggggaccaaggagcac

SEQ ID NO: 14827 - DNA, 531 bp, Artificial Sequence
  Description of Artificial Sequence: Synthetic coding sequence
atgttccatgtttcatttaggtacatttttggtctgccgcctctgatcctggtgttgctgccggtggctagctctgactgcgatattgagggcaaggacggcaaacaatacgaatccgttttgatggtgagtatcgatcaactgcttgacagcatgaaggagataggctcgaattgcctgaataacgagtttaacttttttaagaggcacatttgtgacgcaaataaagaagggatgtttctgtttcgtgcggcgcggaagttgcgacagtttctgaagatgaatagcaccggcgacttcgatcttcatttactgaaggtttctgagggtaccactattctgctgaattgcactggtcaggttaaaggcaggaagccggctgcactgggggaggcgcagccgaccaagtcactggaggagaacaagtctctgaaagagcagaaaaaactcaacgacctgtgttttctgaagcgcctgctccaagaaattaaaacctgctggaacaagatactgatgggtaccaaggagcac

SEQ ID NO: 14828 - DNA, 531 bp, Artificial Sequence
  Description of Artificial Sequence: Synthetic coding sequence
atgttccacgtttccttcaggtacatctttggccttccacctttgatcctcgtgctgctgccagttgcttctagtgattgtgatatcgagggtaaggacggcaaacagtacgagtctgttctgatggtatcaatcgaccagctcttggactccatgaaagagattggtagtaactgccttaacaatgagttcaatttctttaagagacacatttgcgatgcgaacaaagagggaatgttcctgttccgcgccgcccgcaaactgcgccaattcctgaagatgaactctacgggtgatttcgacctccatctgttgaaggtttctgaaggcaccaccatacttctgaactgcacgggtcaagtcaagggtcgcaagccggcagccctcggtgaggcccaacccaccaagagtctggaggaaaacaaatcccttaaggaacagaaaaagctcaacgacctttgtttccttaaaaggctgctgcaagagatcaaaacttgttggaacaagattctcatgggtaccaaagagcac

SEQ ID NO: 14829 - DNA, 531 bp, Artificial Sequence
  Description of Artificial Sequence: Synthetic coding sequence
atgtttcatgtctcttttcggtatatcttcgggctcccccctctgatcctcgtcctgcttcctgtcgctagctctgattgcgatattgagggaaaggacggaaaacaatacgagagcgtgctgatggtgtctatcgaccagctgctggactccatgaaggaaattgggagtaattgtcttaataatgaatttaatttttttaaacgccatatttgtgatgctaacaaagagggtatgtttctctttcgcgccgccagaaagctgcgccagttcctgaaaatgaatagtaccggagacttcgatctgcacctgttgaaagtttctgaaggaacaacgatcctcctgaattgcaccgggcaggtgaaggggaggaagcccgcagctctcggagaggcgcagccaaccaagagcctggaagaaaataagagcctgaaagagcagaagaagctgaatgacctctgcttcctgaaacgacttcttcaggagattaagacttgctggaacaagatactgatgggtactaaagaacat

SEQ ID NO: 14830 - DNA, 531 bp, Artificial Sequence
  Description of Artificial Sequence: Synthetic coding sequence
atgtttcacgtgtcatttcggtacatcttcggtctgccacctttaattttagtgcttctcccggttgcaagctcagactgcgacattgaagggaaggatggcaagcagtatgagtctgtgctgatggtctccatcgatcagttgcttgattccatgaaggagatcggctcgaactgtcttaacaatgagttcaatttctttaaacgccacatctgtgatgcaaacaaggagggcatgtttctgtttcgagcagccagaaagctccggcagtttttgaaaatgaactccacaggtgactttgacctccacctgcttaaggtgagtgaaggcactaccattctgcttaattgcaccggacaggtgaaggggcggaagccagcagcactgggggaggctcagccaacaaagtctctcgaggagaacaagtctctcaaggaacagaagaagttaaatgacctctgcttcctgaaaaggctcttacaagagataaagacatgttggaataaaattctcatggggactaaagagcac

SEQ ID NO: 14831 - DNA, 531 bp, Artificial Sequence
  Description of Artificial Sequence: Synthetic coding sequence
atgtttcacgtgagtttccgttacattttcgggctgccacctctaatcctagtgctgctgcctgttgcttcctcagactgcgacatcgagggtaaagacggcaagcaatatgagagcgtactgatggtgagcatcgaccagttgctagacagcatgaaagaaatagggtctaattgtctgaataacgaatttaacttcttcaaacgacatatctgtgatgccaataaggagggcatgtttctctttcgtgctgctcggaagttgcgacaatttctgaaaatgaactcaacaggcgactttgaccttcaccttctcaaagttagcgagggcacgaccattctgttgaactgcacgggccaagtaaaagggaggaaaccagccgctttgggggaagcccagccaaccaagtctttggaggagaacaagagtctgaaagagcagaagaagctgaacgacctttgcttcctgaagagactcctgcaggagatcaaaacttgttggaacaagattctgatgggcacaaaggagcac

SEQ ID NO: 14832 - DNA, 531 bp, Artificial Sequence
  Description of Artificial Sequence: Synthetic coding sequence
atgttccatgttagcttcagatatattttcggcctacctccattaatcctcgtgctgctgcctgtggcttcgtcggattgtgatatcgaagggaaagacggcaaacaatatgaaagcgtgctgatggtgagtattgaccagctgctggattccatgaaagagattggttctaattgtttgaacaacgaatttaatttcttcaaacggcatatttgtgacgccaacaaggaaggcatgttcctgttcagagcggctcgaaagctgcgtcagtttctgaagatgaactccaccggagatttcgacctgcacctgttgaaagtttcagagggcaccacgattctgcttaactgtaccggccaggtcaaagggagaaaaccagccgcactgggagaagcccagcctacaaaaagcttggaggagaacaaatctctgaaggagcaaaagaaattgaatgatctgtgctttctgaagaggctcttgcaagagataaagacatgttggaataagattcttatgggcacgaaggaacac

SEQ ID NO: 14833 - DNA, 531 bp, Artificial Sequence
  Description of Artificial Sequence: Synthetic coding sequence
atgtttcacgtgagctttagatatatcttcggtcttcccccactgatcctcgtgctgctgcccgtcgcatcaagcgattgtgacatagagggaaaagatggaaaacaatacgaatctgttctgatggtgagcatcgaccagcttcttgacagtatgaaggagattggatcaaactgcctgaacaatgagttcaacttctttaaaagacacatctgtgacgcaaacaaggagggcatgttcttgtttagagccgcccgaaaactgcggcaatttcttaaaatgaacagtacgggagatttcgatctccatctactgaaggtgagcgagggaactactatcctgttgaactgtaccggccaggttaaaggcaggaaacccgccgctctgggcgaggctcaaccgacaaaatcacttgaggagaataagtccctgaaagaacaaaaaaagctgaacgatctgtgcttcctcaaaaggttgttacaggagatcaagacctgctggaacaaaatcctcatgggaactaaggagcac

SEQ ID NO: 14834 - DNA, 531 bp, Artificial Sequence
  Description of Artificial Sequence: Synthetic coding sequence
atgttccacgtgagctttaggtacatatttggtctgcctcctttgatcctcgtactcctccctgtggcctcatcggactgcgacatcgaaggaaaggacggtaaacagtacgagagtgtcctgatggtgtctattgaccagctgctggactcaatgaaggagattggatctaactgtttaaacaacgagtttaacttcttcaaacgccacatttgtgacgctaataaagaggggatgttcctgtttagggcagcgaggaagctgcgacagtttctgaagatgaactccaccggcgactttgacctccacctgttaaaagtaagcgaaggcacgacaatcctgctcaactgcacaggacaggtgaaggggagaaagcctgcggccctcggcgaagcacaacccaccaaatcgctggaggagaataaatcgctcaaagagcaaaagaagttgaatgatctgtgctttctgaagcgtctgctgcaggagatcaaaacatgttggaataaaatcctgatgggtacaaaagagcac

SEQ ID NO: 14835 - DNA, 531 bp, Artificial Sequence
  Description of Artificial Sequence: Synthetic coding sequence
atgtttcacgtcagttttcggtacatctttgggctacccccactgatcctcgttctgctgcccgtcgcatccagtgactgtgatatcgaagggaaagatggaaagcagtatgaatctgttttaatggtgagtatcgatcaactcctcgattcgatgaaagaaatagggtccaactgcctaaacaacgaattcaatttctttaaacggcacatatgcgatgctaacaaagaagggatgttcctgtttagggcagccagaaaattacggcagtttctgaaaatgaatagtacaggggattttgacttgcatctgttgaaagtctccgaagggacaacaatcttactaaattgtacaggacaggtcaaaggaaggaaacccgctgctcttggggaagcacagcccacgaaatccctggaggaaaacaaatcattaaaagagcagaaaaaactcaacgatctgtgctttctgaaacgactcctccaggaaatcaaaacttgttggaataaaattttaatgggaacaaaagagcac

SEQ ID NO: 14836 - DNA, 531 bp, Artificial Sequence
  Description of Artificial Sequence: Synthetic coding sequence
atgttccacgtgtcatttaggtatattttcggccttcctccgctcatcctggtgttgctcccagtggcctcatccgattgtgatatagagggtaaggatggcaaacagtatgagtctgtcctcatggtgtcaatcgatcagctgctggattcaatgaaggagatcgggtctaattgtctcaataacgagtttaatttctttaaaagacacatttgcgatgctaataaagagggaatgttcctcttccgagcggcccggaagctaagacaattcctaaaaatgaatagcacgggggatttcgaccttcatctacttaaggtcagcgaaggcaccacaattcttctgaactgcacaggccaggtcaagggtcggaaaccagctgctttgggtgaggcccaacccacaaagagcctcgaagaaaataagtctctcaaggaacagaagaagctaaacgacctctgcttcctgaagagacttctccaggagatcaagacctgctggaacaaaatactcatgggcacgaaggagcac

SEQ ID NO: 14837 - DNA, 531 bp, Artificial Sequence
  Description of Artificial Sequence: Synthetic coding sequence
atgtttcacgtgagcttcaggtatattttcggattgcccccactaatcctggttcttctaccagtggccagtagcgattgtgatattgaaggcaaggacggtaagcagtatgaaagtgtgctcatggtctcaatcgaccagcttcttgatagcatgaaggaaatcgggtctaactgtctgaacaacgaattcaacttcttcaagcgacatatctgcgatgctaacaaagaaggcatgtttctgtttagagccgctagaaaactgagacagtttctcaagatgaattccaccggcgactttgacttacacctgctgaaggtctctgaaggaacgaccattctgctgaactgtaccggccaagtaaagggcaggaagccagcagctctgggcgaagcacaaccaaccaaatcgctcgaggagaacaaatccctcaaagagcagaaaaaattgaatgacctgtgtttcctaaaaaggctgctgcaagaaatcaagacatgctggaataagatcctgatggggacaaaggagcac

SEQ ID NO: 14838 - DNA, 531 bp, Artificial Sequence
  Description of Artificial Sequence: Synthetic coding sequence
atgtttcatgtctcatttagatatatttttggcctgccaccactaatcctggtgttgctaccggtggcatcaagtgactgtgacattgaagggaaggatggcaagcagtacgaatccgtcctgatggtgtcaatcgatcagttgcttgactctatgaaggagatcggatccaattgcctgaataacgagtttaacttttttaagagacacatttgcgacgctaataaggaagggatgtttctcttccgagctgcccggaaactcaggcagttcctgaagatgaattccacaggggacttcgacctacacttgctgaaggtatcagaagggacaaccatccttctgaattgtaccggccaggtgaagggtcgcaaacctgcagcactcggagaggcccagccaactaaaagcctggaagagaacaagtcccttaaggaacaaaagaaactcaatgatctctgcttccttaagcggctactacaggaaattaagacatgctggaataaaatcctgatgggcactaaggaacac

SEQ ID NO: 14839 - DNA, 531 bp, Artificial Sequence
  Description of Artificial Sequence: Synthetic coding sequence
atgttccacgtctctttcagatatatattcggactcccaccactgatacttgtccttttgcccgtggcttccagcgactgcgacattgagggtaaggatgggaagcagtacgagtccgtgttgatggtgtcaatagatcagctgttagattccatgaaggagataggatccaattgcttgaataacgagttcaatttctttaaaagacacatctgtgatgcaaataaggaggggatgtttctcttccgggccgcaaggaaactgcgccagtttcttaagatgaacagtacaggagactttgatctgcacctcctgaaggttagtgagggcacgaccatattactcaactgcacagggcaagtaaaaggccgcaagcctgcagccctgggtgaggcacagccaacaaagagcctcgaagagaacaagagtctcaaagaacagaagaagctcaatgatctatgcttcctcaagagacttctccaggagatcaaaacatgttggaacaaaatcttgatgggaacaaaagaacac

SEQ ID NO: 14840 - DNA, 531 bp, Artificial Sequence
  Description of Artificial Sequence: Synthetic coding sequence
atgtttcacgtctccttccgctacatattcggactgcctcccctgatattagttctcctgcctgttgcatctagcgactgcgacatcgagggtaaggacggaaaacagtacgagtccgtgctcatggttagcattgatcaattgttagactcaatgaaggaaatcggcagtaattgtctgaacaatgagttcaatttcttcaagcggcacatatgtgacgccaataaagagggtatgtttctgttccgggcagccaggaagctgcgtcagtttctaaaaatgaactctacaggagacttcgacctgcaccttctgaaggtgagcgaaggtactacaattctgttaaattgcacagggcaggtaaaaggcaggaagcctgcagccctaggagaggcacaacccaccaaaagcttagaggaaaacaagtcactgaaggagcagaagaagctgaacgacctttgttttttgaaacggctgctacaggagatcaagacatgctggaataagatactaatgggtactaaggaacat

SEQ ID NO: 14841 - DNA, 531 bp, Artificial Sequence
  Description of Artificial Sequence: Synthetic coding sequence
atgttccatgtgtcctttcgatatatcttcggtctgcccccgttaattctagtgttgttgccagtggcctcatccgactgcgatattgaggggaaagacggaaaacagtatgagtccgttctgatggtctcgattgaccagttgttagacagcatgaaggaaataggcagcaattgtctaaataatgagttcaacttctttaaaagacatatctgtgatgccaataaggaaggcatgtttctctttagagccgccaggaagctacgacagttcctaaaaatgaactctactggtgacttcgacttgcaccttctcaaagtgtccgagggcactacaatactgcttaattgtactgggcaggttaaaggccgaaaaccagctgccctcggggaagcccagccaacgaagagcctcgaggagaacaagagccttaaggagcagaagaagttgaacgatctttgttttctaaaacgtcttctacaggagattaagacatgctggaacaagatactgatgggtaccaaagagcac

SEQ ID NO: 14842 - DNA, 531 bp, Artificial Sequence
  Description of Artificial Sequence: Synthetic coding sequence
atgttccatgtatcatttcgatacatctttggactacctccattaatcctggtgcttttgccggtagcttctagcgattgtgacatcgagggaaaagacggaaaacagtatgagtcggtgcttatggtttcaattgaccaacttcttgattccatgaaagaaatcggctcaaattgcttaaacaacgaatttaatttttttaaacgccacatctgtgatgcgaataaagaaggaatgtttctgtttcgcgccgcccgcaaattgagacaatttctcaaaatgaacagtacaggagattttgacttacatcttttgaaagtttctgaggggaccacgattttgctgaattgtacgggccaggttaaagggcgcaaaccagctgcgcttggtgaagcacaaccgacaaaatcgcttgaggaaaataagagtctgaaggagcaaaaaaagttaaatgacctttgctttctaaaacgcctgcttcaagaaattaagacatgttggaacaaaatcttaatgggcacaaaggaacat

SEQ ID NO: 14843 - DNA, 531 bp, Artificial Sequence
  Description of Artificial Sequence: Synthetic coding sequence
atgttccatgtttctttccgatacatattcggccttccacccttgatactagtgctcttgcctgtagcctctagtgactgtgatatcgaagggaaggacggcaaacagtacgaatcagtcctcatggtttctatcgaccagctgctcgactccatgaaagagatcggaagcaactgcctaaataatgaattcaacttcttcaaacgccacatctgcgacgcaaacaaggagggaatgttcctattccgcgccgcacggaagttaaggcagttcctgaaaatgaattcaaccggcgacttcgatttacatctcctaaaggttagcgaggggacgaccatattgctgaattgcactgggcaggtgaagggccggaaacccgctgccttgggcgaggcacaaccaacaaagagcctggaggagaataagtccctcaaggaacagaagaagctgaacgacctgtgcttcttaaaaaggctcctgcaggaaattaaaacctgttggaataagattctcatgggcaccaaggagcat

SEQ ID NO: 14844 - DNA, 531 bp, Artificial Sequence
  Description of Artificial Sequence: Synthetic coding sequence
atgtttcatgtttcttttcggtatatcttcggactacctccactcatactagttctcctgccagtagcttcctcagattgtgatatagaagggaaagacgggaaacagtatgaatctgttctaatggtttcaatcgatcagctactggactcaatgaaagaaattgggagtaactgtctcaacaacgagttcaacttcttcaaaagacatatctgtgatgccaataaagaaggaatgtttttgttccgagctgcccggaagcttaggcagttcctgaaaatgaatagtacaggagactttgaccttcatcttctgaaggtcagtgaaggaactacaatcctgctaaactgcacaggacaggttaaagggaggaaacctgcggcattaggagaagcacagccaactaaaagtctcgaagagaataagagtttaaaagaacagaaaaaactgaacgatctgtgcttcctcaaaagactcctccaggaaattaaaacgtgttggaataaaattctaatgggaacaaaagagcat

SEQ ID NO: 14845 - DNA, 531 bp, Artificial Sequence
  Description of Artificial Sequence: Synthetic coding sequence
atgttccatgttagttttcggtacatctttggtttgccccctctgatcttggtcctccttccagtcgcaagttctgattgcgacatagagggaaaggacggaaagcagtatgagtctgtcctgatggtgagcatagatcagctcctcgacagcatgaaggagatcggatccaactgcctcaacaatgaatttaattttttcaagcgccacatatgtgatgccaacaaggagggcatgtttcttttccgggctgctaggaaactgcgccagtttctgaagatgaactcaacaggagatttcgacctgcatcttctgaaggtctctgagggcaccacaatcttgttgaattgcaccggacaagtcaagggtagaaaacccgccgctctgggagaggctcagccaactaagagcctggaagagaacaagagcctgaaagaacagaagaagctgaatgatctctgcttcctcaaacgactgctgcaagagataaaaacctgttggaacaagattctcatggggactaaggagcat

SEQ ID NO: 14846 - DNA, 531 bp, Artificial Sequence
  Description of Artificial Sequence: Synthetic coding sequence
atgttccatgtctctttccgatatattttcggactgccccccctgatcctcgtccttcttccggtcgcgagcagcgattgcgatattgagggtaaagatggtaagcaatatgagtcagtgcttatggtatctatcgatcagctgttagatagcatgaaagaaattgggtctaactgcctgaataatgaattcaatttctttaagcggcatatctgcgacgctaacaaagaggggatgtttctgttcagggctgctcggaaactcagacagttcctcaagatgaactcaactggggacttcgacctgcatctcctcaaggtgagcgagggcactaccatcctactgaattgcaccggccaggtgaaggggcgtaagcccgccgccctaggcgaagcccaacccacaaaatccttggaggaaaataaatctctcaaagaacagaaaaagctgaatgatttatgtttcctaaagcgcctcctccaggagataaaaacctgctggaacaagatcctgatgggaaccaaagaacat

SEQ ID NO: 14847 - DNA, 531 bp, Artificial Sequence
  Description of Artificial Sequence: Synthetic coding sequence
atgtttcatgttagctttcggtacatcttcgggctgccaccactcatcctcgtgttgctgccagtagcctcatccgattgtgacatcgaaggaaaagacggcaaacaatacgaatctgtactcatggtttctattgatcaactcttggacagcatgaaggaaattggctccaactgcctgaataacgagttcaatttctttaagcggcatatctgcgacgctaataaggagggcatgtttcttttccgggccgccaggaaacttcgccaatttctcaagatgaactcgaccggcgactttgacctgcacctgcttaaagtgtcagagggcacaactattctcctcaactgcacaggacaggtgaagggtaggaagcccgccgccctgggcgaggcccagccaactaaatcacttgaggaaaataagagcctgaaagagcagaaaaagctcaatgacttgtgcttcttaaagagactcctacaggagatcaagacatgttggaataagattctgatgggcactaaggagcat

SEQ ID NO: 14848 - DNA, 531 bp, Artificial Sequence
  Description of Artificial Sequence: Synthetic coding sequence
atgttccatgtctcattcaggtatattttcggattgccccccctcatccttgtactgttgccagtggcaagcagcgattgtgatatcgaggggaaggatggaaaacagtatgagtcagttcttatggtgagcatcgatcagctgctcgacagtatgaaggagattgggagtaattgtctgaacaacgagttcaacttttttaaaagacacatctgcgatgccaacaaggagggcatgtttttattccgagccgctcgcaagttaagacagttcctgaaaatgaactctactggcgacttcgatctccatcttctgaaggtttctgagggaaccactatactcctgaactgcacggggcaggttaagggtcggaaacctgctgcattgggggaagcacagcctaccaaatctctggaagagaataagtctctgaaggagcagaaaaagctgaacgatctgtgctttctgaagcgtctgctacaggagatcaaaacttgctggaacaagattctcatggggacgaaggaacac

SEQ ID NO: 14849 - DNA, 531 bp, Artificial Sequence
  Description of Artificial Sequence: Synthetic coding sequence
atgtttcacgtttctttcaggtacatctttggattaccccccctaattctggtcctgcttccagtcgcgtcatctgactgcgatattgaaggaaaggacggaaaacagtacgaatccgtgctgatggtcagtatagatcagctgctggattcgatgaaagaaattgggagtaattgcttaaataatgagttcaatttttttaagcggcatatctgcgatgccaataaggagggcatgttcctgtttagggccgcgagaaaactgagacagtttttgaaaatgaactcaacaggcgatttcgacctgcacttattgaaggtctctgagggtaccactatccttctcaattgcacaggtcaagttaagggcaggaaaccagccgcattgggcgaagcacagccaactaagtctctggaggaaaacaagagcctcaaagagcagaaaaagttgaacgatctctgtttcttaaagaggctgttgcaagagataaagacatgctggaacaaaatattaatgggtacgaaggagcac

SEQ ID NO: 14850 - DNA, 531 bp, Artificial Sequence
  Description of Artificial Sequence: Synthetic coding sequence
atgtttcatgttagttttcgctatattttcggactccctccattgatcttggtcctcttgccagtcgcatcatctgattgcgacattgagggaaaagatggtaagcaatacgaatctgtcctcatggtttcgattgatcaattgcttgactcgatgaaggagattggatctaactgtcttaacaacgagttcaatttcttcaaacgtcacatctgcgatgcgaacaaagaaggtatgttcctgttccgtgctgcgcgcaaattgcgacagttcttaaagatgaactcaactggagatttcgatttgcatttattgaaggtctctgaaggaaccaccattctcctaaactgcaccggccaagtgaagggtcgaaaaccagccgcactcggagaagcacaaccaaccaaaagtcttgaagaaaacaaatctctcaaagagcagaaaaagttaaatgatctgtgttttctgaaacgccttcttcaggaaattaagacctgttggaataaaatactcatgggaacaaaagagcac

SEQ ID NO: 14851 - DNA, 531 bp, Artificial Sequence
  Description of Artificial Sequence: Synthetic coding sequence
atgtttcatgtttccttccgctacatcttcggtctgcccccccttatcctggtgctgcttcctgtggcctccagtgattgcgacatcgaaggcaaggatggcaagcagtacgaatcggtgttgatggtttcaatagatcagttgctcgactccatgaaggaaataggctcgaattgcctcaacaatgagtttaatttcttcaaacggcacatatgcgatgcaaataaagagggtatgttcctcttccgcgcggccagaaagctccgccaattcttgaagatgaatagcaccggagatttcgatcttcatttgctgaaagtctcggagggcactacaatcttgcttaattgcactggtcaggtgaaaggcagaaagccagctgccctgggcgaagcccagccaaccaagtccttggaggaaaacaagagtttaaaggaacagaagaaactcaatgatctttgctttttgaagcgtttgctccaggaaatcaaaacgtgctggaacaagattctgatgggaaccaaggagcac

SEQ ID NO: 14852 - DNA, 531 bp, Artificial Sequence
  Description of Artificial Sequence: Synthetic coding sequence
atgttccacgtttctttccggtatatcttcggcttgccccctctgatccttgtgctcctgccagtcgcatcctcagactgtgatattgagggaaaagacggcaagcagtacgagagcgtgctgatggtctctatcgaccagcttctggacagtatgaaggaaattggcagcaactgcctgaacaacgagttcaacttttttaagagacatatttgtgacgctaacaaagagggcatgttcctcttcagggcagcccgaaaactgagacagttcctgaaaatgaattctaccggggacttcgatctgcacctgctgaaggtgtcagagggtacaacaatccttcttaactgtacagggcaggtgaagggcagaaagccagctgccctgggagaggcacagcccacgaagagtttagaggaaaataaatcacttaaggagcaaaaaaaactcaacgacctctgctttctaaaaaggctgcttcaggaaatcaagacctgctggaataagattctcatgggaactaaagaacat

SEQ ID NO: 14853 - DNA, 531 bp, Artificial Sequence
  Description of Artificial Sequence: Synthetic coding sequence
atgttccatgtcagtttcaggtatatctttgggctgcctcccttaatcctggtgctgttgcctgtggcctcgtccgactgcgatattgagggcaaggacggtaagcagtatgagtccgtgcttatggtgtctatcgatcaattgctcgactctatgaaggaaataggttctaactgtctgaataatgaatttaacttttttaagcggcacatttgtgacgctaataaggagggcatgttcttatttcgggccgcccggaaattgcggcagtttctgaaaatgaatagcacaggagatttcgatttgcatctgctgaaagtcagtgagggaaccacaatcctgctgaattgcactggacaggtcaagggaaggaaacccgctgctctgggcgaagctcagcccaccaagagcctggaggagaataagtcgctcaaagaacagaaaaagctgaatgatctctgttttttgaaaaggctgcttcaggagatcaaaacctgctggaacaagattctgatgggtacaaaggagcat

SEQ ID NO: 14854 - DNA, 531 bp, Artificial Sequence; identical to SEQ ID NO: 14825
  Description of Artificial Sequence: Synthetic coding sequence

SEQ ID NO: 14855 - DNA, 531 bp, Artificial Sequence
  Description of Artificial Sequence: Synthetic coding sequence
atgttccacgtttcattcaggtacatcttcgggctgccgcctcttattctggtgctgctgccagtggcaagcagcgattgcgacattgagggtaaggatggaaagcagtatgagtctgtgttgatggtgtccatcgatcagctgctggattccatgaaggagattgggtctaactgcttgaacaatgaattcaatttttttaagaggcacatctgcgatgcgaacaaagagggcatgtttctgttccgcgctgcgcgtaagttgagacagtttctcaagatgaactcgacaggagattttgatctgcatctgcttaaggtaagtgagggcacgacaattctgctgaattgtactgggcaggtgaaggggaggaagcccgccgccctaggggaggctcaacccacaaaatcacttgaggaaaacaagtcgcttaaggaacagaagaaactcaacgatctgtgctttctgaagaggctcctgcaggaaataaaaacatgctggaacaaaatccttatgggcaccaaggagcac

SEQ ID NO: 14856 - DNA, 531 bp, Artificial Sequence
  Description of Artificial Sequence: Synthetic coding sequence
atgttccacgtgtctttccgctacatcttcggcttgccacccctaatcttggttttactccccgtggccagcagcgactgcgatatagaaggcaaagatggtaagcagtatgaaagtgtgctcatggtctcaatcgatcagctcctggattcgatgaaagagatcggttctaactgtctcaacaatgaatttaattttttcaagcggcatatttgtgacgccaacaaggaggggatgttcctctttagagctgcaaggaagctacgacagttcctcaaaatgaacagtacaggagacttcgacctgcaccttctgaaagtgtcagagggtaccaccattttgcttaactgtacaggacaggttaaagggcgtaagcctgctgccctcggagaggcacaacctactaagtccctcgaggagaataaaagcctgaaagagcagaagaagcttaacgatctgtgcttcctgaaacggctcctgcaggaaatcaaaacgtgttggaacaaaattctgatgggcacaaaggaacat

SEQ ID NO: 14857 - DNA, 531 bp, Artificial Sequence
  Description of Artificial Sequence: Synthetic coding sequence
atgttccatgtctccttcagatacatattcgggctcccaccgcttatcttggtgctgctgccagtggcaagctccgactgtgatattgaaggcaaggacggaaaacagtacgagtcagttttgatggtgagcatagaccagttgctcgacagtatgaaagaaattggctctaactgcctgaacaacgagtttaattttttcaaacggcatatatgtgacgccaacaaagaaggaatgttcctcttccgcgcagctagaaaactgaggcagttcctcaagatgaacagtacgggcgattttgacttgcacttgcttaaagtgagcgaaggcaccaccattttgctgaactgcaccggccaggttaagggtcggaaacccgctgctctgggggaggctcagcctactaaaagtctggaggagaataaaagccttaaggagcagaagaaattgaacgacctgtgtttcctgaagagactgctgcaggagataaagacgtgttggaataagatcctcatgggaacaaaggagcac

SEQ ID NO: 14858 - DNA, 531 bp, Artificial Sequence
  Description of Artificial Sequence: Synthetic coding sequence
atgttccacgtgtcattcagatacatattcggcctgccgccactcattcttgtcctgttgcctgtcgcctcttcagattgtgacatcgagggcaaggatgggaagcagtatgagtccgtactgatggtttctatcgatcagctgctagactctatgaaggaaataggatccaattgtctcaacaatgaattcaacttctttaagaggcacatctgcgacgcaaataaagagggcatgttcctctttagggccgctcgcaagctgcgtcagttcctgaaaatgaactctactggtgattttgatcttcacctgctgaaagtgtcagaggggactacaatcctgttgaactgtaccggtcaggtgaagggacgaaagcctgccgctctgggtgaggctcagccaaccaagtctctagaagagaacaaaagtctcaaggagcagaaaaagctgaacgacctttgttttctcaagcggctgctgcaggagattaaaacctgctggaataagatcctcatggggacaaaagaacat

SEQ ID NO: 14859 - DNA, 531 bp, Artificial Sequence
  Description of Artificial Sequence: Synthetic coding sequence
atgtttcatgtgagctttagatacatttttggcctaccccctctgattctcgtattgttacctgttgcatcaagtgactgtgacatagagggtaaagatggaaagcagtatgaatccgtattgatggtctccatcgatcagttactggatagcatgaaggagatcggctctaactgcttgaacaacgagttcaacttttttaagaggcacatctgcgacgctaacaaagaggggatgtttctgtttagagctgctcgcaaactgcggcaatttcttaaaatgaactccactggggactttgacttacacctgcttaaggtgagcgaaggaaccacgattctattgaattgcaccggacaggtgaaagggcgcaaacccgctgctctgggcgaagctcagcccacaaaatcgttggaagaaaataagtctctgaaggagcagaagaagcttaatgatttatgtttcttgaagcgcctgctccaggagattaagacgtgctggaataagatcctgatggggaccaaagaacat

SEQ ID NO: 14860 - DNA, 531 bp, Artificial Sequence
  Description of Artificial Sequence: Synthetic coding sequence
atgttccatgtgtcctttcgctacatctttggtcttcctcccttaattttggtgttgctcccggtggcgagcagcgactgtgacatagagggcaaagacggaaaacagtatgagagcgtactaatggtgagcattgatcagttgctggatagcatgaaagaaatcggatccaattgcctgaataatgaattcaattttttcaagcggcatatctgcgatgcaaataaagaggggatgttcctgttccgagcggctcgaaagctacgccagttcctgaagatgaactcgactggtgactttgatctccatctgctgaaggtgagcgagggtaccaccatccttcttaattgcaccggacaggtgaagggcaggaagcctgctgcactgggcgaggcgcagccaacgaagtcactggaggagaacaaatctctgaaggagcagaaaaaactcaatgatctgtgtttcctgaaaaggctgctccaggagataaaaacctgctggaataaaatcctcatggggaccaaagagcac

SEQ ID NO: 14861 - DNA, 819 bp, Artificial Sequence
  Description of Artificial Sequence: Synthetic coding sequence
atgaagaagacccagacctggatactgacatgcatctatttgcagcttcttctgttcaacccgctcgtcaagactgagggcatttgcagaaatcgcgtcacaaacaatgttaaggatgtgacaaagttggttgccaacctccctaaagattatatgatcactctgaaatacgtccccgggatggacgtgctgccctcccattgctggataagcgagatggtggtccagctctccgacagcctgacagaccttctggataagttttctaacatttcagagggtcttagtaattattccatcatcgataagctggtgaacatagtagacgatctggtggagtgtgtgaaggagaatagcagcaaggacctgaaaaagagcttcaaatcccctgagcccaggctcttcactccggaagaatttttcaggattttcaatcgaagcatcgatgcattcaaggatttcgtagtagcttctgagacaagcgattgtgtcgtcagttccacactctcacccgagaaggacagtagggtttccgtgaccaagccatttatgctgccccctgtggccgcatcttctctgcgcaatgactcctcaagttccaatagaaaggccaaaaacccccccggggattctagccttcattgggccgccatggccctgcccgcactgttctcccttatcatcgggttcgccttcggcgccctgtattggaagaagcggcagccatccctgactagggccgtcgagaacatccagataaatgaggaggacaatgagatctctatgctgcaagaaaaagaaagagaatttcaggaggta

SEQ ID NO: 14862 - DNA, 819 bp, Artificial Sequence
  Description of Artificial Sequence: Synthetic coding sequence
atgaagaagacccagacctggattttgacctgtatttacctgcaacttttgcttttcaaccccctggttaagacagaggggatctgtcgcaatcgcgtcacgaacaacgtcaaagacgtgacgaaactggttgcaaacctgccgaaggactacatgatcacccttaaatatgtgccaggtatggacgtgctgccatcccattgctggataagtgaaatggtggtgcagctatccgacagcctgactgacttactggataaattctctaatatttctgaggggctgagtaactactctattatcgacaaactagtgaatattgtcgacgacctcgtggaatgtgtgaaagaaaactctagcaaagacttaaagaagagttttaagtcacccgagcccagactttttactcccgaagagtttttccgtatcttcaaccggtctatagatgcattcaaggactttgtggttgcgtcggagacgagcgactgcgtggtgtcctccacgctgtcaccggagaaggatagtcgggtatccgttaccaaacctttcatgcttcccccagtcgcagcctctagtctgagaaacgactcatctagctctaatcgaaaagccaagaaccctccaggagactcatcactgcattgggctgctatggcactgcctgctttgttctccctgatcatcgggttcgcgtttggagctttgtactggaaaaagcgccagccttcgctgactagagcagttgaaaatattcagataaacgaggaagataatgagatctccatgctacaggagaaagaacgcgagtttcaggaggtg

SEQ ID NO: 14863 - DNA, 819 bp, Artificial Sequence
  Description of Artificial Sequence: Synthetic coding sequence
atgaagaagacacaaacctggatccttacctgcatctacctccagcttttactcttcaatccactagtgaagacagagggaatttgccggaacagagtgacaaacaatgtcaaagacgtgacaaagctggttgccaatctgcctaaggattacatgatcaccctgaagtacgtgccggggatggacgttctgcctagtcattgctggattagcgagatggtggtccagttgtcagacagcctgactgatttactcgataaattttctaatataagcgagggcctctccaattactctattattgataaactggttaacatcgttgatgacctggtcgagtgcgtgaaagagaatagctcaaaagacctgaagaagagcttcaaatcacctgagcctcgtctgtttacacctgaggaattctttaggatattcaatcggagcattgatgctttcaaggatttcgtggtggccagcgagacaagcgactgtgtggtcagttctaccctgtcaccggagaaagactcccgtgtgtctgttaccaagcctttcatgctcccgcccgtcgctgcatcctccctgaggaacgattccagcagttctaacaggaaggctaagaatccccctggcgatagcagcctccactgggccgccatggcccttcccgctcttttcagcttgattattggcttcgcctttggtgccctgtattggaaaaaacggcagcctagcctcacgcgtgcagttgagaacatccaaatcaatgaagaggataatgagatttccatgctgcaggaaaaggagcgtgagttccaggaggtc

SEQ ID NO: 14864 - DNA, 819 bp, Artificial Sequence
  Description of Artificial Sequence: Synthetic coding sequence
atgaaaaagactcagacgtggattcttacctgtatctaccttcagcttcttctgtttaaccctttggtgaaaacggaagggatctgccgcaatagagtgaccaacaacgtgaaggatgtgaccaagctggtcgccaacctgcccaaagattacatgattactctcaaatacgtccccggaatggatgtgctcccttcacattgttggatctccgaaatggtcgtgcaactttcggattcccttactgacctgcttgataagtttagcaacatctccgaaggactttccaattactcgattattgataaacttgtgaatattgtcgatgatctggtcgaatgtgtgaaggaaaactcgagcaaggatttgaagaagagctttaagtcccctgagccacgcctttttactcctgaagaattctttcgaattttcaacagatcgattgatgcatttaaggactttgtcgttgcctcggaaacttcggattgtgttgtctcgtccactctgagcccagaaaaagacagcagagtgtccgtgactaaaccattcatgctcccacctgtcgcggcctcctcccttcggaatgacagctccagttcgaatcggaaagccaaaaatccacccggtgactcgtcgctgcactgggctgccatggcccttccagccctcttttcactcatcatcggattcgcattcggtgcactttactggaagaaaaggcaaccttcacttactcgggcagtggagaacattcagattaacgaagaagataacgagatctcgatgctgcaagaaaaagagagagagttccaagaagtg

SEQ ID NO: 14865 - DNA, 819 bp, Artificial Sequence
  Description of Artificial Sequence: Synthetic coding sequence
atgaagaaaacccagacttggatactaacctgcatttatctgcagttgctcctatttaatcctctggtgaaaacggagggcatctgtcggaacagggtgacaaacaacgtcaaggacgtgactaagctggtcgcaaatctgcctaaagactatatgataacattgaagtacgtcccgggcatggatgtgctcccatcccattgttggatctccgaaatggtagttcagctcagcgatagcctgacagacctcctggataaattcagcaacatcagcgagggactctccaactactcaatcatagacaagctggtaaatatagtggatgatttggttgaatgtgtgaaagagaactcgtccaaggatctcaagaagtccttcaagagtccagaaccccgtctgttcacccctgaggagttttttcgtatatttaaccgttccatagacgcctttaaggatttcgttgtggcctcagagaccagtgactgcgtcgtgtcgtctaccttgtcccctgagaaggactctcgagtgtcagtgacgaaaccattcatgctgcctcccgtggctgcaagttcattgaggaacgactcctccagcagtaatcgcaaagctaagaatcccccaggcgactcttcgctgcactgggcagccatggctctgcctgcactgttctcactcataattgggtttgcatttggggcactgtactggaaaaaacggcagccttctctgacgagagccgtggaaaacattcaaattaacgaggaggacaatgagatcagtatgctgcaggaaaaggaacgagaattccaggaggtt

SEQ ID NO: 14866 - DNA, 819 bp, Artificial Sequence
  Description of Artificial Sequence: Synthetic coding sequence
atgaaaaagactcaaacttggattctcacttgcatctacctgcagttgctccttttcaacccgctggtgaaaactgaaggaatctgccgcaatcgggtgacgaacaatgtgaaggatgtgaccaagctggtggcgaacctcccgaaggactacatgattacgctgaagtacgtgccgggaatggatgtgctcccgtcgcattgctggatttcagagatggtggtgcaacttagcgactcactgaccgatctgttggacaagttcagtaatatcagcgaaggattgtcaaattacagcataatcgataagctggtgaacattgtagacgacctcgtggagtgcgtcaaggagaattcctcgaaagacctcaagaagtcattcaagtcgcccgagcccagacttttcacgcccgaggagttcttcagaatctttaacagatcgatcgatgcattcaaggacttcgttgtcgcaagcgaaacctccgactgtgtggtgagcagcaccctgagcccggagaaggactccagagtgtctgttactaagcctttcatgctgccgccggtcgcggctagttcgctccgcaacgactcgagctcctcaaaccgaaaggcgaaaaaccctccaggcgacagctcactccactgggcagccatggccctcccggcactgttttcactcatcatcggcttcgcgttcggggccctgtactggaagaagcggcaaccgtcgctgacgcgcgctgtggaaaacatccagatcaatgaagaagataacgaaatctccatgctgcaggaaaaggagcgcgagtttcaggaagtg

SEQ ID NO: 14867 - DNA, 819 bp, Artificial Sequence; identical to SEQ ID NO: 14862
  Description of Artificial Sequence: Synthetic coding sequence

SEQ ID NO: 14868 - DNA, 819 bp, Artificial Sequence
  Description of Artificial Sequence: Synthetic coding sequence
atgaagaagacccagacatggatccttacctgtatttatctccagctgctcctcttcaacccgctcgttaagaccgagggaatttgccgcaacagagtgaccaacaacgtcaaggacgtaactaagctggttgccaacctccccaaggattacatgatcactctgaagtacgtcccaggtatggacgtgctgccttcccactgttggatttccgagatggtagtacaactgtctgacagcctgacggacctgttggacaagttttctaacatctctgaaggactgtccaattactcaatcattgataagcttgtcaatatcgtggacgatctcgttgaatgcgttaaggagaatagctccaaggacctgaaaaagagctttaaaagtccagaacccaggctgttcacccctgaggaatttttcaggatctttaacaggtcaatcgatgcattcaaggacttcgtggtggctagcgagactagcgactgtgtggtttcttccaccctgagtcccgaaaaagattcacgcgttagcgttactaaaccgttcatgttgccaccagtggccgccagcagcctcaggaatgattcaagttcatcaaatagaaaagcgaagaaccctccaggcgactcttcattgcactgggcagccatggctctgcccgctctgttctcactgattattggattcgcctttggtgcactctactggaagaagagacaaccatcactgacccgcgccgtggaaaacatccagatcaacgaagaggataatgagatatccatgctgcaagagaaggagagggagtttcaggaggtg

SEQ ID NO: 14869 - DNA, 819 bp, Artificial Sequence
  Description of Artificial Sequence: Synthetic coding sequence
atgaagaaaacacagacttggatcctgacctgcatttatctccagcttctgctttttaacccactggtcaaaactgagggtatatgtcgaaatagagtgacaaataatgtaaaagacgtgacaaaactagtggctaatctgcccaaagactatatgattactctcaagtacgtgcccggaatggatgtactcccaagtcactgttggatctctgaaatggtggtgcagctaagtgatagtttgacggatctcctcgacaaattttcaaatatatcggaggggctgagtaattattcaataatcgacaagcttgtgaatattgtggacgacctggtggagtgtgtaaaagagaattcatctaaagatttgaagaagagcttcaagtctccggagcctaggttgttcacacctgaagaattttttcggatctttaatcgcagtatcgatgccttcaaagatttcgtagtggccagcgaaacatcagattgtgtggtaagctctacactgtcccccgagaaagattccagagtaagtgtaactaagccgtttatgttgcctccagtagccgccagctcccttcgcaatgatagctcttcatccaacaggaaagctaaaaatccccctggggactcctctctgcattgggctgccatggctctgccggcattgttctcactcattatcggtttcgcctttggcgccctgtactggaagaagcggcagccatccctgacacgtgccgtcgaaaacatccagatcaatgaagaagacaacgagatctccatgcttcaggagaaggaaagagagtttcaggaagtg

SEQ ID NO: 14870 - DNA, 819 bp, Artificial Sequence
  Description of Artificial Sequence: Synthetic coding sequence
atgaaaaagacgcagacctggatcctgacttgcatttatctgcaactgctcctctttaatccgttggtgaaaaccgaggggatctgtcgcaatcgggtgaccaacaacgtgaaagatgtcaccaagctggttgcaaatcttccaaaggattacatgatcaccctgaagtacgttcctggaatggacgtcctccctagccattgctggatcagtgagatggtggtgcaactttcggactccctgactgacctgctggacaaattctcgaacatttcggagggattgtccaattactcgatcatagacaagctggtgaacatcgtggacgacttggtggaatgcgtgaaagaaaactccagcaaggacttgaagaagtccttcaaatcgccggaaccgagattgttcactccagaagaattctttcggatcttcaaccgatcgatcgacgctttcaaggactttgtcgtcgcgtcagagacttcggactgcgtggtttctagcaccctctcgcccgaaaaggactcacgggtatccgtcactaagccattcatgctgcctcccgtggctgcatcgagccttcggaatgactcgtcaagctcaaatcggaaggccaagaatccgccgggcgattcatcgctgcattgggccgcaatggccctcccagccctgttcagcctgattatcggattcgccttcggagcactgtattggaagaagcggcagccgtccctcacgcgcgcagtggaaaacatccagatcaatgaggaggacaatgagatctcaatgctgcaggaaaaagaacgcgagttccaggaggtc

SEQ ID NO: 14871 - DNA, 819 bp, Artificial Sequence
  Description of Artificial Sequence: Synthetic coding sequence
atgaaaaagactcagacgtggattctgacgtgtatataccttcaacttctccttttcaacccgcttgtcaagactgagggcatctgtcgcaatagggtgactaacaatgtcaaagatgtgaccaagctggtggcaaatctccctaaagactacatgatcacgttgaagtacgtgcctggaatggacgtgctgccatcccattgctggatatcagaaatggtcgtccagctctcggattcgcttactgatctgctggataagttctcgaatatctcggaaggtctgtcgaattactccatcattgataaacttgtcaacattgtcgacgatctggtggaatgcgtcaaggagaacagctccaaggatctgaagaaatcgtttaagtcgcctgaacccagactctttaccccagaggaattcttccgcattttcaatagatcgattgacgcattcaaagattttgtggtcgcgtccgaaacttcggattgtgtggtgtcctctaccctttcccccgaaaaggattcacgcgtgtcagtgactaagccgttcatgcttcctccggtggctgcctcgtcgttgagaaacgactcgtcgtcctccaatcgtaaagccaaaaatcccccaggggattcatcactccattgggcagcgatggcactgcccgcacttttctcactgattattggcttcgcctttggtgctctgtactggaagaagaggcaaccatcgctcaccagggcagtggaaaacattcagatcaacgaagaagataatgaaatctcgatgttgcaagaaaaagaacgggagttccaggaagtg

SEQ ID NO: 14872 - DNA, 819 bp, Artificial Sequence
  Description of Artificial Sequence: Synthetic coding sequence
atgaaaaagacccaaacttggattctcacctgtatatacctccaactgcttttgtttaacccgctcgttaagacggagggtatttgtaggaaccgcgtgaccaacaatgtgaaggatgtgaccaagctggtggcaaatctcccaaaggactacatgattaccctgaaatatgtgcctggtatggatgtgctcccatcccattgttggatatcggaaatggtggtgcagctctcagatagccttactgatctgctggataagttcagcaacatttccgagggcttgagcaactactctatcattgataagttggtcaacatcgtggacgatctggtggaatgcgtgaaggaaaattcgtcaaaggatctgaagaaatcattcaagtcacccgaaccaaggctgtttactccagaggaattctttaggatctttaaccgatccattgacgcattcaaagattttgtggtcgcgtcagaaacttccgattgtgtcgtgtcatccacccttagtccagagaaggatagcagggtgtccgttacgaaaccatttatgctgccgcctgtggctgctagctccctcagaaacgactcatcgtcatcgaatagaaaggctaagaacccacctggtgactcctctctgcattgggcagcaatggccctgccggcgctgtttagccttatcatcggattcgcattcggagccctttactggaagaaaagacagccatcattgacccgtgcagtggagaatattcaaatcaacgaagaagataatgaaatttccatgctccaggagaaggaaagagaattccaagaggtc

SEQ ID NO: 14873 - DNA, 819 bp, Artificial Sequence
  Description of Artificial Sequence: Synthetic coding sequence
atgaagaaaacgcagacttggatcctaacctgcatctacctgcaactcctgttgttcaatcccttagtgaaaacagaaggcatctgccgtaacagagttacaaacaacgttaaagatgtgacaaagttggtggctaatcttccgaaggattacatgattacactgaagtacgtgcccggcatggatgtgctcccatcgcattgctggatctcggagatggtggtgcagttgtctgactccttgacagatctgcttgataaattttcgaacatcagcgagggcctctccaactactccatcattgataagctggtcaacattgtggatgatttggttgagtgcgtgaaggagaacagtagcaaggacctgaagaagtcctttaaatcaccggaacccaggctgttcacccctgaagaattttttcggatttttaatcgctcgatcgacgcattcaaagactttgtcgtggcatccgagacttccgactgcgtggtgagtagcaccctttcgccggagaaggattcccgcgtgtcggtcactaaaccatttatgcttccgccggtggccgcttcttctctgagaaacgatagtagcagttccaatcgcaaagccaaaaacccccccggagattcttcgctgcactgggctgctatggctttgcccgcactgttcagcttgatcattggatttgcatttggcgcactgtattggaaaaaacgtcagccgtccctgacgcgcgccgtggagaatattcaaataaatgaggaagataacgagatttcgatgctgcaggaaaaagagcgggagtttcaagaagtc

SEQ ID NO: 14874 - DNA, 819 bp, Artificial Sequence
  Description of Artificial Sequence: Synthetic coding sequence
atgaagaagacgcagacttggattcttacctgcatttatctacagctgctactatttaatccattggtgaagacagagggcatctgtagaaatcgagtaactaacaatgtcaaagatgttacaaaactagtcgccaacttaccaaaagattatatgataaccctcaagtatgttcccggtatggacgttctgccttcacactgttggatttccgagatggtagtgcagctttccgatagccttacagacctactcgacaaatttagcaatatcagtgaggggctgagtaattactcaattatagataagctcgttaacattgtggacgacctcgttgagtgtgtgaaagaaaactcctccaaggacctgaaaaagtcctttaaaagtcccgaacccaggttattcacgcctgaagagtttttcagaatcttcaacaggtcaatagacgccttcaaggatttcgtggttgcgtctgaaacctctgactgcgtggtgagttccaccctgagtcccgaaaaagactcgcgggtgtccgtgaccaaacccttcatgcttccccccgttgcggcctcctcattgcggaacgactctagtagttctaaccgcaaggctaagaacccgcccggagactcaagcctgcattgggctgccatggccctgcccgccctttttagcttgataatcggattcgcatttggcgctctttattggaagaagcggcagccatctctgacaagagccgttgaaaacatccaaatcaatgaggaggacaatgagatatccatgctacaggaaaaggagcgggaatttcaggaagta

SEQ ID NO: 14875 - DNA, 819 bp, Artificial Sequence
  Description of Artificial Sequence: Synthetic coding sequence
atgaaaaagacccagacttggattctgacttgtatctacttgcaactattgctattcaatcccctggttaaaacagaaggtatctgcagaaaccgggtgactaataacgtgaaagacgtgactaaactcgtggccaacctgcccaaagattacatgatcaccttaaaatacgttccggggatggacgttctaccatctcattgttggattagtgagatggtggtgcagttgtctgattcgttgactgatctgctcgataagtttagtaacatctccgaaggtctctccaactattcgataatagacaagctagtcaacattgtagatgacctggtggaatgcgttaaggagaactcctcaaaagaccttaaaaagtccttcaaatctccagagccgcgactgtttacccctgaggaattcttcaggatcttcaacaggagtatcgatgcattcaaagattttgtcgttgcttcagaaaccagtgattgtgtggtcagctccacacttagccctgagaaggatagccgggtttccgtgaccaaacctttcatgcttcccccggtggctgctagcagtcttagaaacgactctagttccagtaaccgaaaggccaagaatccccccggcgatagcagtctgcactgggctgctatggcgcttccagcgttgttcagccttattatcggcttcgcattcggtgccctgtattggaaaaagcgccagccaagcctcactcgggctgtggagaacatacagataaatgaggaagataatgagataagtatgctccaagagaaagagcgggagttccaagaagtg

SEQ ID NO: 14876 - DNA, 819 bp, Artificial Sequence
  Description of Artificial Sequence: Synthetic coding sequence
atgaaaaagacccaaacctggatcctgacctgcatctacctgcaactcttgctgtttaatcctctcgtcaagactgaaggtatctgcagaaatcgtgtcaccaacaacgtgaaggacgttactaagctggtcgctaacctgccgaaagactacatgatcactctgaagtacgtcccgggaatggatgtgttgccatcacattgttggatttccgaaatggtggttcagctgtccgactcgctgaccgacctcctggataagttctccaacatctcagaggggctgtcgaactactccatcatcgataagttggtgaacatcgtggacgatctggtggaatgtgtgaaggagaactcgtccaaggacctcaaaaaatcgttcaaaagcccagaaccgcggctcttcactcccgaggaattcttccgcattttcaacaggtctatcgatgcgtttaaggacttcgtcgtggcgtcggaaacctcagactgcgtggtgagctcaactctgtcacccgagaaggattcgcgcgtgagcgtcactaagccttttatgctcccgccagtcgctgccagcagccttcggaatgacagctcgtccagcaatcgcaaggctaagaaccctcctggcgactcgagcctgcattgggcagccatggcactccccgcgctgttctcccttataatcgggttcgcgttcggagccctgtactggaaaaagcgccagccgtccctcacccgcgctgtggaaaatatccagattaacgaggaagacaatgaaatctcaatgctccaggaaaaggaaagggaattccaggaagtg

SEQ ID NO: 14877 - DNA, 819 bp, Artificial Sequence
  Description of Artificial Sequence: Synthetic coding sequence
atgaaaaaaacacaaacctggatcctaacgtgtatttatttgcagcttttgttgttcaacccgttggttaagacggagggcatatgtagaaacagagtgaccaataacgtgaaagatgtgactaagcttgtcgccaaccttcctaaggactatatgatcactttgaaatacgtccccggaatggacgtcttgccttcgcactgctggatttcggaaatggtcgtgcagctcagtgattcattaacagacttgttggataaattcagcaacatctcagaaggtttaagtaactattcaatcattgacaagctcgtgaatattgtcgacgatttggttgaatgtgtgaaggagaactcatcaaaggacctcaagaaatcgttcaaatcaccagagccgaggttgttcaccccagaggagttctttcgcattttcaacagatcgattgatgcctttaaggatttcgtggttgcatcggagacatccgactgtgttgtgtcttcgacactatcaccggaaaaagacagcagggtgagtgtgaccaagcccttcatgcttcctccagtcgcagcttcttccctaaggaatgattcttccagtagcaatcggaaagctaaaaacccaccaggagatagttcgctgcattgggcggcaatggcccttccagcccttttttcgttgatcattggatttgcattcggtgctctctactggaaaaagcggcaaccatctctcactcgtgctgttgaaaatatccaaataaacgaagaggacaatgagatctctatgttacaagaaaaagaacgggaatttcaagaagtt

SEQ ID NO: 14878 - DNA, 819 bp, Artificial Sequence
  Description of Artificial Sequence: Synthetic coding sequence
atgaagaaaactcagacttggatactcacatgcatatatctgcagctcctgttgtttaacccacttgtaaaaaccgaaggaatctgccgaaatcgagtgaccaataacgtcaaggacgtgacgaagttggtcgccaacctacccaaagactatatgattacacttaagtacgtccccggcatggatgtcttgccaagccattgctggatctcagaaatggttgtgcaactcagtgacagtctgaccgatctgctggataaattctctaatattagtgaggggttgagcaactactctatcatcgataaattggtgaacattgtggacgacctcgtcgaatgtgtgaaggaaaattcctccaaagatctaaagaagtcttttaagtcccctgaaccaaggctgttcaccccagaggaattcttccggattttcaatagaagtattgatgcgttcaaggattttgtcgtagcaagcgagacaagtgattgcgtggtttcatctaccctgtctccagagaaagattcacgggtatctgtaactaaaccctttatgttgccaccggtggccgcctcatcacttagaaatgacagctcatcctcaaatcgaaaggcaaaaaatccccccggcgactcgtccctgcactgggctgcgatggcactccccgcgttgttctcacttatcataggcttcgctttcggtgccctttactggaaaaagcgacaacctagtctgactagggccgtggaaaatatacagatcaacgaggaggataatgagatctccatgttgcaagagaaggaaagagagtttcaggaagtc

SEQ ID NO: 14879 - DNA, 819 bp, Artificial Sequence
  Description of Artificial Sequence: Synthetic coding sequence
atgaagaagacccagacttggattctgacttgtatttacctacagcttctgctctttaatcccctggtcaagaccgagggcatctgcagaaatcgggtaaccaacaacgtcaaagatgtcacaaaattggtggccaatctaccaaaggattacatgattaccctgaaatacgtccctggcatggatgttttaccaagtcattgctggatatccgaaatggtcgtgcagctgagcgactcattgactgacctgctggacaagtttagcaatatcagtgagggactctccaattactccataattgacaagctggtcaacattgtcgacgacttagttgagtgtgtgaaggagaacagttctaaggatctgaagaagtcttttaaatccccagaaccacggctgtttacccctgaagaattcttcaggatcttcaacagaagcattgatgccttcaaggacttcgtggtagcttccgagacttccgattgcgttgttagcagtactctgtccccagagaaggatagccgggttagcgttaccaagcctttcatgctgccaccagtggctgcctcctctttacgcaatgacagctcaagcagtaaccgcaaggccaagaatcctcccggtgatagtagtctacactgggccgctatggctctgcctgccctgttctcattaattatcgggttcgctttcggcgccttatattggaaaaaaagacagccatcattaactagagccgtggagaatatacagatcaatgaggaggataacgaaatatcaatgctgcaggaaaaggaacgagagttccaagaggtt

SEQ ID NO: 14880 - DNA, 819 bp, Artificial Sequence
  Description of Artificial Sequence: Synthetic coding sequence
atgaaaaagacccaaacttggattcttacttgcatatacctccaactgcttctgtttaaccctcttgttaagaccgagggcatctgccgaaatagagtgactaataacgtgaaagatgtgaccaagctggtcgcaaacctgccgaaagactacatgattacgcttaagtacgtgccaggaatggacgtgttgccaagccactgctggatctcggaaatggtggtccaacttagcgattcgctcaccgatctccttgacaagtttagcaacatttccgagggattgtcaaactactcaatcattgacaaacttgtcaacattgtggacgatctggtggagtgcgtcaaggaaaactcgtcgaaggatcttaagaagtcattcaagtcgccagagcctagactgttcacccccgaggaattcttccgcatctttaacagatcaatcgacgcatttaaggatttcgtggtcgcgtccgaaacttccgattgcgtcgtgtcctccactctttcccctgaaaaggatagtcgggtttccgtgaccaagccattcatgctgcctcctgtcgccgcgtcgtcacttaggaacgactcctcgtccagcaataggaaagccaagaaccccccaggtgattcgtcgcttcattgggcagcaatggcgttgcctgcactgtttagcttgattataggatttgcatttggtgcactttactggaaaaagaggcaaccctccttgactagggccgtggagaatattcagatcaacgaggaagataacgaaattagcatgcttcaggaaaaagagcgcgagtttcaagaagtg

SEQ ID NO: 14881 - DNA, 819 bp, Artificial Sequence
  Description of Artificial Sequence: Synthetic coding sequence
atgaagaaaacccagacctggatcctgacctgtatctacctgcagcttctgctgttcaatcctctggtcaagactgagggaatctgccgcaaccgggtcaccaataatgtcaaagatgtgaccaagctcgtcgccaaccttcctaaggactacatgattacgcttaagtatgtgcctggaatggacgtgctgccttcacactgctggatctccgaaatggtggtgcagttgtcggattcgctgaccgatctgctggacaagttctcgaatatctccgaaggactgtccaactattctatcatcgataagctcgtcaatatcgtcgatgatctggtggaatgtgtgaaggaaaactcgtccaaggatttgaaaaagagcttcaaatcgccggaaccccggctgttcactccggaagagttttttcggatcttcaaccggtccatcgatgccttcaaagacttcgtggtggcgagcgaaactagcgattgcgtggtgtcatcgaccctgtcaccggaaaaagactcacgagttagcgtgacgaagccttttatgctcccgcccgtggccgcatcgtccctcaggaacgactcgtcatcgtctaatagaaaggccaagaacccaccaggggacagcagcttgcactgggcggcgatggctcttccagctctttttagcctgatcatcggatttgccttcggagctctgtactggaagaaaagacagccttcgctcacccgggctgtggagaacatccagattaacgaagaggacaatgaaatctcgatgctccaagaaaaggagcgcgagttccaggaggtg

SEQ ID NO: 14882 - DNA, 819 bp, Artificial Sequence
  Description of Artificial Sequence: Synthetic coding sequence
atgaaaaagacccagacttggattctcacctgcatttacctgcagctgctgctcttcaaccctctggtcaagactgagggcatatgccgtaaccgggtgactaacaatgtgaaggatgtgaccaagctggtcgccaatcttcctaaggattacatgataactttgaaatacgtgccagggatggacgtgcttccgtcccactgttggatttccgaaatggtcgtgcaactttctgactccctgacggatctccttgataagttttcgaacatttcggaaggcctttcaaactactccattatagataaacttgttaacatagtggacgatctggtggagtgtgtgaaggagaattcgtccaaggatctcaaaaagtccttcaagtcccccgagccgcgcctttttacccctgaggaattcttcagaatcttcaaccgtagcattgatgcttttaaggacttcgtggtcgcctcggagacttcggattgcgttgtctcgtcaaccctgtcccctgaaaaagactcgcgggtgagcgtgaccaagccatttatgcttcctcctgtggcagcctcgtccctgagaaacgattcctccagctcgaaccgaaaggctaagaacccacctggagattcgtcactgcattgggcagcgatggcgcttccagcactgttttcactgatcatcggttttgctttcggcgcgctttattggaagaagcggcaaccttcgcttactagagcagtcgaaaacatccagattaatgaagaggacaacgaaatctccatgctccaggaaaaggaacgggagttccaagaagtc

SEQ ID NO: 14883 - DNA, 819 bp, Artificial Sequence
  Description of Artificial Sequence: Synthetic coding sequence
atgaaaaagacccagacctggatcctcacgtgcatctacttgcagctccttctttttaatccattagtaaagaccgagggcatctgccgtaatcgggtcaccaataatgtgaaggacgtgaccaaactggtggcaaaccttccaaaggactacatgatcacactaaaatacgtgccggggatggatgttctgccctctcactgctggataagcgagatggttgtacagctgtctgactcactgactgatctgttggataagttctccaatatcagcgaaggcttgagcaattacagcattattgacaagctcgtgaatattgtggatgatctagtggagtgtgtaaaagaaaactcaagtaaagacctgaagaagtccttcaagtcccctgaacccaggctgttcacccccgaggaattttttcggatcttcaatcggtccatagacgcatttaaggattttgtggtagcctccgagacatccgactgtgtggtaagcagtacgttgtctcctgaaaaagacagccgcgtgagtgtcacaaaaccgtttatgttacctcctgtggccgcctctagtctgcgcaacgattcttctagctcgaaccgaaaagccaaaaaccctccgggagacagcagcctgcactgggctgccatggccctgccggcgctgttcagcctgatcattgggttcgcgttcggtgccttatattggaagaaacgccagccatccctgacgcgcgcggttgaaaacatccagataaacgaggaagataacgagatttcaatgctgcaagaaaaagagcgggaattccaggaggtc

SEQ ID NO: 14884 - DNA, 819 bp, Artificial Sequence
  Description of Artificial Sequence: Synthetic coding sequence
atgaaaaagacccaaacctggattcttacctgtatctacctccaactcttgcttttcaacccacttgtcaagaccgaaggaatttgccggaacagagtgaccaacaatgtcaaagatgtgactaagctcgtcgcaaaccttcctaaggattacatgattacccttaagtacgtccctggaatggacgtgctcccctcgcattgttggatctcggagatggtcgtgcagctcagtgattctctgaccgacctcttggataagttttccaacatttcggaaggcctgtcgaattactccatcattgacaaactggtgaatatcgtggacgaccttgtggaatgcgtgaaggagaactcctccaaagaccttaagaagtcgttcaaatctccagaaccccgcttgtttactcctgaggagttttttcgcattttcaatcggtcaatagatgcattcaaagattttgtcgttgcatctgaaacttcagactgcgtcgtctctagcactctttccccagaaaaggattccagagtgtccgtcaccaaaccctttatgctgccgcctgttgcggcgtcctcacttcgcaatgacagctcctcatcgaaccggaaggcaaaaaaccctccaggagactcgagcctgcattgggccgcaatggctctgcctgcccttttcagccttatcataggattcgcatttggagcactctactggaaaaagaggcaaccttcgctgacccgtgctgtggaaaacatacagatcaacgaggaagataacgaaatttccatgctccaagagaaggagagagaatttcaagaggtg

SEQ ID NO: 14885 - DNA, 819 bp, Artificial Sequence
  Description of Artificial Sequence: Synthetic coding sequence
atgaaaaaaacccagacatggatcttaacatgcatctatctacagctgctgctgttcaatcccttggtgaagaccgaggggatatgccggaatcgagttaccaacaatgtgaaggacgtcacaaagttagtggctaacctccctaaagattacatgataacattaaaatacgtgcccgggatggatgtcctgccatcccactgttggatatccgaaatggtggtacaactgtctgactcactcacagacctcttggataaattctcaaatatatcagaaggtctctctaattatagtatcatcgataagctcgtgaatattgttgacgatctggtggaatgtgtgaaagaaaactcttctaaggaccttaagaaatcatttaagtctcccgagcccagactcttcactcctgaagagtttttccggattttcaaccggagcattgatgcgttcaaggacttcgtggtggcatccgaaacgtccgactgtgtggtatctagcacgttgtcaccagagaaggactccagagtttctgtgacaaagcctttcatgctgccgccggtcgcggcttcctcgctccgcaatgattcaagcagctccaatcgtaaagctaaaaatccacccggcgacagtagtctgcattgggctgctatggctctccctgctttgtttagcctcatcattgggttcgcattcggggccctgtactggaagaagcggcagccttccctgacccgcgccgtcgaaaatattcaaatcaacgaggaagacaacgagatttctatgcttcaggagaaggagcgagagtttcaggaagtg

SEQ ID NO: 14886 - DNA, 819 bp, Artificial Sequence
  Description of Artificial Sequence: Synthetic coding sequence
atgaaaaagactcagacctggattctgacctgcatttatctgcagctccttcttttcaaccctctggtgaaaactgagggaatttgccggaacagagtgacgaataatgtgaaggatgtcactaagctggtggcaaatcttccaaaagattacatgatcactctgaagtacgtcccaggaatggacgtgttgccttcgcattgctggatctctgaaatggtggtccaattgagcgattcactgaccgatcttcttgataagttttcgaacatctccgaaggtctgtcgaattactccattattgacaaacttgtgaatattgtcgacgacctggtggaatgcgtgaaggaaaacagctcaaaggatctgaagaaatcgtttaagtcgcctgaacctcgcctctttacccctgaagagttttttcgtatctttaatcgttcgatcgatgcgttcaaggattttgtggtcgcatcggagacgtccgactgtgtggtgtcctccactctgtcccctgaaaaggattcaagagtgtcggtgactaagccattcatgctgccacccgtggcagccagctccctgcggaacgactctagctcgtcaaatcggaaagcaaagaaccccccaggagactcctctttgcattgggctgctatggcactgccagcactgttttcgcttatcattggatttgcgtttggcgcactttactggaagaagagacaaccctcactgactagagcagtggagaacatccagataaacgaggaagataacgaaatcagcatgcttcaagagaaggagagagagtttcaagaagtc

SEQ ID NO: 14887 - DNA, 819 bp, Artificial Sequence
  Description of Artificial Sequence: Synthetic coding sequence
atgaagaaaactcaaacctggatcctgacttgcatatacttgcaactgcttctcttcaacccgctggtcaagacggagggaatctgtcgcaaccgggtgactaacaacgttaaagatgtgaccaagctcgtggccaatctgcccaaggactatatgattactctgaagtacgtcccaggaatggacgttcttccatcccactgctggatcagcgagatggtggtccagctgtccgactcacttaccgacctgctcgataagttctcgaacatttctgagggactctcgaactattcaatcatcgacaagctggtcaacatcgttgacgacttggtcgagtgcgtgaaagaaaattcatccaaggacctgaaaaagtcctttaagtcgcctgaaccgcgcctgttcaccccggaggaattcttccggattttcaaccgctcgatcgatgcgtttaaagacttcgtggtggcctccgagactagcgactgcgtggtgtcgtcaactttgtcgccggaaaaggatagcagagtgtcagtgactaagccatttatgctgccgccggtcgcggcgtcctcgctccgcaatgattcaagctcctccaaccgcaaagcgaagaaccctccgggtgattcctcgctgcactgggcagcgatggccctgccagctctgttttccctgatcatcggttttgcgttcggcgccctgtactggaagaaacgccaacccagcttgacgcgcgcggtggaaaacatccagattaatgaagaggacaacgaaatctccatgctccaggaaaaagagcgcgagttccaggaggtc

SEQ ID NO: 14888 - DNA, 819 bp, Artificial Sequence
  Description of Artificial Sequence: Synthetic coding sequence
atgaagaaaacccagacttggattctcacctgtatctaccttcagctccttttgttcaaccctctggtgaaaaccgaaggaatttgtagaaaccgcgtaaccaataatgtgaaagatgtgactaaattggttgctaatctgcctaaggattacatgattactctcaaatacgtccctggaatggacgtcctcccgtcacactgctggatctcggaaatggtcgtccaactgagcgattctctcaccgaccttcttgacaagttttcgaacatttccgaaggcctgagcaactactcaatcatagacaaattggttaacatcgtggatgatcttgtggagtgtgtgaaggaaaacagcagcaaggatctcaagaagtcctttaagtccccggaaccccgtctgtttacccctgaagagttcttccggatctttaacagatcgatcgatgcatttaaggactttgttgtcgcatctgaaacttcggattgtgtggtgagctcaactctttcgcccgagaaagattctagggtgtcagtgactaaaccatttatgcttcctccagtggctgcatccagcctcagaaatgatagctcatcatcaaacagaaaggcgaaaaacccgccaggtgacagctccctgcattgggcagcgatggctcttcctgcgctcttctccttgattataggatttgcatttggagccctctactggaagaaacgacagccatccctcacccgagcagtcgaaaacattcaaatcaacgaggaagataacgagatctccatgttgcaggagaaggaaagagaattccaagaagtg

SEQ ID NO: 14889 - DNA, 819 bp, Artificial Sequence
  Description of Artificial Sequence: Synthetic coding sequence
atgaaaaagacacaaacctggatactgacctgtatctacctccagctgttgctgttcaatcccctcgtgaaaacggaagggatatgccgcaaccgggtgacaaacaacgttaaggatgtcacaaagctggtggccaaccttcctaaggactatatgatcaccctgaagtacgtacccgggatggatgtgctaccctcacactgctggatcagtgagatggttgtgcagcttagcgactccctgacagatctgctggataaattctctaacatctcagagggactttccaattactccatcatagacaagctggtgaatattgtggatgaccttgtcgaatgcgtgaaagagaacagcagcaaggatctgaaaaaaagctttaaatcccctgaacctcggttgttcacccccgaagaattcttcagaatcttcaatagatcaatcgacgccttcaaagattttgtggtggcatcagagacttccgactgcgtggtctcttccactctgagtcccgaaaaagactcaagggtctcagtgacaaaacccttcatgctccctcccgtggcggcatcttctcttaggaacgacagctcctccagcaatcggaaagccaagaacccgcccggcgactcctctcttcactgggctgccatggctcttccggccctgttcagtctgataatcgggttcgcatttggggccctctattggaaaaagcgccagcccagccttaccagggccgtcgagaacatccagataaatgaggaggataatgaaatcagtatgctacaggaaaaagaaagggagtttcaggaggtg

SEQ ID NO: 14890 - DNA, 819 bp, Artificial Sequence
  Description of Artificial Sequence: Synthetic coding sequence
atgaagaaaacccaaacctggatcttgacttgtatctaccttcagctgctgctgttcaacccgctggtcaagacggaaggaatttgccgcaatcgcgttaccaacaacgtcaaggacgtaaccaagctcgtggcgaacctccccaaggactacatgatcacgctcaagtacgtgccgggcatggacgtgttgccatcgcactgctggatttcggaaatggtggtgcagttgtcagacagccttactgatcttctggataagttctccaacatatcagaaggactgtctaattactcgatcatcgataaactggtgaacatcgtggacgacctggtggaatgcgtcaaggagaattcctctaaggacctgaagaagagtttcaaatcaccggaacctcggctgttcaccccggaggagtttttcagaatctttaaccgctcgatcgatgcctttaaagatttcgtcgtggcctccgagacttccgactgcgtggtatcgtcaaccctctcgccggagaaggactcgcgggtgtccgtgactaagccattcatgctgccaccagttgctgcaagctcactcaggaacgattccagctccagtaacagaaaagccaagaaccctccgggtgacagttctctccattgggcagcgatggccctccccgcgctgttctcacttatcatcggattcgcctttggggctctctattggaaaaagcggcaaccttcgcttactcgtgcagtcgagaatatccagattaatgaggaagataatgaaatctccatgctgcaagaaaaggagcgagaattccaggaagtg

SEQ ID NO: 14891 - DNA, 819 bp, Artificial Sequence
  Description of Artificial Sequence: Synthetic coding sequence
atgaaaaaaacccagacatggatactgacctgtatttatctgcagttactgctgttcaaccccttggttaaaacggagggtatctgtcgcaatcgggtgaccaataatgtcaaggatgtgactaagctggtggcaaacctgcctaaggactacatgatcaccctgaaatatgtgcccggcatggatgtgctccctagtcactgctggatttcagaaatggtggttcagctaagcgactccttaacagacctgctggataagttctcgaacatatctgaagggctgtccaattacagtatcatagataagctagtaaatatcgtcgacgacttagtggagtgcgtcaaggaaaacagttctaaggatttgaaaaagagtttcaagtcacctgagccccggctgtttacaccagaggagttctttcggatattcaatcgcagcattgatgcattcaaggacttcgttgtcgctagtgagactagcgactgtgtggtgtccagcactctgtcaccggaaaaggactctcgggtttccgtaacaaagcccttcatgctgccgcccgttgccgcctcctcgctgagaaatgattcatcttcttcaaatcgcaaggccaagaaccctccgggcgacagcagcctacactgggcagcaatggcgctccccgctctattctctctgatcatcggatttgcctttggtgcgttatattggaaaaagcgccaacccagtctcactcgggcggtcgaaaacatccagattaatgaggaagataacgagatctcaatgcttcaggagaaagaacgggagttccaggaggtg

SEQ ID NO: 14892 - DNA, 819 bp, Artificial Sequence
  Description of Artificial Sequence: Synthetic coding sequence
atgaaaaagactcagacctggatcctcacttgcatttatctccaactactgctgttcaatccgctggtcaaaacagagggcatctgtcggaaccgagtgacaaataatgtgaaggacgtgaccaagttggtagcaaatttgcctaaggattatatgattaccctcaaatacgtgccgggcatggatgttctgcctagccactgttggatttcagagatggtagtgcagctttccgatagcctgactgatctgctcgacaaattttcgaatatctctgaaggactcagcaactattccatcatcgacaagctcgtgaatatcgtggatgacctggtagagtgcgtgaaagaaaactcctcaaaggaccttaaaaagtcttttaaatctcctgagcctcgacttttcaccccagaagaattcttcagaatttttaacaggtccatcgacgccttcaaggactttgttgttgcgtcagagacaagcgactgtgtggtcagctccacactgagcccagagaaagactctcgtgtgtctgtcaccaaaccttttatgctcccacctgtggctgcaagcagtcttcgcaatgacagttctagctccaatcggaaggccaaaaacccacctggtgactcgtcactacattgggctgccatggcgttgcctgccctcttttctctaataatcgggtttgctttcggggcgctgtattggaaaaagaggcagccatccctgaccagagctgtggagaatatccagataaatgaggaggacaatgagatatctatgctgcaagagaaagaacgagagtttcaagaagtc

SEQ ID NO: 14893 - DNA, 819 bp, Artificial Sequence
  Description of Artificial Sequence: Synthetic coding sequence
atgaaaaaaactcagacctggattcttacctgtatatatctgcagcttctcttgttcaaccccctcgtgaaaacagaaggcatctgtcgcaaccgtgtgactaacaatgtgaaagatgtgaccaagctcgtagcgaatctgcctaaggactacatgataacactcaaatatgttcctggcatggacgtcctgccgagccactgctggatctcagagatggttgtccagctgagcgattctttgaccgatctattggataagttctcgaacatcagtgagggactttcaaattacagcattattgataagctcgtgaacattgtcgacgacttagtggaatgcgtcaaggaaaactcaagcaaagatctcaaaaagtcatttaaatcgccggagcccagattgtttacccctgaagaattcttccgcatctttaaccggagcatcgatgcctttaaggacttcgtcgtggcatcagagacgtcagattgtgtggtttcatccactctgtcgccagaaaaagattcaagagtctcagtgaccaaacctttcatgctcccaccagtcgccgccagttctttgcgaaacgattcttcgagtagtaaccgtaaggcgaagaacccgcccggcgactcgtccctccattgggccgcaatggcactgccagctctgttcagtctaattattgggtttgcctttggggcgctatactggaaaaaaaggcagcctagcttaacccgcgctgtggaaaatattcagattaatgaggaggataatgagatctcgatgctacaagaaaaggaacgtgagttccaagaagtc

SEQ ID NO: 14894 - DNA, 819 bp, Artificial Sequence
  Description of Artificial Sequence: Synthetic coding sequence
atgaaaaagacccagacctggattctgacctgtatctacctgcaactgcttttgtttaatcctcttgtgaaaaccgaagggatttgcagaaatcgcgtgaccaataacgtgaaggacgtgaccaagctggtggctaacctgcccaaggactacatgattactcttaagtatgtccccggaatggacgtgctgccttcgcattgttggatctccgagatggtcgtgcaactctccgactcgctgactgaccttttggataagttttcaaacatttcggagggactctccaactacagcataatcgataagctggtgaatatcgtggatgatctggtggagtgtgtgaaagaaaacagctcgaaggatttgaaaaagtccttcaaatcaccagaaccccgactttttactcctgaggaattctttcgaatattcaatcgatccatcgatgcattcaaggatttcgtggtggcctcagaaacttccgattgcgtggtatcttccacgttgagccccgaaaaggactcccgcgtgagcgtgactaaacctttcatgctgccacctgtcgcagcgagttctctgcggaacgattcctcatcctccaacagaaaggcaaagaaccctccaggcgactcctcgttgcactgggccgcaatggcacttcccgcacttttttcactcattattggtttcgcatttggtgcactgtactggaagaaaagacagccatccctgacccgcgctgtcgagaatatccagatcaacgaagaggataacgaaatctcgatgctgcaagaaaaggagcgcgaattccaagaagtg

SEQ ID NO: 14895 - DNA, 819 bp, Artificial Sequence
  Description of Artificial Sequence: Synthetic coding sequence
atgaaaaaaacacagacatggatcctcacatgtatatatctgcagctgttactatttaatcctttagtgaaaacagaagggatctgtcgtaaccgggtaactaacaatgtgaaggatgtcacaaaactcgtggccaatttacccaaagattatatgataacgttaaaatatgtacccgggatggatgttcttcccagtcattgctggatctctgaaatggtggtgcagctatcggattcactcactgatctcctcgacaaattttccaacatttctgaggggctttcaaactatagtataatcgataaacttgtaaatattgtggatgatctcgtcgaatgtgtgaaagagaattcctcgaaagatctgaagaaatctttcaaaagtcctgagcctaggctgttcacacccgaagaatttttcaggatctttaaccggtcaatcgatgcattcaaggattttgtcgtagcttcagaaacaagtgattgcgtagtgtcctccactctctcaccagagaaagactctagggtgtccgtaactaaacccttcatgcttcctcccgttgctgcatcctcactacggaatgattccagttcctctaacagaaaagcaaaaaacccccctggggattcaagtctgcattgggctgctatggctctaccagctctgttctctctgataattggatttgccttcggagctctctactggaaaaaacggcaaccctccttgacaagggccgtcgaaaacatacagattaatgaagaagataacgaaatatccatgctccaggaaaaagaacgggaattccaggaagtc

SEQ ID NO: 14896 - DNA, 819 bp, Artificial Sequence
  Description of Artificial Sequence: Synthetic coding sequence
atgaaaaagacccaaacttggatcttgacttgtatttacctgcagctgctgcttttcaacccgctggttaagactgagggaatctgtcggaacagagtcaccaacaatgtgaaagatgtcactaagctcgtcgctaacctcccaaaggactatatgattaccctcaaatacgtacctggaatggatgtgctgccgtcacactgctggatatccgagatggtggtgcaactgtccgacagccttaccgatctcctcgacaaattctcaaatatcagcgagggtttgagtaactactcgatcattgataagctggtgaacatcgtggacgatttggtcgaatgcgtaaaggagaactcgtcgaaggatttgaaaaagtcgtttaagtcgcccgagccgcggctgtttacgccggaagaattctttcggatcttcaatcgatcaatcgacgcattcaaagatttcgtggtggcctctgaaacgtccgactgcgtcgtctcctcaactctgtccccagagaaggattccagagtctccgtgactaagcctttcatgctccctccggtggctgcctccagccttcgcaacgactcgtcgagctccaaccgcaaggccaaaaatccgccgggggactcatctctgcattgggctgcaatggcactgccggcacttttctcactgatcatcggattcgccttcggcgcgctgtactggaagaagcggcagccgtccctgacccgcgccgtggaaaacatccagataaatgaagaggacaatgagatcagcatgctgcaagagaaagagagagaatttcaggaagtg

SEQ ID NO: 14897 - DNA, 819 bp, Artificial Sequence
  Description of Artificial Sequence: Synthetic coding sequence
atgaagaagactcagacatggattctgacctgcatctatctccagttgttgctgtttaaccctctagtgaagacagagggcatatgtcgcaaccgcgtgaccaacaacgtcaaggacgtcactaagctggtggccaacctacccaaagattacatgatcactctcaagtatgtgcccgggatggatgtgctaccaagtcactgctggatcagcgagatggttgtgcaactgtccgatagcttgactgacttgctggataaattctctaatatttccgaagggttaagcaattattcgattattgataagctcgtgaacatcgtcgatgatctggttgaatgtgttaaggagaattcaagcaaagatcttaagaagtcatttaagagtcccgagcctcgattgtttacccccgaggagttcttcaggatcttcaatcgctcaatcgatgctttcaaggacttcgtggtggcctctgaaacatctgattgcgtggtctcctccacactgtccccagagaaggatagtagggtaagtgtcaccaagccgttcatgctgccacctgtggctgcttcctcccttagaaatgacagttcttccagcaatcggaaggccaagaatccccctggtgacagcagcctacactgggccgccatggcattgcctgctttgttttcgctgataatagggttcgcattcggagctttgtattggaagaaaaggcaaccgtcattgaccagggccgtcgagaatatccagatcaatgaagaggacaatgagatcagtatgctccaggaaaaagagcgcgagttccaggaagtg

SEQ ID NO: 14898 - DNA, 819 bp, Artificial Sequence
  Description of Artificial Sequence: Synthetic coding sequence
atgaagaaaactcaaacctggatcctgacgtgcatctatttacagttgctcctgtttaatccccttgttaagaccgaaggcatatgtcgcaaccgcgtcactaataatgtaaaggatgtgaccaagctggtagccaacctacctaaagattacatgataactctgaagtacgtgcccggtatggatgtcctgccaagtcattgttggatttcagagatggtagttcagctgtccgattcactcacagatctgcttgacaaattctccaatatcagtgaaggcctttcaaactatagcataatcgacaagttggtgaatattgtcgacgatctcgtcgaatgcgtgaaggaaaattccagtaaggaccttaagaaaagttttaaaagcccagagcctaggctgttcactcccgaggagttttttaggatcttcaaccgttcaatcgatgcttttaaggatttcgtggtagctagtgagacctcagactgcgtggtgtccagtacgctctccccagaaaaagattctagggtttccgttactaagccatttatgttgcccccagtcgccgcttcttccctacgcaatgactccagctccagtaatcgcaaggcaaagaacccaccaggcgacagctctttgcactgggctgcaatggccctgcctgcgctgttcagcctgattataggttttgccttcggggccctgtattggaagaaacgccagccgtctttgacacgtgctgtggaaaatattcagatcaatgaggaagacaatgaaattagcatgctccaggagaaggagcgagaattccaggaggtg

SEQ ID NO: 14899 - DNA, 819 bp, Artificial Sequence
  Description of Artificial Sequence: Synthetic coding sequence
atgaagaaaacccagacgtggattctgacctgcatctacctgcaattactgctgtttaaccctctggtgaaaaccgagggaatctgtcgaaacagggttaccaataacgttaaagatgttactaagctggtggccaatttacctaaggactatatgatcacacttaaatatgtcccaggcatggatgttctccctagccactgctggatctctgagatggtagtgcaacttagtgactccctgacagacttactcgacaaatttagcaatatttctgagggtttgagcaattacagcatcatagataaacttgttaacatagttgacgacttagtggagtgcgtaaaggagaattctagtaaggacctgaaaaagtccttcaagtcccctgagccccgcctgttcacgcctgaggagttcttcaggatatttaatcggtcgatcgatgcatttaaagactttgtggtcgcctcggaaacctctgactgcgtggtaagttctaccctgtcccctgagaaggattccagagtgtctgtcaccaagccattcatgctaccgcctgttgcggccagctccctgaggaatgactcctctagcagcaatcggaaggcaaagaatccgccaggggactcttccctacattgggctgctatggcactgcccgccttgttctcacttatcatcggctttgccttcggagccctttactggaagaagcggcagccttcgctgacgcgtgccgtcgaaaacatccagataaatgaggaagacaatgaaatatcaatgttgcaggagaaggagagagagtttcaggaagtg

SEQ ID NO: 14900 - DNA, 819 bp, Artificial Sequence
  Description of Artificial Sequence: Synthetic coding sequence
atgaagaagacacagacatggattctgacttgtatctacctgcagctgcttcttttcaaccccctggtgaagaccgaaggaatttgccggaatagagtcaccaacaacgtaaaggatgtgacaaaactggtcgccaacctcccaaaagactatatgatcacacttaaatatgtcccgggaatggacgttctcccttcccattgttggatctccgagatggtagttcagctgtcagattctttgacagacctcctggataaattctctaacattagcgagggcctgagcaactactctattattgacaagcttgtgaatattgtagatgatcttgttgagtgtgtcaaggagaattcctctaaggatctcaaaaagagctttaagagtcctgagcctcgccttttcactcctgaggagtttttccgaatcttcaacaggtccattgatgcctttaaagactttgtggttgcctccgaaacatccgactgcgtggtgtctagcacactgtctccagagaaggacagccgggtgagcgtcaccaagccctttatgttgccgcctgtcgcggcaagctctctgaggaatgattcctcctcctctaacaggaaagctaaaaacccaccgggcgattcctctctgcactgggcagccatggctcttcccgctctgtttagtctgatcatcggattcgcctttggagccctgtactggaagaaacgccagccaagtttgacgcgcgctgttgaaaacatacagattaatgaggaggacaacgagatttccatgctgcaggaaaaggagagagagttccaggaggta

SEQ ID NO: 14901 - DNA, 819 bp, Artificial Sequence
  Description of Artificial Sequence: Synthetic coding sequence
atgaagaaaacccagacctggattctgacctgcatctacctgcagcttctgctgttcaacccgctggtgaaaaccgaaggaatctgccggaatcgggtgaccaataatgtgaaagatgtgaccaagctcgtcgctaacctcccgaaggactacatgattaccctcaagtacgtgccgggcatggacgtgctgccttcccattgctggatttcggaaatggtggtgcaactgtcggattccctgactgaccttttggacaaattctccaacatctctgaagggctctcgaactactcgattatcgacaagctcgtcaatatcgtcgatgatctggttgagtgcgtcaaggaaaactccagcaaagatttgaagaagtctttcaagtccccggagccgcgcctgttcacgcctgaagagttcttccgaatctttaaccggtccatcgacgcctttaaggatttcgtggtagcctcagaaacctcagattgcgtggtgagctccaccttgtcacctgagaaggattcgcgagtgtccgtcactaagcctttcatgctgccaccggtcgcagcaagttctctcagaaacgattcaagctcatcgaacagaaaggcgaagaaccccccgggtgactcgtccttgcactgggctgcgatggccttgccggcgctcttctccctcatcatcggattcgcctttggagcactctactggaagaagcgccagccctcgctgactcgcgcggtcgagaatatccagattaatgaggaagataacgagatctccatgctgcaggaaaaggagcgcgaattccaggaagtg

SEQ ID NO: 14902 - DNA, 819 bp, Artificial Sequence
  Description of Artificial Sequence: Synthetic coding sequence
atgaagaagactcaaacctggattctgacctgtatttacttgcaattgctattattcaaccctctggtgaagacggaggggatttgtagaaacagagttacaaacaacgttaaagacgtgactaagctcgttgctaatcttccaaaagactatatgattactctcaaatacgtcccaggcatggacgtacttccatcccattgttggatatcagaaatggtggtacagctatccgattcactgactgatctactggataaattcagcaacatttccgagggcttgagcaactactccataattgacaagttggtaaacatagtggatgatctagtcgaatgtgtgaaggaaaattcctccaaggacctgaaaaagtcctttaaaagccctgagccaagattgttcactcccgaggagttctttaggatcttcaaccggtccattgacgctttcaaggactttgttgtggcttctgagaccagtgattgcgttgtgtcctcaacactcagccccgagaaggactctcgtgtgtcagtgactaagccctttatgctgccaccagtggccgcttcaagcctgcggaacgacagtagctcctccaatagaaaagctaaaaatcccccaggcgactcaagccttcactgggcagcaatggctcttccagcgctattctcccttatcatagggtttgcatttggcgccctgtattggaagaagcggcagccaagtctgacccgagctgtcgagaatatacagatcaacgaagaagacaatgaaattagcatgctgcaagaaaaggaacgggaatttcaggaagta

SEQ ID NO: 14903 - DNA, 819 bp, Artificial Sequence
  Description of Artificial Sequence: Synthetic coding sequence
atgaagaaaactcaaacgtggatcttgacctgtatctaccttcagcttctgcttttcaatccacttgtaaagaccgagggaatttgcagaaatcgcgtgactaataacgtgaaagatgtgaccaaacttgtggcaaatctgcctaaggattacatgataactctcaaatacgtgcccgggatggatgtcctgccctctcactgttggattagcgaaatggtcgtgcaactctcggatagcttgactgaccttctcgataagttttcaaacatcagcgagggactgagcaattactcgattattgataagctcgtgaacatcgtggatgaccttgtggagtgtgtgaaggaaaattcatcgaaggacctcaagaagtccttcaagtcccccgagccacgtctgttcacgccagaagagtttttcagaatctttaacagatcgattgacgcctttaaggactttgtggtggcaagcgagactagcgactgtgtggtgtccagcactctgtcgcccgagaaagactcccgcgtgtcggtcaccaagccttttatgcttcctccggtggcggcatcctcgcttaggaatgatagctcgtcgtccaacagaaaggctaagaaccctccaggtgatagctctctgcactgggccgcaatggcactgcctgcgctgttctcattgatcattggatttgcatttggagcactgtactggaaaaagagacagccgagcttgactcgagccgtggagaacattcaaatcaacgaagaagataatgaaatcagcatgctccaagaaaaggaaagagaatttcaggaagtg

SEQ ID NO: 14904 - DNA, 819 bp, Artificial Sequence
  Description of Artificial Sequence: Synthetic coding sequence
atgaagaagacacagacttggattcttacgtgcatctatttgcagctgttgttattcaaccctctcgtgaaaacggaggggatatgtcgcaatagagtaacaaacaatgttaaagacgtgaccaaactggtggccaacctgcccaaagactatatgattactctgaaatacgtgccaggaatggacgttctgcctagtcactgttggatatcagaaatggtcgtccagttgtctgactcacttaccgatctccttgataaattctccaatatctctgaaggactttccaattactccattatcgacaagcttgtgaacatcgtcgatgacttagtggaatgtgttaaagagaacagctcaaaggaccttaagaaaagttttaagtcaccagagccccgtctgtttactcccgaagagttttttcgtatcttcaatagatctattgacgccttcaaagactttgtggtcgcttcagagacctcagactgcgtcgtctcatctactttatcaccagaaaaggatagccgcgtcagcgtcacaaaacctttcatgttgccaccagtcgctgcttcttcgctaaggaacgattcgagctcttccaataggaaggccaaaaatccccccggggattcaagcctacactgggctgctatggcgctaccagcgttattttctctgatcatcggctttgcattcggcgccttgtattggaaaaagcgccaaccctctctgacccgagccgtggaaaatatacagatcaatgaagaagacaacgagatctcaatgttgcaggagaaggaaagggagttccaggaagtc

SEQ ID NO: 14905 - DNA, 819 bp, Artificial Sequence
  Description of Artificial Sequence: Synthetic coding sequence
atgaaaaagacacagacgtggattttgacctgtatctatctgcagttactgctgtttaatccactcgtcaagacagaggggatctgtaggaaccgagttaccaacaacgtgaaggacgtcaccaagttggttgccaatctgcctaaggactatatgatcaccttgaaatatgtccccggcatggacgtactgccctcacattgctggatcagtgaaatggtcgtacagttgtctgatagtctcacagacctcctggacaaatttagtaatatctcagaagggctgtccaattactctattattgataaattggtaaacatcgtggatgacctagtagaatgcgtaaaggaaaatagctcaaaagatcttaaaaaatcattcaagtccccagagccgagactttttacaccagaagagtttttccgcatatttaaccggtccatcgatgcattcaaagatttcgtcgtggcgtctgagacatccgactgtgtcgtatccagcacactttccccggaaaaagatagtcgcgtgtccgtgaccaaaccctttatgcttcctcccgtcgctgcatcttctttgcgcaatgactccagttcatccaaccggaaggcaaaaaatccaccaggagactcctccctgcactgggcggccatggcccttcctgcccttttctccctgataatcgggttcgcgtttggcgcactgtactggaaaaagcgccaacctagcctgactcgcgcagtggaaaatatacagatcaatgaggaagacaatgagataagtatgctgcaggaaaaagagagggaattccaggaggtg

SEQ ID NO: 14906 - DNA, 819 bp, Artificial Sequence
  Description of Artificial Sequence: Synthetic coding sequence
atgaagaaaacgcaaacttggatccttacctgtatttacctgcagcttctgctctttaacccactcgtcaaaacggagggcatttgcagaaatcgggtcactaacaacgtcaaagatgttactaagctggtcgcaaatcttcccaaggattacatgatcactcttaagtatgtgccgggaatggatgtgcttccgtcgcattgttggattagcgaaatggtggtccaactttcggactccttgaccgatctcctcgataagttttccaacatttcggaaggactcagcaactactccatcatcgataagctggtgaacattgtggatgacctggtcgaatgtgtgaaggagaattcctcgaaggatctgaaaaagtcattcaaatcgcccgagccacgtctgttcacgccggaagagttttttcggatcttcaaccgctcgatcgatgcgttcaaagatttcgtcgtggcatccgaaacttcggattgcgtggtgagctctaccctgagcccagagaaggattcaagagtgtctgtgaccaagccttttatgcttcctccagtggcagcgtcgtctctgagaaacgattcctccagctcgaatagaaaagccaagaatcctcctggtgactcatccttgcactgggcggctatggctctgcctgcactttttagcctcataattggatttgcgtttggcgctttgtactggaagaagcgacagccatcactgaccagggcagtggagaatattcaaatcaatgaggaagataatgagatctcgatgctccaggaaaaagaaagggagtttcaagaagtc

SEQ ID NO: 14907 - DNA, 819 bp, Artificial Sequence
  Description of Artificial Sequence: Synthetic coding sequence
atgaaaaagacccagacatggatcttaacgtgtatatatctccaactgctgctgtttaacccccttgttaaaaccgaaggcatttgtcggaacagggtaacaaataatgtcaaggacgtgactaaactagtagccaatctgcctaaggattatatgatcacgctcaagtacgtgccaggcatggatgtcctaccgagtcactgttggatcagcgaaatggtggtgcagttatcagacagtcttactgacctgctggacaagtttagtaacatcagtgagggtctctctaactactcaattatcgataagctggtaaacatcgtcgatgacttagtggagtgcgtaaaagaaaattccagcaaggatctcaaaaagtccttcaagagtcctgagccacggctctttacccctgaggaatttttccgtatcttcaatcggtccatagatgcctttaaggactttgtggtcgcctccgaaactagcgattgcgtggtgtcatccaccctttccccagaaaaggattccagggtgtcagtgacgaagcctttcatgttaccccctgttgccgcgagtagcctccgtaatgacagctcttctagtaatagaaaggctaagaatcccccaggcgattcctcccttcattgggctgccatggcgcttcccgcattatttagcctcataatcggttttgccttcggggctctgtactggaaaaagcggcagccttctctgactcgagcagttgaaaacatccagatcaacgaggaggacaacgaaatctccatgttgcaggagaaagaacgcgagttccaggaagtg

SEQ ID NO: 14908 - DNA, 819 bp, Artificial Sequence
  Description of Artificial Sequence: Synthetic coding sequence
atgaagaagacccagacttggattctgacctgcatctacctgcaacttctcctgttcaacccattggtcaagacggagggcatctgccggaaccgtgttactaacaacgttaaggatgttacaaaactagtcgcaaatctgcccaaggactatatgatcactcttaaatatgtgcccggtatggacgtcctgcctagtcattgctggatttccgagatggtggtacagctgtcagacagtctgacggatctgctggacaaattctctaacatcagtgaggggctgagtaactattccattattgataagctagtaaacatcgttgatgacctagtagaatgcgtgaaagaaaattcttccaaggacctcaaaaaaagcttcaagtctcctgagccaagattatttacacccgaggagtttttcaggatttttaatcgttcgatcgatgccttcaaagactttgtcgtcgcctcagagacgagtgattgtgtcgtgtcctctaccctctcccccgagaaagacagtagagtttctgtcacgaaaccctttatgcttccacccgtggccgcttcatccctgcggaacgactcaagctcctcgaatcgtaaagccaaaaatccccccggagatagcagtttacattgggcagccatggccttgcccgcgctgttttcactaattatcggatttgcgtttggcgctttgtactggaagaaaaggcagccatctctcacgcgcgcagttgagaatattcagatcaacgaggaagacaatgagataagcatgctgcaagaaaaggagagggaattccaggaagtc

SEQ ID NO: 14909 - DNA, 819 bp, Artificial Sequence
  Description of Artificial Sequence: Synthetic coding sequence
atgaaaaaaactcagacttggattctcacatgtatctatctccagcttctactctttaatcccctcgtgaaaactgaaggaatatgccgaaaccgggttacgaacaatgtaaaggacgtcactaaactggttgcaaacctgcccaaggattacatgataacactcaaatatgtgccagggatggacgtacttccttcgcattgttggataagtgaaatggtggtccagctgtctgactccctaacagatctattggataagtttagtaacatatcagaagggctatcaaactactctataatcgataaacttgtcaatatcgttgatgatttggtggaatgtgtcaaagaaaattcctcaaaagatctgaaaaagagtttcaaatcacctgaaccacggctgttcactcctgaagagttctttagaatctttaatagatctatcgatgcctttaaagacttcgttgtggcctctgaaacttccgactgtgttgtctcgtctactctctcgcctgaaaaagattctagagtgtctgtaactaaaccttttatgttacctcccgtagcagcaagttctttacgcaatgattcttcatcaagtaaccgaaaagccaaaaacccaccaggggattcttcattgcattgggctgcaatggctttaccagcccttttttcactcatcattgggtttgccttcggagccctctattggaaaaaaagacagccttcactcacacgggctgtggaaaatatccaaataaacgaggaagataacgaaatatcaatgctacaggagaaagagcgagaattccaggaagtg

SEQ ID NO: 14910 - DNA, 819 bp, Artificial Sequence
  Description of Artificial Sequence: Synthetic coding sequence
atgaagaaaacgcaaacctggatactcacttgtatctacctgcaactgctgttgtttaacccactggtgaaaactgaaggaatctgcaggaatcgggtgactaacaacgtgaaagatgtcactaagctggtggcgaatctccctaaggactacatgattacgctgaagtacgtgcccgggatggatgtgctcccatcccattgttggatctcagaaatggtggtgcagctttcggacagcctgactgacctgcttgataagttctcaaacatctcggaagggctctcgaactactctattatcgacaagctggtcaatattgtggacgatctggtggaatgcgtgaaggaaaactcctcaaaggatctcaagaagagctttaagtccccggaaccccggctctttacccctgaggaattctttcgtatcttcaatagatccattgatgcattcaaagattttgtcgtggcgtcggagactagcgattgcgtcgtgtcgagcacgctgtcgcccgaaaaggactccagagtgtccgtgactaaaccattcatgctgcctcccgtggctgcctcgtcccttcgaaacgactcgagctcgtccaaccgaaaggcgaagaacccacctggtgattcctcgcttcactgggcagctatggcactgcccgcgctcttctcactgatcatcggatttgcatttggagccctttactggaagaagagacagccttcgcttacccgggcggtggaaaacatccagatcaacgaagaagataatgagatttcgatgctccaagaaaaagagagagaatttcaagaggtg

SEQ ID NO: 14911 - DNA, 819 bp, Artificial Sequence
  Description of Artificial Sequence: Synthetic coding sequence
atgaagaaaacccaaacctggattcttacttgtatttacctgcagcttcttcttttcaatccgctcgtcaaaactgaaggaatttgtcggaatcgggtcacgaataatgtcaaggacgtcactaagctggtcgcgaacctgcctaaggactacatgattactctcaaatacgtgcccggaatggatgtgctgccttcgcattgttggatcagcgaaatggtggtccagctttcggactccctcacggatttgctggataagtttagcaatatctccgaaggtctgtcgaattactcgattatcgataagctggtcaatatcgtggacgacctggtcgaatgcgttaaagaaaactctagtaaggatcttaagaagtcgtttaagtcgccggagcctcgcttgttcaccccggaggagttctttagaattttcaacagaagcattgatgcgtttaaagactttgtcgtggcatcagagacttcggattgtgtggtgagctcaacgctctcgcccgaaaaggattcaagagtgtcggtgaccaaaccatttatgctccctcctgtggctgcatcatcgctgcggaacgacagctcctcgtccaaccgaaaggcgaaaaacccaccgggtgactcttccctccactgggcggccatggcgcttcccgccctgttctcgctgatcatcggctttgcatttggtgcactgtactggaaaaagcgacaacctagcttgaccagggccgtggagaatattcaaatcaatgaggaggataacgaaatctccatgcttcaagaaaaggaaagagagtttcaagaagtg

SEQ ID NO: 14912 - DNA, 819 bp, Artificial Sequence
  Description of Artificial Sequence: Synthetic coding sequence
atgaaaaagacccagacctggattctgacttgtatatacctgcagctcctgctgtttaatcctctcgtgaaaaccgaaggaatctgtcgcaatagagtgaccaacaacgtcaaggatgtcactaagctggttgcaaaccttcccaaggattacatgattactctcaagtacgtgccagggatggacgtccttccttctcattgctggatctcggaaatggtggtgcaactctccgacagcctgaccgatcttcttgacaaattctccaatatctcggaaggcctgagcaactactcgataattgataaactggtgaatattgtggatgatctcgtcgaatgtgtcaaggaaaacagctcaaaggacttgaagaaatcatttaagtcgcctgaacctcggctgtttaccccggaggaattcttccgcatctttaatcgatcaatcgatgcatttaaggattttgtggtggcgtcggaaacttcggattgcgtggtcagttcgaccctgagcccggagaaggattcccgggtatcagtcaccaaacccttcatgcttcctcctgtggcagcatcgagcctgagaaatgattcctcatcatccaacaggaaagccaagaatcctcctggagattccagccttcactgggcggccatggcactgccggcgttgttttcactcatcattggttttgcatttggtgcactgtactggaaaaagcggcagccttcgctgacccgggccgtcgagaatattcaaatcaatgaagaggataacgagatcagcatgttgcaggagaaggaacgggaatttcaagaggtc

SEQ ID NO: 14913 - DNA, 819 bp, Artificial Sequence
  Description of Artificial Sequence: Synthetic coding sequence
atgaagaagacacagacctggattctgacttgtatctacctccagctgctgctgttcaaccctctcgtgaagacagagggaatctgccggaacagggtcacaaacaacgtgaaagacgttaccaagttagtagcaaatctgccgaaagactacatgatcaccttaaaatacgtaccgggtatggacgtactgccttctcattgctggatttcagaaatggtagtgcaactgtccgatagcctcactgacctgctggacaaattctcgaacatcagcgaagggctgtcaaattacagcattattgataagttggtgaatattgtcgatgatctcgtggagtgtgtaaaggaaaacagtagtaaagatttgaagaagagcttcaagtcaccagagcccagactctttactcctgaagaattcttccgaatattcaataggagcatcgatgcctttaaggacttcgtcgttgcttcggagacctccgactgtgtcgtctcttccacgttgtccccggagaaagatagtagggttagtgtcactaagccgttcatgctccctcccgttgctgcctcctccctgagaaacgattcttcttcttcaaatagaaaggctaaaaacccccctggggattcatcccttcactgggctgccatggctcttcctgccctgttttccctgatcatcgggttcgctttcggcgccctctattggaagaagcgacagccatcactgacccgcgccgtggaaaacatccagatcaatgaggaggataatgaaatctcaatgttgcaggagaaggagagggagttccaggaagtg

SEQ ID NO: 14914 - DNA, 819 bp, Artificial Sequence
  Description of Artificial Sequence: Synthetic coding sequence
atgaagaaaacccagacctggatcttgacctgtatttacctgcagctgctgctgtttaacccgttggtcaaaaccgagggtatctgccgcaatcgcgtgaccaacaacgtgaaagacgtcactaaactggttgcgaacctccctaaggactacatgatcacgttgaagtacgtgcccggaatggatgtgctgccttcgcattgctggatctccgaaatggtggtgcagctttcagactctctgactgacctgctggacaaattcagcaacatctccgagggactttcaaactactcaatcattgacaagctcgtgaatattgtagacgatctcgtggagtgcgtgaaggagaactctagcaaggatctgaagaagtccttcaagagcccggaacccagactgtttactccagaggagttttttcggatcttcaaccggtcaatcgatgcatttaaggattttgtggtcgcttcagaaacctccgactgtgtcgtctcaagcactctcagcccggagaaagactcgagagtgtcagtgactaaacctttcatgttgccgccggtggctgcgtcctcgctgagaaatgactcgtcctccagcaaccggaaggccaaaaacccgccaggagactcgtccctgcactgggccgccatggcgctgccggccctgttctccctgatcatcggctttgcgttcggggccctgtactggaagaagcgccagcccagcctgaccagagcagtagaaaacatccaaatcaacgaggaagataacgaaatctccatgcttcaagaaaaggaacgcgagttccaagaggtg

SEQ ID NO: 14915 - DNA, 819 bp, Artificial Sequence
  Description of Artificial Sequence: Synthetic coding sequence
atgaaaaagacccagacctggatcctgacgtgcatctatctgcagctgctgctattcaatccactggtgaaaaccgagggaatttgccgcaatagggttactaacaatgtcaaggacgttactaaactggttgcgaatctgcctaaagattatatgatcaccctgaagtacgttccaggaatggatgtgctgccatcccactgttggatctcggagatggtagtgcagctgagcgatagtttgacagatctcttggataagtttagcaacatctcggagggcctaagcaattactccattattgataagctggtgaacatcgtcgatgacttggtggaatgtgtgaaagaaaacagctccaaagacctgaaaaaaagctttaagagcccggagccgcgcctgtttactccagaggaattttttcgcatcttcaatcgctctatcgacgcgtttaaagactttgttgtcgcttcggaaacgtccgactgcgtggtgagctcaacgctaagccccgagaaagacagccgcgtgagcgtcacgaagccatttatgttgcccccagttgcggcgagcagcctcaggaatgacagttcaagctcgaatcgcaaagcgaagaatccaccgggggacagcagcctgcattgggcggctatggccttacccgctctgtttagcctgatcatcgggtttgcttttggcgctctgtactggaagaagcgccagccctccctgacccgtgccgttgagaacattcaaatcaacgaggaggataacgaaattagtatgctgcaggagaaggagcgggagtttcaagaggtg

SEQ ID NO: 14916 - DNA, 819 bp, Artificial Sequence
  Description of Artificial Sequence: Synthetic coding sequence
atgaagaagacacagacatggatcttgacctgcatctatttgcagttacttctgttcaacccgttggtgaagacagagggtatctgcaggaacagagttactaacaacgtaaaggacgtgaccaaactggtggcgaacctccctaaagactatatgatcactttgaagtacgtccctgggatggacgttctgcctagccactgttggatttccgaaatggtcgtgcagctctccgatagcctgacagatttgctcgataaatttagtaacatcagcgaggggctttcaaattactctatcattgataagttggttaatattgtcgatgacctcgtggaatgtgttaaggagaatagcagtaaggatctgaagaaaagtttcaagtctcctgagccgaggctgttcacaccagaggagttttttagaatcttcaaccgctctatcgacgcattcaaggactttgtggtcgccagtgagacaagcgactgcgttgttagttcgactctgtcaccggagaaggattctagagtaagcgtgaccaagccattcatgttgcctcctgtggcagccagctccctgagaaacgactcatctagctctaacagaaaggccaaaaacccgccaggcgattcttctctgcactgggctgccatggcactgcccgctctgttcagcctcatcattgggtttgcttttggtgccctgtactggaagaagagacagcccagcctgacccgagccgtggaaaatatacagatcaacgaagaagacaatgagatcagcatgctgcaggagaaggagcgcgagttccaggaggtt

SEQ ID NO: 14917 - DNA, 819 bp, Artificial Sequence
  Description of Artificial Sequence: Synthetic coding sequence
atgaagaaaacccagacttggattttgacctgcatctatctccaactgctgctgttcaatcctctcgtcaaaaccgaggggatctgccggaaccgggtgactaacaacgtaaaggacgttactaagctggtcgctaacctgccgaaagattacatgatcactctcaaatacgtaccgggaatggatgttctcccatctcattgttggatttcggaaatggtggtgcagctttccgacagcctgacggacttgttggacaagttctcaaatatctcggagggtctgagcaattactccatcatcgataagctggtgaacatcgtcgatgatttggtggaatgcgtgaaggaaaattcgtctaaggacctgaaaaagtccttcaagtcgccggaaccacgcctcttcaccccggaagagttctttagaatctttaatcgtagcatcgacgccttcaaggattttgtggtggcgtctgaaacctcagactgcgtggtgagctcaaccctgtccccggaaaaagactcccgcgtgtcagtcactaagcctttcatgctgcctccggtcgccgccagctcccttaggaacgacagttcatcttccaaccgcaaggcaaagaatccacccggagacagttcgttgcactgggctgccatggcgctcccagcgcttttttcgctgatcattggcttcgcattcggagccctctactggaagaagcgccagccctctctgactagagcagtcgaaaacattcaaatcaacgaggaagataacgagatcagcatgctccaagagaaagagcgggagttccaggaagtg

SEQ ID NO: 14918 - DNA, 819 bp, Artificial Sequence
  Description of Artificial Sequence: Synthetic coding sequence
atgaaaaagacgcagacatggattcttacttgtatatatctgcagctcttactctttaatcccttagtcaagacggaagggatttgccggaacagagtaaccaacaacgttaaggatgtcaccaagctagttgccaaccttccaaaggactatatgattacactgaaatatgtgcccggcatggatgtgctcccaagccactgttggatatctgagatggtggttcaacttagtgactctctcaccgacctgctagacaaatttagtaacatctcagagggcctgagtaactatagcattatcgacaagttagtgaatatcgtggatgacttagtggagtgtgtgaaggagaattcatccaaagacctgaaaaaaagctttaaatcccccgaaccacgcctgttcacccctgaagagttttttagaatattcaatcgctccattgatgcttttaaagacttcgtggtggccagcgagaccagcgactgtgtagtttcatctaccctcagcccagagaaggactcccgagtgtcagtgacaaaaccattcatgctgcctccagtggctgcctctagtctccggaatgactcctcttccagtaaccgcaaggctaagaacccgccgggcgacagtagccttcactgggcggcaatggctcttcccgcactcttctctcttattatcgggttcgcctttggggctctatattggaaaaagcgccagccatcacttacccgcgccgtggagaatatccaaattaatgaagaagataacgagataagcatgctgcaggagaaggaacgcgagtttcaggaggtg

SEQ ID NO: 14919 - DNA, 819 bp, Artificial Sequence
  Description of Artificial Sequence: Synthetic coding sequence
atgaagaaaactcaaacttggatcctgacttgcatttatctgcaactcctcctgtttaatcctcttgtaaaaaccgaagggatctgcaggaaccgggtgaccaacaatgtgaaggatgtgacgaagctggtggccaacctcccgaaggactatatgatcaccttgaagtacgtcccggggatggacgtgctcccttcacactgctggataagcgagatggtggtgcagctgtcggattcgctgaccgacctgctcgacaaattctcgaatatcagcgaaggcctgagtaactactccatcatcgacaagctggtgaacattgtggatgacctggtcgaatgtgtcaaagagaactcctctaaagatctcaaaaagtcgttcaaatcgccggaacctaggctgttcactccagaagagtttttccggatattcaacagatcaatcgacgcttttaaggacttcgtcgtcgcaagcgaaaccagcgattgcgttgtgtcctccacgctctccccagaaaaagatagccgggtttcggttaccaagcccttcatgttgcctcctgtggctgcgtcatccctgcgtaacgatagctctagctcaaatagaaaggccaagaatcccccaggcgattcgtccctccattgggcagctatggcccttccagcacttttttcgttgatcattggattcgctttcggagccctctactggaagaaacgccagccgtcactcactcgcgcggtggaaaacatccaaatcaatgaggaggacaacgaaatcagtatgctgcaggaaaaggaaagagagttccaggaagtg

SEQ ID NO: 14920 - DNA, 819 bp, Artificial Sequence
  Description of Artificial Sequence: Synthetic coding sequence
atgaagaagacacaaacctggattctgacctgtatctacctgcaactcctgttattcaatcccctagtcaaaactgaagggatttgtaggaacagggtgacaaacaacgtcaaggatgttactaaactggtggcgaacctacctaaggactatatgatcacattgaagtatgtcccaggtatggatgtacttccatcacattgctggatttcggagatggtcgtgcagctatcagattctctcactgacctcttggataagttcagtaacatctctgagggactgtcgaactactcgattattgataagcttgtcaatatcgtggatgatctcgtcgaatgtgtcaaagagaacagtagtaaggacctcaagaaatctttcaaatctcctgagccgcgccttttcacaccggaggagttctttcgcatcttcaaccgttcaattgatgcgttcaaggatttcgtcgtcgcctctgagacatctgactgcgtcgtcagtagtacactgtcccccgaaaaggactcccgagtaagtgtcaccaaacctttcatgctacctcccgtggctgcttcctcgctgaggaacgattctagctcatccaacaggaaggccaagaatcccccgggggatagttcccttcattgggctgccatggcgctacctgccctgttcagcttaatcatcggcttcgcgtttggggcgttgtattggaagaagaggcagccatcgctaacgagagccgtagaaaacatccagatcaacgaggaggacaatgaaatttcgatgcttcaggaaaaggaacgcgaattccaggaggtc

SEQ ID NO: 14921 - DNA, 819 bp, Artificial Sequence
  Description of Artificial Sequence: Synthetic coding sequence
atgaaaaagactcaaacctggatccttacttgtatatacctgcaacttctgctctttaatcctttggtaaagaccgaaggaatctgtcgcaacagagtgactaataacgtgaaggacgttaccaagctcgtcgcgaaccttccaaaagactatatgatcacccttaagtacgtgccgggaatggacgtcttgccctcgcattgctggatctcagagatggtggtgcagctgtccgacagcctgacggatcttctcgacaagttctccaacatctccgaagggttgagtaactactctattatcgacaaactcgtgaacatcgtggacgatctggtcgaatgcgtgaaggaaaacagcagcaaagatctgaagaagagcttcaaatccccggagccgaggttgttcactcctgaggagtttttccgcatcttcaacagatcaatcgacgcgtttaaggattttgtggtggcgtccgaaacctcagactgcgttgtgagcagtaccctctcacctgaaaaggactcccgggtgtcagtcactaagcctttcatgctcccacctgtagctgcctcgtctctgcgcaatgattcctcatcctcgaatagaaaggccaagaatccgccaggggattcgagcctccactgggctgcaatggctctgccagccctgttcagcctgatcattggtttcgccttcggcgcactctactggaaaaagaggcaaccctcactcacccgggctgtcgagaacatccagatcaacgaggaggataatgaaattagcatgctgcaggaaaaggaacgagaattccaggaagtg

SEQ ID NO: 14922 - DNA, 819 bp, Artificial Sequence
  Description of Artificial Sequence: Synthetic coding sequence
atgaaaaagactcagacatggatcttgacctgcatctacctgcagctgctgctgttcaatccattggtcaaaaccgagggtatatgcagaaatagagtaacaaataatgtgaaagacgtgacaaaactcgttgccaatctgcccaaggactatatgattacactcaaatacgtgccaggcatggacgtattgccatctcactgctggatatctgagatggtggtgcaactatctgactcgctcacggacctccttgacaagtttagtaacatttcagaagggctgagtaactattccattatcgacaaactggtcaacatcgtagacgacctggtagaatgtgtgaaagagaattcatccaaagacctgaaaaagtcctttaaaagcccagagcctagactttttaccccagaggagttttttagaatctttaaccgttccattgacgctttcaaggattttgttgtggccagtgaaaccagcgattgcgtcgtgtctagtactctgagccccgagaaggattccagggttagcgtcactaagcccttcatgctgccccctgtggctgcctcaagcctgagaaacgattccagttcatctaaccggaaggcaaagaacccccccggtgactctagcctgcactgggccgccatggctctccccgctctcttttccctcatcatagggttcgcattcggggcactatattggaaaaagcgccaaccatccctgacacgcgccgtcgaaaatattcagataaatgaggaagataacgagatttccatgttgcaggagaaggaaagagagttccaggaagtg

SEQ ID NO: 14923 - DNA, 819 bp, Artificial Sequence
  Description of Artificial Sequence: Synthetic coding sequence
atgaaaaagactcagacttggattctgacatgcatatacctccagctgctgctgtttaaccccctcgttaaaactgagggtatatgcaggaaccgtgtgaccaacaatgtgaaggatgtaactaaactcgtggctaacttgccaaaggattatatgattaccctgaaatatgtgcccggtatggacgtcttgccaagccactgttggatatctgaaatggtggtgcagctttctgactcccttaccgatttgctggacaagttttccaacatttccgagggcctctccaactatagtatcattgacaagctggtgaacatcgtcgacgatctcgttgaatgcgttaaagagaattcaagcaaggatttgaagaagagcttcaagtcccccgaacccagattgttcacccccgaggagtttttcaggatttttaaccgctccatcgacgcatttaaggactttgtagtggcttccgagactagtgactgtgttgtgtccagcaccctgtctcccgaaaaggactctcgcgtttctgttacaaagcctttcatgctcccccctgtagccgcttccagtcttaggaatgacagttctagctccaaccgcaaggctaagaacccccctggcgattcctctttgcattgggctgcaatggcattgcccgctcttttcagcctgatcatcggattcgctttcggagccctctactggaaaaaacgccagcccagtctcactcgcgctgttgaaaatatccagatcaacgaggaggataatgaaatatctatgctgcaggaaaaagagagggaattccaggaagta

SEQ ID NO: 14924 - DNA, 819 bp, Artificial Sequence
  Description of Artificial Sequence: Synthetic coding sequence
atgaagaaaacacagacttggatccttacatgtatttacctgcaactgttactgttcaatcctcttgtaaagacagaagggatatgcagaaaccgtgttacgaataacgttaaagacgtaacaaaactggtcgccaacctgccgaaagattatatgatcactcttaagtatgttccgggaatggatgtacttccgagccattgctggatttccgagatggtagtccagttatcggactcactaacagacctcctagacaaattttcaaatattagcgaaggacttagtaattactcaattatcgataagcttgtaaatatcgtagacgatttggtagagtgcgtcaaagagaatagttcaaaagatcttaaaaaatcattcaaatctccagaacctaggttgttcacaccggaagaattttttcgcattttcaatcgctcaatcgatgcgtttaaagactttgtggtggcgtccgaaacgagcgattgtgtcgtcagcagtacgctttctccggaaaaagattctagagtatctgtaaccaagccgtttatgctaccgccggtggcggcttccagtttacggaacgatagctcaagctcaaacaggaaagccaaaaacccgccgggtgattctagtttacattgggctgcgatggcacttccggctttgtttagtttgatcattggttttgcgtttggcgcactttattggaagaagcgacaaccctctctaacacgtgccgtagagaatattcagattaatgaggaagacaacgaaatctctatgcttcaagaaaaagaaagagaatttcaagaagtc

SEQ ID NO: 14925 - DNA, 819 bp, Artificial Sequence
  Description of Artificial Sequence: Synthetic coding sequence
atgaagaaaactcagacctggatcctgacctgtatttacttgcaactgcttctctttaaccctctggtcaagactgaaggaatttgccgcaatcgagtcactaataacgtcaaggacgtcaccaagctcgtggccaacctgcccaaagactatatgattaccctcaagtacgtgccgggaatggacgtgctcccgtctcattgttggatatccgaaatggtggtgcagctgtcagactccctcacggatctgctcgacaaattctccaatatctcggaaggactttccaattacagcattattgataagttggtgaacattgtggatgatcttgtcgaatgtgtgaaggagaactccagcaaggatctgaagaagagcttcaaatccccagagccccgtcttttcacccccgaagagtttttcagaatctttaatcgcagcatcgacgcatttaaggattttgtggtggccagcgagacgtcagattgcgtggtttcatcaactctgtcaccagaaaaggattcacgggtttcggtgaccaaaccttttatgcttcctccggtggccgcgtcatcgcttagaaacgatagctcatcatcgaatcggaaggcaaagaaccctcccggcgactctagcctgcactgggcagcaatggcactcccggctcttttttctcttatcatcggctttgccttcggtgcattgtactggaagaaaagacagccatcccttaccagagcagtcgaaaacatacagattaacgaagaagataacgaaatttccatgcttcaggaaaaagagcgcgagttccaagaagtg

SEQ ID NO: 14926 - DNA, 819 bp, Artificial Sequence
  Description of Artificial Sequence: Synthetic coding sequence
atgaaaaaaacgcaaacgtggatattaacgtgtatatatttacaattattattatttaatccgctagttaaaacggaaggtatatgtcgtaatcgagtaacgaataatgtaaaagatgttacgaaactagtagcgaatttaccgaaagattatatgataacgttaaaatatgtaccgggtatggatgttttaccgtcgcattgttggatatcggaaatggtagttcaattatcggattcgctaacggatttactagataaattttcgaatatatcggaaggtctatcgaattattcgataatagataaattagtaaatatagtagatgatttagttgaatgtgtaaaagaaaattcgtcgaaagatctaaaaaaatcgtttaaatcgccggaaccgcgattatttacgccggaagaattttttcgtatatttaatcgatcgatagatgcgtttaaagattttgtagtagcgtcggaaacgtcggattgtgttgtttcgtcgacgttatcgccggaaaaagattcgcgtgtatcggttacgaaaccgtttatgctaccgccggttgcggcgtcgtcgttacgtaatgattcgtcgtcgtcgaatcgtaaagcgaaaaatccgccgggtgattcgtcgttacattgggcggcgatggcgttaccggcgctattttcgctaataataggttttgcgtttggtgcgctatattggaaaaaacgtcaaccgtcgttaacgcgagcggtagaaaatatacaaataaatgaagaagataatgaaatatcgatgctacaagaaaaagaacgagaatttcaagaagta

SEQ ID NO: 14927 - DNA, 819 bp, Artificial Sequence
  Description of Artificial Sequence: Synthetic coding sequence
atgaagaaaacccaaacctggatccttacctgtatatacctccaactgctcctctttaacccgctcgtgaaaactgaaggaatctgtagaaacagagtcactaataacgtgaaggatgtgaccaagctcgtggctaacctgccaaaggattacatgattaccctcaagtacgtgccaggaatggatgtgcttccttcccactgttggatctccgaaatggtggtccagcttagcgattctcttacggatctgcttgataagttctcgaacattagtgaaggtctttccaattacagcatcatcgacaagctggtcaatatcgtggatgatctggtggagtgtgtcaaagaaaactcatcgaaagatctgaaaaagtcctttaagtccccagagccgagactgttcacccctgaggaattcttccggatattcaacaggtcgattgacgcatttaaggattttgtcgtcgcttcggagacttcagattgcgtggtgtcctcgactttgtcaccagagaaggatagcagagtgtccgtgaccaagcctttcatgcttcccccagttgccgcatcctcacttcgaaacgatagctcaagcagcaatcggaaagcaaagaatcctccaggtgattcttccctgcactgggccgcaatggcacttccagctcttttttcgctgattatcggatttgcgtttggggccctgtactggaagaagagacaaccttctctcaccagagcagtggagaacattcagataaatgaggaggacaatgaaatttccatgcttcaagagaaagaaagagaatttcaagaagtg

SEQ ID NO: 14928 - DNA, 819 bp, Artificial Sequence
  Description of Artificial Sequence: Synthetic coding sequence
atgaagaagactcaaacgtggatactcacatgtatataccttcagttgctgctatttaacccgctggtaaaaaccgagggtatttgtaggaatcgagtcacaaataatgtcaaggatgtcaccaaattggtagccaatctcccaaaggactacatgatcacactcaaatacgtgcccggcatggacgtgctgcccagccattgctggatttctgaaatggtggttcagctttccgactctctgaccgacctgctcgataaattttctaacatatctgaagggctgagtaactacagcatcatcgacaaactggtcaatatagtggacgatctggtcgagtgtgtgaaagaaaactcctcgaaagatctgaagaagtcctttaagagccccgagcctcgcctgttcaccccggaggagttcttccggattttcaaccgctccattgatgcattcaaggacttcgttgttgcgtctgagacttccgactgtgtagtgtcgagcacactcagcccagaaaaagatagcagagtgagtgtcaccaagccctttatgctgccccccgtggctgccagtagcctgcgaaatgatagctcaagtagcaatcgaaaggctaagaatcctcctggtgacagcagcttacactgggccgctatggccttgcccgccttgttttctttgatcatcggattcgctttcggggctctgtactggaagaaaagacagccctcactgacgagagctgtggagaatattcagattaatgaggaagacaatgagatctcaatgctgcaggagaaagaaagagaatttcaggaagtg

SEQ ID NO: 14929 - DNA, 819 bp, Artificial Sequence
  Description of Artificial Sequence: Synthetic coding sequence
atgaagaagacccaaacgtggattctcacttgcatctacctccagttacttttgttcaacccgctggtgaagactgagggtatatgccgtaacagagtcacgaacaacgtcaaggacgttactaagctcgtcgctaacttgcccaaggattacatgatcaccttgaagtatgttcccggcatggacgtgcttccctcccactgctggatttcggagatggtcgtgcagctgagcgactcgctaactgacctgcttgataagttcagcaatatctcagaaggcctctccaactattctatcatcgacaagctggtgaacattgtcgatgatttggtcgagtgtgtgaaggagaactcatccaaggacttgaagaagtcttttaagagtcctgagcctcggctgttcacgccggaggagttcttccgaattttcaatagatccatcgacgcctttaaggacttcgtcgttgcatcagagacctcggattgcgtcgtgtcttccaccctgtccccggagaaagactcccgagtgtcggtcactaagccctttatgcttccgcctgttgccgccagcagtctccgtaacgattccagcagttcgaatcgtaaggcgaagaacccccccggtgatagcagcctgcactgggccgcaatggcactgcctgcccttttcagccttatcattggattcgcctttggtgcgctgtactggaagaaacgacagccaagcctaacgagggcggtcgaaaacatccaaataaacgaggaagacaacgagatcagtatgctgcaggagaaggagcgcgaattccaggaggtg

SEQ ID NO: 14930 - DNA, 819 bp, Artificial Sequence
  Description of Artificial Sequence: Synthetic coding sequence
atgaagaaaacccagacttggatcctcacttgcatctacttgcaactgttgctgttcaacccgctggtcaagaccgagggaatctgccggaacagggtgaccaacaacgtgaaagatgtgactaagctcgtcgccaacctgccgaaggactacatgatcactctgaagtacgtgcctggaatggatgtgcttcctagccactgttggatctcggaaatggtcgtgcagctgtcggactcgctgaccgatctcctggataagttttcaaatatctcagagggactgagcaattactcaatcatcgacaagctggtcaatattgttgacgacctcgtggaatgcgttaaggaaaactcctccaaggatctgaaaaagagcttcaaatcaccagagcctcggctcttcactccggaagagttcttccggatctttaatcgttcgatcgacgccttcaaagatttcgtggtggcctccgagacttcagattgcgtggtcagctcaaccctgtccccggaaaaggacagccgcgtgagcgtgaccaagccatttatgctccccccggtggcggcttcctcgctcagaaatgactcctcgtcgtccaaccggaaggcaaagaacccgccgggagattcatcactgcactgggccgcaatggcactgccagccctttttagccttatcattggattcgcgttcggggcgctgtactggaaaaagcgccagcccagcttgactcgggcagtggagaatatacagatcaacgaggaggacaacgaaatctcgatgctccaagagaaagagagagagttccaggaggtg

SEQ ID NO: 14931 - DNA, 819 bp, Artificial Sequence
  Description of Artificial Sequence: Synthetic coding sequence
atgaagaaaacacagacctggatccttacatgtatctacctgcagctcctcctgtttaacccgctggttaaaacagaaggtatatgtaggaacagggtaacaaacaacgttaaagatgttaccaaactggtggctaacttgcccaaggactatatgataactctgaagtacgtccccggaatggacgtgttgccgtcacactgttggattagcgagatggtggtgcagcttagcgattctctgacagacctgttggacaaattcagcaatatttcagagggcctgtccaactattctatcatcgataaattggtcaatatcgttgacgatctggtcgagtgcgtcaaagagaacagcagcaaagatcttaagaagtcctttaagagccctgagccgagactgttcacccctgaagagtttttccgcatctttaaccgcagcatcgacgcctttaaagatttcgttgtagccagtgagacctctgattgcgtggtgagttctactctgagtcctgaaaaagactccagagttagcgtgaccaaaccatttatgctgccccctgtggccgcatctagtctgaggaatgattcctcatcttccaacagaaaggctaaaaaccctcccggtgattctagcctgcattgggctgcaatggctcttcctgctttattcagcctcatcatcggcttcgcatttggtgcattgtattggaaaaagcggcagccgtcccttacaagagcggtggagaatatccagatcaacgaagaagacaacgagatatcaatgctgcaagaaaaggaacgagagttccaagaagtt

SEQ ID NO: 14932 - DNA, 819 bp, Artificial Sequence
  Description of Artificial Sequence: Synthetic coding sequence
atgaagaagactcagacctggatcctcacctgtatttacctgcaacttttgctttttaatcccctcgtgaaaacggagggcatatgcaggaaccgggtgactaacaatgttaaggatgtgacgaaactggtggccaatctgcccaaggactacatgatcactctgaagtacgtgcctgggatggatgtgcttccctcacactgttggatatctgaaatggtggtacagctctctgattccctgaccgacctcctcgacaaattttccaacatctctgaaggcctgtcaaattattctatcatcgataagcttgtcaacatcgtggatgacctggtcgaatgcgtaaaggagaatagttcaaaagaccttaagaagagctttaagagcccagaaccccgattgtttacccctgaggaatttttcaggatctttaatcggtccattgatgcttttaaggattttgtcgtcgcctctgagaccagcgactgcgttgtgtccagcacactctctcctgaaaaggactctagagtgagtgtgacgaagccctttatgcttcccccagtggctgccagctccctgaggaatgacagttcatcatctaaccgcaaagccaaaaaccccccgggcgacagctctctgcattgggccgccatggccctgcccgcactgttttccttgatcatcgggttcgcttttggcgccttgtattggaaaaagagacagccgagccttacacgcgccgtagagaatatacagatcaatgaagaggataacgagatctcaatgcttcaggagaaggaaagagagtttcaggaggta

SEQ ID NO: 14933 - DNA, 819 bp, Artificial Sequence
  Description of Artificial Sequence: Synthetic coding sequence
atgaagaaaactcagacctggattctcacctgcatctacttgcaacttctgctgtttaaccctctggttaaaacggaaggtatatgccgcaatcgagtcacgaacaatgtgaaagatgtaaccaaactggtggcaaatcttccgaaggattacatgatcactctgaagtacgtccctggaatggacgtgctgccatcccattgctggatctccgaaatggtggtacagctttcggacagcctcaccgatctgctggacaagttctctaacatctcggagggcttgtcgaactactcaatcatagacaaactcgtgaatatcgtggatgatttggtcgagtgcgtcaaggagaattcctccaaggacctcaaaaagtccttcaagtcaccggaacctcggctcttcaccccggaggagttcttcagaatcttcaaccggagcattgacgcttttaaggattttgtggtggcctctgagacttccgactgtgtggtgtcctcgactctgtcgcccgaaaaggactcacgggtgtcggttactaagccgtttatgctgcccccggtggccgccagctccctcagaaacgacagttcaagctcaaaccgcaaggcgaaaaacccaccaggcgactcaagcctccactgggccgcgatggcgctgccagccctgttctctctgattattggattcgcattcggggctctttattggaagaaaaggcaaccgtcactcacccgcgcagtggaaaacatccagatcaatgaagaagataacgagatctccatgctgcaggagaaggagcgcgaattccaagaagtc

SEQ ID NO: 14934 - DNA, 819 bp, Artificial Sequence
  Description of Artificial Sequence: Synthetic coding sequence
atgaagaaaactcagacttggattcttacctgtatctacctccagctgctacttttcaatccactcgtcaaaactgaagggatctgcaggaatcgcgtcacgaacaacgtgaaggatgtgaccaagctcgtggctaatctcccgaaagattacatgataacccttaagtacgtgccaggcatggatgttctcccaagccattgttggatctctgagatggtcgtgcagttgagcgactctctgaccgacctattggataagttttcaaatatctccgaggggctgagcaactattcaattattgataagcttgtcaacatcgtggacgatctggtcgagtgcgtaaaagaaaattcctctaaagacctaaaaaaatcctttaaatctcctgagcctcggctattcaccccagaggagttctttcgaatattcaacagatccatcgacgcttttaaagattttgtggtagcttcagagactagcgactgtgtggtgagctcgacactgtcccctgagaaggatagcagagtgagcgtcaccaagcccttcatgctcccgccagtggctgcatccagtctccggaacgatagcagctcttccaatcgcaaagcgaagaacccaccaggggacagcagtttacactgggccgctatggcgctaccagctctgtttagcctaatcataggatttgcgtttggagcactgtactggaagaagcgtcaaccatcgctcactagagctgtcgagaacatacagattaatgaggaggacaacgagatcagcatgttgcaggagaaggagcgcgagtttcaggaagta

SEQ ID NO: 14935 - DNA, 819 bp, Artificial Sequence
  Description of Artificial Sequence: Synthetic coding sequence
atgaagaaaacccagacttggattctgacttgtatctaccttcagcttcttctcttcaacccgttggtcaaaacggaaggaatttgtaggaacagagtgactaacaacgtgaaggatgtgacgaagctcgtggcaaacctcccgaaagactacatgattacccttaagtacgtgccaggaatggatgtgctccccagccactgctggatttcagagatggttgtgcagctcagcgactcgttgaccgatctgttggacaaattcagcaacatttccgagggactctcgaactacagcatcattgataagctcgtcaatattgtcgacgatctggtcgagtgtgtcaaggaaaattcctcgaaagacctgaagaagtcctttaagtcacccgaaccacgcctgtttacccccgaggaattctttaggatcttcaaccgctcgattgatgcctttaaagattttgtcgtcgcatcagagacttcagattgtgtggtgtcgtcaaccctctcacctgagaaggatagtagagtctccgtgacgaagcctttcatgcttcctcctgtggcagcatcgtcgcttcgcaacgacagctcgtcctcgaaccgaaaagcaaagaaccctccaggcgactcttccctgcattgggcagccatggccctgcccgccctgtttagcctcatcattgggtttgcgttcggcgcgctttactggaagaagaggcagccatctctcactcgtgctgttgaaaacatacaaatcaacgaagaggataacgaaatttccatgctgcaggaaaaggaaagagaattccaagaagtc

SEQ ID NO: 14936 - DNA, 819 bp, Artificial Sequence
  Description of Artificial Sequence: Synthetic coding sequence
atgaaaaagacccagacttggattttgacttgtatttacttgcagttgctgttgtttaacccactcgtgaaaaccgaaggcatctgcaggaatagggtgaccaataacgttaaggatgtgaccaagctggtcgccaatctcccgaaggactacatgatcacgctgaaatatgttccaggtatggacgtgcttccgtcgcactgctggatctcggaaatggtcgttcagctgtccgactcactcactgatttgctggataagttcagcaacatttcagaaggactgtcaaactactcaatcatcgacaagctggtcaatatcgtcgacgacctggtggaatgcgtcaaagagaattccagcaaggacctgaagaagtcgtttaagtccccagaacctagactgtttactcctgaagagttcttccgcattttcaaccgctcaatcgatgcatttaaggacttcgtggtggcttcggaaacctcagattgcgtggtcagctctactctctcgccggagaaggattcccgcgtgtcagtgaccaagccgtttatgcttccacccgtcgctgcgagttccctgcggaatgactcatcgtcgtcgaaccggaaggcaaaaaacccgccaggagattcgtcactgcactgggccgcaatggccctgccagccttgttttcgctgatcatcgggttcgctttcggtgcactgtactggaagaagcgccaaccgtctctgacccgcgccgtcgagaatatccagatcaacgaagaagataatgaaatctcgatgcttcaagagaaggagagggagtttcaggaagtg

SEQ ID NO: 14937 - DNA, 819 bp, Artificial Sequence
  Description of Artificial Sequence: Synthetic coding sequence
atgaagaaaacgcaaacttggattttgacatgcatttatctgcaacttttgctttttaatccacttgttaaaacagaaggaatttgtagaaacagagtcactaataatgttaaagatgttacaaaattagtcgctaatctgcctaaagattatatgatcaccttgaagtatgtccctgggatggatgttctgccttcacattgctggattagcgaaatggtcgtccagctgtcggactcattgacagatcttcttgataaattttctaacatttctgaggggctatcgaattacagtataatcgacaaactcgttaatattgttgatgaccttgtggaatgtgttaaagagaattcgtccaaagatttgaaaaagagttttaaaagcccagagccacgattgttcacaccagaagagttttttagaatttttaatcgttcaattgatgccttcaaagacttcgtcgtggcgtcggaaacatctgactgcgtcgttagttcaactctttccccagaaaaggatagtcgagttagcgttactaaaccatttatgttgccacctgtggcagctagttcactcaggaacgatagttcctcttctaatcgtaaagccaagaacccccctggagattcttcattacattgggcagctatggccctcccggctcttttctctttgatcatcggattcgcatttggggcactctactggaaaaagagacagccaagtttgactagagcggtcgaaaacattcagatcaatgaagaggataacgagatctctatgttgcaagaaaaggaacgggaattccaagaagta

SEQ ID NO: 14938 - DNA, 819 bp, Artificial Sequence
  Description of Artificial Sequence: Synthetic coding sequence
atgaaaaagacacaaacatggatccttacttgcatctatttgcagttgctcctgttcaatccactcgtaaaaaccgaaggcatatgtagaaaccgagtgacaaataacgtgaaagatgtgaccaaattggtcgccaacctgccaaaagactacatgattaccctgaagtacgtccccggaatggatgtgttacccagccattgttggattagcgaaatggtggttcagctctctgactctttgaccgaccttctggacaaattctctaacatatcagaaggtctgagcaactactcaatcatcgacaagctggttaacatcgttgacgaccttgttgaatgtgtgaaagagaatagcagcaaggatctgaaaaagagcttcaaatcacctgaaccaaggctgtttacgcctgaagagttctttagaatcttcaaccggagcattgatgcctttaaagacttcgtggtcgcctctgagacttcagactgcgtagtgtcatctaccctgagcccagaaaaggactctcgcgtgtcagtgacaaagccatttatgttgcctcctgtggcggctagctccctgaggaacgatagtagcagctcaaataggaaagcaaaaaatccgcccggagatagctccttgcattgggcagccatggcacttccagctctttttagccttattataggctttgctttcggcgcactgtactggaagaaaaggcagcctagcctgacacgtgctgtcgagaatatccaaattaacgaggaggataacgagatctctatgctgcaggaaaaagagagagaatttcaggaagtg

SEQ ID NO: 14939 - DNA, 819 bp, Artificial Sequence
  Description of Artificial Sequence: Synthetic coding sequence
atgaaaaaaacacaaacatggattttaacatgtatctatttacaattattattatttaacccacttgttaaaacagaaggaatttgtcgtaatagagttacaaacaacgttaaagatgttactaaacttgttgctaatttaccaaaggattatatgattactcttaagtatgtcccagggatggatgttttaccaagtcactgctggatctcagaaatggttgtacaattgtctgattctcttacagaccttttagataaattttcaaatatctcagagggactttcaaattattcaattattgataaattggttaacattgtagatgatttagttgaatgtgttaaggaaaatagttctaaggatttaaaaaaatcattcaagtcacctgaaccaagattatttactccagaagaattttttagaatctttaatcgttcaattgatgcatttaaagattttgttgttgcttctgaaacttcagactgtgttgtttcgagtacactatcgcctgaaaaagattcacgtgtttcagttactaagccatttatgttaccaccagtagcagctagtagtttaagaaatgactcatcatcatcaaatcgaaaagccaaaaatccaccaggagattcatcattacattgggctgcaatggcattaccagctttgttttctttaattataggatttgcatttggagcattatattggaagaaaagacaaccaagtcttacacgtgctgtagaaaatattcaaattaatgaagaagataatgaaatttcaatgttacaagaaaaggaaagagaattccaagaagtt

SEQ ID NO: 14940 - DNA, 819 bp, Artificial Sequence
  Description of Artificial Sequence: Synthetic coding sequence
atgaaaaagactcaaacgtggatcctaacttgtatttacctccaattgttactctttaatccgctggtaaaaaccgagggcatttgccgcaatagagtgaccaataatgtgaaggacgtgacaaagctggttgccaacctgcctaaagattacatgataacactgaagtatgtgccgggtatggatgtccttccatcacattgctggataagtgaaatggttgtccagctctccgactccttgactgatctgttggataagttctcgaacattagcgaagggctttccaactacagcattatcgataagctggtcaatatagtggacgacttagtcgaatgcgttaaggagaacagtagcaaagatctgaagaaatctttcaagtcacctgagcctcgcctgtttactccagaggagttttttagaattttcaatcgcagtatcgatgccttcaaagatttcgtggttgcaagtgaaaccagtgattgcgtggtgtcatccacgctttccccggaaaaggactctagggtgtccgtgacaaaaccctttatgctgcccccggtggctgctagtagtctccggaatgattcatctagctccaatcgtaaggcgaaaaatccgcccggcgattcctcgctgcactgggccgccatggcactgccggcgctcttcagcttgatcatcggtttcgcgttcggagccctttactggaagaagaggcagccctctctgacacgcgcagtcgaaaacatccagattaatgaggaggacaacgagataagtatgctgcaagagaaggagcgagaattccaggaggtc

SEQ ID NO: 14941 - DNA, 819 bp, Artificial Sequence
  Description of Artificial Sequence: Synthetic coding sequence
atgaaaaagactcaaacctggatcctcacttgcatctacttgcagctgctgctgttcaaccctctggtcaagactgagggcatctgtaggaatcgtgtgaccaataacgtgaaggatgtgactaaactggttgcgaacctgccgaaggactacatgatcactctgaagtacgtcccagggatggacgtgctcccctcccactgctggatcagtgagatggtcgtgcagctgagcgactccctcaccgatctcctcgacaagttttctaacatttccgaaggcctgtccaactactcgatcatcgataagctggtgaatatcgtggatgaccttgtggaatgtgtgaaggagaattcgagcaaagatctgaaaaagtctttcaagtcgccggagcctcgactctttaccccagaagagttcttccggatcttcaacagatctattgacgccttcaaagattttgtggtggcgtccgaaacgtcggactgcgtggtgtcatccacgctttcacccgagaaggactccagggtcagtgtcaccaagccgttcatgctcccgccagtcgctgcttctagcctccgcaatgacagctccagctcaaatcgcaaggcaaagaatccacctggtgactccagccttcactgggcagccatggcgcttccagctttgttctccctgatcatcgggttcgcttttggagcactgtactggaagaaacggcaaccatcgctgacccgcgcggtcgaaaacatccagatcaacgaagaagataacgaaatctcaatgctccaggaaaaggaaagggaattccaggaggtc

SEQ ID NO: 14942 - DNA, 819 bp, Artificial Sequence
  Description of Artificial Sequence: Synthetic coding sequence
atgaagaaaacccagacctggattctgacatgtatatatttacagctgttgctgttcaaccccctcgtgaaaacagagggtatttgccgaaatagggtgacaaataacgtgaaggatgtgaccaaacttgtggcaaacttgcctaaggactacatgattactctgaagtacgtgcccgggatggatgttctaccttcccactgttggatttcagagatggtggtgcaattatctgatagtctcaccgacttgctggacaagttctccaatataagcgagggactatctaactactcaatcattgataaactcgttaatatcgttgatgatctggtcgaatgtgtcaaggagaattcatccaaggacctgaagaaatcatttaaaagcccagaaccacgactcttcacccccgaagagttcttccgaatttttaaccgaagcatcgatgcattcaaagacttcgtggttgcaagtgaaacctccgactgcgtcgtgtccagtacgctatctcccgagaaggactccagggtgagcgtgaccaagccttttatgcttcctccagtcgctgccagcagcctgcgaaacgattcgagttcttctaatcgcaaggcaaaaaatcctccaggtgactctagtctgcattgggctgccatggctctgccagcactgttctccttgatcattggatttgcgttcggcgctctgtactggaagaaaagacagccgagtctgacacgcgccgtggagaacattcaaatcaacgaggaagataacgagatctccatgctgcaggaaaaggagcgtgagttccaagaagta

SEQ ID NO: 14943 - DNA, 819 bp, Artificial Sequence
  Description of Artificial Sequence: Synthetic coding sequence
atgaagaaaactcaaacttggatcctcacttgcatttacttgcaacttctgctcttcaatccgcttgtcaaaaccgaaggaatctgccgtaaccgagtcactaacaacgtgaaggacgtgaccaagctggtcgcgaatttgccaaaggactatatgattaccctgaagtacgtgccgggcatggacgtgctcccgagccactgttggatttctgaaatggtggtgcagctgtcagactcactgacggacctgctggacaaattcagcaatatctccgaagggctgagcaactactccatcatcgacaagctggtgaatatcgtggacgatctcgtggagtgcgtcaaggagaactcctcgaaggatttgaagaagagcttcaagagcccggaacctcggctcttcacccccgaggagttctttagaatcttcaacaggtccatcgacgcatttaaggactttgtggttgccagcgaaaccagcgattgtgtggtgtcctcaaccctgtcccccgagaaagactcgcgcgtctcggtcaccaagccattcatgctgccacctgtcgcggcctcgtcactgaggaatgattcctcatcatcaaatcggaaagccaaaaatccaccgggagattcgtcgctccactgggccgcaatggcgctcccggcccttttctccctgatcatcggattcgccttcggggccctgtactggaaaaagagacaaccatcactgacccgggcagtggaaaacattcaaatcaacgaggaagataacgaaatcagcatgctccaggagaaggagagagaatttcaggaagtc

SEQ ID NO: 14944 - DNA, 819 bp, Artificial Sequence
  Description of Artificial Sequence: Synthetic coding sequence
atgaaaaagacccaaacttggatcctgacttgcatctacttgcagctcctgctcttcaacccgctggtcaagaccgagggaatctgccggaaccgcgtcaccaataacgtcaaggacgtgactaagctggttgccaatctgccgaaagactacatgatcacgctgaagtatgtcccaggtatggatgtattgccgtcgcattgctggatctcggaaatggtggtccagctctccgactcgcttaccgatctgttggataaattctcgaatatctcagaaggactgagcaactacagcattatcgacaagctcgtgaacatcgtggacgatctcgtggagtgcgtgaaagaaaattcgtcaaaagatctgaagaagtcattcaagtctccggaaccacggctgttcaccccagaggaatttttccgcatcttcaaccgatctattgatgcgtttaaggattttgttgtggcctccgagacgtcagactgtgtcgtgtcgtccactctttcacccgagaaggactcgcgcgtgagcgtgaccaaaccgttcatgctccctccggtggccgctagctccctgagaaacgacagttcctccagcaacagaaaggctaagaatcctcccggagacagctccctgcactgggccgcaatggcgctcccagcactcttcagcctgatcatcgggttcgcgtttggcgccctctactggaagaagcgccagccttcgctgactcgggcagtggaaaacatacagatcaacgaagaggacaatgaaatttccatgcttcaagagaaagaaagggaattccaagaggtg

SEQ ID NO: 14945 - DNA, 819 bp, Artificial Sequence
  Description of Artificial Sequence: Synthetic coding sequence
atgaagaagacccaaacctggatattgacctgtatctacctgcagcttcttttgtttaatccccttgtcaaaactgaggggatatgccgcaatagagtcaccaacaatgtcaaggatgtgactaaattagtggccaacctaccgaaggattatatgatcacactgaagtatgttcctggaatggacgtacttcccagccattgttggatttcagagatggtcgtgcagttatccgacagtttaactgacctcctcgataagttcagcaacatatcggaaggcctgtccaactattcaattattgataagctggtgaacatagtggatgacctcgtcgaatgcgtgaaagagaactcatccaaggatctcaagaagagctttaagagtcccgagccccggctgttcaccccagaagagttctttcgtatctttaacagatcgatcgatgcattcaaggattttgtcgtagctagcgagacatccgattgtgtcgtgtcttcaacactatcccctgaaaaggactcacgggtgagcgttactaagcctttcatgcttcccccagtagctgcaagctcactgcggaatgatagctcatcctctaacagaaaagccaaaaaccctcccggagactcatccctgcattgggctgccatggctttaccggcactgttttctctgataattggattcgccttcggcgcgctttattggaaaaagcgacaaccgtccttaacgcgcgccgttgagaacatccagatcaacgaggaggacaacgaaatctctatgctgcaagagaaagaaagggaattccaggaggtt

SEQ ID NO: 14946 - DNA, 819 bp, Artificial Sequence
  Description of Artificial Sequence: Synthetic coding sequence
atgaagaagacgcagacttggattctcacttgcatttacttgcagctgctgctgttcaacccgttagtgaagacagaaggaatttgtcgaaacagagtgacgaataacgtgaaagacgtgacgaagctggtggccaatctgcccaaagattacatgattaccctgaagtacgtacctggcatggatgttttgccctctcactgttggatttctgagatggtggttcagcttagtgattctttaaccgatctgctcgataaattcagcaatatttccgagggtctctctaactatagtattatcgataaattggtcaacatcgtcgacgacctcgtcgagtgtgtcaaggagaattccagcaaagatctgaaaaaaagctttaaaagccccgagccaagactgttcactcccgaggaattcttcaggatctttaatcgaagtattgatgcctttaaagatttcgtggtggcctccgagacaagtgattgcgttgtctcctcaacactgagccctgaaaaggactctcgtgtcagtgtcacaaagccgttcatgcttccccccgtcgccgctagctcactaaggaatgactcgtcctcttccaacaggaaggccaaaaaccctccaggtgattctagcctgcattgggctgccatggccctgcccgcactgtttagcctaattatcggctttgcctttggtgctctatactggaagaagcggcagccgagcctcactcgagccgtcgagaacatccagatcaatgaggaggacaacgaaatcagcatgctgcaagaaaaggagagagaattccaggaagtg

SEQ ID NO: 14947 - DNA, 819 bp, Artificial Sequence
  Description of Artificial Sequence: Synthetic coding sequence
atgaaaaagacgcaaacgtggatcctcacgtgtatttacctgcagcttcttctgttcaacccactcgtgaaaactgagggaatctgtcggaaccgggtcacgaataacgtcaaggatgtgactaaactggtcgcaaacttgcctaaggactacatgatcaccctcaaatacgtaccaggcatggatgtcctgccgtcccattgctggatctccgagatggtcgtccagctctcggactcgctcactgatctgttggataagttctccaacatatcagagggactgtccaactactcaatcatcgacaagctggtgaacatcgtcgacgacctggtcgaatgcgtgaaggagaattcgagcaaagatttgaagaagtcctttaagagcccagaaccgagattgttcaccccggaggaattcttccgaatcttcaatcggtccatcgacgccttcaaagacttcgtggtggcctcagaaacctcagactgcgtggtgtcatcgactctgtctccggagaaagactcaagagttagtgtgaccaagccgttcatgctgccgcctgtggcggcctcgtccctgaggaatgactcttcgagcagcaataggaaagctaaaaacccgccgggagattcgtcgctgcactgggccgcaatggcactgcccgcccttttctcgctgatcatcggttttgcttttggagctctctactggaaaaagagacaaccgagcctgacccgcgcagtcgaaaacatacagatcaatgaggaggacaacgaaatctcaatgctccaagaaaaagagcgcgaattccaggaagtg

SEQ ID NO: 14948 - DNA, 3036 bp, Artificial Sequence
  Description of Artificial Sequence: Synthetic coding sequence
atgccggcgtcggcgccgccgcgtcgaccgcgtccgccgccgccgtcgctatcgctattattagtactactaggtctaggtggtcgtcgtctacgtgcggaaccgggtgatggtgcgcaaacgtgggcgcgattttcgcgaccgccggcgccggaagcggcgggtttatttcaaggtacgtttccggatggttttttatgggcggtaggttcggcggcgtatcaaacggaaggtggttggcaacaacatggtaaaggtgcgtcgatatgggatacgtttacgcatcatccgttagcgccgccgggtgattcgcgaaatgcgtcgctaccgctaggtgcgccgtcgccgttacaaccggcgacgggtgatgttgcgtcggattcgtataataatgtatttcgtgatacggaagcgctacgtgaactaggtgttacgcattatcgtttttcgatatcgtgggcgcgtgtattaccgaatggttcggcgggtgtaccgaatcgtgaaggtttacgatattatcgacgtttattagaacgtctacgtgaactaggtgttcaaccggtagttacgctatatcattgggatctaccgcaacgtttacaagatgcgtatggtggttgggcgaatcgagcgctagcggatcattttcgtgattatgcggaactatgttttcgacattttggtggtcaagtaaaatattggataacgatagataatccgtatgttgtagcgtggcatggttatgcgacgggtcgtctagcgccgggtatacgtggttcgccgcgattaggttatttagtagcgcataatctattattagcgcatgcgaaagtttggcatctatataatacgtcgtttcgtccgacgcaaggtggtcaagtttcgatagcgttatcgtcgcattggataaatccgcgtcgtatgacggatcattcgataaaagaatgtcaaaaatcgctagattttgtactaggttggtttgcgaaaccggtttttatagatggtgattatccggaatcgatgaaaaataatctatcgtcgatattaccggattttacggaatcggaaaaaaaatttataaaaggtacggcggatttttttgcgttatgttttggtccgacgttatcgtttcaactattagatccgcatatgaaatttcgacaattagaatcgccgaatttacgtcaactattatcgtggatagatttagaatttaatcatccgcaaatatttatagtagaaaatggttggtttgtttcgggtacgacgaaacgtgatgatgcgaaatatatgtattatttaaaaaaatttataatggaaacgttaaaagcgataaaattagatggtgtagatgtaataggttatacggcgtggtcgttaatggatggttttgaatggcatcgaggttattcgatacgtcgtggtctattttatgttgattttctatcgcaagataaaatgttattaccgaaatcgtcggcgttattttatcaaaaattaatagaaaaaaatggttttccgccgctaccggaaaatcaaccgttagaaggtacgtttccgtgtgattttgcgtggggtgtagtagataattatatacaagtagatacgacgttatcgcaatttacggatctaaatgtatatctatgggatgttcatcattcgaaacgtttaataaaagtagatggtgttgtaacgaaaaaacgtaaatcgtattgtgtagattttgcggcgatacaaccgcaaatagcgctattacaagaaatgcatgtaacgcattttcgtttttcgttagattgggcgttaatactaccgttaggtaatcaatcgcaagttaatcatacgatattacaatattatcgttgtatggcgtcggaattagttcgagttaatataacgccggtagttgcgttatggcaaccgatggcgccgaatcaaggtttaccgcgattactagcgcgacaaggtgcgtgggaaaatccgtatacggcgttagcgtttgcggaatatgcgcgattatgttttcaagaattaggtcatcatgtaaaattatggataacgatgaatgaaccgtatacgcgaaatatgacgtattcggcgggtcataatctattaaaagcgcatgcgctagcgtggcatgtatataatgaaaaatttcgacatgcgcaaaatggtaaaatatcgatagcgttacaagcggattggatagaaccggcgtgtccgttttcgcaaaaagataaagaagtagcggaacgtgtattagaatttgatataggttggctagcggaaccgatatttggttcgggtgattatccgtgggtaatgcgtgattggttaaatcaacgtaataattttttattaccgtattttacggaagatgaaaaaaaattaatacaaggtacgtttgattttctagcgttatcgcattatacgacgatactagttgattcggaaaaagaagatccgataaaatataatgattatttagaagtacaagaaatgacggatataacgtggctaaattcgccgtcgcaagtagcggttgttccgtggggtttacgaaaagtattaaattggctaaaatttaaatatggtgatttaccgatgtatataatatcgaatggtatagatgatggtttacatgcggaagatgatcaattacgagtatattatatgcaaaattatataaatgaagcgctaaaagcgcatatattagatggtataaatctatgtggttattttgcgtattcgtttaatgatcgaacggcgccgcgttttggtttatatcgatatgcggcggatcaatttgaaccgaaagcgtcgatgaaacattatcgaaaaataatagattcgaatggttttccgggtccggaaacgttagaacgtttttgtccggaagaatttacggtatgtacggaatgttcgttttttcatacgcgaaaatcgctattagcgtttatagcgtttttattttttgcgtcgataatatcgttatcgttaatattttattattcgaaaaaaggtcgtcgatcgtataaa

SEQ ID NO: 14949 - DNA, 3036 bp, Artificial Sequence; identical to SEQ ID NO: 14948
  Description of Artificial Sequence: Synthetic coding sequence

SEQ ID NO: 14950 - DNA, 3036 bp, Artificial Sequence
  Description of Artificial Sequence: Synthetic coding sequence
atgcccgcctcagcgccacccaggcggccacggcccccaccacctagtctctccctcctgttagtgttactcgggcttgggggacggcgccttagagccgaacctggagatggggctcagacttgggctaggtttagtcggccccctgctcccgaagcagccggactcttccagggaacttttcccgatgggttcctttgggccgttgggtctgccgcctaccagacagagggagggtggcagcagcatgggaagggggcctctatctgggatactttcactcatcatcccctggccccacccggagattctcggaacgcatcactgccactcggagccccctcaccattgcagcctgccacaggagatgtggcatcagacagttataacaacgtattccgcgatacagaagccctccgagagctgggagttacacattaccgcttcagtataagttgggcccgagtactccctaatgggtccgccggagtacccaaccgagagggactgcgatattatcggcgcctgctcgaaagacttcgggaactcggggtccagcctgtggtcacactttatcactgggatctgcctcagaggctccaagacgcatatggagggtgggcgaatcgagctttagccgatcactttcgcgattacgcagaactatgttttcggcacttcgggggacaggttaaatattggattactatcgataacccttatgtcgtggcctggcacggatacgccacaggaaggctcgctcctgggatccgggggtccccaaggttagggtatctggtggcacacaatctgcttcttgcgcatgctaaagtctggcatttatataacacatcattccgaccaacacaagggggacaggtgtctatagctctcagttcccactggataaatcctcgccgaatgactgatcactctataaaagagtgccagaaatctctagactttgtgcttggatggtttgctaaacccgttttcatagatggagactaccctgaaagtatgaaaaataacctgagttctatactaccagatttcacggaatcagaaaagaagttcatcaaagggactgctgatttctttgctctttgtttcgggcctacgctttcttttcagctactagatcctcatatgaagtttcgacagttggaatctcccaacttgagacagctcctcagttggatcgatcttgaattcaaccaccctcagatttttatagtggaaaacggatggttcgtttctggaacaactaaaagagatgatgctaaatacatgtattacctcaaaaaattcatcatggaaactctgaaggccatcaaactggatggggtggatgtgatcgggtacacggcatggtcacttatggatggattcgaatggcaccgagggtactcaatccgcagagggcttttttacgtcgacttcctaagtcaggacaagatgctcctaccaaaaagttctgcacttttttatcagaaactcattgaaaaaaacggattccctccactgcccgaaaaccagccattggaggggacatttccatgtgactttgcatggggggtcgtagataattatatacaggtagatactactctatctcagtttacagatcttaacgtgtatctttgggatgtccatcatagtaagagactgataaaggtggatggagtcgtaacaaaaaaaagaaaatcctactgtgtagattttgccgcaatccagcctcagatagccctgctgcaggaaatgcatgtaacacattttcggttctcactcgattgggccttaatactgcccttagggaatcagtctcaagtcaatcacactattcttcagtactaccgatgcatggccagtgagcttgtacgggtgaacatcacaccagtggtcgccctatggcagccaatggcacccaatcagggactaccaagacttttggcaaggcagggggcatgggagaacccctatacagcactagctttcgccgaatacgctcgactttgtttccaggaacttggacatcatgttaaattgtggattacaatgaatgaaccatatacacggaatatgacatattccgctggacacaacttgctaaaggcacacgcactagcatggcacgtatacaatgaaaagtttaggcatgctcagaacgggaaaatctcaatcgctctccaagctgattggatcgagcctgcttgtcctttttctcagaaagataaagaagtggccgaacgggtacttgagttcgatattgggtggcttgccgaacccattttcggatctggggattatccatgggttatgagagattggctcaatcagcggaacaactttctcttaccctatttcactgaggatgaaaaaaaattaatacagggaacatttgacttcctagcacttagtcactacacaactatcctcgtggattctgaaaaagaagaccctataaaatataatgactatctagaagtccaggaaatgacagatatcacatggctgaattcaccatcacaggttgccgttgtgccatggggactaagaaaagtactgaactggcttaaattcaaatatggggacctccctatgtacataatatcgaacggaatcgatgatgggttacatgcagaagatgaccagctaagagtgtactacatgcagaactacatcaatgaagccctgaaagcccacattctagatggaatcaacttgtgtggatacttcgcatatagttttaacgatcgtacagcccctaggttcggactttaccggtatgcagctgatcagttcgaacccaaagcctccatgaaacattataggaagatcatcgactccaacgggtttcccgggcccgagactctcgaaaggttttgccctgaagagtttacagtgtgcacagaatgctccttcttccatactagaaaatcacttctggctttcatagctttccttttcttcgcttccatcatcagtcttagtttgattttttattattctaaaaaaggacgccggtcttataag

SEQ ID NO: 14951 - DNA, 3036 bp, Artificial Sequence; identical to SEQ ID NO: 14950
  Description of Artificial Sequence: Synthetic coding sequence

SEQ ID NO: 14952 - DNA, 3036 bp, Artificial Sequence
  Description of Artificial Sequence: Synthetic coding sequence
atgccagcgtctgcaccccctaggcgccctcgtcctccacctccctcgctgtccctcctccttgtccttttgggacttggaggacggagactgcgggcagagcccggtgatggagcgcagacctgggcccgcttttcaagaccaccagcccctgaggcagccggtctgtttcaaggaaccttccccgatggattcctctgggcagtcggatccgctgcctaccaaaccgaaggggggtggcagcaacacggaaaaggtgcttcaatttgggacacttttacccatcacccgctcgcacctcctggagattcccgtaatgcctcgctgcctcttggtgcgccgtcgcctcttcagcctgcgaccggagatgtggcgagcgattcgtacaataacgtgtttagagatactgaagcactccgagagcttggcgtcacccattacagattttccatctcatgggcacgggtgttgccaaatggatccgcaggagttcctaaccgtgaagggctgagatactaccgaaggctcttggaaagactccgcgaactgggagtgcaaccagtggtcaccctgtatcactgggatctgcctcagagactgcaagacgcttacgggggttgggcaaatagagcactggccgatcactttcgagattatgcagaactctgttttcgacatttcggaggccaggtgaagtactggatcactattgataacccctacgtggtggcatggcacggttatgcaactggtagactcgcacccggaattcggggatcgccaaggcttggttacttggtcgcacataacctcctgcttgcacatgccaaggtgtggcatctgtacaacacctcgtttcgacctacccaaggtggacaagtgtcgatcgcgctctcctcacattggattaacccacggaggatgaccgatcatagcattaaggaatgtcagaaatcgcttgattttgtgctgggatggttcgccaaacctgtctttatagacggggattaccccgagtccatgaaaaacaacctgagcagcatcctgcccgattttaccgagagcgagaaaaagttcattaagggaacggcagactttttcgcgctctgtttcggccctacgctttcattccagctgcttgaccctcatatgaagttccgccaactggaaagccctaatctgcgtcaattgctgagctggatagacctggaattcaaccatccacagatattcattgtggaaaatggttggtttgtctcaggcacgaccaagcgcgatgatgcaaagtatatgtattacctcaagaagttcattatggagacgctgaaggccattaagctggatggggtcgatgtcataggttacaccgcctggtcgctgatggacgggttcgaatggcaccggggttactcaattcggaggggcctgttttacgtggactttctgagccaagacaagatgctgcttccaaagtctagcgcactgttctaccagaaactgattgagaagaatggttttccgcctctcccagagaaccagcccctggaaggtactttcccttgtgatttcgcatggggtgtggtggataactacatccaagtcgatactaccctctctcaattcacggatttgaacgtgtacctgtgggatgtccaccactcgaagagactcatcaaggtggatggagtggtgaccaaaaagaggaaatcgtactgcgtcgattttgcagccatccaaccacaaatcgccctccttcaagaaatgcatgtcacccattttaggttctcgctcgattgggcgttgatccttcctctggggaaccagtcgcaagtgaatcataccatccttcagtactacagatgcatggcaagcgagctcgtgagagtgaatatcaccccagtggttgcactctggcagccaatggcgcccaatcaaggccttccacgccttttggcaaggcaaggggcctgggaaaacccatacaccgctcttgctttcgcagagtacgcaaggttgtgctttcaggagctggggcaccatgtgaaactttggatcaccatgaacgaaccatacactcgcaatatgacttactcggcaggtcataatctgctgaaagcacacgcgttggcgtggcatgtgtacaatgaaaagtttagacatgcacaaaacggcaagatttcaattgcgcttcaagcagactggatcgaacccgcatgcccattctctcagaaagataaggaggtcgcagaacgcgtgctggaatttgacattggatggctggcagaaccgattttcggatccggcgattacccttgggtgatgagagactggttgaaccagcgcaacaacttcctgctcccctacttcaccgaagatgaaaagaagctgatacaaggcactttcgatttcctcgcgctgtcccattacaccaccatcctggtcgattcggaaaaagaggaccctattaagtacaacgattacttggaggtgcaggagatgactgacatcacctggctcaattcgccttcccaagtcgccgtcgtgccgtggggacttagaaaggtgctgaattggctgaagttcaagtacggtgacctgcccatgtacattatctcgaacggaattgacgacgggcttcacgcggaagatgaccagcttagagtctactacatgcaaaactacattaatgaggctttgaaggcacacatcctggatggaatcaacctctgtggttactttgcgtattcctttaacgatcgcaccgcgcctcgttttggactctaccgctatgctgcggaccaatttgagccaaaagccagtatgaagcactaccgcaagatcattgacagcaatggcttcccaggaccggagactttggaacgcttttgtccggaagaattcaccgtgtgtactgaatgctcattctttcacactagaaagtcccttctcgcgtttatagcttttctgttctttgcatcgatcatctcgctgtccttgattttctattactcgaagaaagggcgaaggtcatacaag

SEQ ID NO: 14953 - DNA, 3036 bp, Artificial Sequence; identical to SEQ ID NO: 14952
  Description of Artificial Sequence: Synthetic coding sequence

SEQ ID NO: 14954 - DNA, 3036 bp, Artificial Sequence
  Description of Artificial Sequence: Synthetic coding sequence
atgccagcctcagcaccaccgagacgcccacgaccgccacctccctcgctctccctgcttctggtcctcctgggacttgggggacggcgactgcgagctgagccaggtgatggagcacagacctgggcaagattctcaagaccacctgcaccggaggccgccgggttgtttcaaggcaccttccctgatggtttcctttgggcagtgggaagcgcagcttatcaaactgaaggaggatggcagcagcacggtaagggcgcatccatttgggatacctttacccatcatcccctcgcacctcccggtgattccagaaacgcaagcctcccactgggcgcaccaagccctcttcagcccgccactggggatgtcgcatcggactcgtacaataatgtttttcgcgacaccgaggcattgcgtgaactcggtgtcactcactacagatttagcatctcctgggcccgcgtgctcccaaatggtagcgcaggagttcccaaccgggaggggctgcgctactacaggaggcttcttgagcgtctccgcgaactcggggtgcagccagtggtcactctgtaccattgggatctgccccagcgacttcaagatgcatacggcgggtgggcgaatagggccctggccgatcatttcagggattacgccgaattgtgctttaggcacttcggcggacaagtaaagtactggataaccattgataatccctatgtggttgcatggcacggttacgcaaccggacggctcgcccctggcataaggggatcccccagacttggttacctggtggcgcataatctgcttcttgcgcatgccaaggtgtggcacctctacaatactagctttcgtcctacccagggaggacaggtgtcgatcgctctttcatcccactggatcaaccccagacgcatgaccgaccattccattaaggaatgtcagaagtcccttgactttgtgctgggatggttcgcaaagccggtctttatagatggagactaccctgagtcaatgaaaaacaatttgtcctcaatactccctgattttactgaatccgaaaagaagttcatcaaagggaccgcggactttttcgcactgtgctttggacccaccctgtcctttcagctgctggatccccatatgaaattccgccaactcgaatcgccaaatctgagacagcttctgtcctggatagaccttgaattcaaccatcctcagattttcatcgtggaaaatggatggttcgtgagcggcaccactaaaagagacgatgccaagtacatgtattatctgaagaagttcattatggaaactctgaaggccatcaagctcgacggtgtggacgtcattgggtacaccgcatggtcgctcatggatggattcgagtggcatagggggtacagcattcgacggggcctgttctacgttgatttcctctcacaggacaagatgcttcttcctaaatcatcagccctgttttaccagaagctcattgaaaagaacggattccctccactcccagagaaccagccactcgagggaacctttccctgtgactttgcctggggagtggtggacaattacatccaagtcgataccactctgtcacaattcaccgatctcaacgtgtacctttgggatgtccatcattcgaagcgcttgattaaggtggatggcgttgtgaccaagaagagaaagtcgtactgtgtggatttcgccgcaatacaaccacaaatcgcactcctgcaggaaatgcatgtgacccatttccgattttcactggactgggctcttattcttccgttgggcaaccagtcccaagtgaaccataccattctgcaatactaccgctgtatggcatcggagctcgtcagagtgaacattactcctgtggtcgcgctctggcaaccaatggcaccaaatcaaggcctgccgaggctgcttgcgagacaaggagcatgggaaaatccttacactgctctggcatttgccgagtacgcaagactttgctttcaggagctgggacatcacgtcaaactttggattactatgaacgagccatatactcgcaacatgacttactccgcaggacacaatcttctgaaagcgcatgccctggcatggcatgtgtacaatgagaagtttagacatgcgcaaaacggcaagatcagcattgccctgcaagcagattggattgagccggcgtgtcctttctcgcagaaggataaggaagtggcagagcgagtcctcgagttcgatatcgggtggctggccgaaccgatatttggttcgggtgactacccatgggtgatgagggattggcttaatcaacgcaacaactttttgctgccatacttcactgaggatgagaaaaaactgattcagggaacttttgattttctcgcactgtcccactataccaccatacttgtggacagcgaaaaagaggacccaatcaagtacaacgattacctggaagtgcaagaaatgactgatatcacgtggctgaactccccatcccaagtggcagtggtgccttggggtctgcggaaagtccttaactggctgaaattcaagtatggagatctgccaatgtacattatctctaatggtatcgatgatggactgcatgctgaggatgatcaactccgcgtgtactatatgcaaaactacattaatgaagcgctgaaggcccatattcttgacggaataaacctctgtggctactttgcctattcgttcaatgatagaacggcgcctagatttggcctttaccggtacgcggctgatcagtttgagccgaaggcctccatgaagcactacagaaagattatagatagcaatggattcccaggccctgagactcttgaacggttctgccctgaagagtttaccgtgtgtactgaatgctcctttttccatacccgaaaatcgctgctcgcattcattgcatttcttttcttcgcatccataatcagtcttagcctgattttctactactcaaagaaagggcggaggtcatacaag

SEQ ID NO: 14955 - DNA, 3036 bp, Artificial Sequence; identical to SEQ ID NO: 14954
  Description of Artificial Sequence: Synthetic coding sequence

SEQ ID NO: 14956 - DNA, 3036 bp, Artificial Sequence
  Description of Artificial Sequence: Synthetic coding sequence
atgccggcttctgccccgccacgccggcctagacctccccccccttcactatccctgctgctggtattgttgggactgggtggcagacgactcagagcagaaccaggcgatggagcgcaaacctgggcccgtttctctagaccacctgcccccgaagccgccggcctgtttcagggaacattccccgacggcttcttgtgggccgtagggtcagctgcctatcaaactgaagggggctggcaacaacacgggaagggcgcctctatctgggataccttcactcaccatccactcgcgcctcccggtgactctcgaaatgcgtccctgccactgggtgccccctcccccttgcagcctgctactggcgatgtggccagcgatagctacaacaatgtcttccgcgacaccgaagctctgcgagagctcggggtgacccactatcgtttttcgatcagctgggcacgcgtgctgccaaatggttcagcgggcgtgcctaatcgggagggattgcggtactacagacggcttttagaaagactgcgagagctgggcgttcagcccgtggtgaccctttaccactgggatttgccacagaggctgcaagacgcttatggaggctgggctaaccgcgcgctcgctgaccattttcgcgattatgccgaattgtgcttcaggcactttggaggacaggtcaagtattggattactatcgataacccgtatgtggtggcatggcatggctatgccacagggcggcttgcccctggcatcaggggctccccgcggctaggctacttagtcgcccataacctgctcctagcacacgccaaggtttggcatttgtataatacctccttcaggcctacacagggcgggcaggtctcaatcgctctctctagccattggatcaatcctaggagaatgacagaccactcaattaaagagtgtcagaagtctttggatttcgttctaggatggtttgcgaaacctgtgttcatcgatggcgactatcccgaatccatgaagaacaatctctcatctatactcccagattttaccgaatccgaaaaaaagttcatcaaggggaccgccgacttttttgccctgtgtttcggcccaaccctgtcattccagcttctggaccctcatatgaagtttagacaactcgaaagtcctaaccttaggcagctactttcatggatcgacttggagttcaatcacccgcaaattttcattgtggagaatggctggttcgtatccgggaccaccaaaagagacgacgccaaatatatgtactatttaaagaagttcattatggagacactgaaggccatcaagctggatggcgttgacgttatcggttacactgcctggtcactcatggatggtttcgagtggcataggggatacagtatcaggcgcggtctgttctacgtggactttttaagtcaggataagatgctcttgccgaagtcgagcgccctattttaccagaaactgattgagaaaaacgggtttccaccacttcccgagaatcagcccctggagggtacattcccttgcgatttcgcctggggcgtcgtggacaattacattcaggttgacactacgctttcacagtttactgaccttaacgtgtatttgtgggacgtccatcattctaaacggctgatcaaggttgacggagtcgttacgaagaagaggaagagctattgtgtggatttcgcagcaatccagccccagatagctctattgcaggagatgcacgtgacccactttcgattctcattggactgggcgctgatattgccgcttgggaaccagtcccaggtgaatcatacaatccttcagtattatcggtgcatggcctcagaactcgtgcgcgtgaacatcactcctgtggtggcgctatggcagccaatggccccaaaccaaggactccctcgtctcctggccagacagggagcctgggagaacccttataccgctctagccttcgcagaatacgctaggctatgctttcaggagctcggccatcatgtcaagctgtggatcactatgaacgaaccttacacccggaatatgacctacagtgcaggccacaatctgctgaaggcgcacgcgctcgcgtggcatgtgtacaatgaaaaattcagacatgcccagaacggcaaaatttcaatcgccctccaggcagactggatagagcctgcttgtcccttctctcagaaagataaagaagttgctgaaagggttttggagttcgacatagggtggctcgccgaacccatttttggaagcggcgactacccctgggttatgagggactggctgaaccagaggaataacttcctcctcccctattttacggaggacgaaaaaaaattgattcaaggtacattcgatttcttggccctttcccactatacaacaattctggtggactccgaaaaagaggatccaattaagtacaacgattatctggaggtacaggagatgactgacatcacgtggctcaacagcccttcccaagtggcggtggtgccatggggtctgagaaaggtgctcaactggctgaagttcaagtacggagacctgccaatgtacattattagcaatggaatcgacgacggtctgcatgccgaagatgaccagctgagagtgtattacatgcagaattacatcaacgaggcgttaaaggcacacattctcgacgggataaatctgtgtgggtattttgcatactcttttaacgaccggacggcccctaggtttggcctgtaccgatacgccgctgatcagtttgagcccaaagcctcgatgaagcattaccgcaagattatcgatagtaacggcttcccaggacccgaaacccttgaacgtttctgtcctgaggaatttacagtgtgtaccgagtgttcattcttccacacgcgaaaatcgctactcgcattcattgctttcctattttttgcttccatcatctctctgtctttgatattttattattccaagaagggccggcgttcgtacaag

SEQ ID NO: 14957 - DNA, 3036 bp, Artificial Sequence; identical to SEQ ID NO: 14956
  Description of Artificial Sequence: Synthetic coding sequence

SEQ ID NO: 14958 - DNA, 3036 bp, Artificial Sequence
  Description of Artificial Sequence: Synthetic coding sequence
atgcctgcctcggcaccacctcggcgcccacggcctcccccgccatcgctctcgctgcttcttgtgctcctggggcttggtggaagaagattgcgtgccgaaccgggagatggagcacagacctgggcccgcttcagcagacctcctgccccagaagcagcaggactgtttcagggcacttttcccgatggatttctgtgggccgtgggatcggcagcatatcagactgaagggggttggcaacaacatggcaagggcgcatccatttgggatacgttcacccaccacccccttgctccccctggcgattcgaggaacgcctcgctgcctctgggagcaccttcccccctgcaacctgccactggggacgttgcatcagatagctacaataacgtgttcagagatactgaagctctgcgcgagctgggtgtgactcactaccgattctcgatcagctgggcccgtgtccttcccaatggctcggcaggtgtgcctaatagggagggtcttaggtactaccgccgactgctggaaagattgcgggaattgggggtgcagccagtggtgaccctctaccactgggatcttcctcagaggcttcaagatgcatacggaggttgggctaaccgggcccttgcagatcactttagagactacgccgaactttgttttcgtcactttggaggacaagtcaaatactggattactattgataacccctacgtggtcgcatggcacggctacgccactggtcgccttgcacccggaatccgaggatcacctcggctcggctacctcgtcgcacataatcttctcttggcccatgcaaaggtctggcacctttacaacacctccttccgaccaactcaaggcggacaggtgtcaatcgccctgtcatcgcactggattaaccccaggagaatgaccgatcattccatcaaggaatgtcaaaaaagccttgacttcgtgctcggttggttcgcgaagcctgtctttattgatggagattacccagaatcgatgaagaataacttgtcgtcgatcttgccagattttactgaatcggaaaagaagtttatcaaaggaaccgccgatttctttgccctgtgcttcgggccaaccctttcgtttcaactcttggaccctcacatgaaattccggcagctggagtcccctaaccttagacaactgctgtcctggatcgacctcgaattcaaccatccccagatctttattgtggaaaacggctggtttgtgtcggggaccactaagagagatgacgccaagtatatgtactacctgaaaaagttcattatggaaaccctgaaggcaattaagctggacggagtggatgtcattggttacactgcatggagcctgatggatggctttgaatggcacagaggctattccataagaaggggtctgttttacgtcgattttctctcacaagataagatgctccttccaaagagcagcgctctcttctaccaaaaacttattgaaaagaacggatttccaccactccctgaaaaccagcctctggaaggaacttttccatgcgactttgcgtggggagtggtcgataactacatccaagtggacaccaccctctcgcaattcactgatctcaacgtgtacctttgggatgtgcatcattccaagaggctgattaaggtggatggcgtggtgactaaaaagcgcaaatcgtactgtgtggattttgccgcaattcagcctcaaattgcacttctgcaggaaatgcacgtgactcattttcggttcagcctggactgggcacttatactgcctcttggaaatcagtctcaagtgaaccacaccatcctccagtactaccggtgtatggcaagcgaacttgtgagagtgaacattaccccggtcgtggccctgtggcagccaatggcaccaaatcagggactccctagactccttgcaaggcagggtgcatgggagaacccatacacggcacttgcatttgcagagtatgcaaggctgtgcttccaagagctggggcatcacgtgaagctgtggattactatgaatgaaccttacactcgcaacatgacctactcagcaggacacaatcttctgaaggcacacgccctcgcgtggcatgtctataacgaaaagttccgtcatgctcaaaatggaaagattagcattgcacttcaggccgattggattgaaccagcatgtcccttctcacaaaaagataaggaagtggcggagcgcgtcctggaattcgacattggttggttggcagagccgatttttgggtcgggagattacccttgggtcatgagagactggctgaaccaaagaaacaacttcctcctgccatactttactgaggacgaaaagaagctcattcaaggaacgtttgactttcttgcactgtcgcattacactactattctcgtcgactcggaaaaggaggatccaatcaaatacaacgattatcttgaagtgcaagaaatgactgatatcacgtggctgaattcgccgtcccaagttgcggtggtgccttggggtcttagaaaagtgctgaactggctgaagttcaaatacggtgacctgccaatgtacattatctccaacggaattgatgacggcttgcatgcggaagatgatcaactccgagtctactacatgcaaaactacataaatgaggcccttaaggcccacattcttgatgggattaatctttgtggatacttcgcctactcgtttaatgataggactgcacctcgctttggactgtacagatatgctgcagaccaatttgaaccaaaagcatctatgaagcactaccgtaagattattgacagcaacgggtttcctggacccgagactttggaaagattttgtcctgaagaatttaccgtgtgtactgaatgttcttttttccatacccgaaagtcgctccttgcattcattgccttcctgttctttgcatctattatctcactgtccctcatattctactacagcaaaaagggccggcgctcgtacaaa

SEQ ID NO: 14959 - DNA, 3036 bp, Artificial Sequence; identical to SEQ ID NO: 14958
  Description of Artificial Sequence: Synthetic coding sequence

SEQ ID NO: 14960 - DNA, 3036 bp, Artificial Sequence
  Description of Artificial Sequence: Synthetic coding sequence
atgccagccagcgctccaccgagacggccaagaccaccgccgccatctcttagtcttctcctcgttctgctgggcctgggcggtcgtcgtctgcgcgcggaaccgggtgatggggcgcaaacatgggcacgtttctctagaccgccagctcccgaagcggctggactttttcaaggaacgttcccggacggatttctttgggctgtcggctcagccgcctatcaaacggaaggcgggtggcagcagcatggtaaaggcgcgtcgatctgggatacatttacgcatcatcctcttgcgccgccaggggatagcaggaacgcaagtctacctttgggcgcgccaagcccgctacaaccggccactggcgatgtagctagcgattcttacaataacgtgttcagggatactgaagccctgcgcgagttaggagtgacgcattatcgtttttccatttcatgggccagagtactgccgaatggcagcgctggagtcccgaacagagaaggcctgcgttactatagacggctgcttgaacgccttagagaactgggcgtccagccggttgtcacgttgtatcattgggaccttcctcaacgtcttcaggacgcgtacggaggttgggcgaatcgagcactcgctgatcattttcgagattatgcggaactttgttttcgccatttcgggggccaggtcaaatattggattacgatcgacaatccatatgtagtcgcttggcatggctacgctacaggacgtttagcgccgggcatccggggatcgccacgactgggctatcttgtagcgcataatctgctgctcgcccatgcaaaagtctggcacctctacaacacatctttcagacctacccagggtggacaagttagtattgcgctttcctcacattggataaatccccggcgcatgacagatcactcaattaaagagtgccagaaatccctcgattttgtcctgggatggttcgctaaaccagttttcattgacggggattatccggagagcatgaagaacaatttaagctctattttgcctgacttcacggaatctgagaagaaattcatcaaaggaacggcagatttttttgcgttatgtttcggtcctacattgtcttttcagctgctggacccacacatgaaatttagacaattggaaagccccaaccttcgtcaactactttcgtggattgacctggaatttaaccatcctcagatctttatcgtggaaaatggctggtttgtgtcaggcacgacgaaacgcgatgatgccaaatatatgtattatctcaaaaagtttattatggaaacgttgaaagcgatcaaactggacggagtggacgtgattggttatacagcgtggtccttaatggacggctttgaatggcatcggggttactccattcgaaggggcttattttatgtggatttcctgtctcaggataaaatgctccttccaaaatctagcgctttattttaccagaaattgattgaaaagaacgggttcccgccccttccggagaaccaaccgttagaggggacatttccttgtgacttcgcgtggggggtcgtcgataactacatccaagtggacacgacgctgagtcaatttactgatcttaacgtgtatctgtgggacgtacatcatagtaagagattgattaaagttgacggagtagtgacaaagaaaaggaaaagttattgcgttgattttgctgcaattcaaccacaaatcgctctgctccaagaaatgcatgtgacacattttcgtttctctttagattgggcccttattctgccccttggtaatcagtctcaggtaaatcacactattttacaatactatcgctgcatggctagcgaactggtgcgggtcaatattacaccggtagtcgccctttggcaaccgatggcacctaatcaggggttaccgcggctgctggcacgccaaggtgcttgggaaaatccttatacggcacttgcttttgctgagtacgcccgtttatgctttcaggagctgggacaccacgtaaaactttggattacgatgaatgaaccttatacaaggaatatgacatatagcgctggccataatctgttaaaagcacacgctttggcctggcatgtttataatgaaaagtttaggcatgcacaaaatggtaagatttcaatcgcgttacaagctgattggattgaaccagcttgcccgtttagccagaaggataaagaagtcgcggaaagggtcctggagtttgacataggctggctggcggaacccatctttggatctggggactatccgtgggtcatgcgggattggcttaaccagagaaacaactttctgctgccgtatttcaccgaagatgaaaaaaaattaatacagggcactttcgattttctcgcgctgtcccactatacaacaattttggttgactcagagaaggaagacccgattaaatataatgattatcttgaagtacaggaaatgactgatatcacatggttgaactccccaagccaggtggccgtggtgccttggggccttcggaaagtgcttaattggctgaaatttaagtatggcgatctgccgatgtatattatcagcaatggaattgatgacggactgcatgctgaggatgaccaactaagagtttactacatgcagaactatataaacgaagctctaaaagcccatatccttgacggaatcaatctctgcggctactttgcatactcattcaatgataggactgctcccaggtttggactgtaccggtatgcggccgatcaatttgaaccaaaagcctctatgaaacactatagaaaaatcatcgatagcaatggcttccctggaccggaaacacttgaacgcttttgcccagaagaattcacagtatgcacggagtgcagtttttttcacactagaaaatcccttcttgcgttcattgcgtttctgtttttcgcgtctattatttcactgtctttgatcttctattactctaaaaaaggcagacggagctataaa

SEQ ID NO: 14961 - DNA, 3036 bp, Artificial Sequence; identical to SEQ ID NO: 14960
  Description of Artificial Sequence: Synthetic coding sequence

SEQ ID NO: 14962 - DNA, 3036 bp, Artificial Sequence
  Description of Artificial Sequence: Synthetic coding sequence
atgccagcctcggcacctcctcggcgccctcgtcctccacccccttcgttgtcactgcttcttgtcctgctgggactgggagggagacggctccgggccgaacctggggacggcgcacaaacctgggccagattttccagaccacccgcacccgaggccgctggattgtttcaaggcacttttcccgatggatttctgtgggcagtgggttcggcagcttaccaaaccgaaggggggtggcagcaacacgggaaaggagccagcatctgggatacgtttactcaccacccgcttgccccgccgggggattcaagaaacgcctcgcttcccctgggtgccccctcacctcttcagccagccaccggagatgtggcctccgattcgtacaacaacgtctttagggataccgaggcgcttcgagaactgggcgtgacccactacagattttcaatttcgtgggcccgagtgctccctaatgggtcggccggggtgcccaaccgcgagggactcagatactaccgaaggcttcttgaacgcctccgcgagctgggagtccagcctgtggtgaccctgtaccactgggaccttcctcaaaggctgcaggatgcatacggcgggtgggccaacagagcacttgcagaccatttccgagattacgcagaactgtgttttcggcattttggtggccaagttaagtattggatcaccatcgataacccatacgtggtggcctggcatggttacgcaaccggcagacttgcaccaggtatacgaggatcgccgcgacttgggtacctggtggcccacaatctcctcctggcccatgctaaggtttggcatctgtacaacacgagctttagaccgacccagggaggtcaggtgagcattgcgctgtcctcgcattggattaatccccgcagaatgaccgatcactccattaaggaatgccagaaatcgctggatttcgtgcttggatggttcgcgaagcctgtctttattgacggagactacccagagtcaatgaaaaacaacctttcgtccattcttccagacttcactgagtcggaaaagaagtttatcaagggtaccgcagatttctttgccctgtgttttgggccgactctcagcttccaacttctcgatccacacatgaagtttaggcaactcgaatcgcctaacctgagacagcttctgtcctggattgacctcgagtttaatcatcctcagatctttatagtggaaaatggatggtttgtctccggtactactaagagagatgatgccaaatacatgtactacttgaagaagttcatcatggaaactctgaaggctataaagctcgatggcgttgatgtgatagggtatacggcatggagtttgatggatggctttgagtggcatcggggttactccattcgaagaggtttgttttacgtggactttctctcgcaggacaagatgcttctgccaaaaagctccgcccttttctaccaaaaacttatcgaaaagaacggatttcctccgcttcctgagaatcaaccacttgagggtacttttccatgtgattttgcttggggagtggtcgacaattacatccaggtggatactactctttcacaatttaccgatctgaatgtgtacctctgggatgttcaccactcgaaaagactcatcaaggtagacggcgtggtgactaagaagcggaaatcctactgcgtcgactttgccgcaattcaaccccagattgcacttctccaggagatgcatgtgactcatttcagattctccctggattgggcacttatacttccacttggaaatcagtcgcaagtgaaccacaccatacttcagtactatcggtgtatggcatcggaactcgtccgcgtgaacattactccggtggtggccctctggcaacccatggcacctaaccaaggcctgcctagactgctggcaagacagggtgcgtgggaaaacccgtacacggctctggcatttgccgaatacgcacgactgtgtttccaagaacttggtcatcacgtgaagctgtggatcacgatgaatgaaccgtatactaggaacatgacctactcagcaggacataacctgctcaaagcgcatgcccttgcctggcatgtctacaacgagaagtttcggcatgcacaaaacgggaagatttccattgctctgcaagcagattggattgaacccgcatgtccattctcccagaaggataaagaagtcgcagaaagagtgcttgagttcgacatcggatggttggccgaaccaatattcggaagcggagattacccttgggtgatgagggactggcttaatcaaagaaacaactttctgctgccatactttactgaagatgagaagaagctgatccagggaacctttgactttctcgcgctgtcacattacaccaccatactcgtggattcggagaaggaggacccaatcaaatacaacgactacctggaggtgcaagagatgacggacatcacctggctgaactcacccagccaagtggctgtggtgccttggggactcagaaaggtcctcaactggctgaagtttaagtacggagatctgccaatgtacattatctcaaatggtatcgatgacggcctgcacgccgaagatgaccagttgcgcgtgtactacatgcagaattacattaacgaggcccttaaggctcatatcctggatggaatcaatctgtgcggatatttcgcgtactcatttaacgatagaacggcacctcgcttcgggctttacagatatgcagcagatcaattcgaaccaaaagcatcgatgaaacattacagaaaaatcatcgactccaacgggtttccaggacctgaaacccttgagagattctgtccagaagaatttaccgtctgcactgagtgttcattctttcatactagaaagtccctgctggcgtttatcgcatttctgttttttgcaagcattatctccctttcactgattttctactactcgaaaaagggccgcagaagctacaag

SEQ ID NO: 14963 - DNA, 3036 bp, Artificial Sequence; identical to SEQ ID NO: 14962
  Description of Artificial Sequence: Synthetic coding sequence

SEQ ID NO: 14964 - DNA, 3036 bp, Artificial Sequence
  Description of Artificial Sequence: Synthetic coding sequence
atgccagcatctgccccgcccaggcgcccgcggcccccaccaccgtcgctgtcactgctcctcgtgttgttgggactcggtggacggagactgcgggccgagccaggggatggagcccaaacttgggctcggttcagccggcctcctgcgccggaagcggcaggcttgtttcaggggaccttccctgacggatttctgtgggcggtgggcagcgctgcataccaaaccgaaggcggatggcagcaacacggcaagggagcttcgatctgggataccttcactcaccatccactggctccgccaggggactccagaaacgcgtctctcccgctcggagcaccttcccctctccagccggcaaccggagacgtcgcttcggattcgtataacaacgttttccgcgacactgaggcgctccgcgaacttggagtgacccactacagattctcgatctcgtgggccagagtgctcccgaatggatccgctggagtgccgaaccgcgaagggcttcgctactacaggaggctgctggagcggctcagggaactgggagtgcaacctgttgtgaccttgtatcactgggatctcccacagcgcctccaggacgcgtacggaggttgggcgaatcgtgccctcgctgaccattttagagactacgctgaactttgcttccgccacttcggaggccaagtgaagtactggatcactattgacaacccttacgtcgtggcctggcatggctacgccactggacgcctcgctcctggcatccgcggatccccacgcctgggctacctcgtggctcacaacctgctcctggctcacgcgaaggtgtggcacctgtacaacacctcgttcagaccgactcagggaggacaagtgtccatcgcgttgagcagccactggatcaatccgagacggatgaccgatcacagcattaaagagtgccagaagagcctggacttcgtgcttggttggtttgccaagccggtctttatcgatggagactacccggagtcgatgaaaaacaacttgtcgtcgatcctgccggatttcaccgagagcgagaaaaagttcattaagggaacggcggactttttcgcactgtgcttcggcccaactctgagcttccagctgctcgatccacacatgaagttcaggcagctcgaatccccgaacctgcgccagctgctctcctggatcgacctggaattcaatcacccgcagatcttcatcgtggaaaatgggtggttcgtctcaggaacgactaaacgcgatgatgcgaagtacatgtattacctcaagaagtttatcatggagactctgaaggcgattaagctggacggggtcgacgtgatcggctacactgcttggtctttgatggatgggttcgagtggcaccgtggatactcgatccggcggggactcttttacgtggacttcttgtcgcaagataagatgctcctgccgaaaagctccgccctgttttaccagaagctcatcgaaaagaacggattcccaccgctgccagaaaatcagccgctggaggggacctttccgtgcgactttgcatggggcgtcgtggacaactacatccaggtggacaccactctctcgcagtttactgacctcaacgtgtacttgtgggacgtgcaccatagcaagcggctgatcaaggtcgacggagtcgtgaccaaaaagagaaagagctactgtgtggattttgcagcaatccagccccagatcgctcttctgcaggagatgcacgtgactcacttcaggttttccctggactgggcactgatcctgcctctgggtaaccagtcccaagtgaaccacactatcctccagtattaccgctgcatggcctctgaactggtgagagtgaacatcacgccggtcgtcgcgctgtggcagccgatggcaccaaaccagggactgcctagattgcttgctaggcagggtgcctgggaaaacccttataccgctttggccttcgcagagtatgcaagactctgcttccaggagctcggacatcacgtcaaactttggatcacgatgaacgagccttacactaggaacatgacctactcagccggacataacctgctgaaggcacatgcactcgcctggcatgtgtataacgaaaagttccgccatgctcagaacggcaagattagcatcgcactgcaggccgactggattgaacctgcctgtcccttctcccagaaggataaagaagtagcggagagagtcttggaatttgatatcggctggttggcggaacctatattcgggtccggagactacccctgggtgatgagagactggttgaaccagcgcaacaatttcctgctgccatacttcaccgaggacgaaaagaaactgatccaggggactttcgacttccttgcactttcacactacactaccatcctggtggattcagaaaaggaggacccaattaagtacaacgattacctggaggtgcaagagatgacggacatcacctggctgaactcaccgtcgcaggttgccgtggtgccgtggggactcaggaaggtgctgaactggctgaagttcaagtacggagatctgccgatgtacatcatcagcaatggaatcgatgatggcctgcatgccgaggatgatcagcttcgggtgtactacatgcaaaactacatcaacgaagcattgaaggcccatatcttggacggaattaacctctgtggatatttcgcctactccttcaatgatcggactgcacccagattcggactttaccgatacgccgctgatcagttcgaaccaaaggcaagcatgaaacattacagaaaaatcattgattcaaacggattcccgggacctgaaaccctggagagattctgtcccgaagagttcactgtgtgcaccgaatgctcatttttccacaccaggaagtcgcttttggccttcatcgcctttcttttctttgcgtccatcatttccctgtctctgatattctactactccaagaagggacgccgctcctacaag

SEQ ID NO: 14965 - DNA, 3036 bp, Artificial Sequence; identical to SEQ ID NO: 14964
  Description of Artificial Sequence: Synthetic coding sequence

SEQ ID NO: 14966 - DNA, 3036 bp, Artificial Sequence
  Description of Artificial Sequence: Synthetic coding sequence
atgccagctagtgcaccaccaagaagaccaagaccacctccaccttctttgtctttgcttttagtattacttggattaggaggaaggcgattgagagctgaaccaggagatggagcccaaacttgggctagattttcaagaccaccagctccagaagcagcaggtctttttcaaggtacttttccagatgggtttttatgggctgttggttcagcagcatatcaaactgaaggaggatggcaacaacacggaaagggagcatcaatatgggatacatttacacatcatcctttagcacctcctggtgattctagaaatgcatcacttccattaggtgcaccttcaccacttcaaccagctactggagatgtcgcatctgattcatataataatgtttttagagatactgaagctcttcgagaattgggagttactcattatagattctcaatttcatgggcaagagttttacctaatggatcagcaggtgttccaaatagagaaggattaagatattatcgaagattattagaaagattaagagaattaggagttcaaccagttgtcacactttatcattgggaccttcctcaacgattacaagatgcatatggaggatgggcaaatagggcattagctgatcattttagggattatgcagagctttgtttcagacatttcggtggtcaagttaagtattggattacaattgataatccttatgtagttgcatggcatggatatgctacaggaagacttgcaccaggaattcgtggatcaccaagattaggatatttagttgcacataatcttttacttgctcatgcaaaggtatggcatctttataatacaagttttagaccaactcaaggaggacaagtatcaatcgcattatcatcgcattggattaatcctagaagaatgactgaccattctattaaggaatgtcaaaaatcattagattttgttttaggatggtttgccaagcctgtttttattgatggagattatcctgagtcaatgaaaaataatttaagtagcatcttaccagactttactgaatctgaaaaaaaatttataaaaggtacagcagattttttcgctctttgttttggtccaacgttaagttttcaattattagatccacacatgaaatttagacaattagaaagtccaaacttacgtcaattactttcttggattgatcttgaattcaatcatccacaaatcttcatagttgaaaatggatggtttgtatctggaacaactaaaagagatgatgcaaaatatatgtattatttaaaaaagttcattatggagactcttaaggcaattaagcttgatggagttgatgttattggatatacagcatggagtcttatggatggatttgagtggcatagaggatattctataagaagaggtttattttatgttgattttttatcacaagataaaatgcttcttccaaaatcatcagcattattttatcaaaaattaatagaaaagaatggatttccaccacttccagaaaaccaaccattagagggaactttcccatgtgattttgcatggggtgttgttgataactatattcaagtagatactacattatcacaatttacagatcttaatgtttatctttgggatgtccatcattctaaaagacttattaaagttgatggagttgtaactaaaaaaagaaaatcttattgtgtggactttgctgcaatacaaccacaaatagctttacttcaagaaatgcatgttacacattttcgtttttccttagattgggcattaattcttcctttaggaaaccaatcacaagttaatcatactattttgcaatattatcgttgtatggcatcagaattagttagagtaaatattacaccagttgttgctttatggcaaccaatggctccaaatcaaggtttaccaagattattagcacgacaaggtgcatgggaaaacccatatacagctttagcttttgctgaatatgcaagattgtgttttcaagaattaggtcatcatgtaaagctttggattactatgaatgaaccatatactaggaatatgacctatagtgcaggtcataatcttttgaaagcacatgcattggcttggcatgtttataatgagaaattcagacacgcacaaaatggaaaaattagcattgcccttcaagctgattggatagaaccagcatgtccattttcacaaaaagataaggaagttgcagaaagagtattagaatttgatattggatggcttgcagaaccaattttcggatcaggtgattatccatgggtaatgagagattggttaaatcaaagaaataattttttacttccatatttcacagaagatgaaaaaaaattaattcaaggtacatttgattttttagcattaagtcattatactacaattttggtagattctgaaaaagaagatccaataaaatataatgattatcttgaagttcaagaaatgacagatattacttggctcaattctccatcacaagttgctgttgttccttggggtttgagaaaagttttaaattggttaaaatttaaatatggagatttaccaatgtacattatttctaatggaattgatgatggattacatgcagaagatgaccaattgagagtttattatatgcaaaattatattaatgaagcattaaaggctcatattttagatggaattaatctttgtggatattttgcatattcttttaatgatagaacagcaccaagatttggactttatagatatgcagctgaccaatttgaaccaaaggctagtatgaaacactatagaaagattattgattcaaatggatttccaggtcctgaaacacttgaacgattttgtccagaagaatttacagtttgtacagaatgttctttctttcatactagaaaatcattgttagcttttattgcatttttattcttcgcatcaattatttcattatcattaattttttattactcaaagaaaggaagaagatcatacaaa

SEQ ID NO: 14967 - DNA, 3036 bp, Artificial Sequence; identical to SEQ ID NO: 14966
  Description of Artificial Sequence: Synthetic coding sequence

SEQ ID NO: 14968 - DNA, 3036 bp, Artificial Sequence
  Description of Artificial Sequence: Synthetic coding sequence
atgccagcaagcgcaccccccaggcgtcctcgcccacccccaccctctctttcgcttctcctggtgctgctgggtctgggcggccggcgtctcagagcagaacctggagatggagcacagacctgggcgaggttttcaagacctcctgcgcctgaagcagctggtctttttcagggtacttttccggacggatttctgtgggcggtcgggtccgcggcataccaaactgaaggaggatggcaacaacacgggaaaggcgcctcgatctgggacacctttactcatcatcccctggcaccaccaggagattcccggaatgcctcgctccctctcggagcccctagcccactccagcctgcgactggggatgtggcaagcgattcatacaacaacgtgttccgtgacactgaagcactccgcgaattgggagtgacccattaccgtttcagcattagctgggcccgtgtgcttcccaacggatcggcaggagtgcctaaccgggaaggtctgaggtactacagacggcttctggaacgcctccgggaactcggcgtgcaacctgtggttacgctttaccattgggatctgccacaacgactccaagatgcttatggaggatgggccaatcgcgcacttgcagatcacttccgagattacgcagagctgtgttttcgtcatttcgggggacaggtgaagtactggattaccatcgacaatccatacgtggtggcgtggcacggttacgcaaccggccgccttgcacccggaattcgcggctccccccgcctgggctacctggtggcacacaatttgttgcttgcgcatgcaaaggtgtggcacctttacaataccagctttcgccctacccagggaggacaagtctcaatcgccctgtcgtcacattggattaatccgcgacggatgaccgatcattccattaaggagtgtcaaaagtccctggacttcgtcctcggttggtttgcgaagcctgtctttattgatggtgattacccagagtcgatgaaaaacaacctctctagcattctgcctgacttcaccgaatctgaaaagaagttcataaagggcaccgctgacttttttgcgctctgctttggtccgaccctctcctttcagctcctcgatcctcatatgaagtttagacagctcgagagccctaacctgagacagctgctttcatggattgatctggagtttaaccacccacagattttcattgtggaaaacggatggtttgtctcaggtactaccaagagagatgatgcaaaatacatgtactatctcaagaagttcattatggagactctgaaggcaatcaagctcgacggcgtggacgtgatcggttacactgcctggtcgctcatggacggcttcgaatggcacagagggtacagcattagacgaggactgttttacgttgacttcctctcccaagacaagatgcttctgcctaagtcgtcagcactcttttaccagaagctcatagaaaagaacggctttccacctcttcctgaaaaccaacccttggaagggaccttcccctgtgactttgcctggggcgtggtcgataactacattcaggtcgatactacgctctcacaatttactgatttgaatgtctacctgtgggatgtgcaccactcgaagaggctgatcaaggtggatggggtcgtcactaagaagagaaagtcgtactgtgtggattttgcagcaatccagccacagattgcgctcctgcaagagatgcatgtgacgcattttagatttagccttgattgggcactcatcctccccctcggtaatcaaagccaagtgaaccacacgatcctccagtactacagatgtatggcatcggagcttgtgcgtgtcaacattactccagtggtcgcactttggcaaccaatggcaccaaaccagggccttcctagactgctggcccggcaaggagcctgggaaaacccttacaccgcccttgctttcgcagaatacgcaagactgtgttttcaagaattgggtcatcacgtcaaactgtggatcactatgaatgagccttacactcgcaacatgacctactctgcaggtcataatcttcttaaagcgcacgcacttgcatggcacgtgtacaacgagaaattcagacatgcacagaatggaaagatctcaattgccctgcaggcagactggatcgaacctgcatgcccgttttcgcagaaggacaaggaagtcgcagaacgagtgctggaatttgatataggttggttggccgagccaatctttggatcaggagattacccttgggtgatgagagactggctgaatcaaaggaacaactttcttctcccatacttcaccgaggatgagaagaagctgatccaaggaacctttgactttctcgcacttagccactacactactatcctggtggactctgaaaaggaggatccaattaagtacaatgactacttggaagtgcaagaaatgactgacattacttggctgaactcgccctcccaagtcgccgtggtgccgtggggactgcggaaggtgttgaattggttgaaattcaagtacggcgatctgcctatgtacatcatttccaatggaatagatgacggacttcatgcagaggatgaccaactgcgcgtgtattacatgcagaattacattaacgaagcactcaaagcacatatcttggacgggataaacctctgtggttacttcgcttactccttcaacgatagaactgcccctcgctttggactttatcgatacgcagcagaccaattcgaacctaaggcatcgatgaaacattacagaaaaatcattgacagcaatggattccccggacctgaaaccttggaacgattctgccctgaagaattcaccgtgtgtactgaatgtagcttctttcatactcgcaagtcgctcctggcctttattgcctttctgttttttgcttcaattatctcgctcagcctgattttctactactccaaaaaaggtcgacgctcctacaag

SEQ ID NO: 14969 - DNA, 3036 bp, Artificial Sequence; identical to SEQ ID NO: 14968
  Description of Artificial Sequence: Synthetic coding sequence

SEQ ID NO: 14970 - DNA, 3036 bp, Artificial Sequence
  Description of Artificial Sequence: Synthetic coding sequence
atgccggcatcagcaccacctagaaggccaagacctccccctcctagcctgtccttgctcttggtcctgttggggctgggaggacggcgcctgcgcgcagaacccggtgatggagcacagacttgggcaagattctcaagaccaccagcgccggaagctgccggactttttcagggtacctttcccgacggctttctctgggcagtgggatccgcagcgtatcagactgaaggtggttggcagcagcacggcaagggagcatctatatgggacacttttacgcaccatcctcttgcccctccaggagatagccggaacgcatccctcccacttggggcaccttcccctctgcaaccagcaaccggcgatgtggcatcggactcatacaataacgtctttcgtgacacggaggccctgcgagaacttggagtgacccattacagattttcaatctcctgggcgcgggtgctcccaaatggctcagcaggcgtgccgaacagagaaggccttcgctactaccgacgactgcttgaacgactgcgggaattgggggttcaacccgtggtgaccctttaccactgggacctgcctcagcgactccaggacgcgtacggaggttgggccaaccgagcgctggccgatcatttccgcgactacgcagaactgtgcttcagacatttcggtggacaagttaagtactggataactatcgacaatccatatgtggtcgcatggcatgggtacgcgactggtcggcttgcgcctggaatacgaggttcgccccgtctcgggtacctggtggcacacaaccttctcctggcacacgcaaaggtctggcatctttacaacacttcgtttcgacctacccaaggtggacaagtctcgattgcgctgagctcgcattggattaatcccagaagaatgacggaccatagcattaaggaatgtcaaaagtccctcgactttgtgctgggatggtttgctaaaccggttttcattgacggtgattacccagaatcgatgaagaacaatcttagcagcatcctgcctgactttaccgagtcagaaaagaagttcataaaagggaccgcagatttctttgcactgtgtttcggtcccacgctttcctttcaactgttggatccacacatgaagtttagacaacttgaaagcccgaatcttcggcagctgttgtcctggatcgatctcgaattcaatcacccgcagatattcatcgtggaaaatggatggttcgtctcaggtacgactaaacgggacgatgcaaaatacatgtactatctcaagaaattcatcatggaaacgctgaaggcaataaagctggatggcgtggacgtgatcggctacaccgcctggtcactgatggatggctttgaatggcacagaggatactcgatacgcagaggactcttttacgtggattttctttcgcaggataagatgctcctccctaagagttcggccctcttttaccagaaacttatcgagaagaatgggtttccgccactgcctgagaaccagcctctcgaggggacctttccttgtgattttgcctggggcgtggttgacaactacatacaggtcgacactaccctgagccaatttaccgaccttaacgtgtacctttgggatgtgcatcattcgaaaagactgattaaagttgatggagtcgtgaccaaaaagagaaagtcctactgtgttgatttcgccgctattcaaccacaaattgcacttctgcaagagatgcacgtgacccatttccgtttctctcttgactgggccctcattctccccctgggcaaccagagccaagtgaatcacactatcctgcagtactacagatgcatggcaagcgagctggttagggtcaacattacccctgtcgtcgccctttggcagcctatggcacccaaccaagggttgcctcgcctgcttgcacggcagggagcctgggagaacccttacaccgcgcttgcattcgccgagtacgcgagactttgcttccaggagttggggcatcatgtgaagctgtggattactatgaatgaaccttacactagaaacatgacctatagcgcaggtcataacctgttgaaggcgcacgcattggcatggcacgtgtataatgagaagttccgccatgctcagaacggaaagatatcaatagcactgcaagctgattggatcgagccagcatgtcccttttcgcagaaagataaggaagtcgcagagagagttctcgagtttgatattgggtggctggcggaaccaattttcgggtccggggattacccttgggtgatgagagattggctgaaccaaagaaacaacttcctgctgccgtactttaccgaagatgaaaagaagctgattcaaggaacctttgattttctcgccttgtctcattacactacgatcctcgtggactccgaaaaggaagatcccatcaagtataatgattacctggaggtgcaagaaatgactgacataacttggctcaactcgccctcccaagtcgcagtggtgccttggggacttcgcaaggtcctcaactggctgaagttcaagtacggtgatctcccgatgtacattatctcgaatggaattgatgatgggctgcacgcagaggatgatcaattgcgagtatactacatgcagaactacattaatgaggcactgaaggcacatatactggacggtattaacctgtgtggatactttgcatactcgtttaatgacagaactgcgccgagattcggtctgtataggtacgcagcagatcaattcgaacctaaggcctccatgaaacattataggaagattattgattctaacggatttccaggacccgagactcttgaaaggttttgcccggaagagttcaccgtgtgtactgaatgctcattctttcacaccaggaagtcacttctggcattcattgcctttcttttctttgcatcaattatctcgctttccctgatcttttactactcaaaaaagggtcggagaagctacaag

SEQ ID NO: 14971 - DNA, 3036 bp, Artificial Sequence; identical to SEQ ID NO: 14970
  Description of Artificial Sequence: Synthetic coding sequence

SEQ ID NO: 14972 - DNA, 3036 bp, Artificial Sequence
  Description of Artificial Sequence: Synthetic coding sequence
atgcccgcaagcgcgcccccgagacgcccacggccaccgccgccaagcctctccctcctgctcgtgctcttgggtctggggggacggagactgagagctgaacctggagacggagcgcagacttgggcacgcttttcgaggccaccagcgccggaggcggcaggactgtttcagggcaccttcccggacggattcctgtgggccgttggatcggccgcctaccaaactgaaggaggctggcagcagcacggaaagggggcctccatctgggacacttttactcatcatcctctcgcgccaccaggcgactcacggaacgcttccctgccgctcggtgccccgtcccctctgcaaccagcgaccggagacgtcgcctctgactcatacaataacgtgttccgggatactgaggcgttgcgagaactgggagtgacccattaccgcttctcgatctcgtgggcgagggtcctgccaaacggatccgccggcgtcccaaaccgcgagggactccgttactaccgcagactgcttgaacggctcagagaactcggagtgcagccggtcgtgacgttgtatcattgggacctcccgcagcggctccaggacgcctacggtgggtgggctaaccgggcgctggccgatcatttcagggactacgcagaactgtgtttccgccacttcggcgggcaggtgaaatactggatcaccatcgataacccctacgtggtcgcttggcacggttacgcaacgggcagactggccccgggcatcagaggatccccgcgcctgggataccttgtcgcccataacctcctgctggcccacgcgaaggtctggcacctgtacaacactagcttcagaccgacccaaggtggtcaggtgtccatcgcactgtcgtcgcattggattaacccccggaggatgactgaccatagcattaaggagtgtcagaaatcactggatttcgtgttgggctggtttgccaaaccggtgttcatcgacggagattaccccgaatcaatgaagaacaacctctcgtccatcctcccggacttcactgagtccgaaaagaagttcataaaggggaccgcggacttctttgctctctgctttgggccgaccctgtcttttcagctcctggatccgcacatgaaattccggcagctcgagtccccgaacctgaggcagttgctgagttggatcgacctggagttcaatcacccacagattttcatcgtggaaaacggatggttcgtgtcgggcaccactaaaagggacgacgccaagtacatgtattacctgaagaaattcatcatggaaactctgaaggccatcaaactggacggcgtggacgtgattggctacactgcatggtcactgatggacggattcgaatggcaccgggggtactccatccggcgagggctgttctatgtggacttcctttcccaggacaagatgctcctccctaaatcgtcggcgctgttctaccagaagctgatcgaaaagaacgggttccctccattgccggagaaccagcccctggaaggaactttcccatgcgattttgcatggggagtggtggacaactacatacaggtcgacaccaccctctcccaatttaccgatttgaacgtgtacctgtgggatgtgcatcattccaagcgcctcatcaaagtggacggagtcgtgaccaaaaagaggaaatcatactgcgttgacttcgctgccattcagccgcagatcgcactgttgcaagaaatgcacgtgactcatttccggttcagccttgattgggccctcatcctgccgttgggaaaccagtcgcaagtgaaccatactatcctgcagtactacagatgtatggcgtccgagctcgtccgtgtgaatatcaccccggtggtggcattgtggcaacctatggcaccgaaccagggactgcctaggttgctggccagacagggtgcttgggagaatccgtacaccgcattggccttcgccgaatacgcacgcctgtgctttcaggaactgggccaccatgtcaaactgtggattaccatgaacgagccgtacactcgcaatatgacttactcagcaggacacaatctgctgaaagcccatgcactggcatggcacgtctacaatgagaaattcaggcacgctcaaaacgggaagatctccatcgcgttgcaggccgactggatcgaacccgcatgtccgttctcgcagaaagacaaggaggtggcagaacgcgtgctggaattcgacattggctggctggcggaacctatcttcggatctggagattatccctgggtcatgagggattggcttaaccaacgcaataactttctgctgccttactttacggaggacgaaaagaaactcatccagggaaccttcgacttcttggccctgagccactacactaccattctggtggactcggagaaggaggaccctatcaaatacaatgactacctggaagtgcaagagatgactgacatcacttggctgaactctccttcccaggtggccgtggtgccttggggtctgcgcaaagtgttgaattggctcaaattcaaatacggagatctcccgatgtacatcatcagcaatgggatcgacgacggcctccacgcggaagatgatcaactgagagtctattacatgcagaactacatcaacgaagcgctcaaggcccacattctcgacggcatcaatctgtgcggatacttcgcttactcgttcaacgaccggacggcaccaagatttggtttgtacagatacgcggctgaccagttcgaaccaaaggcaagcatgaagcattacaggaagatcatcgactcaaacggattcccaggaccagagacgctcgagcgcttttgtcccgaagaattcaccgtgtgtaccgagtgcagcttcttccacaccagaaagtcgctgctggccttcatagccttcctgttttttgctagcattatctccctgtcgctcatcttttactactcaaaaaagggccggcggtcatacaag

SEQ ID NO: 14973 - DNA, 3036 bp, Artificial Sequence; identical to SEQ ID NO: 14972
  Description of Artificial Sequence: Synthetic coding sequence

SEQ ID NO: 14974 - DNA, 3036 bp, Artificial Sequence
  Description of Artificial Sequence: Synthetic coding sequence
atgcctgcatccgcacctcctaggcgcccccggccgccgccaccgtccctttccctgcttcttgtgcttcttggtctgggaggacggaggctgcgggcagaacctggagatggagcgcaaacgtgggccagatttagccgccctcctgcccctgaggcagcaggtcttttccaaggaacctttccggatggatttctttgggcggtcggaagcgcagcataccagaccgaaggaggctggcagcagcacggcaagggagcgtccatttgggacacttttactcatcacccacttgcaccccccggagattcccgaaatgcaagccttccgctgggagcaccttcgccacttcaacccgcaactggtgatgttgcatccgattcttacaacaacgtctttcgcgatactgaagctcttcgggaactgggtgttacccactacaggtttagcatctcgtgggcacgtgtgcttccaaacggttcggccggagtgccaaatcgagagggtctgcgatactaccgacgtctgctggaacggctgagagaacttggtgtccagcccgtagtgactttgtaccactgggatctcccgcaaagacttcaagacgcatacggtgggtgggcaaatcgggcactcgcggatcacttcagggattacgcagaactttgttttcgacacttcggaggtcaagtcaaatactggattaccattgataacccgtatgtggtggcttggcatggctacgcaaccggacgcctggcccccggtatccgtggatccccacgacttggttaccttgtcgcacataaccttctgcttgcgcatgcgaaagtgtggcatctgtacaacacttcctttcggcctactcagggaggacaggtttcgattgcgttgtcatcacattggattaaccctagaagaatgaccgatcacagcattaaggaatgtcaaaaaagcctcgactttgttcttggctggttcgcaaagccagtgtttatcgatggagactaccctgagagcatgaagaataacctgtcatccatcctgccggattttactgaatccgagaagaaattcattaagggaacggccgacttttttgcattgtgttttggaccaactcttagttttcaactgctcgacccccacatgaaattcagacagctggagtcccccaacctgagacagctgctttcctggatcgacctcgagtttaatcaccctcagatattcatagtcgaaaatggctggttcgtcagcggaaccactaaaagggatgatgcaaagtatatgtactatcttaagaagttcattatggaaaccctcaaggcaatcaaacttgacggagtggatgttataggctacaccgcttggagcctcatggatggattcgaatggcaccggggatactccatacgccgggggcttttctatgtagactttctgtcacaagacaaaatgctgcttccaaaatcgtcggccctgttttaccaaaagttgatagagaaaaacggattccctccactcccagaaaatcagcctctcgagggaaccttcccttgtgatttcgcatggggtgtggtggacaattacattcaggtcgacaccactctttcgcagttcactgatctcaacgtgtacctttgggatgtccatcattccaagagactcattaaggtggacggagtggtcaccaagaagagaaagtcgtactgtgtcgactttgcagcgattcaaccacaaattgcactgctccaagagatgcacgtgacgcattttcgattcagccttgattgggccctgattttgccgctcggcaaccagtcgcaggtgaatcatactatactgcaatactaccgctgtatggcaagtgaactggtgcgggtgaacatcacccctgtggtggccctgtggcagcctatggcccctaatcaaggactcccgcgtctgctggcacggcaaggtgcatgggagaacccatacaccgcccttgcatttgcagagtacgcccgcctttgctttcaagagctgggacatcacgtgaaactgtggattaccatgaatgaaccatatactcgcaacatgacttactccgcaggacataacctgcttaaggcacacgcgctggcatggcatgtgtacaatgagaagtttagacatgcgcagaacggcaagatttcgatcgcactccaagcggattggattgaacccgcatgccccttcagccaaaaggataaggaggtcgcggagagagtgcttgaatttgatattggatggctggcagagccaatattcggttctggcgactacccttgggtgatgagagactggcttaaccagcgtaacaattttctgttgccctatttcaccgaggatgaaaagaagctgattcaaggtaccttcgattttctggccctctcccattacactaccatccttgtggatagcgaaaaagaagatcctattaagtacaatgattaccttgaagtgcaagaaatgaccgatattacctggcttaactcccctagccaggtggcagtcgtcccttggggtctgcgcaaggtgctgaattggctcaagtttaagtacggggacctcccaatgtacatcatttcaaacggaatagatgacggccttcacgcagaggatgaccagttgagagtctactacatgcagaactatatcaacgaagcacttaaggcgcatatcctggatgggataaacttgtgtggttactttgcatactcatttaacgacaggactgcaccaaggttcggactttacaggtacgctgcagaccagtttgagccgaaagcctcaatgaaacattaccgaaagattatcgactccaacggcttccccggaccagaaactcttgaacgattttgtccagaagaattcacggtgtgcaccgaatgctccttctttcatactcgaaagtcacttctggcattcattgcatttctgtttttcgcatccatcatttcacttagcctgattttctactactcaaagaaaggtcgcagatcctacaag

SEQ ID NO: 14975 - DNA, 3036 bp, Artificial Sequence; identical to SEQ ID NO: 14974
  Description of Artificial Sequence: Synthetic coding sequence

SEQ ID NO: 14976 - DNA, 3036 bp, Artificial Sequence
  Description of Artificial Sequence: Synthetic coding sequence
atgcctgcttccgccccccctagacggcctcgcccccccccaccgagtttgtctctcctgcttgtgcttttgggactcggaggaaggcggctgagggcagagcccggggatggcgcacagacatgggccagatttagccggccccctgctcccgaagcagcggggctgtttcagggcactttccctgatggctttctctgggccgtgggatctgctgcctatcagaccgaagggggctggcagcaacacgggaagggggccagcatatgggacacattcacccaccatccgctggccccacctggtgacagccgaaacgcaagcctgcctctcggtgccccgagccccctgcaacctgccactggtgacgtggcttccgacagctataacaatgtttttagagacacagaggccctgagagagcttggcgtcactcactaccgattttccatctcatgggcacgggtcctccctaatgggtctgctggagtccccaacagagaaggacttagatattatcgcagactgctcgaacgcctgagagagttgggagttcagccagtcgtgaccctgtatcattgggatttgcctcagaggctgcaggatgcatacggagggtgggcaaaccgggcactcgctgatcacttccgcgattacgcagaactgtgttttagacactttggaggtcaagtaaaatactggataacaatcgacaacccatacgttgttgcctggcacggatacgctactggtcgccttgccccgggaattcgggggtctccccgactgggttacttggtggcacacaacctgctgttggcccatgccaaggtgtggcacctgtataatacctctttcagacccacccagggtggtcaggtctctatcgccctgtcttctcattggatcaaccctaggcgaatgacggaccattctatcaaggagtgccagaagtcacttgacttcgtcctcgggtggttcgccaagcctgtttttatcgacggcgactatcccgaaagcatgaagaataatttgagcagtatcctccccgactttactgagagcgagaaaaaatttatcaaggggacggcagatttctttgccctttgttttggcccaaccttgtccttccagctgctggatccccatatgaagtttagacagcttgagagccccaacctgaggcagctcctgtcatggattgacctggagtttaaccatccccagatctttattgtggagaatggatggttcgtctcaggcaccacaaaacgcgatgatgctaaatatatgtactatttgaagaagttcattatggagaccctgaaggccattaagctggatggcgttgatgtgattggatatacggcctggagcttgatggacggattcgaatggcatcgcggttactcaattcgccggggcctcttttatgtggacttcttgtcacaggataagatgctcctgccaaagtctagtgcactgttctatcagaaactcatcgaaaagaacgggttcccccccctccccgagaaccagcctctggagggaaccttcccttgcgatttcgcttggggcgtggtggacaactacatccaggtggatactacactctctcagtttacagaccttaatgtgtatctgtgggacgtacatcatagcaagaggctcatcaaagtggacggcgttgttactaagaaaagaaaatcatattgtgtggactttgccgcgattcagccacagattgcccttctgcaagagatgcacgttacgcatttcagattctctctcgattgggccctgatccttcctctggggaaccagtcacaggtcaatcacaccatactgcagtattatcgatgcatggcaagcgagttggtccgggtgaatataacacctgtggtggcgctgtggcagcctatggcgccaaaccagggactccccagactgctggctaggcagggtgcgtgggaaaatccttacactgccctggcattcgccgagtacgcacgcctttgttttcaagaactgggacaccacgtaaagctctggatcactatgaacgagccttacacccgcaatatgacctacagtgcaggacataatcttttgaaggctcatgcactcgcctggcatgtgtataacgagaagtttcgacatgcccagaacggcaaaatttccatcgcccttcaggccgactggattgagcctgcatgtcctttttcccaaaaggacaaggaggttgcggaaagggtcctggaattcgatattggatggctcgctgagcctatttttggttctggggactacccctgggtgatgcgcgattggctgaaccagagaaacaacttcttgttgccctattttactgaggacgagaaaaagctgattcaagggacatttgactttctggcactgtcccattatacaaccatcctggtagattccgaaaaagaggacccaattaaatacaacgactatctggaagtacaagagatgactgatataacatggctgaactctccatcccaggtggctgtggtaccatggggattgcggaaggtgctcaactggttgaagttcaaatatggagacctgcctatgtatattatcagtaatggaattgatgacggcctgcacgctgaggacgaccagttgcgagtatactacatgcaaaactatatcaatgaggcactgaaggcccacatactcgatgggataaacctgtgtggttattttgcgtactcctttaacgaccgaacagcccccagatttggactctaccggtacgcagccgatcagtttgagccgaaggcctcaatgaagcactacaggaaaataatcgactccaacgggttccctgggcctgaaacgctcgagcggttctgtccagaggagttcactgtttgcaccgagtgctctttctttcacactagaaagagcctcctggcgtttatcgcttttctgttttttgctagcatcatcagcctgagcttgatcttctactattccaaaaagggaaggcgaagttacaag

SEQ ID NO: 14977 - DNA, 3036 bp, Artificial Sequence; identical to SEQ ID NO: 14976
  Description of Artificial Sequence: Synthetic coding sequence

SEQ ID NO: 14978 - DNA, 3036 bp, Artificial Sequence
  Description of Artificial Sequence: Synthetic coding sequence
atgccggctagcgcgcctcctcgcagaccacgcccgcctccaccgtcattgtccctgctgcttgttctgctggggctgggagggaggcggctgcgggccgagccgggcgatggtgcccagacatgggcccgcttctcacgaccgccagccccagaggctgcaggcttattccagggaacttttccggatggctttctgtgggctgtaggtagcgccgcctaccagaccgagggtggctggcaacaacatgggaaaggtgctagcatttgggacaccttcactcaccacccactggcgccaccaggagactctcgcaatgcaagtctgccgttgggggcgccatcacctttgcagccagccaccggcgacgtagcctccgacagctacaataatgtatttagagatacagaagccctgcgggagctgggcgtaacacactacaggttttcaattagttgggcacgcgttctgcccaacggaagtgctggtgtaccgaaccgcgagggattacgttactaccgtcgcttgctcgagagattgcgcgagttaggggtgcaacccgtggtgaccttgtatcattgggatctgccacaacgattgcaagacgcatacggcgggtgggcaaacagggcgctggcagatcatttcagagattatgcggaactctgcttcaggcacttcggaggccaggtaaagtactggatcacaatcgacaacccttatgtggtggcatggcatggatacgccactggaaggctggcacctggtataagaggcagtccaagactgggctacctcgtggcccataatctgctgcttgctcacgccaaagtctggcacctgtacaacactagctttcgcccaacccagggagggcaagttagcattgcgttatccagccactggatcaatccaaggagaatgaccgaccatagtataaaagagtgtcagaaaagcctggacttcgttctggggtggttcgccaagcctgtgttcatagacggagattatcctgagtctatgaagaacaatctgtcttccatcttgccggacttcacggaatctgagaaaaaattcatcaagggaactgccgatttttttgctttatgctttggtccaacactttcttttcagcttctcgacccccacatgaagtttagacagttggagagtccaaacctgcgccaacttctcagctggatcgatttagagttcaatcacccccagatcttcatagttgaaaacggttggtttgtaagtggtacaaccaagcgcgacgatgccaagtatatgtattaccttaagaagttcattatggagaccttgaaagctattaagctcgatggggtggacgtcatcggctacacagcatggtcattaatggacggctttgaatggcatcggggatacagtatccgaagggggttattctatgtcgatttcctttctcaggacaaaatgctcttgcccaagtcttctgccctcttctaccagaagctgatagaaaagaacggatttccccctctccctgaaaatcagccattggaagggacgtttccctgcgatttcgcctggggagtggtcgataactacattcaagtcgataccacactgagtcagttcacagacctgaatgtgtatctgtgggacgtacaccattctaagcgactcatcaaagtggacggcgttgtgactaagaaaaggaaatcctactgcgtcgacttcgccgcgatccagcctcagattgctttgctgcaagagatgcatgttacgcacttccgctttagcctagattgggcactgatcctacccctggggaatcagagtcaagtgaatcatacaatattacagtactatcgatgcatggcctccgaactcgtgagagtgaacatcacccctgtcgtagccctgtggcagccaatggcacccaaccaaggcctcccacgcctcctcgcacgacaaggtgcctgggagaatccttacacagcactggccttcgcagaatacgctaggctctgctttcaagaattaggccatcacgtcaagctctggattaccatgaatgagccttataccagaaacatgacctactccgccggacacaatttattgaaggcacacgccttggcatggcatgtgtacaatgaaaagttcagacatgcccagaatgggaagatctctatcgcccttcaggctgattggattgagccagcctgtcctttttcccagaaagataaagaggtggcagaacgcgtactggagttcgatataggctggctggccgaaccgatttttgggtcaggtgactatccatgggtcatgagggattggctgaaccagcggaacaatttcctgctgccttatttcactgaagatgagaaaaagctgatccaaggtactttcgactttctggccttgtctcactacaccacaatcctggtggacagcgagaaggaggaccctatcaaatacaatgattatttggaagttcaagagatgactgacattacctggttgaatagcccgtctcaggtggccgtggtaccgtggggtttgcgcaaggtattaaactggcttaaattcaagtatggagacctcccaatgtacataatttccaacggcatcgatgatggactgcacgccgaggacgatcagctgcgggtgtattatatgcaaaactacatcaacgaagctcttaaggctcacattctggacgggatcaatctgtgtggatacttcgcttatagctttaatgacagaaccgccccacggttcggactctatcggtatgcagctgaccaattcgagccaaaggctagcatgaagcattatcgtaaaatcatcgattcaaatggtttcccaggacccgaaacactggaacggttctgccccgaggaatttacagtctgcaccgagtgtagcttctttcacactagaaagtcgcttctggcgttcattgcgttcctgttcttcgccagtattatttccttatcactcatcttttactactccaagaagggtcgtcgcagttataaa

SEQ ID NO: 14979 - DNA, 3036 bp, Artificial Sequence; identical to SEQ ID NO: 14978
  Description of Artificial Sequence: Synthetic coding sequence

SEQ ID NO: 14980 - DNA, 3036 bp, Artificial Sequence
  Description of Artificial Sequence: Synthetic coding sequence
atgccagcctcggcgccacctaggcggcctcggccacctccaccttcgctgagccttctgctcgtgctgctggggctcggagggcggagactgcgagctgaacctggagatggtgcccaaacgtgggcacgcttttcccggccacccgcccccgaggccgcagggctttttcagggcacgtttcccgatggttttttgtgggcggtgggttcagcggcctaccaaaccgaaggaggttggcagcaacacggtaagggggcaagcatttgggatactttcacgcatcacccgttggcacctccgggtgactccaggaacgcatcgcttccactgggagcacctagcccccttcagcctgccaccggtgatgtggcctcggatagctataacaatgtgttccgagatactgaggcccttagggaactcggtgtgacccactaccggttttcaatttcgtgggctagggtgctcccaaatggttccgcgggagtgcccaatagagaaggactccggtactaccgcagattgcttgagaggcttagagagctgggagtccaacctgtggtgacgttgtaccattgggaccttcctcaacgcctgcaggatgcatacggtgggtgggcaaaccgcgctcttgcagaccacttccgggattacgccgaactttgcttcaggcatttcggaggtcaggtgaagtactggattactattgacaacccctacgtggtggcctggcatgggtacgcgaccggtcgactcgcccctggaatacgagggagccctcggctggggtacttggtggcccataatcttcttctggcgcatgccaaggtgtggcacctctacaacactagctttaggccaacccagggaggacaggtttccatcgcactttcgtctcattggattaatcctcgccgtatgactgatcactcaattaaggaatgccagaagagcttggactttgttctgggctggttcgctaagcctgtgtttattgacggagattaccctgagtctatgaaaaacaacctgtcgtcaatactcccagactttactgagtcggaaaagaaattcataaagggaacggctgacttttttgcactttgtttcggccccaccctgtcgtttcagttgcttgatcctcacatgaagtttcggcaactcgaatccccaaacctccgccaactgctttcctggatcgatctggaattcaaccatccacagatattcatcgtggaaaatgggtggtttgtgagtggcactactaagcgtgacgacgcaaagtacatgtattacttgaaaaagttcataatggaaactcttaaggcaattaagctcgacggagtcgacgtgatcggatacacggcttggtcccttatggacggttttgagtggcatcgaggttacagcatcagacggggccttttctatgtggattttctttcccaggataagatgctgttgcccaagagctccgcactgttctaccaaaagctgattgagaagaatggatttccacccttgcccgagaatcagcctctcgaaggaaccttcccttgcgactttgcgtggggcgtcgtggataactacattcaagtggataccactttgtcccaatttaccgaccttaacgtctacctttgggacgttcatcattccaaacggttgatcaaagtcgacggagtggtgactaagaaacgaaagtcgtactgcgtggattttgcagcaatccaaccacaaattgcgcttctccaagagatgcacgtgactcatttccggttttctctggattgggcacttatcttgcctctgggcaaccaaagccaagtcaatcatacgatccttcaatactaccgctgcatggcttccgaactggtgcgtgtgaacataaccccagtcgtggctctgtggcagccaatggcacccaatcagggacttccacggcttttggccaggcaaggagcttgggagaatccatacaccgcactcgcctttgccgaatacgcaagactctgttttcaagagctgggccatcatgtgaagctgtggatcactatgaatgagccatacactcgtaatatgacctactcggctggccataacctcctgaaggcacatgcattggcgtggcacgtttacaatgagaaatttcgccacgcccaaaatgggaaaatctcaattgcacttcaggctgattggattgaacctgcatgtccgttctcacaaaaagacaaggaggtggcagaacgcgtccttgagtttgacatcggctggctggcggaacccatttttggttcgggcgattacccttgggtcatgcgagactggcttaatcaacgcaataactttctcctgccatacttcactgaggatgagaagaagttgattcagggtaccttcgatttcctcgcactttcgcactacactactattctggtggactcagaaaaagaggaccccatcaaatacaacgattacctcgaagtccaggaaatgactgatatcacttggctgaattccccaagccaagtggcagtcgtgccttggggtttgcgtaaagtgttgaactggctgaagtttaagtatggagatctgccaatgtacattatctcaaacggaatagatgatggacttcacgcagaggacgatcagctgcgggtgtactacatgcagaattacatcaatgaagcccttaaagcacatatcctggacggaattaacctgtgtggatactttgcatattcgttcaacgatcgtaccgcgcccaggttcgggctttatagatacgcagcagatcaatttgaaccgaaggcatcaatgaaacactacaggaagattattgattcaaacggatttccaggacccgagactctggaacgattttgccctgaagagtttaccgtctgcaccgaatgctcctttttccataccagaaagagccttctggcctttatcgcatttctcttctttgcctcgatcatttcactttcgcttatcttttactatagcaagaaaggcagacgttcgtacaag

SEQ ID NO: 14981 - DNA, 3036 bp, Artificial Sequence; identical to SEQ ID NO: 14980
  Description of Artificial Sequence: Synthetic coding sequence

SEQ ID NO: 14982 - DNA, 3036 bp, Artificial Sequence
  Description of Artificial Sequence: Synthetic coding sequence
atgcctgcatccgcaccaccaagacggccccgcccaccacctccttccttgagcctgctcctggtgcttctcggcctgggtggtcggcgactgagagccgaaccaggtgacggtgcacaaacctgggcgaggttttctaggcctccagcccctgaagcagcaggactcttccaaggcaccttcccagacggatttctgtgggcagtcggatcagcagcctaccaaaccgagggaggatggcagcaacacggtaagggcgcatcaatttgggacacctttacccaccacccactggcccctccaggtgattcccggaatgcatcgctcccactcggcgcaccttcgcctctgcagccggcaacgggagatgtggcatctgatagttacaataacgtgtttagagatactgaagctctgcgggaactcggtgtgacccattacaggttctctattagctgggcaagagtgctgccaaatggatccgcaggagtccccaacagggaaggtctgcgctactatcgccgcctgctggagagattgcgcgaacttggcgttcagcctgtcgtgactttgtaccattgggaccttccacagagactccaggatgcctacggcggatgggcaaacagagcactggcagatcatttcagggactacgcagaactctgttttagacatttcggcggacaagtgaagtattggatcactattgacaacccttacgtggtggcttggcatggatacgcaacgggacggctggcgcccggaatcagaggttcgcctaggcttggataccttgtggcacataacttgctgctggcccacgccaaagtgtggcatctgtacaatacttcatttcgtccgacccaaggtggacaagtgtcgatcgctctctcctcacattggattaacccacggaggatgactgaccactcaatcaaggagtgtcagaaatcgctggattttgtgcttggttggtttgcaaagcctgtgttcatcgacggggactaccccgagtcgatgaagaacaacctgtcgtcaatccttcctgatttcaccgaaagcgaaaagaaattcatcaagggaactgcagacttcttcgcgttgtgtttcggccctaccctttcattccagcttcttgaccctcacatgaagtttcggcaactggaatcccccaacctgaggcagcttctgtcgtggattgacctcgaattcaatcacccacaaatctttattgtggagaatggatggttcgtctctggaaccactaagcgcgatgacgcaaaatacatgtactacctgaagaagttcatcatggaaactttgaaggccattaaacttgatggagtggatgtgattggctacaccgcatggtcactgatggatggatttgaatggcacagaggctactcgattaggcgcggccttttctatgtggattttctctcccaagataagatgctcctgccgaagtcgtcggcactcttctaccaaaagctcatcgaaaagaacgggttccctccacttcctgaaaaccagcctctggagggaacttttccttgtgatttcgcctggggagtcgtggataactatattcaggtggatacgaccctctcccagtttacggatttgaacgtgtacctttgggatgtccatcacagcaagagacttatcaaggtcgacggagtggtgaccaagaaaagaaagtcgtattgcgtggactttgcagcaattcaacctcaaatagcacttctgcaagaaatgcacgtgacccactttaggttttcgctggattgggcgctgatcctgcctttgggtaaccaatctcaggttaatcacacgattctgcaatactaccgttgtatggcatcagaactcgtcagggtcaacatcactcctgtggtggccctttggcaacctatggctccaaaccagggtttgccgcggctcctcgcccgccagggtgcctgggaaaacccatacactgcactcgcgtttgcagagtacgcacgtctgtgttttcaagaactgggacatcatgtgaaactttggataactatgaacgagccctacacgcgcaacatgacctattcggcgggacataacctgctgaaggcacatgctctggcctggcatgtctacaatgagaaattcagacatgcacagaacggaaagatcagcatcgcactgcaggccgactggattgagccggcctgccctttttcgcagaaggataaagaagtcgcagagagagtcttggagtttgatataggttggctggcagaacccatatttggctcgggcgactacccttgggtgatgcgagattggctgaatcagcgcaacaactttcttctcccttactttaccgaggatgaaaagaaacttattcagggcacttttgacttccttgcgctttcccactacaccactatactggtggattccgaaaaagaagatccgataaagtacaatgattacttggaagtgcaggagatgacggatatcacttggctgaactctccttcacaggtggctgtcgtgccttggggactccgcaaggtcctgaattggctcaaattcaagtacggagatcttccgatgtacattatcagcaatggaatcgacgacggacttcatgcagaagatgatcagttgagagtgtactacatgcaaaactacataaatgaagccctcaaggcgcacatactggatggaattaacctttgcgggtactttgcatactcatttaacgacagaactgcaccaagatttgggctctacaggtatgcggccgatcaattcgaacccaaagcaagcatgaagcactaccggaagataattgactcgaacggcttcccggggcctgagactctcgagcgattctgtccagaagagtttacggtgtgtactgagtgcagcttttttcacaccagaaaatctctgctggcatttatcgctttcctcttcttcgcctcgattatctcacttagccttatcttttactacagcaagaagggtcggcgctcatacaag

SEQ ID NO: 14983 - DNA, 3036 bp, Artificial Sequence; identical to SEQ ID NO: 14982
  Description of Artificial Sequence: Synthetic coding sequence

SEQ ID NO: 14984 - DNA, 3036 bp, Artificial Sequence
  Description of Artificial Sequence: Synthetic coding sequence
atgcccgcatctgccccccccagacgcccccgtccccctcccccatcgctgagtctcctacttgtcttattgggcctggggggtcgtcgcctgcgagctgagccaggagacggagcccagacttgggccagattcagtcgaccccctgcgccagaggctgccggcctcttccaggggacctttcccgacggcttcctttgggccgtaggttcagcagcataccagacagagggcggatggcaacagcatgggaagggagcctctatttgggatacattcacacaccaccctttggccccccctggcgacagtcgaaatgcatcactgccattaggggccccttctcccctacagcctgctacgggcgacgttgcatccgattcctacaacaacgtgtttcgagataccgaggcgctcagagagctgggggttacacattatcgcttttccatctcgtgggctcgcgtgctgcccaacggctcagccggagtgcccaatcgcgaggggttgaggtactaccggaggctgctcgagcggctgcgcgagctcggagttcagccagtggtgacactctaccactgggacctgccgcagcgtctgcaggacgcatacggagggtgggccaaccgggcactagcggatcatttccgagactatgcagaactgtgttttaggcactttggagggcaagtgaagtactggattaccatcgataatccgtatgtagtggcatggcatggctatgctactggtagactggccccagggatcagggggtctcctaggctaggttatttggtcgcacacaacttgctgttagcccacgctaaggtgtggcacttatataatacctcattccggcccacgcagggcgggcaggtgagcatcgccctttcttctcactggattaacccacgccgaatgaccgatcatagcattaaagagtgccagaagtcactggactttgtgctgggatggtttgcaaaacccgtatttatagacggtgactatcctgaatctatgaagaacaatttgtcatctatattacctgactttactgagagcgagaaaaagttcatcaaaggaactgcagacttcttcgctctgtgttttggccccacacttagttttcagctgcttgatccacacatgaagttccgccagctggaatcccctaacctgcgacagctgctcagctggatcgacctggagtttaatcatccacagatctttatcgttgagaatgggtggtttgtgtcaggtacaacgaaacgcgatgacgcgaagtatatgtattacctgaaaaaatttattatggagacgctcaaggcaataaaactggacggcgttgatgtgatcggctacacagcctggtcgttaatggacggcttcgaatggcacaggggctattccataaggcggggactgttttacgtggatttcctttcacaggataagatgctgctgcctaagagctccgctctgttctaccagaaactcattgaaaagaatggcttcccacctctgccagagaatcagcccctggaggggaccttcccatgcgactttgcctggggcgtggtggataactacattcaggtcgacactactttgagccagttcaccgatctgaatgtgtacctctgggacgtccaccacagcaagcggttaatcaaggtggacggtgtggttacaaagaagcggaaaagctactgtgtggactttgcagccattcagccccaaatcgccctccttcaggagatgcacgttacacacttccggtttagtctggattgggcgcttatcttgcccctagggaatcagtcgcaagtgaaccatacgatccttcaatactatagatgcatggcctctgagctcgttcgagtgaacatcacgccagtcgtggcactttggcagccaatggcccccaatcaagggctcccaaggctgctcgctagacagggggcttgggaaaatccttatacagctctagcattcgcggaatatgcaaggctgtgcttccaagagctcggccaccatgtcaaactgtggattaccatgaatgaaccttacacacgaaacatgacatacagcgccggtcacaatttgcttaaagcgcacgccctggcctggcacgtctacaatgaaaaattccgccatgcacaaaacggcaagataagcatagctctgcaggcagattggatcgagccggcttgcccgtttagccagaaggacaaagaagtagcagaacgggtgcttgagttcgacataggctggctggccgaacccatttttgggtccggcgattatccatgggtgatgagggattggctgaaccaacggaataattttctgttaccgtatttcaccgaagacgagaagaaactgatacaagggacatttgactttctggccctctctcactacaccaccattctggtggattccgagaaggaagatccaattaagtacaacgattatcttgaagtccaggagatgacagacatcacttggttaaactccccatcacaggtggctgtggtcccctggggacttcgcaaagtactgaactggcttaaatttaagtacggagatctccccatgtacatcataagtaacggaattgacgacgggctgcacgctgaagatgaccagttaagagtgtactatatgcagaactacataaatgaggctcttaaggcccacatcttagatggaattaatctgtgcggctacttcgcttattcctttaatgacaggactgcacctaggtttggtctgtataggtatgccgccgatcagtttgaacccaaagcttccatgaagcattatagaaaaatcattgatagtaacgggttcccaggccccgagacactggaacggttctgcccagaggagttcaccgtgtgcacggagtgcagctttttccacacaaggaaatcattgttggcattcatcgccttcctattcttcgcctctatcatcagcctgagtcttatcttctactacagcaagaagggaaggcgatcgtacaaa

SEQ ID NO: 14985 - DNA, 3036 bp, Artificial Sequence; identical to SEQ ID NO: 14984
  Description of Artificial Sequence: Synthetic coding sequence

SEQ ID NO: 14986 - DNA, 3036 bp, Artificial Sequence
  Description of Artificial Sequence: Synthetic coding sequence
atgcctgcaagcgcgccacctcgccgcccgcggcctccaccacctagcctgtccctgctgctcgtgctcctcgggctggggggacgcagactgagggcggaacctggggatggtgcgcagacttgggcacgcttttctcggccgccggctcctgaggccgcagggctgttccagggtaccttcccggacggattcctgtgggccgtgggatcagccgcgtaccagactgaaggaggctggcagcagcacggcaagggcgcctcgatttgggacacttttactcaccacccactggccccaccaggagatagccggaatgccagcctgccactgggagccccaagcccgctccagccggccaccggcgacgtggcaagcgactcctacaataacgtgttccgcgatacggaagccttgcgcgagctcggagtcacgcattacagattctccataagctgggccagggtgctcccaaatggatccgctggcgtgcccaaccgcgagggcctccgctactaccggagactcctggagcgcctccgggaactgggagtccagccagtcgtgaccctttaccactgggacctgccgcagagactgcaagacgcctatggaggatgggcaaatagagcgctggcggatcatttcagagactacgctgagctgtgcttcagacacttcggaggacaggtgaagtactggatcaccatcgataatccgtacgtggtcgcgtggcacggatacgctaccggacgcctcgcaccgggcatccggggatcgccgaggctgggttacctggtggctcacaatctgctgctcgcccatgccaaggtgtggcatctttacaatacttcgtttaggccgactcaaggcggacaagtctccatcgctctcagctcacactggatcaacccacgccgtatgaccgatcattcgatcaaggaatgccaaaaatcgctggattttgtgcttggttggtttgccaagccagtgtttatcgacggcgattacccggaatccatgaagaacaatctctcatccatcttgccggattttactgagtcagaaaagaaattcatcaaaggaaccgccgactttttcgcgctgtgcttcggacctaccctgtcattccaactgctggatccacacatgaagttccgccagctggaatcgcctaatctcagacaacttctgtcttggatcgatctggaattcaaccatcctcaaatcttcatcgtcgagaatgggtggttcgtgagcggaactactaaacgtgatgatgcgaagtatatgtattacctgaagaagttcatcatggaaacccttaaggccatcaagctcgacggagtggatgtgatcggttacactgcttggtccttgatggacgggttcgaatggcacaggggatactcaattcgccggggactcttctacgtggatttcctttcgcaggataagatgctcttgccgaaaagctctgctctgttttaccaaaagctgatcgaaaagaatggattcccgcctctgcctgagaaccaaccactcgaaggcaccttcccgtgtgacttcgcgtggggagtggtggacaactacattcaggtcgacacgaccctcagccaatttactgaccttaacgtctacctgtgggacgtgcaccactccaagagactgatcaaagtggacggagtcgtcaccaaaaagaggaagtcctactgtgtggacttcgccgcgattcaaccgcagatcgccctgcttcaggaaatgcatgtgacccacttccggttctcccttgattgggcactcatcctcccactgggaaaccagtcgcaagtcaaccacactatcctgcagtactaccgctgcatggcatcagaactcgtccgcgtcaacatcactccggtggtggcgttgtggcagccgatggctcctaatcagggactcccaagactcctcgctcggcagggtgcctgggaaaatccgtacacggcgctcgcgttcgcggaatacgcgagactgtgcttccaggagctgggacaccacgtgaagctctggatcacgatgaatgagccctacacccgtaacatgacttacagcgccggccataacctgctgaaggcccacgccctggcctggcacgtgtacaatgaaaagttccgccacgcgcagaatggcaagatctcaatcgccttgcaggcggattggattgagcccgcctgcccgttttcccagaaggataaggaggtcgctgaacgggtgttggagttcgatatcggatggctggccgaaccaatcttcgggtcaggagactacccgtgggtgatgagagactggctcaaccagcgcaacaacttcctgctgccatacttcactgaagatgaaaagaagctcatccagggcacgttcgacttcttggcactgtcgcactacactactatcctggtggactccgagaaggaggaccccatcaaatacaacgactacctcgaagtgcaggaaatgactgacatcacttggctgaactccccgtcgcaggtggccgtagtgccatggggacttcggaaagtcctgaactggctcaagttcaagtacggcgatctgcctatgtacattatctcgaacggaatcgacgacggactccacgctgaggacgaccaactgcgggtgtactacatgcaaaactacataaacgaggcgttgaaggcccacatcttggacggtatcaatctttgcggctacttcgcttactcgttcaacgatcggactgcaccgagatttggcttgtaccggtatgccgccgatcagttcgagccaaaggctagcatgaagcactacagaaaaatcatcgactcgaacggatttcccggaccggaaaccttggagcgcttctgcccggaagaatttaccgtctgcactgaatgctcatttttccacactcgcaagtcactgctggctttcatcgccttcctcttcttcgcatccatcatctccctctcgctgatcttttactactcgaagaaggggcgccgcagctacaag

SEQ ID NO: 14987 - DNA, 3036 bp, Artificial Sequence; identical to SEQ ID NO: 14986
  Description of Artificial Sequence: Synthetic coding sequence

SEQ ID NO: 14988 - DNA, 3036 bp, Artificial Sequence
  Description of Artificial Sequence: Synthetic coding sequence
atgccagcctcggcaccgccacggcggccaagacctccaccaccaagcctgtcgcttctgttggtgctccttgggctcggcggaaggagacttcgggccgagccgggcgatggagctcaaacctgggctcggttctcacgtccccctgccccagaggccgccggtctttttcagggtaccttcccggacggttttctttgggcagtgggctcggcagcgtatcagacggaggggggctggcaacaacacggtaagggcgcctcaatctgggataccttcacccaccatccactggcaccaccaggagactccagaaacgcatcgcttccacttggagctccttcacccttgcaaccagcaactggggatgtcgccagcgactcgtacaacaatgtgtttcgcgataccgaagcactgcgcgagctcggagttactcattacaggttttcgatttcctgggcacgcgttctgccaaatgggtccgcgggagtccccaaccgagaagggcttcggtactacaggagactgcttgagaggctgcgagaactgggtgtgcagcctgtggtcaccctgtaccactgggacctgcctcagcgcctccaagatgcgtacggaggatgggctaatagagcacttgcagatcatttccgggattacgcggaactgtgcttcaggcatttcggaggacaagtgaagtactggatcactatcgacaacccttacgtggtggcatggcatggatacgcaaccggtaggctggcaccaggtattagaggaagcccgaggctcggatacctcgtcgcgcacaaccttttgctcgcacatgcaaaagtgtggcacctgtacaatacctcgtttaggccaacccaaggaggacaagtctcaattgctctgtcgtctcactggattaacccacggcgcatgactgatcattcgatcaaggaatgtcaaaagtcactcgactttgtgctcgggtggtttgctaagccagtgtttattgatggagattaccctgaatcgatgaagaataacttgtcctcgattctgcctgattttaccgaatcggagaagaaattcattaaaggcacggccgacttttttgcattgtgtttcggccccactctttcgtttcagcttcttgaccctcacatgaaattcagacagcttgagtctccaaaccttcgccagcttctgtcctggatcgacctggagtttaaccatcctcagatcttcatcgtggaaaacggctggttcgtctccgggaccaccaagagagatgatgcaaagtacatgtattacttgaagaagtttatcatggagactctcaaagccattaagctcgacggtgtcgatgtgattgggtatactgcatggtcgctgatggatggttttgagtggcatcggggctactcgatccgccgcggcctcttttacgttgattttctctcgcaagacaaaatgctgctgcccaagtctagcgctcttttctaccagaaacttatcgaaaagaacggatttccccctctccctgagaaccaaccacttgaagggacctttccttgtgattttgcatggggagtggtcgataactacattcaagtggataccaccctgtcgcaattcaccgatctcaatgtgtacctgtgggacgtgcatcatagcaagcggctcattaaagtggacggtgtggtgaccaaaaagagaaagtcatactgtgtggactttgctgcaatccaaccgcaaatcgcacttcttcaggagatgcatgtcactcactttaggttttcgcttgattgggctctgatccttcccctgggcaatcagtcccaagtgaatcatactatactccaatactaccgttgcatggcatccgaacttgtccgagtgaacattacccctgtcgtggccctttggcagccgatggcgcctaatcaaggactgccgcgcctgttggcacgacagggtgcctgggaaaatccctacaccgcacttgcatttgcagaatacgcccgcctctgctttcaggagcttggccatcatgtcaaactgtggattactatgaatgaaccatacacccgaaacatgacgtacagcgctggtcacaacctcctcaaggcgcacgccctggcctggcatgtctacaacgaaaagttccggcatgctcagaacggaaagataagtattgcactgcaagctgattggattgagcccgcatgtccctttagccagaaggataaggaagtggctgaacgcgtgctggagttcgacataggatggctggcggagcctatctttggatcaggagactatccttgggtgatgcgagattggctgaaccagcggaacaacttccttctgccctactttaccgaagatgaaaagaagctcattcaaggaacgtttgattttcttgcactgagccattacacgactattctggtggattcggagaaagaagatccgattaagtacaacgattacctggaagttcaagagatgaccgatattacctggcttaattcgccttcgcaagtcgcagtggtcccatggggattgcgaaaggtgctgaactggcttaagttcaaatacggcgaccttccaatgtacatcatttccaatggaattgatgacggacttcatgcggaggatgaccagctgcgcgtgtattacatgcagaattacatcaatgaggcactgaaagcccacattctggacggtattaacctttgcggctacttcgcatactcctttaatgatagaaccgccccccgttttggcctgtaccggtacgctgctgatcaattcgaaccaaaggccagcatgaagcactaccgtaaaatcatcgattccaatggatttcctggaccagaaacccttgaacgtttctgccccgaagaatttaccgtctgtaccgaatgtagcttttttcataccagaaagtcccttcttgcgttcattgcatttctcttttttgccagcatcatcagcctttccctcattttctactattcgaagaagggtcggcgatcgtacaag

SEQ ID NO: 14989 - DNA, 3036 bp, Artificial Sequence; identical to SEQ ID NO: 14988
  Description of Artificial Sequence: Synthetic coding sequence

SEQ ID NO: 14990 - DNA, 3036 bp, Artificial Sequence
  Description of Artificial Sequence: Synthetic coding sequence
atgcccgcgtcggcaccgccacggcggcctcgtccacctcccccctcactctccctgctgctcgtgttgctgggactcggaggccggcggctgagggctgagccaggcgacggcgcacagacctgggcaagattctcccggcctcctgcgccagaagcggctgggctctttcagggtaccttcccggatggattcctctgggccgtgggcagcgcagcataccagactgagggaggatggcagcaacacggcaaaggcgcctcgatctgggacaccttcacccatcatccgttggcgccgcccggagattcccggaatgcgtctcttccgttgggggccccgtcgccgctgcagccagccactggagatgtggcctccgactcctacaataacgtcttcagagacacggaggccctgagggaattgggagtcacccattaccgcttttctatcagctgggcacgagtgctgcctaacggatcagcgggagtcccgaacagagaagggctcagatactaccgcagactcctggaacgactgcgagaactgggtgttcaaccggtggtcacgttgtaccactgggacttgccgcagcgacttcaggacgcatacggaggctgggcgaaccgcgccctcgcagatcacttcagggactatgctgaactgtgctttagacactttggtggacaggtgaaatactggattactatcgacaacccttacgtggtggcgtggcacggctacgcgactggcagactggcacccggcatccggggatccccaaggctgggatatctggtggcccataatctgctcctggcccatgcgaaggtttggcacctttacaacacctcgtttcgcccaacgcaaggaggacaagtctcgattgccctcagctcccactggattaacccccgccgtatgactgatcacagcattaaggaatgccaaaagtcccttgatttcgtgctcggttggttcgccaagcccgtctttatcgacggcgactaccctgaatcgatgaagaacaatctcagcagcatccttccggactttaccgagtccgaaaagaagtttatcaagggcaccgccgacttctttgcgctttgcttcgggcccactctgagcttccaactcctggaccctcacatgaagttcagacaacttgagtcgcctaatctgcggcaactcctcagctggatcgacctggaattcaatcatccacaaattttcattgtggaaaacggttggttcgtctcagggaccactaagcgggatgacgctaaatacatgtactatctgaagaagttcatcatggaaacgttgaaagccatcaagctggatggtgtggatgttatcggatacaccgcctggagcctcatggacggtttcgaatggcatcggggatactccatccggcggggattgttctacgtggatttcctttcccaagataagatgctgcttcctaaatccagcgccctgttctaccagaaactgatcgaaaagaacggatttcctccactcccggaaaaccagccgcttgagggaaccttcccgtgcgacttcgcatggggcgtggtcgacaactacatccaggtggataccactctgtcccagtttactgatctcaacgtttacttgtgggacgtgcaccactccaagcgcctgatcaaagtggacggagtcgtcaccaagaaacggaagagctactgcgtggacttcgccgctatacagccgcagatcgcactgttgcaggagatgcacgtgactcacttcagattctccctggattgggccctgatcttgccactcggtaatcagtcccaagttaaccatactatcctgcagtactaccgttgtatggcctcggagttggtgagggtcaacatcaccccagtggtggccctgtggcaaccgatggctccaaatcaaggcctcccccgccttctcgcgagacaaggtgcctgggaaaatccgtacaccgccctggcgttcgccgagtacgcccgtctgtgcttccaggagctggggcaccacgtcaaactgtggataactatgaatgagccgtacactcggaacatgacgtactctgcgggccataacctgctgaaggcccacgctctggcttggcatgtgtataacgaaaagttccggcacgcccagaacggtaagatctcaatcgccctgcaggcggactggatcgaaccagcctgtccgttctcccaaaaggataaagaggtggccgaacgcgtgctggaatttgatatcgggtggctggccgagccgatcttcggtagcggagattacccgtgggtgatgcgggactggctcaatcaacgcaacaactttctcctgccgtacttcaccgaggacgaaaagaaacttatccagggaacttttgacttcctggccctgtcgcactacactactatactggtcgattcggaaaaagaagatccgatcaagtataacgactacctggaagttcaggagatgaccgacatcacttggctgaactccccttcacaggtggcagtcgtgccttggggtctgcgcaaggtgcttaattggctcaagttcaaatacggagatctgcccatgtacatcatctcgaatggaatcgacgacggcctgcacgcagaggatgatcagctccgcgtgtactacatgcagaattacattaatgaggcactgaaggcgcatatcctggacggtataaacctctgtggttactttgcgtactcatttaacgatcgcaccgcccctcgattcggactctaccggtacgctgctgaccagttcgagccgaaagcgagcatgaagcactaccgcaagatcatcgacagtaatggcttcccgggaccggaaacgctggaacgcttctgcccggaggagttcaccgtttgtaccgaatgttcgttcttccatactcggaagtcgctcctggcctttatcgcgttcctcttcttcgcctcgattatttcgctgtccctgatcttttactattcgaagaaaggtcggaggagctataag

SEQ ID NO: 14991 - DNA, 3036 bp, Artificial Sequence; identical to SEQ ID NO: 14990
  Description of Artificial Sequence: Synthetic coding sequence

SEQ ID NO: 14992 - DNA, 3036 bp, Artificial Sequence
  Description of Artificial Sequence: Synthetic coding sequence
atgccagcttccgccccgcccagacgacctcgaccccctcccccatctttatcactgctcctggtgctgctcgggctgggaggtcgacgattacgggccgagcctggagatggagcccagacatgggcaaggttctcacgaccccctgccccggaagcagcaggccttttccaaggaacatttccagacgggttcttgtgggccgtggggtcggctgcctaccagacagagggaggctggcagcagcatggtaaaggcgcgagtatttgggacactttcacccatcatcctctggctccgcctggcgacagcaggaacgcgtccctacccctgggcgccccatctccccttcaacccgccacgggtgatgtggcgagtgactcttataataacgttttccgtgatacagaagccctgagggaactcggcgtgacacattacaggttttcgatcagctgggcacgagtactccctaacggtagcgccggcgttccaaacagagagggtcttcgatactatagaaggctgttggaacggttgcgggagctcggagtccagcctgtcgtaaccctgtatcattgggatctgccccagcggctccaggatgcgtatgggggttgggctaatagggcgctggccgaccattttcgggattacgcagagctgtgcttccgacactttggcggacaggttaagtattggatcaccatcgataacccatatgttgttgcctggcatgggtacgccaccggaagactcgcacctgggattcgaggatccccaagactggggtatttggttgcccacaatctgctccttgcacacgctaaggtgtggcatctctataatacatccttcagacctacacagggtggtcaggtgagcattgccctgtcctcacactggatcaatcctaggcgaatgaccgaccacagcatcaaggaatgtcagaagtcactggattttgtgctgggttggtttgctaaaccggtgttcattgacggagattatcctgaatccatgaagaataatttgtctagcatcctgcctgattttacagaatcggaaaagaaattcatcaagggaaccgccgactttttcgccttgtgcttcgggcctacgctcagttttcagttattggacccgcacatgaagttcagacagctggaaagtcccaacttgcgacagcttctgtcctggatcgacctggagtttaaccacccgcaaatctttatagtggaaaatggctggttcgtgagcgggactacaaaacgcgatgatgctaaatatatgtattacctaaagaaatttattatggaaacactcaaagccattaaacttgacggagtggatgtgatcggctatacagcatggtcactgatggacgggtttgaatggcataggggatacagcatacgaaggggccttttctacgtcgactttctttcgcaggacaagatgctactccctaagagctcagccctgttttaccagaaattaatcgaaaaaaacggattcccacctctgcccgagaatcagcccttagaaggtacgtttccctgcgacttcgcctggggagtcgtagacaattacatccaggtggacacgacactcagtcagttcaccgatctgaatgtgtatctttgggacgtccaccattctaagaggctgataaaagtggacggagtcgtcaccaaaaaacgaaaatcctattgcgtcgactttgcagccattcagcctcagattgccctcctgcaggagatgcacgtgacacacttcaggtttagcctcgactgggccctcatcctgccactggggaaccaatcccaggtgaatcacaccatcttacagtattaccggtgcatggcttcagaactggtgagagtcaatattacccctgtcgtggctctttggcagcccatggccccaaaccagggcctgccaagactgctggcccgacagggagcgtgggaaaacccttacaccgcactagctttcgctgaatacgccaggctttgtttccaagaactggggcatcatgtgaaactctggataacaatgaatgaaccctataccagaaatatgacttactctgccggccataacctccttaaagctcacgccttagcctggcacgtttataatgaaaaatttcgacacgcccagaacggaaagatcagcattgcactgcaggcagattggatcgagccggcctgtcccttctcacaaaaggacaaggaagtggctgagcgcgtgcttgagtttgatatcggctggctggcagaacccatctttggatcaggtgactacccatgggtcatgagagactggctgaatcagaggaacaactttttactgccatattttactgaggatgagaagaaattaatccagggaacgtttgatttcctcgcactctcccattacactacaatcctcgtggactcagaaaaagaagacccaattaagtacaacgattatctggaagtccaggagatgacggacatcacatggttgaactcaccatcccaggtagcggtggtcccatggggactgcgaaaggtgctgaactggcttaagttcaagtacggcgacctgccaatgtacatcatcagcaacggcattgatgatggcctgcacgctgaggacgatcagctcagggtttactacatgcagaattacataaacgaggccctgaaggctcatattctggatggaatcaacctatgcggctactttgcctactcttttaacgatagaactgctccccgatttggattgtatagatacgccgccgatcagttcgagcccaaggcaagtatgaagcattaccggaagataattgatagcaacggctttccaggccctgagaccctggagagattctgccccgaggagttcacagtgtgcacggagtgctccttcttccatactcgaaagagccttctagctttcatcgccttcctttttttcgcctcgattatctcactaagcctcatcttttactactccaaaaagggcagacgttcgtacaaa

SEQ ID NO: 14993 - DNA, 3036 bp, Artificial Sequence; identical to SEQ ID NO: 14992
  Description of Artificial Sequence: Synthetic coding sequence

SEQ ID NO: 14994 - DNA, 3036 bp, Artificial Sequence
  Description of Artificial Sequence: Synthetic coding sequence
atgccggcgtctgcaccgccacgaagacctaggccacccccgcctagcctttccttgctactagttctattgggcctcggaggtcgccgtctacgtgctgaacctggagacggtgctcagacttgggcccgtttcagcagacccccagccccagaagccgctggcctgttccagggcacctttccggacgggttcctgtgggcggtgggctccgccgcttatcaaacagaaggaggttggcaacagcacggaaagggcgcgagtatctgggatacttttacacaccatccactggccccacccggtgacagccgaaacgcgagcttacccctgggcgcacccagtccgctccagcccgccaccggtgatgtcgcctcggactcgtacaataacgtgttccgtgatactgaagccctgcgcgaactgggtgtgacacactaccgcttttcgatttcatgggccagagtgctgcccaatggctccgccggagtgccaaaccgagaaggcctccggtattataggagactgctcgagaggctgagagaactcggtgtccagccggtcgttacgctatatcattgggatctgcctcaacgtctgcaggatgcgtacggaggctgggccaatagggccttagccgaccactttcgcgactacgcagaactctgctttagacatttcggcggtcaggtcaagtactggataaccattgacaatccttatgtcgttgcctggcatggctacgccaccgggcgcctggctccgggaatacgtggtagcccgcgcttgggatacttagtggctcacaatctgctgttggctcatgccaaagtgtggcatctatacaatacatcctttcgtcctactcagggcggtcaggtgtcaattgccttgtcctcgcattggatcaacccccgtagaatgactgaccacagcatcaaagaatgtcagaagtccctagactttgtgctgggctggtttgccaaacccgttttcattgatggcgattatcctgagagcatgaagaacaacctgtcctctattcttcccgattttaccgaaagcgagaagaagttcatcaaaggtactgctgatttctttgccctatgctttggtcctactctgtccttccagctattggaccctcacatgaagtttcgtcagttagaatcgccaaacctgcgtcaactgttatcatggatcgatctggaattcaatcatccgcagatcttcatagtcgaaaatggatggttcgtgtcgggcaccaccaaacgagacgatgctaaatacatgtactacctcaaaaagttcataatggagacattaaaggcgataaagctggatggggttgacgttatcgggtacacggcatggagcctgatggatgggttcgagtggcatcgtggctacagcattcgccgtggccttttttatgttgattttctgagccaagataagatgcttctaccaaaatcgtcagccctgttctaccaaaagctaatcgagaagaacggcttcccccctttaccggagaaccagcctctcgaagggacctttccctgtgatttcgcgtggggagtggtggacaattacattcaggtggatacaacactgtcgcagttcacagacctgaatgtgtacctgtgggatgtgcaccactcgaagcgcttgattaaggttgatggcgtcgtcactaagaagaggaagtcgtattgcgtggattttgccgccattcaaccgcagatagccctgcttcaggagatgcatgtgacccatttcagattctctttggattgggccctgattttgcccctgggcaatcagtcccaggtgaatcataccatcctgcagtactataggtgcatggcatccgagctagtgagggtcaacattactcctgttgtcgccctctggcaacccatggcgcccaaccagggcctcccccgcctgctggcgaggcaaggtgcctgggaaaacccgtataccgccctggcctttgcggagtatgcgcggctgtgctttcaggaattgggccaccatgttaagctatggataaccatgaacgagccctacacccgcaatatgacgtatagtgccggtcacaaccttctaaaggcacacgctttggcgtggcatgtgtataatgaaaagtttagacacgcccagaacggaaagatttcaatagctctccaagccgactggatcgagcccgcctgcccgttctcgcagaaggacaaagaagtggccgagcgcgtcttggaattcgatataggctggttagctgaacccatcttcggtagtggcgattacccgtgggtaatgcgggattggctgaaccagcggaacaactttctactgccatacttcacggaggatgaaaaaaaactaattcaaggaaccttcgattttctggccctgtcgcattacacaacgatcttggtagatagcgaaaaggaggatcccatcaagtacaatgactatctggaagtgcaggaaatgactgatatcacgtggctgaacagcccctcgcaggtggctgttgtgccctggggcctgcgcaaggtgctgaattggttgaagttcaagtatggagatcttcctatgtacattatttccaacggaatagacgatggccttcacgccgaggacgatcaactgcgtgtctattacatgcagaactatattaacgaggccttgaaggcgcacattttggatggaatcaatctctgcggctacttcgcctacagtttcaacgatcgcacggctccacgcttcggactgtacaggtatgcggcagaccaatttgagccaaaggcgagtatgaaacactaccgaaaaataatcgactcaaacggatttcccggaccagagacgttggagcgtttctgtccggaggaatttaccgtctgcacggagtgcagttttttccacactcggaaaagcctgctggccttcatagccttcctgttcttcgcaagtataatctccctgtcgttgattttttactacagtaagaagggccgacgaagctacaag

SEQ ID NO: 14995 - DNA, 3036 bp, Artificial Sequence; identical to SEQ ID NO: 14994
  Description of Artificial Sequence: Synthetic coding sequence

SEQ ID NO: 14996 - DNA, 3036 bp, Artificial Sequence
  Description of Artificial Sequence: Synthetic coding sequence
atgcctgcctccgcacctccgcggcgccctagaccgccgccgccatctctgtcgctgctgctggtccttctgggacttggcgggcggcgtctgcgtgcggagccgggagacggcgcccaaacctgggcacggttctcacggcccccagcgccagaggctgccggcctcttccagggaactttcccagacggcttcctctgggcggtcggaagcgccgcgtaccagacggaggggggctggcagcaacatggcaagggagcctcgatctgggacactttcacccatcacccactcgccccaccgggcgattcgcggaatgcgtcgctcccgctcggagccccgtcacctctccagccagcaactggagacgtggcttcggactcctacaacaacgtattccgggacactgaggccctgcgcgagctcggagtgacccactaccgcttctccatttcctgggcacgggtgctgcccaatggaagcgcaggtgtgcctaaccgggagggtctgcgctactaccggcgcctgctggaacggctccgggagctgggggtccaaccggtggtgaccctgtatcactgggatctcccgcagcggcttcaggacgcctacgggggctgggcaaaccgcgcccttgccgaccatttcagagactacgcagaactctgctttcggcactttggaggccaagtgaaatactggatcaccatcgataacccatacgttgtggcatggcatggatacgcgaccggccggctcgcccctgggatccgcggaagcccgcggctggggtatctcgtggcccacaacctgctcctggcccacgcgaaggtgtggcacctgtacaacacgtcgttcagacctactcagggaggacaagtgtcaatcgcgctcagctcacactggatcaatccgcgaaggatgaccgaccactctattaaggaatgccaaaagtcgctcgactttgtgctgggatggttcgcaaagccagtgttcatcgacggagactacccggaatccatgaagaataatctgtcctcgattctgccggatttcacggagtcagaaaagaagttcattaagggaactgccgatttcttcgcgctgtgttttggaccaactttgtcgttccagctgctggacccgcacatgaagttcagacaactggaatccccaaatctccgtcagctgctcagctggattgaccttgaattcaaccatccacagatctttatcgtggaaaatggatggttcgtgagcggcaccaccaagagggacgacgctaagtatatgtattacctgaaaaagtttatcatggaaaccctgaaggccatcaagttggacggagtggatgtgatcggttacaccgcgtggtcactgatggacggatttgaatggcaccggggctactcgatccggaggggactgttctacgtggatttcctgtcgcaggataagatgctgctgcctaagtcaagcgcgctgttttaccagaaactgatcgagaaaaatggatttccgcctctgcccgaaaaccaaccgctggagggaacttttccatgtgatttcgcttggggcgtggtggacaactacattcaagtcgataccactctcagccagttcactgatctgaacgtgtacctttgggacgtgcatcattccaagcggctgattaaggtggacggcgtggtgactaagaagcgcaaaagctactgtgtggacttcgcggcgattcagccacaaatcgccttgctccaggagatgcatgttactcacttccggttctcgttggattgggccttgatattgccgctgggaaatcagtcccaagtgaaccacactattctgcaatactacagatgtatggcatccgaacttgtcagagtgaacatcacccctgtggtcgccttgtggcaaccgatggcccctaatcaagggctgccgagacttctggcaaggcaaggcgcgtgggagaacccgtacactgccctcgcgttcgcggagtacgcccggctctgcttccaggagctggggcatcatgtgaagctgtggatcaccatgaatgaaccgtacactcgcaacatgacgtacagcgctggccacaatctcttgaaagcccatgccctcgcctggcacgtctacaacgaaaagttcaggcacgctcagaacggtaagatctccatcgcactccaagctgattggatcgagccggcgtgcccgttctcacaaaaggataaagaggtcgcggagagggtcctggagttcgatatcggatggctggccgaaccgatcttcggatctggagattacccgtgggtcatgcgggactggttgaaccaacgcaacaattttctgctgccttacttcaccgaggacgagaagaagctgattcaagggacttttgacttcttggcgctgtcccactacaccaccatcctggtcgatagcgaaaaggaagatccgatcaagtacaacgactacttggaagtccaagaaatgactgacatcacctggctgaactcaccctcgcaggtcgccgtggtcccgtggggactgagaaaagtgctcaactggctcaaattcaagtacggagatttgccgatgtacatcatctccaatggaatcgacgacggactccatgctgaggacgaccaactgagagtctactacatgcagaactacattaacgaagccctgaaggcacacatcctggacgggatcaacctgtgtggatactttgcatacagcttcaatgaccgcaccgctccccgcttcggattgtaccggtacgccgctgaccagtttgagcctaaagcctcaatgaaacattaccggaagatcatcgactcgaacggattccctggacctgaaactctcgagcggttttgtccggaggaatttactgtgtgcaccgagtgttcatttttccatacccgcaagtccctgctcgctttcatcgctttcctgttcttcgcatcgatcatttcgctgtccctgatcttctactactctaagaagggaaggcggtcatataag

SEQ ID NO: 14997 - DNA, 3036 bp, Artificial Sequence; identical to SEQ ID NO: 14996
  Description of Artificial Sequence: Synthetic coding sequence

SEQ ID NO: 14998 - DNA, 3036 bp, Artificial Sequence
  Description of Artificial Sequence: Synthetic coding sequence
atgccggcttccgcccctcctcgccgcccaagacctccgccaccgtcgctgagcctgcttttggtgctgctgggactgggcggacgtcgcctccgagccgaaccgggagacggagcacagacttgggcgcgcttctcgcgaccgcctgcaccggaagcagccggactgtttcagggaactttcccagacggctttctctgggctgtgggatccgccgcataccagactgagggagggtggcagcagcacgggaagggcgcgtccatctgggacacttttacccaccacccacttgcaccacctggcgattcaaggaatgcctccctcccgctgggcgccccttccccgctgcaacctgccaccggggacgtcgccagcgatagctacaataacgtgttccgggacactgaagcactcagggaactgggggtcacccactaccgcttctcgatctcctgggctcgggtgttgccgaacggctcagccggagtgccgaatagagaaggtctgcgctattaccgccggctgctggagcgcttgcgcgaactgggagtccaaccggtcgtcacgctctatcattgggacctcccgcagcgcctccaggatgcttacggtggttgggccaaccgggccctcgctgatcactttcgcgattacgcggagctgtgcttccgccatttcggaggacaggtgaagtactggatcaccattgataacccgtacgtggtggcgtggcatgggtacgctaccgggcggctggcgccgggaatccgaggctcgccgagactgggctacctggtcgcccataatctgctgttggcacatgcaaaggtttggcatctgtataacacttccttccgcccgactcagggtggccaagtgagcatcgcactgtcatcacattggatcaacccgcggaggatgactgaccactcaataaaggagtgccagaaaagcctcgacttcgtgctgggatggttcgcaaagccggtattcattgatggagactacccggagagcatgaaaaacaatctctcatcaatcctgcccgattttactgagtcggaaaagaagttcatcaagggaacggcggatttcttcgcactttgttttggaccgactctgtcatttcagctgctggacccacatatgaaatttcgacaactcgaatcacctaatctgcgacagctgctctcatggatcgatctcgaattcaatcacccacagattttcattgtggaaaacggatggtttgtctccggcaccactaaacgcgacgacgcaaaatacatgtactacctgaagaagttcattatggaaaccctgaaggccatcaagttggacggtgtggatgtcattggatacaccgcctggagcctgatggacggtttcgagtggcacagagggtacagcatcaggcggggactgttttacgtggacttcctgagccaggataagatgctgctgccgaagtcgtcagcgctgttctaccaaaaactcatcgaaaagaacggatttcctccactgccagagaaccagccgcttgaaggcactttcccatgcgacttcgcctggggagtcgtggacaattacattcaggtcgataccaccctgtcgcagttcactgatcttaacgtgtacctctgggatgtccaccattccaagcggctcatcaaggtggatggtgtggtgaccaagaagcgaaaatcctactgtgtggattttgcagctatccaaccgcagatcgccctgctgcaggagatgcacgtgacgcacttccgcttctccctggactgggcgctgatcctgccactcggaaaccagagccaggtgaatcataccatcctgcaatactacaggtgcatggcgtcggaactggtgcgcgtgaacatcacccccgtggtggccctgtggcagccgatggcgcccaaccaagggttgccgcgcctgctggcaagacagggtgcgtgggagaatccttacactgctttggccttcgcggaatacgcccgcctgtgctttcaggagttgggacaccatgtgaagctctggattaccatgaacgagccatacacccgaaatatgacctactcggcgggtcataacctgctcaaggcccatgcactcgcgtggcacgtctacaacgagaaatttcggcacgcccagaatggcaagatctctatcgccctgcaggcagactggattgagccggcctgccccttctcacagaaggacaaggaggtcgctgaacgcgtcctcgagttcgacatcggttggctggccgaaccaatctttgggtcgggtgactatccgtgggtgatgcgggattggctgaatcagcgtaacaatttcctgttgccatacttcactgaagatgagaaaaagttgatccagggaaccttcgatttcctcgcgctttcgcattataccacgatccttgtggactcggaaaaggaggaccccattaagtacaacgactatctggaggtccaggaaatgacggacattacgtggctgaattctccatcgcaggtcgctgtcgtgccttgggggctgagaaaagtgctgaattggctgaagttcaagtacggagacttgccgatgtacatcatctccaacggaatagatgatggacttcatgccgaggacgatcaactgagggtgtactacatgcaaaactacatcaacgaagccctcaaagcacatatcctcgatggcatcaacctttgcggatacttcgcgtactcgttcaatgaccggaccgcaccacggtttggcctctaccgctacgcagcggatcaattcgagccgaaggcgagcatgaagcactacagaaaaatcatcgatagcaatggattccctggacctgaaacgctggaacgcttctgccccgaagaattcaccgtctgcacggagtgctccttctttcacacccggaagagcctgctggccttcatcgccttcctgtttttcgcaagcatcatctccctgtcactcatcttctactactctaaaaaggggagacgctcatacaag

SEQ ID NO: 14999 - DNA, 3036 bp, Artificial Sequence; identical to SEQ ID NO: 14998
  Description of Artificial Sequence: Synthetic coding sequence

SEQ ID NO: 15000 - DNA, 3036 bp, Artificial Sequence
  Description of Artificial Sequence: Synthetic coding sequence
atgccagccagtgcccctccccgaagacccagaccacccccaccgagcctgagcctcctgttggtactgcttggactcggtgggcgcagactgcgggccgagccaggtgatggcgcccaaacttgggcacgatttagtcgtccacccgccccagaggcagcgggcctgtttcagggcacgttccctgatggctttctatgggccgtggggtccgcagcataccagaccgagggtggttggcagcagcacgggaagggagcatcaatttgggatacatttacccaccacccactcgcgccgccaggggactcgagaaatgccagcctgcccctaggagctccctccccactgcaacccgctacaggcgatgtggctagtgatagctacaacaacgtctttcgggacacagaagctctgcgtgaactcggcgtgacccactaccggttcagcatctcctgggcccgtgtgctgcctaacggcagtgcgggggtgccaaaccgtgaaggattgcgctactatcgcaggctgctagagaggttacgagagttgggcgtgcagccagtcgtgacattgtaccactgggatctaccgcaacgtctgcaggacgcatatggcggatgggccaaccgagctctggctgaccacttccgggattacgctgaattgtgttttcgccacttcggcggacaggtaaaatactggataacaatcgacaacccttatgtagtggcttggcacggttatgccactggccgcttggccccgggaatcaggggttccccccgcctcgggtaccttgtcgcccataacctgctgctggcccacgccaaagtgtggcacctttataatacctcctttcggccaacgcaagggggccaagtgtccattgccctgagctcccactggatcaatcccaggaggatgacggaccattctattaaggagtgccagaagagcctcgacttcgtgctaggttggttcgctaagcccgttttcatcgacggtgattaccctgaaagcatgaagaacaatttgtcaagtatcttaccagacttcactgagtcagaaaaaaagttcattaaaggaacagccgactttttcgccttatgctttggccctaccttgtctttccagcttcttgatccccacatgaagttcagacaactggagtctccaaaccttcgacagctgctctcttggattgatcttgagtttaatcacccccagatctttatagtggaaaacggttggttcgtcagtggaaccacaaaacgtgacgacgctaagtatatgtattacctgaaaaaattcattatggagaccctgaaggctatcaagctagatggtgtggatgttatcggatacaccgcttggtccctcatggatggatttgagtggcaccgcggatatagcatacgacgtggccttttttatgtggattttttgtctcaagacaagatgcttctcccaaaatcctccgccctcttctatcagaagctcatcgaaaagaacgggttcccgccactcccagagaaccaacctctggagggtacattcccctgtgattttgcgtggggcgtcgtcgataattacattcaggttgacacgactctgagccagttcaccgacctcaatgtttatctctgggatgtccatcacagtaagcgattgatcaaggtagacggagtggttaccaaaaagcgcaagagttactgtgtggactttgcagctatccagccccagatcgcccttctgcaggaaatgcatgtcacacacttccgattttcactcgattgggctctgatacttccgctagggaatcagtcacaggtcaatcacaccattttgcagtattaccgatgcatggcttctgagttagttcgagtcaatatcaccccagtagtcgctctctggcaaccgatggcaccaaatcagggattgcctagactactagctaggcaaggcgcttgggaaaacccttataccgccctcgcctttgcagaatacgccagactgtgcttccaggaactggggcatcacgtcaagctgtggatcactatgaacgagccctacacaagaaacatgacctacagcgctggccataacttgctgaaagcacatgccctggcgtggcatgtttataacgaaaaattccgccatgcccagaacggcaagataagtatcgccctgcaggcggactggattgagccggcatgtccctttagccagaaggataaggaagtggcggaaagagttttggaattcgatattgggtggctggcggaacctatctttggcagtggtgattatccctgggtgatgcgggattggcttaatcagagaaataactttctgttgccctattttaccgaggatgagaagaaactgatacaaggcaccttcgattttcttgcgctaagccattacactactattctggtagattcagagaaggaagaccctattaagtacaacgactatctggaggtacaagagatgacggacattacctggctgaacagtccctcacaagtcgcggtcgtgccttgggggttacggaaggtgttaaattggctaaagttcaagtacggcgaccttcccatgtacatcatttcaaacgggatcgacgatggcctgcacgctgaagatgaccaactccgcgtctactatatgcagaactacatcaatgaggctttgaaagctcatattctagacggcatcaacctttgtggatactttgcatactccttcaacgacagaaccgcccctaggttcggactgtacagatacgctgctgatcagttcgaacccaaggctagtatgaaacattacaggaaaatcattgatagtaacgggtttcctggacccgagactttggagagattctgccccgaggaattcactgtatgcactgaatgcagctttttccatacccgcaaaagcctgctggccttcattgcgtttctattttttgccagtattattagcctctcgctcattttttattatagcaaaaaaggcaggcggagctacaaa

SEQ ID NO: 15001 - DNA, 3036 bp, Artificial Sequence; identical to SEQ ID NO: 15000
  Description of Artificial Sequence: Synthetic coding sequence

SEQ ID NO: 15002 - DNA, 3036 bp, Artificial Sequence
  Description of Artificial Sequence: Synthetic coding sequence
atgccagccagcgcgccccctaggaggccgaggcctcctcctcccagtctgtctcttctgttggtcctgctcggtctgggtggtagacgcttgcgcgcggagcctggtgatggtgcacaaacctgggcaagattttccagaccaccagctcccgaggccgcaggactctttcagggcacgtttccagacggcttcctgtgggcagtcggcagtgctgcttaccaaaccgagggcggctggcagcagcacggcaagggagcttccatctgggatacatttacacaccaccctctcgcaccacctggcgacagtcgcaatgcgtctttgccacttggcgctccttcccccctgcagcccgcaacaggtgatgtggcctccgacagctataacaacgtcttccgcgacacagaggcccttcgcgagcttggagttactcattacagattttccataagctgggcaagagttctccccaacggttcagcgggagtgcccaaccgcgagggcctcagatattacagaaggttgctcgagaggctgcgcgaactgggagtgcagcctgtagtgactctttaccactgggaccttcctcagaggctccaggatgcctatggaggctgggcgaaccgcgctttggctgaccatttcagagattatgctgaactgtgttttcgccacttcggcggacaggtcaagtattggatcactatcgataatccatacgttgtggcttggcacggctacgcgaccggacgcctcgctccgggcatcagaggctctcctagattgggatacttggtggcacataacctgctccttgcgcacgctaaagtgtggcatctttataacactagcttcagacctacacagggtggtcaggtcagcattgctcttagtagtcactggatcaaccccaggaggatgaccgatcactccatcaaggagtgccagaagtcactggattttgtcctcggttggtttgcaaagcccgtgttcatcgatggcgactaccctgaatcaatgaaaaacaatctgtcttccattctgccagatttcacagaaagcgagaaaaaatttatcaaaggcactgcagatttctttgccctctgctttggtccaacattgtcattccaactcctcgatccacatatgaagttccgccagctcgaaagtccaaaccttcgccagttgctttcctggatcgacctggagttcaaccacccccaaatctttatcgttgagaacggctggttcgtgtctggcacaactaaaagggacgacgcgaagtatatgtactacctcaagaaatttatcatggagacactcaaggcgataaaactggacggagtggacgttattggatacaccgcctggtcactcatggatggtttcgagtggcacagaggctattccatcaggaggggtcttttctacgttgacttcctgtctcaagataagatgctgttgcctaagtcctcagccctgttctaccagaaactgatcgagaagaacggcttccccccgctcccagagaaccaacccctcgagggtacgttcccctgtgattttgcttggggcgtggtggataattacattcaggtcgatacgactctgagccagttcactgatctcaacgtgtatctgtgggatgtccatcacagcaagcgcctgattaaggtcgatggagtcgtcactaagaagcgcaagtcttattgtgtagacttcgctgctatacaaccgcagatcgctctgctccaggagatgcacgtgacccatttccgcttcagtctggactgggctttgatcttgcctctcggaaaccaatcccaggtgaaccacacgatcttgcaatactacaggtgcatggcttccgagctcgtacgcgtcaacataacgcctgtggtggccttgtggcaacccatggctccaaatcagggcctgcccaggctgctcgctaggcagggagcctgggagaatccatatacagcgctggctttcgctgagtacgcacgcctctgcttccaggaactcggccaccacgtcaagctctggatcacgatgaacgaaccgtacactagaaacatgacctactctgccggccataatttgctcaaggcgcacgccctggcctggcacgtgtacaacgagaagtttcgccacgctcaaaacggtaagatatctattgcactgcaagctgattggattgagccagcgtgtccgttctcccaaaaggacaaggaagttgcagagagggtcctggagttcgatatcggatggcttgccgaaccaatcttcggtagcggtgattacccttgggtaatgagagactggttgaaccagaggaataactttctccttccctactttacagaggatgaaaagaaactcatccagggcacgttcgatttcttggcgctgagtcactacacaactatacttgtggactcagagaaggaggaccccatcaaatataatgattatttggaggtacaggagatgactgacatcacatggctgaattctccctctcaggttgctgtagtcccttggggattgcgcaaggttcttaattggctgaagttcaaatacggagatcttccaatgtatattatttctaatggaatcgatgatggactgcacgctgaggacgatcagcttagagtgtactacatgcagaactacatcaacgaagcgcttaaggctcacattctggacggaatcaacttgtgcggatactttgcctacagtttcaacgacaggacagcgccgagattcggcctgtacaggtacgctgcagatcaattcgagccaaaggcatccatgaagcactataggaagatcattgactctaatggtttcccgggacctgaaactctggaaaggttttgcccagaagaatttaccgtatgcaccgagtgctcatttttccacacgcgcaagtccctccttgccttcatcgccttcctcttttttgcttcaattatctctttgtccctgattttctactactctaagaagggtaggcgctcttataag

SEQ ID NO: 15003 - DNA, 3036 bp, Artificial Sequence; identical to SEQ ID NO: 15002
  Description of Artificial Sequence: Synthetic coding sequence

SEQ ID NO: 15004 - DNA, 3036 bp, Artificial Sequence
  Description of Artificial Sequence: Synthetic coding sequence
atgcccgcctccgcccctccccgccgtcctcggcctcctccgccgtctctgagtctgcttctcgtcctccttggcctaggcggaagacgacttcgtgccgaaccaggcgatggagcgcagacatgggcccgtttcagcagacctcccgcccccgaggcagcgggtctctttcaagggacctttcctgacggctttctctgggccgtggggagcgccgcctatcagactgagggggggtggcagcagcatgggaagggagcatcgatttgggacacattcacgcaccatcctttggctccacctggagattcccgcaacgcaagcctccccttgggcgccccttccccacttcagcccgccacaggggatgtcgcgtccgacagttacaacaacgtatttcgggacacggaagccttgcgcgagctgggggtgactcattacagattttccatctcatgggctcgtgttctgccaaatggatctgccggcgtgccaaaccgcgaaggcctgcgatattaccgcagactcctggagagactgcgggagctcggcgtccagcccgttgtaactttgtatcactgggacctgccacaacgtctccaggatgcatacgggggctgggcgaaccgcgccctcgctgaccacttcagggattatgcggagctctgtttccgtcacttcggcggtcaagtgaagtactggatcacaatcgacaacccgtatgtagttgcatggcatggttacgccacagggcgcctggctccagggatccggggatcccctcgtctcggttacttagtagctcacaatctgctcctcgctcacgccaaggtgtggcacctctacaacacttcatttcggcccacacagggcggacaggttagcattgccctgagctcccactggatcaaccccaggcgaatgactgaccactccattaaagagtgccagaagtctctggattttgtgctgggctggttcgccaaaccagtgtttattgacggcgattacccggaatccatgaaaaacaacttatcgtccatcctccctgacttcacggagtcagagaagaagtttattaagggaaccgctgacttcttcgctctatgctttggtccaacactatcattccagctcctcgaccctcatatgaaattccgacaactcgaatcccccaatctgaggcagttactgtcttggatagatttagaatttaatcacccccagatcttcatcgttgagaacgggtggttcgtctcaggtacaactaagcgggatgacgcgaagtatatgtattatcttaaaaagttcatcatggaaacactgaaggctattaaacttgatggtgtcgatgtgatcggctacaccgcctggagcctaatggacgggttcgagtggcacagagggtacagtatccggagagggctgttttacgtggactttctgtcgcaggataagatgcttctccccaagagctccgccctgttttaccaaaaactgatcgagaaaaatggatttccaccgcttccagagaaccagcccttggagggcaccttcccctgcgactttgcctggggcgtggtggacaactatatccaagtcgatacgacactttctcagttcaccgacctgaatgtgtatttgtgggatgtccaccacagcaagagattgattaaagtggacggagtggtaacaaaaaagcgcaaaagttattgcgtggattttgccgccattcagccacagatcgccctgttacaagagatgcatgtcactcacttccggttcagtctggactgggcgttgattctgcctctggggaaccagtcccaggttaaccatactatcctacagtattatcgctgcatggcaagtgaactggtgcgggtaaatatcacaccggtggtcgccctgtggcagccaatggctcctaaccaaggactaccccggctactcgcaagacagggtgcttgggagaacccttacaccgctctggccttcgccgagtacgctcgcctgtgtttccaggaacttgggcaccatgttaagctgtggattacgatgaatgagccctacactcggaatatgacctattcagcgggtcacaacctcctgaaagcacacgcactggcatggcacgtgtacaacgagaagttcagacatgctcagaacggcaagataagcatagcccttcaggcggattggatcgagcccgcctgtccattctcgcagaaagataaggaggtagctgaacgggtactcgagtttgacatcggctggctggcagagccaatcttcgggagcggagattatccttgggtgatgagggattggctgaatcaacgaaacaactttcttcttccttatttcacagaggatgagaaaaagctgatacaaggaactttcgactttctggcactatcacactatacaactatccttgttgacagcgagaaggaggaccccattaagtacaatgattacctggaggtgcaggagatgactgacataacttggctgaattctcccagtcaggtcgcagtggtcccttgggggctgcgcaaagtcctgaactggttgaagtttaagtatggagatctccctatgtacatcattagcaatggcattgacgatggcctgcacgccgaggacgaccaactgcgggtatattatatgcagaattacataaatgaggcactgaaggctcacatcttggacggaattaatctgtgtgggtactttgcttactctttcaacgataggacagcccccagatttggcctctaccggtacgccgcggatcagtttgagccaaaggcttccatgaagcattatcgtaagataattgactctaatgggttccccggccccgagacactggaaaggttctgccctgaggagttcaccgtctgcaccgagtgtagcttttttcataccagaaagtcacttctcgcttttatagcgtttcttttcttcgcatccattattagcctttccctgattttttactactctaaaaaaggacggagaagctacaag

SEQ ID NO: 15005 - DNA, 3036 bp, Artificial Sequence; identical to SEQ ID NO: 15004
  Description of Artificial Sequence: Synthetic coding sequence

SEQ ID NO: 15006 - DNA, 3036 bp, Artificial Sequence
  Description of Artificial Sequence: Synthetic coding sequence
atgccagctagcgccccccctcgacgaccacgcccaccccccccgtctttgtctctgttgttagtactgctcggtctcgggggaagacgtctccgagcagagccaggtgacggggcccaaacctgggctcgtttcagtagacccccagcacccgaggccgctggcctgttccaggggacctttcctgatggctttttatgggctgtcggcagtgcagcctatcagacagagggcggctggcagcagcacggcaaaggggcttctatctgggatacgtttacccatcacccacttgcacctccgggagattctcgcaatgccagcctccctttaggagccccttccccactccagcctgccaccggagacgtcgcctctgattcatataacaacgtctttcgcgacacggaagccctcagagaactcggagtcacccactacaggttcagtatttcctgggccagagttttgcccaacggttcagctggcgtccccaaccgggaggggctaagatattatcgccggctgcttgagcgcctgcgcgaactaggcgtccagcccgtcgttaccctctaccattgggacctccctcaacgcctacaggatgcatatggcggctgggccaacagagctttagccgaccattttcgggattatgcagagctttgctttagacactttggaggccaggtgaagtattggataactatagacaacccttacgtcgtggcttggcatgggtatgcaaccggtaggctagcacctggtatccgggggtcccctagactgggatatctggtggcccataaccttctattggcccatgcgaaggtctggcatctgtacaatactagtttccggcccacacaggggggccaagtctcaattgctctgtcttctcattggatcaatcccaggcgaatgaccgatcattctattaaagagtgtcagaagtccttagatttcgtgcttggatggttcgctaagccagtgttcattgatggtgactaccccgaatcgatgaaaaacaacttatcctccatactgcccgacttcaccgagtcagagaaaaaattcataaagggcacggcggacttttttgcgctgtgtttcggcccgaccttatccttccagctcttagatccacatatgaagtttagacaactggaaagccccaatctgaggcaactcctttcatggatcgatctcgaattcaaccatccccagatctttattgtcgaaaacgggtggtttgtcagtggcacgacaaagagggacgacgcaaagtatatgtactacctgaaaaagttcatcatggaaacactgaaggcaatcaaactcgatggggttgatgtcatcggatacaccgcctggagtctgatggacgggttcgagtggcatcgagggtacagtattagacgaggtctattttacgttgacttcctcagccaggacaaaatgttactgcctaaatcctcagcactattctaccagaagcttattgagaagaacggattccctcctctgccagaaaaccagcctcttgaggggacttttccgtgtgacttcgcttggggggtggtggacaactacattcaagtggataccaccctcagccagtttaccgatctgaacgtgtacttgtgggatgtgcaccacagcaagagactaatcaaagtcgacggtgtggtgaccaaaaagagaaagtcatactgtgtggactttgcagcgatccaaccccagatagccctgctgcaggagatgcacgtgacgcactttcggttttcactggattgggctttgatcctcccactcggaaatcagagtcaagttaatcatacaatcctgcagtattacagatgcatggcaagcgagctggtacgagtgaacataacacctgtggttgccctgtggcagccaatggcaccaaatcaaggcttgccccgactcctcgccagacagggggcatgggaaaatccttataccgcactcgccttcgcagaatatgcgcgcttgtgctttcaggaactcggtcaccatgtcaagctgtggataactatgaatgaaccctacaccagaaacatgacgtactcagctgggcacaaccttttgaaggcgcacgcattggcatggcacgtgtacaacgaaaagttccggcatgcacagaatggtaaaattagcatcgcgttgcaggcggattggatcgagcctgcatgtcccttttctcagaaggacaaggaggtggcggagcgggtcctggagtttgatatcggatggctagcagagcccatcttcggctcaggcgactacccctgggttatgagggattggctcaaccagcggaacaacttcctgctgccttacttcactgaagacgaaaaaaaactgatccaggggacatttgatttcctggccctcagtcactatacaaccatcctggtggattccgagaaagaggatccaattaagtataatgattacctcgaggttcaggaaatgaccgatattacatggctgaattcaccctcacaggtggccgttgtgccttggggactgaggaaagtgttgaactggttgaaattcaaatatggagacctacctatgtacataatcagtaacggcatagatgatggcctccatgccgaggacgaccaactccgcgtgtattatatgcagaattatataaacgaagctctgaaggcacacattctcgacggaataaacctttgcggctatttcgcctattctttcaacgaccggaccgcccctcgttttggcctatatcgttacgctgctgaccagttcgagcctaaggcatcaatgaaacattatcgcaagatcatcgactcaaatggcttcccagggcccgaaactttagaaagattttgccccgaggaatttacagtgtgtacagagtgtagctttttccatacaagaaagagcctccttgctttcatcgcctttttgttctttgcctctataatcagcttaagcctaattttttactactctaagaaggggaggaggtcatacaaa

SEQ ID NO: 15007 - DNA, 3036 bp, Artificial Sequence; identical to SEQ ID NO: 15006
  Description of Artificial Sequence: Synthetic coding sequence

SEQ ID NO: 15008 - DNA, 3036 bp, Artificial Sequence
  Description of Artificial Sequence: Synthetic coding sequence
atgcctgcctctgctcccccacggaggccaaggcctccccccccttcgttgtctctgcttctggtcctgctcggtctcggcgggcgccgcctacgagccgaacccggcgacggggcccagacctgggcccgatttagtcgccctccggctcctgaggcagctgggctgttccagggcacctttccagacgggtttctgtgggccgtggggtctgctgcctatcagaccgagggcggctggcagcagcacggaaagggagctagcatttgggacacctttacacaccatccactggctcctccaggagactctaggaatgccagtctaccccttggcgctccctcacccttgcagcccgccacaggggatgtggcttccgacagttacaacaatgtgttccgggatacagaagccctgagggaacttggagttacccattatcgcttttcaatcagctgggcccgagtcctacccaacggaagcgctggggtccctaatcgggaaggattacgatactaccgcaggcttctggaaagactgagagaactcggcgtgcagcccgttgtgaccctgtatcattgggacttaccccagcgcttgcaagacgcatacggtggatgggctaacagggccttggctgatcactttcgagactacgctgagctatgctttcggcactttgggggacaggtgaagtattggattacgatagacaatccctacgttgtcgcttggcatgggtacgcaaccggacggctagcccctggtattcgggggagcccgcgcctgggctacctagttgcccacaacctgctgctcgcacatgccaaggtgtggcatctttataataccagcttccgtcctactcaggggggccaggtctctatcgcccttagctctcattggattaatcccagacgcatgaccgaccactccattaaggagtgtcagaagtccctcgatttcgttctcggctggttcgcgaaaccagtttttatcgatggagactatcccgagagcatgaagaacaatctgagctcaatccttcctgatttcacagagtctgagaagaagtttatcaaaggcactgctgatttttttgctttgtgttttggtccgactttatcttttcagttattggatccccatatgaaattccgtcagctggaatcccctaacctgaggcaacttctctcttggatcgatctggagttcaaccatccacagatctttattgttgagaatggctggttcgtatccggcacaaccaaacgggacgatgccaagtatatgtactacctgaagaaattcatcatggagactctgaaggcgatcaagctagacggggtggacgtaatcgggtacactgcctggtccctgatggacggcttcgaatggcatagaggttatagtataaggagagggctcttctatgtggacttcctgagtcaggacaagatgcttctgccaaaatcctcagccctcttctaccagaagcttatcgaaaagaacggattcccccctctcccagagaatcaaccattggaaggcaccttcccctgcgactttgcctggggggttgtagacaactatatccaggtggacaccacccttagccaatttacagatctcaacgtatacctgtgggatgtgcaccactcaaaaagactcatcaaggtggatggtgtggtcaccaagaaacggaagtcctattgtgtggatttcgcagcaatccagccacaaattgccctgctgcaagaaatgcatgtgactcattttcgcttcagtctagattgggcacttattctccccttgggaaaccaatcccaggtgaaccacactatcctgcagtactatcgctgcatggcttcagaactagtgcgcgtaaatatcacgcccgtggttgccctttggcagccaatggcgccaaatcaggggctgccaagattgctcgcccgtcagggggcttgggaaaatccgtacactgccttagcattcgccgagtacgcccgtctctgttttcaagaattgggtcaccacgtgaagttgtggatcacgatgaatgagccatacacacgaaatatgacctacagcgcaggccataacctgttaaaggcccacgccctcgcttggcatgtatataacgagaagttccggcatgcacaaaacggcaagatttccatagctctgcaggccgactggattgaacctgcctgtcccttcagccagaaggacaaggaggttgccgagagggtgctcgagttcgacatcgggtggctcgctgagcctatcttcgggtcaggggattacccctgggttatgcgcgactggctgaatcagcgcaacaactttttgctgccatattttactgaggatgaaaaaaaacttattcaaggcacatttgacttcctggcactgtcccattatactacaattctcgtcgatagcgagaaagaggatcccattaagtacaacgactacctagaagtgcaggagatgactgatattacttggcttaactcaccatcccaggtagccgtggttccatgggggcttcgcaaagtgttgaactggctgaaattcaaatacggagatcttcctatgtatattatttcaaatggaattgacgacggcttacacgcagaggatgatcagctcagggtgtactacatgcagaactatattaatgaggctctgaaagcccatatcctggacgggattaacctgtgcggctactttgcttactccttcaatgaccggaccgctccacggtttggcctttaccggtacgccgccgaccagttcgagcccaaagcctcaatgaagcactataggaagataatcgattccaacgggttcccaggccctgaaacgctggaacggttttgtcccgaagagttcacggtttgtacagaatgctcctttttccatacacggaagagcctcctggcttttattgcttttttgttttttgccagtattataagtctctctctgatcttctactactccaagaaggggaggcgctcctacaag

SEQ ID NO: 15009 - DNA, 3036 bp, Artificial Sequence; identical to SEQ ID NO: 15008
  Description of Artificial Sequence: Synthetic coding sequence

SEQ ID NO: 15010 - DNA, 3036 bp, Artificial Sequence
  Description of Artificial Sequence: Synthetic coding sequence
atgcctgcttccgcaccccccagacgaccccggccacccccgccatctctgagcctactcctggtgctgctaggtctgggggggcggagactgcgcgccgaacccggagatggagcccagacttgggcacgttttagtcgacctccagcgcccgaggcggcaggactgttccaaggcacttttccggatgggttcctgtgggccgtcggcagcgctgcctatcagacagaaggaggttggcagcagcacggcaagggtgcttctatctgggacacattcacccatcaccccttggccccccctggagatagcagaaacgcctcactgcctttgggcgctccaagtcccctacagcctgctactggggatgtcgcttctgacagttacaacaatgtattcagagataccgaagccctgagggaacttggcgtcacccactatcgattcagcataagctgggccagagtactccctaacggatccgctggagtccctaacagagagggcttgcggtattaccggcggttgctagagagattgcgtgaactaggggtccaacctgttgttactctgtatcactgggatctgccccagcggctgcaagacgcatatggaggatgggctaatagagcgctggctgatcacttccgggattatgctgagttatgcttccgtcattttggaggccaagtcaaatactggatcacaatcgataatccatacgtggtcgcctggcacggatacgcaaccggcagactggcccccggcattcggggatccccccggcttggctacctggttgcacacaatctcctgctggctcatgcgaaagtgtggcatctctataatacatcatttcgtcccactcagggcggtcaggtgagtatagccttatcttcccactggattaatcccaggcggatgaccgaccatagtattaaggaatgccagaagagcttggattttgtcctgggctggttcgccaaacccgttttcatcgacggcgattaccccgagtccatgaagaacaacctctcgtctatattacccgattttacggagagcgaaaagaagtttatcaaaggcaccgctgatttcttcgccctgtgttttggccccacactgtcgtttcagcttctcgacccacacatgaaatttcgacagctggagagcccaaatctaaggcaactgctaagctggattgacctagagttcaaccatcctcagatatttatagtggaaaatggctggttcgtaagtggaacaaccaaaagagatgacgccaagtatatgtactacctgaaaaaatttattatggaaacgctgaaagccattaaactagacggggttgatgttatagggtacacagcctggtcattgatggatggctttgaatggcatcgcggttatagtatccgcagaggcctgttctacgtggacttcctcagccaagacaagatgctgctgcctaagtctagtgctcttttttaccagaaactgattgaaaagaacggtttcccccctctcccagaaaaccagccattggaaggcacgttcccatgtgatttcgcatggggggtcgttgacaactacatacaggtggatactacactgagtcagttcacggacctgaacgtttacctctgggatgttcatcactcaaaacgtctgatcaaggtggacggagtggtcacaaaaaaacggaagagctattgtgtggattttgcagcaattcagccacagatcgcactgcttcaagaaatgcacgttacccactttcgtttctctttggactgggccttgatcttgcccctaggcaatcagagccaggtgaaccatactattctacagtactacaggtgcatggccagcgagctggttcgtgtaaacatcacgcccgtagtggcgctctggcaacctatggcccccaaccagggcctcccaaggcttctcgctcgccagggagcctgggagaatccatatactgcactcgcctttgccgaatatgccaggctgtgcttccaagaactcggacatcatgtgaaactctggattaccatgaacgaaccctatacgaggaacatgacctattccgcaggacacaacctgctgaaagctcacgctctggcgtggcacgtgtataatgagaagtttcggcatgctcagaatggcaaaattagcatcgctctgcaggctgattggatagagccagcttgtccgtttagtcagaaagacaaggaggtagcggagcgcgttctggaatttgatatcggttggttggccgagcccattttcgggtctggggactacccctgggtaatgagagactggcttaaccagcgcaacaattttctgctcccatacttcacagaggatgaaaagaagctcatccaaggaacatttgactttctcgccttgtcgcattatacaactatcttagtggactctgaaaaagaagacccaatcaagtataacgactacttagaggttcaggaaatgaccgatatcacttggctgaactctccctcccaggtagccgtcgtgccctggggactccggaaggttctcaattggctgaaattcaagtatggcgatctgccaatgtacatcattagcaatggcatcgatgatggccttcatgcagaggatgaccagctgcgtgtctattatatgcaaaattatattaacgaggccttgaaagcccatattctagacggtatcaatctttgcggctactttgcttacagtttcaatgaccgaacagcccctcgtttcggcttgtatagatacgccgcagatcagtttgaaccaaaggcatccatgaagcattaccgaaaaatcattgatagtaacggatttcccggacccgagacactggagcggttctgtcccgaagagttcacagtttgcacggaatgttccttttttcatacccgtaagtctcttctggcttttatcgcttttttgttctttgcaagcatcatttccctgagcctgatcttctactattcgaagaaaggccgacgcagctacaag

SEQ ID NO: 15011 - DNA, 3036 bp, Artificial Sequence; identical to SEQ ID NO: 15010
  Description of Artificial Sequence: Synthetic coding sequence

SEQ ID NO: 15012 - DNA, 3036 bp, Artificial Sequence
  Description of Artificial Sequence: Synthetic coding sequence
atgcccgcttctgctcccccgaggcgtccccggccccctccaccctcgctgtccctgctgcttgttctcttagggctgggagggcgacggctgcgcgccgagcccggagacggagcccagacctgggcccgctttagccgccctcctgcgcccgaggcggctggactgttccaaggcacatttcccgatggattcctttgggcggtggggagtgctgcataccaaaccgagggcggttggcagcaacacgggaaaggggcatctatatgggacacttttacacaccatcctctagcaccccctggagacagtcggaatgcttctcttccacttggggccccatctcctctccagcccgcgacaggcgatgtcgcttccgactcttacaataacgtgttccgggacacagaggccttacgtgagctcggcgtgactcactaccggttctctattagctgggcacgggtgcttcctaacggctcagcgggcgtgccaaaccgggagggtcttcggtactatcggcgactgctggaaaggctgcgggaacttggcgtgcaacccgtcgtcactctgtaccactgggatttgccacaaagattacaggacgcatatggcggatgggccaacagagcactagctgaccattttagggactacgcggagctgtgcttccgccattttgggggccaggtgaaatactggatcacaattgataatccctacgttgtggcatggcacggatatgccacaggtcgactggcacctggaatccgggggtctccccgactgggctatttggtcgcccataatctattgctggcgcatgcaaaggtgtggcacctctataacaccagcttcagacctactcaaggcggacaggttagtattgccctttctagccactggataaacccccgcagaatgactgatcattccatcaaagagtgtcagaagtcattggacttcgtcctcggatggtttgccaaacccgtcttcattgatggggactatcctgagtctatgaagaacaacctgtcttctatactaccagactttacggagtctgagaagaaatttattaaggggactgccgacttcttcgccctctgtttcggccctaccctctcctttcagctccttgacccgcatatgaagttccgccaattggaatctccgaatctcaggcaactgctaagttggattgacctggaattcaaccatcctcagattttcattgttgaaaacggttggttcgtgtcagggacgaccaaaagggacgacgcaaaatacatgtactatttaaagaaatttattatggaaaccttaaaggccatcaagctagacggagtagacgtcatcggatatactgcctggagcttgatggacgggtttgagtggcatagaggctactctatccgtaggggcttgttctatgtggattttctctcccaggacaaaatgttgcttcctaagagtagcgctctcttttaccagaagctcatcgaaaagaacggattcccacccttgcctgagaaccagcccctcgagggtacctttccatgtgactttgcatggggggtagttgacaactacatccaggtagacacgacactgtctcagttcactgatctgaacgtgtatttgtgggacgtgcaccactccaagcggctaatcaaagtggatggagttgtgacaaagaagaggaaatcatattgcgtcgattttgcagcaatccagccccagatcgctctgctgcaggaaatgcacgtgacccacttcagattttccctggattgggctctgattttacctcttgggaaccaatctcaagtgaatcacactatcttacagtactacaggtgtatggccagcgaactcgttcgagtgaacataacaccagtggtggccttgtggcagcctatggctcccaaccaaggccttcctagactgctggcccggcagggggcctgggaaaatccctatacagccctcgctttcgcagagtatgcgcgcttgtgcttccaggagctggggcaccatgtgaaactctggatcactatgaacgagccctacacgaggaacatgacctatagtgccggtcacaatctgctgaaagcccacgccctcgcatggcatgtgtacaacgaaaaattccggcatgctcagaatgggaaaatctcaatcgcgctgcaggccgattggatcgagcccgcctgtccctttagccagaaggacaaggaggtcgcagagagggttttggagttcgatataggatggctggccgagcctatcttcggttccggtgattacccatgggttatgcgggattggttgaatcaaagaaacaacttcctgctcccatattttactgaagacgagaaaaaattgattcagggaacattcgacttcctcgctctgtctcactacactaccattcttgtggatagcgagaaggaggacccaatcaaatataacgattacctggaagtccaagaaatgacggacatcacgtggctgaactcaccatcgcaagtcgcagtggtgccctggggtctgaggaaagtgctgaattggcttaaattcaagtatggtgacctgcctatgtatattatctccaatgggattgacgatggtctccacgccgaggacgaccagctgagagtgtattacatgcagaattacattaatgaagcactgaaagctcacattttggatggcattaacctgtgcggatattttgcatacagctttaacgacagaactgctcctaggttcggcctttacagatacgccgcagatcagtttgagcccaaagcctcaatgaagcattataggaagatcatcgattctaacggatttccaggccccgagactctcgagaggttctgccccgaggagttcactgtgtgtaccgaatgctctttcttccacacccggaagagcctcctggcattcatcgccttccttttttttgcaagcattatctccctgagtctaatcttttattactctaaaaaggggagacggtcttacaaa

SEQ ID NO: 15013 - DNA, 3036 bp, Artificial Sequence; identical to SEQ ID NO: 15012
  Description of Artificial Sequence: Synthetic coding sequence

SEQ ID NO: 15014 - DNA, 3036 bp, Artificial Sequence
  Description of Artificial Sequence: Synthetic coding sequence
atgccagcttcggctccaccacgtcgcccgaggcctccaccgcctagtctctccttgttattggttttactcgggttaggcgggaggcgactacgtgccgaaccaggagacggggctcagacctgggctcgtttttctagaccaccagctcccgaggctgcagggctatttcagggaacttttccagatgggtttttgtgggcagtgggatccgctgcataccaaacagaaggaggttggcaacaacatggcaaaggtgcgagcatctgggacacattcacccatcatccattggcacccccaggggattccagaaacgccagtcttccacttggggccccttctccattacagcctgctacaggcgatgtcgcttccgattcttataacaacgtgttcagggacactgaggctcttagggagttgggagttactcattatcgtttttccatcagctgggctagggttttgcccaacggatctgctggggttcctaacagggaagggcttagatactatcgtagactcttggaacgcttgagggagctgggcgtgcagccagttgtgaccctttaccactgggatcttccccagagattacaggatgcttacggcggatgggctaatagggccttggctgatcattttagggattacgcagagctttgttttcgtcattttggaggacaagtgaaatactggataacaattgacaatccttacgttgtcgcttggcacggatacgccactggaagactcgcccctggcattcgaggaagcccccgattgggttatcttgtagcccacaacttactgttggctcacgctaaagtctggcacctgtacaatacctccttccgtcctacacaaggggggcaagtatcaatagccctttcaagccattggataaatcctcgaagaatgactgatcactctattaaagagtgccagaagagcttggatttcgttttggggtggtttgctaaacctgtatttatcgatggcgattaccccgagtccatgaagaataatctcagttccatactcccggactttacagagtctgagaagaaatttattaagggaacggcagacttctttgctctgtgttttggtcctacactctcgtttcagctgctcgatcctcatatgaagtttaggcagttggagtcaccaaatctccggcagttattatcctggatcgatcttgagtttaaccatccccagatatttattgttgagaacggttggtttgtctctggtacaacaaagcgtgacgacgccaagtatatgtactacctcaagaaatttattatggagaccctgaaggctatcaagcttgatggtgtggatgttatcggctacactgcgtggtctcttatggatggcttcgagtggcataggggctattcgattcggcggggtctcttctacgtcgattttctttctcaggataagatgctactcccaaagtcatctgccttgttctatcagaagcttatcgagaagaacggcttccctcccctacctgaaaatcaaccacttgaggggacttttccatgcgatttcgcatggggtgttgtggacaactatattcaagttgatacaactttgtcacagtttactgacctcaacgtttatttgtgggatgtgcatcattccaagcgcctcattaaggtggatggtgttgtgactaaaaagcgtaagagttactgcgtagacttcgctgcaattcaacctcagattgcgctcctgcaggagatgcacgtcacacactttaggttttctcttgattgggctctcattttgccacttggaaatcagtctcaagtcaaccacactattctgcagtactataggtgtatggcaagtgaactcgtcagggtgaacattacgccagttgttgcattatggcagcccatggctcctaaccagggtctgcccagattgcttgctaggcaaggagcttgggaaaacccatacactgctttggcattcgccgaatatgctagattgtgcttccaagagcttggacatcatgttaaattgtggataaccatgaatgagccctatactaggaatatgacatattcagctggccataatcttttaaaagcacatgccctggcttggcacgtttataatgaaaaattcagacacgctcaaaatggaaagatttcaatcgctcttcaggctgactggattgaaccggcttgtcccttttcacaaaaggataaggaggtggctgaacgtgttttggaatttgatatcggatggttggcggaacctatctttggaagtggcgattacccgtgggttatgcgggactggctgaatcaacgtaacaacttcttgctaccatactttaccgaagatgagaaaaagcttatccaaggaacctttgacttcttggcactttcacattataccacgatccttgttgattccgaaaaggaagatcctatcaaatataacgactatttggaggttcaggagatgacggatattacatggttgaattccccaagccaagtggcagtggtgccatgggggttacgaaaagtgctcaattggctgaagtttaagtacggtgacctacccatgtacataattagcaatgggatagatgatgggttgcatgccgaagacgaccaactcagggtttattatatgcaaaattatattaacgaagctttgaaggctcatatccttgatgggattaatttgtgtggatacttcgcatattcctttaatgataggactgcacctcgttttggcctgtaccgttacgcagcggatcaattcgaacccaaggctagtatgaagcattacaggaaaatcatagattccaacggttttccgggacctgaaacattagaaaggttctgcccagaggaatttaccgtatgcaccgaatgcagtttttttcacacccgaaagagcctccttgctttcattgccttcttgttcttcgcttcgatcatctcactaagtcttatattttattatagtaagaagggtaggagatcgtacaag

SEQ ID NO: 15015 - DNA, 3036 bp, Artificial Sequence; identical to SEQ ID NO: 15014
  Description of Artificial Sequence: Synthetic coding sequence

SEQ ID NO: 15016 - DNA, 3036 bp, Artificial Sequence
  Description of Artificial Sequence: Synthetic coding sequence
atgcctgcatccgcccctcccagaaggccaaggcctccaccaccatccctgagccttctgctcgtccttctgggactgggcggacgccggctgcgcgccgagccaggcgatggagcacaaacttgggccagattttcgaggccccctgcaccggaagctgcgggtttgttccaaggtacgttcccagacggatttctgtgggcagtgggatcggcagcctaccagaccgaagggggatggcaacagcacggaaagggtgcttcgatctgggacacgttcacccatcaccctttggcacctcctggggattccagaaatgcatcacttccactcggcgcgccctcgcctctccaacccgcaacgggagatgtggcatccgattcatacaacaacgtatttagagataccgaggcattgcgagagcttggcgtgactcattaccgcttctcgattagctgggcgagagttctcccaaatggaagcgcaggcgtgcctaaccgtgagggactgcggtactatcgaaggctcttggaacgactcagagagctgggcgtgcaaccggtcgtcactctttaccattgggatctgccgcagagactgcaagacgcgtacggagggtgggcaaaccgggcactggccgatcactttagggattacgctgaactttgttttcgacatttcggagggcaggtgaaatactggattaccattgataacccttacgtggtggcgtggcacggttacgcaaccggtaggctggcccctggtattcggggaagccctaggctggggtacctggtcgctcataacttgcttcttgctcatgctaaggtctggcatctctacaataccagttttagacctactcaagggggtcaagtgtcaattgcattgtcgtcacattggattaacccacggcgaatgaccgaccacagcattaaggagtgccagaagtcgcttgatttcgtgctcggatggttcgcaaaaccggtctttatagatggcgactaccctgaatcaatgaagaataacctgagctctattcttcctgactttaccgaatcagagaagaagttcattaaaggcactgccgacttttttgcgctgtgtttcggacccacccttagctttcaactcttggatccgcatatgaagtttcgacaacttgaatctcctaacctgaggcaactgcttagctggattgatcttgaattcaaccaccctcaaatctttattgtcgaaaacggatggttcgtgagcgggaccacgaagcgagacgatgccaagtacatgtattatcttaagaaattcattatggagactctgaaggcgatcaaactggatggagtcgatgtgattggatacactgcgtggtccctcatggacggtttcgaatggcacagaggttacagcataagacgggggctcttttatgtcgactttttgtcgcaagacaagatgctgcttccaaaaagctcggcactgttttaccagaagctgattgaaaagaacggtttccctccacttccagaaaaccaaccactggagggcacgtttccatgcgactttgcatggggagtggtcgataactatatacaagtcgacacgactctttcccagtttaccgacctgaacgtctacctgtgggacgttcaccactccaagcggctgattaaggtggatggggtcgtcactaagaaacggaagtcgtactgcgtggattttgccgcaattcaaccacaaattgcccttttgcaggagatgcatgtgacccattttcgcttctccctggattgggcactgattctgccactgggaaatcagtcgcaagtgaaccataccatcctccaatactaccgctgtatggcgtcggaattggtcagagttaacatcacccccgtcgtcgccttgtggcaacccatggcaccgaatcaagggcttcctcgtctgttggcgcgccagggagcctgggaaaacccatacaccgcacttgcttttgcggagtacgcacgcttgtgcttccaagaactgggacatcacgtgaagctgtggatcactatgaacgaaccatatacccgcaacatgacttactctgcaggtcataatcttctgaaggcacatgcacttgcatggcatgtctacaacgaaaagtttagacacgcacagaatggaaagatatcgattgccctgcaagctgattggattgaacccgcatgtccgtttagccagaaggataaggaagtggccgagagagtgcttgaatttgatataggttggctggcagaaccgatttttggatccggtgattacccgtgggtgatgagagactggctgaaccaaaggaataacttcctgctgccctactttactgaggacgagaaaaaacttatccagggtacttttgattttctcgctctttcccattataccaccattctggtggactcagagaaagaggaccccattaagtacaacgattaccttgaagtccaggagatgaccgatataacgtggttgaactccccttcccaggtcgcagtcgtgccttgggggctgcgtaaggtgctgaactggctgaagtttaagtacggtgatctgcctatgtacattatctcgaacggtatcgatgacgggctccacgcagaagatgatcaactccgagtgtactatatgcagaactacataaacgaagcactgaaagcacatatactggatgggataaatctgtgtgggtactttgcctactcgttcaacgaccggaccgcaccgcgctttggcctttacagatacgcagcagaccagtttgaacccaaagcgtcgatgaagcattaccgaaaaatcatagattcaaatggctttccgggacctgaaacgctggagcggttttgtccagaagaattcaccgtgtgtaccgagtgcagcttttttcatactcgcaagtcgcttctggcctttattgctttccttttctttgcatcaattatcagtctttcactgatcttttactactcgaaaaagggtaggcgatcctacaag

SEQ ID NO: 15017 - DNA, 3036 bp, Artificial Sequence; identical to SEQ ID NO: 15016
  Description of Artificial Sequence: Synthetic coding sequence

SEQ ID NO: 15018 - DNA, 3036 bp, Artificial Sequence
  Description of Artificial Sequence: Synthetic coding sequence
atgcccgcatcggcgccgcctcggcgccctagacccccccccccgtctctctcactgcttctcgttcttttgggcttgggcgggcgccgactccgtgctgaaccgggcgacggcgcacagacctgggctcggttctcccgccccccggcacctgaggccgcgggattgttccaggggacattcccggatggcttcttgtgggccgtggggtctgcggcctatcaaaccgagggtggctggcagcaacacggcaagggcgcctctatctgggatacattcacccaccatcccctcgcccctcccggcgactcccggaatgcctcgctcccccttggcgcgccttcacccctccagcccgccaccggtgatgttgcttctgactcctacaacaatgtttttcgggacaccgaggcgctccgcgagctcggcgtgacccattatcgtttctctattagttgggcccgcgtcctgcccaacggttctgcgggtgtgccgaaccgagaaggactgagatattatcgtcgactgcttgagcgactacgcgagttgggtgttcagcccgtggttaccttgtaccactgggacctgccccaacgacttcaagacgcttatggaggttgggcgaatcgtgccctagctgatcatttccgcgattatgccgaactttgtttccgccacttcggcggccaggtcaagtattggatcacaatcgacaacccctacgtggtcgcgtggcacggctacgcgaccggtcgcctggcgcctggtatccggggaagtccacgactgggctacctagtcgcccataatcttttgctcgcccatgctaaggtttggcacctgtacaacacctctttccgcccaactcagggcggtcaagtgtccattgcgttgtcgagccactggattaacccccgtagaatgactgatcactctatcaaggagtgccagaagtcgctcgatttcgttctgggttggttcgcaaaacctgtcttcatcgacggagactaccccgaaagtatgaagaacaacttgtcgtccatcctgcctgacttcaccgagtcggagaagaagttcatcaagggaacagccgatttctttgccctgtgctttggccccactttaagcttccagctgttggaccctcatatgaagttccgtcaactggagagccccaaccttcgccagttactgtcctggatcgatctggagttcaaccacccacagatcttcattgtggagaatggttggttcgtgtcaggtaccaccaagcgggatgacgccaagtacatgtactatctcaagaagttcatcatggagaccctcaaggccatcaagcttgacggtgtggacgtgattggttacaccgcgtggagcctgatggacggcttcgagtggcatcggggctacagtatccgccgcggcctgttctatgttgatttccttagtcaggacaagatgctgctgcccaagtcctccgccctgttctaccagaagctgatcgagaaaaacggctttcccccgctcccggagaaccaacctctagagggcaccttcccctgcgacttcgcctggggcgtggtggacaactacattcaggtcgacacaaccctgagccagttcaccgatctcaacgtgtatctctgggatgtgcaccattctaagcgtctgatcaaagtggacggcgtggtgacgaagaagcgtaagtcgtactgtgtagacttcgccgccatccagcctcagattgcccttcttcaagagatgcacgttacgcacttccgcttctccctcgattgggctctcatcttgcccttaggtaatcagagccaggtgaaccataccattttgcagtattaccgctgcatggcttctgaactggtccgcgtgaatatcacccccgtcgtagccctgtggcagcctatggctcccaaccaggggttgcctagactccttgcgcgccagggcgcttgggagaacccctacaccgctctggctttcgcggagtacgctaggttgtgcttccaggagctgggccatcacgttaagctgtggatcaccatgaacgagccgtacactaggaacatgacctactccgctgggcataacctcctgaaggcgcacgcgctcgcttggcatgtttataacgaaaagtttcgtcacgcccagaacggtaagatttcgatcgcgctccaggccgattggatcgaacccgcatgcccgttctcccaaaaagataaggaggtcgctgaacgtgtccttgagttcgacataggttggctggccgaacccatcttcggtagcggtgactacccctgggtcatgcgcgattggttgaaccagcggaacaacttccttctcccctacttcactgaggacgagaagaagcttatccagggcactttcgacttcctcgccctcagtcattataccactatcctagtcgactcggagaaggaagatccgattaagtataacgactacctcgaggttcaggaaatgacggatattacgtggctcaactccccatcgcaagtggctgtagttccttggggcttgcgcaaggtcctcaattggctcaaattcaagtacggggatctcccaatgtatattatttcgaacggcatcgacgatggcctacacgccgaagacgaccaactccgtgtctactatatgcagaactacatcaacgaagctttgaaggcccacattctggatggaatcaacctctgcggttatttcgcctactcattcaacgacaggaccgccccacgtttcggtctgtatcgttacgcggctgatcagttcgaacctaaggcatctatgaagcactaccgcaaaatcattgactctaacggtttcccgggcccggagaccttggagcgcttctgcccggaggaatttaccgtgtgcaccgagtgctccttcttccacacgcgaaagagcctgctggcattcattgccttcctcttcttcgccagtatcatcagcttgtccctgatcttctactatagcaagaagggccgccgttcttataag

SEQ ID NO: 15019 - DNA, 3036 bp, Artificial Sequence; identical to SEQ ID NO: 15018
  Description of Artificial Sequence: Synthetic coding sequence

SEQ ID NO: 15020 - DNA, 3036 bp, Artificial Sequence
  Description of Artificial Sequence: Synthetic coding sequence
atgcctgcctcagctcctccaagacggcctcgacccccacctccctctctgtccttgctccttgtacttcttgggctcggaggacgccgactcagagctgaacccggagacggggcacagacatgggcgcggttttctagaccaccagctcctgaagctgctggattgttccaggggacatttcctgatggatttctttgggctgtgggatctgccgcatatcagacagaaggagggtggcagcaacacggaaagggagcttctatctgggacactttcacacatcatccactagctcctcctggggattcaaggaacgccagtctccctttgggggctcccagtcctctgcagcctgccactggggacgtggcttcagactcatataataatgtgttccgggatacagaggccctcagggaactcggagtaacacattacagattctcaatatcctgggctcgggtccttccaaacggatctgcaggggtgcccaatagagaaggacttcgctattatcgacgactcctcgagaggttacgggaactcggggtgcagcctgttgttacactttaccattgggatctaccccagaggctgcaggatgcgtatgggggatgggccaatagggccctagccgatcactttagagattacgccgagctttgtttcaggcactttgggggacaggtgaaatactggatcactatcgataacccttatgtggtagcctggcacggatatgccacagggaggctcgcccccggaatccgggggtctccacggcttggatatctagttgcccataatctcctgttagcccatgccaaagtgtggcatctttataatacatcattccggccaacacaaggagggcaggtgtctattgctctcagttctcattggatcaatcccaggcggatgactgatcactctataaaagaatgtcagaaatcactcgactttgtgctgggatggtttgcaaaacctgtgttcatcgatggagattacccagagagtatgaaaaacaacctttcatcaatactacctgatttcacagaatctgagaaaaaatttattaaagggacagctgatttctttgccttatgctttggacctacactctcctttcagcttctggacccccacatgaaattccggcagcttgagagtcccaacctcagacagctgttatcttggattgatcttgaattcaaccacccccagatattcatagtggaaaatggatggtttgtctctgggacaacaaaacgggatgatgcaaaatatatgtattatctcaaaaaattcatcatggaaacattgaaggccattaaattagatggggtagatgtcattgggtatactgcctggtcactcatggatgggttcgaatggcataggggatactctattaggcgcgggctattttatgtcgacttcttgtcccaggataaaatgctcctaccaaaatctagtgcccttttttatcagaaactgatcgaaaagaatgggttcccacctctccctgaaaatcagccactagagggaacattcccttgtgattttgcttggggggtcgttgataactatatacaggtggatactacgctctctcagttcactgatttgaatgtgtatctctgggatgttcaccatagtaagagattaatcaaagtcgatggggtggttacaaaaaaaagaaagtcctattgcgttgatttcgcagccatccagccccagattgccttgttgcaggaaatgcacgtgacacactttcgattttcactggattgggccttaatactaccattgggaaatcagagtcaggtgaaccacacgatactgcagtattacaggtgcatggcttcagaactggtgagagtgaacataacacctgtcgtggcgctgtggcagcccatggcacctaaccagggactcccgcgccttctcgcccgacagggagcatgggagaacccctatactgcactggcatttgcagagtatgccagactgtgtttccaggaactcggacatcatgtgaaactttggatcacaatgaacgaaccttatactaggaacatgacttatagtgctggacacaacctactgaaggctcacgcacttgcttggcacgtatataatgaaaagtttagacacgcccagaatgggaaaatatctatcgctctccaggccgattggatagaacctgcctgtcctttcagtcaaaaagacaaagaagtggccgaaagggtgctggaattcgatataggatggctcgctgaaccaatcttcgggagtggggattacccttgggtaatgagggattggctaaaccagcgtaacaattttctcctgccatattttactgaagacgaaaaaaaactgatccagggaacttttgattttctcgctctgtcccattacacaactatattagtcgatagtgagaaagaggacccgataaaatacaatgactaccttgaagtacaagaaatgacagatatcacatggcttaactctccttctcaggtcgcagttgtaccctgggggctgcggaaagttctcaactggttaaaatttaaatacggagacctgcccatgtatataatttcgaacgggattgatgatgggctacatgctgaggatgatcagctacgcgtgtattatatgcagaattatattaacgaggcattaaaagcccatatacttgatggaattaacttgtgcgggtatttcgcctactcatttaacgatcggacggctccacgcttcggactgtatcgctatgccgcagatcagtttgaacccaaggcctcaatgaaacactatagaaaaataattgattcaaacggatttccaggacccgaaactttagagagattttgtcccgaagagtttactgtctgtacagaatgcagtttttttcatactaggaaatcactccttgcatttatagccttcctattcttcgcttctatcatctctttgtcccttatcttctactactccaaaaaaggaagacgatcatacaaa

SEQ ID NO: 15021 - DNA, 3036 bp, Artificial Sequence; identical to SEQ ID NO: 15020
  Description of Artificial Sequence: Synthetic coding sequence

SEQ ID NO: 15022 - DNA, 3036 bp, Artificial Sequence
  Description of Artificial Sequence: Synthetic coding sequence
atgccagcatctgcaccacctcggcggccccgaccgcctcccccgtctctgtccctgctactcgtcctcttaggtcttggcgggcgtcgcctcagagcagagcctggagacggcgcacagacctgggcaagattctctcggccgccagcacccgaggccgctgggctgtttcaaggaaccttcccagatggctttctttgggcggttggtagcgctgcatatcagacagaaggcggctggcagcaacacggtaagggagcctccatttgggacacattcactcatcatcccttagcccctccaggcgattctcggaatgcctctttgccccttggcgccccgagcccactgcagcccgcaaccggggatgtggcctctgatagctataataacgtctttcgggacacagaggcactgcgggaactcggtgtcacacactatagattttctatatcctgggctcgggtgttgcccaatggaagtgccggcgtgccgaacagggagggcttaagatattaccggcggttactggagcgactgagagagctgggggtccagccagtggttactttatatcattgggatctgccccagaggctgcaggacgcctatggtggctgggctaatcgggcacttgcagaccatttcagagactacgctgagctgtgttttcggcactttggcgggcaggttaagtactggataaccatcgacaatccatatgttgtggcttggcatggatatgccaccgggcgtctcgcgccgggtattcgggggtcccctagactgggctacctcgtggcccacaacctattactggcccatgctaaggtctggcacctttataacactagctttagacctacccaagggggtcaggtgtctatcgcactgagcagccactggattaatccaaggagaatgacagaccactccatcaaagagtgtcagaagtctctggatttcgtgctaggctggtttgctaagccagtcttcatcgacggagactacccagaaagtatgaagaacaacctgtcctcgattttacccgactttactgagtctgagaaaaagttcattaaagggactgctgatttctttgccctatgctttgggcctacgctgtccttccagcttttggatccccatatgaagttccggcagttggagtcacctaacctcaggcagttactaagctggatcgatctcgaattcaatcatccccagattttcatcgtagagaacggctggttcgtctcagggacaactaagcgtgacgacgccaaatatatgtattatctgaaaaagttcatcatggaaaccctgaaagccattaaactagacggcgtggacgtaattggttacaccgcctggtccctcatggacggattcgaatggcacaggggctattcaataagacgggggctgttttacgtcgactttctatctcaggataagatgctcctccctaagagcagtgccttgttctatcagaaactcatcgagaagaacgggtttcccccactgcccgaaaatcagcccctggaaggtactttcccttgcgactttgcatggggcgtggtcgacaactatatacaggtcgacacgaccctgtcgcaattcacagatttgaacgtttacctctgggacgtccaccacagcaagcggttgatcaaagtggacggggtggtaaccaagaaaaggaaaagctactgtgtcgatttcgcagccattcagcctcaaatagctctgctgcaggaaatgcacgtgacacactttcgattttctttagactgggctctgattctacctcttggtaatcagagccaggtgaatcacaccatcttgcagtattaccgatgtatggcctccgaactggtcagggtgaacataactccagtcgtggccttgtggcagccaatggcccccaatcagggactacctcgtctcttggctagacagggagcctgggagaatccgtatactgccctcgcctttgctgaatatgctcggttatgttttcaggaactgggacaccatgtgaaattgtggattaccatgaacgaaccttatacgcgcaacatgacgtattctgcgggacacaacttgcttaaggcacacgccctggcatggcacgtgtataacgaaaaatttaggcacgcccaaaatggaaaaattagcattgctttgcaggctgattggattgaaccagcatgccctttctcacaaaaggataaagaagtggctgaaagggtactcgagttcgacattgggtggctggctgaacccattttcgggtctggcgattacccatgggtgatgcgcgactggctgaaccaacggaataactttctgctgccatactttacagaagatgagaagaagctcatccagggtacatttgatttcctggcacttagtcactacaccacaatactggtcgacagcgagaaagaggaccccattaaatacaacgactatctcgaggtccaggaaatgacagacatcacatggctcaactctccaagtcaggtcgcggttgtaccctgggggcttcgtaaggtattgaactggctgaagttcaaatatggtgatctgccaatgtacatcattagtaatggaatcgacgatgggttgcacgccgaggacgaccaactccgggtttactacatgcagaactatataaacgaagccctgaaggcacacattctagatggcattaacctgtgcggatatttcgcgtactcttttaacgacagaaccgcaccaagatttggactgtacagatacgcagctgaccagtttgaacctaaggcctccatgaagcattatcgcaagataatagactccaatggttttccaggaccggagacgctggaacggttttgccctgaggagttcactgtttgtaccgaatgcagcttttttcacactcggaagtctcttctggccttcatcgcattcctcttcttcgcgtccattatatccttaagcctcatattctattattcgaaaaaaggccgcagaagctacaaa

SEQ ID NO: 15023 - DNA, 3036 bp, Artificial Sequence; identical to SEQ ID NO: 15022
  Description of Artificial Sequence: Synthetic coding sequence

SEQ ID NO: 15024 - DNA, 3036 bp, Artificial Sequence
  Description of Artificial Sequence: Synthetic coding sequence
atgcccgcatcagcacctccacgtagacccaggcctccaccaccaagcctgtcactccttctggtcttgctgggactgggcggtcggcggctgcgtgcagaacctggtgacggtgcacagacctgggcaaggttttcgcgtcccccagccccggaagccgccggactgttccaaggtacctttccggacggatttctctgggcagtcggcagcgcagcgtaccagactgaaggaggatggcagcaacatggtaagggcgcatctatttgggatacctttactcatcacccactcgcccctcccggcgacagccgaaatgcgtcccttcctctgggcgcaccttctccacttcagcccgcaaccggagatgtcgcgtccgattcctacaacaacgtgttcagggataccgaagcactgcgggaactgggagtgactcattacaggttttcgatctcctgggcacgcgtgctccctaacggaagcgccggcgtgccgaaccgggaagggctgcgttactaccgcagacttttggagaggcttcgcgaacttggcgtgcaacccgtggtgaccctttaccattgggacctgccccaaaggctgcaagacgcttacggaggatgggctaatcgagccttggccgatcatttcagagattatgcggaactttgttttagacatttcggtggacaggtcaagtactggattactattgacaacccttacgtggtcgcatggcatggatacgcaactggcaggcttgccccgggcatcaggggatcacctaggctgggttaccttgtcgctcataacctgcttcttgcacatgccaaagtgtggcatctgtataacacgtcattcagaccaacccagggaggtcaagttagcattgctctttcgtcgcattggattaatcctaggcggatgactgaccatagcataaaggagtgtcaaaagtccttggattttgtccttggttggtttgcaaaacctgtgttcatagatggagattaccctgaatccatgaagaacaatctgtcgtccatactccctgactttaccgaatcagaaaagaagtttatcaaaggtactgccgatttcttcgctctgtgtttcggtcctactctctcctttcaacttctggatcctcacatgaaattccgtcagcttgaatcgccaaacctgagacagctgctttcgtggattgatctggagtttaatcatccgcaaatcttcatagttgaaaacggatggttcgtctcggggactactaagagagacgacgccaagtacatgtattacctcaagaagttcatcatggaaactctcaaagcgataaaactcgatggagtggatgtgattgggtacactgcgtggtccctcatggatgggtttgaatggcatcgtggctacagcattcgaaggggactgttttacgtcgatttcctgtcccaggacaaaatgctgctccctaagtcctctgcactcttttaccagaagctgattgaaaagaacggatttcccccacttcccgaaaaccaacctcttgagggaacgtttccatgtgattttgcctggggcgtggtcgataactacattcaagttgacaccaccctgagccaatttaccgatctgaacgtgtatctctgggatgtgcatcacagcaaaagactgattaaggtggacggagtggtcaccaaaaagcgaaaaagctactgtgttgattttgcggcaatccaaccacagattgcactgcttcaggagatgcatgtgactcactttagattttcacttgattgggccctgatcctgcctcttggaaaccagtcgcaagtcaaccataccatcctgcagtactacagatgtatggcatcggaactcgtgagggtgaacatcactcctgtggtggcactctggcagccaatggccccgaaccaagggcttccgcggctgctggcaagacaaggagcgtgggagaatccctacaccgcgctggcttttgcagaatacgctcgactttgcttccaagagcttggacaccatgtgaagctgtggataactatgaatgagccttacaccaggaacatgacctactcagcaggccacaaccttcttaaggcgcatgcactggcctggcacgtctacaacgaaaagttccgtcacgcacaaaacggtaagatctcgatcgcgctccaggcagactggatcgagccggcatgccctttttcgcagaaggataaggaagttgcagaacgggtccttgagtttgatattggatggcttgcagagcccatttttggatcaggtgactacccttgggtcatgcgcgattggttgaatcaaagaaacaatttcctgctcccttacttcacggaggacgaaaagaagctgatccagggcacctttgactttctcgcactctcgcactatacgaccatcctggtcgattccgagaaagaggaccctattaagtataatgattatctggaggttcaggagatgaccgatatcacttggcttaatagcccctcacaagtcgcagtggtgccgtgggggctgagaaaggtgcttaattggctcaagtttaagtacggcgatcttcccatgtacatcatttctaacgggatagatgacggactgcatgcagaagatgatcaactgagagtgtactacatgcagaactacattaatgaggctctcaaggcccatatactggatgggatcaatctctgtggttactttgcgtactcctttaatgatagaaccgcaccaaggtttggtctgtacagatacgcggccgatcaatttgaacccaaagctagcatgaagcactaccggaagattattgactctaacgggttccccgggcccgaaactcttgagcggttctgcccggaggaatttacggtgtgcaccgaatgttccttttttcacacccgcaaatcgctcttggcattcatcgcatttctgttcttcgcatcgatcatttcccttagcctgatattctactacagcaagaagggaagaagatcatacaaa

SEQ ID NO: 15025 - DNA, 3036 bp, Artificial Sequence; identical to SEQ ID NO: 15024
  Description of Artificial Sequence: Synthetic coding sequence

SEQ ID NO: 15026 - DNA, 3036 bp, Artificial Sequence
  Description of Artificial Sequence: Synthetic coding sequence
atgccagcatcggcaccacctaggcgaccgcgacccccaccgccctccctctcgcttcttttggtgcttcttggactgggtggtcgcagacttcgcgcagaacctggggatggcgcacaaacctgggcccggttttccaggccccctgcaccagaagcagccgggctctttcaaggaacgtttcccgacggtttcctgtgggcagtgggttcagcagcgtaccagactgaaggtggatggcaacagcatggaaaaggagcatcaatctgggatacgttcacccatcatcctctcgctccccctggagatagcagaaacgcctccctcccactgggagcgccctcacccttgcagcctgctaccggagatgtggcctcagattcctacaataatgtgttccgggataccgaagcactcagagaacttggagtgactcattatcgtttttcgatttcgtgggcacgtgtactgcctaacggctcggccggcgtcccaaaccgagagggcttgagatactacaggcggctcctggaaaggctccgtgagctgggggtgcagccagtggtgactctgtaccattgggatcttcctcagcggctgcaggatgcttacggtggttgggccaaccgggcacttgcggatcactttagagattacgcagagctgtgttttcggcattttggcggtcaggtgaagtactggataaccattgacaacccatacgtcgtcgcatggcatggctacgccaccggaaggcttgccccaggaatccggggcagcccgaggcttggatacttggtcgcccataatctgctgctggctcatgcgaaggtgtggcatctctacaacacttccttccgcccgactcagggcgggcaggtgtcgattgcactctcctcgcattggattaacccccgaagaatgacggaccatagcataaaggagtgtcagaagagccttgattttgtcctgggctggtttgccaagcctgtctttattgacggggactacccagaaagcatgaagaacaatctttcgtccatcctcccagatttcaccgagagcgaaaagaagttcattaaagggaccgccgatttctttgccctctgtttcggaccaactttgagcttccagctgcttgacccacacatgaagtttaggcaactggaatcacctaacctccgacagcttctgagctggattgatctggagtttaatcatccccagatcttcattgtggagaatggttggtttgttagcggaaccactaagagagacgatgccaagtatatgtactaccttaagaagtttatcatggaaacgctgaaagcgattaagctcgatggagtcgatgttattggatatacggcatggtcccttatggacggattcgaatggcaccggggatattcgatacgccgtggactgttctatgtggatttcctttcccaagacaagatgctgctgccgaagtcctcggcactgttttaccaaaagttgattgagaaaaacggcttccctcctctccctgagaatcagccccttgaaggaaccttcccgtgcgactttgcctggggtgtcgtagacaactatattcaggtcgatacgactcttagccagtttaccgatctgaacgtctacctttgggacgtgcatcattcgaagcggttgataaaagtggacggagtcgtcaccaaaaagagaaaatcctactgtgtggactttgcggcaatccagcctcaaatagcactgctgcaagagatgcacgtgacgcactttcgattttccctggattgggcactcattctgccccttggaaatcagtcacaggtgaaccacactatccttcagtactaccgatgtatggcaagcgaacttgtgagagtcaacattactccagtcgtggcactgtggcaaccaatggcacctaatcaaggacttcctcgtctcttggcccgtcaaggcgcttgggagaacccttacactgcccttgcatttgcagaatacgccagactttgtttccaagagctcggacatcatgtgaaactttggatcactatgaacgagccttacacccggaatatgacctacagcgccggccacaatctgcttaaagcacatgctttggcgtggcacgtttacaacgaaaagttccgtcatgcacaaaacggcaagatctccatcgcactgcaggccgattggattgagcctgcatgtcctttttcgcagaaagataaggaagtggccgaacgcgtcctggaatttgatatagggtggctcgcagaacctatattcggttcgggtgactacccttgggtgatgagagactggctgaaccaacgaaacaattttctgctcccttactttaccgaggacgagaagaagttgatacaaggaacttttgatttcctcgcgctctcacactacactaccattcttgtggatagcgaaaaggaggacccaattaagtacaatgactacctcgaagtgcaagaaatgaccgatataacgtggctcaactcgccttcacaagtggcagtggtgccgtgggggcttcggaaagtcctgaattggctgaagtttaagtacggtgatcttccaatgtacataatctccaatggcatagacgatggattgcatgcagaagatgaccagctgcgagtgtactacatgcaaaactacattaacgaagccctgaaggcacacatcctggatggtataaacctgtgcggatactttgcatacagctttaacgatagaaccgctcctagatttggactttacaggtacgcagcagatcaatttgaacctaaggcaagcatgaagcattacaggaagattattgattcaaacggatttcccgggccggaaacccttgaaaggttttgccctgaggaatttaccgtgtgcacggagtgttcgttcttccacactaggaagagccttcttgcatttatcgcattccttttctttgcctcgattatcagcctgagcctcatcttttactatagcaaaaaaggaaggcggagctacaaa

SEQ ID NO: 15027 - DNA, 3036 bp, Artificial Sequence; identical to SEQ ID NO: 15026
  Description of Artificial Sequence: Synthetic coding sequence

SEQ ID NO: 15028 - DNA, 3036 bp, Artificial Sequence
  Description of Artificial Sequence: Synthetic coding sequence
atgccagcctcggcgccaccgaggcgaccgcggcctccaccgccgagcctgtccctgcttctcgttctcctcggcttgggagggcgccgcctgcgcgccgagcctggagacggtgcccagacctgggcccggttctcccgtccgcccgcgccggaagccgcaggactgtttcagggcacttttcccgacggatttttgtgggctgtcgggtctgccgcatatcagactgaggggggttggcaacaacacggaaagggtgcatcgatctgggacacctttacccaccacccccttgcgcctccaggagactcaagaaacgcgtccctcccgctgggcgctccgtcgccgcttcagcctgcgaccggggatgttgcctccgattcatacaacaacgtgtttcgcgacaccgaagcgctgcgcgaactcggtgtcactcattatcgcttttccatctcctgggccagggtgctcccaaacggctcagccggagtcccgaatcgggaaggactcagatactaccgcaggctgctggaaagactgcgcgaactgggcgtgcaaccggtggttaccctctaccattgggatctccctcagcggctgcaggatgcgtacggagggtgggctaaccgggccctggcggaccatttcagagattacgccgagctgtgctttcggcattttggtggccaggtgaaatactggattactatcgataacccgtacgtcgtggcctggcacggctacgcgaccggtagactggccccgggaatcagagggtcgcccagactgggatacctggtggcccataacctgctcctcgcccatgccaaagtgtggcatttgtacaacaccagcttccggccaactcaagggggccaggtgtccatcgcgctgtcctcacattggatcaacccacggagaatgactgaccactcgatcaaggagtgccaaaagagcctggacttcgtccttggttggttcgccaagccggtgttcatcgacggagattacccggagtcaatgaagaataatctctcctcaatcctgccagacttcaccgagtccgaaaagaagttcatcaagggcactgccgatttctttgcactgtgcttcggccctacgctgtcgtttcagctcctggatccgcacatgaagttccgccagttggagagccctaatctcaggcagctcctctcctggatcgacctggagttcaatcacccgcagattttcattgtggagaatggctggtttgtgtcaggaaccactaagcgcgatgatgcgaagtatatgtattacctcaagaaattcattatggaaaccctcaaggcgatcaagctggacggagtggacgtgatcggctacacggcgtggagcttgatggatgggtttgagtggcaccggggatactcgattagacggggtctgttctacgtggacttcctctcacaagacaagatgctgctcccgaagagctccgctctcttctaccagaagctcatcgaaaagaacggctttccgccgctcccggagaatcagccacttgaaggaaccttcccgtgcgacttcgcttggggagtggtggacaattacatccaggtggacaccaccctgtcccagtttacggacctgaatgtctacctgtgggacgtgcatcattcgaaacgcctcataaaagtcgacggcgtcgtgactaagaagcggaagtcctactgcgtcgacttcgcggcgatacagccgcagatcgcgctgctgcaggaaatgcacgtcacccattttcgcttttcactggactgggcgctcatcctgcctttgggaaaccaatcgcaagttaatcatactatcctgcagtattaccgctgcatggcctccgaactggtgcgggtgaatatcaccccggtcgttgccctctggcaacctatggctccaaaccagggactccctcgactcctggcgcggcaaggagcgtgggaaaatccatacactgccttggctttcgccgaatatgcccggctgtgctttcaagagctcggccaccacgtcaaactctggatcactatgaacgaaccgtacaccaggaacatgacctactcggcaggccacaacctgcttaaagcccacgcccttgcgtggcatgtgtacaatgagaaattcaggcatgcccagaacggaaaaatctcaatcgcgctgcaggccgactggatcgaacctgcctgccccttctcacagaaggacaaggaagtggccgagagagtcctggaattcgatatcggatggctggccgagccgattttcgggagcggagactacccgtgggtgatgcgagactggctgaaccagcgaaacaatttcctcctcccgtacttcactgaagatgagaagaagctcatccaagggaccttcgatttccttgcattgtcccattacaccaccattctggtcgatagcgaaaaggaggacccaatcaagtataacgactacctcgaggtgcaggaaatgactgatatcacgtggttgaatagcccatcacaggtggcggttgtgccgtggggactgcgcaaggtgctcaactggctgaagttcaagtacggcgacctgccgatgtacattatctccaacgggattgacgacggactgcatgcggaggatgatcagctcagggtgtactacatgcagaactacatcaacgaagccctgaaggctcacatccttgatggcatcaacctgtgtggttacttcgcctactcattcaacgatcgcaccgctccacgcttcggactctaccggtacgcagccgaccagtttgagccgaaagccagcatgaagcactacagaaagatcatcgactccaacgggtttccgggtccagaaaccctcgaacgcttctgtccggaagagttcactgtttgcactgaatgctcgttctttcatacccggaaaagcctgctggcgttcatcgcattcttgttcttcgcctcaattatctcactctcgctcatcttctactactctaagaagggaagaaggtcatacaag

SEQ ID NO: 15029 - DNA, 3036 bp, Artificial Sequence; identical to SEQ ID NO: 15028
  Description of Artificial Sequence: Synthetic coding sequence

SEQ ID NO: 15030 - DNA, 3036 bp, Artificial Sequence
  Description of Artificial Sequence: Synthetic coding sequence
atgcccgcatccgctccccctagaaggcctcgcccaccgcctccttctctaagcctgcttttggtgctgcttgggcttggcggtagacgtctgagggccgaaccaggggacggcgcccaaacttgggccagatttagccgtccccctgccccagaggcagccggcctgtttcagggcacttttcccgacggctttttgtgggcagtcgggtccgcagcataccaaacggaagggggttggcaacagcacggcaagggagctagtatctgggataccttcactcatcaccccctggcacctccaggcgactcaaggaacgcctccctgcccctgggagctccatctccgctgcagcctgcaaccggcgacgtggccagcgacagctataacaatgtgtttagggacactgaagctttacgtgaactgggcgtgacgcactaccgattttcaatatcctgggcccgggtgctaccaaatggttccgccggcgtaccaaacagggaagggctacggtattacagacgtttgctggaaaggctgagggaactaggtgtgcaacccgttgtgacactataccattgggatctgccacagcggctgcaggacgcatatggaggatgggccaaccgagccctggctgaccatttcagggattacgctgaactgtgctttaggcattttggggggcaggtaaaatattggatcactatcgataatccctatgtcgtggcctggcacggatacgcgacggggcggcttgcccctggcatcaggggatctccccgactgggatatctggtcgctcataacctgctgctagcgcacgctaaggtttggcacttatataacaccagctttcgacccacccagggcgggcaggtgagtatcgcactgtcttctcattggatcaacccccgacggatgaccgatcatagcataaaagagtgccagaagagcctggactttgtgttgggctggtttgctaagccggtgtttatcgacggcgattaccccgagtctatgaagaataatctgagttccatcttaccagacttcactgagtcagagaagaagttcattaaaggtaccgctgattttttcgcactgtgctttggccccacactgtctttccagctgctcgaccctcatatgaaattcaggcagttagaatccccaaacctgcgccagttgctgtcctggatcgatctggagttcaatcatccccaaatttttattgtggaaaatggatggtttgtttcaggtacgactaaaagggacgacgctaagtatatgtactatttgaaaaaatttataatggaaacattgaaggcgattaagttagacggagttgatgtcatcgggtacacagcttggagcctcatggatggctttgaatggcataggggttactccattcgaagggggctgttctacgttgacttcctctcccaggacaagatgctcctccccaagtcaagcgccctcttttatcagaagctaatcgagaaaaatgggttcccacctttgcctgaaaaccagccgttggagggcacatttccctgcgacttcgcctggggggtggtggacaactatatccaggtggatacaaccctatctcaatttaccgacctgaacgtgtacctttgggacgtgcaccactccaaaagactcataaaggtggacggcgtcgtgactaaaaagcgtaagtcttattgcgtggatttcgccgcaatccaaccgcagattgcgttactgcaggaaatgcatgtgacccacttccgtttttcccttgattgggctctgattttacccctcggtaaccagtctcaggtgaaccacacaatattgcagtactaccggtgtatggcttctgaactggttagggtaaacatcacaccagtggtcgccctgtggcagcccatggcacccaatcagggactgccgagactgcttgccagacagggagcgtgggaaaacccctacaccgcactcgcatttgcagagtacgcaagactgtgtttccaagaactgggacatcatgtgaagttatggatcaccatgaatgagccttacactcgaaacatgacctattctgcaggacataatttattaaaggctcacgcgttggcgtggcacgtctataatgagaaatttagacacgcacaaaacggcaagataagtatcgcattgcaggctgattggatcgaacctgcctgccctttttctcaaaaagacaaggaagtcgcagagagagtgctcgagttcgacattggatggcttgcggaacccatcttcggtagtggcgactacccatgggtgatgagagactggttgaaccagcgaaacaattttctgctgccttatttcaccgaagatgaaaaaaagttgatccaaggcacgttcgacttcctggctctgtcccactatacgacaattctcgtggactctgaaaaagaagatccgattaagtacaatgattatttggaagtacaggaaatgacggacatcacgtggctcaacagtccatcgcaagttgctgtagtaccctggggcctgagaaaggtactcaactggctaaaattcaagtacggggacctgcctatgtacatcatttctaatggcattgacgatgggttacacgcggaggatgatcagctgagagtctattatatgcagaattacatcaatgaggcccttaaagcgcatattctagacgggattaatctgtgcggatacttcgcctattcttttaacgaccgaaccgccccgaggtttggtctctatcggtacgcggctgaccagttcgaaccaaaggcctccatgaagcattaccgcaagattattgattctaacggattccccgggccagaaaccttggagagattttgtcccgaagagttcacagtgtgcactgagtgctcttttttccacacacgcaaatccctgctggcctttatcgcatttctgttcttcgctagcattattagcttgagccttatcttttactatagtaaaaagggcaggagatcatataag

SEQ ID NO: 15031 - DNA, 3036 bp, Artificial Sequence; identical to SEQ ID NO: 15030
  Description of Artificial Sequence: Synthetic coding sequence

SEQ ID NO: 15032 - DNA, 3036 bp, Artificial Sequence
  Description of Artificial Sequence: Synthetic coding sequence
atgcctgcttcggcgccaccaagacggccgaggccaccgcctccttcgctgtcattgctcctcgtgcttctcggactgggcggacgacgcctgagagctgaacctggagacggagcccagacctgggcccgtttctcacgcccgccggcgccagaagccgccgggctcttccaagggacgttccctgacggattcctgtgggctgtgggttcggccgcgtaccaaaccgagggtggctggcaacagcacggaaaaggagcgagcatctgggatactttcactcaccaccctctggcaccaccaggcgactcccgcaacgcttcacttccgctcggcgcaccaagcccgctccaaccagcaaccggagacgtcgcgtccgactcctataacaacgtgttccgagatactgaggccctgcgggagctcggggtgacgcactacagattttcgatctcgtgggcacgggtgctgcctaatggatccgccggtgtgccaaaccgggagggactgcgctattaccgcagactcctggagcgcctgagagaactgggagtccagccagtggtcaccctgtatcattgggacctgccacagcgactgcaagatgcctacggaggttgggccaaccgggcactcgccgaccatttcagagactacgctgaactctgtttccggcacttcggaggacaggtgaaatactggattactatcgacaatccatacgtcgtggcttggcacggatatgccactggacgactggctcccggaatcaggggcagcccaagactgggatacctggtggctcacaacctcctgcttgcccacgcaaaggtgtggcacctgtacaacacttcatttaggcctacccaagggggacaggtgtcgatcgctctctcaagtcactggattaaccctaggagaatgactgaccattcaatcaaggaatgccagaaatccctggactttgttctgggctggttcgcgaaaccggtctttattgacggagactatccagagtccatgaagaacaacctgtcgagcatcctgccggacttcaccgaaagtgagaagaaattcatcaagggaaccgccgacttctttgcgctgtgcttcggaccaacgctctcattccagctgctggatccacatatgaagttccggcagctggaatccccgaacttgagacagctcctgagctggatcgatctggagttcaaccacccgcagattttcatcgtcgagaatggatggttcgtgtcgggaactaccaagagagatgatgccaaatacatgtactatcttaagaagtttatcatggagactcttaaggccattaaacttgacggcgtggacgtgatcggctacaccgcctggtcgctgatggacggattcgagtggcacagaggatactccatccgccgcggactgttctacgtggatttcctgtcacaggataagatgctgctgcctaagagctcggcactgttctaccagaaacttattgaaaagaatgggtttccgccactgccagagaaccaaccgcttgagggtacttttccttgtgactttgcctggggtgtggtcgacaactacatccaggtggatactaccctgtcacagtttaccgacctgaatgtctacctgtgggacgtgcatcacagcaagaggctcattaaagtggacggagtcgtgactaagaaacgcaagtcctactgcgttgacttcgctgccatccagcctcagatcgcccttttgcaggaaatgcacgtgacccatttcagattctccctggactgggccctcatcctcccactgggaaatcaatcccaggtgaaccacactatcctccaatactaccgctgcatggcttccgaactggtgcgcgtcaacattaccccggttgtcgcgctgtggcagccaatggccccaaaccagggcctgccgcgattgctggccagacagggggcctgggagaacccatacacggctctcgcgtttgcggaatacgcccggctgtgcttccaagaactgggacatcatgtcaagctgtggatcaccatgaatgaaccttacactcgcaacatgacttactcggcggggcacaatctcttgaaggcccatgccctggcttggcatgtctacaacgaaaagttccgccacgcacagaatggaaagatttccattgcactgcaagcggactggatcgaaccggcttgccctttttcacagaaggacaaggaggtggcggaacgcgtgctcgagttcgatatcggatggctggcagaaccgatctttggctccggcgattacccatgggtgatgcgggattggctgaatcagcggaataacttcctgctgccgtatttcaccgaggatgaaaagaagctgatccaaggtactttcgattttctggcgctcagccattacaccaccatcctggtggattccgagaaggaagatccgatcaagtacaatgattacctcgaagttcaagagatgactgacatcacttggctcaattccccctcccaagtggcagtggttccgtggggtctgcgcaaagtgctcaattggctgaagttcaaatacggggacttgccgatgtacatcatctccaacggcatcgatgatggactgcacgctgaagatgaccagctgcgcgtctattacatgcaaaactacatcaacgaagccctcaaggctcacatcctggacggaatcaatctctgcggatacttcgcttactcgttcaacgatcggactgcaccccggttcggcctctaccgctacgccgctgaccagttcgaaccgaaggcaagcatgaagcactaccgcaagataatcgactcgaacggattccctggaccggaaaccctcgaacgcttctgccctgaagagtttactgtgtgcactgagtgctccttttttcacaccaggaagtcgctccttgctttcatcgcattcttgtttttcgcatccatcatcagcctctcccttatcttttactacagcaaaaagggacggcggagctacaaa

SEQ ID NO: 15033 - DNA, 3036 bp, Artificial Sequence; identical to SEQ ID NO: 15032
  Description of Artificial Sequence: Synthetic coding sequence

SEQ ID NO: 15034 - DNA, 3036 bp, Artificial Sequence
  Description of Artificial Sequence: Synthetic coding sequence
atgcctgctagtgcaccgccacggcggccacggcccccccctccctccttatccttgctgctcgtcttgctcggattaggaggccggcgactgcgcgcagagcccggggatggcgctcaaacatgggctcgcttcagccggcccccagccccagaagccgcaggactgttccagggaaccttccccgacggcttcctctgggcagtgggaagcgcggcctaccaaaccgagggcggctggcagcagcacggcaagggtgcttctatttgggatacattcacacaccacccgctggcacccccaggtgatagtaggaatgcttctttgcctctgggcgccccatcacctctgcagcccgccacaggagacgtcgctagtgacagctataataacgtgttccgcgatacagaggcgctccgagaattgggagtgacccactatcgtttctcaatcagctgggcccgagtcctgccgaacgggagcgcaggggtgcccaatcgggaaggcctgcgttactatcgaaggctgctggagcgtttgcgggagctgggcgtccaacccgtcgtgacgttgtatcactgggacctgccacagcggctgcaggacgcctacggtggatgggcaaaccgtgctctggcggaccatttccgagattatgccgaactgtgttttcgccattttggcggacaggtcaagtattggatcactattgataatccctacgtcgtcgcttggcatggctacgccactggtcgtctagctcccggaatcaggggctccccccgcctggggtacctcgttgcccacaacctgctcctggcccacgcgaaagtctggcacttgtataatacttcctttcggccaacccagggcggacaggtctctatcgccctgagcagtcactggattaatccccgccggatgacagatcatagcattaaggaatgtcagaagagcctcgacttcgtattgggatggttcgccaagcccgtttttatagacggagactatccagagtctatgaaaaacaatctgtcctccatcctgccagatttcaccgagtctgagaaaaaattcattaagggaactgccgatttcttcgctttgtgtttcggtcctacattgtcctttcagctcctcgatcctcatatgaaatttagacagctggaaagtcccaatctccgtcagttgctttcatggattgatcttgaatttaaccacccacaaattttcatcgtggaaaatggctggttcgtcagcggcacgaccaaacgggatgatgctaagtacatgtattatcttaagaagttcattatggagacgttaaaggccatcaagctggacggcgtggatgttataggctatactgcatggagtctgatggatgggttcgagtggcacaggggctactctatacgccgtgggctattctatgtggacttccttagccaggataagatgctcctgccaaagtcgtctgctctcttttaccagaaactgatagaaaaaaacgggtttcctccattacctgaaaaccaacccctcgaaggcacctttccctgcgattttgcctggggtgtcgttgataattatatccaggtggataccactctgagccaatttacagatctcaatgtatatctttgggatgtgcaccacagtaaacgcctgatcaaagtggacggcgtcgtaaccaagaagaggaagtcttactgcgtggattttgccgccattcaaccccaaatcgcacttctccaggagatgcatgtaacgcacttcaggttctccctggactgggcgttaatcctcccgttggggaaccaatctcaggttaaccatactattcttcagtactatcgctgcatggccagtgagctagtgcgagtgaacattacacctgtggtggcactctggcagccgatggcaccgaaccaaggtctacctcgcctcctggctaggcaaggcgcgtgggaaaatccttacactgctctggctttcgccgagtatgccaggctttgttttcaagaactggggcaccacgtaaaactgtggatcacaatgaatgaaccctacactcggaatatgacctactccgcaggccacaacctactcaaagcgcatgcgctcgcctggcatgtttataatgagaaattccgtcacgcacagaacggcaaaatatccatcgcactccaggcggattggatcgagccagcctgcccgttcagtcagaaggacaaagaggtggcggagagagtcctggagtttgatatcgggtggctggcagaacccatctttggcagcggagactacccatgggtgatgagagactggctcaatcagaggaacaacttcctccttccctatttcaccgaagacgaaaagaaactgatacaaggtacatttgacttcttggccctgagccactacacaaccatcctggttgactctgaaaaagaggatcctatcaaatacaacgactacttggaggtacaggagatgacggatattacatggctcaactcgccctcacaggtggcagtggtgccttggggattgaggaaagtgttgaattggttaaaattcaaatacggggacttgcctatgtacataatttccaatggcattgacgatggactccatgccgaagacgaccagctcagagtgtattacatgcagaactacatcaacgaggcgctgaaagcacatattttggatgggataaatttgtgtgggtattttgcatattcctttaacgaccggacagcaccacgattcggattgtatcgctacgccgctgatcagttcgagcctaaggcttctatgaaacactacaggaaaattatagactctaatggtttcccaggcccagagacactggagcgtttctgtcctgaggagttcaccgtctgcacggaatgcagtttcttccacacgaggaagtcactcctggcgttcatagcttttctttttttcgcttctatcatctcactttccctaatcttttactacagtaagaaaggacggcgctcctataag

SEQ ID NO: 15035 - DNA, 3036 bp, Artificial Sequence; identical to SEQ ID NO: 15034
  Description of Artificial Sequence: Synthetic coding sequence

SEQ ID NO: 15036 - DNA, 3036 bp, Artificial Sequence
  Description of Artificial Sequence: Synthetic coding sequence
atgcctgcatcggcaccacctcgcagacctcggccgcctcctccctccctgagccttctccttgtgttgctcgggctgggtggccgtaggcttcgcgcggaaccaggagacggggcacaaacctgggcaagattttcgaggcccccggctccagaagccgccggactgttccagggtacttttcccgatggattcttgtgggcagtgggtagcgccgcataccaaaccgagggtggatggcagcaacatggcaagggagcaagcatttgggatacgtttacccatcaccccctcgcacctcctggcgactcgagaaacgcgtcgctcccattgggggccccttcaccactccaaccggccactggagatgtcgcctcagatagctacaataatgtgtttcgggataccgaagcactgagggagctgggagtgactcattaccgctttagcatttcatgggcaagagtgctcccgaatggctcggcaggagtgcccaacagagaaggtctgagatactaccggcgcctcctggaacgactccgcgagcttggggtccagcctgttgtgaccctttaccattgggacctgcctcagaggttgcaggacgcatacggaggatgggcgaaccgggcgctggcagatcatttccgggattatgccgagctttgcttcaggcatttcggagggcaggtcaagtactggattactatagataacccatacgtggtggcatggcatggatacgcaaccggaaggctcgcacctggaattagaggatcgcctcggcttggttaccttgtggcacacaacctgctgctggcccatgcaaaggtttggcacctgtacaatacctcgttccggcctactcaaggtggacaagtctcgattgcactgtccagccattggatcaacccaaggagaatgaccgaccactccattaaggaatgtcaaaagagcctcgactttgtgcttggctggttcgcaaaaccagtgttcatcgacggggactacccagaaagcatgaagaacaacctttcatccattcttccggattttactgaatcagaaaagaaattcatcaagggtactgcggacttctttgcactctgctttggcccaaccctgtcttttcaacttctcgacccacacatgaagtttagacaactcgagtcgcctaacctgagacagctgctgtcctggattgatcttgagttcaatcatccgcagatattcatcgttgaaaatggctggtttgtgtcaggcactactaagagagacgatgcgaagtatatgtattacttgaagaagtttatcatggaaacgcttaaagcaattaagctggacggcgtcgatgtgatcggttacactgcatggagcttgatggacggttttgaatggcaccggggctactccattcgtcgcggtctgttctacgtggattttctgagccaggacaaaatgctgcttcctaaatcatcggctctcttttaccaaaaacttatcgaaaagaatgggtttccgccattgccagagaatcagcctctggagggcacctttccttgcgacttcgcatggggggtggtcgacaattacatacaagtggataccaccctttcccaatttaccgatcttaacgtgtatctgtgggatgttcatcattcaaaacgtctcattaaagttgatggagttgtgactaagaaaagaaagagctactgtgtggactttgcagctattcaaccacaaattgctctcttgcaagaaatgcacgtgacgcatttccgcttctccctggattgggcactgattctgccgctgggaaatcagtcccaggtgaaccacactatcctgcagtactaccgctgcatggcatcggaactggtgcgcgtgaacattacgcctgttgtcgcactctggcaaccgatggctccaaaccagggtttgccccgacttcttgcaagacagggtgcttgggaaaacccatacacggcactcgcatttgcagaatacgcgagactgtgctttcaagagctggggcaccatgtcaagctgtggatcaccatgaacgaaccctacactcgcaacatgacctactccgccggacataaccttctgaaggcacacgcccttgcatggcatgtgtacaacgaaaagtttaggcacgcccaaaacggaaagatttccattgcacttcaagctgactggattgaacctgcatgtcctttttcacagaaggataaagaggtcgcggagcgcgtgctggagtttgatattggctggcttgcagaacctatctttggatcgggagattacccgtgggttatgcgggattggcttaatcaaaggaacaactttctccttccttactttactgaagatgagaagaaacttatacaaggcacctttgattttctcgccctctcccattataccaccatccttgtcgattcggaaaaggaggaccctataaagtacaatgattatctggaggtgcaggagatgacggatataacttggttgaactctccatcccaggtggccgtggtgccttgggggcttcggaaagtgctgaactggctcaagtttaagtatggtgacctgccgatgtacataatcagcaatggaatcgatgatggacttcatgccgaggacgaccaactgagggtgtactacatgcagaattacatcaacgaagcgcttaaggcccacatccttgatggaattaacctgtgtggctacttcgcctattcctttaatgatagaactgcaccccgattcggtttgtacagatacgcagcggatcaatttgaacccaaggcgtcgatgaaacattaccggaagatcatcgattctaacgggttcccggggcccgaaactttggaacgcttttgtccggaagaattcaccgtgtgtaccgaatgttcttttttccatactagaaagagcctgctcgcgttcatcgcctttctctttttcgcatccatcatttctctttcgcttatcttctactacagcaagaagggacgacggtcatacaaa

SEQ ID NO: 15037 - DNA, 3036 bp, Artificial Sequence; identical to SEQ ID NO: 15036
  Description of Artificial Sequence: Synthetic coding sequence

SEQ ID NO: 15038 - DNA, 3036 bp, Artificial Sequence
  Description of Artificial Sequence: Synthetic coding sequence
atgcccgcctccgccccccccagacgcccccgtccacctccccccagtctttcacttctgctggtactcttgggactcggaggtcgccgtctcagggctgagccaggcgacggcgcacaaacctgggcacgtttttcaagacctcctgccccagaagctgctggtctgtttcagggtaccttccccgatggtttcctctgggctgtgggatccgcagcctatcaaactgagggtggttggcagcagcatggcaaaggagcttctatctgggacactttcactcatcatcctttggcaccacccggcgactcaaggaatgcttctctgcctttgggagccccctctccactccagcccgcaacaggagacgtagcatcagactcatacaacaatgtctttagggatactgaagcccttcgcgagctgggagttacacattatcgtttcagcatcagttgggctcgcgtgctgccaaacggttccgcaggtgtccccaaccgtgaaggtctgcgctactaccgcaggctgctggagaggctgagagagcttggagtgcagcccgtcgtgacactctaccactgggatctgccccaacgtctgcaggacgcttatggaggatgggccaacagggccctggccgatcacttcagggactacgcagagctttgctttcgccatttcggcggacaggtgaagtactggatcaccattgataacccctacgtggtcgcctggcatggatacgccaccggtcgcctggccccaggcattaggggctcacctaggcttggatatcttgtggcccacaaccttcttctggctcacgctaaagtgtggcacctttacaatacctcctttcgcccaactcagggcggacaagtgtctattgccctcagttcccattggattaaccccagacgcatgactgatcattctatcaaagagtgccaaaaatccttggattttgttctcggatggtttgccaagcctgtgtttatcgacggtgattatccagaatctatgaaaaataatttgtctagcatcctgcccgacttcactgagtctgaaaaaaaattcatcaaaggaaccgccgatttctttgctctgtgcttcggacccacactgagcttccagctgctggacccccatatgaagttcagacagcttgaatcccccaatctccgtcaactgttgagttggattgacctggaattcaatcaccctcaaatctttatcgtggaaaacggctggttcgtgagcggaaccacaaagcgcgacgatgctaagtacatgtattacttgaagaagttcataatggagactctcaaagctatcaaactggacggtgtggatgtgattggctataccgcctggtctcttatggatggcttcgaatggcatcgtggatactcaattcgccgcggcttgttctatgttgacttcctgagtcaggataagatgcttcttcctaagtcctccgcacttttctatcagaaactcatcgaaaagaacggcttccctccattgccagagaaccagccactggaaggaactttcccctgcgacttcgcttggggcgtggttgacaactatatccaggtcgacaccactctgagccagttcactgatctgaacgtttacctgtgggatgtgcatcacagcaaaaggctgataaaggttgacggcgtcgtcacaaagaagagaaaatcctactgcgttgattttgctgccatccagccacagattgccttgttgcaggaaatgcacgtgacacacttcagattcagtctcgactgggcactgatcctgcctctgggaaaccagtcacaggtgaatcacacaatactgcagtactacaggtgtatggctagtgaactcgtccgtgtcaatataaccccagtcgtggccctgtggcagcctatggctccaaatcagggtctgcctcgcctgcttgcaaggcagggcgcctgggagaatccttatacagccttggcattcgccgagtatgctcgcctttgtttccaagagctgggccaccatgttaaactgtggatcacaatgaatgagccctacactcgcaacatgacctactctgccggacacaacctcctcaaggctcatgccctggcttggcatgtttataacgagaagttcaggcacgctcagaacggcaagatctccatagctctgcaagccgactggattgagcctgcctgcccattctctcagaaagataaagaggtcgcagagagagtgctcgaatttgatatcggttggctggctgaacctattttcggaagtggcgactacccctgggttatgcgcgattggctgaaccagagaaataacttcctgctgccctacttcacagaagacgagaaaaaacttattcagggcaccttcgattttctggctctgtctcactacaccaccatcttggtggactctgaaaaggaggacccaattaagtataatgactatctggaggtgcaggagatgactgacatcacctggttgaactcaccctcccaagttgccgtagtgccctggggcctgaggaaagtcctgaactggcttaagtttaagtacggagacctgccaatgtatatcataagtaatggcatcgatgacggcctccacgctgaagacgatcagcttagggtttactatatgcagaactacatcaatgaagctctcaaggcccacatcctggatggtattaacctgtgtggatattttgcttactcattcaacgatcgtacagctcctagattcggcctgtaccgctacgctgcagaccagttcgagcctaaggcttctatgaaacattataggaagatcattgacagtaacggtttccctggtcccgaaactctggagagattttgtcctgaggaattcactgtatgcactgagtgctccttttttcacaccaggaagtccctcctggctttcatcgccttcctgttctttgcttctatcatcagcttgtcccttattttttactactctaagaaaggccgcaggtcctacaag

SEQ ID NO: 15039 - DNA, 3036 bp, Artificial Sequence; identical to SEQ ID NO: 15038
  Description of Artificial Sequence: Synthetic coding sequence

SEQ ID NO: 15040 - DNA, 3036 bp, Artificial Sequence
  Description of Artificial Sequence: Synthetic coding sequence
atgccagcttcagccccacccagaaggccgagaccacctccccctagtttgagccttctgcttgtgctcctgggcctgggaggtcgacggctccgggcagagccaggtgacggcgcccaaacatgggcaagattctccagacctccagcaccagaagccgccggcctgtttcagggcacatttccagacgggttcttatgggcagtgggctctgctgcataccaaactgagggagggtggcaacagcatgggaaaggtgctagtatttgggatacatttactcatcaccctctggcgccacccggggattccaggaatgcctccctgcctctgggggctccatcacccctgcagcccgcaactggcgatgtagcaagcgactcatataataacgtgtttagagacaccgaggctctgagagagctgggagtcactcactacagattttctattagctgggcaagggtgctgcccaatggcagtgcaggcgtcccaaaccgggagggcctgagatattacagaagactccttgagaggcttcgggagttgggcgtacaaccagtagtgaccctttaccattgggacctgccacagagattacaggatgcgtacggcgggtgggctaatcgcgccttagctgaccatttcagagattacgccgagctgtgcttcaggcacttcggtgggcaggtaaagtactggatcaccatagataacccatacgtcgtggcatggcacggatatgcaaccggtcgcctggcccctgggatcagaggctcaccaagactcggctatctggtggcccataatttgctgttggcccatgcgaaggtttggcacctatacaatacttctttccgaccaactcaggggggccaggtgtccattgcactgtctagccattggataaacccccgtaggatgaccgatcacagtatcaaagagtgtcagaaatccttggactttgtgttgggatggttcgcgaagccagtgttcattgatggtgactatcctgagtccatgaagaataatctgtcctctatcctgccagactttactgagtctgagaaaaagttcataaagggtaccgccgattttttcgccctctgctttgggcctacactaagtttccagctgttagacccccatatgaagttcaggcaactcgaatccccaaacctgcggcagctgctgtcatggatagatctggaattcaaccatccacagatttttatcgtggaaaacgggtggtttgtgtctggaacaaccaaaagagacgacgccaaatatatgtattacctgaagaaatttatcatggagaccctcaaggccataaaacttgacggagtcgacgtgattgggtacaccgcgtggtcgttgatggacggttttgaatggcataggggttactcgattaggcgcggcctgttctacgtcgatttcctgtcacaggacaagatgctcctcccgaagtcgtccgccctgttttaccagaagttaatcgagaaaaatggatttccacctcttcccgagaaccaaccactggagggcactttcccttgtgacttcgcctggggggtggtggataattacatacaggtcgacaccacactgtcacagttcacggaccttaatgtgtatctgtgggacgtacaccattctaagcgtctgattaaggtggatggtgtcgtcacaaagaagcgcaaaagctactgcgtcgatttcgctgctattcagcctcaaatcgctctgttacaggaaatgcacgttacccacttccggttctctctggattgggcgctgatacttccattgggaaaccaatcacaggtgaatcataccattctgcagtattatcggtgcatggcatccgagctggtgcgagtgaacattacacctgtcgtagctctgtggcagcctatggccccaaatcaagggttgccccgccttttagcccggcaaggggcgtgggagaatccatacacggcactcgctttcgcagagtatgcacggttgtgtttccaggaactcggacatcatgtgaagttatggatcacaatgaacgaaccgtatacccgaaatatgacctacagcgcgggtcataacctgctcaaagcgcacgccctcgcttggcatgtgtacaatgagaaattcagacacgcacagaacggaaagatttcaattgcactgcaggctgactggatagaaccagcttgtccgttttcccagaaagataaggaagtcgccgaacgtgtgctcgagtttgatataggctggttagccgaacccatcttcgggtccggagactatccatgggtaatgagagattggctgaaccagcggaataatttcctcttgccttactttacagaagatgagaagaagctaattcagggcacctttgatttcctagcactatcgcattacacaaccatcctggttgacagcgagaaggaggatccaatcaaatataacgactatttagaggtacaggaaatgacagatatcacatggttaaactcaccttctcaggtggcagtagtgccttggggactcaggaaggttctgaattggctgaagtttaagtatggcgatctgccaatgtatatcatctccaatgggatcgatgatggcctccacgccgaggacgaccaattgagggtgtattacatgcagaattatatcaacgaggctctgaaggctcacatcctcgatgggattaatctttgcggctattttgcatactcctttaatgaccgcaccgcaccccgtttcggcctgtaccgttatgcggccgaccagttcgagcccaaagcaagcatgaagcattaccgaaagatcatcgactccaatggatttccggggcctgagaccctggaacgcttctgtcccgaagaatttacggtatgtactgaatgcagttttttccacactagaaagtccctcctcgccttcattgcctttctcttctttgcctcaatcatctcactgtctctcatcttctactatagtaagaaaggcaggagatcctataag

SEQ ID NO: 15041 - DNA, 3036 bp, Artificial Sequence; identical to SEQ ID NO: 15040
  Description of Artificial Sequence: Synthetic coding sequence

SEQ ID NO: 15042 - DNA, 3036 bp, Artificial Sequence
  Description of Artificial Sequence: Synthetic coding sequence
atgccggcctcggcacccccccggcggcctagacccccaccacccagtctgagcctcctgctcgtcctcctaggactgggaggccgcaggctgagggcagagcccggagacggcgctcaaacatgggcgcgtttcagcagacctcctgcccctgaagccgcaggtctgttccaggggacattccctgatggtttcctgtgggccgtgggatccgccgcttatcagaccgagggagggtggcagcagcacggcaagggcgctagcatttgggatacatttactcatcatcccctcgctccacctggtgactccagaaatgcatcactgcctctcggggcaccgtcccctctgcagccggccaccggcgatgtggcaagcgactcttacaataacgtttttcgggacacagaggcactgcgggagttaggagttactcattatcgtttctccatttcgtgggctcgcgtcctccccaacggttccgccggtgtgccaaaccgggaggggttaagatactatcgccgactgctcgagcgtctgcgcgaattgggtgtgcagcccgtagtgacactgtatcactgggacttgccacagaggttgcaggacgcgtacggtggatgggccaatcgcgcactggccgaccatttcagggattacgccgaactgtgtttccgccattttggtggtcaggtgaagtactggattactattgacaacccttacgtcgtagcctggcatggctatgctaccggacggttggcccctggcattcgcggttctccgaggctgggctatctggttgctcacaacttgctactcgcccacgcaaaagtgtggcacctttacaacacttcttttcgccccacgcagggcggacaggtatccattgccttgtcttcgcactggatcaatcctcggcgtatgaccgaccacagcattaaagaatgccagaagagcctagatttcgttctggggtggtttgcaaagcccgtgtttattgacggcgattaccctgaaagcatgaagaacaatttgtcaagtattttgccagattttactgagtccgagaagaagttcatcaaaggaaccgctgatttcttcgccttgtgttttgggccaaccctgtctttccaactgctggacccgcatatgaaattccggcagctggagtccccaaaccttcgccagcttttgagctggattgaccttgagttcaaccaccctcagatatttatagtggagaacggttggtttgtgtctgggacaaccaaaagggatgacgcaaagtatatgtactacctcaagaaattcatcatggaaaccttgaaggcaatcaagctcgacggtgtggatgtgatcgggtacactgcctggagtttgatggatgggtttgagtggcatcgtgggtatagcatcagacgcggactattttatgtggatttcctgtctcaagataagatgctgctgcccaagtcctccgccctgttttatcagaaacttatagagaaaaatgggttccctccgttgcctgagaatcagccacttgagggcacctttccgtgcgattttgcttggggggtcgtcgataactatatccaggttgataccaccctgtcgcagttcacagacctcaacgtgtacctgtgggatgtgcaccattccaagcggctgatcaaagtcgacggagtggtgaccaagaagcggaaaagctattgcgtggacttcgccgctatccagccacagatcgctttactccaggagatgcacgtgactcacttccggttcagtcttgactgggcactcatactacccttgggcaaccagtctcaagtcaaccataccatcctgcagtattatcgatgcatggcatctgagctggtgcgagtcaatatcactccagtggtcgcgttgtggcagccaatggctcctaaccagggccttcccaggctgctcgctcgacagggggcctgggaaaacccatatacagcactcgcctttgctgaatatgcacgtctctgcttccaggagttgggccatcatgtgaagctgtggattacaatgaatgagccctacaccagaaacatgacatattccgcaggccataatctgttaaaagcccatgccttagcctggcacgtgtacaacgaaaagttccggcacgctcagaatggaaagatatctatagccctccaggccgactggatcgagcctgcctgtccattttcccaaaaggacaaggaagtcgcggagagagttctggagtttgacatcggttggctggccgagcctatttttggatccggcgattacccgtgggtgatgagagactggctcaaccaacgcaacaattttcttctgccctacttcacggaggatgaaaaaaaactgatccagggtacctttgatttcctggcgctctctcattataccaccatcctggtggactccgagaaagaggaccctatcaagtataatgattacctggaagtgcaagagatgacagatataacctggctaaattcacccagccaggttgctgtcgtcccctggggactaaggaaggtgttgaactggctgaaattcaaatatggcgacctgcctatgtacatcatatctaatggaattgacgatggcttgcacgctgaagatgatcagctgagagtttactatatgcagaactacattaatgaagccctgaaagcacacattctggatgggattaacctgtgcggctatttcgcttatagctttaacgaccgcacagccccacgcttcggcctgtaccggtacgccgccgatcagtttgaacctaaagcaagtatgaaacattacaggaaaatcatagattccaacggctttcccggaccagagaccctggagagattctgccctgaagaatttaccgtgtgcacagagtgttcatttttccatacccggaagtccctgttggcttttattgcgtttttatttttcgcaagcattatttcgctttctcttatattctattactcgaaaaaagggagacggtcttacaag

SEQ ID NO: 15043 - DNA, 3036 bp, Artificial Sequence; identical to SEQ ID NO: 15042
  Description of Artificial Sequence: Synthetic coding sequence

SEQ ID NO: 15044 - DNA, 3036 bp, Artificial Sequence
  Description of Artificial Sequence: Synthetic coding sequence
atgccggcttcagcacctccgagaaggccgcgccctccgccgccatccctctcgctgcttctcgtcttgttgggtctgggaggaaggcgcctgcgcgcggagccgggagacggcgcccagacgtgggcacggttttccagacctcccgcccctgaagccgccggacttttccaagggactttcccggatggttttctgtgggctgtggggtcggcggcctaccaaactgaaggaggatggcagcaacacggaaagggcgcaagcatttgggatacgttcactcatcatccgctcgctccgccaggagacagccgtaacgcttccctcccactcggcgcgccaagcccactgcaaccggccaccggggatgtcgccagcgactcctacaacaacgtgttcagagacaccgaagcgctgcgagaactgggggtcacccactaccggtttagcatctcatgggcgcgggtgctgccgaacggaagcgcgggcgtcccgaaccgggaaggcctgaggtactacagacgcctcctggagcggctgcgagagttgggcgtgcagcctgttgttaccctgtatcactgggacttgccgcaacgcctccaagatgcatacgggggttgggccaatcgcgccctcgcagatcattttcgagactatgctgagctgtgcttccgccatttcggcggacaggtcaaatactggatcactatcgacaatccttatgtggtggcttggcatggatacgcaaccggccggctcgccccgggaatccggggctcgccaaggctcgggtacctggtggctcacaacctcctgcttgctcacgcgaaagtgtggcacctgtataacacctcgttccggccgactcagggtggacaggtgtccatcgcactgtcaagccattggatcaatccgaggcgcatgaccgatcactcaatcaaggagtgccaaaagtctctggacttcgtgttgggatggtttgccaagcctgtgttcatcgacggagactaccccgagtcgatgaagaacaacctctcgtcgatccttcctgatttcaccgaatcggagaaaaagttcatcaagggaactgccgacttcttcgcgctttgtttcggaccgaccctgtcctttcagctgttggacccacatatgaagtttcgccagctggaatcgcccaacctcagacagctgctgagctggatcgatctggagttcaatcacccgcagattttcatcgtggagaatggatggttcgtctccggcactactaagagagacgacgccaagtatatgtactatctcaagaagttcatcatggaaactcttaaggcaatcaaacttgacggagtggacgtgatcggatacactgcgtggtcactgatggatggcttcgagtggcaccggggctactccatccgccggggtctgttctacgtcgacttcctgtcccaggacaagatgctcttgcctaagtcatccgcgttgttttaccagaagctgatcgaaaagaatggattcccgccgttgcccgaaaatcaaccgctcgagggtacttttccgtgtgacttcgcttggggagtggtggacaactacattcaagtggacactaccctttcacaattcacggaccttaatgtgtacttgtgggatgttcaccattccaagcggctgatcaaagtggacggagttgtgacgaagaaaaggaaatcatactgcgtggatttcgctgccatacaaccacagatcgcgcttctgcaagaaatgcacgtgactcacttcagattctctctggactgggcgcttatactccctcttgggaaccagtcacaggtgaaccacactattctgcagtactatcggtgcatggccagcgaactggtccgcgtgaacatcacccctgtcgttgcactgtggcaacctatggccccaaaccagggccttccgaggctccttgcccgccagggagcatgggaaaatccgtacaccgccctcgccttcgccgaatacgcccggttgtgtttccaagaactgggccaccatgtgaagttgtggatcaccatgaatgagccatacactagaaacatgacttacagcgcggggcataatctgttgaaggcgcatgcgctggcctggcacgtgtacaacgagaagtttaggcatgcacaaaacggaaagatttcgatcgcgctccaggcggactggattgagccggcgtgccccttttcgcaaaaggacaaagaagttgccgaacgtgtcttggagttcgacattgggtggctggcagaacccatcttcggatccggtgactacccttgggtgatgagggattggctgaaccagcggaacaacttcctcctgccatacttcaccgaggacgagaaaaaactcatacagggaacgtttgattttctggccctctcccactacaccaccatcctggtggattccgagaaagaagatcccatcaaatacaatgattacctcgaagtgcaggagatgacggacatcacctggctgaactcgccctcccaagtggccgtggtcccgtggggtctgagaaaggtgcttaactggctcaagtttaagtacggtgatctgccgatgtacatcatctcgaacggcatcgatgacgggctgcacgccgaggatgatcagctgcgcgtctactacatgcagaattacatcaatgaggcgttgaaagcacacatcctggatgggataaatctgtgcggttacttcgcttactcttttaacgatcgcaccgcgccacgcttcggcctgtacagatacgccgctgaccagttcgaacctaaggcctcgatgaaacattacaggaagattatcgactcaaatggatttccgggaccagaaactctggagcgattttgcccggaagaattcaccgtgtgcaccgaatgctcattcttccacacccgcaaatcgctcctcgccttcatcgcattcctcttcttcgcctctatcatctctctttcactgatcttctactacagcaagaagggacggcggagctacaag

SEQ ID NO: 15045 - DNA, 3036 bp, Artificial Sequence; identical to SEQ ID NO: 15044
  Description of Artificial Sequence: Synthetic coding sequence

SEQ ID NO: 15046 - DNA, 3036 bp, Artificial Sequence
  Description of Artificial Sequence: Synthetic coding sequence
atgcctgccagcgcccccccaaggcgaccgcggccccctcctccttctctgagccttttgctggtgctgttggggctaggaggacgcagactgcgggcagagccaggggacggcgctcaaacatgggcccggtttagccgcccgcccgcgccagaagcagcagggttattccaaggcacctttcctgacggatttctctgggcagttggatctgccgcttatcagacagaaggcggatggcagcagcatggtaaaggagcctctatctgggacactttcacccaccacccactcgcacctccaggagatagcaggaatgcatccctgcctctgggtgcaccgtcgcctttacaacccgcaaccggcgatgtggcatccgatagctacaacaacgtgttccgcgataccgaagccctgcgggagttgggagtgacccattaccgcttttccatctcttgggcccgcgtgctgcctaacggcagcgctggggttcctaatcgtgaagggttgcgttattatcgaaggctcttggagcggctgagggaactcggggtccagcccgtggtgacactgtaccattgggatctgccccagaggttgcaagacgcctatggtggctgggccaatcgcgctctggctgaccatttcagggattacgctgaactgtgcttcaggcatttcggaggtcaggtgaagtactggataaccatcgacaacccgtacgtagtagcttggcacggctatgccacaggtaggcttgcacccggcattaggggcagcccgagactcggttacctcgtggcccacaacttgcttctggcccacgcaaaagtgtggcacctttacaatacttcattccgccccacacagggaggacaagttagcatcgccctgtccagtcactggataaacccacggcggatgaccgatcatagtatcaaagaatgccagaagtcactggacttcgtactgggctggttcgccaaaccagtttttatagatggggactaccctgaatccatgaaaaataacctcagcagcattctgcctgacttcaccgagtctgagaagaagttcatcaagggaaccgccgatttctttgccctttgctttggacccaccctgtctttccaacttttggatcctcatatgaagtttagacagctggagtcccctaacctgcgccagttgctctcatggatcgacctggagttcaaccacccccaaatctttattgtcgagaatggatggtttgtgagtgggactacaaagcgggacgacgctaagtacatgtactacctcaagaagtttataatggaaactctgaaagctatcaagctggatggagtcgacgtcatcggctataccgcatggagccttatggatggatttgaatggcaccgcggatacagcattaggaggggcttgttctacgttgactttcttagtcaggataagatgctcctgcctaaatcatccgcactgttttatcagaaattgatcgaaaaaaacggattcccacctctccctgagaatcagccactggaagggacctttccctgcgacttcgcttggggagtcgtggacaattatatccaggtcgatacaaccctgagccagttcactgacctaaatgtatacctgtgggatgttcatcacagcaagaggcttataaaggtggacggggtcgttaccaaaaaacgtaaaagttactgtgtggactttgcggccatccaacctcagatagctctcttgcaagagatgcacgtcacccactttcgcttcagcctggactgggccctcatcctgcccttgggcaaccagagccaagtcaaccatacaatactccagtactacaggtgcatggcatctgagctggtgagagtgaacatcacaccggttgttgctctgtggcaaccgatggcaccaaaccagggactgccaaggctgctggctcgacaaggcgcatgggagaatccctacactgcactggcattcgccgaatacgctcgcctgtgttttcaggaattgggacatcatgtgaaactgtggattacaatgaacgagccatatacccggaacatgacatactcggccggccacaacttgttaaaggcacacgctcttgcctggcacgtctataatgaaaaattcagacatgcacaaaacgggaagatctctatcgcattgcaagccgattggatcgagcctgcgtgtcctttctcccagaaagataaggaagtggcagagagggtgctggagttcgacatcggatggcttgcagaacccattttcgggagcggggactacccttgggtgatgagagactggctaaaccagcgcaacaactttctgcttccatactttacagaggatgagaaaaaactgattcaggggacctttgacttccttgctctctcccactatacaactatcttagtcgacagtgagaaggaggatcctatcaaatacaatgattacttggaggtgcaagagatgacggacataacttggctgaattcacccagccaggtggcagtggtcccgtggggccttaggaaggtactgaattggttgaaatttaaatatggagatctgcctatgtacattatttccaacggaatcgacgatggactgcacgccgaagatgatcaactcagagtctactatatgcagaactacattaacgaagcattaaaggcccacatcctggatggcatcaatttgtgcggctactttgcttacagctttaacgataggacagctccacgattcgggctctatagatacgctgccgaccaattcgaacctaaagcatcaatgaagcactatcgtaagatcattgatagcaatggatttccgggcccggagaccctggaaaggttctgtcccgaggaattcacagtgtgtactgagtgcagcttctttcacacccgcaaatcgctcctggcgtttatcgcttttctttttttcgccagtatcattagtcttagcctgattttctactactcaaaaaagggtagaagatcatataag

SEQ ID NO: 15047 - DNA, 3036 bp, Artificial Sequence; identical to SEQ ID NO: 15046
  Description of Artificial Sequence: Synthetic coding sequence

SEQ ID NO: 15048 - DNA, 3036 bp, Artificial Sequence
  Description of Artificial Sequence: Synthetic coding sequence
atgcctgcgagcgccccaccaagaagaccaagaccacctcccccaagtctcagcctgcttcttgttcttcttggcttgggaggcagaaggctgcgcgctgaacctggagacggagcccagacatgggctaggttttctagaccgcccgctccagaagccgcaggcctgttccagggaactttccccgacggattcctctgggcagtaggctccgccgcataccagacagaagggggatggcagcaacacggcaaaggcgcatcaatttgggacacgttcacgcaccatcctcttgcaccaccaggcgactcacggaatgctagtctacccctgggggccccaagcccgttgcaaccagctaccggagatgtcgcatctgacagttacaataacgtattccgtgacacagaggccctccgcgaactgggggtgacacattatcgttttagtatttcctgggctagggtgttgccaaacgggagcgcaggagtccctaaccgcgagggactgaggtactacagaagactgctcgagaggctcagagagctgggggtccagcctgtcgtcaccctgtaccactgggatctgccacaacgtctccaggacgcttacggcggctgggcaaatagagctctcgcagatcatttccgcgactacgccgaactttgcttcaggcacttcggaggccaagtaaaatactggatcacaattgacaacccctacgtcgtggcttggcacggttacgccacgggacgtcttgctcctggaatcagaggatctcctcggctgggatatttggtcgctcataacctgctgctagctcacgctaaagtctggcatttatacaatactagctttcgcccaacacaaggaggacaggttagcattgcgctctccagtcattggatcaatccgcgcaggatgaccgaccacagcatcaaagagtgccaaaaatctcttgactttgtgctcggctggttcgctaagcctgtttttatcgacggtgactatcctgagagtatgaaaaacaacctcagcagcatcttaccagattttaccgaatcagagaaaaaattcattaaaggtacagctgatttcttcgccctttgtttcggacctaccctctctttccagttgctagacccacacatgaagtttcgtcagctggaaagcccaaacctgaggcagctcctgtcatggattgacctggaatttaaccaccctcaaatttttatcgtcgaaaacggttggtttgtctcgggcactacaaaaagggacgacgctaagtacatgtactacctgaagaagttcatcatggagactttaaaggccataaaattagatggtgtggacgtgatcggctacactgcatggtcccttatggacggatttgaatggcataggggctattccatcaggagaggactcttttatgtagactttctgagtcaggataaaatgctgctccctaaaagcagtgctttgttttaccaaaaattaatcgagaaaaacggttttcccccacttccagaaaaccagcccttggaaggcactttcccttgtgatttcgcttggggagtggttgacaactacatccaggttgatactaccctctctcagttcacagacttgaatgtgtacctgtgggacgtgcaccactccaagaggctgatcaaggtggacggagtggtcacaaaaaagagaaaaagttactgcgtggacttcgcggctattcagccccagatcgctcttcttcaggaaatgcatgtcacccactttcgctttagcctggactgggccctcatcctgcctctggggaaccagtcgcaggttaaccacacaatcctccaatactaccgctgcatggccagcgaacttgtaagggtgaatataactccagtcgtcgcattatggcagcccatggcacccaaccaaggcctccctagactcctggcccgccagggagcctgggaaaatccgtacacggctctcgcgttcgcagagtacgcaagattgtgtttccaagagcttggccaccacgtgaagctttggatcaccatgaatgaaccatatacgcggaacatgacctatagcgctggacacaacctcctaaaggctcacgctctcgcatggcacgtgtacaacgagaagttcagacacgcccaaaacggcaaaatctcaatcgctctgcaggcagactggatagaacctgcctgcccattctcacagaaggataaagaggtggcagaacgagtattagagttcgatattggctggttggctgaaccaattttcggcagcggggactacccttgggtgatgagggactggctaaaccagaggaataacttcctgctgccatattttacagaggatgaaaaaaaactgatccagggtacctttgatttcctagctctctctcactataccacaatactcgtggatagcgaaaaggaggatccaatcaagtataatgattatctcgaagtgcaggaaatgaccgacattacatggcttaacagcccgagccaggttgccgtggttccttgggggcttagaaaggtgttgaattggctgaaattcaagtacggggacctgcctatgtacatcatcagtaacggaatcgatgacgggctccacgccgaagacgatcagctgcgcgtctattacatgcagaactatattaacgaggctttaaaggcacacattcttgatggcatcaacttgtgcggctattttgcatactcctttaacgatagaactgcacccagatttggattgtaccggtacgccgctgatcagtttgaacccaaggctagcatgaaacactacaggaaaatcatagactccaacggattccccgggccagagacccttgagaggttttgccccgaagaatttactgtgtgcacggagtgcagcttctttcacacccgtaagagtctgttggcatttatcgcattcttgttttttgcgagcattatcagcctgtcactgattttttattacagtaaaaaagggaggaggagttataag

SEQ ID NO: 15049 - DNA, 3036 bp, Artificial Sequence; identical to SEQ ID NO: 15048
  Description of Artificial Sequence: Synthetic coding sequence

SEQ ID NO: 15050 - DNA, 3036 bp, Artificial Sequence
  Description of Artificial Sequence: Synthetic coding sequence
atgcctgcctctgcacctccacgccgcccccggccacctcctccctctctaagcttattgctggtcctgctggggcttgggggaagacggctccgcgccgaaccaggtgatggcgctcagacttgggcaaggtttagcaggccccccgctcctgaggcagcgggtttgttccaaggtactttccctgacggattcctgtgggctgtgggatctgccgcataccagaccgagggaggttggcagcagcacggaaagggagccagcatctgggacaccttcacccaccaccccctggcaccgcccggtgactctcgtaacgcctcactcccgctgggtgccccaagtcccctccagccggcaaccggggatgtcgccagtgattcctataacaatgtcttccgcgacacagaggccctcagagaattaggagtcacccactacagattcagcatctcttgggcccgagtcttacccaatggttccgcaggcgtcccgaatagagagggactgagatattacaggcggctgcttgagcgcctccgtgagctgggcgttcagccagtggtgacgttgtaccactgggatctgccccagcgcctacaagacgcatatggcggatgggccaatcgagcccttgcagatcactttagagattatgctgaactttgtttcaggcacttcggcggacaagtcaaatactggataactattgacaatccttacgtcgtggcttggcacgggtacgcaacgggtcggctagcacccgggattcggggatcccccagactgggctatttagtggctcataacctgctgctggcccatgctaaggtttggcatctctataatacatccttcaggcctacgcaaggtggacaggtcagtatcgcgctgtcttctcactggattaaccccagaagaatgacggatcattctataaaggagtgtcagaagagccttgatttcgtgcttgggtggtttgcaaagccggttttcattgatggagattatcctgagtctatgaaaaacaatctttcatctattctgcccgactttaccgaaagtgaaaagaaattcataaagggaactgccgactttttcgcgctgtgcttcgggcctaccctctcgttccagctgctagacccacatatgaaatttcgacagctcgaaagccccaacctgcgccaactgctgagttggatcgatctggaattcaatcatccacagatcttcatcgtggaaaacgggtggttcgtgtcaggcactaccaagcgcgacgacgccaagtatatgtactatctcaagaagttcattatggagacacttaaagccatcaagcttgatggcgtggatgtcattggttataccgcatggtcacttatggacggtttcgagtggcatcggggctacagtattcggagaggactcttttatgtggatttcctgagccaggacaagatgctgctgcctaagtccagcgcgctgttctaccagaaactgattgagaagaacggttttccacccctgcccgagaatcagcccctggaagggacttttccgtgtgactttgcctggggtgtggttgataattatatccaggtggacaccaccctgagtcagtttacggatctgaacgtgtatttgtgggatgtgcatcattccaagcgtttgatcaaagtggatggcgtcgtcaccaagaagcgcaagagctattgtgtcgacttcgccgcaatccagccgcagattgcactcctgcaagagatgcacgtaactcacttcagatttagtctagattgggccctgatcctaccgcttggtaaccagtcccaagtcaatcataccattttgcagtactaccgttgcatggctagcgagctggttagggtcaacattacacccgtggtcgccctttggcagccaatggcaccaaatcaaggcctgcccagacttttagccagacaaggcgcatgggaaaacccctatactgctctggcctttgcagaatacgcacgcctttgcttccaggagcttggacaccatgtcaaactctggattaccatgaatgagccttatacgcggaacatgacctattccgcagggcacaatctacttaaggcacacgccctggcctggcacgtgtataatgaaaagttccgccatgcacagaacgggaagatctccattgcgctccaggctgattggatcgagcccgcctgcccgttcagccaaaaggataaagaggtggccgaacgcgtgcttgagttcgacatcgggtggctggcagaacctatcttcggttccggtgactatccatgggtaatgagagattggctcaatcagcggaataatttcttgttgccctacttcacagaagatgaaaagaaacttatacaggggacattcgactttctcgcattgtcccactataccaccatactggtggattctgagaaagaagatcctatcaaatataatgattatctggaggtccaggagatgacagacataacatggctgaactccccctcacaggtcgctgtcgttccttggggcctgaggaaggtgctcaattggttgaagttcaagtatggggatttacctatgtacataataagcaatggtatcgacgatgggttacacgctgaagatgatcagcttagggtatattacatgcagaattacatcaatgaggccctgaaggctcacattctggatggtattaatctttgtgggtatttcgcctacagctttaacgacagaacagccccacgcttcggcctgtacagatacgcagccgatcaattcgaacccaaagcttctatgaaacattacaggaaaataattgatagcaatggcttccccggacctgagacactggaaagattctgtcctgaagagttcactgtttgtaccgagtgtagtttttttcacactcggaagagcctgctggcattcatagcgtttctgttttttgcatcaattatctcactttcactgatcttttactattccaagaagggccgcagaagctacaag

SEQ ID NO: 15051 - DNA, 3036 bp, Artificial Sequence; identical to SEQ ID NO: 15050
  Description of Artificial Sequence: Synthetic coding sequence

SEQ ID NO: 15052 - DNA, 3036 bp, Artificial Sequence
  Description of Artificial Sequence: Synthetic coding sequence
atgccggcttctgcccccccaaggcggccaagaccccctccgcccagtctttcactgctgctggtgttgctcgggttggggggacgcagactgagagccgaacccggcgatggagctcagacatgggctcgcttttcccggccccccgcacctgaggccgcaggattgtttcagggaacctttcccgacggctttctgtgggcagtcggaagtgccgcctatcagaccgagggaggttggcagcaacacggcaaaggggccagtatatgggacacattcactcaccaccctctcgccccccctggggattccagaaacgcctcactcccactgggcgccccgagccctctccagcccgccacaggggacgtggcaagcgattcatacaataacgtgtttagagacaccgaagcgttgagggagttgggcgtgacccactacagattctctatctcctgggctagggtcctccctaatggaagtgcgggggtccccaacagggagggccttaggtactacaggcggctcttggagcggctgagagaactcggcgtgcagccggttgtcactctttaccactgggacctgccacagcggctccaggacgcttacggaggctgggctaatagggccttggctgaccattttcgggactacgctgagctgtgcttccggcatttcggcggccaggtgaagtactggataaccatagataatccgtatgtagtggcctggcacggatatgccaccggtaggctggctccagggatccggggatctccacgcctggggtacctggtggcacacaatctgctgctcgcacatgcaaaagtttggcacctgtataacacgtcttttagacccacacaggggggccaggtgtccatagcgctgagcagccactggatcaatcccaggcgcatgacagaccactccattaaggagtgccagaagagcctggacttcgtgttggggtggttcgccaaacctgttttcattgacggggactacccggagtccatgaagaataacctttccagcatcctcccagatttcacagagagcgaaaagaaatttatcaaaggcacggcagacttcttcgcactgtgcttcggccccaccctgtcctttcagctgctcgacccacatatgaaatttagacaactggaatcccccaatctgcggcagctcctcagctggatcgatcttgaatttaaccacccccagatctttatcgtcgaaaatggctggtttgtctccggaacaaccaagcgagatgacgcgaagtatatgtactatctgaagaagttcattatggaaactctgaaggccatcaagctcgacggagtggacgtaatcggatacacagcatggtctctgatggacggcttcgaatggcatcggggttactcaattagaaggggactgttctatgtcgattttctcagccaggacaagatgttgctcccaaagagcagcgcacttttttatcagaagctgatagagaaaaacgggttcccacccttgcctgaaaaccagcctctggagggaaccttcccctgcgacttcgcttggggagtcgtggataactatattcaggtagataccaccctcagccagtttacagatctcaatgtatacctgtgggatgtacaccacagcaagagactcattaaggtagacggggttgtgaccaaaaaacggaagagttattgcgtagatttcgctgctattcagcctcagattgctctgcttcaggagatgcacgtgacccacttcagattttccctggattgggctctgattcttcccttgggcaaccagagtcaagtcaatcacacgatccttcagtattatcgatgcatggcttccgaactggtgcgagtgaatataacccccgtggtcgcgttgtggcagccaatggcccctaatcagggcctgccccgcctcctcgcccggcagggggcctgggagaacccatataccgccctggctttcgctgagtacgcaaggctgtgcttccaggagctgggccaccacgttaaactgtggatcaccatgaacgagccgtacacacggaacatgacgtacagtgctggacacaacctcttgaaggcccacgctctggcatggcacgtttataacgagaagtttcggcacgctcaaaatggcaagatctccatagctcttcaagctgattggattgaaccagcctgccccttctctcagaaggataaggaagttgccgagcgcgtactcgaatttgacattgggtggctggctgaacctatcttcgggagcggagattacccctgggtgatgcgcgattggctgaatcagaggaataattttctcctgccatatttcaccgaggacgagaagaagctgatccagggcaccttcgacttcctggcactttctcattatactactattcttgtcgattcagagaaggaagaccccattaaatacaacgattacctggaggtgcaggagatgacagacatcacttggctgaattcaccaagccaggtggctgtggtcccctggggcctcagaaaagtattgaactggctgaagttcaagtatggtgatctccccatgtacatcatctccaatgggatcgacgacgggcttcatgccgaggatgatcagctgagggtctactatatgcagaactacatcaacgaggctttgaaggcgcacattctggacgggataaacttgtgcggttacttcgcatatagttttaatgatcgaaccgcaccacgctttggactctaccgctatgcagctgaccagtttgagccaaaggcctcaatgaagcactataggaagatcatcgacagcaacggcttccccggtcccgaaaccttggagcgcttttgccctgaagaatttacggtgtgcaccgagtgctccttttttcataccagaaaatcacttctggccttcattgcttttctgttctttgccagcatcattagcctgtcacttatattctactattccaagaagggacggaggtcctacaag

SEQ ID NO: 15053 - DNA, 3036 bp, Artificial Sequence; identical to SEQ ID NO: 15052
  Description of Artificial Sequence: Synthetic coding sequence

SEQ ID NO: 15054 - DNA, 3036 bp, Artificial Sequence
  Description of Artificial Sequence: Synthetic coding sequence
atgccggcttccgcccccccacgtcggcccagaccccctcccccatcattatctctgctgctggtgttactcgggctgggcgggcggcggctccgggctgagcccggagatggagcacagacatgggctcggttctcaaggccaccggcccccgaagccgccggtttgttccagggcaccttccctgatggttttctttgggccgtcggctctgcagcctatcaaacagaggggggatggcaacaacatggcaagggcgctagcatatgggatacctttacacaccatcccctggccccccccggggattcaagaaacgcgagtctgccccttggcgctccttccccactgcaacccgcaactggggacgtggcgtctgattcgtacaacaacgtgttccgcgacaccgaggctctgagggagctgggagtgacacactataggttctctatctcttgggctcgggttctccctaacggctccgctggggtgccgaaccgcgaaggcctccgctactataggcgcctacttgagcggctgcgggaattaggagtgcagccggttgtcacactataccactgggacctgcctcagagacttcaggatgcatacggcggttgggccaaccgagcgctggcagatcacttcagagactacgccgagctctgtttccgccacttcggaggccaggtgaaatactggatcactattgataatccctatgttgtggcgtggcacgggtacgcaaccgggcgtttagcacccggaatccgagggtctcctcgcttaggctaccttgtggcacacaatctcctgctggcccatgccaaggtctggcatttgtataacacgtcttttagacccacccagggcggacaggtgtccattgctttaagttcacactggatcaatcccagacgcatgacagaccattccatcaaagagtgtcagaaatctctagacttcgttctgggttggttcgcgaagcccgtgttcattgacggcgactatcctgagtccatgaagaacaacctttcaagtatcctacctgactttacagaatccgagaaaaaattcatcaaggggactgctgactttttcgccctgtgtttcggacccaccctctcctttcaacttctggatcctcatatgaagtttcgccagttggagagtccaaatctgcggcagctcctgtcctggattgatttggagttcaaccatcctcagatctttattgtggaaaacggctggttcgtgtcggggactacaaagagagatgatgcgaaatacatgtattacctgaagaaattcatcatggagacccttaaagctataaagctggacggggttgacgtaatcggctatacagcttggtctctgatggatggtttcgaatggcatcgcgggtacagcatcagacggggactcttctacgtggacttcctctcccaggacaaaatgctgctacctaaatcttccgcgttgttctaccagaaactgatagaaaagaacggttttccccccctgcctgaaaaccagccgttggaaggtacattcccatgcgacttcgcctggggcgtcgtcgataactacattcaagtagacacaactttaagccaattcaccgacttaaatgtatacctttgggacgtgcaccacagtaagagactgattaaagtagatggggtagtgactaagaaacgtaagagttactgtgtggactttgctgctattcagccacaaatcgccctcctccaggagatgcatgtcacccatttcagattttccttagattgggcgctgatcctccccctggggaatcagtcccaggtgaatcacacaatccttcagtactatcgatgtatggccagcgagctggtgcgcgtaaacatcacaccagtcgtggccctgtggcaacccatggccccaaaccagggcctgcctcggcttctggctcgccagggagcttgggaaaacccttataccgcgctcgcttttgcggagtatgccaggctctgctttcaggaactcggacatcacgtcaagttgtggataacaatgaatgaaccctatacgagaaatatgacgtatagcgccggccacaatctcctgaaagcccatgcgcttgcctggcacgtgtacaatgaaaagtttagacatgcccaaaatggcaagatatccatcgccctgcaggccgattggatcgaacctgcttgccctttcagccaaaaggataaggaggtggcagaacgggtcctggagttcgatatcgggtggcttgcagagccaatcttcggtagtggtgactacccctgggtgatgagggactggcttaaccaacgtaataatttcctgctcccctattttaccgaagatgaaaaaaaactgatacaaggcacgtttgactttctggcattgagtcactatactactatcctcgtcgattccgaaaaagaggatccaatcaagtataacgactatcttgaggtgcaggagatgaccgatattacctggttgaactccccatcccaggtggcagtggtgccatggggactacgcaaagtattgaactggttgaagttcaagtacggcgatctccccatgtacataatcagtaacggaattgacgatggcctgcatgcggaggacgatcagttgcgcgtgtactacatgcagaattacatcaatgaggcacttaaagcacacatcctagacggaattaatttgtgtggctatttcgcctatagtttcaacgatcgcactgcaccgagattcggcctgtaccgctacgctgccgatcagtttgagcccaaggccagcatgaaacattacaggaagattatcgattcaaacgggttccccggccccgaaaccctcgagcgtttctgtcctgaggaattcaccgtttgtacggaatgtagcttctttcacacacgcaagagcctgttggcgttcatagcctttctctttttcgcatctattatttcactgagcctgatcttctattatagcaaaaaggggaggaggtcctataaa

SEQ ID NO: 15055 - DNA, 3036 bp, Artificial Sequence; identical to SEQ ID NO: 15054
  Description of Artificial Sequence: Synthetic coding sequence

SEQ ID NO: 15056 - DNA, 3036 bp, Artificial Sequence
  Description of Artificial Sequence: Synthetic coding sequence
atgcctgccagtgccccgccccgacgaccccgcccgcccccaccatcacttagccttctgctggttctgctcggactgggcgggagacgcctgcgcgcggaaccaggagatggagcgcagacttgggcgcgcttttcgcggccgccggctcccgaagcagcgggactgttccagggaacgtttccggacggcttcttgtgggccgttggatcggccgcctaccaaactgaaggcggctggcaacagcatggaaagggcgcttcaatctgggacaccttcactcaccatccgcttgccccgccgggggactctcggaatgccagcctcccgctgggagcaccgtccccactgcagccagcaacgggggacgtggccagcgactcgtacaacaatgtgtttagggatacggaggcccttcgagaattgggagtcacccattaccgattctccatatcatgggctagagtgctccccaatgggtccgctggggtgcctaaccgcgaaggtctgcgttattaccggcggctgctcgaacgcctgagagaacttggagtccagccggtcgtgaccctctaccactgggatttgcctcagagactgcaagatgcgtacggtgggtgggctaatcgggccctggcagaccatttcagggactacgccgaactgtgctttagacattttggaggacaggtcaagtactggattacgatcgataatccatacgttgtcgcctggcacggctacgccactgggcgcttggcgccaggtatccgcggatcaccgcggttgggttaccttgtcgcgcacaacttgctcctcgctcacgctaaagtctggcacctctacaacacttcgttccgcccgacccagggagggcaagtgtcgatcgctctgtcctcacactggatcaacccaaggaggatgactgatcattcgataaaagagtgccagaaaagcctcgacttcgttttgggctggtttgccaaacctgtgttcattgacggagactaccctgagagcatgaaaaacaacctgtcgtccatcctgcctgattttactgagtcggagaagaagtttatcaagggcaccgcggacttctttgcattgtgcttcggacctaccctcagtttccagctgctggacccacacatgaaattccggcaactggaaagcccaaatctccggcagttgctgtcgtggattgacctggagttcaatcacccacagatattcatagtcgagaacgggtggttcgtgagcggaaccactaaacgggacgacgccaagtatatgtactatctcaagaagttcatcatggagactctgaaggccatcaagctggacggcgtcgatgtcattggctacaccgcttggagcctgatggatggcttcgaatggcatcggggatactccatccggcgggggttgttctacgtggacttcctgtcgcaggacaagatgttgctccctaagagctcggccctgttctaccaaaagctgatcgaaaagaacgggttcccgccgcttccggagaaccaacccttggaaggaactttcccgtgcgacttcgcgtggggagtcgtagataactacatccaagtggacaccaccctgtcccaattcactgatctcaatgtgtacctgtgggatgtccaccactccaagcggctgatcaaggtggatggggttgtcactaaaaagagaaagagctactgcgtggattttgccgccatccagccgcaaatcgccctgctccaagagatgcatgtcacgcatttccggttttccctggactgggcactcatcctgccgctcggaaatcagtcgcaggtgaaccacaccattcttcaatactaccgctgtatggcttcagaactggtgagggtgaacatcaccccggttgtcgctctgtggcaacccatggcgccgaaccagggcctgccgcgtttgcttgccaggcagggagcctgggagaatccgtacaccgcgctggcctttgcagaatacgcgcggctgtgtttccaggagctgggacaccatgtgaagctctggatcactatgaacgagccgtacacccggaatatgacgtactctgccgggcacaacctcctgaaagctcacgcactggcatggcacgtgtacaatgagaagtttaggcacgcgcagaacggtaagatctcaattgcactgcaggcagattggatcgaacccgcatgccccttctcacagaaggacaaagaagtcgccgaacgcgtgctcgagtttgacatcggctggctcgccgaaccaatcttcggaagcggtgattacccctgggtgatgagagactggctcaatcaaaggaacaactttctcctcccgtacttcaccgaggacgagaaaaagctcatccagggaacttttgacttcctggcgctttcacattatactacgatcttggtggacagcgagaaggaagatccaatcaagtacaacgactatctggaggtccaagaaatgaccgacataacctggctgaactccccatcgcaagtggcagtggtgccgtggggcctgcgcaaagtgctgaactggctcaagttcaaatacggagatctgccaatgtatatcatttccaatggcatcgatgacggtctgcacgcggaagatgaccagttgcgagtgtactacatgcagaattacatcaacgaggccctcaaggcacacatcctggatggtatcaacctgtgtggatactttgcctactcgtttaacgaccggactgccccgaggttcggtctttaccgctacgccgcggaccaattcgagccgaaggcttcaatgaagcattaccgcaagattattgattcaaatggcttccctggtccagaaactcttgaacggttctgtcctgaagaattcactgtctgcactgaatgttctttctttcacacgagaaagtccttgctggcgttcatcgcgttcctcttctttgctagcatcatctcgctttcgttgatcttctactacagcaaaaaaggcagaagatcctataag

SEQ ID NO: 15057 - DNA, 3036 bp, Artificial Sequence; identical to SEQ ID NO: 15056
  Description of Artificial Sequence: Synthetic coding sequence

SEQ ID NO: 15058 - DNA, 3036 bp, Artificial Sequence
  Description of Artificial Sequence: Synthetic coding sequence
atgcctgcctcggcacctcctagacggcctagaccgccacccccgtcactgtccctcctccttgtactcctcggcctgggaggtcgacgcctcagagcagaacctggagacggtgcccagacttgggctaggttttcacggccccctgcaccagaagctgcaggcttgtttcaaggtactttcccagatggttttctgtgggcagtggggtccgcagcataccaaaccgagggaggttggcaacaacacggtaagggtgcatcaatctgggatacttttacccaccatcctttggcacctcccggtgacagcagaaatgcatcgcttcctttgggggccccttccccacttcagcctgcgacgggcgatgtggcctcagacagctacaacaatgtattcagggataccgaggcgcttcgagaattgggagtcactcattacagattttcgatcagctgggcacgcgtcctgcccaacggatcagcaggagtgccaaaccgggaaggacttagatattacagacggctcttggagagactccgggaactgggagtccaaccagtggtcactctgtaccactgggaccttccccagcgcctgcaagacgcgtacggaggctgggccaaccgagccctcgcagaccatttccgtgactacgctgaactgtgctttcgacattttggcggccaagtgaagtactggattactatcgataatccctacgtggtggcatggcatgggtacgcaactggacggctggctccagggattcggggttcgcctaggctcggctacctcgtcgcccataaccttcttcttgcacatgctaaggtgtggcatttgtacaacaccagctttcgtccaacccaaggtggacaggtgtcaattgctctttccagccactggataaatccaagacggatgaccgatcactcgataaaggagtgtcaaaagtccttggattttgtcttgggctggtttgcaaagccagtgtttatagatggggattacccagagtccatgaagaacaatctgagttcgattctcccagatttcaccgagtcggaaaagaagtttatcaagggaactgcggatttcttcgctctctgtttcggacccaccctttcgtttcagctgctcgatccacacatgaaattcagacaattggagagtccaaacttgagacaactcttgtcctggattgacctggagttcaaccacccccagattttcattgtggaaaacggctggtttgtctccggtaccacgaagagggatgatgcaaagtatatgtattacttgaagaagttcattatggaaaccctcaaggccataaagctggatggtgtggatgtcataggctacactgcatggtcgctgatggacggattcgaatggcaccgcgggtacagcattcggagggggttgttttacgtggatttccttagccaggataagatgcttctgcctaagtcatccgcactgttttaccagaagctgattgagaaaaatggatttccacccctccctgaaaatcagccactggaaggcactttcccctgcgattttgcatggggggtggtggacaactacatccaggtcgacactaccctgtcgcaatttaccgaccttaacgtgtacctttgggatgttcatcatagcaaaagactcatcaaagtggatggagtggtgacgaaaaagagaaagtcgtactgcgtcgatttcgcggcaatccagccacagatcgcactgctgcaggagatgcatgtcactcatttccgcttttccctggactgggccctgatccttcctttgggaaatcaatcacaggttaaccatactattctccaatactacagatgtatggcgtccgaactcgtgcgcgtgaacataacgcccgtcgtggccctttggcaaccgatggcaccaaaccaaggccttccacgcttgctggcacgccagggcgcatgggagaacccttacaccgcacttgcatttgccgaatacgctcggctgtgctttcaggaattgggtcaccatgtcaagctgtggattactatgaatgaaccctatacccgtaatatgacctactctgcgggacacaatttgctcaaggcacacgcccttgcatggcatgtgtacaacgaaaagtttcgtcatgcacaaaacggcaagatctccatagcacttcaggcagattggattgagcctgcatgccctttttcacagaaggataaggaagtcgcagaaagagtcctggagttcgatattggatggctggccgaaccaattttcggtagcggggactacccatgggtgatgagagactggctgaatcaacgaaataacttcctgcttccttactttaccgaggacgagaagaagctgattcaaggcactttcgattttcttgcgctgtcccattacaccactattttggtggatagcgaaaaggaagatcccataaagtacaacgattaccttgaagtccaagaaatgacggatatcacctggttgaattcaccatcgcaagtggcggtggtgccatggggactcagaaaagtgctgaactggcttaagtttaagtacggggaccttcctatgtatatcatttcaaacggaatagacgatggtttgcatgcggaagatgatcagctgagggtctactacatgcaaaactacattaacgaggcgctcaaggcgcatattcttgatgggatcaacctttgtggctactttgcctactcgttcaacgaccgcaccgcccctagatttggactgtacaggtacgcggcagatcaattcgaaccaaaagcatccatgaagcactatcggaagattatcgactcaaacggttttcctgggcctgagactctggaacgtttttgtcctgaggaatttaccgtgtgtacggaatgctccttttttcacacccgcaaatccctgcttgcattcattgcattcctgttttttgcatccattatctccctcagcctcatcttctactactcgaagaagggacgccggtcatacaaa

SEQ ID NO: 15059 - DNA, 3036 bp, Artificial Sequence; identical to SEQ ID NO: 15058
  Description of Artificial Sequence: Synthetic coding sequence

SEQ ID NO: 15060 - DNA, 3036 bp, Artificial Sequence
  Description of Artificial Sequence: Synthetic coding sequence
atgcctgcttccgccccgccgagacgcccccgcccccctccgccatcactgtccctgcttttggtgctgctgggactcggcgggcggcgcctgcgcgcagaaccaggagacggtgctcagacctgggcccggttctcgcggccccccgctccagaagccgccggcttgttccagggtacttttcccgatggattcctgtgggctgtgggatctgccgcttaccagactgagggagggtggcaacagcacggcaaaggtgcgtccatctgggacactttcacccaccatccattggcgccgcctggcgattcacgcaacgccagcctcccgcttggcgccccgtccccattgcagccagccaccggcgacgtggcctcggactcctacaataacgtctttcgggataccgaagccctgagagaacttggcgtcacgcactaccggttctcgatctcctgggccagagtcctccctaacggatcggcgggagtgcccaaccgggagggcctccgctattaccgtcggcttctggaacgtctccgcgagctgggcgtgcaaccggtggtgacgctctaccactgggacttgccccagcggctgcaagatgcgtacggagggtgggccaaccgcgcgctggctgatcatttccgggactacgctgagctttgttttcgccattttggaggacaggtgaagtactggatcaccatcgataacccgtatgtggtggcctggcatggctacgctactgggagactggctccgggcattcgcggttcaccgcggctgggatacctcgtcgcgcataatctgcttctggcccacgccaaggtgtggcacctgtacaacacctccttccgcccaactcaggggggccaggtcagcatcgcgctctcatcgcactggatcaaccctagacggatgactgatcattcaatcaaggaatgccagaagagcctggacttcgtgctgggctggtttgctaagccggttttcatcgatggggactacccggagtcgatgaagaacaatctctcctcaattctcccggacttcaccgagtccgagaagaagtttatcaagggaacggcagacttcttcgcgctctgcttcgggccgaccctgtcatttcagctgctggacccgcacatgaaattccgccagctggaatccccgaatctgcgccaactgctgtcctggatcgatttggagttcaaccacccgcaaatctttatagtggagaacggatggttcgtgtcaggcacgaccaaacgagatgatgctaaatacatgtactatctcaagaagttcatcatggaaactctcaaagccatcaaactggatggagttgacgtgatcgggtacactgcgtggagcctgatggacggattcgaatggcacaggggatactcgatccgccgaggactcttctacgtcgatttcttgtcgcaggacaaaatgctcctcccaaagtccagcgcgctcttttatcaaaagctgatcgagaagaacggcttccccccactgcctgagaaccagccgctggaagggactttcccgtgcgatttcgcctggggagtggtcgacaactacatccaggtggatacgactctctcacaatttactgacctgaacgtctacctgtgggacgtccatcattccaaaaggctgatcaaagtcgacggcgtcgtcactaaaaagcggaagtcgtactgcgtggactttgccgctattcaacctcagatcgctctgcttcaggaaatgcacgtgacccatttccgattctcactggactgggcgctgattctcccgctcggcaaccaatctcaagtgaaccataccatcctgcagtactaccggtgcatggcctcggagctggtgagggtcaacattaccccagtggtcgccctgtggcaaccgatggcccctaaccaggggctgccacgcctccttgcgagacagggcgcctgggaaaacccatacactgccctggcctttgctgagtatgcacgcctgtgtttccaggagctggggcatcacgtgaagctgtggatcaccatgaacgagccttacactaggaacatgacttactcagccggacataacttgctgaaagcgcacgcactggcgtggcatgtgtacaacgagaaatttcggcatgcccaaaatggcaagatcagtatcgctctgcaggccgactggatcgaaccggcttgtcccttctcacaaaaagacaaggaggtggcagaaagagtgctggagttcgacatcggatggctggcggaacccatctttgggtccggagactacccttgggtcatgcgcgactggctgaaccaaaggaacaacttcctcctcccgtatttcactgaggacgagaagaagctcattcagggaactttcgacttcctcgcactgtcccactatactactatcttggtcgactccgaaaaggaagatccaatcaaatacaatgactacctggaagtgcaagaaatgaccgacatcacctggctcaattcgccttcgcaggtcgccgtggtgccgtggggcctgcggaaggtgctgaattggctgaagtttaagtacggagacttgccgatgtacatcatctcaaacggcattgatgacgggctccacgccgaggacgatcagctgcgcgtctactacatgcaaaactacatcaacgaggccctcaaggcccatatcctcgatggaatcaatctgtgcggttacttcgcctattcgtttaatgatcggactgcaccaagattcggactgtaccggtacgcagctgaccagtttgagcccaaagcaagcatgaagcattaccggaagattatagactcgaatggatttccggggcccgagactctggagcgcttctgtccggaggagttcactgtctgtaccgaatgctcgttcttccataccagaaagtcgctcctggccttcattgcttttcttttcttcgcctcaatcatcagcctgtcgttgatcttttactacagcaagaaggggcggcggtcctacaag

SEQ ID NO: 15061 - DNA, 3036 bp, Artificial Sequence; identical to SEQ ID NO: 15060
  Description of Artificial Sequence: Synthetic coding sequence

SEQ ID NO: 15062 - DNA, 3036 bp, Artificial Sequence
  Description of Artificial Sequence: Synthetic coding sequence
atgccagcatctgctcccccccgcaggcccagacctcctcctccttccttatctttgttactagtccttctaggtctgggagggagaaggctacgcgctgaacctggcgatggggcacagacctgggcacggttctcccgccccccagcacccgaggctgcagggctcttccagggtactttcccagatggctttctgtgggccgtaggttcagcagcctatcagaccgagggaggttggcagcagcacggaaagggcgccagcatctgggacaccttcactcatcaccccctggcacccccaggggactctaggaacgcaagccttcccctgggcgctccttcaccactgcagccggctaccggagacgtggcttcagacagctataataatgtctttagggatactgaagcactgcgcgagcttggcgtgactcactacagattcagtatctcctgggcacgcgtgctacctaatgggtccgctggcgtgccaaaccgtgaggggctacgatactacaggcggctgctggaacgcctgcgcgaactgggggtgcagcctgtggtgaccctgtatcattgggacctcccccagaggttgcaggacgcatacgggggatgggctaacagagccttggctgatcactttagagattatgccgaactgtgcttcagacactttggtggtcaggtcaagtactggataaccatagataatccatatgtggttgcatggcatggctacgcaactggaagactggcaccagggattaggggctccccccgactgggctacttagtggctcataatctgctgctggctcacgccaaagtttggcatctctataacacatcttttagacctactcagggcgggcaggtgtcaatcgcactgtcttcacattggatcaacccacggcggatgaccgaccacagcattaaagagtgtcagaagtctctggactttgtgttgggatggttcgccaaacctgtgttcatcgatggggattaccctgagagcatgaaaaacaatctcagttctatcctccccgactttacagagagtgagaagaagttcataaaaggaaccgccgactttttcgctttatgcttcgggccaaccctaagctttcagctgctggacccccacatgaaatttcggcagctggagtcccccaatctgcggcaactcctgtcttggatagacctcgagtttaaccacccacagatctttattgtggagaacgggtggtttgtctccggcactaccaaacgggacgatgcaaaatacatgtactatctgaagaaatttatcatggagaccttaaaggctattaagctggatggtgttgatgtgattggttacaccgcttggagcttaatggatggattcgaatggcacaggggctacagcattcggaggggtctgttctatgttgattttctcagccaggataagatgctcctccctaaatctagtgccctgttctaccagaaactgatagaaaagaatggcttcccacccctgccagagaatcagcccttagaaggaacttttccttgcgatttcgcttggggcgtggttgacaattacatccaagtagacaccactctgtctcagttcacagatttaaatgtttatctatgggacgtgcaccattctaagaggctgatcaaagtcgacggcgttgtcacaaaaaagagaaaaagttattgcgtcgacttcgccgcaatccagccacagattgccctgttacaggaaatgcatgtgacacacttccggttctctctagattgggcccttattctcccactgggaaaccaatcccaggtgaaccatacaattttacagtattaccggtgtatggccagcgagctggtccgcgtgaatatcactccagtggtggccctgtggcagccaatggctcccaaccagggccttcctcgcctgctagctaggcagggagcctgggaaaatccttacacagctctggcatttgccgagtatgcccgcctatgctttcaggaactagggcaccacgttaaactgtggattacaatgaatgagccctatacccggaacatgacatactccgctggacacaacctccttaaagctcacgcactcgcctggcatgtgtataatgaaaagttccgccatgctcagaacgggaagatttccatcgccttacaggccgactggattgagccagcctgtccatttagccagaaggataaggaggttgccgagcgggttcttgaattcgatataggatggctggcagagcccatatttgggagcggggactatccctgggtgatgagagattggctcaatcagaggaataatttcctgttaccatattttactgaagatgaaaagaagttgattcaggggacatttgatttcctcgcactcagtcactacacaacaattctggtggatagcgaaaaagaggaccctattaagtacaatgactacctggaggtgcaggagatgaccgatatcacttggctgaattccccaagtcaggtggctgttgtaccatggggactccggaaggtgctgaactggctgaagtttaaatatggcgacctgcctatgtacataatcagcaatggaattgatgatggcctgcatgccgaggacgaccagctgagagtttattatatgcagaactacattaatgaagcactcaaagcacacatcctcgacggcattaacctgtgtggatatttcgcctatagtttcaatgacagaactgccccccgatttggcctgtacaggtatgccgccgatcaattcgaacccaaagcttccatgaaacattatcgcaaaattattgacagcaatggattccccggccccgagaccttagagaggttctgcccagaggaattcaccgtgtgtactgaatgctctttttttcacaccaggaagtccctattggcattcatagccttcttgtttttcgcatccattatctctctaagcttgatcttctactatagtaaaaaaggccggagaagctataaa

SEQ ID NO: 15063 - DNA, 3036 bp, Artificial Sequence; identical to SEQ ID NO: 15062
  Description of Artificial Sequence: Synthetic coding sequence

SEQ ID NO: 15064 - DNA, 3036 bp, Artificial Sequence
  Description of Artificial Sequence: Synthetic coding sequence
atgccggcgtcggcacctccacgcaggccaagaccaccgcctccctccctctcacttctgctcgtgctgctgggactggggggtcggcgcctgagagcggagccgggcgatggagcacaaacttgggcacgcttctcccggccgccggctccggaagcggccggattgttccaagggaccttccctgatggattcttgtgggccgttggatccgccgcctaccaaactgaaggagggtggcaacagcatggtaagggcgcttccatctgggacacgttcacccaccatccgctggccccaccgggtgactccagaaacgcttctctgcccctgggggctccgagcccgcttcaaccggccaccggggacgtcgcatcggactcatacaataatgtgttccgggacaccgaggcactgagagaactgggtgtgacgcactaccggttctcgatctcgtgggcgcgcgtcctgcccaatgggtccgcgggagtgcctaatcgggaggggctcaggtactacaggcgcctgcttgagagactccgtgagctgggagtccagcctgtcgtgactctctaccactgggacctgccacaaagactccaggacgcttacggaggatgggccaaccgggccctggcggatcacttcagagactacgccgaactgtgctttcggcattttggagggcaagtcaagtactggataactatcgacaacccttacgtggttgcatggcacgggtacgcgaccggcagactggcccctggaatcagaggctcccctcgactcggatacctggtggcgcacaatcttctgctggcccacgctaaggtgtggcatttgtataacaccagcttccggcccactcagggaggacaggtgtctatcgcattgagctcacattggatcaacccgcggagaatgaccgatcactcgattaaggaatgccaaaaatcactggacttcgtcctcggctggtttgctaagcctgtctttatcgatggagactacccggagagcatgaagaacaacctctcatcgatcctccccgactttactgagtccgagaaaaagttcattaagggtactgccgacttttttgccctctgtttcggacctaccctctcatttcaactgctcgacccgcacatgaagttcaggcaacttgagtcgcccaacctgaggcaactcctgtcgtggatcgaccttgaattcaaccacccacaaatcttcatcgtcgaaaacggctggttcgtgtcagggaccactaaacgcgacgatgcgaagtatatgtattacctcaaaaagtttatcatggaaaccctcaaggcgattaagctggacggagtcgacgtgatcggatacaccgcctggtcacttatggatggctttgagtggcacagggggtactcgattagaaggggccttttctacgtcgactttttgtcccaggataagatgcttctcccaaagtcaagcgcactgttctatcagaagctcatcgaaaagaacggattcccgccgctgccggagaatcaaccgctggaaggaacttttccatgcgattttgcctggggagtggtcgacaactacatccaggtggacaccactctgtcgcagttcaccgacctgaacgtgtacttgtgggacgtgcatcactccaagagactcatcaaggtcgacggtgtcgtgactaagaagcggaagagctactgtgttgacttcgccgcaatccaaccacagatcgcactgttgcaggaaatgcacgtcacccacttccgttttagccttgactgggctcttatcctgccgttgggaaatcagtcgcaggtgaaccacacgatcttgcagtactaccgctgcatggcaagcgaactggttcgggtcaacatcacccctgtcgtggccctctggcaaccaatggccccgaaccagggactgccacggctcctcgcaagacaaggcgcttgggagaatccgtacaccgccctggccttcgcggagtacgctagattgtgttttcaggagttgggacaccacgtgaaactttggattacgatgaacgagccgtacactcggaacatgacttactcggcgggccacaacctcctgaaagcacacgcattggcatggcatgtgtacaacgaaaagttcagacatgctcagaacggcaagatctcgatcgcgctgcaggccgattggatcgaaccagcttgcccgttctctcagaaagataaagaagtggcggagagagtgctggagtttgatatcggctggctggccgaacccatcttcggctcgggggattatccatgggtgatgcgcgactggctgaatcaacgcaacaacttcctgctgccatatttcaccgaagatgagaaaaagctcattcaaggaactttcgactttctggctctttcgcattacactactatcctggtggatagcgaaaaagaagatccgatcaagtacaacgattacctggaagtgcaggagatgaccgatatcacctggctgaactccccctcccaggtggccgtcgttccgtggggactgcggaaggtccttaactggctgaaattcaagtacggagatctccccatgtacatcatctcaaacggaatcgatgacggactgcatgccgaggacgaccagctgagagtgtactatatgcagaattacatcaacgaggcgctgaaggcccacattctggacggcatcaatctctgtggttatttcgcttactcgtttaacgacaggaccgcacctagattcggcctgtaccgctacgcagcggaccaatttgagccgaaggcgagcatgaagcattaccggaagatcatcgattccaatggtttcccaggaccggaaacgctcgagagattttgcccggaagagttcacggtctgcaccgagtgctcatttttccatactcgcaaatccctgctcgcctttattgccttcctcttcttcgcatcgatcatcagcctgtccctcatcttttactactctaagaagggtcggagatcgtacaaa

SEQ ID NO: 15065 - DNA, 3036 bp, Artificial Sequence; identical to SEQ ID NO: 15064
  Description of Artificial Sequence: Synthetic coding sequence

SEQ ID NO: 15066 - DNA, 3036 bp, Artificial Sequence
  Description of Artificial Sequence: Synthetic coding sequence
atgccggctagtgcgcctcctcgtaggccaagacctcctcccccttccttgagtctccttctcgtcctgctggggttgggcggacgccggctcagggcagaaccaggcgacggcgcccaaacctgggcccgtttttcgagacccccagcacctgaagcggccgggcttttccaagggacattcccggacggcttcctgtgggctgtggggagcgctgcttatcagaccgaaggagggtggcagcagcacgggaagggcgcctcaatctgggacacatttacacatcacccgttggcccctcctggcgactctcgaaacgcctccctcccgctcggagctccctccccactgcaacccgcaaccggagatgttgcatctgacagctacaataacgtctttcgggacaccgaggcacttagagaattgggcgtgacacattacagattcagcataagttgggccagagttctcccaaatggctccgccggggtccccaatagggagggactgcggtattatcgcagattgttagagagactgagggagcttggcgtgcagccagtagtgactctgtatcactgggacctaccacagcggctacaggacgcctatgggggatgggcaaatcgagccttggccgaccactttagggattacgctgaactgtgttttcgacacttcggcgggcaagtgaaatactggattacaatagacaacccctacgtagtcgcctggcacggctacgcgactggacggctcgcgccaggcattcgtgggagtcctagactgggatacctcgtggcacacaatctactgctggcacacgccaaggtttggcatttgtacaatacatctttccggccaacacagggcggtcaggtgagcatcgccctgagttctcactggattaacccacgcaggatgacagatcattctattaaggaatgccagaagagcttagacttcgtgttgggctggtttgccaaaccggtgttcattgatggtgactacccggaaagcatgaagaacaatctttcttcaatactgccagatttcacagagtcagagaagaagttcatcaaagggacggcagatttttttgctctttgtttcggcccaacattgtcatttcaactattagacccccacatgaagttccgccagctagaatctcctaacctcagacaactgctgagttggattgacctggagttcaatcatcctcaaattttcatcgtggaaaacggatggttcgtttcaggcaccacgaaaagggacgacgcaaagtacatgtactatctgaaaaagttcatcatggaaaccttgaaagccatcaagctcgacggcgttgacgttattggatacacggcctggtctcttatggatggattcgaatggcatagggggtactctattagacgagggctcttctatgttgactttctaagtcaggataaaatgctcttgccgaagtcaagtgccctgttttaccagaaactgattgagaaaaacggcttccccccactgcccgagaatcagcccctggaaggcacatttccctgtgactttgcctggggggtggtggacaattacattcaggtggatactactctcagccagtttaccgatctgaatgtctatctatgggatgtgcaccatagtaaaaggctcatcaaggtcgacggggtcgtcactaagaagaggaaatcctactgcgtcgattttgcagccatccagccccagatagcactgctgcaggaaatgcacgtgacccactttagattttcgctcgattgggctcttatcttgcctctggggaaccagtcacaggtaaatcacacaatcctgcagtattaccgatgtatggcaagtgagttggtgagggtgaacatcaccccggttgttgccctttggcagcctatggcacctaaccagggcctgcctcgtctattagcccggcagggggcctgggagaacccatataccgccctcgctttcgccgagtacgctagactctgctttcaagagctgggacaccatgtcaagctatggataactatgaatgaaccctacactcgcaacatgacttatagcgccggccataaccttcttaaggcccacgcactggcttggcatgtgtataatgagaaattccgacacgctcaaaatggcaaaataagtatagccttgcaggctgattggatcgagcccgcatgtccgtttagccagaaggataaggaagtcgccgaaagagtgcttgaatttgatatcgggtggcttgctgagcccattttcggctccggcgactacccatgggtgatgcgggactggctaaaccagcgcaacaatttcctcctgccttacttcactgaggacgagaagaagctgatacagggaacgttcgacttcctcgctctgtctcattataccaccattctcgtcgactctgagaaagaggaccccatcaagtataacgattacttagaagttcaagaaatgaccgacattacatggctaaattctccaagccaggttgccgttgttccttggggtctgcgcaaggtcctgaactggttgaagttcaaatatggcgacctccccatgtacataattagcaatggcattgacgatggtttacatgcagaggatgaccagcttcgagtctactacatgcaaaactatatcaatgaagcgttaaaggcgcacattctggacggcataaacctgtgtggatacttcgcctattcattcaacgatcggaccgcaccaagatttgggctgtatcgatacgccgccgaccaattcgagcccaaggccagcatgaagcattatagaaagatcattgactccaacggttttccagggcccgaaactctcgaaagattctgccccgaggagtttacggtgtgcacggagtgtagtttctttcataccagaaagtccctcctggcatttatagccttcctgttctttgcctcaataattagtctgtccctgattttttactacagcaaaaaagggagacgctcatataag

SEQ ID NO: 15067 - DNA, 3036 bp, Artificial Sequence; identical to SEQ ID NO: 15066
  Description of Artificial Sequence: Synthetic coding sequence

SEQ ID NO: 15068 - DNA, 3036 bp, Artificial Sequence; identical to SEQ ID NO: 15022
  Description of Artificial Sequence: Synthetic coding sequence

SEQ ID NO: 15069 - DNA, 3036 bp, Artificial Sequence; identical to SEQ ID NO: 15022
  Description of Artificial Sequence: Synthetic coding sequence

SEQ ID NO: 15070 - DNA, 3036 bp, Artificial Sequence
  Description of Artificial Sequence: Synthetic coding sequence
atgccagcatccgcgcccccacgcagacctcgcccccctccaccatccctcagcctccttttggtgcttctgggcctgggtggacgacggctcagggctgagccaggggatggagcgcaaacctgggcacgattttcccgcccgcctgcgccagaagcagcaggactcttccaaggaacgtttccagacggctttctgtgggccgtgggaagcgcagcgtaccagactgaaggtggctggcaacaacatggtaagggagctagcatatgggatacgtttactcatcatccgttggcgcctcccggggactcgaggaacgcatcgctgcctctgggggcgccatcccctcttcaaccggcaactggtgatgtggcatccgattcgtacaataacgtctttagggataccgaagcattgcgtgaattgggagtcactcactacagattctccattagctgggcccgcgtcttgcctaacggctcagcgggtgtgccaaacagggaaggactgagatattaccggcgcctcttggaacggctccgtgagcttggggtccagccagtggtgaccctctaccactgggaccttcctcaacggctgcaagatgcatacgggggctgggctaacagagcactcgcggaccattttagagactatgcggagctgtgctttagacattttggaggacaggtgaagtactggattacgatcgataatccttacgtcgtggcatggcatggctacgcaaccggaaggcttgcccccggcatacgcggatccccaaggcttggttacctggttgcacataatctgctgctcgctcatgcaaaggtgtggcatttgtataacacctcctttcgccctactcagggaggacaagtgtccatagcacttagcagccactggattaatcccaggcgaatgacggatcattccattaaggaatgccaaaagagcttggacttcgtcctgggatggtttgccaaacctgttttcattgatggagattacccagaaagcatgaagaacaatctttcctctatcctgcctgacttcactgagtctgaaaagaagttcataaaaggtaccgccgacttctttgccctgtgtttcggaccgaccctctcctttcaacttctcgaccctcatatgaagtttagacagctggagtcgccaaaccttagacaactgctgtcatggatcgaccttgagttcaaccatccacaaatctttatagtcgaaaacggatggttcgtgtcaggtacgaccaagagagatgatgcaaagtatatgtattacctgaaaaagttcataatggagactttgaaggcgattaaactcgacggagttgacgtcatcggatacacggcctggagccttatggatggtttcgagtggcaccggggttacagcattcggagggggctgttctacgtggactttctctcccaggataagatgctgctgccaaagagctcggccctcttttaccagaagctgatcgaaaagaacggtttcccacccttgcctgaaaaccagcctctggaaggaacttttccttgcgactttgcatggggagtggtggacaactacattcaggtggacactaccctttcgcaattcactgatctgaatgtgtacctttgggacgtgcatcactcgaaacgcctcatcaaggtggacggtgtagtgactaaaaagagaaaatcgtactgcgtggatttcgcagccattcagcctcagatcgctcttttgcaggagatgcacgtgacccattttagattttccctggactgggctctgattcttcccctcggtaatcagagccaagtcaaccacactattcttcagtactatagatgcatggcatcagaactggtccgtgtcaacattacccctgtggtagcactttggcagcccatggccccaaatcaaggacttcccagacttctggcacgacagggtgcctgggaaaatccttacaccgctctggcatttgcggagtacgccaggctttgttttcaggagttgggacatcacgtgaaattgtggattactatgaatgagccttacacccgtaatatgacttacagtgcaggccataacttgcttaaagcacatgccctcgcatggcacgtctacaatgaaaagtttaggcacgcacaaaacgggaagatctccatcgcactccaagcagattggatcgagcccgcatgtccttttagccaaaaggataaggaagtggcagaacgggtactggaattcgatattggttggctcgcagaaccaatattcggaagcggcgactacccgtgggtgatgcgcgattggctgaatcagagaaataactttttgttgccctactttactgaagatgaaaagaaactgatccaaggtaccttcgactttctggcgcttagccattatactactatccttgtggacagcgaaaaagaagatccaattaagtacaacgattacctggaggtgcaagagatgactgatatcacgtggttgaactcgccgtcacaggttgccgtggtcccctggggccttcggaaagtgctgaactggctgaagttcaaatacggtgatcttcctatgtacattatctcgaacggcatcgatgacgggcttcacgctgaggatgaccaacttcgcgtctactacatgcaaaactacatcaacgaagccctgaaggctcatatcctcgatggaattaacctctgtggttactttgcatactcgtttaacgataggaccgccccaaggttcggtctttaccgatacgcagcagatcagtttgaacctaaagcctcaatgaaacattacagaaagattatcgattcaaacgggtttcctggacctgaaaccctggagcgtttttgtccggaagaatttactgtgtgtacggagtgttccttttttcatactagaaagagcctgcttgcattcattgccttcctgtttttcgcctccatcattagcctcagcctgattttctactactcaaagaaaggacggagaagttacaag

SEQ ID NO: 15071 - DNA, 3036 bp, Artificial Sequence; identical to SEQ ID NO: 15070
  Description of Artificial Sequence: Synthetic coding sequence

SEQ ID NO: 15072 - DNA, 3036 bp, Artificial Sequence
  Description of Artificial Sequence: Synthetic coding sequence
atgcccgcatccgctcccccaaggagaccccgcccacctcctccatccttaagtttgctgttggtgcttctcggattaggtggccgtcgcttgagggccgagccaggtgatggggcccaaacctgggcgcggttctctcgcccgccagctccagaggctgcaggcctgttccaaggcacattccctgacggctttctgtgggctgtcggaagcgctgcatatcagactgaagggggctggcagcagcatgggaagggtgcctccatctgggacacattcacacatcatccactggctcccccgggtgactcccggaatgcgtcgcttccactcggagctccgtcacccttacagccagctaccggcgacgtcgcctccgactcctataacaatgttttcagggacacggaggccctccgcgaactcggcgtgacacattaccgtttttccattagttgggctcgcgtgctgccgaacggctcagccggtgtgccaaacagggaagggctgcggtattatcgcagattgttggaacggctgagggaactgggggtgcaacccgtggtcactctttatcattgggaccttcctcagcgtctccaggacgcctatggtgggtgggctaaccgcgcactagccgaccacttccgggactatgctgaattgtgctttcgtcactttggcggccaggttaaatactggatcacaattgacaacccttatgtcgtcgcgtggcacggttatgcaaccggcaggttggcaccaggtatccgcggtagcccccgactgggctacctggtcgctcacaacctcctcttggctcacgcaaaggtgtggcatctgtacaatacatcatttagaccgacgcagggcggtcaggtgtccattgccttatcaagccactggattaatcccagaaggatgacagatcacagtattaaggagtgtcagaagtcgctcgacttcgtcctgggctggttcgcaaagcctgtttttattgatggagactatcccgaaagtatgaagaataacctttcttcaatccttcctgacttcaccgagtccgaaaaaaaatttatcaaggggaccgcagatttttttgccctgtgcttcggccccactctcagcttccagttactggacccacacatgaagttccggcaactagaatcacctaatctacgacaactgctaagctggatagacctggaattcaatcacccccagattttcatcgtggaaaacggctggttcgtgagtggaaccaccaagagggatgacgccaagtatatgtactaccttaagaaatttattatggaaactctgaaggccattaagctagacggtgtggatgtgatcggctacactgcttggtcacttatggatgggtttgagtggcaccggggatatagtatccgccgcgggcttttttatgtggactttctgtcccaggataaaatgctgctgcccaagagcagcgctctgttttaccaaaagctaattgagaagaacggctttccacctcttcccgaaaatcagccgctcgaaggcacgtttccatgtgacttcgcctggggggttgtggacaattacattcaggttgacactacactgtcccagtttacagatctgaatgtgtatctctgggacgtgcatcattcgaagcgtttgataaaagtcgacggggtggtaactaaaaaaagaaagagctactgtgtggatttcgccgcaattcagcctcagattgccctactgcaggagatgcacgttacacattttcgattctccctggactgggcactgattttaccattaggaaaccagtcacaggtgaatcatactatcctgcagtactaccggtgtatggccagcgaactggtccgagtcaatatcacccccgtggtggcactgtggcaacctatggcccccaatcaaggcctgcctagactgctcgcgagacagggggcctgggaaaacccttacactgcgctggcattcgccgagtacgcccggctgtgcttccaggaactggggcatcatgtgaaactatggatcaccatgaatgaaccctatacccgcaacatgacatattcagccggacataatttattaaaagctcacgctctggcatggcatgtgtacaacgagaaattcagacacgctcagaacggaaagatttcaattgccctgcaggccgactggatcgaaccggcttgcccttttagccaaaaggacaaggaggtggccgaacgtgttctggagttcgacatcggttggctggctgaaccgatatttggatcaggggattacccatgggtgatgagagattggctcaatcagaggaacaatttccttctcccttactttactgaggacgagaagaagctgatccagggtacgttcgatttccttgctcttagccactacacgaccatcttggtggatagtgagaaagaggatccgattaagtataacgattatctagaggtccaggaaatgactgacatcacctggcttaattcaccgagtcaggtcgctgtggtgccttggggtcttagaaaagtgctcaactggctcaaatttaagtatggcgacctgccaatgtacattatttcaaatggcatagacgatgggttgcatgcggaggatgaccaactgcgagtgtactatatgcagaactatataaacgaagcactcaaggcccacatcctcgatggtattaacctctgtgggtacttcgcttactcttttaatgaccgcacagctcctcgattcgggctctatcggtacgcagccgaccaattcgaaccgaaggcgagcatgaaacactaccgcaaaataatcgacagtaacggattccctggcccggagaccctagaacgcttttgcccagaagagttcactgtttgcaccgagtgttcctttttccatacacggaagtcactgctcgctttcattgccttcctgttctttgccagcattatctcgctgagtctgatattctactattccaagaaaggcaggcgtagctacaaa

SEQ ID NO: 15073 - DNA, 3036 bp, Artificial Sequence; identical to SEQ ID NO: 15072
  Description of Artificial Sequence: Synthetic coding sequence

SEQ ID NO: 15074 - DNA, 3036 bp, Artificial Sequence
  Description of Artificial Sequence: Synthetic coding sequence
atgcctgcaagcgctccacctcggcggcctaggcctcctcctccatctctctctttgttgcttgtgttattagggttggggggtcgccggttgcgggccgagcccggggacggtgcacagacttgggctaggttctctaggccgcccgcgccagaggctgctggattattccaaggcacattccccgacggtttcctttgggctgtcgggtccgctgcctatcagactgaaggtggttggcagcagcacgggaagggggcatcaatctgggatacattcacccatcacccgcttgcaccacctggcgactccagaaatgcctctctgcctctgggggctccctcccccctgcagccagcgacaggggatgtagcttccgactcctataacaacgtgtttagagacactgaggcgctgagagagctaggcgtgacccactaccgatttagcatcagctgggctcgagtcctacccaacggcagtgcgggggtccccaatcgggagggtcttagatactaccgccgcctgctcgagagactccgtgagctcggagtgcagccagtcgtaaccttataccactgggatctgccgcagcgcctacaagacgcatacggaggctgggctaatcgggctctggctgatcactttcgggattatgcagagctttgttttcggcacttcggcggccaggtcaagtactggataactattgacaacccctacgtggtggcctggcatggctacgccacaggtcggttggcacctggcattagggggtctccgcgtctcgggtacctggtggcacacaatctgctgcttgcccacgcaaaagtatggcacctgtacaatacttcattccggcctacacaggggggccaggtctcaatagcgctttctagccattggattaatccgagacgcatgactgatcactccattaaagaatgccaaaagagcctcgacttcgtcttggggtggtttgcaaaacctgtctttatcgatggtgactatccagaaagcatgaaaaataacttgagttccatcctcccagactttacagagtccgagaaaaagttcattaaaggtaccgcagacttttttgcgctctgtttcggcccgacactctcttttcaattactggatccccacatgaagttccgtcaattggaaagtcccaacttgcgtcaactactaagttggattgaccttgaattcaatcaccctcagatattcattgtcgagaatggctggtttgtctccggcaccactaaaagagacgacgccaaatacatgtactacctgaagaaattcattatggagacacttaaggcaattaaactggacggggtggacgtgattgggtatacagcttggagcctgatggatggttttgaatggcaccggggatacagcatcagacgtggtcttttttatgtcgacttccttagtcaagataaaatgttgctcccgaaatcttcggcactcttctaccagaagttaatcgagaagaacggattcccacccctacccgaaaaccagccgttagagggtaccttcccttgtgatttcgcttggggggtcgtagacaactacatccaggtggatactacactcagccagttcactgacctaaatgtgtatctctgggacgtgcaccactcgaagaggctgataaaggtcgatggcgtagtgaccaagaagcgcaagagctattgcgtggactttgcggccatccaacctcagattgcgctgctgcaagaaatgcacgtgacccatttccgtttcagccttgattgggccctgatcctgcccctggggaatcagtctcaggtaaatcatactattcttcagtattatcgatgtatggcttccgaacttgtaagggtcaacattaccccggttgtagctctctggcagcctatggcgcccaatcagggcctccctcgcttactggcccgtcagggcgcttgggagaatccatacactgcacttgccttcgccgaatacgctcgtctatgcttccaggaacttggtcatcatgtaaagttatggatcacaatgaatgaaccgtacaccagaaacatgacatactccgctggccacaatttactgaaagctcatgcgcttgcctggcacgtgtataacgaaaagtttcggcacgcacagaatggcaaaatctccatagccctccaagctgactggatcgagcctgcatgccccttctcacagaaagataaagaggttgccgagcgagtactggagttcgacatcggctggctggccgagcctatttttggtagtggtgactacccatgggtcatgagggactggctgaaccagagaaataatttcctgctgccctacttcacggaggacgagaaaaaattaatacagggcaccttcgatttcctcgcgctgagccattataccacgattttggttgactccgaaaaagaggaccctattaagtacaatgactatctggaggtgcaggagatgacggatatcacttggctcaatagtccatcccaggtagctgtggtgccctggggcctgaggaaagtactcaattggttgaagtttaaatatggggacctcccgatgtatattatcagcaacggaattgacgatggtctccatgctgaagacgatcagctgcgagtgtactatatgcaaaactacattaacgaagccctgaaggctcatattctggatggaataaacttgtgcggctactttgcatatagttttaacgatcgcaccgcccctcggttcggcctgtatcggtatgcagccgatcagtttgagcctaaggccagtatgaaacactaccgcaaaatcatcgactctaatggatttccagggcctgaaactctggagcgcttttgtcccgaggaatttaccgtttgcaccgaatgctctttctttcacaccaggaagagtctgctagcatttattgccttcttattttttgcatctataatttccttatccctgatcttttactattcaaaaaagggtcgcagatcctataag

SEQ ID NO: 15075 - DNA, 3036 bp, Artificial Sequence; identical to SEQ ID NO: 15074
  Description of Artificial Sequence: Synthetic coding sequence

SEQ ID NO: 15076 - DNA, 3036 bp, Artificial Sequence
  Description of Artificial Sequence: Synthetic coding sequence
atgcctgcctccgctccaccaaggcggcctcgcccgccccctccaagtcttagcctgcttctggtcctgctgggtttgggcggccgaagacttcgagctgagcccggcgacggcgcccagacttgggctcggttttctaggccaccggcccctgaggccgcgggcctgtttcagggcacgttcccggacggcttcctgtgggccgtgggctccgccgcttatcagacggagggaggatggcagcagcacggcaagggtgccagcatttgggatacgtttactcaccacccactggccccgccgggcgattcaaggaatgcaagcctcccattgggggcgccatcccctctccagcccgccaccggggatgtcgcttctgattcttacaacaatgtctttcgcgacactgaggcgctgagagaacttggcgtgacccactaccgctttagcatctcttgggctagggtcctgcccaacgggtctgctggggtgcctaatcgcgagggactgcgctactaccgacgcctcttggagaggctgcgggaattgggcgttcagcccgtggtgacgctgtaccactgggacctcccacagaggctccaagacgcttatggcggttgggccaacagggccctggctgatcattttcgagattacgccgaactgtgtttcaggcactttggggggcaggtcaagtactggattacaatcgataatccctacgtcgtggcctggcacggatacgccactggaaggctggcgcctgggatccgagggagtcctcggctcggttatctggttgcacacaacttgctgttggcccacgctaaggtttggcacctgtacaacacttcatttagaccgactcaagggggccaagtgtctatcgctctgagctcacactggatcaacccccgccggatgaccgatcactcaatcaaggagtgtcagaagagcctggattttgtcctgggatggtttgcaaagcccgtgttcatcgacggagactacccggagtccatgaaaaacaacctgtcttcaattctgcctgattttactgagtcagagaaaaaatttatcaagggcaccgccgacttcttcgccctgtgctttggtccgaccctttccttccagcttctggaccctcacatgaaatttcggcagctggaaagccccaatttgcgacagctgctcagttggatagatctcgagtttaaccatcctcaaatattcatcgttgagaatggctggtttgtgagcggaactaccaagagagacgacgctaagtacatgtactacctgaaaaagtttattatggagacgctgaaggccattaaattggacggggtggatgtcataggctacacggcatggtccctgatggatggtttcgagtggcaccgcgggtacagcattcggaggggcttgttttacgttgattttctctcccaggataaaatgctgctgcccaagtcatcagctctcttctatcagaagctgatcgagaagaacgggttcccaccactgccagagaaccagccattggaagggacctttccctgcgatttcgcctggggtgtcgtggataactatatacaggtggatacaactctgtcccagtttacagatctgaatgtatatttgtgggatgtgcaccactctaaacggttgatcaaggtggatggagtcgtgacgaaaaagaggaagagctactgtgtggactttgcagcaattcagccgcagattgcgcttctgcaagaaatgcacgtcacgcacttccgcttctcactcgactgggcgctcattctgccactgggcaaccaatcacaggtgaaccacacaattctgcagtactaccgatgtatggccagcgaattggttcgcgtcaacatcacgccggtggtcgccctgtggcagccaatggcccccaatcagggtctgcctaggctgctggcccgacagggggcctgggagaacccatacacagccttggcattcgcagagtacgcacgactgtgctttcaggagctgggtcatcacgtcaagctctggatcacgatgaatgagccttacacccgcaatatgacctatagcgcggggcataatttgctgaaagcacatgccttggcctggcacgtctataatgaaaaatttaggcacgcgcagaacggtaagatttctatcgcacttcaggcagactggatagagcctgcttgccccttctctcagaaagacaaggaggtcgctgagagggtgctggaattcgatattggatggcttgccgagcctatcttcggcagtggcgactacccctgggtcatgcgggattggttgaaccagcggaataatttcttgcttccctatttcacagaagacgagaaaaagctgatccagggtacctttgacttccttgccctttcccactatactacaattctcgtggactccgagaaggaggatccgattaagtacaacgactatctggaggtacaggagatgacagatatcacttggctgaactccccctcacaggtagcagtagtaccgtgggggctgcggaaagtgttgaactggctgaaattcaaatacggtgatctgccaatgtacatcatcagcaatggaattgacgatggactgcacgctgaggacgaccagcttagagtttattacatgcaaaactatataaacgaagctctcaaagcccatattttggatggcatcaatctgtgtggatactttgcctacagtttcaacgacagaacggcgcctcgcttcggactgtacaggtacgcagccgaccagtttgagccgaaggcttccatgaaacactatagaaagatcattgactctaacggcttcccagggcctgaaacccttgagagattctgcccagaagaattcaccgtctgcactgaatgcagcttctttcatacgcgcaagtcacttcttgccttcatcgcttttcttttttttgcatctattatctccttgtcactcattttttactattccaagaaaggccgccgcagctacaag

SEQ ID NO: 15077 - DNA, 3036 bp, Artificial Sequence; identical to SEQ ID NO: 15076
  Description of Artificial Sequence: Synthetic coding sequence

SEQ ID NO: 15078 - DNA, 3036 bp, Artificial Sequence
  Description of Artificial Sequence: Synthetic coding sequence
atgcctgcctccgcaccgccgcggcgccccagacctccaccaccttcgctgtcactgctccttgtgcttctggggctgggaggcagacggctgagagccgaacctggagatggtgcccagacgtgggcacgcttttcccgaccacccgcacccgaagcagcaggtctgtttcaagggacctttccggatggatttttgtgggcggtcggaagcgcagcataccaaaccgaaggaggttggcagcagcatggtaaaggggcctcgatttgggatacctttactcatcaccctctggcacctcctggcgactctcgaaacgcaagcctgcctcttggagccccttcaccgctgcaaccagcaaccggtgatgtggcgtcggactcttacaacaacgtgttccgggacaccgaagcactgagggaactcggtgtgacgcattaccgattttcgatctcgtgggcccgggtcctccctaacggctcggctggcgtgcctaatcgggagggactgagatactacaggaggcttcttgaacgtttgcgtgaacttggagtgcagcctgtggtgactctgtaccattgggacctgccacaacgactgcaagacgcatacggtggatgggcaaatcgcgcactcgcggatcactttagggattacgccgaattgtgtttccgccattttggaggacaggttaagtactggatcaccatcgataatccatacgtggtcgcctggcatggatacgccaccggacgtttggccccaggaattcgcggatcccctcggctcgggtaccttgtggcccataaccttctgctggcacatgcaaaggtgtggcatctgtacaacacttcctttcgtccaacgcaaggtgggcaagtgtcaattgccctgtctagccattggattaatcctcggaggatgacggaccattccattaaagaatgtcaaaagtccttggactttgtccttgggtggtttgcaaagccagtgttcattgatggtgattaccctgaatccatgaagaataacctctcctcaattctccctgacttcaccgagagcgagaagaagttcataaaggggacggcagacttttttgccctttgcttcggcccaacccttagcttccaactgttggatcctcatatgaagttccggcagctggagtcgccaaatctcaggcaattgctcagctggattgaccttgagtttaaccatcctcagattttcatagttgaaaacggctggtttgtcagcgggacgactaagcgagatgatgcaaaatacatgtactatctcaagaagttcattatggagactcttaaagccattaaacttgatggagtggatgtcattgggtacaccgcatggagcctgatggatggttttgagtggcatcgcggttacagcattagaagaggattgttctacgtcgattttctgtcacaggataagatgctgctccccaaatccagcgctcttttctaccagaaactgattgaaaagaatggattccctcctcttccagaaaaccaaccactggagggcacttttccttgcgattttgcttggggtgtggtcgataactacattcaagtggataccactctgtcacaattcaccgaccttaacgtgtacctttgggacgtgcaccattccaaacgcctgatcaaagtggatggcgtggtgaccaagaagcggaaatcgtactgcgtggattttgcggccatccaacctcaaattgcacttctccaggaaatgcatgtgacgcatttccggttttcactggattgggccctcattctgccacttggtaatcagagccaagtcaatcataccatccttcaatactatagatgtatggcttcagaattggtgcgagtcaacattactccggtggtggccctttggcagccaatggcgcccaaccaaggtctgccacgactcctcgcaaggcaaggtgcatgggaaaacccttacaccgctcttgcattcgcagaatacgcaagactttgttttcaggagctgggacaccatgtcaagctctggattaccatgaatgagccttataccagaaacatgacctacagcgcaggacataacctgctgaaagcgcacgcgcttgcatggcatgtgtacaacgaaaagttccgccacgcccaaaatggaaagatcagcatcgcgcttcaagcagattggatcgagcccgcgtgtcccttttcgcagaaggataaggaagtcgcagaacgcgtgcttgaatttgatatcggatggttggccgaacctattttcggatccggagattacccctgggtgatgcgcgattggctgaaccagcgcaacaacttcctccttccatatttcactgaggatgaaaagaagctcatccagggaacttttgattttctcgcgttgtcacattataccaccattctggtggattccgaaaaggaagatcccatcaagtacaacgattacctggaggtccaggaaatgaccgatattacctggttgaactcgcctagccaggtggcagttgtgccatgggggttgaggaaggtcctcaactggctcaagtttaagtacggggaccttcccatgtatatcatttcaaacggtattgacgacggactgcatgcggaggacgatcagcttcgggtgtactatatgcagaactacatcaatgaagcactgaaggcacacattcttgatggtattaacctctgtggctactttgcatactcatttaacgaccgcaccgctcccaggtttggtttgtacaggtatgcggccgatcaatttgagcctaaagcgtccatgaaacattacagaaagattatcgacagcaacggttttcctggtccagaaacccttgagcgattttgtcctgaggaatttactgtctgcactgaatgctccttctttcacactagaaaatccctcctcgcattcattgctttccttttcttcgcatccatcatttcactttcattgatcttttactactcgaagaagggtagaagaagctacaag

SEQ ID NO: 15079 - DNA, 3036 bp, Artificial Sequence; identical to SEQ ID NO: 15078
  Description of Artificial Sequence: Synthetic coding sequence

SEQ ID NO: 15080 - DNA, 3036 bp, Artificial Sequence
  Description of Artificial Sequence: Synthetic coding sequence
atgccagcatctgcgccgccaagacgcccgcggccgccgccgccttccctgtcactcctgctcgtgctcctcggtctgggtggccgccgcctccgtgctgaacctggggacggtgcgcagacctgggcccgcttcagcagaccaccggccccggaagcggctggattgttccaagggacgtttccagacggcttcctttgggcagtgggttccgcagcttaccagactgagggcgggtggcagcaacatggaaaaggagcctccatttgggacactttcacccatcatccactggcaccacctggggactcccgcaatgcttccctgccgctgggagccccttcacccctgcaacctgccaccggtgatgtggctagcgactcctacaacaatgtgttccgcgacacggaagccttgcgggaactcggagtcacccactatcggttcagcatctcatgggcgagagtcctgccgaacgggtcagctggagtcccaaaccgcgagggactgcgctactacagacggctgctggagagactgcgcgaactcggagtgcagccagtggtgactctgtaccactgggacctgccacagaggcttcaggatgcgtacggaggatgggccaatcgggccctcgccgaccattttcgcgattacgcggagctttgttttcgccatttcggtggacaggtcaaatactggatcaccatcgataatccgtacgttgttgcttggcatggatacgcaactggccggctggcccctggcatccgagggtccccccgcctcggatacctggtggcgcacaatctcctcctcgcccatgctaaagtgtggcatctctacaacacttcgttccgcccgacccagggcggacaggtgagcatcgcgctcagctcgcattggatcaacccgcgacgcatgactgatcacagtatcaaggaatgccagaagagtttggatttcgtcctgggctggttcgccaagcccgtgttcatcgacggagattaccccgaatcgatgaaaaacaatctctcgtcgatcctgccggatttcactgaaagcgagaaaaagttcattaagggaaccgcggactttttcgccctgtgctttggccctaccctctcattccaactgttggacccgcacatgaagttccggcagctggaatcacccaacctgagacagctgctctcctggatcgacctcgaattcaaccatccccaaatcttcatcgtggagaacggatggtttgtctcagggaccactaagcgcgatgacgcgaagtatatgtattacctgaagaaattcattatggaaactctgaaggccattaaactcgacggtgtcgatgtgatcggatacaccgcgtggtcactcatggacgggttcgagtggcaccgcggttacagcatccgtaggggcttgttctacgtggatttcttgagccaggataagatgttgttgccaaagtccagcgctttgttctaccaaaagctgatcgaaaagaacggctttccaccgcttccggagaaccagccattggagggtacgttcccctgcgatttcgcttggggtgtggtggacaattacatccaagtggacactactctgtcgcagttcaccgatctgaatgtgtatttgtgggacgtgcaccattcaaagcgcttgattaaggtggacggcgtggtgaccaagaagcgcaagtcctactgcgtggattttgccgcaatacagcctcaaatcgcgctgctgcaagagatgcatgtgacgcactttcggttttcactggattgggcacttatcctgccgctcggaaaccagtcccaggtcaatcacactatcctgcagtactatcggtgtatggcttccgaactggtcagagtcaacataacgcctgtggtcgccctttggcagccgatggcgccgaaccaaggtttgccgcggcttcttgccagacaaggggcatgggaaaacccgtacaccgcactcgccttcgccgaatacgcgaggctgtgctttcaagagctgggacatcatgtcaagctctggatcacgatgaacgagccgtacactcgcaacatgacctacagcgccggtcataacctgcttaaggcccacgccctggcctggcacgtgtacaacgagaagttccgccatgcccagaacggtaagatctcgatcgcccttcaggcagactggatcgaacctgcctgcccattctcccagaaggataaagaagtcgctgaacgggtgttggaattcgatatcggctggctcgccgagccgatcttcggctcgggggactacccctgggtcatgcgggactggctcaatcaacgtaataacttcttgttgccttacttcacggaggacgagaagaaactgatccaaggtaccttcgacttcctggctctgtcacactataccaccatcctcgtggattccgagaaggaggaccccatcaagtacaatgactacctggaggtgcaggaaatgaccgatatcacctggctgaactctccaagccaggtggcagtggttccgtgggggttgagaaaagtgctgaactggctcaagttcaaatacggcgatctgcccatgtacatcatcagcaacggaatcgatgacggcctccatgcggaggacgatcaacttcgggtctattacatgcagaactacatcaacgaggccctgaaggctcacatcctggatggcatcaatctgtgcggttacttcgcctactcgtttaacgaccggactgccccacgtttcggcttgtaccggtacgccgccgaccaattcgagcctaaagcatcgatgaaacactaccgcaagatcatcgactcgaacggattccctggcccagaaacccttgaacgattttgcccggaggaatttactgtctgtaccgaatgctccttcttccatacccggaagtcactgctggcatttatcgcgttcctcttcttcgcaagcatcatttcactctccctgattttctactactcgaagaagggccgacggagctacaag

SEQ ID NO: 15081 - DNA, 3036 bp, Artificial Sequence; identical to SEQ ID NO: 15080
  Description of Artificial Sequence: Synthetic coding sequence

SEQ ID NO: 15082 - DNA, 3036 bp, Artificial Sequence
  Description of Artificial Sequence: Synthetic coding sequence
atgcctgctagcgccccgccacgtcgccccagacctccccccccctccctgagcctgctgttagtcctcttgggcttggggggtcgtagactgagagctgaaccaggagacggcgcacagacctgggccaggttcagccgcccaccagcccctgaggcagccgggttgttccagggaacattccccgacggtttcctttgggcagtcggttcagcagcctatcagactgagggtggctggcagcagcatggaaagggggcctctatatgggatacattcacgcaccaccccttggcccccccgggtgacagcaggaacgcatctctacctcttggtgccccctctcctctgcaacccgcgactggggacgtggccagcgacagttataataacgtgtttagagacaccgaagcactgcgtgagctgggggtcacgcactaccgcttcagcatctcatgggcccgtgtgcttcccaacgggtctgctggagtgcctaaccgagaagggctccgttactataggaggctcttagagcgactgagggagctcggcgtccagcccgtggtgaccttataccactgggacctgccccagagactccaggatgcttatggaggttgggcaaacagagctctggccgatcatttccgggattacgcagagctgtgctttcgccattttggagggcaggtgaaatattggataacgatcgacaacccgtacgtggtcgcttggcacggatacgctacaggtcgcctggctcccggaatcaggggctccccaagactggggtatcttgtggcacacaacctgcttctggcccatgcgaaggtgtggcatctgtacaacacatcattccgccctacacaagggggacaagtgagtatcgcattaagctcccattggatcaacccacggaggatgacagatcattccattaaagagtgtcagaagagtctggacttcgtgttaggttggtttgccaaaccagtgtttatcgatggcgactaccccgagagcatgaaaaacaacctgtcttccattctgcctgattttacagagtcagaaaagaaatttataaagggaactgcggacttcttcgctctgtgttttggacctacactgtcttttcagttgttggatcctcatatgaaatttaggcaattggaaagtcctaatctccgacaactgctgtcatggattgacttagaattcaatcatccccagatattcatagtcgagaatggttggtttgtctcgggcacaacaaaaagggatgacgctaagtatatgtactatctcaaaaagttcattatggagacattgaaggccatcaaactggacggagtggatgtcatcggatacactgcctggtcactcatggacgggtttgagtggcatagagggtactctatacggcgtggccttttctacgtcgatttcctgtcccaggacaagatgctgctgcctaagtcctccgctcttttttaccaaaagcttatcgaaaaaaatggcttcccgcctcttccggaaaatcagcctctcgaggggacgttcccttgtgacttcgcttggggagttgtggataattatatacaagtggacactacactgtcacaatttacagacctgaatgtatacctgtgggacgtacatcactccaaaaggctcatcaaggttgatggggtcgtgacaaagaagagaaagtcctattgtgtagacttcgccgccatacagccccagattgcacttctgcaggaaatgcacgtgacccacttccggttctctctggactgggcattaattctgcccttggggaaccagagtcaggtcaaccataccatcctccagtattatcggtgcatggcctccgaattggtcagagttaacattacaccagtggttgcactctggcaacccatggcaccgaatcagggcctgccacggctacttgcccgccaaggggcatgggagaacccatatacagctctcgcctttgccgaatatgcccgcttgtgttttcaggaactgggacaccatgtcaagctctggatcactatgaacgagccgtacacgagaaacatgacttactcagcaggacacaacctccttaaagcacacgctctggcgtggcacgtgtataacgaaaagttcaggcacgcccaaaacgggaagatatcaatcgctctgcaggctgattggattgaacctgcctgtcccttctctcagaaggacaaagaggtcgctgaacgggtgctggagttcgacatcgggtggctggccgaacctatttttggctctggcgattacccatgggtgatgcgggattggttaaatcagagaaataattttctcctcccttacttcactgaggacgagaaaaagctaatccagggaacctttgatttcttggcactcagccactacaccactattctagtggacagcgaaaaagaggatccaattaagtacaatgattacctggaggtgcaggagatgacagacattacatggcttaattctcccagccaggtggccgtcgtgccatggggattacgaaaggtcctcaattggctgaaattcaagtacggagatttacccatgtatatcatcagcaatgggattgatgatggtctccatgccgaggacgatcagcttcgagtgtattatatgcagaactacatcaacgaagcactaaaggcccacatattagatggcatcaacctgtgcgggtattttgcttattctttcaatgatcggacagctccccgttttggtctgtataggtacgcagctgaccagtttgaacctaaggcttctatgaaacactataggaaaatcattgacagtaatgggttcccaggtccggaaacactcgagcgattttgccctgaagagtttacagtgtgtactgagtgcagcttctttcacaccagaaagtcactgcttgccttcatcgccttcttatttttcgcaagcatcattagcctctcgctgatcttttattatagtaagaagggaaggcgttcctataag

SEQ ID NO: 15083 - DNA, 3036 bp, Artificial Sequence; identical to SEQ ID NO: 15082
  Description of Artificial Sequence: Synthetic coding sequence

SEQ ID NO: 15084 - DNA, 3036 bp, Artificial Sequence
  Description of Artificial Sequence: Synthetic coding sequence
atgccagcatccgcgccgccaaggcggccccggcccccacctccctcactttcgctgctgttggttctgctgggcctaggcggtcgtaggctgagagctgagcctggggacggagcgcagacctgggcccgattcagcagaccgcctgcacctgaggccgccgggctgttccaggggacattccccgacggtttcctctgggctgtcggcagcgctgcataccagacagaaggtggctggcagcagcatggaaagggtgcaagtatatgggacaccttcactcaccacccgctggccccgccaggcgattcacggaatgcctctttaccactgggggccccatccccattacaacccgctactggtgacgtcgcatccgacagttacaataatgtgttccgagatacggaggcgctccgggagcttggggtcacacattacagattcagtatctcatgggctagagtgcttcctaatggcagcgctggtgttcccaatcgcgaaggtttacgctattataggcgcctgttggagcggctccgcgaattgggcgttcagcccgttgtgacgctgtatcattgggatctaccgcagcgcttacaggatgcctacggcggatgggccaatcgggccttagcagaccacttcagagattacgccgagctgtgtttccggcattttgggggccaggtgaagtactggattaccatcgataacccctacgtagtcgcctggcatggctacgctactggccggctcgctcccgggatccgcggcagtccacggctcggatatctggttgctcacaatcttctcctcgcacatgctaaagtgtggcacctgtataatacaagcttcagaccaacccagggaggacaggtgtccattgcactgtcgtcccactggattaaccctcgacggatgacagatcattcgattaaggaatgccagaagtctcttgattttgtcctcggatggttcgctaaacctgtcttcatcgacggtgattatccagaatccatgaagaataatttaagttctattctcccagacttcacggaatctgaaaagaagtttattaaaggcaccgcagacttttttgctctttgttttggtcccacacttagttttcagctgctggatccgcacatgaagttcagacagctggagtctccaaacctgcggcagttactgagctggatcgacctagagttcaatcatccacagatctttattgtcgagaacggctggttcgtcagcgggactacgaagagggacgatgctaagtacatgtattatctcaaaaagttcatcatggaaactttgaaggcaatcaaactcgatggcgttgacgtgatcgggtatacggcctggtcattaatggatggttttgagtggcatcgtggttactccattcggcggggtctgttttatgtcgattttttgtcccaagataagatgttgttgcccaaatccagcgctctcttctatcagaagctaatcgagaaaaacgggttccccccattgccagaaaatcaaccgttggagggcacattcccttgtgactttgcatggggtgtagtggataactacattcaggtggacacaaccctctcccaattcaccgatctgaacgtgtacttatgggacgtacaccactcaaaaaggctgattaaagttgatggggtagtgacaaaaaagcgaaaatcatattgcgtagacttcgctgcaattcagccccagattgcactcctgcaggaaatgcacgtgacccactttcggttttcactggattgggccctgattctaccactggggaatcagagccaggtgaatcacacgatcctgcagtattatcggtgtatggcttcagagttggttcgtgtaaacatcacacctgttgttgcattatggcagcccatggcaccgaaccaaggattgccccgcctgctggcccgccagggggcgtgggagaacccgtacacagctctggcctttgctgaatacgcaaggctctgttttcaagagctgggccatcatgtaaagctgtggattacaatgaacgagccctacactagaaacatgacttattcagcaggtcataaccttctgaaggcgcacgccctcgcatggcacgtgtataatgaaaaattccgccatgcacagaatgggaagattagcatcgccctgcaggctgactggatagagcctgcatgccccttcagccagaaggataaagaagtcgcagaacgcgtcctcgagttcgacattgggtggctggcggagccaattttcgggtccggagactacccatgggtgatgagggattggctgaaccagagaaacaacttcctgttgccatactttactgaggatgaaaaaaaactgatacaagggacattcgactttcttgccctgtcacattacactacgattttggtggactctgagaaggaagatcccatcaagtacaatgactatttagaggtacaagagatgacagatataacatggttaaactctccaagccaggtggccgtagtgccttgggggcttaggaaagtgctgaattggctgaagtttaaatacggggacctcccaatgtatataatctcgaatgggatcgacgatggtctgcacgccgaagatgatcaactgcgggtgtattatatgcagaactatatcaatgaagccctgaaggcccacatccttgacggcatcaatctgtgcggttattttgcctacagctttaatgatcgtaccgcacccaggttcggtttatatagatacgctgccgaccagtttgagcccaaggcaagcatgaaacattatcggaaaataattgactccaacggcttcccaggcccagagacccttgagaggttttgtccagaagaatttactgtctgcaccgagtgtagctttttccatacaaggaagtccctgcttgcctttatagcctttctcttttttgcctcaatcatttcattgtccctcattttctactactccaaaaaaggtcgccgctcttataaa

SEQ ID NO: 15085 - DNA, 3036 bp, Artificial Sequence; identical to SEQ ID NO: 15084
  Description of Artificial Sequence: Synthetic coding sequence

SEQ ID NO: 15086 - DNA, 3036 bp, Artificial Sequence
  Description of Artificial Sequence: Synthetic coding sequence
atgcccgcatccgcccccccccggagaccccgtccccccccaccttctttgagtcttcttttggtgctgctcggcttgggtggaagaaggctccgggccgagcctggggacggcgcccagacttgggcccgctttagccggcctccagcccccgaagcagctggcttgttccagggcacctttccagacgggttcctgtgggccgtgggctccgctgcctaccagacagagggcgggtggcagcagcatggtaagggcgcgagtatctgggacacgttcacacaccaccccctggcccctccaggtgactcaaggaacgcatccctccctctgggggccccttcaccgctccagccggcaaccggcgacgtcgcctcggactcttacaataacgtgttcagggacaccgaagcacttagggagcttggcgtcacgcattaccgcttctctatctcttgggcccgggttctgccaaacggcagcgcaggcgtccctaacagggagggcctgaggtactatcgcaggctccttgaacgtcttcgagaactgggagtccagccagtggtgactctgtaccattgggatctcccacagagattgcaggatgcatatgggggatgggccaatcgggctctcgcagaccatttccgagattatgccgaactgtgctttcggcactttggcggacaggtgaagtattggatcactattgacaacccctatgtggtggcctggcacggatacgccacaggccgcctggcacctgggattcgaggctccccccggctggggtacctggtggcccacaacctgctgcttgcacacgctaaagtgtggcacctgtataacaccagctttagacctacccagggaggccaagtttccatcgcactctcctctcactggattaatccccgccggatgactgaccacagcatcaaggagtgtcagaagagtctcgacttcgtgttgggttggtttgccaagcccgtgttcatcgatggggactatcctgaatcaatgaagaacaatctgtctagcattctcccagactttactgagtctgaaaaaaagttcattaaaggcacagcggacttcttcgcactgtgtttcggccccactctttccttccagctattggacccgcacatgaagttccgacagctggaaagccctaatctgcggcagctgctgagctggatagacctggagttcaatcaccctcaaattttcatcgtggagaatggctggtttgttagtggcaccaccaaaagggatgatgccaagtatatgtactacctgaagaagttcattatggaaacgctgaaggctattaagctggacggcgtagatgtgatcggctataccgcctggtccctaatggacggctttgaatggcacagaggttacagtattagacggggactgttttacgtcgacttcctgtctcaggataagatgctccttcccaagtcctcggccctgttctaccagaaactcattgaaaaaaacggattcccccctctgccagagaatcagcccttagaaggcaccttcccgtgcgactttgcgtggggagtcgtcgacaactacatacaggtggataccactctttctcagttcacagacttgaatgtttacctctgggatgtgcaccattccaaaaggttgatcaaagttgatggcgtggtcacgaagaagcggaagtcctattgtgtggatttcgcagcaattcaacctcaaattgcactccttcaagagatgcatgttacacattttcgcttttcccttgactgggccctgatcctgccgctcgggaaccagagtcaagtaaatcataccatactccagtactatagatgtatggcttctgagttggtgagggtcaatatcacaccggtcgtggccctatggcagccaatggcgcccaatcagggcctgccaagactgcttgcgaggcagggcgcctgggagaatccctatacggcgctggcatttgcggagtatgccagactttgctttcaagaattaggtcatcatgtaaaactgtggatcacaatgaacgagccatacacccgtaacatgacatactcggccggacataatctgttgaaagcgcacgcgttagcatggcacgtttacaacgaaaagtttcgtcacgctcagaacggcaaaatcagcatcgcacttcaagcagactggattgaaccggcatgccctttttcccagaaggacaaggaggtcgccgagcgggtactcgaattcgacattggatggcttgccgaacctatttttggaagtggagactacccctgggttatgcgtgactggctaaatcagcggaataacttcctcctgccttactttacagaagacgaaaagaaactgatccaaggtacatttgattttctggctctgagccattacactacaatcctggtcgacagcgagaaagaagatcccatcaagtacaacgactaccttgaagtacaggaaatgacagacatcacctggctcaattccccaagccaggtggctgtggtgccctggggacttagaaaagttctaaactggttgaaatttaaatacggcgacctgccgatgtacatcattagcaacggcatcgatgacggtcttcatgccgaggacgatcagcttagggtctactacatgcaaaactacattaacgaggctctgaaagcccacatactcgacggtattaatctctgcggctactttgcctattccttcaacgaccgcaccgctcctcgattcggattgtaccgctatgcggctgaccagttcgaacccaaggccagtatgaagcactaccgtaagatcatcgatagcaatggattccccggaccagagaccttggaacggttttgcccggaggaattcaccgtgtgcacggagtgttcttttttccatacccgaaaaagcctcctggcattcattgcctttctgtttttcgcctcgatcattagcctaagtctcattttttattatagcaaaaaagggagacggtcttataaa

SEQ ID NO: 15087 - DNA, 3036 bp, Artificial Sequence; identical to SEQ ID NO: 15086
  Description of Artificial Sequence: Synthetic coding sequence

SEQ ID NO: 15088 - DNA, 3036 bp, Artificial Sequence
  Description of Artificial Sequence: Synthetic coding sequence
atgccagcaagcgcgcctccccgcaggcctcgaccgcctccgccaagcctgagtctactcctcgtcctactgggcctgggtggccggaggttgcgcgcagagcccggcgatggtgcccaaacgtgggcacgtttttcacgcccgcccgcacctgaggcggccggtctatttcaaggtacgtttccggacggctttctgtgggcagtgggtagcgcggcctatcaaaccgaaggtggctggcagcagcatggtaaaggtgcaagcatctgggacactttcactcaccacccacttgctccgccaggtgactctcgcaatgcgagcctcccgttgggggcaccgagcccgttgcaacctgctacaggcgacgtcgcttccgatagctataacaatgtgtttcgcgacactgaggctttgcgtgaactgggtgttactcactaccgcttctcgatctcttgggcgcgtgttctgcctaatgggagcgccggtgtgccaaaccgcgagggacttcgctactataggcgcttgctcgaacggcttagagaacttggtgtgcaacctgtggtgactctgtatcactgggatctcccacagcgcctgcaagacgcatacggcggctgggccaaccgcgcgttggcggaccattttagagattatgccgagctctgttttcgacacttcggaggtcaggtgaagtattggattaccatcgacaatccatacgtggttgcctggcatggctatgcaacgggtagactggccccaggtattcgtggcagccctcgcttgggctatttagttgcccataatctgctcttagcccacgctaaggtctggcacctctacaacaccagcttccgcccgacgcaagggggtcaggttagcatcgcgcttagctctcactggatcaatccacggaggatgaccgaccacagcattaaagagtgccaaaaaagcctggattttgtcctgggttggtttgcgaaacccgtatttatcgacggggactatccggaaagcatgaaaaacaatctgtcaagtatcctgcctgatttcaccgaaagcgagaagaaatttattaagggcaccgcggacttttttgccctctgcttcgggccgaccctgagcttccagctgctggacccacacatgaagtttcgccaattggaaagccctaacctccgtcagctgttgagctggatcgatctcgagttcaatcacccacagattttcatcgtggaaaatggttggtttgtttccggcactacgaagcgtgatgacgccaaatatatgtactacctgaaaaagttcattatggagactctgaaagctattaaactggatggcgttgatgtcatcggctacactgcctggtccttgatggatggttttgagtggcatcgtgggtactcgatccgccgcggtctattttatgttgattttctgtcacaagataaaatgttgctgccgaaatccagcgccctgttttaccaaaagctaatcgaaaaaaacggttttcctccgttgccagagaatcagccactggagggcactttcccttgcgattttgcatggggtgtggtcgacaattatattcaggttgataccaccttgagccagtttaccgacctcaacgtctacttgtgggatgttcaccactccaaacgcctgattaaggttgacggtgtcgtcacaaagaagagaaaaagctactgtgtggattttgcagccatccagcctcaaatagctctgttacaggagatgcatgttacccatttccgcttctctctcgattgggctctgatcctccctcttggcaatcagagtcaggtgaaccataccatcctgcaatattaccgctgtatggcatccgaactggtacgcgttaacatcaccccagtggttgcgttgtggcagcctatggcgcctaaccagggacttccacggttgctggcccgacaaggtgcttgggaaaacccttacaccgccttggcattcgctgagtacgcccggttatgcttccaggagcttggtcatcacgtgaaactttggatcaccatgaacgagccgtatacccgcaacatgacatattcagccgggcacaatctgctgaaggcacatgccctggcttggcacgtctacaatgagaagtttcgccatgctcaaaacggcaaaataagcattgctctgcaggcagattggatcgaaccggcctgcccgtttagccaaaaggacaaagaagtggccgagagagtgctggagttcgatattggctggttagcggaaccaatatttggcagcggcgattacccatgggtcatgcgtgattggcttaatcagaggaataatttcctcctgccttatttcactgaagatgaaaagaagctgattcagggtaccttcgactttctggcactgtcccattacacgaccatcctggtggatagcgagaaggaggatccaatcaaatataacgattacctggaagttcaggaaatgactgacattacctggctcaacagcccaagccaggtggccgttgtcccatggggtctgaggaaggtcctgaactggttgaagttcaagtatggcgacctgccgatgtacattatcagcaatgggatcgacgatggcttgcatgccgaagacgatcagttacgtgtgtactatatgcagaattatattaacgaggccctcaaggcgcacattctggatggcatcaacttgtgtggctactttgcgtacagcttcaatgacagaacagcaccccgcttcggcctgtatcgctacgcagcggaccaatttgaacccaaggcatcaatgaaacattaccgtaaaatcatcgatagcaatggtttcccgggcccggagactctggagcgcttttgtcccgaggagtttaccgtgtgcactgagtgtagtttttttcacaccagaaagagcctgctggcgttcatcgcattcctcttttttgccagtatcatttcgctgtccctgatattctactactccaagaaaggtcggaggagctacaaa

SEQ ID NO: 15089 - DNA, 3036 bp, Artificial Sequence; identical to SEQ ID NO: 15088
  Description of Artificial Sequence: Synthetic coding sequence

SEQ ID NO: 15090 - DNA, 3036 bp, Artificial Sequence
  Description of Artificial Sequence: Synthetic coding sequence
atgccggcttcggcaccccctcggcgcccgcgtcccccgccgccgagcctgtcgctgctgctggtgctcctcggactcggcggtcgcagactgcgtgctgaaccaggggacggcgcgcagacctgggcacgcttcagcaggccccccgcacctgaggctgcgggacttttccagggtacctttcctgacggcttcctctgggcagtgggctccgctgcgtaccagactgagggagggtggcagcagcatggaaagggagcatccatctgggataccttcactcatcatccgctggcccctccgggagattcccgcaacgcttccttgccgctcggggccccatcccctctgcagccggcgactggcgatgtggcgtctgactcctacaataatgtgttccgggataccgaagccctgcgcgagctcggagtgacccactaccgcttttcgattagctgggctcgcgtccttccaaacggatcagccggcgtgccaaatagggaaggcctgcgctactaccgccgcctgcttgagcgcctgcgcgaactgggagtgcagcctgtggtgactctctaccattgggatctgccacagcggctgcaagatgcctacgggggatgggccaaccgggccctcgctgatcactttcgcgattatgcagagctgtgcttccggcactttggaggtcaggtgaaatactggatcaccatcgacaacccatacgtcgtggcttggcatgggtacgcaactggacgcctggcgcctggaatcaggggctccccgagattgggatacctcgtcgctcacaatttgctcctcgctcacgccaaggtctggcacctttacaatacctccttcagaccgacgcagggtggccaggtgagcatcgctctgtccagccactggatcaaccctcgccggatgaccgatcattcgatcaaggagtgtcaaaagtccctcgacttcgtgctgggttggttcgccaagcctgtgttcatcgacggggactacccagaatcaatgaagaataacctctcgtcaatcctccctgacttcactgaaagcgagaagaaattcattaagggaactgctgatttctttgccctgtgtttcggtccgacgctgtccttccaactgctggacccccacatgaaattccgacaactcgaatccccgaatctccgccaacttctgtcatggattgatctggagttcaaccatccacagatcttcatcgtggaaaacggatggttcgtcagcggcactaccaagcgcgacgacgctaagtatatgtactatttgaaaaagttcattatggagacgttgaaagcgatcaaactcgatggagtggatgtgatcggctacactgcttggtcgctcatggacggattcgagtggcatcgcggttactccatcagacggggacttttctacgtcgacttcttgtcgcaggataagatgttgctgccgaaatcgtctgccctcttttaccagaagctgatcgagaagaatggattccctccgctgcccgagaatcaacctttggaaggcacttttccctgtgacttcgcctggggagtggtggacaactacatccaggtcgacaccactctgtcccagtttaccgacttgaatgtctacctttgggacgtgcaccattctaaacggctgatcaaggtggacggcgtggtcactaagaagcgaaagagctattgcgtggatttcgccgcgatccagccgcagatcgcgctgctgcaggagatgcacgtcactcatttccgcttctccttggattgggcgctcatccttccgctcgggaatcaaagccaagtgaatcacaccatcctgcagtactaccgctgtatggcttccgaactggtgagagtgaacatcactcccgtggtggcgctctggcagccaatggcacctaatcaggggcttccgaggctgcttgcacggcaaggagcgtgggaaaatccgtacaccgcgctggcgttcgcggaatacgcgagactctgcttccaagagttggggcatcacgtcaaactgtggattactatgaacgaaccttacacccggaacatgacttactcggctggacacaatcttctgaaggctcatgccctggcttggcacgtttacaatgaaaagttcagacacgcgcaaaacgggaaaatctcgattgcgctgcaggcagactggatcgagccagcctgccctttctcacaaaaggataaggaggtggccgaacgcgtcctggaatttgacatcggatggctggcggagccaattttcggatccggagattacccgtgggtgatgcgtgactggttgaatcagcgcaacaacttcctcctcccgtacttcactgaggacgaaaagaaacttatccaaggaacttttgacttcctcgcactgtcgcattatactaccatactcgtcgattcggaaaaagaggacccgattaagtacaatgactacctggaagtgcaagagatgaccgacattacctggctgaattccccgtcgcaggtggcagtggtgccgtggggactgcgcaaggtcctcaactggctgaagtttaagtacggtgacctgccgatgtacatcatatcgaatggcatcgatgatggtttgcacgcggaagatgaccaattgcgggtgtactacatgcaaaactacattaacgaagcgctcaaggctcacatcctcgatggcatcaacctgtgcggttacttcgcttactcatttaacgaccgcactgcccccagatttggactctaccgctatgccgccgaccaatttgaaccgaaggccagcatgaagcattaccgcaagatcatcgactcgaacggattccctggacccgaaaccctggagcggttttgccctgaggagttcaccgtttgcaccgaatgttcgttcttccatactcgcaaatcacttctggccttcatcgcctttctgttctttgcgtcgatcatctcgctgagcctgatcttctattactccaaaaagggccggcgctcctacaag

SEQ ID NO: 15091 - DNA, 3036 bp, Artificial Sequence; identical to SEQ ID NO: 15090
  Description of Artificial Sequence: Synthetic coding sequence

SEQ ID NO: 15092 - DNA, 3036 bp, Artificial Sequence
  Description of Artificial Sequence: Synthetic coding sequence
atgccagcaagcgcacctcctcggagaccgcggcccccccctccatcgctgtcattactcctcgtgctgctgggacttggaggtcggagactgcgcgcagaacccggagatggagcccagacgtgggcgcgtttctctcggccaccagcccccgaggctgcaggactcttccagggcacattccccgatggattcctctgggccgtaggctcagcggcttaccagactgagggcgggtggcagcagcatggaaagggcgcttccatttgggatacgtttactcatcacccgctggctccaccaggagacagcagaaatgcctctctgccactgggggcaccctctccccttcaaccagctaccggcgatgtggcgtccgacagttacaacaacgtcttcagagacactgaggctctgcgggaactgggcgtgacacactatcgctttagcatctcttgggcccgagtgctgcccaatggatctgcgggagtgccaaaccgagaggggctcaggtactaccgcagactactggagcggctcagggagctcggggtacagcccgtggtgacattgtatcattgggatctgccccagcgattgcaggacgcttatggcgggtgggccaatagagctctggctgaccacttcagggactacgcagagttgtgtttccggcattttggcggccaggtgaaatattggattacaatcgacaatccgtacgtagtggcatggcacgggtacgctactgggagactggcccccgggattcgaggctcaccgcgtctcggatatcttgtggcacacaacctattgttggcgcacgcgaaagtgtggcacctctacaatacctcattcagacccacgcagggcgggcaagtatccattgccctttcgtctcattggataaacccccgtcggatgaccgaccactcaatcaaggagtgtcagaaaagcctggattttgttttaggctggttcgctaaacccgtgttcatcgatggggattacccagagagtatgaagaacaaccttagttcaattcttcctgacttcacggagtccgaaaagaagttcataaaagggaccgcagacttcttcgccctatgcttcggaccaaccctttcttttcaacttctggatcctcatatgaaattccggcaattagagagccccaacctgcgacagttgctcagctggatcgacctcgaattcaatcatccgcagatctttatcgttgagaacggctggtttgtgtcaggcacaacaaaaagggacgatgctaagtatatgtactacctgaaaaagtttatcatggagaccctgaaagcaatcaagctcgatggagtggacgtgattggctacacggcgtggtcgctcatggacggctttgagtggcacaggggctacagcatcaggaggggtctattttatgtggattttctgtctcaggataagatgttgctgcctaaatccagcgccttattttatcagaagctgatcgagaagaacggattccctcccctcccagagaatcagcctcttgaggggaccttcccctgtgattttgcttggggcgtggtcgacaattatattcaggttgatacaacactgagtcagtttactgacttaaatgtgtacttgtgggatgtgcatcactcaaaaagactcatcaaagtggatggggtcgtaactaagaagagaaagtcttattgcgtcgattttgccgctattcagccccagatagcgctgctccaagagatgcacgtgacacactttcggttcagtctggattgggctctgattttgccgctcggcaatcagtctcaagtcaatcatacgatcctgcagtattatcgctgtatggccagcgagttggtgagggtaaatatcacacctgtcgtggcattatggcagcccatggctccgaaccaagggttaccccgactgctggcccgccagggagcatgggaaaatccttacactgcactagctttcgccgagtatgccaggctctgtttccaagaacttggtcaccacgtgaaattgtggataacaatgaatgaaccctacacccgcaatatgacctacagcgcggggcataacttgctgaaagctcatgcccttgcctggcacgtatataatgagaaattccggcacgctcagaacggaaaaatctctattgccctccaggccgattggatcgagcctgcatgtccttttagccagaaagataaggaggtcgctgagcgagtcctagaatttgacatcgggtggctggcagaaccaatctttggatccggggactacccctgggtgatgcgggattggctgaatcagcggaataatttcctgctgccgtattttaccgaggacgaaaaaaaactaattcagggtacattcgacttcctcgccttaagccactacacaacgattcttgtcgattctgagaaagaagaccccatcaaatataatgactacttggaggtgcaggaaatgacagacataacctggctcaactcaccgagccaggtagcggtggtcccgtgggggctcagaaaagttctcaattggctcaaatttaaatatggggacttacccatgtacatcatttctaacggcattgacgacggactgcacgctgaagacgaccaactccgtgtgtattacatgcaaaattacatcaacgaggctttaaaagcccacatccttgacggcataaatctgtgtggctactttgcatactcctttaacgatcgtacagcccccagattcggcctgtatagatatgccgcggaccagttcgagcccaaagcctctatgaagcattataggaagattattgatagcaatggatttcccgggcctgagacgctggaaaggttttgcccagaggaattcactgtgtgcactgagtgtagcttctttcacaccagaaagtctctcttagccttcattgctttcctatttttcgcttccatcatcagtctaagccttatattttactattcaaaaaaaggtcggaggtcatataag

SEQ ID NO: 15093 - DNA, 3036 bp, Artificial Sequence; identical to SEQ ID NO: 15092
  Description of Artificial Sequence: Synthetic coding sequence

SEQ ID NO: 15094 - DNA, 3036 bp, Artificial Sequence
  Description of Artificial Sequence: Synthetic coding sequence
atgccggcgtcagcccctccacgccgccctagaccgcctcctccgtcgctctcgctgcttctggtgctgctcggactgggcggacgccggctgcgggcggaaccgggggacggcgcccagacctgggcgcgcttcagcagaccgccagcacccgaagcggcagggctcttccaagggacttttccagacggctttctgtgggccgtcggatctgcagcctaccagactgagggaggctggcagcaacacggcaagggagcatcgatctgggatacctttactcatcacccactcgcgccgcccggtgactccaggaatgcgagcctgccactgggagctccatcgcctttgcagccggcaaccggggatgtggcctccgattcctacaacaacgtgttcagagataccgaggccctgcgggagctgggcgtgacgcactaccgcttcagcatctcatgggcgcgcgtgcttccgaacggtagcgccggagtgccgaatagagagggattgagatactacagacggcttctcgagcggctgagagagctgggcgtccaacctgtggtaactctctatcactgggatcttcctcaacggctgcaggatgcctacggaggatgggccaacagagcactcgccgatcacttccgagattacgccgaactgtgcttccggcatttcggaggacaggtgaagtactggatcactatcgataatccgtacgtggtggcatggcacggatacgccacgggaaggctggctcccggaattcgggggtccccgaggctcggctacctggtcgcacacaacctcctcctcgcccacgcgaaagtttggcatctttacaatacttccttccgccctacccagggtggacaggtgtccatcgctctgtccagccactggataaatcctcgccggatgactgatcattcaatcaaggaatgccagaagagtctggacttcgttttgggctggttcgccaaaccagtctttattgacggagattacccagagtccatgaagaacaacctgtcgtcaattttgccggacttcaccgagtcagaaaagaagttcatcaaagggaccgccgacttctttgcactgtgtttcggcccgactctgagtttccaactgcttgatccgcacatgaagtttcgacagctcgaatcccccaatctgagacagctgctgtcgtggatcgacctcgaattcaatcacccgcagatcttcatcgttgagaatggatggtttgtgtcaggaaccactaaacgtgatgatgcaaagtatatgtactatctgaagaagttcataatggagactctcaaggcaattaagctcgatggtgtcgacgtcatagggtacacggcctggagcctgatggacggtttcgaatggcatcggggatatagcatccgcaggggcctcttttacgtggactttctctcgcaggataagatgctgctgccgaagtcgagtgcgctgttctaccaaaaactgatcgaaaagaacggatttccaccactgcccgagaaccagccgctggagggaactttcccgtgcgacttcgcctggggtgtggtggataactacattcaagtggacaccaccttgtcccagttcacggacctgaacgtgtacttgtgggacgtgcatcactctaagcgcctgatcaaggtcgacggcgtcgttaccaaaaaacggaagtcctattgcgtggacttcgccgctatccaaccccagattgcactgcttcaagagatgcacgtgacccatttcagattcagccttgactgggcgctgatcctgccgcttgggaaccagtcacaagtgaatcataccatcttgcaatactacagatgtatggcctcggagttggtgcgggtgaacatcactcccgtcgtggcactgtggcaaccaatggcccccaaccaaggactgccacgcctcctggccagacagggagcttgggaaaatccttacaccgccctggctttcgcggaatatgcgagactgtgttttcaggaactgggtcaccacgtgaagctctggatcaccatgaacgaaccctatacccggaacatgacctacagcgctggccataacctcttgaaagcccatgccctcgcctggcatgtgtacaacgagaagtttcgtcatgcgcagaacggaaagatctccatcgccctgcaggcggactggattgaaccggcttgccccttctcgcaaaaggataaggaggtcgcggaacgggtgttggaattcgacattggatggcttgccgaaccaatcttcggctcaggagactacccctgggtaatgagagactggcttaatcagcgcaataactttctcctgccttacttcaccgaggatgagaagaaactgatccagggtacctttgactttctcgcactgtcccactatacgactatccttgtcgactcagaaaaagaggaccccatcaaatacaatgattacctggaagtccaggaaatgactgacatcacttggctcaactcgccgagtcaggtcgcggtggtgccatggggtctgcgcaaggttctgaactggctcaagtttaagtatggagatctgccgatgtacatcatctcgaacgggatcgacgatgggctgcacgcagaggacgaccagctcagagtgtactatatgcagaactacatcaatgaagccctcaaagcccatatcctggacgggatcaacctgtgcggatacttcgcttactccttcaatgaccgcactgcaccacgcttcggactgtaccgttacgctgcggaccaattcgagcctaaagcgtcaatgaagcactaccgcaagatcatcgactcgaacggctttccgggaccagaaaccctggaacgcttttgcccggaggaatttactgtgtgtactgaatgcagctttttccacaccaggaagtcgctcctggcgttcatcgctttccttttcttcgcatctattatctccctctcactgatcttctactacagcaagaaaggtaggcgcagctacaag

SEQ ID NO: 15095 - DNA, 3036 bp, Artificial Sequence; identical to SEQ ID NO: 15094
  Description of Artificial Sequence: Synthetic coding sequence

SEQ ID NO: 15096 - DNA, 3036 bp, Artificial Sequence
  Description of Artificial Sequence: Synthetic coding sequence
atgcccgcatcagctccaccccgacggccccgtcctcctccaccaagcttgtcactcctgctcgtgttattggggttgggcggacggcggcttagggctgagcccggtgatggggcccaaacatgggcaagattctcacgccctcccgctcccgaagccgcgggtctgttccagggaacctttcccgatggcttcttgtgggctgtgggctccgccgcctaccagacggagggaggctggcagcagcatggtaagggcgcatctatatgggacacattcactcatcatcccttagcaccccccggggatagcagaaatgccagccttccgcttggagcaccgagtccacttcagccagccactggagatgttgcatcggacagctacaataatgtgttcagggatacagaggccctccgcgaattaggcgtgactcactatcgcttttccatttcatgggccagggttttgcccaacggcagtgccggagtacccaacagggaggggcttcgctactacagaaggttgctcgaacggctgagggaattgggcgtgcagccggttgtgacactctatcactgggatctgcctcagaggctccaggatgcctacgggggctgggcaaatcgggctctcgcagaccattttagagattacgcagagctgtgttttagacacttcggtggacaagtgaagtactggataactattgataacccctatgtcgttgcctggcatgggtacgccacaggccgactcgctcccggcattcgcggctccccacgccttggctatcttgtggcacataacttgctgctagcacacgccaaagtgtggcacctctacaacacctctttcagaccgacacagggcgggcaggtctccatagcactatctagtcattggattaacccccgacgcatgacagaccactccataaaggagtgccagaagtcactagacttcgtcctgggttggttcgctaaacccgtcttcatcgacggcgactatcctgagtcaatgaagaataacctgagttctatcctacctgattttactgagtctgaaaaaaagtttatcaagggtaccgcagattttttcgctctctgctttgggcctaccttgtcgttccagctgctggatccccacatgaagttccgtcagctagagtcgcccaaccttcgtcagctgctgagctggattgatttggagtttaatcacccccagatcttcattgtggaaaatggatggtttgtgagcggtacaacaaaacgggatgatgccaagtatatgtattacctgaaaaaatttataatggagaccctcaaggctatcaagttagacggggtcgacgtgatcggatacaccgcgtggtccctaatggacggtttcgaatggcacagaggctatagtattaggagaggacttttttacgtggactttcttagccaggataaaatgctcttgcccaaatctagtgctttgttttatcagaagttaatcgagaagaacgggttcccaccactccccgaaaaccaacctctggagggcaccttcccatgcgacttcgcatggggagtggtcgataactatatccaggttgacactacactcagccagtttacagatttgaacgtttatctgtgggatgtacaccatagtaaaagactgatcaaagtggacggcgtggtgaccaaaaaaaggaaatcttattgtgtggacttcgcagcaattcaaccacaaattgctctccttcaggaaatgcacgttactcacttccgattttcactggactgggcactgatcctcccactggggaaccagtcccaggtgaaccacaccatccttcagtactaccgatgtatggcgagcgagttggttagggtgaatatcacccccgttgtggctttatggcagcctatggcccctaaccaaggcctgcctagactcctcgctcgccaaggcgcttgggaaaacccttacaccgcattggcctttgccgagtacgctcggctgtgcttccaagagctgggacaccacgtgaagctctggataacaatgaatgaaccttatacacgaaacatgacatatagcgccggccataatttgttgaaagcccacgccctggcgtggcacgtctataacgagaaattccggcacgcacagaatggtaagattagcatcgcactgcaggccgattggatcgagccagcttgtcccttcagtcagaaggacaaggaggtggcagagagggttctggaatttgacatagggtggcttgctgaaccgattttcggatcaggggactacccatgggtgatgagagactggctgaatcagcgcaataactttttgctcccctacttcacagaagatgaaaagaagctgatccaaggaacgtttgattttttggcactgagtcattacacgacgatcctagtcgactcagagaaggaagatcctataaagtataacgactacttggaagtacaggagatgacagatatcacatggttaaactcccccagccaagtcgctgtggttccttgggggttgcggaaagtgctcaactggctgaaattcaaatatggcgacttgcccatgtacattatcagtaatgggatcgacgacggcctccacgcagaggatgaccagcttcgggtctactacatgcaaaactatattaatgaagctctcaaggctcacattctcgacggtattaacctttgtggatattttgcctactccttcaatgataggacagctcccaggttcggtttgtatcgatacgcagcggaccagttcgagccaaaagcaagtatgaaacattatcggaagattatcgactccaatggcttcccgggccccgagaccttggaacgtttctgccccgaggagttcactgtgtgtacagagtgttctttttttcacacacgcaagtcgctgctcgcattcattgccttccttttcttcgcctcaataataagcttgagtctgatcttctattattcaaagaaaggacgtcgctcttacaaa

SEQ ID NO: 15097 - DNA, 3036 bp, Artificial Sequence; identical to SEQ ID NO: 15096
  Description of Artificial Sequence: Synthetic coding sequence

SEQ ID NO: 15098 - DNA, 3036 bp, Artificial Sequence
  Description of Artificial Sequence: Synthetic coding sequence
atgccagccagcgcccccccgcggagacctcgcccccctcctccctccctgagtctactcttggtcctgttaggtttgggaggccggcgactgcgagcagagccaggcgatggtgctcagacctgggcacgctttagcaggccccccgccccagaggccgccggcttgttccaggggacctttccggatggttttctttgggctgtgggttcggccgcctatcaaacagaaggcgggtggcagcaacatggaaagggcgcatccatttgggatacatttacccaccatcccttagccccacccggcgattccagaaatgcaagccttcctctgggcgcgccgtcacctctgcagcctgcaaccggcgatgtcgctagcgattcttataataatgtgttccgagataccgaggccctaagggaactcggcgtgacacattatcgattcagtatttcatgggccagagtcctcccaaatgggagcgcaggtgtgccgaatcgagagggactgcggtactatcgaagactattagagaggctacgggaactgggcgttcagcccgtggttacgctgtatcactgggatttgccacagagactgcaggatgcctacgggggttgggctaatcgagcgctggccgaccatttccgggattacgctgagctctgctttagacactttgggggacaagttaaatactggattacaatcgacaacccttacgtcgtagcttggcatggatatgccaccggaagactggccccaggaatcaggggatcccccagactaggctacctggtggcccacaacttgttactggcgcatgccaaagtgtggcatctttataacacaagcttccgtcctacacaggggggacaggtctcaattgctctgagctcccactggatcaacccccgccgcatgaccgaccatagcataaaagagtgccaaaagtccctggatttcgtactgggatggtttgccaagccagtattcattgatggcgattatccggaatcgatgaaaaacaacctgagttcaattctgcctgatttcaccgaatccgaaaagaagttcatcaagggcacagcagacttttttgcactgtgcttcggccctacactgtctttccagctcttagacccacatatgaagttcaggcagcttgagtcacctaacttgcggcagttactttcctggatcgaccttgaattcaatcacccccagatttttatagtcgaaaatgggtggtttgttagcggtaccaccaagagggacgacgcaaaatacatgtactacctcaaaaagttcatcatggaaacactgaaagccataaaactggacggagtagacgtaataggatacaccgcttggtctctcatggacgggttcgagtggcacaggggctattcaattcgtaggggactattttacgtcgacttcttaagtcaggataaaatgctactgcccaagtcatcagcgctgttctaccaaaaactcattgagaagaatggatttccaccgctgccggaaaaccagcctttggagggaactttcccttgcgactttgcctggggcgtggtcgataactatatacaagtggacacgacactctcccagttcacagacctcaatgtttatctatgggacgttcaccacagcaagagattaataaaggtggatggcgtggttactaagaaacgcaagtcctattgcgtggacttcgcggcgattcagccacagatcgccctacttcaggagatgcatgtgacccactttcgattttcactggactgggcgcttatcctccctctgggcaatcagagccaggtcaatcataccattcttcagtattatcggtgtatggcctccgagcttgtcagagtgaatatcacgcccgtcgtggcgctctggcagccaatggcgccaaatcaggggctacctcgccttctcgctagacagggtgcatgggaaaatccatatacagcgttggccttcgctgaatacgcacgtctatgcttccaagagctggggcatcatgtgaagctatggatcacaatgaacgagccatataccaggaatatgacttacagtgccgggcacaatctccttaaggcccatgctttagcctggcacgtgtacaatgaaaaatttcggcacgcccaaaatggcaagatctccatcgcactccaggccgactggatcgagcctgcgtgccccttttcacagaaggacaaggaagtcgctgagagggtgctcgagtttgacataggctggctggccgaacccatattcggatccggcgattatccatgggtgatgcgagactggctgaatcaaaggaacaattttttattgccctacttcaccgaggacgaaaaaaaactgattcaggggacgttcgactttcttgcactgtcacattatacgaccatcctggtggactccgagaaggaggatccaatcaaatacaacgactacctagaggtccaggaaatgactgacattacctggcttaattccccaagtcaggtcgcggtggtgccttggggactgcgcaaagtgctgaattggttgaaattcaaatacggcgacctgccaatgtacatcatctcaaacggcattgacgacggcctgcatgctgaggatgaccaactgagagtgtattacatgcaaaactatattaatgaggcactcaaagcccacatcctggacggcattaacctgtgcggctacttcgcatacagttttaatgaccgaactgcacctcggttcggcctgtaccgctatgccgccgaccagttcgagcccaaggcttccatgaagcattataggaaaattatcgacagtaacggtttccctggccccgagaccctggagcgtttctgtccagaggagtttaccgtgtgcaccgagtgttcatttttccatacccgcaaatccttactcgccttcatcgcgttcctcttctttgcttctataatctctttgtcacttatcttctattatagtaagaaaggccgccggtcatataaa

SEQ ID NO: 15099 - DNA, 3036 bp, Artificial Sequence; identical to SEQ ID NO: 15098
  Description of Artificial Sequence: Synthetic coding sequence

SEQ ID NO: 15100 - DNA, 3036 bp, Artificial Sequence
  Description of Artificial Sequence: Synthetic coding sequence
atgcctgcgtccgcgccaccgcgcaggcctcgcccgccgcccccttccctgtccctgctattggtgttactgggcctaggcgggaggcggctgagggctgagcctggtgacggggcccagacatgggccaggttcagcaggcccccagctcccgaggcggctgggctttttcaaggtacctttcctgatggattcttgtgggcggtcgggagtgcagcctaccagactgagggcggctggcagcagcacggaaaaggcgccagcatctgggacacattcacgcaccatcctctagcgccccccggtgactcaagaaacgcgagcctgcctttgggcgcccccagccctttacagccagcaaccggcgatgtggccagtgacagttacaacaacgtattccgggatacggaagcccttcgtgaactgggcgtgacccattatcgctttagtatcagttgggcacgggtactgcctaatggctctgctggcgttccaaatcgggagggccttaggtactatcggaggctcctggaacgactccgggaactcggcgtgcagccggtggtgactctataccactgggatctcccccagaggctgcaagatgcttacggagggtgggcgaacagggccctggccgatcactttcgagattatgccgaactgtgtttccgccacttcggggggcaagtgaaatactggatcaccattgataacccttacgtcgtggcttggcacggctatgcaacgggcaggttggcccccggaattcggggatctccccgcctgggctatttggtggcacacaacctgctcttggctcatgcaaaggtgtggcatctctataacacatccttcaggccaacccaggggggccaggtgagtatcgctttgtctagtcattggataaacccacgccgtatgactgatcacagcataaaagagtgccagaaaagccttgatttcgtgttaggttggttcgccaagcctgtgttcattgatggcgattatcctgaaagcatgaagaacaatttatcctcaatcctgcctgacttcaccgagagtgagaagaagttcatcaaaggcactgccgatttcttcgcactgtgtttcggacctaccttatcatttcaactcttggaccctcacatgaaattcaggcagctggagtcccccaacctgcggcaacttctaagctggattgacctcgaattcaatcatccccagattttcatagtcgagaatggatggttcgtgagcggcactactaagcgggacgacgctaagtatatgtactacctgaagaagttcataatggagaccctaaaagccataaagcttgatggcgtggacgtcatcggttacaccgcctggtctcttatggacggattcgaatggcatagaggttacagcatcagaaggggcctattctacgtagactttctgtcccaggacaaaatgctgctccctaagtccagcgcgttattctaccagaagttaattgaaaagaatgggttcccacctttgcctgaaaaccagcctctggagggaacttttccatgtgactttgcttggggagtggtggacaactacatacaggtggatacgactctgtctcaatttaccgatcttaatgtgtatttgtgggacgtgcaccatagtaaaagattaataaaggttgatggggtcgtaactaagaagcgcaaatcatattgtgtggacttcgccgccatccaaccacagattgccctcctacaagagatgcatgtgacccacttcaggtttagtctggactgggcgctgatactccctctcggcaatcaaagccaggtgaatcatacaatcctgcagtactatcgctgcatggcaagcgagctggtaagggtgaatatcacccctgttgtggcgctctggcagcccatggctccaaaccagggactcccccgattgctcgctcgacagggagcatgggaaaacccctatactgctctagcattcgccgaatacgcgaggttgtgtttccaggagctgggacatcacgtgaagctgtggatcacaatgaatgaaccctacacccggaatatgacatattcagccgggcacaatctcttgaaagctcatgccctggcatggcatgtatacaacgagaagtttcggcatgcccagaatggtaaaattagtatcgcgctgcaagccgactggattgagcccgcctgcccattcagtcaaaaggacaaagaagtggcggaaagagtgcttgaattcgacattggatggttggcggagcccatcttcggtagtggagactatccttgggtaatgagagactggcttaatcagcgaaataactttctcctgccatacttcactgaggacgaaaaaaaactgatccagggaacatttgactttcttgcactgagccattacactaccatattagtcgactccgagaaagaggaccccattaaatataacgattatctcgaagttcaggagatgaccgatatcacctggctgaactccccgtctcaggtggcagtggtgccttggggtctccgaaaggtcctaaattggctgaagttcaagtacggggacttacccatgtatatcataagtaatggaatcgatgatggactgcacgcagaagacgatcaacttcgggtatactatatgcagaactacatcaatgaggctctcaaagcacatattttagatggtattaacctgtgtggctacttcgcttattcctttaacgacaggacagccccccggttcgggttgtataggtacgccgcggatcagttcgagcccaaagctagtatgaagcactatagaaagataatcgacagcaatggctttcctggtcctgagacgctggagcgattttgtccagaggaattcacagtttgcactgaatgtagcttttttcatactcggaaatcgcttctagcgttcatcgcgttcctcttcttcgcaagcattatttctttgtctttgatcttctactatagcaagaagggtaggcgcagctacaaa

SEQ ID NO: 15101 - DNA, 3036 bp, Artificial Sequence; identical to SEQ ID NO: 15100
  Description of Artificial Sequence: Synthetic coding sequence

SEQ ID NO: 15102 - DNA, 3036 bp, Artificial Sequence
  Description of Artificial Sequence: Synthetic coding sequence
atgcccgcgtctgctcccccgagacgtcccaggcctcctccacctagtttgagtctgcttctggtccttctgggccttggtggtcgaaggctgagggctgaaccaggtgacggagctcagacgtgggcccgattttccaggcctccggcgcccgaagcagctggactctttcagggcacttttcccgacggatttctgtgggccgtgggctctgccgcataccaaactgaaggtggctggcagcagcacggcaaaggtgcttccatctgggatacgtttactcaccatccactggccccccccggtgactcacggaacgcttccttaccattgggggctccctcacccttgcagcctgcaacaggagatgtggcgtcggatagttacaacaacgtgttcagagacacggaggccctgcgggagcttggcgttacgcactatcgtttcagcatctcttgggcaagggtgctgcccaacggcagcgcgggcgtacccaatcgtgaaggtcttcgttattaccgtcgcctcctcgagcggttgagggagcttggtgtgcagcccgtggttacactttatcactgggacctccctcaacggctgcaggacgcttacggaggatgggctaaccgagccttagccgatcacttccgggactacgcagagctgtgctttcgccatttcggaggacaagtgaaatattggatcaccatagacaacccgtacgtggtagcatggcacgggtacgccactgggcggttggctccggggatccggggaagtcctagactagggtacctggtggcgcataacttgctgttggcacatgcgaaagtctggcacctgtacaacaccagctttcgccccactcaagggggccaggtttccatcgctctgtccagccactggattaacccgaggcgcatgacagaccactcaattaaagagtgccaaaagtcattagactttgtactcggatggttcgctaagcccgtgtttatagacggggactaccccgagagcatgaagaataatttaagcagtatcctacctgactttacagagagcgagaaaaaatttataaagggaacagccgactttttcgccctgtgcttcgggcctactctaagctttcagctgctcgatccacatatgaagtttaggcagctggagtcacccaatctgagacagctgctgtcctggattgatttggagtttaaccacccccaaatctttatcgtggaaaatggttggttcgtgagtggcactaccaaacgagacgatgctaagtacatgtattatctaaagaaatttatcatggagactttgaaggcaatcaagctcgacggcgtggatgtcattggctacaccgcctggagtctgatggacgggtttgaatggcataggggttacagcattcgcagaggcttgttttatgtggatttcctgtcacaggacaaaatgctcttgcccaagagctctgcactgttttaccaaaaactgatcgagaaaaacgggtttccccccttacccgagaatcagccactcgaaggaacatttccttgtgacttcgcctggggcgtggtcgataactacatacaagtggatactactctctcacagttcaccgatctgaacgtttatctgtgggatgttcatcattccaagagactaatcaaagtagatggcgtggtgacaaagaaacgcaagagctattgcgtcgatttcgcggccattcagccccagatcgccctgctccaggaaatgcacgttacccactttcgcttctcccttgattgggctctgatacttccccttggaaaccaatctcaggtgaaccacactatcctgcagtactacagatgtatggccagcgagctggtgcgtgtaaacattacacccgttgtggccctatggcagcctatggcccctaaccagggactgccacgcctgctggccaggcagggggcgtgggagaatccatataccgcattagctttcgccgaatatgctaggctgtgcttccaggagctgggacatcacgtcaagctctggataacaatgaatgagccgtacacccgaaacatgacctatagcgcaggccacaacctgctgaaagcacacgcgctcgcctggcatgtgtacaatgagaagtttcgccatgcccagaatgggaagattagtattgccctgcaagccgattggatagagccagcgtgccccttctctcaaaaggacaaagaggtggctgagcgcgtgcttgagttcgatatcggttggctcgccgagcctatattcgggtcaggggactatccatgggtgatgcgtgattggttgaatcagcggaacaactttttacttccttactttacagaggacgagaaaaagctgattcagggtacctttgacttccttgcattgtctcattacacgactatccttgtggattccgagaaagaggatccgatcaaatataatgattacctggaggtccaggagatgacagacataacatggctgaattcccccagccaggtggccgttgtgccctgggggctaaggaaagtgctgaactggttgaaattcaaatacggtgacctgccaatgtatataatctccaatggtattgacgacggcctccatgccgaggatgaccagctgcgggtgtactacatgcagaattacataaatgaagcgctcaaggctcatatcctggatggaataaacctctgcgggtactttgcttactccttcaatgatagaaccgcacctcggttcgggctctatcggtatgcagctgaccagttcgagcccaaagcaagcatgaagcactatcgcaagatcatcgatagcaatgggtttccgggtccagagactttggagcggttttgtccggaggaatttaccgtgtgtaccgagtgctcctttttccacacgcgcaagtctcttctggctttcatagcgttcttgtttttcgcgagcatcatttctctctcgcttattttctactattcgaagaagggccggaggagctacaaa

SEQ ID NO: 15103 - DNA, 3036 bp, Artificial Sequence; identical to SEQ ID NO: 15102
  Description of Artificial Sequence: Synthetic coding sequence

SEQ ID NO: 15104 - DNA, 3036 bp, Artificial Sequence
  Description of Artificial Sequence: Synthetic coding sequence
atgccagcctccgcgccccctcgccgaccacgacctccgccgccctccctgtctttattgctcgtcttactgggacttggtgggagacgactgcgagcggagcccggtgatggagcccagacttgggcccgattcagccgcccccccgctcccgaagcagccggcctgttccaaggcactttccccgacggattcctgtgggccgttggttcggcagcttatcagactgagggtggatggcagcaacatgggaagggggcttcaatttgggacacattcacccatcatcctctcgcgccaccaggtgatagcagaaacgccagtttgccgttgggggctccatctccgctgcaaccagcgactggcgatgttgcgagcgactcgtacaacaatgtattcagggacaccgaggcacttcgcgagctaggtgtcactcactatcgattctcaatctcatgggctagggtactgcctaacggcagcgccggggtgcccaacagggaaggcctccgatactacagacgtctgcttgaaaggctacgtgaactgggcgtgcagccagttgtgacattgtaccactgggatcttccgcagaggctgcaagatgcgtatggtggctgggccaatcgggctttagccgatcacttccgagattacgcagaattgtgtttccgacactttggtggtcaggtcaagtattggattactatcgacaatccctatgttgttgcgtggcatggatacgccaccgggcgtttggcacctgggatccggggcagtccgcggcttggctacctggtggcgcacaatttgttgttggcacacgcaaaggtttggcacctgtacaacacgtcatttcgaccaacacaggggggtcaggtatccattgccttgtcaagccattggattaatccacgccggatgacggatcattccataaaggaatgtcagaagagcttggattttgttctcggctggttcgccaagcccgttttcatagacggtgattaccccgagtccatgaagaataacctatcaagcatactccctgatttcactgaatcggaaaagaagttcatcaagggcacggcggatttctttgcgctttgtttcggaccgaccttatcatttcaactgctggatcctcacatgaaattcagacagctggagtctcccaatctccggcaactcctttcctggattgacctagagtttaaccatcctcaaatctttatcgtggaaaacggctggttcgtgtctggaaccaccaaacgggatgatgctaaatacatgtactacctgaagaaattcatcatggagacgctgaaggccatcaagcttgatggcgtcgatgtgatcggctatacagcttggtctctcatggatggctttgagtggcatcgcggctattcaattcgtcggggtcttttctacgtggactttctttcacaagacaaaatgctgcttcctaaatcctctgccttgttttatcaaaaactgatcgagaagaacggctttccaccccttcccgaaaatcaacctctcgaaggaacgtttccatgcgacttcgcatggggggtcgttgacaattatattcaagtcgacaccacactctcgcaattcaccgatctcaatgtttatctttgggatgtccatcactctaagcggctcatcaaagttgacggagtggttaccaagaaacgcaagagttactgtgttgatttcgctgccatccaaccgcagatcgcactcttacaggaaatgcacgtcactcactttagattcagcttggattgggcattgattttgccgcttgggaatcagtcccaggtcaaccataccattcttcaatattaccgttgcatggcgtccgaattggtccgggtgaacatcactccggtggtcgctctgtggcagcccatggcgcccaatcaaggcctcccaagactactagcccgacaaggcgcctgggagaacccgtacacggctcttgccttcgctgagtacgccaggttgtgcttccaggaactcggacatcacgtgaaactgtggattactatgaatgagccttacacccggaacatgacgtattctgccggccataatctgctcaaagcccatgctctggcgtggcatgtctacaacgaaaagttccgccatgcacaaaatggaaagatctccattgctctgcaggctgattggattgaacccgcatgcccatttagtcagaaagataaggaggttgcggaaagggtcctggaattcgatattggttggttggcagagccgatcttcggttccggagattatccgtgggtgatgcgggattggctgaaccaacgtaacaatttcctgttaccatatttcacggaagatgaaaagaagctaattcaaggcacgtttgattttcttgcgttgtcacactatacaaccattctggtggattcagaaaaggaagaccctatcaagtacaacgactatctggaggttcaagagatgaccgatattacgtggttgaatagtccaagccaagtcgcagttgtgccttgggggctccgaaaggtccttaattggctcaaattcaagtatggggatctgcctatgtacattatttcgaacggtattgatgacggtctgcatgccgaagatgaccagcttcgggtctactacatgcagaactatataaatgaggcccttaaagcacatatcttagatggcataaacctttgcggatacttcgcctatagctttaacgaccgaaccgctccacggttcgggctgtacaggtacgccgcagaccaatttgaacctaaggcttccatgaagcactataggaagatcatcgattctaacggctttccgggacctgaaaccctcgagaggttctgccccgaggaattcaccgtgtgcaccgagtgttccttctttcatactaggaagtcccttctcgcattcatcgcttttctttttttcgcgagtatcatctccctgtcactgatcttctactactcgaaaaaggggcgccgcagctataag

SEQ ID NO: 15105 - DNA, 3036 bp, Artificial Sequence; identical to SEQ ID NO: 15104
  Description of Artificial Sequence: Synthetic coding sequence

SEQ ID NO: 15106 - DNA, 3036 bp, Artificial Sequence
  Description of Artificial Sequence: Synthetic coding sequence
atgccggcctcggcgccgccaagacgcccgcgccctccgccgccttcactttccctgctcttggtgctgttgggactgggaggccggcgattgcgcgccgaaccgggagacggtgcacagacctgggctcgcttcagcagacctcccgccccggaagcagcaggactctttcaaggaactttccccgacggctttctgtgggctgtgggatcggccgcgtaccagaccgagggcggctggcaacagcacgggaaaggagcctcaatctgggacacctttacccatcatcccctggcgccaccgggtgatagccgcaacgcgtcgctgccactcggagccccctcgccactgcagcctgccactggagatgtagcaagtgattcctacaacaacgtgttccgagacaccgaggctctccgcgagctgggcgtcactcattatagattctccatctcgtgggcccgtgttctcccgaacggctcggccggtgtgccaaacagagaaggactgagatactaccggagactcctggaaaggctgcgggagctgggagtgcagccagtggtgaccctctaccactgggatcttccccagcggctccaggacgcatacggtggatgggcgaaccgcgccctggcagaccacttcagggactacgctgaattgtgcttccggcatttcggagggcaagtgaagtattggatcaccattgacaatccctacgtggtcgcttggcacgggtacgcaaccggacggctggcgccggggatccgtggctcaccaaggcttgggtacctggtcgcccacaatctgctgctcgcccacgccaaggtctggcatctttacaacacctcctttcggccgacccagggtggacaggtgtctatcgctctctcgtcgcactggatcaaccctcggcgcatgacggatcattcaatcaaggagtgccagaagtcccttgatttcgtgctgggatggttcgccaaacctgtgttcatcgacggtgattacccagaatcgatgaagaataacctgtcctcgatcctgccagacttcacggagtcggagaagaagtttattaaggggaccgcagacttttttgccttgtgcttcggacccactctcagcttccaactcctggacccgcacatgaagttccgccaactggaaagcccgaacctccggcagctgttgtcctggatcgatctcgaattcaatcatccgcaaatcttcatcgtggaaaacggttggttcgtgtcaggtactactaaacgcgacgatgccaaatacatgtactatctgaaaaagttcatcatggaaactctcaaggcaatcaagctggacggcgtcgacgtgatcgggtacactgcgtggagccttatggacggattcgagtggcatagaggctatagcatccgcaggggtctgttctacgtcgactttctgtcccaggacaagatgctgctccctaaaagctcagcactcttttaccaaaaactcatcgagaagaatggcttcccgccgcttcctgagaatcagccactcgagggaaccttcccgtgcgattttgcttggggagtcgtcgacaattacatacaagtggacactactctctcccaatttaccgaccttaatgtgtacttgtgggatgtgcatcacagcaagcggctgatcaaggtcgacggcgttgtgactaagaagagaaagtcctactgtgtggatttcgccgccatccaaccgcagatcgcgctgctgcaagagatgcatgtgacccacttccggttctcgctggattgggcgctcatcttgcctctcggaaaccagagccaggtcaatcacactatcctgcaatactacaggtgcatggcctccgagttggtgcgggtcaacatcacgccagtggtcgcactctggcagccaatggccccgaatcagggcctgccgcgcctgctggctagacagggcgcctgggagaatccatacactgctctggcttttgccgagtacgcccgcctctgtttccaggaactgggccaccacgtgaaactgtggattactatgaacgaaccttacaccagaaacatgacgtacagcgctgggcacaacctgctgaaggcccacgcccttgcatggcacgtctacaatgagaagttccggcatgcccagaacgggaaaatctctattgcgctgcaagcggactggatcgaaccagcgtgccccttcagccaaaaagataaggaagttgccgaacgagttctggaattcgatatcggatggctcgcggaaccaatcttcggcagcggagactacccttgggtgatgagagactggctgaatcagagaaacaacttcctgctgccgtacttcactgaggacgagaaaaaacttattcagggaacgtttgactttctcgccttgtcccattacaccaccatcctcgtggattcagaaaaggaggacccgatcaagtacaacgactacctggaagtgcaagaaatgactgatatcacctggctcaatagcccttcacaggtggcagtcgtcccgtggggactgcgcaaagtgctgaactggctcaaattcaagtacggagatctgccgatgtacataatctcgaacggaattgacgacggactgcacgcggaagatgaccagctccgggtgtattacatgcagaactacatcaatgaggccctgaaggcacatatcttggatggcattaacctttgtggatacttcgcgtactcattcaacgatcgcaccgcgccgcggttcggactctacaggtacgctgctgaccagttcgaacccaaggcctccatgaagcactaccgcaaaattatcgattccaacgggttcccgggaccggaaactctggagcgcttctgcccagaagaattcaccgtgtgcaccgaatgctcattcttccacactcggaagtcgctgctggcatttatcgcgtttttgttcttcgcgtccattatctccctttcgctgatcttttactactcaaagaagggacgcaggtcgtataag

SEQ ID NO: 15107 - DNA, 3036 bp, Artificial Sequence; identical to SEQ ID NO: 15106
  Description of Artificial Sequence: Synthetic coding sequence

SEQ ID NO: 15108 - DNA, 3036 bp, Artificial Sequence
  Description of Artificial Sequence: Synthetic coding sequence
atgccggcttccgcaccaccgcggcggccgcggcctcccccgccatcactgtcgcttcttctggtgctgctggggcttggaggacggagactgcgggctgagccaggcgacggagcacaaacctgggcgagattttccagacccccagctccggaggctgccgggctgtttcaggggactttccccgacggcttcctctgggctgtggggagcgcggcgtaccagacggaaggaggatggcagcagcatggaaaaggcgcgtccatctgggacaccttcacccaccaccccctcgccccgccgggagattcccgcaacgccagcctgccactcggggcgccgtcaccgctgcagcctgcaaccggagatgttgccagcgattcatacaacaatgtgttccgggacactgaagcactgagagaacttggcgtgacgcactatcgattctccatctcttgggcccgcgtgctcccgaacgggtcggcgggcgtgccaaaccgggaaggcctgcgctactacaggaggctgttggaacggctcagggagctgggtgtgcagccggttgtcacgctgtaccactgggacctgcctcaacgccttcaagatgcatacggaggctgggctaatcgggccctggccgaccatttccgagactatgctgaactttgtttccgccacttcggaggtcaagttaagtactggattaccattgacaacccgtatgtcgtggcctggcacggatacgccaccggacgtctggctccaggcatccgaggaagcccaagactgggatacctggtggcgcacaacttgctcctggcgcacgcgaaggtctggcacctgtacaatacttcgttccgccctactcagggtggccaggtgtcgattgctctctcctcccattggatcaaccctcgccgcatgactgaccattccatcaaggaatgccaaaagtccctcgatttcgtgctgggatggttcgccaaacccgtgttcatcgatggagattacccggaatcgatgaagaataacctttcttccattctcccggactttactgagagcgaaaagaaattcataaagggtaccgcggatttcttcgccctgtgtttcgggcccactctctcctttcagctgctggatcctcacatgaaattccggcagctcgagtcacctaatttgcgccaactgctgagctggatcgacttggagtttaaccacccccagatcttcatcgtcgaaaacggctggtttgtttcaggtactacgaagagggacgatgcaaaatacatgtactaccttaagaaattcatcatggaaaccctcaaggcaatcaagctggacggtgtggacgtcatcggatatactgcctggtcgcttatggatggcttcgagtggcatcgcggatactcaatccggcggggactgttttacgtcgacttcctgtcgcaggacaagatgctcttgcctaagtcctccgccttgttctaccaaaagctgatcgagaagaatgggttcccgccactcccggagaaccagccactcgaaggaactttcccgtgcgacttcgcttggggagtggttgataactacatacaagtggacaccactttgagccaattcaccgacctgaatgtgtacctctgggacgtgcaccatagcaagagactgatcaaggtggacggcgtcgtgaccaagaaacgcaagtcgtactgcgtcgacttcgctgccattcaaccccaaatcgcactcctccaagagatgcacgtgacccatttcaggttctccctggactgggcgcttattctgccgttggggaaccaaagccaagttaaccatactatcctccagtattacaggtgcatggcgtcggagctggtccgggtgaacatcactcctgtcgtggccctgtggcagccaatggccccgaaccagggactgcctaggcttctggctagacagggcgcgtgggaaaatccatacaccgccctggcttttgcggagtacgcgcgtctttgctttcaagaactcggacaccacgtcaaactgtggataaccatgaacgaaccatacacccgaaacatgacctactcagccggacacaacctcctcaaggcacacgcgcttgcatggcacgtctacaatgagaaatttcgccatgcccaaaatggaaagatttctatcgcgttgcaggcagattggattgaacccgcttgtcccttttctcagaaagacaaggaggtggcggagcgagtgctggaattcgatattggctggctggcggagcccatcttcggtagcggtgactacccttgggtgatgcgcgactggctgaatcagcgcaataacttcctgctgccttacttcaccgaagatgaaaagaaactgatccagggtacttttgacttccttgccctcagccattacacgactatcctcgtggactccgagaaagaagatccgatcaagtacaatgattatcttgaagtccaggaaatgaccgatatcacctggctcaattcaccgtcgcaggtggccgtggtgccttggggactgcggaaagtgctgaactggctcaagttcaagtacggggatctgccgatgtacattatcagcaacggaatcgacgatgggctgcatgcagaggacgatcagctgcgggtttactacatgcagaactacatcaatgaggcgctgaaggcccacatcctggacggtatcaacctctgcggctacttcgcatactcgtttaatgaccgcaccgcaccacggtttgggctctacagatacgcagccgatcaattcgagcctaaggccagcatgaaacattacagaaagatcatcgattcgaacgggtttcctggcccggaaaccttggaaaggttttgcccggaggaattcactgtctgcacggaatgctcattcttccatacccgaaagtccctgttggcattcatcgcgttcctcttttttgccagcatcatctctttgtcactgattttctactactcaaaaaagggccggcggtcgtacaag

SEQ ID NO: 15109 - DNA, 3036 bp, Artificial Sequence; identical to SEQ ID NO: 15108
  Description of Artificial Sequence: Synthetic coding sequence

SEQ ID NO: 15110 - DNA, 3036 bp, Artificial Sequence
  Description of Artificial Sequence: Synthetic coding sequence
atgcccgcatccgcaccccccagacggcccagaccaccacctccaagtctttctcttctgctggtcctgcttggcctcggagggcgcagacttcgcgcagagcctggggatggggcacagacttgggctagattctctcgaccaccggctcccgaggctgccgggctgttccagggtacgttccccgatggcttcctgtgggccgtaggatcagcggcctatcagacagagggggggtggcagcagcacggcaagggagcctccatatgggataccttcacacaccaccccctggctccgcccggggattcacgaaatgcttcgctacctttgggcgccccctcgccactgcagcctgccaccggcgatgtggcttcagattcctataacaatgtgttcagagataccgaggccctgcgggagctcggagtcacccactaccgcttttccatcagttgggccagagttctgcctaatgggagcgcaggcgtgccgaatagagaaggcttgaggtattaccgtcggctgctcgagcgcctccgcgagctgggagtgcagccagttgtgaccctctaccattgggatctgcctcagcgcctgcaggatgcttacggcgggtgggcgaacagggccttggccgatcacttccgcgactacgctgagctgtgttttagacacttcggcggccaagtgaagtactggatcacaatcgataacccatacgtagtagcctggcatggttacgcaacgggtaggctggcacccggaatccgcggcagtcctcgcctggggtacctggtggcccacaaccttctcttagcccacgccaaagtctggcatctgtataacaccagcttccggcctacacaggggggccaggtgtccattgctctgagtagtcactggataaaccctagacggatgaccgatcactctattaaagagtgtcaaaaatctttagatttcgtgctaggatggttcgcaaagccggtctttatcgatggggattatcctgaaagtatgaagaataatctgagctcaatcctgcctgactttacggagagcgagaagaagttcatcaagggcactgctgacttcttcgctctgtgtttcggcccgaccttatcatttcagcttttagatcctcacatgaagttcagacaattggagtcacccaatctccgacagcttttgagctggatcgatctggagttcaatcacccccagatcttcattgtagaaaatggctggtttgtgtctgggactactaagcgtgatgacgctaagtacatgtactacctcaaaaagttcatcatggagacgctcaaagccatcaagctggatggcgtagacgtgattggctacaccgcctggagcctcatggatggatttgaatggcatcggggctactctattcgcagaggactgttttacgtggatttccttagccaggataaaatgctactaccaaagtctagcgccttattctaccagaaactgatcgagaaaaacgggttcccgcccctgcccgagaaccagcccctggaaggaacatttccttgtgatttcgcgtggggagttgtggataactacattcaagttgatacaacactgtcgcaattcacggatctcaacgtgtacctatgggatgtgcaccacagtaagcgcctgattaaggtggatggcgtagtgactaaaaagagaaagtcttactgcgtggactttgccgcgattcaacctcagattgccttgctgcaggaaatgcacgtcacccattttcgctttagcttagattgggctctcatactgcctcttgggaaccagtcccaagtgaaccacacaatattacagtactataggtgcatggcgtctgaacttgtgagggtcaacatcacacccgtggtggccctgtggcaacctatggctcctaaccaggggctcccaaggctgctggcgcgccagggcgcttgggaaaatccatacaccgcccttgcctttgcagagtacgctagattgtgcttccaggaactgggtcaccacgtaaagctctggatcacaatgaacgagccttatactcgcaatatgacgtactctgctggacacaacctgttaaaggcacatgccctggcgtggcatgtgtacaacgagaagttccgacacgcccagaatggaaaaatttccatcgccctacaggctgactggatcgagcctgcatgtccttttagccagaaagataaggaggtggcggagagagtgttagagttcgacatcgggtggctcgcggagcctattttcgggagcggcgattacccatgggtcatgcgggattggttgaatcagcggaacaatttcctgctaccttacttcacagaagatgagaaaaagttaatccaaggtacatttgactttctggccctgagccactatactaccattcttgtggatagcgaaaaggaggacccaataaagtacaatgactatctcgaagttcaagagatgaccgacatcacttggctcaactctcctagccaggtggccgtggttccgtgggggttgcgcaaagtcctgaattggctcaagttcaaatacggagacctcccaatgtacattatttctaacgggatcgatgatggattgcacgccgaggacgaccagctgcgtgtatactacatgcagaactacatcaatgaggccctcaaggcacacatcctggatggcatcaacctgtgcggatattttgcttactcctttaacgaccgcacagccccaagatttgggctgtacagatatgctgcagatcaatttgaaccaaaggccagcatgaaacattatagaaaaatcattgattcaaatggatttcctggcccagagactctagagcgcttttgtccggaggaattcacagtgtgtaccgagtgttccttcttccacacccgaaaatctttattggcattcatagcttttctattcttcgcctcgatcatctcattgtcactgatcttttactactcaaagaagggtcgtaggtcctacaaa

SEQ ID NO: 15111 - DNA, 3036 bp, Artificial Sequence; identical to SEQ ID NO: 15110
  Description of Artificial Sequence: Synthetic coding sequence

SEQ ID NO: 15112 - DNA, 3036 bp, Artificial Sequence
  Description of Artificial Sequence: Synthetic coding sequence
atgccggcatcagcgccgccacgccgcccgcggcctcccccgccctcgctctccctcctgctcgtcctgctcggactgggagggcgcagattgcgcgcggaaccaggagacggagctcaaacttgggctcggttctcgcgcccaccagccccggaggcagctggacttttccagggtactttcccggacggtttcctgtgggccgtggggagcgccgcctaccaaactgaaggaggatggcaacagcacggaaaaggcgcgtcgatctgggatactttcacccatcaccccctggcaccaccaggcgactcccgaaatgctagcctgccgctgggtgcaccctcccctcttcaaccagctactggagacgtggcaagcgactcctacaacaacgtgttcagggacaccgaagccctgagagagctgggtgtgactcattaccgcttttctatctcatgggcgcgcgtcctgcctaatggctcagcaggagtacctaaccgggaaggactgcggtactaccgcaggctcctggaacgtctgcgggagctcggagtgcagccagtggtgactctgtaccactgggatctgccgcaacggctccaggatgcttacggaggatgggctaaccgggccctggcggatcacttccgcgactatgccgaactctgcttcaggcacttcgggggtcaggtgaagtactggatcacgatcgataacccgtacgtggtggcctggcatggttacgccaccgggcgcctcgcccctggaattcggggatcgccacggctgggttacctcgtggcccataacttgttgttggcgcatgcaaaggtgtggcatttgtacaacacgtccttccgcccaacccagggaggacaagtatccatcgccctcagctcacattggatcaacccaagacgaatgactgaccattcgatcaaggagtgccaaaagagcttggactttgtgttgggatggtttgccaagccagtgttcatagacggcgactacccagaatctatgaaaaacaatctgtcatccatcttgccagacttcaccgagtctgaaaagaagtttatcaaaggaactgctgacttctttgcgttgtgttttggcccgactttgagcttccagctgcttgatcctcatatgaagttcagacagttggaatcacccaacctgagacagctgctcagctggattgacctggagtttaaccacccgcagatcttcatcgtggaaaatggatggttcgtgtcggggaccaccaagcgcgacgacgcaaagtatatgtattacctgaagaagttcatcatggagactctcaaagccatcaagctggatggcgtggacgtcatcggatataccgcgtggtcgctcatggatggattcgaatggcatagaggatactccatccggcgcggcctgttctacgtcgattttctgtcgcaagataagatgcttcttcctaaatcgagcgcactgttctaccaaaagctgatcgagaaaaacggattcccgccgctgcctgagaaccagccgctcgagggaaccttcccgtgcgattttgcctggggagtggtcgacaactatatccaagtcgacaccactctctcccagttcacggatttgaatgtttacctgtgggacgtgcaccacagcaagcgtctcatcaaggtcgacggtgtcgtcacgaagaaacgcaagtcatactgcgtggacttcgcggccatccaaccgcaaatcgccttgctgcaggaaatgcacgtcactcattttcggtttagcttggattgggccttgatcctgccgttggggaaccagtcacaggtgaaccacaccatcttgcagtattaccggtgtatggcctcagagctcgtcagagtgaacattaccccggttgtggccctctggcaaccgatggctcctaaccaaggcctgcctcggctcctcgctagacagggtgcctgggagaatccctacaccgctttggcattcgcagagtacgccagactctgtttccaggaattgggacaccacgtgaagctctggataactatgaacgagccttacactaggaacatgacctactcggcggggcataatctgcttaaggcccacgcgctggcgtggcacgtctacaatgaaaagttcagacacgcccagaatggcaagatctcgattgcactgcaggcggattggatcgaaccggcttgcccattctcccagaaggacaaggaagtggcggaacgagtgctggagtttgacatcggctggctcgccgaaccgatcttcggcagcggggactacccatgggttatgcgggattggcttaatcagcgcaacaacttccttctgccctacttcactgaggatgagaaaaaactcatccaggggaccttcgactttctggccttgtcccactacactaccatcttggtcgacagtgaaaaagaagatccgatcaagtacaatgactacttggaggtgcaggaaatgaccgacatcacctggcttaactcgccttcccaagtggctgtagtgccttggggcctgaggaaagtgctgaattggctcaagttcaagtacggagacttgccgatgtacatcatctcaaacggcattgacgatggactgcacgctgaagatgaccagctccgcgtctactacatgcagaactacattaatgaggcgttgaaggcccatatcctggacggaatcaatctgtgcggttacttcgcctactcatttaacgacaggacggcgcctagattcggactctaccgttacgcggccgatcaattcgaacccaaggcgtcaatgaaacactaccgcaaaatcatcgattcgaatggtttccccggcccggaaaccctggagcgcttttgcccggaagaattcaccgtgtgcaccgaatgttcgttcttccacacgcggaagagcctcctcgcgttcattgcattcctgtttttcgccagcatcatctcgctgtctctgatcttttactattccaagaaggggcgccgatcatacaaa

SEQ ID NO: 15113 - DNA, 3036 bp, Artificial Sequence; identical to SEQ ID NO: 15112
  Description of Artificial Sequence: Synthetic coding sequence

SEQ ID NO: 15114 - DNA, 3036 bp, Artificial Sequence
  Description of Artificial Sequence: Synthetic coding sequence
atgccagcgtccgcaccgccaagaaggccacgacctccacctccgtctctgtcactgctcctggtgctcctgggactggggggcaggaggctgagagcagaaccaggggacggcgcccaaacctgggccaggttctcccgacctcctgctccggaagctgccggcctctttcaggggacctttcccgatggtttcttgtgggcagtggggtcagcagcctaccagacagaaggggggtggcagcagcatggcaagggtgcttccatctgggacacttttacacatcatcctctcgcccctccgggggacagcaggaacgcctctctcccgctgggcgctccctctcctctgcagcccgcgacaggggacgtggcatccgactcttacaacaatgtgtttcgtgatacggaggctctgcgcgagctgggagtgactcactacaggttcagcatatcctgggcacgggttctacctaacggatctgccggtgttcccaatagagaggggcttaggtactatcggaggctcctggaacgcctaagggagcttggagtgcagcccgttgtaaccctgtatcattgggatctgccccaaaggctccaggatgcatatgggggctgggcgaatcgcgccctcgccgaccatttcagggactatgctgagctctgtttcagacattttggagggcaagtaaagtactggatcaccatcgataacccgtacgttgtggcatggcacggatatgccacgggacgactggcccctgggattcgcgggagccctaggctgggttatctggtcgcgcataaccttctgctggcccatgcaaaggtgtggcatctctacaacactagtttcaggccgacacagggggggcaggttagtatcgctctatcttcccactggattaatcctcgaagaatgacggatcactccattaaggaatgccaaaagtctctggacttcgtcctcgggtggtttgctaagcctgtctttatagatggcgattaccccgagagtatgaagaataatcttagttctatactgccggattttaccgaatcggagaaaaagttcatcaaaggaactgcagacttctttgccctgtgttttgggcccacgctgtcttttcagctgctggatccccatatgaaatttagacagctcgagagccctaatcttcggcagctgctctcttggatcgatctggagttcaatcatccacagatcttcatcgtggaaaatggctggtttgtctctggcaccaccaagcgcgacgacgctaaatacatgtactacctcaagaaatttattatggaaacactcaaggctattaagctcgatggagtcgacgtgatcgggtacacagcctggtccctgatggatggattcgaatggcatagagggtattcaattcggagaggcttgttttatgtcgacttcctgagccaagataagatgttacttcccaagtctagcgccctgttctaccaaaaactcatcgagaagaacggttttcctcctctgccagaaaatcagcccctggaaggaacatttccttgtgactttgcctggggagtggtagataattatatccaggtcgataccacactctcccagttcaccgacctcaacgtgtacctttgggacgtacatcactctaaaaggctcattaaggtagatggtgtggtgacgaagaaaagaaaaagctactgtgtcgattttgcagcaatccagccacagatagcacttctgcaagaaatgcacgtcactcactttcgattttctcttgactgggccctcattctgcccctgggcaatcagtcccaggtcaatcataccattctacagtactaccgatgcatggcatctgagctggtgcgcgttaacataacaccagtggtggcactgtggcagcctatggcaccaaatcaagggctgccacggctcttggccagacaaggcgcgtgggagaatccttatacagctcttgcctttgcggagtatgcgcgactgtgtttccaggaactaggacaccacgtgaaattgtggatcacaatgaacgaaccttataccagaaatatgacatacagcgccgggcacaatttgctgaaggcgcacgcactggcttggcacgtctataatgaaaagtttaggcacgcccaaaacggaaagataagtatcgctctccaggcagactggatagaacctgcttgcccattttcacagaaagacaaagaagtggccgaaagggttttggagttcgacataggctggctagccgagccaatctttggctcgggggattacccatgggtcatgcgtgattggcttaatcagcggaacaactttctgctgccttatttcacagaagatgaaaaaaagttaatccaaggaacgtttgattttttagcactctcccactatacaacgattcttgtggatagcgaaaaagaggatccaatcaaatataacgactacctggaggtgcaggaaatgacagatatcacttggctgaactcgccctcccaagtagccgtggttccatggggactgcgcaaagtgctgaactggctcaaattcaaatacggcgacttgccaatgtacattatatcaaatggcatcgacgacggactccatgcagaggacgaccagctgagagtgtattatatgcagaattacattaacgaggcactgaaggcacatatcctcgatggaatcaatctttgtggttactttgcgtacagcttcaacgacagaacagctcctaggtttggtctttaccgttatgccgccgatcagtttgaacctaaggcctccatgaaacattaccgaaagatcatcgattcgaatggattcccaggccccgaaacccttgagcggttctgtccggaagagttcacagtgtgcaccgagtgctccttcttccacaccaggaaaagcctgctagccttcattgcctttttattctttgcttcaataatatccctctcgttaatcttctattactctaagaagggcagaaggtcctacaag

SEQ ID NO: 15115 - DNA, 3036 bp, Artificial Sequence; identical to SEQ ID NO: 15114
  Description of Artificial Sequence: Synthetic coding sequence

SEQ ID NO: 15116 - DNA, 3036 bp, Artificial Sequence
  Description of Artificial Sequence: Synthetic coding sequence
atgccagcttcagctcctccaagacgaccaagacccccgccaccatctctatcactgttgttggtcttgctaggcttaggaggacgaagattacgtgccgaaccaggtgatggagcccagacatgggctagattttcacgccccccagcacccgaagcagctggactgtttcaaggaacgttccctgatggtttcctatgggctgttggttctgctgcatatcaaactgagggaggatggcaacaacacggaaaaggtgcatcaatttgggatacgtttactcatcatccactcgctccaccaggagattcccgtaatgcaagcttacccttgggtgccccttcgccactccagccagcaaccggggacgttgcttccgattcttataataatgtctttcgtgatacggaagcgcttagagaacttggagttactcattacagattcagcataagctgggctagagttttgccgaacggtagtgctggagtgcctaatcgggagggtctaagatactaccgcagacttcttgaacgtcttcgtgagctaggagtccaacctgtggttactctctaccattgggatttgccacaacgtttgcaagatgcctacggaggatgggccaatcgcgctcttgctgatcactttagagattatgccgagctgtgcttccgccactttggagggcaagtaaaatactggatcacaattgataatccatatgtagttgcatggcacggttacgccactggacgtcttgccccgggaatccggggcagtccgcgtctcggctaccttgttgcgcataacctgctgctcgcccatgcgaaggtttggcacctttataacacttcgtttcgtccaactcaggggggacaagtcagtattgccctcagcagtcattggatcaatccacggcgcatgacagaccatagtatcaaggagtgtcaaaaatcacttgactttgttttgggctggtttgcgaagcccgtatttattgatggcgattatccagagtccatgaagaataatctatctagcatcctcccagatttcactgaatctgaaaaaaaatttattaaaggaactgcagactttttcgccctttgttttggaccgactctatcttttcaactgcttgatccacatatgaaatttcgacaactcgaatctccgaacttgaggcagcttctatcttggattgatctggaattcaatcatccacaaattttcatcgtcgagaatggatggtttgtcagcgggacaacgaagcgggatgatgccaagtatatgtattacctaaagaagttcattatggagacactgaaggcgatcaaactggacggagtcgacgtgataggatacacagcttggtcactaatggatggatttgaatggcacagaggttacagtatcagacgtggtctcttctatgttgacttcctttcccaagataagatgttgttgccaaagtcaagtgctcttttttaccaaaagcttattgaaaaaaacggcttcccaccacttccagagaaccaaccactggaggggacattcccttgcgattttgcctggggagttgttgataactacattcaagttgatacgaccctatcacagttcactgatttgaatgtgtatctttgggatgtgcatcactccaaacggcttattaaagtagacggcgttgttaccaagaaacgaaagagctattgtgtagactttgcagccattcagccacagattgccctgctgcaagagatgcacgttacgcacttccgtttctcgctcgactgggctctaatcctccctcttggaaaccagtcacaagttaatcatacaattttgcagtactatcgctgtatggccagtgaactggttcgcgtgaacattactcccgtggttgcattatggcaaccgatggctccgaaccaaggattaccaagactacttgcgagacagggagcgtgggaaaatccgtataccgcactcgctttcgctgagtatgctagattgtgtttccaagagttaggacatcatgttaaattatggattacaatgaatgaaccgtatactaggaacatgacttattctgctggccacaaccttttgaaggctcatgctttggcttggcatgtttacaatgaaaagttccgccacgctcaaaatggcaaaatttcaattgccctccaagccgattggattgaaccagcctgtccatttagtcaaaaagacaaggaagtagctgagagagtccttgagttcgacattggatggctcgcggaacctatctttggtagcggagattatccatgggttatgagagactggttgaatcaacggaacaatttcctccttccatattttacagaagatgaaaaaaaattgattcaaggaaccttcgattttcttgcgttgtcacactatactacaatattagtcgattctgaaaaagaagaccctattaagtacaacgattaccttgaagtccaagagatgaccgacattacctggcttaactcgccatcccaagtggctgttgttccatggggacttcgaaaggtgttaaattggcttaagttcaaatatggagatcttccaatgtatatcatcagcaacggtatagatgacggactacatgcagaagatgaccaattgagggtctattacatgcaaaactatatcaatgaggcgttgaaggcacatattcttgacggtatcaacctctgcggatattttgcttacagttttaatgatagaacagcgccaagattcggactgtacagatacgcagctgatcaattcgaaccgaaagcttcgatgaaacattatagaaaaattattgattcgaatggatttccaggacctgaaacgttagaaagattctgcccagaagagtttacagtttgtacagagtgttccttttttcatacacgcaaaagtttgttggcttttatcgcatttctttttttcgcttcaataatatctctatcgctcattttttactattctaaaaagggtcgtaggtcttacaaa

SEQ ID NO: 15117 - DNA, 3036 bp, Artificial Sequence; identical to SEQ ID NO: 15116
  Description of Artificial Sequence: Synthetic coding sequence

SEQ ID NO: 15118 - DNA, 3036 bp, Artificial Sequence
  Description of Artificial Sequence: Synthetic coding sequence
atgccagcgtccgctccgcctcgcagaccgcggccgccgccgccttccctgtcgctgctgctcgtcctgctgggcctcggaggaagaaggctgcgggccgagcccggtgatggagcgcaaacttgggcacgcttttccaggccgccggccccggaggccgcaggcttgttccaaggaaccttcccggatggcttcctctgggccgtggggtccgctgcctaccaaactgaaggaggctggcagcagcatggaaagggtgctagcatctgggacaccttcacccaccatccgctcgctcccccgggtgactcaaggaacgcctcgctgccgctgggagcaccctcaccactgcaaccggccactggagacgttgcgtcggactcgtacaacaacgtgttccgggatacggaggcgctcagggagctcggagtgacccactaccggttctcgatctcctgggcacgggtgctcccgaacggatcagcgggggtgccaaacagagagggactcaggtactacagacgccttctcgaaaggctgcgcgaacttggtgtccaaccggtcgtgactctgtaccactgggatctgccgcaacgcctccaggatgcctatggggggtgggcgaatcgggccctggccgatcatttccgggactatgccgagctctgtttccgtcacttcggagggcaggtgaagtactggatcaccattgacaacccgtacgtggtggcatggcacggctacgccactggacgcctggcacctggcatccgcggctcgcccagattgggatacctcgtggcacacaatctcttgctggcgcatgccaaggtgtggcacctctacaatactagctttcggcctacccagggtggccaggtcagcatcgcgctgagctcacactggatcaatccgagacgcatgaccgatcactcaatcaaggaatgccagaagagcctggatttcgtcctgggatggttcgccaagcctgtgtttatcgacggagactatccggaatcaatgaagaacaacctgagtagcattcttccggattttactgaaagcgaaaagaagttcatcaaagggactgccgacttctttgccctgtgcttcggtcctactctgagctttcagctgctcgaccctcatatgaaattccgccagctcgaaagccctaacctgcggcagctgttgagctggatcgatctcgagtttaaccatcctcagatctttatcgtcgagaacggttggtttgtgtccggtactactaagcgggacgatgctaagtacatgtattacctgaagaagtttatcatggagactctcaaagccatcaaactcgatggcgtcgatgtcatcggatacacggcgtggagcttgatggacggattcgaatggcatagaggctacagcatcagaaggggtcttttctacgtggacttcctgtcccaagacaagatgctgctgccgaagtcctcagcgttgttctaccagaaactcatcgaaaagaacggattcccaccattgccggaaaaccaacctctggaaggtactttcccatgcgattttgcgtggggagtggtggacaattacattcaggtggatactaccctctcacagttcactgatctgaatgtgtacctctgggatgtgcaccacagcaaacggctgatcaaggttgatggagtggtgaccaagaaacggaaatcctactgcgtggattttgcagcgatccaacctcagatcgccctgctgcaagaaatgcacgtcactcatttccgcttcagcctggactgggcactgatcctgccactgggtaaccagtcgcaggtcaatcataccatcctccaatactaccggtgcatggcctcagagctggtgcgcgtgaacattaccccggtggtggccctctggcagccgatggcccctaaccagggtttgccgcggttgttggcacgccaaggggcctgggagaacccatataccgcccttgcgtttgccgaatacgctagactctgctttcaggaactcggacaccatgtgaaactgtggatcaccatgaacgaaccctacacccgcaatatgacttactcagccggacataacctcctcaaggcccacgccctggcctggcatgtgtacaacgagaaattccgtcacgcccaaaacggaaagattagcatcgccctgcaggcggactggatcgagcccgcttgccctttcagccaaaaagataaggaagtggctgagagggtcctcgaattcgacatcggatggctggctgagcctattttcggatcgggcgactacccgtgggtgatgcgcgattggctcaaccaacggaataacttcctcctgccatacttcaccgaagatgaaaagaagctgatccagggtactttcgactttctggcactgtcccactacactaccatcctggtggactccgagaaggaagatccaatcaagtacaatgactacctcgaagtccaggagatgaccgatatcacttggctgaactcaccgtcccaagtggccgtggtgccgtggggactccggaaggtgctcaactggttgaagttcaagtacggtgacctgccaatgtacatcatctccaatggaattgatgatggactccatgccgaggacgaccagctgcgcgtgtactacatgcaaaactacatcaatgaagccctgaaggcacacatattggatggaatcaacttgtgcggatacttcgcatactcgttcaatgaccggactgcgccgcgctttggcctgtacagatacgctgcggaccaatttgaaccaaaggcctcgatgaaacactaccgcaagattatcgacagcaatggattcccaggcccagagactttggaacgcttctgcccggaggaattcaccgtgtgtaccgagtgtagcttcttccacacgcggaagagcttgctcgcgttcatcgccttcctctttttcgcctcaataatctcactttctctgatcttttactactcgaagaagggccgtagatcgtacaag

SEQ ID NO: 15119 - DNA, 3036 bp, Artificial Sequence; identical to SEQ ID NO: 15118
  Description of Artificial Sequence: Synthetic coding sequence

SEQ ID NO: 15120 - DNA, 3036 bp, Artificial Sequence
  Description of Artificial Sequence: Synthetic coding sequence
atgccagcatcagcacctcctagacggccccgcccccctccccctagcctctctttgttactcgtattgcttggtctaggaggacggcgactgagggcagaaccaggggatggcgcccagacttgggccagattctcccgcccacccgcaccagaagcggccgggctgttccaagggacattccccgacgggtttctgtgggctgtagggagcgccgcgtaccagactgagggaggttggcagcagcacggaaagggcgcctccatttgggacacttttactcatcatcccctcgccccacctggggatagccgaaacgcttcgttgccgctgggagctccaagtcccctgcagcctgccacaggggatgtggcgtcagacagctacaacaatgtattccgggacacagaggccctccgtgaactcggagtcacccactaccgcttctctatctcttgggccagggtgctgcctaatggatccgccggggtgcctaatcgcgaggggcttcgttactataggaggttattagagagactgcgggaacttggcgtccagcccgtagtgactctgtatcattgggatcttccacaacgattgcaggacgcctacggagggtgggccaacagagctctggccgaccatttcagggattacgctgaactgtgctttcgacacttcggcggacaggtgaagtactggatcacgatcgataacccctatgttgtggcttggcacgggtacgctacgggccggctggcgcctggcattagaggcagtccccgtttgggatacctggtcgctcataacctgctcctggcacacgcgaaggtgtggcacctgtataacacatcatttcgtccgacgcagggaggtcaggtcagtatcgccctgtcttcacattggatcaatccaaggcggatgacggaccactcaatcaaggaatgccagaaaagcctggattttgtacttggctggtttgctaagccagtatttatcgatggtgactatccagagtcaatgaaaaataacctgtcatctatcctcccagactttacagagtcagaaaagaaatttataaagggcactgctgatttctttgccctgtgttttgggcccacactcagttttcagttgttggaccctcatatgaaattccgccagctcgagtcccctaatctgcggcagctgctttcatggattgatctagaatttaatcacccacagatttttatagtggagaatggatggttcgtttcggggaccaccaaaagagatgatgctaaatacatgtactatctcaaaaagttcatcatggagacactgaaggcaataaagcttgatggcgtcgatgtgatcgggtataccgcgtggtcacttatggatggcttcgagtggcacagaggctacagtattcgcagaggattgttttacgtagactttcttagccaggacaagatgctacttcccaagagtagtgccttgttttatcagaagcttatagaaaagaatggattcccacccctgcccgagaaccagccactggaggggactttcccctgcgactttgcgtggggcgtcgtggataactacattcaggtggacacaactctctcgcagttcactgacctgaatgtctatctatgggacgttcaccattccaaaaggctaatcaaagtcgacggagtggtaacaaagaagaggaaatcctactgtgtcgacttcgcagccatccagccccagatcgcccttttgcaggagatgcatgtgacccactttaggttttcattagactgggcactgatcctgcccttggggaaccagagccaggtgaatcacactattctacagtattaccggtgcatggcctcagagctcgtccgtgtgaacataacacccgtggtcgccctctggcagccgatggccccaaaccagggcctaccacgactgctcgcgaggcagggagcctgggaaaatccatacaccgcactggcctttgctgaatatgctcgactttgctttcaggaattgggccaccatgtcaagctgtggatcactatgaacgagccttacaccaggaatatgacgtattcagctggtcacaaccttctgaaggcccatgccctggcttggcacgtttataatgagaaatttcggcatgctcagaacggaaaaatttcaatcgcactccaggctgattggatcgagcctgcttgtcccttttcgcagaaggataaggaagtggcagaacgggtcctggagttcgacatcggctggctggccgagcccatcttcggcagcggcgattacccttgggtgatgagagactggctaaaccagcggaacaatttcttgttaccatattttacagaggacgagaagaagctaatccagggtacttttgattttctcgcactttcccactacaccaccatattggtcgactcagagaaggaggatccaatcaagtataatgattacctggaagtgcaagagatgacggatattacttggctgaacagtcctagtcaagtcgccgtagtgccctggggcctgcgcaaggtcctgaactggctgaagttcaagtacggggatctgccaatgtacattattagcaatgggatcgacgatggcctgcacgcagaggacgatcagctcagagtatattacatgcagaactatataaatgaggccctcaaggcacacattcttgacggcatcaatttgtgcggttatttcgcctacagttttaacgatagaaccgctccgcggtttggcttgtataggtacgccgccgatcagtttgagcctaaggcttctatgaaacattaccgcaagataattgacagtaacggatttcccggcccagagacactagagcgcttttgtccagaggaattcactgtgtgcacggaatgcagtttcttccacacaagaaagtcactcctggcctttatcgctttccttttcttcgcatccatcatttcactgtcattaatcttctactacagcaaaaaagggagaagaagttataag

SEQ ID NO: 15121 - DNA, 3036 bp, Artificial Sequence; identical to SEQ ID NO: 15120
  Description of Artificial Sequence: Synthetic coding sequence

SEQ ID NO: 15122 - DNA, 1647 bp, Artificial Sequence
  Description of Artificial Sequence: Synthetic coding sequence
atgcctgcatcagctcctccccgcaggcctagacctccaccccctagtctctcactgttgctcgtcctcctgggactgggtggaaggcgcctgcgcgctgaacctggagacggcgctcagacttgggctcgcttctctaggccaccagccccagaagcagccggcctgttccagggcacttttcccgatggtttcctgtgggccgtaggtagtgccgcttatcagacagagggcggttggcaacagcacggcaaaggcgctagcatttgggatacctttactcatcacccacttgcaccaccaggcgattcacgtaacgcctccctgccactcggcgctccatcacctcttcaacctgccaccggagatgttgctagcgactcttacaacaatgtgttccgtgatacagaagctttgagagagctgggagttacccactaccgctttagtattagttgggctcgtgtgctgcccaacggaagtgcaggcgtgccaaacagggagggactccgttactacaggagactgctcgagagacttcgtgaattgggcgtgcaacccgtcgtgactctgtaccactgggatctgccccagagactccaggacgcctacggtggttgggcaaatcgtgcactggctgaccactttagagactatgcagagctttgttttagacacttcggtggacaggtgaagtattggatcaccatcgacaacccctacgtggtggcatggcatggctatgctaccggccgccttgcccctggaatccgcggctctccccgcctgggatatctcgtcgctcacaacctgctcttggcccatgccaaagtttggcatctctataatacatccttccgccccactcaaggtggtcaggtctctatcgccctgtcttcacactggattaaccctaggcgtatgactgaccatagcatcaaagagtgccagaagtcccttgattttgtgttgggatggtttgctaaacccgttttcatagatggcgattatccagaatctatgaagaacaacttgagttctattctgccagacttcactgaaagcgaaaagaaattcattaagggtactgccgacttctttgctctgtgcttcggtcctaccctgtccttccaactgctggatccacatatgaaattcaggcagctcgagtcccctaacttgcgccagctgctcagttggatcgacctggaatttaaccatccacagatcttcatcgtcgagaacggttggttcgtatctggaactactaagcgcgatgatgctaagtacatgtactacttgaagaagtttatcatggagaccctcaaagctattaagcttgacggagttgatgtcattggctatactgcttggtccctgatggatggtttcgagtggcataggggttacagtatacgccgtggtctgttttacgtcgacttcctctctcaggataagatgctgctccctaagtcatcagccctgttctaccagaagttgatcgaaaagaatggattccctccactgcctgaaaaccaaccactggagggtaccttcccctgtgacttcgcctggggcgtggtggacaattacatccaggtcagtcagcttaccaaacctatttcctctctgaccaaaccataccac

SEQ ID NO: 15123 - DNA, 1647 bp, Artificial Sequence; identical to SEQ ID NO: 15122
  Description of Artificial Sequence: Synthetic coding sequence

SEQ ID NO: 15124 - DNA, 1647 bp, Artificial Sequence
  Description of Artificial Sequence: Synthetic coding sequence
atgccagcaagtgcaccaccacgtagaccacgtccacctccaccaagtttatcacttcttttagttttattaggacttggtggacgtcgattaagagctgaaccaggagatggagctcaaacttgggcaaggttttctagacctcctgcacctgaagctgctggtctttttcaaggaacatttccagatggtttcctttgggcagttggatctgcagcttatcaaactgaaggaggatggcaacaacatggaaaaggagcttctatttgggatacttttactcatcatccattagcaccaccaggtgattctagaaatgcttcattacctttaggtgcaccatcaccattacaaccagcaactggagatgttgctagtgattcatataataatgtttttagagatactgaagcacttagagaacttggagtaactcattatagatttagtatttcttgggcacgtgttttaccaaatggtagtgccggagtaccaaatagagaagggttaagatattatagaagattacttgaaagattaagagaattaggagttcaacctgttgttactctttatcattgggatttaccacaacgtcttcaagatgcatatggaggatgggctaatagagctttagcagatcacttcagagattatgctgaattatgttttagacattttggtggtcaagttaagtattggataacaattgataatccatatgtcgtagcttggcatggttatgcaactggaagattagcacctggaattaggggttcaccaagattaggttatcttgtcgcacataatttgttattagcacatgctaaagtatggcatttatataatacttcatttagaccaacacaagggggacaagtttcaattgcattatcaagtcattggataaacccaaggagaatgactgaccattctattaaggaatgtcaaaaaagcttagactttgttttgggttggtttgctaaacctgtttttattgatggagattatccagaatctatgaaaaataatttaagtagtatattaccagatttcaccgaaagtgaaaaaaaattcataaaaggaacagctgatttttttgctttatgttttggtccaactttatctttccaattattagatccacatatgaagtttagacaacttgaaagtccaaatcttagacaattattatcctggatagacttagaatttaaccatccacaaatatttatcgttgaaaatggatggtttgtttcaggtactactaaaagagatgatgctaaatatatgtattatttaaaaaaatttattatggagactttaaaagcaattaaattagacggtgtagatgttattggatatactgcttggtcattaatggatggatttgaatggcatagaggatattcaataaggaggggattattttatgttgattttttaagtcaagataagatgttacttcctaaaagttctgccttattttatcaaaaacttattgaaaaaaacggatttcctccacttccagaaaatcaaccacttgaaggaacatttccatgtgactttgcatggggtgttgttgataattatatacaagtttctcaattaactaaaccaatcagttcattgacaaaaccatatcat

SEQ ID NO: 15125 - DNA, 1647 bp, Artificial Sequence; identical to SEQ ID NO: 15124
  Description of Artificial Sequence: Synthetic coding sequence

SEQ ID NO: 15126 - DNA, 1647 bp, Artificial Sequence
  Description of Artificial Sequence: Synthetic coding sequence
atgccagcatcagccccgcctcgacggccacgaccaccacctcctagcctctcccttctccttgtgctgctgggacttggagggcggcgactccgggcagaacctggtgacggtgcccagacctgggccaggttttccaggcccccagcccctgaagcagcagggcttttccagggtactttccctgacggctttctctgggcggtgggatccgctgcataccaaactgaaggcgggtggcaacagcatggaaagggagcctccatttgggacacgtttactcatcaccccttggcccctcccggagattcgcggaacgcgtcacttccactgggcgcaccttcgcccctccaacctgccaccggagatgtcgcctccgactcttataacaatgtgttcagagacaccgaggcacttagagagttgggggtgactcactaccggtttagcatctcgtgggcgagggtgctgcccaacggtagcgcaggagtgcccaacagagaaggtttgaggtactaccggcgcctcctcgagcgcctccgagagctgggcgtccaaccagtcgtgacgttgtatcattgggacctgcctcaacgccttcaagacgcatacggtggctgggcaaatcgtgcactggcagatcacttcagagattatgccgagctgtgtttccgccattttggggggcaagtcaagtactggattaccattgataacccatatgtcgtcgcatggcatggttacgcaactggcagacttgcacctggtattcggggtagcccaaggctgggatacctcgtggcacataacctgctgctcgcacatgcgaaagtttggcatctctacaatacctcgttcaggcctacccagggcggtcaggtgtcgattgccttgtcctcacattggattaaccctagaaggatgacggatcatagcattaaggaatgtcaaaagtcgctggactttgtgctcggatggtttgcaaaacctgttttcattgacggagactaccccgagtcgatgaagaataatctttcgagcatactgccagacttcactgaatccgagaagaagtttatcaagggcaccgcggatttctttgcactttgcttcggaccaacgctttcattccaactgctcgatccccatatgaaattccggcagctcgagtcgccaaacctgaggcaactcctgagctggatcgatctcgaattcaaccacccgcagattttcattgtggaaaatggttggttcgtgtcgggaaccacgaaaagagatgatgcgaaatacatgtactacctcaagaagttcattatggaaacccttaaggccattaagctcgatggtgtggatgtgattggttacactgcatggtccctgatggatggatttgaatggcatagagggtactcaattcgaagagggctgttttacgtggatttcctgtcgcaggataagatgctgctgcctaagtcctcggcactgttttaccaaaagctgattgagaagaacgggtttccgccgctgcccgaaaaccagcccctcgaaggtacctttccatgcgactttgcatggggagtggtcgacaattacattcaagtgtcgcagcttaccaagccaatctcatcgctcactaagccttatcac

SEQ ID NO: 15127 - DNA, 1647 bp, Artificial Sequence; identical to SEQ ID NO: 15126
  Description of Artificial Sequence: Synthetic coding sequence

SEQ ID NO: 15128 - DNA, 1647 bp, Artificial Sequence
  Description of Artificial Sequence: Synthetic coding sequence
atgccggcaagcgcccccccacggcgaccccggccgcctcctccaagcctgagcctgctgctcgttctattaggccttggcgggaggcggctcagagctgaacccggagacggcgcacagacatgggcccggttctcccgacctccagctccagaggcggctggtctgtttcagggaactttccccgatggtttcctctgggccgtgggcagtgcagcttaccagacagagggcggctggcagcaacacggcaagggtgcctccatctgggataccttcacgcatcatcctttggcaccgcccggggattcacggaatgcctccttacctctaggcgctccctctcccctgcagccagctactggagacgtggccagcgattcatacaacaatgtgttcagagatactgaagccttaagagagcttggggttactcactatcgcttttctatttcctgggctcgggtcctgccgaacggcagtgcaggggtccctaacagggaaggactgcggtattaccggcgactcctggaacggctcagagagttgggagtgcagccggtcgtaactctttaccactgggacttgccacagcgactgcaggatgcctatggtggctgggctaatcgggcactggctgatcacttccgcgattacgcagaactgtgcttccgccacttcggaggtcaggtaaaatattggataacaatcgataacccctacgtggtggcctggcatggctacgccacaggtcggttggcaccaggcatcagggggagtccccgattgggatatcttgtggcacataacctgctgctggcgcacgctaaagtctggcacctgtacaacacgagtttcagacctacacagggcggccaggtgtcaatagcccttagtagccattggatcaatcctcgcaggatgaccgaccatagtattaaagagtgtcagaaatcactggacttcgtgttgggctggttcgcgaagcccgtattcatcgacggcgattaccctgagagcatgaaaaacaatctgtcttccatcctgcctgattttaccgagtctgagaagaagttcattaagggcacagccgacttcttcgccctgtgtttcggccctacgttgtcctttcagttgctcgaccctcacatgaagttccgtcaattggagtcacccaacttacggcaactgctaagctggatcgacctggagttcaatcacccccagatcttcatcgttgagaacggctggtttgtatcaggtacgaccaagcgggacgatgcaaagtatatgtactatcttaaaaaattcattatggaaaccctcaaggccattaagcttgacggggtggacgtgataggatatacagcctggtctctgatggatggctttgaatggcacagagggtattctattagaagggggttgttctacgttgattttctcagccaggataagatgcttctgcccaagtcttctgcccttttctaccagaagttgatcgaaaagaatggcttcccacctctgccggagaaccagccactggagggtacgttcccttgcgatttcgcctggggagtagtggataactatatccaggtgagccaactaacaaaaccaattagctccctgacaaaaccttatcac

SEQ ID NO: 15129 - DNA, 1647 bp, Artificial Sequence; identical to SEQ ID NO: 15128
  Description of Artificial Sequence: Synthetic coding sequence

SEQ ID NO: 15130 - DNA, 1647 bp, Artificial Sequence
  Description of Artificial Sequence: Synthetic coding sequence
atgccggcatcagcaccgccccggaggccacgcccgccgccacctagtttgtctcttttgttggtgctccttggccttggcggcagacgcctgcgggccgaaccaggtgatggggcccagacttgggctcgcttcagccgcccaccagccccggaagccgccggactgttccaggggactttccctgacggtttcctgtgggcggtggggtccgcggcttaccagactgaaggggggtggcagcagcacggaaagggagcttcgatttgggacaccttcactcatcacccattggcccctcccggagacagccgaaatgcttcgctgccgctcggagctccatccccattgcaacctgctacgggcgacgtggcctccgacagctacaacaatgtgtttagagacaccgaggcgctgcgcgagctgggtgtgacccattaccgcttctcgatttcatgggctcgggtgctccctaacggatcagcgggagtgccaaaccgcgagggactcagatactacaggagattgctggagagactgagggaactgggagtgcagccagtggtgactctctaccactgggacctgccgcaacgcctgcaggatgcgtacggaggatgggctaatcgggcgctcgcagaccactttcgcgattacgctgaactgtgcttccggcacttcggcggtcaggtcaaatactggatcactatcgataacccgtacgtggtggcctggcacggatacgcaaccggccgcctggcgcctggaatccgcggaagcccgcgcctcggatacctcgtcgcgcacaacctgctcctcgctcacgcaaaagtctggcacctgtataacacttcattccgcccgacccagggcggacaggtgtcgatcgccctctcttcgcattggatcaaccctcgcagaatgaccgatcactcgatcaaggaatgccaaaagtcgctggactttgtcctgggctggttcgccaagccagtgttcattgatggagactacccggagtcgatgaagaacaacctgagctccatcctgccagatttcactgaatccgagaagaagttcatcaagggcaccgctgacttcttcgcgctgtgcttcgggcccactctctctttccaattgttggacccccacatgaagttccggcagttggagtcccctaacctccgccagctcctctcatggatcgacctcgagttcaatcacccacaaatcttcatcgtggaaaatgggtggttcgtctcgggaaccactaaacgcgacgatgccaagtatatgtactacctcaagaaattcattatggaaaccctgaaagcgatcaagctggacggtgtggatgtgatcggatacactgcctggagcctgatggatggatttgaatggcacagaggctactcgatccggcgcggactgttctatgtcgacttcttgtcccaagataagatgctgttgccgaagtcatcggctctgttttatcagaagctgattgagaaaaatggatttccaccgctgccggaaaatcagccactggagggcacgttcccgtgcgacttcgcgtggggcgtcgtcgataactacatccaagtctcacaactgaccaagccgatctcgtcgctgaccaagccataccat

SEQ ID NO: 15131 - DNA, 1647 bp, Artificial Sequence; identical to SEQ ID NO: 15130
  Description of Artificial Sequence: Synthetic coding sequence

SEQ ID NO: 15132 - DNA, 1647 bp, Artificial Sequence
  Description of Artificial Sequence: Synthetic coding sequence
atgcctgcctccgccccaccacgtcggccacgacctccacccccttccctttccttgctgctggtcttactgggattaggaggtagaaggttgagggccgagccaggcgacggtgcacaaacctgggcccgattttccagaccacctgcaccagaagccgcgggcctcttccagggaaccttcccagacggcttcctgtgggctgtggggtctgccgcatatcaaacagaggggggctggcagcagcacgggaaaggggcctccatatgggatactttcacccaccacccgttggcacctccaggtgatagtcgcaacgcctctctgcccttaggggcccccagcccattgcagcctgccacaggggacgtcgcctccgactcttacaacaacgtgtttagagacaccgaggctttaagagagttaggagtgacccattatcgcttttccattagctgggccagagtgcttccaaacggaagtgcgggtgtgccgaacagggagggactgagatattacagacgattgctggaaagactccgggaactcggagtccaacccgtagtcacgctttaccactgggatctgcctcagcggctccaggacgcctacgggggctgggcaaatcgtgcgctggccgaccacttcagagattacgctgagctgtgttttcggcactttgggggacaggtaaagtattggatcacgatcgataacccatatgtggtggcatggcatggctatgccaccggaagactcgcccccggtatacggggatcccctagattgggatacctcgttgcccacaatttgttgttggctcatgccaaggtgtggcacctttacaacacgagctttaggccaactcaaggaggacaggtgtccatcgcactgtcatcacattggattaatcccagacggatgacggatcactctatcaaggaatgtcagaagtctctggacttcgtgctaggttggttcgccaagcctgtgttcattgacggagactaccctgaatccatgaagaataacttgagcagcatccttcctgacttcacagagagcgaaaaaaaattcattaagggaactgccgactttttcgccttatgtttcggtccaacactgagctttcaactgctggacccccatatgaagttccgccagctggaatctcccaatctgcgacagctcctctcctggattgacctggagttcaatcatccacagatctttatcgtggaaaatggatggttcgtaagcggcacaacaaagagggatgatgccaagtacatgtactacctgaagaaattcataatggagaccttgaaggccataaaactggacggcgtggatgtcattggatacactgcttggagccttatggatggcttcgaatggcaccgcggctattccatcagaagaggtctattctacgtggactttctctctcaggacaagatgctcttacccaagtcttccgccctgttctatcagaaactgatcgagaagaatggctttccacccctgcccgagaaccagccacttgagggcacttttccctgcgatttcgcctggggagtggtggacaattatattcaggtgagccagctcaccaaacctatctcctcgcttactaaaccatatcac

SEQ ID NO: 15133 - DNA, 1647 bp, Artificial Sequence; identical to SEQ ID NO: 15132
  Description of Artificial Sequence: Synthetic coding sequence

SEQ ID NO: 15134 - DNA, 1647 bp, Artificial Sequence
  Description of Artificial Sequence: Synthetic coding sequence
atgccagcctccgcccctcctcgccgtccacgacctcctccgcctagtttgtccctgctgcttgtgctgctgggcctgggtggcaggcgtcttcgagcagaaccgggcgacggtgcacagacctgggctcgttttagccgcccacctgcacctgaggcagcggggctgtttcagggcacgttcccagacggcttcttgtgggcagtgggtagcgccgcctaccagactgaaggtggttggcagcaacacggtaaaggcgcgtcaatctgggacacttttacccatcacccgctggcaccgccaggtgacagccgcaacgccagtctgccgcttggtgccccttcgccactccaaccagctaccggtgacgttgcatctgatagctataataacgtatttagggataccgaggctctgcgtgaactgggtgttactcactaccgtttttctattagctgggctcgtgttctgccaaatgggagcgcgggcgtaccaaatcgcgagggcctccgctattacaggcgtctgctggaacgtttgcgcgaactgggcgtccagccggtggtgacactgtaccactgggacctgccacaacgcctccaggacgcgtatggtggttgggcaaaccgcgcactggcggaccacttccgggattacgcggaactgtgcttccggcattttgggggccaggtaaaatactggattacaattgataacccatatgtggtggcatggcacggctatgcaacgggccggctagcaccgggtattcggggctctcctcgcctgggttaccttgtcgcccacaatctcctgttggcacacgctaaagtctggcatctgtacaacaccagcttccgcccaactcagggcggtcaggttagcatcgccctcagctcccattggattaacccaaggaggatgacggatcacagcattaaagaatgccagaagtcgctggatttcgtgctgggctggttcgccaagcctgtgttcattgacggcgattaccctgagtccatgaaaaacaacttgagttccattttgcccgatttcaccgaaagcgagaagaaatttattaaaggcactgcagacttcttcgctctctgctttggccctaccctgagcttccagctcctggatccacacatgaagttccgacagttggagtccccaaatctgcgccagctcctgtcatggatcgacctggaattcaatcatcctcagatctttatcgtagagaatggatggttcgtttccggtaccaccaaacgcgacgacgctaagtatatgtactacctgaagaagtttatcatggaaacactaaaagcaataaagcttgatggtgttgatgtgattggctataccgcctggtctcttatggatggtttcgagtggcaccgtggttactcaatccgccggggactgttttacgtagatttcctgtctcaggacaagatgctgctgccaaaatccagcgcgctgttctaccagaagttgatcgagaaaaacggttttccgcctctgccggaaaaccagcctctggaggggaccttcccgtgtgatttcgcatggggtgttgttgataactatattcaagtgagccagctgacaaagccaatctcttctctgacgaagccttaccat

SEQ ID NO: 15135 - DNA, 1647 bp, Artificial Sequence; identical to SEQ ID NO: 15134
  Description of Artificial Sequence: Synthetic coding sequence

SEQ ID NO: 15136 - DNA, 1647 bp, Artificial Sequence
  Description of Artificial Sequence: Synthetic coding sequence
atgccagcgagcgccccgccgagacggcccagaccgcctccgcctagcctgtcgctcttgctggtcctgttgggcctcggcggacgccggctgcgagccgagccaggtgatggcgcgcagacctgggctagattctccagaccgcccgcgcccgaagctgcgggactgtttcaaggtactttccctgacggattcctgtgggccgttgggtccgcggcctaccagaccgaaggcgggtggcagcagcatgggaaaggagccagcatctgggataccttcactcatcatccgctggcgccacctggagattcccgaaacgcaagcctccccttgggagccccctcgcctctgcaaccggccaccggggatgtggcaagtgattcatacaacaacgtgttcagggatactgaggctctccgtgagttgggcgtgacccattaccggttctccatctcgtgggcgcgcgtcctgccgaacggctccgctggagtgccgaatcgggagggcctcaggtactaccggagactcctggagcgccttcgggaactgggagtgcagccggtggtgacgctctatcactgggaccttccacagaggctccaagatgcctacggaggatgggccaaccgcgcactcgcggaccactttagagactacgcggaactgtgctttaggcactttgggggacaggttaagtactggatcaccattgataacccgtacgtggtggcatggcacggatatgccactggacgcctggctccagggatcagggggagcccgagattgggatacctggttgcacataatctgctgctcgcccatgcgaaagtgtggcatctgtataacacttctttccggccgactcagggaggacaagtgtccatcgccctctcaagccactggatcaacccaagacgcatgactgatcactcgatcaaggaatgccagaagtcgcttgatttcgttcttggttggttcgcaaagcctgtattcatcgatggagattacccggagagcatgaagaacaacctgtcctccattctcccggactttacggaaagtgagaagaagttcattaaaggaactgcggactttttcgcattgtgcttcgggccgaccctgtcctttcagctcctggatccccacatgaagtttcggcaactcgagtcgccgaatctgaggcaactgctgtcctggatcgacctcgagtttaaccacccccagatctttattgtcgaaaacggatggtttgtgagcggaacgaccaagcgggacgatgctaaatacatgtactacctcaagaagttcatcatggagactctcaaagccatcaagctggacggagtggacgtgatcggatacactgcgtggtcattgatggacggattcgagtggcacaggggatactcgataagacgcggactgttctacgtggacttcctgtcgcaggataagatgctgttgcccaagtcgagcgcccttttctaccaaaagctgatcgagaaaaacggcttcccacctctgcctgaaaatcagcccttggaaggcacctttccgtgcgatttcgcctggggcgtggtcgacaattacatccaagtgtcgcaactgaccaagccgatcagctcgctgaccaagccataccac

SEQ ID NO: 15137 - DNA, 1647 bp, Artificial Sequence; identical to SEQ ID NO: 15136
  Description of Artificial Sequence: Synthetic coding sequence

SEQ ID NO: 15138 - DNA, 1647 bp, Artificial Sequence
  Description of Artificial Sequence: Synthetic coding sequence
atgccggcttcagcgccgccacgccgtccgcgtcctccgccgccctcgttgtcactgctcttggtcctgcttgggcttggagggcgccgcctgagagctgaacccggtgacggggcccagacctgggccagattttcaaggccgccagccccggaagccgctggattgttccaaggaaccttcccagacggattcctttgggccgttgggtcggctgcctaccaaaccgaaggcggatggcagcaacacggcaagggcgcatcgatttgggatactttcacccaccatcccctggcaccccctggcgactcccgcaatgcgtctctcccactcggagccccttcgcctctgcagccagctaccggagacgtggcctcggactcctataacaacgtgttcagggataccgaggccctccgcgagttgggcgtgactcactacagattttctataagctgggcgcgcgtgctgccgaatgggagcgccggtgtgcctaaccgggagggactgcggtactaccgacgcctgctggaacgcctgcgggaattgggagtccagccggtggtcacgctgtaccactgggatctgccacagcggctgcaggatgcatacggcggctgggcgaacagagcactggctgatcactttcgcgactacgcggagctttgcttccggcatttcggcggacaggtcaagtactggatcactatcgacaatccgtacgtggtggcctggcatggttacgcgactggtaggctcgcgccagggatacgcggcagtcctcggctgggatatctggttgcacacaatctcctcctggcacacgcgaaggtctggcatctctacaatacgtcatttaggccgacccaaggaggccaggtgtcgattgcgctgtcctctcattggatcaaccctcgacggatgactgatcattcaatcaaagaatgccagaagagcctggacttcgtcctgggatggttcgctaaacccgtgtttatcgacggtgactacccagaatcgatgaaaaacaatctgtcgtccatcttgccggacttcacggaatcagagaagaagtttatcaagggtaccgcagatttcttcgctctctgctttggaccgactctgtcattccagctgctggacccgcacatgaagttccggcagctcgaatctccgaatcttcggcaactcctcagttggatcgacctcgagttcaaccacccgcagatattcattgtggaaaacggatggtttgtgtccggaactactaagcgggatgacgccaaatacatgtactacctcaagaagttcatcatggaaaccctcaaagccattaagctggatggagtcgatgtgatcggatacaccgcctggtcgttgatggatggcttcgagtggcatcgcggatacagcatcaggagaggattgttctacgtcgacttcttgtctcaagacaagatgctgcttccgaagtcaagcgccctgttctaccaaaagttgatcgagaagaacggcttccccccactcccggagaaccagccactggaaggtacctttccatgtgacttcgcatggggagtggtagacaactacatccaagtgagccagctcactaaacctatctcctcgctcaccaaaccatatcac

SEQ ID NO: 15139 - DNA, 1647 bp, Artificial Sequence; identical to SEQ ID NO: 15138
  Description of Artificial Sequence: Synthetic coding sequence

SEQ ID NO: 15140 - DNA, 1647 bp, Artificial Sequence
  Description of Artificial Sequence: Synthetic coding sequence
atgcctgcatcggcccctcctcgccggccaagacctccaccaccctcacttagccttcttctggtcctgcttggacttggaggtagacggcttagagcagaaccgggtgacggcgcgcaaacctgggctcgcttttcccgtcctcctgcacctgaagcagccgggcttttccagggtacgtttccagacggtttcctgtgggcagtgggtagcgcagcctaccaaactgagggcggttggcaacagcatgggaagggcgcatccatttgggatactttcacgcaccaccctctggcaccgcctggtgattcaagaaacgcatcgctccctctgggcgcaccttcgccactccagccagccacgggggatgtggcaagcgattcctataacaacgtgttccgtgacactgaagcactgagggaactgggggtcacccattacagattcagcatctcgtgggctagggtccttcccaatggctcggcgggggtgccgaatagagagggtctgaggtactatagaagattgctggagagactgcgggagctgggagtgcagcccgttgtcactctgtaccattgggacctccctcaacgactgcaggatgcgtacgggggctgggcgaatagggcgctggcagaccattttagagactacgcggagctttgttttcggcacttcggaggtcaggtgaagtattggataactatcgacaacccttacgttgtcgcatggcacggatacgcaaccgggcgacttgctcctgggatccgcggttcgcctagattgggttacctggtggcgcataatctgcttcttgcgcatgccaaggtgtggcatttgtacaatacctcatttcgacctacccagggtggccaagtctctattgcactgtccagccattggatcaatccaaggagaatgacggatcactcaattaaggagtgtcagaaatccctcgatttcgtgctcggttggttcgccaagcctgtctttatcgacggagattacccggagagcatgaagaacaacctctcctcgattctgccagattttaccgagtcggaaaagaagttcattaagggaaccgcggatttctttgctctctgtttcgggcctaccctctcctttcagctgctggatcctcatatgaaatttcggcagctggaatcgcctaacctgcgccaactgctctcctggattgatctggaattcaaccatccccagatctttattgtggagaatggttggtttgtctcaggcaccaccaagagagacgacgccaagtatatgtattacctgaaaaagtttatcatggaaacccttaaggccatcaaactcgatggagtggacgtgattggatacacggcgtggtcgctgatggacggattcgaatggcaccggggctacagtattaggagaggtctgttttacgtggatttcttgtcacaagataagatgctgcttccaaagtcctccgcacttttctaccaaaagctcattgagaaaaacgggtttccgccactgcctgagaaccaaccactcgaaggaacgttcccctgtgactttgcatggggagttgtggataactacattcaagtgagccagctgaccaaacctatttcgtcgctcaccaaaccataccat

SEQ ID NO: 15141 - DNA, 1647 bp, Artificial Sequence; identical to SEQ ID NO: 15140
  Description of Artificial Sequence: Synthetic coding sequence

SEQ ID NO: 15142 - DNA, 1647 bp, Artificial Sequence
  Description of Artificial Sequence: Synthetic coding sequence
atgcccgcttctgcgcctccccggcgtcctcgccctcctcctccgtcactgagtttactgctggtattactgggcctgggaggtaggcggctgcgagccgagccaggagatggcgctcagacttgggccagattctctcgcccacccgccccagaagctgcaggactgtttcagggtaccttcccagacggctttttgtgggccgtagggagcgccgcgtaccagaccgaaggaggatggcagcagcatggaaagggcgcgtccatttgggacaccttcacacaccatcccttggctcctccaggggatagtaggaatgccagtctgcccttgggtgcccccagccctctgcaacccgcgaccggagatgtggcgtcagactcatataacaacgtcttcagagataccgaagcgctgcgggagctcggggtcactcattaccggtttagcattagttgggcgcgggtgttacctaatggcagtgccggcgtgccaaatcgggaggggctgaggtactaccgacgactgctagaaagacttcgggagttaggcgtgcagcccgtggtcaccctatatcattgggacctgccacagcggcttcaggatgcctacggcgggtgggccaatagagctctggcagatcatttccgggactacgccgaactgtgtttcagacattttggaggtcaagtgaaatactggatcaccattgataatccctatgttgtggcctggcatgggtacgccactggaagattggcccccggcatcagaggctctccaagattaggatatttggttgcccacaacttactgctggcccacgccaaggtgtggcacctgtataatacctctttccgacccacccagggaggccaagtttcaattgccctgtctagtcattggataaacccaaggaggatgacagatcattcaatcaaggagtgtcaaaaatcgctggattttgtgctagggtggttcgcaaagcccgtgtttatagacggcgattaccctgaatcaatgaaaaataatctgtctagcattttgccagatttcaccgaatcggaaaaaaagttcattaagggcacggcagactttttcgcgctgtgctttgggccgacattgagcttccagctcctcgatccacatatgaaatttcgccagttggagagtcccaatctgcggcagctgctctcctggatagacctggaattcaaccaccctcagatctttatagtggagaatggttggttcgtgtcagggaccacgaaaagggatgacgctaagtacatgtattacctgaagaagtttatcatggagacactgaaggccataaagctggatggggtagacgtgattggatacaccgcctggtcactaatggacggtttcgagtggcatcgcggatatagcataaggagggggctgttctacgtggattttctgagccaggacaagatgctgttacctaagtcatctgccctgttctatcagaagctgatagagaagaacgggtttcccccccttccggaaaaccagcctctggagggtaccttcccctgtgatttcgcctggggtgtggtagacaattacatccaagtgagccagctcactaaacctattagctcccttacaaagccataccat

SEQ ID NO: 15143 - DNA, 1647 bp, Artificial Sequence; identical to SEQ ID NO: 15142
  Description of Artificial Sequence: Synthetic coding sequence

SEQ ID NO: 15144 - DNA, 1647 bp, Artificial Sequence
  Description of Artificial Sequence: Synthetic coding sequence
atgccagcgtcagcaccacctagacggcccaggcccccccccccgtccctctcactgcttttggttctgttaggcctgggcggccgtcgtttgcgagccgagccaggcgacggcgctcagacttgggcacgtttttcacgaccgccagctccggaggcggccgggctgttccagggcacgtttcctgacggtttcctgtgggcggtcgggagcgccgcataccaaacagagggcggttggcagcagcatggaaagggtgccagcatatgggatactttcacccatcaccctttggctccgcccggagactctcggaatgcttccctgcctctaggcgcaccctcaccactccaacccgctacgggtgatgtggcctccgactcttataataacgtgttccgtgatactgaggcccttagagaattgggcgtgacacattaccggttttctatctcttgggcaagggtgctcccaaatggatcggccggcgtgccaaatcgggagggcttacgctattatagacgactcctcgaaaggttgagggaactaggggttcagccagtcgtaaccctgtatcactgggatctgccacagcggcttcaggacgcatatggaggttgggctaatagagcgcttgcagaccattttagagattacgcagaactttgcttccgtcactttggcggtcaagttaagtattggatcaccattgacaacccttacgtggtcgcctggcatggttatgctacaggccggctcgcaccgggaatccgggggtcccctcggctgggttatttagtagcccacaacctgctcctagctcacgccaaggtgtggcatctatacaacacctccttcagacccacccaaggagggcaggttagcattgccctctccagtcactggatcaacccccggcgcatgacggatcactctatcaaggagtgccagaaaagcttggacttcgtgttgggctggttcgcgaagcctgtttttattgatggagactacccagaatccatgaaaaataacctcagcagtatactccccgactttactgagagcgagaagaaatttatcaagggtaccgccgattttttcgccctgtgttttggccctaccctcagcttccaactgcttgatccccatatgaagttcagacaactcgagtcaccgaacctgaggcagttgctttcctggatcgacctggagtttaatcacccccagatctttattgtggagaacgggtggttcgtgtccgggaccacaaaacgcgatgatgctaagtacatgtattacctcaagaaattcattatggaaacgctgaaagccatcaagctggatggggttgacgtcattggctatactgcatggtcattgatggacggatttgagtggcacaggggatactcgatccgccgcggcctcttctatgtcgattttctgtcccaggacaaaatgctgctgccaaaatcttccgcactgttctaccagaagttgatcgaaaagaatggcttcccccccttgcctgaaaatcaaccattggagggaacgtttccttgtgatttcgcttggggcgtggttgataattacattcaggtgagccagctaaccaagcctattagctcgctaaccaagccctaccat

SEQ ID NO: 15145 - DNA, 1647 bp, Artificial Sequence; identical to SEQ ID NO: 15144
  Description of Artificial Sequence: Synthetic coding sequence

SEQ ID NO: 15146 - DNA, 1647 bp, Artificial Sequence
  Description of Artificial Sequence: Synthetic coding sequence
atgcccgcctcggcccctcctcggcgaccgcgtcccccacctccctctctgtctctgctgctggtgctgcttggactcgggggacgtagattgagagccgaaccaggagatggagcccaaacgtgggcacgcttttcgcggcctccggcgcctgaagcagctggactcttccaaggcacgtttcctgatggctttctttgggcagtgggctcagccgcgtaccaaaccgaaggaggctggcaacaacatgggaagggtgcctcgatttgggatacttttactcaccatccactggcgcccccaggcgatagccgcaacgcttcattgcctctgggtgcaccatcacctctgcaaccggcaaccggtgacgtcgcaagcgattcgtacaacaatgtgttcagggatactgaagcactgcgggaacttggggtgactcattacaggttctcaatctcatgggcaagggtgctgccaaacggttcagccggtgtgcccaacagagagggacttcgctactaccggcggcttctcgagagacttcgtgaacttggtgtgcagccagtggtcaccctgtaccattgggatctgccccagcgcctgcaggacgcttacggtggttgggcaaatcgggcgcttgcagatcattttcgtgattacgcagagctctgttttaggcatttcggaggacaagtcaagtactggataaccattgataatccgtacgtcgtcgcatggcatgggtacgcaaccggccgcttggcacctggaattagaggaagccctagacttggatacctcgtggcacataatctcctgctggcccatgcaaaagtttggcacctttacaacacttcattccggcctacccaaggaggtcaggtgtccatagcacttagctcccactggatcaacccaagacggatgactgatcactccataaaggagtgtcaaaaatccctcgattttgtgctcggatggttcgcaaaaccagtgtttatcgacggagattaccctgagagcatgaaaaacaacctgagctcgatcttgcccgattttaccgaatcagagaaaaagtttatcaagggtaccgcagacttttttgccctctgttttggaccaaccttgtcttttcaacttctcgatccacacatgaagttccgacaactggaatcgcctaacctccgccagcttctttcgtggatagatcttgagttcaaccatcctcaaatctttattgtcgaaaacggctggtttgtatcgggtaccaccaaaagagatgacgccaagtatatgtactacctcaaaaagttcatcatggaaacccttaaagcaatcaagctggatggtgtcgacgtgatcggatatactgcctggtcgctgatggacggctttgagtggcaccgcggatactccattcggagaggactgttctacgtggatttcctttcccaggacaagatgcttctgcctaagtcgagcgcacttttctatcagaagctcatcgaaaagaacgggttccctccacttcccgaaaaccaacccctggaaggtacctttccctgtgattttgcttggggtgttgtggataactacattcaggtgagccagctcactaagcccatttcgtcccttaccaaaccttatcat

SEQ ID NO: 15147 - DNA, 1647 bp, Artificial Sequence; identical to SEQ ID NO: 15146
  Description of Artificial Sequence: Synthetic coding sequence

SEQ ID NO: 15148 - DNA, 1647 bp, Artificial Sequence
  Description of Artificial Sequence: Synthetic coding sequence
atgccggctagcgccccacctcgtagacccagaccacctcctccttctctttcgttgcttctcgtgttgctgggacttggaggtagacgcctccgagccgaacctggcgacggggcacaaacctgggcaaggttttccagaccacccgctccagaagccgcaggactgtttcaaggcacctttccggacggattcctctgggcggtgggttcagcagcctaccaaacggaaggtggctggcaacagcatgggaagggtgcatccatttgggataccttcactcatcatcccctggcaccgccaggggattcgcgcaacgcctcactgcctctcggagcaccatccccgttgcagcctgctactggagacgtggcctcagatagctacaataatgtgttcagggacaccgaggcgctcagggagttgggggtgactcattacagattttccatttcgtgggcacgggtgcttcccaacggctcggccggggtcccaaaccgagaaggcctcagatactaccgcagacttcttgagcggttgagggagctcggagtgcaacccgtggtgaccctttaccactgggaccttccacagagactccaggatgcatacggggggtgggctaaccgggctcttgcagatcattttcgagattatgcagaattgtgttttagacattttggaggtcaagtgaagtactggattactattgataatccttacgtggttgcttggcacggttacgccactgggcgtctggcaccagggattcgtggatcgccccggctgggttatttggttgcacacaaccttctgctggcacacgcaaaggtgtggcatctctacaataccagctttagacctactcagggaggacaggtgtcgatagcgttgtcatcccactggattaaccctaggaggatgaccgatcattccattaaagaatgccaaaagagcctggatttcgtcctcggctggttcgcgaagcctgtctttatcgacggtgactatcccgaatccatgaagaataatctttcgtcgattcttcctgactttactgaatcagaaaagaagtttatcaagggaaccgcagatttcttcgccctttgctttggtccaacgctctccttccagctgcttgatccgcatatgaaattccgccaactggagtcgccaaacctgagacaattgctttcttggattgatcttgagtttaaccacccccaaatcttcatcgtggaaaatggatggtttgtgagcggaaccacgaaaagagacgatgcgaagtacatgtattacttgaaaaagttcatcatggagactctgaaggcaatcaagctcgatggagtcgatgtgatcggatacactgcctggtcgcttatggacggctttgaatggcatcgggggtactcgattcgtagagggcttttctatgtcgactttctgtcacaagacaagatgctgctgcctaagtcgagcgcactgttctaccagaaacttatcgagaaaaacgggtttccacccctgccagagaaccaaccgcttgaaggtacctttccttgtgattttgcatggggagtggtcgataactacatacaagtctcgcagctgaccaaacccattagctctcttaccaagccataccat

SEQ ID NO: 15149 - DNA, 1647 bp, Artificial Sequence; identical to SEQ ID NO: 15148
  Description of Artificial Sequence: Synthetic coding sequence

SEQ ID NO: 15150 - DNA, 1647 bp, Artificial Sequence
  Description of Artificial Sequence: Synthetic coding sequence
atgccagcgagtgcccctccccggagacctagaccgcccccccctagcctgagcctgttgctggtgctgctgggcctgggtggccgacgcttgagggcagaaccaggggatggcgcccagacttgggctaggtttagtcggccccctgctcccgaggcagccgggctgtttcaggggacatttccagacggattcctctgggcagtgggatctgctgcctatcagacagaagggggctggcaacaacacgggaagggagctagtatctgggatactttcactcatcaccctctggcaccacccggcgacagcaggaatgcatcactgcctttgggagcaccctcaccacttcagcctgccaccggtgatgtggcatccgatagctacaacaatgtgttccgcgatacagaggccctgcgcgagctcggcgtgactcactaccgatttagcatctcatgggctcgggtgctgcctaacggatctgcgggggtgcccaatagggagggactgcggtactaccgacgactgttggaaaggttgcgagagctcggcgtccagccagtcgtgaccctgtatcactgggacctcccacagagactccaggacgcttacggcggatgggcaaatcgggctctggcagatcacttccgcgactatgccgagctgtgttttcgccacttcgggggccaggtgaagtactggattaccattgacaacccctatgtggtggcctggcatggctacgccaccggcagacttgcccctggcatccgaggctcacctagattgggctacctggtagcccataaccttcttctggctcacgccaaagtgtggcatctttacaacacaagtttccgccccactcaaggcggccaggttagcattgccttgagttcacactggataaaccctaggagaatgaccgaccattctatcaaagagtgccaaaaaagtcttgacttcgtactgggatggttcgccaagcctgtgttcatcgatggcgattatcccgagtcaatgaagaataatctctcttccattctgccagactttacagaatccgaaaagaaattcatcaaaggcactgctgacttcttcgcactgtgttttggccccacactgtccttccagctcctggatcctcacatgaaattccggcaattggagtcacccaacctgcgacaactgctgtcttggattgatctcgaattcaaccatccccagatcttcatagtggagaatggttggttcgtatctgggactaccaagcgcgacgatgccaaatacatgtactatctgaagaagtttattatggaaactcttaaagcgattaagctggacggagtggacgttatagggtacaccgcatggagcctgatggatggttttgaatggcatcggggatacagcatacgccggggactgttctacgtagatttcctgtctcaagacaagatgcttctgcctaagagctcagctctgttttatcagaagttgatcgaaaaaaacggcttcccacctttgccagagaaccagcccctggaggggacattcccttgcgactttgcatggggtgtggtggacaattacatccaggtcagccagctgactaagccaatctccagcctgactaagccctaccac

SEQ ID NO: 15151 - DNA, 1647 bp, Artificial Sequence; identical to SEQ ID NO: 15150
  Description of Artificial Sequence: Synthetic coding sequence

SEQ ID NO: 15152 - DNA, 1647 bp, Artificial Sequence
  Description of Artificial Sequence: Synthetic coding sequence
atgcccgcttcagctccgcctcgacgcccacggcctccccctccatctctgtcgctcctcctcgtacttcttggactcgggggaaggcgcctgagggctgagcctggggatggcgctcagacttgggcccgttttagcagaccacctgcaccggaggcagctggactgttccagggaacatttcctgatgggtttctgtgggccgtggggtcagctgcctaccagacagaggggggctggcaacagcatggaaagggagcctcgatatgggatacttttacccaccatcccctggcaccccctggcgacagtcgcaatgctagcctcccacttggagctccgagtccattgcagccggccaccggagacgtcgcgtcagactcatacaacaacgtgtttcgagatacagaagcccttagggagctcggggtcacccactaccgcttctccataagctgggctagggtcctgcctaatggtagcgctggggtgcccaatagagaaggcctccgctactatcggcggctgctcgagcgtctacgtgaactgggggtccagccagtggtgaccctctaccactgggacctcccgcagcggctgcaggacgcttacggcggctgggcgaacagggctctggcagatcattttagggactatgcggagctgtgttttaggcattttggcggacaggtcaaatattggattaccatagataacccctatgtggtcgcatggcacggttatgccacagggaggttagcaccaggcattagagggtcaccaaggctcggttacctggttgctcataacttgctattagcccacgccaaggtgtggcacctctataacacttccttcaggcccactcagggaggccaggtcagtatagccctcagctcccactggattaatccacgccgcatgacagatcattccataaaagaatgccagaagtcactggactttgtgctcggctggttcgccaagcccgtattcattgacggagactatcctgaaagtatgaagaataacctgtcctctatactgccggactttactgaatccgagaagaagtttattaaaggtacagccgattttttcgctttgtgctttggcccaacactgtccttccagttgcttgacccacacatgaagttccggcagctggagagccccaacctcagacagctgttgtcctggattgacctggagtttaatcaccctcagatcttcatcgtggagaacgggtggtttgtctctgggactaccaaacgtgatgacgctaaatatatgtactacctcaagaagtttatcatggagacgctgaaagccattaaactcgacggagtggacgtgattggctataccgcttggtctctcatggacggcttcgaatggcatcggggatacagtattaggcgtggattgttctacgtggattttctgagccaggataagatgttgctgcctaagtccagcgccttgttctaccaaaagctcattgaaaaaaacggatttcccccacttcccgagaatcagcctctggaaggaacttttccatgcgatttcgcgtggggcgtagtcgacaattacattcaggtgtctcaactcaccaagccgattagctctcttactaagccataccac

SEQ ID NO: 15153 - DNA, 1647 bp, Artificial Sequence; identical to SEQ ID NO: 15152
  Description of Artificial Sequence: Synthetic coding sequence

SEQ ID NO: 15154 - DNA, 1647 bp, Artificial Sequence
  Description of Artificial Sequence: Synthetic coding sequence
atgcccgcgagcgctccgccccggcgccctcggccgcctccacccagcctctcgctgctcctcgtccttctgggccttggaggccgacggctcagagccgaacccggcgacggagctcagacttgggcgcggttctcgcgtccacccgctccggaggccgccggacttttccagggaaccttccctgatgggtttctctgggcagtgggaagcgcagcttaccagactgaaggaggatggcagcaacacggtaagggcgcctccatatgggacaccttcactcatcaccccctcgccccacccggagactcccgcaatgcatcattgccgctgggggcaccatcgccgctccagccggccactggggacgtcgcctcggattcctacaacaatgtgttccgcgacactgaggctctccgcgaactgggcgtgacccactatcgcttcagcatcagctgggcccgggtgctgccaaacggaagcgctggcgtgccgaaccgtgaaggtctgcgctattaccgccgcttgctggagcggctccgagaactgggtgtccaaccggtcgtgacgctctaccattgggatctgccacagcggctgcaggatgcgtacggtggatgggccaaccgggcgctggccgaccacttccgggattacgcagaactctgcttccgccactttggaggccaggtgaagtactggattaccattgacaatccgtacgtcgttgcgtggcatggctacgccaccggccgcctggccccgggcatccggggaagcccgcgcctgggctaccttgtggcgcataatctgctgcttgcccatgctaaggtgtggcatctctacaatacttccttccggccgacgcagggcgggcaagtctcaatcgcgctctcatcccactggattaacccgaggcggatgacggaccatagcattaaggagtgccagaagtctctcgacttcgtgcttggatggttcgcaaagcctgtgttcattgacggagactaccctgaatcgatgaagaataatctgtcgtcgatcctcccagattttactgaatccgagaagaaattcatcaagggcaccgccgacttcttcgccttgtgcttcggcccaaccctgtcgtttcaattgctggatccgcatatgaaattccgccagctggagagcccgaatctccgccagcttttgtcctggattgatctggagttcaaccatccgcaaatcttcatcgtcgaaaatggatggttcgtaagcggaactactaaacgggatgacgcaaaatacatgtactatctgaagaagtttatcatggagacgctgaaagcaatcaagctcgacggagttgacgtcatcggatataccgcgtggtcactgatggacggcttcgaatggcaccgcggctactccatcagaagggggctcttttatgtcgactttctgtcacaggataagatgcttcttccaaagtcctcggccttgttctaccagaagctgattgaaaagaacgggtttcctccactgccggagaatcagccgcttgagggcaccttcccgtgcgacttcgcgtggggggtggtggataactacattcaggtgagccaattgactaagcctatctcgtctctcacgaaaccataccac

SEQ ID NO: 15155 - DNA, 1647 bp, Artificial Sequence; identical to SEQ ID NO: 15154
  Description of Artificial Sequence: Synthetic coding sequence

SEQ ID NO: 15156 - DNA, 1647 bp, Artificial Sequence
  Description of Artificial Sequence: Synthetic coding sequence
atgcccgcatccgcaccaccgaggagaccaaggccgccgcccccttctcttagcctcctcctggtcctgctgggtctcggcggccgcaggctgcgggccgaacccggcgacggtgcccagacatgggcccgattttctcgcccacccgccccagaagccgcagggctcttccaggggactttccctgacggcttcctttgggctgtgggttccgccgcgtatcagacggagggaggctggcagcagcatggaaaaggtgcctctatctgggataccttcacacaccaccccttggcccctcctggggattctagaaacgcctcccttccattgggtgcaccctctcccctccagccagcaaccggcgacgtcgcctccgatagttacaataatgtctttcgcgatacagaggctttgagagagttaggggtgacccattaccgattttccatctcctgggcaagggtgctgcctaatggatcagcgggggtacccaatcgcgagggcctcagatactacaggagacttcttgaaaggctgagggagcttggcgtgcagcccgtggttactttataccactgggaccttccccagcgcctccaagacgcgtatggcggctgggccaatagagccttggctgaccacttccgtgattacgcagaactgtgctttcggcactttggcggccaggtgaagtattggattaccatagataatccatacgtggtggcatggcacggatacgcaaccgggaggctcgcacctgggatccgcggcagccccaggctcggctacttggtagcccacaatcttctcctggcccatgcaaaagtttggcatttgtataacaccagcttcagacccacacagggtgggcaggtctcaattgcattatcctctcattggattaatcctagaagaatgacagaccactcgataaaggagtgccagaaatcactggacttcgttctcggctggttcgctaagcccgtatttatagatggtgactaccctgaatctatgaaaaataacttgtcgagcatcctgccagactttactgaatccgaaaagaagtttatcaaaggcaccgctgatttttttgctctgtgcttcggccccacgctcagtttccagttactggatcctcacatgaagtttaggcagctggagtctcccaatctccggcaactgctttcctggatcgacctggaattcaaccatccacaaattttcatcgtagagaatggatggttcgtctctggcactaccaaacgggatgatgcaaagtacatgtattatctcaagaagttcattatggagacacttaaagccatcaagctcgatggcgttgatgtcataggctatacagcctggtcactgatggatggctttgaatggcatcgtgggtatagcataaggcgcggacttttttacgtggattttctgtcacaggacaagatgctgttacctaaaagcagtgcactgttttaccagaagctgatcgagaagaacggtttccctcccttgccagagaaccagcctctagagggaacattcccctgtgatttcgcttggggagtagtggataactatatccaggttagtcagctaaccaaacctataagttccctgacaaagccctaccac

SEQ ID NO: 15157 - DNA, 1647 bp, Artificial Sequence; identical to SEQ ID NO: 15156
  Description of Artificial Sequence: Synthetic coding sequence

SEQ ID NO: 15158 - DNA, 1647 bp, Artificial Sequence
  Description of Artificial Sequence: Synthetic coding sequence
atgcccgccagcgctccgccgagacggccaagacctccgcctcctagcctctccctgcttctggtcctcctcggccttggcggccgtcggcttcgggctgaaccaggagatggtgcgcagacttgggcgcggttttccagaccaccggccccggaagctgctgggctgttccaaggaaccttccccgacggattcctctgggccgtgggctcagcggcctaccagactgagggtggctggcaacagcacggaaaaggcgcctcaatctgggacacttttacgcatcatccgctcgcaccgccgggcgattcgcggaacgcctcactgccgctgggggctcccagcccgctgcaacctgcgaccggcgatgttgcctcggattcatacaataatgtctttagggacaccgaggcattgagggagttgggagtgacccattatcgcttcagcatttcctgggcgagagtcctgcctaacgggtcggcaggagtcccgaatcgggagggcttgcgctattaccgccggttgctcgagcgattgcgcgaacttggagtgcagccagtcgtgacgctgtaccattgggacctgccgcagcggctgcaggatgcatacggaggttgggcaaaccgcgccctcgcggaccacttccgcgactatgccgaactgtgctttagacacttcggaggtcaagtgaagtactggatcaccatcgacaacccttacgttgtggcctggcacggatacgcaacgggacgtttggccccaggtattaggggaagccccaggctggggtacctggtggctcacaacctgctgttggctcatgccaaggtttggcacctgtacaatacttctttcagaccaacgcagggaggacaagtgagcatcgcactgtcctcgcattggattaacccgcgccggatgactgaccactccatcaaggagtgtcagaaatccctcgatttcgtgctcgggtggttcgcaaaacctgtgtttatcgacggggactaccctgaatcgatgaagaataacctgtcatcaatcctgcctgatttcaccgaatctgagaaaaagttcatcaagggtactgccgacttttttgccctttgcttcggaccgaccctttcgtttcagttgctcgacccgcatatgaaattccgccaactcgaaagccccaacctccggcagcttctgtcgtggatcgacctggagtttaaccacccccaaatcttcatcgtcgaaaatggttggttcgtgtcgggaaccactaagcgcgatgacgctaagtacatgtattatctgaagaagttcatcatggagactttgaaggcaatcaagctggacggcgtcgacgtgatcggatacaccgcgtggtcactgatggatggattcgaatggcaccgagggtactccatccgtagagggctcttctacgtggatttcttgtcgcaagataagatgctgctgcctaagtcctctgccctcttctaccagaagctgatcgagaaaaacggattccccccacttccggaaaatcagccgcttgaaggcactttcccatgtgacttcgcgtggggagtggtggacaactacatacaggtgtcccagctgaccaagcccatatcgtccctcaccaaaccataccac

SEQ ID NO: 15159 - DNA, 1647 bp, Artificial Sequence; identical to SEQ ID NO: 15158
  Description of Artificial Sequence: Synthetic coding sequence

SEQ ID NO: 15160 - DNA, 1647 bp, Artificial Sequence
  Description of Artificial Sequence: Synthetic coding sequence
atgcctgcttctgctccccctcgacgtccaagacccccaccgccgtcattgtccttgttactcgtgctactggggttgggcgggaggcgcctgcgggctgagccaggcgacggagcccagacctgggccagatttagcaggccccccgccccagaagccgccggcctgttccagggaacctttcccgacgggttcctctgggccgttggcagcgccgcctaccagactgaaggaggatggcagcagcatggcaagggtgccagcatatgggacacatttactcatcacccactggcgcctcccggcgatagtcggaacgcctcccttcccctgggagcccctagccccctgcagcccgccacaggggatgttgcctccgactcttacaacaacgtgttccgagacacagaagccttgcgcgagctgggggtgacgcactatcgcttctcgatctcctgggctcgagtgctacccaatgggtcagctggcgtccccaaccgggagggactgcgctattatcggagattgctggagcgcctgagggaactgggagttcagccggtggtgacactatatcactgggaccttccccagcggctccaggacgcctacggggggtgggctaaccgggcacttgctgaccattttcgggattatgcagagctttgctttcgccactttggtggccaggtgaaatactggatcacaatcgataatccgtacgtcgttgcgtggcatggctacgctaccggtcgcttggcacccggtattcggggttcccctaggctgggctacttagtggctcacaacctgctgctcgcccacgcaaaagtgtggcatctgtacaacacgtcctttcgaccgacacagggcggccaggtatcaatcgctcttagcagccactggattaatcctaggcggatgactgaccatagcattaaagaatgccagaagtctcttgattttgtgctggggtggttcgccaaaccagtttttatcgatggggactatcctgaatccatgaagaataatctgagcagtattctcccagacttcacagaatccgaaaaaaagtttatcaaaggcaccgccgacttcttcgctctgtgtttcggccccaccctgtctttccaactcctcgaccctcacatgaaatttcggcagctggaaagtccaaatctccgccagctcctctcctggatcgacctggagtttaatcatcctcagatctttatcgtggaaaacggatggtttgtgagtggaacaaccaaaagggacgacgccaagtacatgtactatctgaagaagtttatcatggagacactcaaagcaataaagcttgatggagttgatgtgataggctatacagcgtggtcccttatggatggctttgagtggcaccgagggtactccatccggaggggacttttctatgtggatttcctctcgcaggataagatgttgctgccaaagagtagtgcactcttctaccagaagctgatcgagaagaacggctttccgcctctgccagagaaccaacccctagaggggacgtttccctgcgattttgcatggggagtcgtcgataactatatccaggtttcacagttaacaaagccaatctcatccctaactaaaccataccat

SEQ ID NO: 15161 - DNA, 1647 bp, Artificial Sequence; identical to SEQ ID NO: 15160
  Description of Artificial Sequence: Synthetic coding sequence

SEQ ID NO: 15162 - DNA, 1647 bp, Artificial Sequence
  Description of Artificial Sequence: Synthetic coding sequence
atgccagcgagcgctcctccccgccggccacggccaccccctccttctttgagcttgctcctggtccttctgggacttggagggcgccgcttgcgcgccgaacccggtgatggagctcagacctgggcaaggttctctagaccacccgccccagaagccgctggactgttccagggaacatttccggacggctttctatgggcagtcggctccgcagcctatcagacagagggggggtggcaacagcacggtaagggcgccagtatttgggatacgtttacgcatcaccctctcgcacctccgggggatagtaggaacgcctcattgccattaggcgctccgtccccgctacaacctgccactggtgatgtcgcatccgactcctacaataatgtctttagagacacggaggctcttagagagctgggcgtaacccattaccgattcagcattagctgggcaagggtgctgcctaatgggtccgccggagttcctaatcgggaaggcctgcggtactataggagactcttggagagactgagggagctgggagtgcagcccgtcgttacattgtaccattgggacttgccccagaggttgcaggatgcttatggcggctgggctaaccgggctcttgccgatcattttcgggattatgcagaactttgtttccgacactttggtgggcaggtgaagtactggatcacaatagataatccatatgtggttgcctggcacggctatgctaccggccgcttagctccaggaattcggggaagccccaggctcgggtatcttgtggcacataaccttctactggcacatgccaaggtttggcacctatacaatacatcctttagaccaacacagggcgggcaggtgtccatcgccctttcatcacattggatcaatccacggcggatgacggatcacagcattaaggagtgccaaaagagcctggatttcgtgttaggctggtttgcaaagcctgtctttattgacggagattaccccgaaagtatgaagaacaacctttcaagcatactgccggactttacagagagcgagaagaaattcataaaggggacagctgactttttcgccctctgtttcggaccaaccctctccttccaactgctggatccacacatgaagtttcgtcagctggagtctccaaacctgagacagctgctttcttggatcgacctggaattcaaccacccccagattttcatcgtagaaaatggctggttcgtgtctggtaccacaaaacgggacgacgccaagtacatgtattacttgaagaagttcatcatggagaccctgaaagctataaaactggacggcgtggacgtgatcggatacaccgcctggagtttaatggatggttttgaatggcacaggggctactctattaggaggggtctgttctacgtggatttcctgtcccaggataagatgctgctaccaaagagtagcgctctgttttatcagaagctgattgagaagaacgggttccccccactccccgaaaatcagccactggaaggtacctttccatgtgatttcgcttggggagtggtggacaactatattcaggtgtcacagctcacaaagcccatctcatcactgaccaaaccatatcac

SEQ ID NO: 15163 - DNA, 1647 bp, Artificial Sequence; identical to SEQ ID NO: 15162
  Description of Artificial Sequence: Synthetic coding sequence

SEQ ID NO: 15164 - DNA, 1647 bp, Artificial Sequence
  Description of Artificial Sequence: Synthetic coding sequence
atgccagcgtcggctccgccacggcgcccacggccgccccctccctcccttagcctcttgctggtgctgctggggctcgggggaagaaggctgagggcggagccgggggacggagctcaaacttgggcacgcttctcgcgccctccggctccggaggcagccggattgtttcaaggcacgttcccggacggtttcctttgggccgttggatcggccgcataccagaccgaaggagggtggcagcagcacgggaaaggcgcatccatctgggataccttcactcaccatccgctggccccgccaggagactcgcggaacgcctccctgcccctgggtgcaccgtcccctctgcagccagccactggcgacgtggcgtccgactcatacaacaacgtattcagagacactgaagcgctccgggaactgggagtcacccattacaggttctccatctcatgggcacgcgtgctccccaacggatcggcgggggtcccgaaccgggaggggcttcggtactaccggcggctcctcgagagactgcgcgagctcggggtgcaaccggtggtgaccctgtaccactgggatcttccacaacgcctgcaggacgcatatggaggatgggccaaccgagccttggccgatcacttcagggactacgcagagctgtgcttccgccatttcggaggacaggtcaagtactggatcaccatcgacaatccatacgtggtggcgtggcacggctacgccactggtcgcctcgccccgggaatccgcggatccccgcgcctgggctatctggtcgcccacaacctcctgctcgcgcacgccaaggtgtggcacctgtacaacacctcattccggccaacccagggaggtcaggtgtccatcgccctgtcctcgcattggatcaatcccagacgcatgactgaccactcgatcaaggagtgccagaagagcctggattttgtgctgggctggttcgccaagcctgtgttcatcgatggagattacccagagtctatgaagaataatctctcctcaatcctgccggatttcacggaatccgagaagaagtttatcaagggaaccgccgacttctttgcactgtgctttggtccaaccctctccttccagctcttggacccccacatgaagttcaggcagctcgagtcaccgaacttgcgccaattgctttcatggatcgatctcgaattcaaccatccacagattttcatagtcgagaatggttggttcgtgagcggcaccactaagagagacgacgctaaatacatgtactacttgaaaaagttcatcatggaaaccctgaaggcgatcaaactggatggcgtcgacgtgataggatacactgcttggtcccttatggatggcttcgagtggcaccgaggatacagcatccggcggggactcttctacgtggatttcctgtcgcaagataagatgctgctccccaagagctccgcgctgttctaccagaaactgatcgaaaagaacggattcccccctctcccggaaaaccagccccttgaaggcacctttccgtgcgacttcgcctggggcgtcgttgacaattacattcaggtgtcgcaactgacgaagccaatctcatccctgactaagccataccat

SEQ ID NO: 15165 - DNA, 1647 bp, Artificial Sequence; identical to SEQ ID NO: 15164
  Description of Artificial Sequence: Synthetic coding sequence

SEQ ID NO: 15166 - DNA, 1647 bp, Artificial Sequence
  Description of Artificial Sequence: Synthetic coding sequence
atgcccgcctcagcccccccccggcggccacgacctccaccgcctagtctctctctccttctcgttctcttggggctcggagggcggcggctaagagctgaaccaggggatggagcacagacatgggctcgattctcacggcccccagcgcctgaggcagcagggctgtttcaagggacttttcctgatggatttctttgggccgtggggtccgcagcctatcagacagagggggggtggcagcaacacgggaaaggggcttcaatctgggatacatttacacaccaccccctcgccccacccggggatagtaggaatgcttcgctacctctcggagccccatcccccctacaaccagccacaggagatgttgcttccgattcctataacaatgtcttcagagatactgaggctctccgcgaattgggggttacacactatcggttttccatttcctgggcacgggtgctaccaaatggatcagctggagtacccaatagggaaggactccgatattataggcggctcctcgaacgacttcgggagctgggggtacagccagtagtaacactgtatcattgggatctgcctcagcggctccaggatgcatatggaggatgggccaatcgagccctcgccgatcacttccgagattacgccgaactatgctttaggcacttcggggggcaggtgaaatattggataacaatagataatccctatgtcgttgcttggcatgggtacgcgactggacgcctggccccagggattagggggtcaccccgcctggggtatctcgtggctcacaatctactattagctcatgccaaggtgtggcatctctataatacaagtttccgcccaactcaggggggacaggtgtccatagctctctcatcacattggatcaacccccggagaatgacggaccatagtatcaaagaatgtcagaaatccctggattttgtgctgggatggtttgctaaaccagtctttattgacggagattatcctgaatcaatgaagaacaaccttagttccatattacccgactttacagaatctgaaaagaaatttatcaaagggacagctgatttttttgccctctgttttgggcccactttgtccttccagcttctcgacccacatatgaaattcaggcagctggaatcccctaacctaaggcagttactttcatggatcgatttagaattcaaccacccacagatatttatcgtagagaacgggtggtttgtgtctggaacaacaaaacgggatgacgcgaagtatatgtactatcttaaaaaatttatcatggaaactctaaaagctatcaaactggatggagttgatgtgatcggatatactgcatggtcactaatggacgggttcgaatggcaccgggggtattccatcagacgaggactcttctatgttgatttcctatcccaggataaaatgctacttccaaaatcttccgccctcttctatcagaagctgattgagaaaaacggattccccccacttccagagaatcaaccactagaaggaactttcccatgtgattttgcctggggagtcgtggataactatatacaggtttctcagttaactaaacccatttcctcattaacaaagccatatcat

SEQ ID NO: 15167 - DNA, 1647 bp, Artificial Sequence; identical to SEQ ID NO: 15166
  Description of Artificial Sequence: Synthetic coding sequence

SEQ ID NO: 15168 - DNA, 1647 bp, Artificial Sequence
  Description of Artificial Sequence: Synthetic coding sequence
atgccagcgtcggccccaccaagacggccccgtccgccgccgccgtcactcagcctgctgctggtcctgcttgggcttggaggtcggagactcagggcagaacctggtgacggcgcacaaacttgggcacgattttctcggcctccagcacccgaagcggcaggactgttccagggaacctttccagacggctttttgtgggctgtcggtagcgcagcataccagacggaggggggatggcaacagcatggaaagggcgcttcaatctgggatacctttactcaccatcctcttgcaccccctggagactcgagaaatgcatcgctgccactgggcgccccaagccccctgcaacctgccaccggagatgtggcctcggacagctacaacaatgtgttccgtgacaccgaagctctccgcgagcttggagtgacccactacagattctcgatttcatgggcaagggtgctcccaaacggtagcgcaggagtgcctaaccgcgaggggttgagatactaccgtagactgcttgagcgccttcgcgaacttggcgtgcagcctgtggtgactttgtaccattgggatctgccccaaagactccaggatgcctacgggggatgggcaaaccgcgcactggccgatcatttccgcgattacgctgaactctgtttccggcattttgggggtcaggtcaaatactggattactattgataatccgtacgtcgtggcatggcatgggtacgcgactgggcgccttgcaccaggaattcgcggatcccctcgattgggctaccttgtggcacacaacctgcttctggcgcatgcaaaggtgtggcatctgtacaatactagcttccgaccaacccagggtggtcaagtgagcatagcactgagctcacattggattaacccccggaggatgacggaccacagcataaaggaatgtcagaagtcgctggattttgtgctgggctggttcgcaaaacctgtctttatagatggagattaccctgaatctatgaagaataacttgtccagcatcctgccggattttactgagtcagagaaaaagttcattaagggaacggcggatttcttcgcactttgttttgggcctactctgtcctttcaacttctggaccctcatatgaagttccgccaacttgaaagcccaaacctgcgccaactgctttcctggattgatctggaattcaaccatcctcagatattcatcgtagaaaacggatggtttgtctcgggtactacgaaaagagatgacgcgaaatacatgtactacctcaaaaagttcatcatggaaactctcaaagccatcaagctcgacggtgtggatgtgatcgggtacaccgcgtggtcccttatggatggatttgagtggcatcgcggttactcgattaggcggggtctgttttacgtggattttctgtcacaggacaagatgcttctgccaaagtcgtccgcactcttttaccaaaaactgattgaaaagaatgggtttcctccgctcccagagaatcagcctttggaagggaccttcccgtgtgactttgcctggggcgtggtcgataactacattcaggtgtcacaactgaccaagccgatatcttcacttaccaagccgtaccat

SEQ ID NO: 15169 - DNA, 1647 bp, Artificial Sequence; identical to SEQ ID NO: 15168
  Description of Artificial Sequence: Synthetic coding sequence

SEQ ID NO: 15170 - DNA, 1647 bp, Artificial Sequence
  Description of Artificial Sequence: Synthetic coding sequence
atgcccgctagcgcccctcctagacgacccagacctccccccccgtcactgtctcttctgttggtcctgctgggcctgggcggtaggagacttcgcgccgaacctggcgatggcgcccagacatgggctcgcttctcaaggcccccagcaccagaagccgctggactgtttcagggcacattccccgatggtttcctatgggccgtgggatccgccgcttatcagaccgaaggtggatggcagcagcacggcaaaggagcatccatttgggacacatttacccaccacccactggccccccccggagactcccgaaatgcaagcttgccgctgggtgcccctagcccgctccagcccgcgacaggggatgtcgcgtctgattcttataataatgtattccgagacaccgaggccctccgggaactgggcgtaacacattaccggttctctataagttgggcaagggttctcccgaatggtagcgctggggtgcctaatcgggagggtctgcggtactaccgtcgtttgctggaacggcttagggagttgggggttcagcctgttgtgactttgtaccactgggacttgccacaacgcctgcaggatgcctatggcggctgggcaaatcgggccctggcagatcacttccgggattacgcagagttatgcttcagacattttggcggccaggtgaaatactggatcacaattgataacccatacgtggtagcgtggcacggttatgctactgggcgcctggctccggggattagagggtcgccccgcttgggatacctggtcgcacacaatctgctacttgcccacgcaaaggtctggcatttgtataacacaagcttcaggcctactcagggaggtcaggtcagtatagcacttagctcgcattggattaatccccgcaggatgacggaccattccatcaaggagtgccagaagtcgctggactttgtcctgggatggttcgcaaagcccgtctttatcgacggcgattatcccgaaagtatgaagaacaatctttcaagcatcttgcctgatttcaccgagtctgagaagaagttcataaaaggtaccgccgatttcttcgcactttgctttggacccacactgtcgtttcaactgctggacccccatatgaagttccgacaactggagtccccgaacctccggcagctgctgtcctggatcgacctggagttcaaccaccctcagatcttcatcgtcgaaaatggttggtttgtgtccggcactacgaagcgggacgatgccaaatacatgtactacctgaagaagttcatcatggaaaccttgaaagcaattaagctagatggcgtggatgtaattggctacaccgcctggagtttgatggatgggtttgagtggcatcgaggctattcgattcgacgaggactgttttacgtcgacttcttgtctcaggataagatgctcctcccaaagtcatccgccctgttctatcagaagttgatagaaaaaaacggattccctcccttgcctgagaatcaaccacttgagggaacattcccttgcgatttcgcgtggggcgttgttgataattatatccaggttagccaactcacgaagcccatttccagtctgacaaagccctatcat

SEQ ID NO: 15171 - DNA, 1647 bp, Artificial Sequence; identical to SEQ ID NO: 15170
  Description of Artificial Sequence: Synthetic coding sequence

SEQ ID NO: 15172 - DNA, 1647 bp, Artificial Sequence
  Description of Artificial Sequence: Synthetic coding sequence
atgccggcctccgcgcccccacgccggcctagaccgccgccaccgtccctgtctctgctgctggtgctcctggggcttgggggacggaggctgcgggccgaacccggcgacggggctcagacttgggcgagattttccaggccgccggcgccagaggctgctggattgttccaaggtacttttcccgacggattcctgtgggccgtgggaagcgccgcgtaccagactgagggaggctggcagcagcacggaaaaggagctagcatctgggacactttcacccatcatccgctggcaccgccgggagactcgcggaacgcctcccttccgctcggcgcaccctccccgttgcaacccgctacgggtgacgtcgcttcagactcatacaataacgtgttccgcgataccgaggcgttgcgggaactcggcgtcactcactacagattttccatcagctgggctcgggtgttgcctaacggaagcgcgggtgtgcccaatcgggaaggactgcggtattaccgccggttgctggagaggctccgggagcttggagtgcaaccagtcgtcaccctctaccattgggatctcccacagcgcctgcaggatgcgtacggaggctgggcaaaccgggccctcgccgaccacttccgggactacgccgagctgtgttttcggcacttcgggggacaggtgaaatactggattaccatcgataacccatacgtggtggcgtggcatggatacgctactggacgtctggccccgggaattcgcggatccccgagactcggttatctggtggcccacaacctcctgctcgcccacgctaaggtctggcatctttacaacacttccttcaggccaacccaggggggccaagtttcgatcgcactgagcagccattggatcaatccacggcgcatgaccgatcattccatcaaggagtgccagaagtcgctggacttcgtgctgggttggttcgccaaacctgtgttcattgacggcgactacccagaaagcatgaagaacaacctctcgtccattctcccggatttcactgaatcagagaagaagtttatcaagggtactgcggatttcttcgccctgtgcttcggacccacgctgtcgtttcagctgctcgatccccacatgaagttcaggcaactggaatcgcctaatctgcgccagctgctgtcgtggatcgacctggagttcaaccatccgcaaatcttcatcgtggaaaatggatggttcgtctcgggcactacgaagcgtgacgacgccaagtatatgtactacctgaagaaattcatcatggaaaccctcaaggctatcaaacttgatggcgtggatgtgatcgggtacactgcctggtcgctgatggatggattcgaatggcatcgaggatacagcatcagacggggcctcttctacgtcgattttctctcccaagacaagatgctcttgcctaagagctccgcgctgttttaccagaagctgatcgagaagaacggctttcctccgctgccggaaaaccagcctttggagggcacctttccatgcgacttcgcctggggggtcgtcgacaattacattcaggtgtcccagctgaccaagccgatttcttcgcttaccaagccataccat

SEQ ID NO: 15173 - DNA, 1647 bp, Artificial Sequence; identical to SEQ ID NO: 15172
  Description of Artificial Sequence: Synthetic coding sequence

SEQ ID NO: 15174 - DNA, 1647 bp, Artificial Sequence
  Description of Artificial Sequence: Synthetic coding sequence
atgcccgcttccgcgcctcctcggaggcctcgaccaccgcctccatcgctctcgctccttcttgtgctgcttggtcttgggggtcggaggctccgggcagaacctggtgatggcgcacagacctgggctagattttcaaggcctccagcacctgaagcagcaggtctgtttcaaggaacgttcccagatgggttcctttgggcagtgggctctgcggcttaccagactgaaggcggttggcagcaacatggaaagggagcctccatttgggatacctttactcatcatccactggcgcctccgggcgattcacggaacgcgtctcttccactcggagcaccatcgcctctccaacccgcaaccggggatgtggcatcagattcgtacaataacgtgtttcgtgatactgaggcactcagggaattgggagtgactcattacaggttctccatttcgtgggcaagagtcctgcctaacgggtcggcaggtgtccccaatagggagggactgagatactaccgccgactcctggaacgacttcgggagctgggagtgcagcctgtggtcactctttatcattgggacctgcctcagcgccttcaagacgcatacggtggatgggcgaatcgtgcactcgcggaccatttccgggactacgccgaattgtgcttcagacactttggaggtcaagtgaagtattggataacgatagacaatccatacgtggtggcctggcatggatacgcaaccggacggcttgcgccaggtattcgcggatccccgcgactgggatacctggtggcacataacttgctgctggcccatgcaaaggtctggcatctgtacaacacctcattccgtccaactcagggtggtcaagtctcaattgcgcttagctcgcattggattaacccacgaagaatgactgaccactcaattaaggaatgtcagaagtcgctggattttgtgcttggatggtttgctaagccagtgttcatcgacggcgactacccagaatccatgaaaaacaatctttcatcgatcctgccagatttcaccgaatcggagaagaagtttatcaagggcaccgctgatttcttcgctctctgttttgggccaaccttgtcctttcaacttctggatccgcacatgaagtttagacagcttgagagccctaacctgagacaacttctgtcatggattgaccttgagttcaatcaccctcagatctttatcgtggaaaacggatggtttgtgagcggaaccactaagagagatgatgccaagtatatgtactacttgaaaaagttcatcatggaaacgctgaaggccattaaactggacggcgtggacgtgatcggttacactgcgtggtcacttatggatggattcgaatggcataggggttacagcatacgtcgtggtttgttctacgtcgactttctcagccaggataagatgcttctgcccaaaagctcagcactgttttaccaaaagctgattgagaaaaatggctttcctcctctgccagagaaccaaccactggaaggtacctttccgtgtgatttcgcttggggagtggtggataactatattcaagtctcgcaattgaccaagcccatttcctcgctgaccaagccctaccac

SEQ ID NO: 15175 - DNA, 1647 bp, Artificial Sequence; identical to SEQ ID NO: 15174
  Description of Artificial Sequence: Synthetic coding sequence

SEQ ID NO: 15176 - DNA, 1647 bp, Artificial Sequence
  Description of Artificial Sequence: Synthetic coding sequence
atgccagccagcgcacccccgaggaggcctcggccaccgcctcctagtctatcactgcttctggtcctattgggattaggaggcagacggcttagggcggagcccggtgatggagctcagacctgggcacgtttctcccgccccccagctcctgaggctgcaggattgttccaaggtacgtttcccgatgggttcctctgggccgtgggttctgctgcttatcaaacagagggcgggtggcagcagcatgggaagggcgcgtctatttgggacacgttcacccatcatccactggccccaccaggcgattccaggaacgcctccctcccactcggggctccctcccctcttcagccagccacaggagatgtggcgtctgatagctacaataatgtgttcagggatacggaggcactgcgcgaactgggggtcacccactaccggtttagcattagttgggcacgagtgctccccaacgggagtgcaggcgttcccaatagggaagggctgaggtactacagacggctgttggaacggctgcgcgagctcggtgtgcagcccgtagttacactttatcactgggatctgccccagaggcttcaagatgcctacggaggttgggcaaatcgcgccctggcggatcatttcagagattatgccgagctctgctttaggcacttcggcggtcaggttaaatattggatcactatcgataacccgtacgttgtagcgtggcacggatacgcgaccggccggctggcccccggaattagagggagtcctaggcttggctacctggttgcccataacctgctgttggcacatgcgaaggtctggcatctgtataacacatcgtttcgaccaactcagggagggcaggtgtccatcgcattgtcaagccactggatcaaccccaggaggatgactgatcactccatcaaagaatgtcagaaaagtctggacttcgtgctcggctggtttgcaaagcctgtctttatcgatggggactatcccgagtcgatgaaaaacaatttatcctcaatactgccagattttactgaatctgagaagaaatttattaagggaacggccgatttcttcgctttgtgctttggacctactctctctttccagttgctggatccacacatgaagttccgacagttagaatcgccaaatttgagacagttgctctcctggatcgacctggaatttaaccatccacagatcttcattgtagagaacgggtggttcgtgtccggcactacaaagagagacgatgctaagtatatgtattatctgaagaaattcatcatggaaaccctgaaagccattaagctggatggtgttgatgtgatcggatacacggcttggtcactgatggatggatttgagtggcatcggggctactccatccgacgtgggttgttctatgtcgattttctgtcccaagacaagatgctgctaccaaagagtagcgcgctcttttaccaaaagctgattgaaaagaacgggttccctcctctccctgagaatcagccactagagggtacattcccgtgcgatttcgcctggggcgtggttgataattatattcaggtaagccagttgacaaagcctatctcttccctcaccaagccataccat

SEQ ID NO: 15177 - DNA, 1647 bp, Artificial Sequence; identical to SEQ ID NO: 15176
  Description of Artificial Sequence: Synthetic coding sequence

SEQ ID NO: 15178 - DNA, 1647 bp, Artificial Sequence
  Description of Artificial Sequence: Synthetic coding sequence
atgccagcaagtgctccccctagacgcccacggcctccgcctcctagcttaagcctgctgctggtgttactaggcttgggcggcaggcgcctgcgcgccgagcccggggatggcgctcagacctgggcccgattctcaaggccccccgcacccgaggccgccggcctgttccagggcactttccctgatggcttcctatgggccgtggggagcgctgcctaccagaccgaagggggctggcagcagcatgggaaaggggcttccatttgggatacctttacacaccatccgctggcccctcctggagactctcgcaacgcctctcttccgctgggcgcaccaagtcctctgcagcccgccaccggcgatgtagccagtgattcttacaacaatgtgtttagggacacggaggcgctacgcgaactcggggtgacccattatcgattctctatctcttgggcaagagttctgccaaatggcagcgctggggtgcccaatagggaggggttacgttactatcggcgtctactcgagaggttgcgggagctgggggtacagcccgttgtgacgctttaccactgggatctgcctcagcgtttgcaagacgcatacggaggctgggcaaatcgggctctggccgaccactttagagattatgccgagttgtgttttcggcactttggcggccaggtgaagtattggattaccatcgataacccctatgtcgtcgcttggcacggttacgctaccggccgcctcgcgccagggatcagaggcagcccccgactcggctacctagtcgcacacaacctgctcctcgcccatgcgaaggtatggcacctttataataccagctttaggccaactcaaggcggccaggtctctattgccttgtcatcccactggattaaccctcgaagaatgaccgatcacagcattaaggaatgtcagaagagtttggacttcgtgctcggctggtttgctaaacctgttttcatcgatggagactaccctgaatccatgaagaacaaccttagctctatattacctgacttcacagagagcgaaaagaagtttatcaagggcactgccgacttctttgcattgtgttttggacccaccctatcatttcagctgttggacccccacatgaagttcaggcaacttgaaagcccaaacctaaggcagctgctgagctggattgatctggaatttaaccatcctcagatattcatcgtcgagaatgggtggtttgttagcgggaccactaaacgggacgatgccaagtacatgtattaccttaagaaatttattatggagacacttaaggcgattaagctggacggtgtggacgttattggttacaccgcctggagtctaatggacggtttcgagtggcatagagggtatagcattcgccggggattattctatgtagactttctgagccaggataagatgctgctgccaaagtcatctgcactgttttatcaaaagctgattgaaaaaaatggctttccacctttgccagaaaaccaacccctggaggggacattcccatgtgactttgcctggggcgttgtagataattacattcaggtttcgcagttaacaaagcccatttcttcactaactaaaccatatcat

SEQ ID NO: 15179 - DNA, 1647 bp, Artificial Sequence; identical to SEQ ID NO: 15178
  Description of Artificial Sequence: Synthetic coding sequence

SEQ ID NO: 15180 - DNA, 1647 bp, Artificial Sequence
  Description of Artificial Sequence: Synthetic coding sequence
atgcccgcctctgctcctcctcgtcgcccaagaccacccccgccttctctctcgctccttctagtcttgctcggcctcggcgggcgaaggcttcgtgcggagccgggcgatggcgcacagacatgggccaggttttcacggccgcctgcgcccgaagccgctggcctttttcagggcactttcccagacgggtttctgtgggcggtgggtagtgccgcctatcagacagagggaggctggcagcaacacggcaagggcgcgtctatctgggacacattcacccatcaccccttggcccctccaggggattctcgtaacgccagcttgcctctgggcgccccatccccactgcagccggccactggagacgtggcctcggactcctacaacaacgtgttcagggatacggaggccctgagagagttgggtgtgacacactaccgcttctcaatcagttgggcccgagtcctgcctaacggctctgccggagtgcccaatagggagggtctccgatactaccggcgattgctggagcggttgcgggagctcggtgtccagccagttgtcacattgtaccattgggatctgccccagagattacaagacgcctacggcggctgggctaaccgtgccctggcagatcacttccgcgactatgctgagctgtgctttagacactttgggggtcaggtgaagtactggattactatcgataacccgtatgtggtggcatggcacggttacgctaccgggcgcctggcacccggtatcagaggctctcccaggctaggttatctggtcgctcataacctgcttttggcccacgccaaagtgtggcatctgtataatactagctttagaccaacacaaggaggtcaggtgagcatagcactcagctcacactggatcaacccacggagaatgacagaccattctatcaaagagtgtcagaaatcactagacttcgttttgggctggttcgcgaaacctgtgttcattgatggggactaccctgagtctatgaaaaacaacttaagctcgatcctccccgacttcacggagagcgagaagaaattcatcaagggaactgccgacttttttgccctgtgcttcggtcctaccctcagtttccaattgttggacccacacatgaaattcaggcaacttgaatcccctaaccttcggcagttgctaagttggatcgatctggagttcaatcatccccaaatctttattgttgaaaacggctggttcgtgagcggaacaacgaagcgcgatgacgcgaagtatatgtactatctcaagaagttcatcatggagactctgaaagctattaagctggacggggtggacgtgatcgggtacacagcatggtctctgatggacggttttgagtggcatcgagggtacagcatccgcaggggcctattctacgtggactttctttcacaggacaaaatgttgctgccaaagagctctgccctgttctaccagaagcttattgaaaagaacggctttcctcctctgcctgagaatcagcccctcgagggaaccttcccgtgcgatttcgcctggggtgtcgtggacaattacatccaggtgtctcaactgaccaagcctatctcttccctcacaaagccataccac

SEQ ID NO: 15181 - DNA, 1647 bp, Artificial Sequence; identical to SEQ ID NO: 15180
  Description of Artificial Sequence: Synthetic coding sequence

SEQ ID NO: 15182 - DNA, 1647 bp, Artificial Sequence
  Description of Artificial Sequence: Synthetic coding sequence
atgcccgcatccgcacctcctcgccgccctcgcccacctccaccgagcctttctctcttgcttgtccttttgggactgggcggtcgaaggctgagagcagaaccaggtgatggtgctcagacttgggcaagattctcaagaccacccgcaccggaggctgccgggctgttccaggggacttttcctgacggatttctttgggcagtgggttccgcagcataccaaactgaaggaggctggcagcagcatggtaagggagcgtcaatatgggacacttttactcatcatccactggcaccacccggagattccagaaatgcatcgcttcctctcggagcaccctctccgcttcaacctgcaaccggggacgtcgcgtccgacagctacaataacgtgttcagggatacggaagcactgcgggaactgggcgtgacccattatcggttttccatttcgtgggcccgagttttgcctaacggttcagctggtgttccgaacagagaaggtctgcggtactacaggcgtctcttggaaagactgagggaacttggtgtccagcctgtggtgactttgtaccattgggatcttcctcaacgattgcaagatgcatacggcggttgggcaaaccgcgctcttgcggaccactttcgcgactacgcagagctgtgctttaggcactttggaggccaggtgaagtattggattactattgataacccttatgtggtggcatggcatggatacgcaaccggaagattggcgccgggaattcggggcagtccacgtctggggtatcttgtcgcgcataatctcctgctggcacatgctaaagtctggcatctgtacaacacctcgtttcgtcctacccaaggaggacaggtttccattgcactgtcgtcccactggattaaccccaggcggatgaccgatcactcgattaaggaatgtcaaaagtcgctggattttgtgttgggatggttcgcaaagcctgtgtttatagatggcgactaccccgagtccatgaagaataacctttccagcattctccccgattttaccgaaagcgaaaagaagttcataaaaggaactgccgacttttttgcactttgttttggtcctactctctcgtttcagcttctggacccccacatgaaatttcgccaacttgaaagccccaatctgcgacaactcctgtcctggatcgatcttgaattcaaccaccctcagattttcattgtggagaatggttggttcgtgagcggaaccaccaagcgagatgatgccaagtatatgtactaccttaagaaattcattatggaaactctgaaggccattaagctggatggtgtggatgtgatcggatacaccgcatggtccctcatggatgggtttgagtggcatcgggggtactccatccgaagaggccttttctacgtggattttctctcacaggacaaaatgcttctgccaaaatcatccgcgcttttctatcaaaagctgattgagaagaacggtttcccacctctgcctgagaatcagcctctcgaaggaacttttccttgcgatttcgcatggggtgtggtggataactacatacaggtatcacaactcaccaagcctatttcgtcactcactaagccgtaccat

SEQ ID NO: 15183 - DNA, 1647 bp, Artificial Sequence; identical to SEQ ID NO: 15182
  Description of Artificial Sequence: Synthetic coding sequence

SEQ ID NO: 15184 - DNA, 1647 bp, Artificial Sequence
  Description of Artificial Sequence: Synthetic coding sequence
atgccagcttctgccccacctcggcggccccgcccccctccgccttcactcagcttactccttgtgctgcttggactgggcggaaggagattacgcgcagaacctggcgatggcgcccagacatgggcccgcttttcacggcccccagcccctgaagctgctgggctcttccagggaaccttccccgacggttttttgtgggcagtgggcagcgcagcgtaccaaactgaaggaggctggcaacagcatggcaaaggcgcctctatttgggatactttcacacatcatccccttgccccccccggcgattcgcggaatgcctctctgcccttaggcgcacctagtccgttacaaccagctaccggagatgtggcctctgactcttataataacgtctttcgcgacaccgaagctctgagagagctgggtgtgacgcactatcggttttctattagctgggccagggtgcttccaaacggatcagcaggtgtgcctaatagggagggtctacggtactacaggcgcctgctggagcgccttcgcgaactaggtgttcagcccgttgtgacgttatatcactgggatctgcctcagagactgcaggatgcgtatgggggctgggccaatagggcgctggcagatcatttccgggactacgctgaactgtgctttcgccattttggaggtcaagtcaagtattggatcacaatagacaacccctacgtagtggcatggcacggatacgccacaggtaggctggcgcccggcatcagggggagcccccggctgggttacctggttgcccacaaccttctgctggcgcacgcgaaggtttggcacctgtataatacttcgttcaggccaacgcagggcggacaggtctctattgcgctttcttctcactggattaaccctcgcagaatgaccgaccactctataaaggagtgtcagaagtcgctcgacttcgtgctggggtggtttgcaaagcccgtattcatcgacggggactatcccgagtctatgaagaataacctttcctccatactgccagattttaccgaaagcgagaagaagtttattaaaggtactgccgacttttttgctttgtgcttcggcccaacactgtcatttcagctcctcgaccctcatatgaagtttcgacagctggagagtcctaacctgagacagttgctgtcgtggatcgatctggagtttaatcatccccaaatctttatcgtagagaacggatggttcgtcagcgggaccacaaaaagggatgacgccaagtatatgtactatctgaaaaaattcatcatggaaactcttaaagccataaagctcgacggcgtcgacgtgattggctacacggcttggagcctgatggacgggttcgagtggcaccgaggatactcaatccgacgaggactgttctatgttgactttctgagtcaggataagatgttgctccctaaatcgtccgcactgttttatcagaaactaatcgaaaagaatggtttccctccactgccagaaaaccagcctctggaaggcacctttccgtgcgattttgcttggggcgtggttgataattatatacaggtaagtcagctgacaaaacctattagcagtttgacgaaaccctatcac

SEQ ID NO: 15185 - DNA, 1647 bp, Artificial Sequence; identical to SEQ ID NO: 15184
  Description of Artificial Sequence: Synthetic coding sequence

SEQ ID NO: 15186 - DNA, 1647 bp, Artificial Sequence
  Description of Artificial Sequence: Synthetic coding sequence
atgcccgcatctgcccctccccgtagacccagaccacctccaccttcgctttcacttctgcttgtccttcttggacttggcggacgcagactccgcgccgagcccggagacggagcacagacgtgggctcggtttagtaggccccccgcccctgaggcagcagggctctttcaaggaacgttcccggatggttttctgtgggccgtgggttcggcagcatatcagacggaaggaggatggcaacagcatggcaagggtgcgagtatctgggatactttcactcatcaccctcttgctccacccggagatagtcgaaatgccagtctcccactcggagcaccctcaccactgcagccagcaactggggatgtggcaagcgactcgtacaataacgtctttcgcgataccgaagcactccgtgagctcggagtgacccattacagattttcgatctcgtgggcacgggttctccctaacggaagcgccggggtgcctaaccgcgagggacttagatactaccgacggcttcttgaaagactgcgtgagcttggcgtgcaacctgtggtcactctgtaccactgggatctgcctcaacggctccaggacgcctatggagggtgggcaaatagagcacttgcggaccactttcgtgactacgcagagctgtgttttagacattttgggggacaggtgaagtactggattaccattgataatccatacgttgtggcgtggcatggctacgccaccggtcgcttggctcccggcattcgtggatcgcctaggttgggttacctggtggcacataacctccttcttgctcacgcaaaggtgtggcatctgtacaatacttccttcaggcctacgcagggtggccaggtgagcatcgctctgtcctcacactggataaaccctcgccggatgactgatcattcgatcaaagaatgtcaaaagagcctcgacttcgtgttgggatggttcgctaagccggtctttattgacggcgactaccccgaatccatgaaaaacaatctgtcatccattctgcctgactttaccgaaagcgaaaagaagtttatcaaaggaaccgcggacttttttgcactgtgtttcggaccaaccctgtcgtttcagctgctggatccccacatgaagttccggcaattggaatctcctaacctgagacaacttttgtcatggattgatcttgagtttaatcatccacaaatctttattgtggaaaacggttggttcgtctcagggactaccaaaagagacgacgccaaatacatgtactacctcaaaaagtttatcatggaaacccttaaagcaattaagctcgatggagtagacgttataggctacaccgcatggtcgctcatggatggttttgaatggcatcgaggatactcgattcggcgaggcctcttctacgtggatttcctgtcccaagataagatgctgctgcctaagagctcggcccttttctatcagaagctgatcgagaagaacggtttcccgccattgcccgaaaaccaacctcttgagggtacttttccttgcgatttcgcatggggtgtggttgataactatatacaagtctcgcaactgacgaagcctatttcctccctgaccaagccctaccac

SEQ ID NO: 15187 - DNA, 1647 bp, Artificial Sequence; identical to SEQ ID NO: 15186
  Description of Artificial Sequence: Synthetic coding sequence

SEQ ID NO: 15188 - DNA, 1647 bp, Artificial Sequence
  Description of Artificial Sequence: Synthetic coding sequence
atgccagcctccgccccacccagaaggcctcggccccctccaccatcactttccctgctgctggttctgctgggtctggggggcaggagattgcgcgccgaaccaggagacggtgctcaaacctgggcccggttttcgcggccccctgcacctgaagcagcaggattgtttcagggcacgtttcctgacggcttcctgtgggccgtgggatccgcagcgtaccagactgagggtgggtggcaacaacacggcaaaggtgcatcaatctgggacactttcacgcaccacccccttgcaccacctggagactcacgaaatgcctctctccctcttggcgccccttcgcccctgcagcctgcgaccggtgacgtcgcgtcggattcatacaacaacgtgtttcgcgacactgaagcactccgagaattgggcgtgacccactacagatttagcatctcctgggcacgtgtgctgcctaatggtagcgccggcgtccctaaccgggagggccttcgatactacagacggctgctcgaacggctccgggagctcggcgtgcaaccagtcgttaccctttaccactgggatcttcctcaacgactgcaagatgcttatggtggttgggcaaatagagccctggccgatcattttcgcgactatgctgaactttgctttcgccatttcggtggtcaagtgaaatactggatcacgattgacaacccctacgtggtggcatggcacgggtacgcaaccggacgtttggcccccggaattagaggatcgcctaggcttggttacttggtcgcacataatcttctgcttgcgcatgcaaaagtctggcatctttacaatacctcatttagacctactcagggtggacaagtctcgattgctttgagcagccattggattaacccgagacgcatgactgatcacagcataaaggagtgtcaaaagtcccttgatttcgtgctgggatggttcgcaaagcctgtgttcatcgatggggattaccctgaatcaatgaagaataacctttcgtccatacttccagatttcaccgagtcggagaaaaagttcattaagggtaccgcagacttttttgcgctttgcttcggacctaccctgtccttccaattgctggatccccatatgaaatttcgacaactcgagtcccctaacctgaggcaacttctgtcatggatcgatctcgagtttaaccatcctcagattttcatcgtggagaacggctggtttgtgtcgggaacgacgaagagagacgacgcaaagtatatgtattaccttaagaagttcataatggaaacccttaaggcgatcaagctggacggagtggatgtcattggatacaccgcttggagcctgatggacggttttgaatggcatagaggttacagcatcagaagaggtcttttctatgtggattttctgagccaagacaagatgctgcttccaaagagctccgcactgttctaccaaaagctcattgaaaagaacggttttccgcctctgccggaaaatcaacctctggaaggaacgtttccttgcgattttgcctggggagtggtcgataactacatacaagtctcccaacttactaaaccgattagcagcctgaccaaaccctaccat

SEQ ID NO: 15189 - DNA, 1647 bp, Artificial Sequence; identical to SEQ ID NO: 15188
  Description of Artificial Sequence: Synthetic coding sequence

SEQ ID NO: 15190 - DNA, 1647 bp, Artificial Sequence
  Description of Artificial Sequence: Synthetic coding sequence
atgcctgcctcagcacccccccggcgccctaggccccctcctccatctcttagtctgcttctggttttgctggggctcgggggccgcaggcttcgggcggaaccaggagatggcgcccagacctgggctcgcttctctaggccccccgcccctgaggccgcgggcctgttccagggaactttcccggacgggttcctttgggccgtggggagcgcagcataccagactgagggcggttggcagcagcatggtaaaggcgcatcaatctgggacacttttactcaccatccgctggccccacccggcgactcacgcaacgcatctttgccattgggcgcgccctctccactgcagccagctaccggagatgtggctagtgatagctataacaacgtatttagagatacagaggctttgcgggaactcggagtgacccactaccgcttctccatcagctgggctagagttctgcccaatggtagtgcaggtgttccaaatcgcgaaggtctgcggtattacaggcgcctcctcgaaaggctccgggaactgggtgtgcagcccgtcgtcaccctctaccactgggatcttcctcaacggctgcaggacgcctatgggggatgggccaaccgagcactcgccgaccactttcgggattacgccgagttgtgttttcggcacttcggtgggcaggttaagtattggattactattgataacccttacgtggtggcctggcacgggtatgcaaccggacggctggcccccggaatccggggctcacctagactcgggtatctggtcgcacacaacctgctcctggctcatgccaaggtatggcacctttacaatacaagttttcgccccactcagggagggcaggtgtctatcgccctgagttcccattggatcaacccccggcgaatgacagaccactccatcaaggagtgtcagaaatccttggattttgtcctgggctggttcgccaaacccgttttcattgacggcgattacccggagagtatgaaaaacaacctgagcagcatcctccctgattttactgaatccgaaaagaaattcattaaaggcacggctgacttttttgccctgtgctttgggccaaccctgagcttccagctcctggatccccacatgaagtttcgacaattggaatcccccaatctgagacagctcctttcctggattgatttggagtttaatcatcctcagatcttcatcgtggaaaacggttggttcgtctcaggcacaacaaagcgggacgatgccaaatacatgtattatttgaagaagttcataatggaaaccttgaaagctatcaagctcgacggcgtcgatgtgattggatacacagcctggtctttgatggatggtttcgagtggcatcggggatactcaatcaggagaggactgttctacgtcgactttttgtcccaggacaagatgctcctgcctaaatcctccgctctcttttaccagaaacttatcgaaaagaacggtttcccccctcttccagagaatcagccacttgaagggaccttcccgtgtgatttcgcctggggagtggtggataactatatccaagtatctcagctgaccaagccaatatcctccttgactaaaccctaccat

SEQ ID NO: 15191 - DNA, 1647 bp, Artificial Sequence; identical to SEQ ID NO: 15190
  Description of Artificial Sequence: Synthetic coding sequence

SEQ ID NO: 15192 - DNA, 1647 bp, Artificial Sequence
  Description of Artificial Sequence: Synthetic coding sequence
atgcccgcctctgcccctcctcgccggcctcgtccccctcctccttctctttcattgttattggttctcttagggctgggcggaagaagactgagggccgagccgggggacggcgcacaaacttgggcaagatttagccggccccccgccccagaagccgccggtctattccagggtacgttcccagatgggtttctctgggcagtgggaagcgcagcctatcagactgagggtggatggcaacaacacggcaaaggagcttctatctgggatacattcactcatcatcctctcgccccgccaggtgattcacgcaacgcctctctgcctttaggagcaccgtcacccttacaacctgctaccggcgacgtagccagcgactcttacaacaacgtgtttcgggacacagaggcccttcgagagctcggagtgactcactatcggttcagcatatcctgggccagggtattgcctaacggcagcgccggggttcctaatagggaaggcctcaggtattatcgcagattgttagagcggctaagggaactgggagtgcagccagtggtgacactctaccattgggatctgccacagagactgcaggatgcctatggcggatgggcaaatagagcattggccgatcatttccgcgattacgcagaactgtgttttcgccattttggagggcaggtgaaatattggataactatcgacaatccatacgtcgtagcatggcatggatatgccaccggccgccttgctccaggcatccgaggaagcccccggttggggtacctcgttgcccataacctgcttctggcccatgcgaaagtgtggcacctgtacaacacttcgttccgcccaacccagggcggacaggtctccatcgctctgagctcccattggattaacccacgccgtatgaccgaccatagtattaaggaatgccagaagtccctggactttgttctgggctggttcgcaaaacccgtcttcatagacggagattatccagaaagcatgaagaataatctgagtagtatactgccggacttcacagaatcggagaagaaattcattaagggcaccgccgacttctttgctttgtgctttggaccaactctgagctttcagctccttgacccccacatgaagttcagacagctggaatcacctaatttacgccagctactgagctggatcgacttggagttcaaccatcctcagatctttattgtggaaaacgggtggtttgtttcggggacgactaaacgagacgatgcgaagtatatgtattatttgaagaaattcatcatggaaacgttgaaagcaattaagctggacggggtggatgtaatcggatacaccgcatggtccttgatggatgggttcgagtggcacaggggttactctattagacgaggcctgttttatgtcgattttctgagccaagacaagatgctgcttcccaagtcaagtgccctcttttatcagaagctaatagagaaaaacgggtttccgccactgcccgaaaatcaaccactggaaggtacattcccttgtgattttgcctggggggtcgtcgataactatatacaggtgagccagctcacaaaacctatatcctccctcacaaaaccgtaccat

SEQ ID NO: 15193 - DNA, 1647 bp, Artificial Sequence; identical to SEQ ID NO: 15192
  Description of Artificial Sequence: Synthetic coding sequence

SEQ ID NO: 15194 - DNA, 1647 bp, Artificial Sequence
  Description of Artificial Sequence: Synthetic coding sequence
atgccggcaagcgccccacctcggaggcccagaccacctccaccctcactctcgttgcttctggtcttgttgggtttgggagggcgcagactgagagcagaaccgggagatggagctcagacttgggcaagattttctcgcccaccggctcctgaagcagcagggcttttccagggaacgtttccggatggttttctgtgggccgtgggatctgcagcataccagaccgaagggggatggcaacagcacggaaagggcgcatcaatctgggataccttcacccatcaccctcttgcccctccaggagatagccgtaacgcgtcgcttccactcggggcaccaagccctctccagccggctactggagatgtggcatccgactcgtataacaacgtgttccgagataccgaagccctgagggaacttggagtgacccattaccgattctcgatcagctgggctcgggtgcttccgaacggttccgcaggtgtacctaaccgggaagggctcagatactaccggcggctgcttgagagactgcgggaacttggtgttcagcccgtggtcacgctctaccattgggaccttccacagcgacttcaagacgcctacggcggatgggcaaaccgggccttggcggatcactttagagactacgccgaattgtgtttccgacattttggtggtcaagtgaaatactggattaccatagataacccatacgtcgttgcatggcatggatacgcaactggaagattggcaccaggcataagagggtccccccgactgggatacctcgtggcgcataacctgcttctggcacatgctaaagtgtggcatctctacaatacgagctttcgcccaacgcagggtgggcaagtgtcgatcgcactttcaagccactggattaatccgaggcgtatgaccgatcatagcatcaaggaatgtcagaagtcgctggactttgtccttggttggttcgcgaagcctgtgtttattgacggtgattaccccgagagcatgaagaataacctgagctccatactcccagattttaccgaatccgagaagaagttcataaaggggaccgccgatttcttcgcactctgtttcggacctaccctgtcatttcagctgcttgatcctcatatgaagttcagacagcttgagagccctaacctgagacaacttctctcctggatcgatctggaattcaaccatcctcagatctttatcgtcgaaaacggatggttcgtgtcaggtacgactaagcgcgatgatgcgaaatacatgtactatctgaagaaattcattatggagactcttaaggccataaaactcgacggtgtcgatgtgatcggctacaccgcctggtcgcttatggatggcttcgaatggcaccggggatactccattcgccggggcctcttttacgtggattttctttcccaagataagatgctgttgcccaagtcctcggcactgttttatcaaaaactgattgaaaagaacggtttcccgccacttccagaaaaccaacctcttgaaggcacttttccttgtgacttcgcatggggagtcgtggacaactacatccaagtgtcgcagcttaccaagccaatttccagcctcaccaaaccttatcat

SEQ ID NO: 15195 - DNA, 1647 bp, Artificial Sequence; identical to SEQ ID NO: 15194
  Description of Artificial Sequence: Synthetic coding sequence

SEQ ID NO: 15196 - DNA, 1647 bp, Artificial Sequence
  Description of Artificial Sequence: Synthetic coding sequence
atgcccgcatccgccccaccccggcgtccccgaccacctcctccctctctatcccttctgttggtccttctaggactaggtgggcggcgactaagggctgaacctggcgacggcgcccagacgtgggccagattctcaagaccccccgcacccgaggccgctgggcttttccaaggcactttccccgacggattcctgtgggccgtgggaagcgctgcgtaccagaccgaggggggctggcagcagcacggcaaaggagcctcaatttgggataccttcacacatcaccccttggcacccccgggggactcaagaaatgcgagcctacccctgggggccccgagccccttgcagccagctaccggggacgtagcgagcgactcatataacaacgttttccgcgacactgaagcactcagagagctgggggtcactcattatcggtttagtatcagttgggctcgggtactccccaatggtagcgctggcgtgcccaacagggaaggcttgaggtactacaggaggctgctggagcgccttagagagctcggtgtgcaacccgttgtcaccttatatcattgggatctcccacagcgactgcaggatgcgtatggagggtgggctaatcgcgcactggcagaccattttcgcgattacgccgaattatgtttcagacacttcgggggccaggttaagtactggatcactatcgacaacccgtatgtagtagcttggcacggatacgctaccggccgactggctcctggcattagggggtctcccagactgggctacttagttgctcacaatctgttgttggctcacgcaaaggtgtggcatctttacaacacctcatttcgtcccactcagggtgggcaggtgtctatcgcactaagttcccactggattaaccctcgcaggatgaccgatcactcgataaaggagtgtcagaaatcactggattttgtcctgggctggttcgcgaaacctgttttcattgatggcgattaccccgagagtatgaaaaataacctgtctagcatccttcccgatttcacagagtcggagaaaaaattcataaaggggactgccgacttcttcgcgctctgcttcgggccaacactgtcgttccagctcctcgatccccacatgaagttcaggcagctggagagccctaacctgcggcagctactttcctggattgacctggagtttaaccatccacagattttcatcgtcgaaaacggctggtttgtgtcaggaacaacgaaacgcgacgacgccaagtacatgtactacctgaagaaattcattatggaaacgctcaaggccataaaattggacggagtggatgtcatcggttacactgcctggtctttgatggacggtttcgagtggcaccggggttactcgatccggagaggtctgttttacgtggacttcctctctcaggacaagatgctgctgcctaagtcatctgccttattctaccagaagctgatagaaaaaaatggcttccctccccttcccgagaaccaacccctggagggaacatttccatgtgatttcgcctggggtgtggttgataattacatccaggtgtctcagctcactaaacccatttcctcgctgacaaagccctaccat

SEQ ID NO: 15197 - DNA, 1647 bp, Artificial Sequence; identical to SEQ ID NO: 15196
  Description of Artificial Sequence: Synthetic coding sequence

SEQ ID NO: 15198 - DNA, 1647 bp, Artificial Sequence
  Description of Artificial Sequence: Synthetic coding sequence
atgcctgcctctgctccaccacgcaggcctcgaccgccaccacctagcctttctctgctgctggttttattggggctagggggcaggagactgcgggctgagcctggggacggggcgcagacatgggctcgtttttcaaggcctccagctccagaggcggctggcctgttccagggtacattcccggacgggttcctgtgggccgtgggctctgccgcttatcagactgaaggaggatggcagcaacatggcaagggggcatcaatttgggataccttcacacatcatcctctggccccccccggtgattcgaggaatgcttcacttccccttggtgccccttccccacttcaaccagcaacaggcgatgtggccagtgattcatacaacaacgtgttcagggatacagaagcccttagagagttaggtgtgacgcactataggttctccatctcttgggctagggttctgcctaacggaagtgcaggagtccctaatagagaggggttgcggtattatcgacggctcttggaacgtctgcgcgagctgggggtccagccagtggtgacactgtaccattgggatttaccacaaaggttgcaggacgcttatggaggttgggccaacagggcactagctgaccactttagggactatgccgagctgtgttttagacacttcggcggccaggtgaagtattggattacaatcgacaatccttacgttgtagcctggcacgggtatgcgacaggtcgattagcacccggcatacgtgggagccctcggctgggatatctggtagcacacaacctgctgctcgcccatgctaaggtttggcacctctataacacatctttcaggccaacccagggagggcaagtgtccatcgctctgtcaagtcactggatcaatccgcggcgaatgacggaccactctataaaagaatgccagaaatctcttgatttcgttttggggtggtttgcgaaaccagtcttcattgacggagattacccagagagcatgaagaacaatttgtcatccattctgccggactttacggaatcagagaaaaagttcatcaagggtactgcagatttctttgcgttgtgcttcggaccaacactcagctttcagctgttggacccccacatgaaattcaggcagcttgagagtcctaatttgcgccaactgctgtcatggattgatcttgagttcaaccacccacagatattcattgtggagaacggttggttcgtgtcgggaaccaccaaacgggatgacgcaaagtatatgtattaccttaaaaagttcataatggagacactgaaagctatcaaacttgacggggtggatgtgattgggtacactgcctggtctctgatggatggcttcgagtggcacagagggtactctatccgacgtggactattttacgtcgactttctgagccaggacaaaatgctcttacccaagtcatctgctctgttttatcagaagttgattgagaagaatggctttcctcctctcccggagaatcagccactcgaggggacttttccttgtgattttgcctggggagtggtggacaactatattcaggtttctcaattgactaagccaatcagttctcttacgaagccctatcac

SEQ ID NO: 15199 - DNA, 1647 bp, Artificial Sequence; identical to SEQ ID NO: 15198
  Description of Artificial Sequence: Synthetic coding sequence

SEQ ID NO: 15200 - DNA, 1647 bp, Artificial Sequence
  Description of Artificial Sequence: Synthetic coding sequence
atgccagcgtcagctcccccgcggcgccctagaccgcctccaccgagcttgagcctgctgttggtactcctggggctcggcggtcggagactgagagcggaaccaggcgatggcgcacagacctgggcgcgcttttcccgccctccggccccagaagctgcaggactgttccaagggacgttcccggacggattcctctgggccgtcggctcggcggcctaccaaaccgagggaggctggcaacagcatggtaagggagcaagtatttgggatacctttactcaccacccacttgcaccgccgggggacagccgcaacgcctcactgcccctcggagcaccttcgccgctccaaccggcgacgggtgacgttgctagcgacagctacaataacgtgttccgggatactgaagcgctgcgcgaacttggagtgacccactaccggttctcgatcagctgggcccgggtccttcctaatggatctgcgggggtgccaaatcgcgaaggccttagatactaccggcggctcctcgaaaggcttcgggaactgggtgtccagccagtggtcactctgtaccactgggacctgccacaacggctgcaggacgcctacggcggatgggccaatcgcgccctggccgatcacttcagggattacgctgagctgtgtttccgccacttcggagggcaggtgaagtactggatcacgattgataatccgtacgtcgtggcgtggcatggctatgctaccggtagacttgcaccgggaatccgcggaagccctcgcctcggatacttggtcgcacacaacctcctcctcgctcacgccaaggtgtggcatctgtacaacactagtttcagaccaactcagggaggacaggtgtcaatcgccttgtcatcccactggatcaacccgcgtcgaatgactgaccatagcatcaaggaatgtcaaaagtccctggatttcgtgctgggctggttcgcaaaaccggtgtttattgacggcgattaccctgagtccatgaagaataacctgtcgtcgatactgccggactttactgagtctgagaaaaagttcatcaagggaaccgcagatttctttgcgctgtgttttggaccaacccttagcttccaattgctggacccacatatgaagttccgccagctggagtcaccaaacttgaggcagctcctctcctggatcgaccttgagttcaaccatccgcagatctttatcgtggaaaatggatggttcgtctcggggactacgaagcgcgatgatgcaaaatacatgtactatcttaagaaattcatcatggagactctgaaggcgattaagttggacggagtggatgtgatcgggtacaccgcctggagtctgatggacgggttcgaatggcatcggggatactcaatcagacgcggtctgttttacgtcgacttcctgtcccaggacaaaatgctgctgccaaaatcgtccgccttgttctaccagaagctcatcgaaaagaacggtttccccccgctgccggagaaccagcccctggagggaaccttcccgtgcgacttcgcctggggggtggtagataactatatccaagtgtcgcaactcaccaaacctattagctccctgacgaagccgtaccat

SEQ ID NO: 15201 - DNA, 1647 bp, Artificial Sequence; identical to SEQ ID NO: 15200
  Description of Artificial Sequence: Synthetic coding sequence

SEQ ID NO: 15202 - DNA, 1647 bp, Artificial Sequence
  Description of Artificial Sequence: Synthetic coding sequence
atgccagcctctgcacctcctagaagacctcgaccaccacctcctagcctgagcctactgctggtgctgctgggcctaggcggccgaaggctgagggcagagccaggcgacggcgctcaaacttgggcccgcttttcccgcccccctgctccagaggccgcagggttattccaaggcacctttcccgatgggtttctgtgggctgtggggagtgctgcataccagactgaaggtggatggcagcagcatggcaaaggggcaagcatttgggacacatttactcatcatcccctggcacctcccggcgatagtcggaacgcctccctgcccctgggggccccatctcccttgcagcctgccaccggtgacgtggcatcagattcatataataacgtgttccgggatactgaagccctgagggagctgggcgttactcactaccggttctctatctcctgggctcgggtactccccaatggctctgccggggtccctaaccgggagggcctgagatactatagaaggttactggagagactccgggagctcggagtgcagcccgtcgtcacactgtatcattgggacctacctcagcggctgcaggatgcctacggaggctgggccaacagggctctggctgaccattttagggactacgccgagctatgtttcaggcacttcggagggcaggtgaagtattggattaccatagataacccatacgtcgtcgcttggcacgggtacgctaccggacggctggccccaggcatccggggttctccacggttaggctatctagtggcccataacctgctgttagcccatgcaaaggtgtggcatctatacaatacaagcttcaggcctacccagggcggacaggttagcatcgctctctcctctcattggatcaaccctagaaggatgactgaccactctattaaagagtgccagaagtcactggatttcgtgctgggctggtttgccaaaccagtatttatcgatggcgactacccagaaagcatgaagaataatttaagtagcattctgccagacttcactgaatctgagaagaagtttattaaagggacagcagatttttttgcactgtgctttgggccaacactttcattccagctgctggacccccacatgaagttccgtcagctggagtctcctaatctgcggcagctcttgagctggatcgacctggagtttaaccatccccagattttcatagtggaaaacggttggttcgtgtctggtacaaccaagcgggacgacgccaagtacatgtactacctgaagaagttcatcatggagactctgaaagccatcaaactggatggagtggacgtgatcggctatactgcttggtctctgatggacgggttcgaatggcaccgcggctatagcatcagacgcggactcttctacgtcgactttctgtctcaggataagatgttactgcctaagtctagtgcactgttttatcagaagctgatcgagaagaacggctttcctccgctgccagagaaccaaccactcgagggcaccttcccttgcgatttcgcctggggagtggtggacaactacatccaggtgtctcagctgacaaagcctattagttctctgactaaaccttaccac

SEQ ID NO: 15203 - DNA, 1647 bp, Artificial Sequence; identical to SEQ ID NO: 15202
  Description of Artificial Sequence: Synthetic coding sequence

SEQ ID NO: 15204 - DNA, 1647 bp, Artificial Sequence
  Description of Artificial Sequence: Synthetic coding sequence
atgcctgctagcgctccacctagaaggcctaggccacctcccccctcactgagtttgctgctggttctcctcggacttggagggagaaggctgagggccgagcctggagacggggctcagacatgggccaggttttcccgccctccagcccccgaagcggccgggctgttccaagggaccttcccagatggttttctatgggcagtggggtctgctgcataccagaccgaaggcggctggcagcagcatggaaagggggcaagcatctgggatacctttacccaccacccactggcaccacccggcgatagccgtaacgcatcactgcccctgggagccccaagccctcttcagccggcaactggtgatgtggcctcagacagctacaacaacgtcttcagagatactgaagctcttagggagttgggtgtgacccattatcgctttagtatcagttgggctcgggtcctccccaacggaagcgcaggagtgccaaatcgcgagggcctgagatactaccgtaggctgctggagagacttcgggaactgggggtccagcctgttgtcacactgtatcactgggatctgccccagcgcctgcaagacgcctacggcggctgggccaacagggctcttgccgatcattttcgggattacgctgagctgtgcttccggcatttcggaggccaggtcaagtattggatcacaattgataacccatacgtggtggcatggcatggttacgctaccggcagactggctccgggaatcagaggctcgcccagactcggatatcttgtagcccacaatctcctgctggctcatgccaaagtgtggcatctctacaatacgagcttccgtcccacccaaggcggccaggtgagcatcgcactgtcaagtcattggataaaccccagaaggatgactgaccatagcatcaaagagtgccagaagagcttggattttgtgctgggctggtttgccaagcctgtctttattgatggtgactacccagaaagcatgaagaacaatctgagctctattctgcctgattttaccgaatctgagaaaaaattcatcaaaggcacagccgatttcttcgcattgtgcttcggccctactttgtccttccaactcctcgatcctcacatgaagtttaggcaactggagtcccccaatctgcgccagcttctctcttggatcgacttggaattcaaccacccacagatatttattgtcgaaaacggctggtttgtgagcggaacaactaagcgggatgacgcaaaatatatgtactatcttaagaagttcatcatggaaaccttaaaagcgattaaactggatggcgtagacgtgatcggttacaccgcctggtccttaatggatgggttcgagtggcatcgtggttacagcatccgcagagggctgttttatgttgactttcttagtcaggataagatgctgttgcctaagtctagcgctctcttctaccagaagctcatagagaaaaacggattcccaccgttgcccgagaaccagcctttggagggcacgtttccttgtgatttcgcctggggcgtagtcgataactacatacaggtgagccagttgacaaaaccaatctctagcttgactaaaccctaccac

SEQ ID NO: 15205 - DNA, 1647 bp, Artificial Sequence; identical to SEQ ID NO: 15204
  Description of Artificial Sequence: Synthetic coding sequence

SEQ ID NO: 15206 - DNA, 1647 bp, Artificial Sequence
  Description of Artificial Sequence: Synthetic coding sequence
atgcccgcttccgcgcctccgcgccgcccgcggccacccccaccgtctctgtcgctcttgctggtgctgctgggcctcggtggtcgtagactgcgggcggagccaggcgatggtgcgcaaacttgggcccggttctcccgcccacccgcgcctgaggctgccggcctctttcaggggaccttccccgacggattcctgtgggccgtgggttcggcggcgtatcaaacggaaggtggatggcagcagcatggaaaaggcgcttctatctgggataccttcacccaccatccactcgccccgccgggcgacagccgcaatgcctcgctcccgctcggagcccctagcccacttcaaccggccactggtgacgtggcctctgactcctacaataacgtctttcgggataccgaagccttgcgcgaacttggagtgacccattatagatttagcatctcctgggcacgcgtgctgccgaatggttcagcaggagttcctaacagagaaggactgcgctactatcggaggctccttgaaaggttgagagagctcggggtgcagccggtcgtcaccctctaccactgggatctgcctcaacggctgcaggatgcatacggaggatgggctaatcgcgccctggccgaccactttagagactacgccgaactgtgttttaggcacttcggaggacaagtcaagtactggatcaccatcgataatccgtacgtcgtggcatggcacggatacgccactggaaggctcgcaccgggaatacggggaagccctagactcggatacctcgtggcccataaccttctcctcgcgcacgcgaaagtctggcacttgtacaacacctcattccggcctacccagggcggtcaagtgtctattgcactgtcgagccattggatcaatccgcggcgcatgaccgatcactctatcaaagaatgccagaagtccctggacttcgtccttggatggttcgctaagccggtgtttatcgacggagattacccggagagcatgaaaaacaatttgtcgtccatcctcccggactttaccgaatccgaaaagaagttcataaagggtactgcggacttcttcgcgctttgttttgggccaactcttagcttccaactcctggatccccacatgaagttccgccaactggaatcgccaaacctgcggcagctgctgtcatggatcgatttggaattcaaccacccccagattttcatcgtggagaacggatggttcgtgtcaggaactactaagagggacgatgcgaaatacatgtactaccttaagaaattcatcatggagacgctgaaggctattaagctggatggagtggacgtgatcggctacactgcctggtcgctgatggatgggttcgagtggcatcgcggatactccattaggagagggctgttctatgttgacttcctctcacaggacaagatgctcctgccgaaaagcagcgcccttttctatcaaaaactgatcgagaagaacggattccctcccctgccagaaaaccagcccctcgagggcacgtttccatgtgactttgcatggggagtggtagacaactacatccaggtgtcccagcttactaagcccatctcatcgctcacgaagccctaccac

SEQ ID NO: 15207 - DNA, 1647 bp, Artificial Sequence; identical to SEQ ID NO: 15206
  Description of Artificial Sequence: Synthetic coding sequence

SEQ ID NO: 15208 - DNA, 1647 bp, Artificial Sequence
  Description of Artificial Sequence: Synthetic coding sequence
atgcccgcctctgcaccgccaaggcgtcctcgcccaccccctccctctttatccctgctgctggtgctgctggggctgggcggccgacgactcagggccgaacctggggatggcgctcagacatgggctaggttcagtagaccccctgcgcccgaggccgctggcctgttccagggcacatttccagacgggtttttatgggccgtgggctcagccgcataccagacagaggggggatggcagcagcatggtaaaggagcatcaatttgggatacctttactcaccatcctttagccccacctggggattctagaaatgctagtctgcccctgggagcccccagtcctttacagcccgccacaggcgacgtggcttccgactcatacaacaacgtttttcgggacacagaggctctgcgtgagcttggggtgacccactatcggttttctatttcatgggctcgagtgctccctaatggctccgctggcgtgccaaaccgggagggtttgcgctactaccggaggctgctcgagaggctccgggagctcggagtacagcctgtggtgaccctgtaccattgggatttacctcagcggctacaggatgcctacggaggctgggcgaatcgggcattggctgatcacttccgggactatgctgagttgtgcttcaggcattttggtggacaggtgaagtattggatcactattgataatccatatgttgttgcatggcatggctatgcgaccggtaggctcgccccaggtattcgcggatccccacgactgggttatctcgtggctcataacctcttgcttgcccacgccaaggtatggcacctttataacacctccttccgcccaacccaggggggacaagtaagcatcgccttatctagtcactggataaacccaaggcgtatgaccgatcattccattaaggaatgtcaaaagtccttggacttcgtgctggggtggtttgccaagcctgtgttcattgacggcgattaccccgaatctatgaagaataatctgagttctattctccctgatttcaccgagagcgaaaaaaaatttattaaaggcacagctgactttttcgctctgtgcttcgggcccaccttgtcgtttcagctgctggacccacatatgaaattccgacagctggagtcacccaacctgaggcagcttctgtcttggatagatctagagttcaaccatccccagatatttatcgtggaaaacggctggttcgtcagtggtaccacgaagcgggatgacgctaaatacatgtactatttaaaaaagttcattatggaaacccttaaggcaatcaagcttgatggcgtcgatgtaataggatatactgcttggtccctgatggatggttttgagtggcatcgagggtatagcatcaggcgaggccttttctacgttgactttctcagccaggacaaaatgctgttaccaaaatccagcgcactgttctaccaaaaactcatcgagaagaacggcttccctcccctgcccgagaaccagccgctggagggcaccttcccctgcgattttgcctggggcgttgtggataactatattcaggtgagccagctgaccaagcctatctccagtttgaccaagccctatcac

SEQ ID NO: 15209 - DNA, 1647 bp, Artificial Sequence; identical to SEQ ID NO: 15208
  Description of Artificial Sequence: Synthetic coding sequence

SEQ ID NO: 15210 - DNA, 1647 bp, Artificial Sequence
  Description of Artificial Sequence: Synthetic coding sequence
atgcccgcaagcgcaccccctaggcggccccggcccccccctccgagcctgagcctcttactggtgctcctgggcttgggtggcagaagactcagagcagagcctggtgacggagcccaaacatgggccagattctcacggccacctgcacctgaggccgccggcctattccagggaacatttcctgacggcttcctgtgggccgtgggcagcgctgcttaccaaactgagggcggctggcagcagcatggcaagggagccagcatctgggatacctttacccatcacccactggctcctccgggcgattctcggaacgcctccttgccccttggagcaccatctcccctccagcctgcaaccggggatgtggccagtgacagttataataacgtttttagagataccgaggcactgcgggaacttggggttacccactaccgcttttcgatcagctgggccagggtcctaccgaacggatctgccggggtgcccaacagagaagggctgcggtactatcggcgcctgctggagcgcctccgcgaattgggggtgcagcccgtcgtgaccctctatcactgggacttgcctcagcgtctgcaggacgcctacgggggatgggctaatcgcgctttggccgaccattttcgagactacgcggaattatgcttccgccactttggaggccaggtgaagtattggattacaattgacaacccgtacgtggtggcttggcacggatacgctacaggccgcctcgcccccggcattagagggagcccacggttgggatacctcgtggcccacaatttgctattggctcatgcaaaagtctggcatctctataacacttctttcagaccaacacagggagggcaggttagtatcgccctcagcagccattggataaaccccaggcggatgactgatcattctatcaaagagtgtcaaaaatctcttgattttgtattgggctggttcgccaagccggttttcatagacggggactatcccgaatctatgaagaacaacctgtctagtatcctgccagattttacggaatccgagaagaagtttatcaaggggactgcagactttttcgctctttgttttggccctacactcagttttcaacttctggacccgcacatgaagtttcgccagttggagtctcctaatctgcggcaactgctgagttggatagatctggagttcaaccacccccagatcttcatcgtggagaacgggtggtttgtgtccggtacaacaaagagggatgatgccaagtatatgtactatctgaaaaagttcattatggagacactgaaagcgatcaagctagacggagtggatgtgatagggtacaccgcttggtcattgatggacggcttcgagtggcacaggggatattccatacgccgtggactgttttacgtcgatttccttagccaagacaaaatgctcctcccaaaatcctcagccctgttttaccagaaacttatcgagaagaacggattcccccccttgcctgaaaaccagcctctggagggcactttcccctgtgattttgcatggggcgtggtggataattacattcaggtcagccagctcacaaagcctatctcatctctcactaaaccttaccat

SEQ ID NO: 15211 - DNA, 1647 bp, Artificial Sequence; identical to SEQ ID NO: 15210
  Description of Artificial Sequence: Synthetic coding sequence

SEQ ID NO: 15212 - DNA, 1647 bp, Artificial Sequence
  Description of Artificial Sequence: Synthetic coding sequence
atgcctgcatcggccccgcccagacgcccacggccaccacctccttccctgagcctgcttcttgttcttctgggcctgggaggacgccgactgcgggcagaaccgggagatggtgcacagacttgggcacgatttagcagaccacctgctcccgaggctgccggtcttttccagggcaccttcccagacgggttcctgtgggccgtgggttccgcagcctaccaaaccgaaggtggatggcagcaacacggtaagggcgccagcatttgggatactttcacccatcatcccctcgcccctccaggagattcgcgaaatgcaagcctgcccctgggagccccttcgccgctccagcctgccactggagacgtggcgagcgattcgtacaataatgtgtttcgtgacaccgaagcacttcgcgaactgggagtgacccactaccgcttttcgatctcgtgggcgcgagtgcttcctaacggttcagccggcgtcccaaatagagaaggactgagatactaccgcagacttcttgaaagactgcgcgaacttggtgtgcagccagttgtgaccctgtaccactgggacttgcctcaacggcttcaggacgcctacggaggttgggcaaaccgcgcactggcagatcactttagagattacgccgaactttgcttcagacatttcggcggacaagtgaagtactggattaccattgacaatccctacgtcgtcgcatggcatggatacgcaaccggtaggctggctcctggtataaggggttccccacggcttggatacctggtcgcacacaatcttctccttgcacatgcgaaagtgtggcacctctacaatacctcatttcgtcccacccagggaggtcaagtgagcattgcactgtcgtcgcattggataaatcctcgaagaatgaccgatcactcaatcaaggaatgtcaaaagtcattggatttcgtcctgggttggttcgcgaagcctgtgtttatagatggcgattaccctgaatccatgaagaataatctctcgtccattctgcctgactttaccgaatctgagaagaagttcattaaaggcacggccgacttctttgcactttgcttcgggcctaccctgtcctttcaacttctcgaccctcatatgaagtttcggcaactggaatcgccgaacctccggcagcttctctcgtggatcgatcttgagtttaaccatcctcaaatctttattgtggagaatgggtggtttgtgtcgggaacgactaagcgcgatgatgctaagtatatgtactacctgaaaaagttcattatggaaacgctcaaggctatcaaattggacggcgtggacgtgattggatacaccgcatggtccctgatggatggatttgaatggcaccggggatatagcatccgtagaggcctgttttacgtggatttcttgagccaggacaaaatgctgcttcctaagtcaagcgctcttttctaccaaaaactcatcgaaaagaatgggtttccaccactccctgaaaaccaacccctcgaaggtacgtttccctgtgattttgcgtggggcgtggtggataactatattcaagtctcccaactgactaaaccaattagctcattgacgaagccttaccac

SEQ ID NO: 15213 - DNA, 1647 bp, Artificial Sequence; identical to SEQ ID NO: 15212
  Description of Artificial Sequence: Synthetic coding sequence

SEQ ID NO: 15214 - DNA, 1647 bp, Artificial Sequence
  Description of Artificial Sequence: Synthetic coding sequence
atgccagcatccgcaccaccgagaaggccacgtcctccacctccatccctcagcctccttttggtcctcctggggctgggtggacgacgcctgagagcggaaccaggagatggagcccagacttgggctcgctttagccggccaccggccccagaggccgcgggactcttccagggtacttttccagacggttttctgtgggccgtcggttcagcagcataccaaaccgaaggaggatggcaacagcatggaaaaggggcctcaatttgggataccttcacccatcatccattggcaccaccaggtgatagccggaacgcttcgctcccactgggggccccttcgcctcttcaaccggcaaccggggacgtggcgagcgattcgtacaacaacgtgtttcgggatactgaggcactccgagagctcggcgtcactcattaccgattctcgatcagctgggcaagggtgctgcctaacggtagcgcaggtgtgcccaatcgggaaggacttcgctactaccggagacttctggagaggctgcgggaacttggagtgcagccagtggttaccctttaccactgggatcttcctcaacgactgcaagacgcctatggaggatgggccaacagggctctcgcggatcactttagagattacgccgagctttgttttcggcactttggaggccaagtgaagtactggatcactatagataatccctacgtggtggcgtggcatggatacgctactggacgtctggcaccgggaattaggggatcgccgcgactcggttacctcgtcgcacataacctccttctcgcccatgcaaaagtctggcatctgtacaatacctcgtttcgacctacccaagggggccaagtctcaattgctctttcaagccactggattaatccgcgtcgaatgaccgaccattcgattaaagaatgtcaaaagtccctcgattttgtgctgggatggttcgcaaagccagtgtttatagacggagattaccctgaatccatgaagaataacctgagttccatccttcctgattttaccgagagcgaaaagaagtttatcaagggcaccgcagatttctttgccctgtgttttggtccaactctgagctttcaactgctggatcctcatatgaagtttagacagctggaatcacctaacctccgccaattgctgtcgtggattgatctggaattcaaccatccacagattttcattgttgaaaacgggtggttcgtctccggaaccacgaagcgagacgatgcaaaatacatgtactacctcaagaaattcattatggaaacgctcaaggctatcaaacttgatggtgtggatgtgatcggatacaccgcatggtcgcttatggatggctttgaatggcatagaggatacagcattcggagaggcctcttttacgtcgattttctctcccaggataagatgctgctgccaaagtcatccgcacttttctaccagaaacttatcgagaagaatggatttcctcctctgccggagaaccagccccttgaaggtactttcccatgtgacttcgcatggggggtggtggataactacattcaggtgtcacagttgaccaagcctatttcgtcgcttactaagccctaccat

SEQ ID NO: 15215 - DNA, 1647 bp, Artificial Sequence; identical to SEQ ID NO: 15214
  Description of Artificial Sequence: Synthetic coding sequence

SEQ ID NO: 15216 - DNA, 1647 bp, Artificial Sequence
  Description of Artificial Sequence: Synthetic coding sequence
atgccggcctcggctccgcctcgtagaccgaggccgccacctccttcactttctttgttattggttctgttgggactcggaggccgaagattacgagccgaaccaggggacggggctcagacctgggcgagattcagcaggccgcctgctccagaagctgccggactctttcagggaacctttcccgatgggttcctgtgggctgtaggttccgctgcttatcagaccgaaggcggctggcagcaacatggcaagggggcctccatctgggataccttcacacatcatccgttagcaccccccggtgatagcaggaacgcttctctgccactcggagctccatccccattgcagccagccacgggggacgttgcctcggattcatacaataacgtgttccgggacaccgaagccctgagggaactcggagtcacacactatcgattctctatctcatgggcccgggtgctacctaacggcagcgccggagtgcccaaccgagagggactgagatattatagacgattgctggaaagattgagggaactgggcgtacagcctgttgtaacgctctaccattgggacctcccacagagactgcaggacgcatatggcggctgggcgaaccgagcattagccgaccactttagggactacgctgagctatgcttccgacacttcggcggacaggttaaatattggattacaatcgacaacccctacgtcgtggcctggcatggctatgccacggggcgactcgccccaggcatccgcggcagtccaaggctgggctatttagtggcccataatctgctgctggcacacgcaaaagtatggcatttgtacaatacctcattccgacctactcagggcgggcaggtgtcgatcgccttgtcaagccattggattaaccctagacgaatgactgaccacagtattaaggaatgccagaagagtcttgacttcgtcttgggatggttcgcaaagcctgtattcattgatggtgactaccctgagtctatgaaaaacaatctgagtagcatattgccagacttcaccgagtcagaaaagaaattcatcaagggaacggccgacttctttgccttgtgctttgggcccacactgagcttccagctacttgacccacacatgaaatttaggcagctggagtcaccgaacctgcgccagctgctcagctggatcgatttggagttcaaccacccacagatctttatcgtggagaatggttggttcgtgtccggaaccacaaagagagatgacgccaagtacatgtattatctgaaaaaatttatcatggaaaccttgaaagctattaaacttgacggagtagatgtgatcgggtacacggcatggtccctgatggacggcttcgagtggcataggggatactctataaggagaggattgttctatgtcgactttttgagccaggacaaaatgctgcttcccaagagcagtgctttattttaccagaagctgattgaaaagaacggatttcctcccctgcctgaaaaccagcctctcgaagggacgttcccatgcgactttgcctggggggtggtagataattatattcaggtttcccagcttacaaagcctatttcttctctgaccaagccctaccat

SEQ ID NO: 15217 - DNA, 1647 bp, Artificial Sequence; identical to SEQ ID NO: 15216
  Description of Artificial Sequence: Synthetic coding sequence

SEQ ID NO: 15218 - DNA, 1647 bp, Artificial Sequence
  Description of Artificial Sequence: Synthetic coding sequence
atgcctgcgtcggcccccccgcgtaggccaagaccaccgcccccctctcttagcttgttgctcgtgctgttgggcctcggtggacgccgcctcagagccgagcctggggatggcgcccagacctgggctcgcttttctcggccgcccgcccccgaggctgctgggttgttccaaggaacattcccggatggtttcctatgggcagtcggctctgcggcataccagaccgaaggaggttggcaacaacacggtaaaggtgcttccatctgggataccttcacgcaccatcccctagctcctcccggtgattcgcgtaacgcctccctgcccctgggtgctccctcccctctgcagcccgccacgggggatgtcgcctcggatagctacaacaacgtgtttcgggacaccgaagctctccgtgagctaggcgttacccactaccggttctcaatttcctgggcccgtgtcctgcccaacggatccgcgggtgtgccaaatcgcgaaggtctgcgttattaccgacgtctcctggagcgattgcgtgagcttggagtgcagcccgtggtcactctgtatcactgggacctaccgcagagactccaggacgcctacggcggctgggccaaccgtgctctggcggaccacttccgggactacgcggagctctgcttccgccatttcggaggacaggtcaagtactggattaccattgacaacccttacgtcgtcgcctggcatggttatgctaccggccggctggcccccggtatccggggttctcccaggcttgggtacctggtggcgcacaacctgctcctagcccacgctaaggtctggcacctctacaatacatctttccgccccacccagggcggccaggtttccatcgctctcagcagtcactggattaacccacgacggatgactgaccactctatcaaggagtgccagaaatccctggatttcgttctcggctggtttgccaagccagtctttattgatggtgattaccccgagtccatgaaaaacaacctctcgagcatcctgcccgacttcacggagtccgagaagaagttcatcaagggtactgctgacttctttgccttgtgtttcggacctaccttgtctttccagctccttgacccccacatgaagtttcgccaactcgagagtcctaacttgcgtcagttgctatcctggatcgacctcgagtttaaccatccgcagatttttattgtcgagaacggttggttcgtctcaggtaccaccaagagggacgacgccaagtacatgtactacctgaagaaattcattatggagacgcttaaggccattaagctcgatggtgtcgatgtcatcggctacacagcttggtcccttatggatgggttcgagtggcaccgcggttactctattcgaagaggtctcttttacgtcgatttcctctcccaggataagatgctcttgcctaagtcttcagccctgttctaccagaagctaatcgaaaagaacggatttccacccttgcccgagaatcaacccctggaaggtaccttcccgtgcgatttcgcctggggtgtcgtcgacaactacatccaggtcagccagcttactaagcctatctctagccttactaagccctaccac

SEQ ID NO: 15219 - DNA, 1647 bp, Artificial Sequence; identical to SEQ ID NO: 15218
  Description of Artificial Sequence: Synthetic coding sequence

SEQ ID NO: 15220 - DNA, 1647 bp, Artificial Sequence
  Description of Artificial Sequence: Synthetic coding sequence
atgcctgcgtccgccccaccaagacgaccccgcccgccccctccgagcctgtccttgctactggtcttgctcggtctagggggccgtagactccgagcagaaccaggggatggagcccaaacatgggcaagattcagccgacctcccgccccagaggcagcgggtctattccagggaaccttccccgatggcttcctttgggctgtcggctctgccgcgtatcagacagaaggcggatggcagcagcacggcaagggcgcgtctatttgggataccttcacacaccatccgctcgccccaccaggcgatagccgcaacgcaagcctgccattgggtgcccctagtcccctgcagcccgcaacaggtgatgtggcctcggatagctataataatgtattcagagacaccgaggccctgcgagaactgggagtgacccactaccgctttagcatttcgtgggccagagtattacccaacggtagtgcgggagtgcccaatcgcgaggggctgcgatactatcgccggctgctagaacgactccgcgagctaggtgtacagcctgtggtgaccctctaccattgggacttgccacagcggctccaagacgcttatggcggatgggctaacagagccctcgccgaccatttcagggactatgcagaactttgtttccgccattttgggggccaggtgaaatattggatcacgattgacaatccgtacgtagtggcatggcacggatatgcaaccggccggctcgccccaggtatccgggggagtcctcgactggggtatctggtcgcacataatctcttgctagctcatgctaaggtgtggcacctgtataatacgtcctttaggccgacccaaggtgggcaggtgtctatagcgctctcctctcactggatcaatcctcgtagaatgaccgatcatagtatcaaggagtgccaaaagagtctcgattttgtgctcggctggttcgctaaaccggtgttcatagacggggattatcccgagtctatgaagaataatctctcttctatcctgccagactttacagagtctgagaaaaagtttatcaaaggtaccgctgactttttcgctctctgcttcggacccactttaagctttcagctgctagacccccacatgaaattccgccagcttgagagtccgaacctgcggcaacttttgagctggatagacttagagtttaaccatccacagatttttatagtcgagaacgggtggtttgtgagcggaaccacaaaacgagacgacgccaagtacatgtattacctaaagaaatttatcatggaaacactgaaagcgattaaactcgacggtgtagacgttatcggttacacagcatggagtctgatggacggcttcgaatggcacagaggctattccatccgccggggtcttttctacgtggacttcctctcccaggacaaaatgctgctccccaagtcaagtgccctcttctatcagaagctgatcgaaaaaaacggattcccccccttgcccgaaaaccagcccctggagggcacgtttccttgtgactttgcgtggggagtggtggacaactacattcaggtttcgcagctgaccaagcctatttctagcttgacgaagccataccac

SEQ ID NO: 15221 - DNA, 1647 bp, Artificial Sequence; identical to SEQ ID NO: 15220
  Description of Artificial Sequence: Synthetic coding sequence

SEQ ID NO: 15222 - DNA, 1647 bp, Artificial Sequence
  Description of Artificial Sequence: Synthetic coding sequence
atgcctgcaagcgcccctcccaggaggcctcgacctcctcctccaagtttatcacttctgttggtgcttttgggtttgggtgggcgccgactgcgagctgaaccaggagatggtgcacaaacttgggcaaggttcagtagaccccctgctcctgaggctgctggtctctttcaagggacctttcccgatggctttttgtgggcagttgggtcagcagcatatcaaactgaaggaggatggcagcagcatggcaagggtgctagtatctgggacacatttacccatcatcctttggcccctcccggtgatagtcgtaatgcatctttaccattgggagctccaagtcctctgcaaccggctacgggggatgttgccagcgattcttacaataatgtatttcgtgatacagaagcacttcgagaattgggagttactcattatcgtttctcgatcagttgggctcgagttctcccaaatgggtccgcaggagtcccaaaccgtgaaggactcagatactacaggagactcctcgagaggctccgggagttgggcgtccagcccgtggtcaccctgtatcattgggatttgccccagaggctacaagatgcatatggaggttgggcaaatcgcgcactagctgatcacttcagagattacgctgaactctgctttaggcattttgggggacaggtgaagtactggattactatcgacaacccatacgtggttgcatggcatggttatgccacaggaagacttgcccccggcattagaggttcgcccaggctcggttatctagtagctcataatcttctgttggctcatgcgaaagtgtggcacttatacaatacttcattcaggcccacccaaggaggacaggtctcaatcgccctttcttcccactggatcaacccaaggaggatgaccgaccactctattaaggaatgtcaaaagtcattggatttcgtactagggtggttcgccaagcccgtttttatcgacggagactacccagagtccatgaagaacaacctgtcatctatcttgcctgatttcaccgagagtgagaaaaagttcattaagggtacagctgatttctttgccctttgtttcggtcccacattgtcatttcagcttttggatcctcatatgaagtttagacagcttgaaagccctaacctgaggcagctcttgagctggatcgatctggagttcaaccaccctcaaatatttatagttgaaaacggttggttcgtatctggaactacgaaacgtgatgacgcaaaatacatgtactatctcaaaaaattcattatggagactttaaaggcaataaaactagatggagttgatgtaattggttataccgcttggtccctgatggatggattcgagtggcatagaggctactccattcgtcggggtttgttctacgttgacttcctttcgcaagataaaatgttgctccctaaatcaagcgcactcttttatcagaaattgattgagaaaaatggatttcctcctcttcctgaaaatcaacctctggaagggacttttccttgtgatttcgcttggggcgttgttgacaattacatccaagtttctcagttaacgaagcctatctcatctctgacaaaaccctatcac

SEQ ID NO: 15223 - DNA, 1647 bp, Artificial Sequence; identical to SEQ ID NO: 15222
  Description of Artificial Sequence: Synthetic coding sequence

SEQ ID NO: 15224 - DNA, 1647 bp, Artificial Sequence
  Description of Artificial Sequence: Synthetic coding sequence
atgccggcttcagctccgccgcgacggcctagacccccaccgccgtcattgtctcttcttcttgtgctcctgggattaggtggacggagactgcgtgcagaaccgggtgatggcgcacagacatgggctcgcttttcccggccgccagccccggaagctgctggtttatttcaggggacgttcccggatggctttttatgggctgtaggtagcgctgcataccaaactgaaggagggtggcaacaacacggcaagggcgcgagcatctgggatacatttacacaccatccacttgcgcccccgggtgattcgaggaatgcgtctctacccttgggggcgccctcaccgttacagccagccacaggggacgtcgcttctgacagttacaataatgtttttcgagacactgaagcgctgagagaattaggcgtcactcattaccgctttagtatcagctgggcacgtgtccttccaaatggtagcgctggcgttccgaatcgggaaggcttaagatactataggagacttctggaacgtctgcgggaattgggcgttcaaccggtagttacattgtatcattgggacttaccccaacggctgcaagatgcttacgggggctgggcgaatagagccttggcagaccatttccgggattatgcggagctttgcttcagacattttggaggacaggtgaagtactggattactatagataatccgtatgtagtagcttggcatgggtatgccaccgggcgtttggcccctggaattaggggctctccgaggttaggatatttggtcgcccataatcttttgcttgcgcacgcaaaagtgtggcatttgtataacacatcgtttcgtcctacgcaaggaggtcaggtttccattgcattatcctcacattggatcaacccgcgacgcatgacggatcattcaatcaaagaatgtcagaagagtcttgacttcgtgttaggttggttcgcaaaaccggtgtttatcgatggggattatccggaaagcatgaaaaataatctgtcgtcaattctgcctgactttacggagtccgagaaaaaatttattaaaggcacagcagatttctttgctctgtgctttggtccgacacttagctttcagttattggatcctcatatgaagtttagacagctggagtcgccaaaccttcgacagctattgtcatggatagacctcgaattcaatcatccccagattttcatcgtcgaaaacgggtggttcgtatcaggaaccacaaaacgcgatgatgcaaaatatatgtactatcttaaaaaattcattatggagacattaaaagccataaagttggatggcgtagacgtaattggctatacggcatggagcctgatggatggttttgaatggcatcgtggttactctattcgtagaggactgttttatgtagattttttgagccaagataaaatgcttctccctaaaagctccgccttattttaccaaaaattaatcgagaaaaatggctttcctcctcttcctgaaaatcagccgttagaaggaacatttccatgtgattttgcttggggtgttgttgataattatattcaggtaagccagttgacgaagccgataagctcattaaccaagccatatcat

SEQ ID NO: 15225 - DNA, 1647 bp, Artificial Sequence; identical to SEQ ID NO: 15224
  Description of Artificial Sequence: Synthetic coding sequence

SEQ ID NO: 15226 - DNA, 1647 bp, Artificial Sequence
  Description of Artificial Sequence: Synthetic coding sequence
atgcccgcatctgcacctccaaggcgccctcgacctccgccccccagcctgtctctgcttcttgtcttgctgggcctgggaggtaggcgcctgagggctgaacccggtgatggagctcagacttgggcccgcttttcgcggccccctgcgcctgaggccgcaggcctattccaggggactttccccgatggattcctgtgggctgtcggcagcgcagcctatcagactgagggggggtggcagcagcacgggaagggcgcaagtatatgggacaccttcacgcaccacccactagctcctcctggcgactctagaaacgctagcttgccccttggcgctccctcccccctgcagccagcaacaggcgatgtggccagcgatagctacaacaacgtattcagggatacagaggcactgcgcgagttgggagtgactcactatcgcttttctatttcctgggctcgtgtgctcccgaacggtagtgctggggtccccaacagagaaggcctgcggtactatagaagattgctcgaacgactcagagagctaggcgtgcagcctgtggttacactataccactgggacctaccccagcggctgcaggacgcttacgggggttgggccaatcgggcactggccgatcatttcagggactatgcagaactttgttttcgacacttcggaggccaagtgaagtattggatcaccatcgataatccctatgtcgttgcctggcatggctacgccactggccgattagctcccggaattcgcggttcgcccaggctgggctatctggtcgcgcataacttgttgctggcacacgctaaagtgtggcacctctacaacacaagcttccgtccaacccagggcggccaagtgagtatcgcattgagttctcattggataaaccctcggagaatgactgaccattcaataaaggagtgccagaagagtttggacttcgtgctgggatggttcgccaaaccggtcttcatcgacggagactatcctgaaagcatgaaaaacaatttatctagcatcctccctgactttacggagagcgagaaaaaattcatcaagggcacggcagatttttttgctctttgcttcgggccaaccctcagcttccagctcttggaccctcacatgaagttcagacagctcgaatcgcctaatctgcgtcagctgctgtcttggatcgacctggaatttaaccacccgcagatattcattgttgagaacggatggttcgtgtccggtactactaaacgggatgacgctaagtatatgtattacctaaaaaaatttatcatggaaacactgaaggctattaagttggacggggtggatgttatagggtatactgcttggagcctgatggacggattcgagtggcataggggttatagcatccggcgagggctgttttacgtggacttcctgtcacaggacaaaatgcttctgcccaaatcttctgccttattttaccaaaaactcattgagaagaacggatttcccccacttcctgagaaccaacccctggaggggacttttccctgcgatttcgcatggggcgtcgtggacaattatatccaggtgagtcagctaacaaagcctatttcatctctgaccaagccctatcac

SEQ ID NO: 15227 - DNA, 1647 bp, Artificial Sequence; identical to SEQ ID NO: 15226
  Description of Artificial Sequence: Synthetic coding sequence

SEQ ID NO: 15228 - DNA, 1647 bp, Artificial Sequence
  Description of Artificial Sequence: Synthetic coding sequence
atgcctgcttccgcgcctccaaggaggcccaggcccccacccccatcactctcattgctcctcgtactgctgggcctcggcggcagaaggttgcgcgcagaacccggagatggtgctcagacctgggctaggttttccaggcctcccgctcccgaagccgctggactgttccaaggcacatttcccgacggctttctgtgggctgtgggatctgcggcatatcagactgaaggaggttggcaacagcacggcaagggagcctcaatctgggatacgtttactcatcatccacttgcgcccccgggcgactctaggaacgctagtcttccactgggcgcccctagccctctgcaacccgcaacaggcgacgtcgctagcgattcctacaacaacgtgtttcgcgataccgaggctctgagagagcttggcgtgacacactacaggttcagtatatcctgggcgcgcgtactgccgaatggttcagcaggcgtgcccaatagggaaggcctgagatattatcgccgccttctcgaaaggctgcgcgaactgggcgtgcaacctgtcgtgacactgtatcattgggacctccctcagaggctccaagatgcatacggtggttgggcaaacagagctctcgcagaccacttccgcgattatgcagagctctgtttcagacactttggaggtcaggtcaaatattggatcactatagacaacccttatgtggtcgcttggcacggttacgctacaggccgcctcgcgcctggaatcagaggttctcccagacttggctacctcgtggctcataacttgctgttggcgcatgccaaagtgtggcacttgtacaatacttccttccgcccgacacagggcggccaggtctctatcgccctctcctctcattggatcaatcccaggcgcatgacagatcactctattaaagaatgtcagaaaagcctggatttcgttctgggctggttcgctaagccggtctttatcgacggagattacccggaatcaatgaagaacaatttgagttccatcttgcccgacttcaccgagtccgaaaagaagttcatcaagggtacagcagacttcttcgcactgtgctttggacctaccctctctttccagctcctggatccccatatgaaatttaggcagctcgagtcccccaacttgagacagttgctcagttggattgacctggagttcaaccaccctcagatcttcattgttgaaaacggatggttcgtgagcggaaccactaagagagacgacgctaagtatatgtactatctgaagaagttcattatggagaccttgaaagccatcaaacttgacggtgtggatgtcattggctatactgcttggtctctgatggatggctttgaatggcaccgcggatactccatcaggagaggccttttctacgttgactttctgagtcaggacaaaatgctgctgcccaagagctctgctctgttctatcagaaactgatcgagaaaaatggatttccaccactgcccgagaaccagccactggaaggcacattcccttgcgacttcgcctggggtgtggtggacaactacatccaggtaagccaactgacgaagcccatctcctccctgactaaaccttaccat

SEQ ID NO: 15229 - DNA, 1647 bp, Artificial Sequence; identical to SEQ ID NO: 15228
  Description of Artificial Sequence: Synthetic coding sequence

SEQ ID NO: 15230 - DNA, 1647 bp, Artificial Sequence
  Description of Artificial Sequence: Synthetic coding sequence
atgcctgcaagtgctccaccccgcagaccaagacctcctccgccgagtctgtctctgctcttggtgttattagggttgggagggaggaggctgcgggccgaacccggcgacggcgctcaaacgtgggctcgattctcacggcccccagctcccgaggccgcgggactctttcaaggcactttccccgatggattcctgtgggcggtgggcagcgccgcgtatcagacggaaggcggatggcagcagcacggcaagggggcgtcgatctgggataccttcacacaccacccattggcaccccccggggactcgcgaaacgccagtttgcccctgggtgccccttctcccttacaacctgctacgggggacgttgcatctgattcttataataacgtgttccgggacactgaagccttgcgagagttgggagtgacacattaccgcttcagcattagttgggcaagagtgctgcccaacggaagcgctggggtgcctaaccgtgagggtctgaggtactaccgtcggctcctggaaagattaagggagttaggcgtccaacctgtggtcaccctgtatcattgggatcttccacagcggctgcaggacgcttatgggggctgggcgaatagagcgctcgcagaccattttcgcgactatgctgaactctgcttcagacacttcgggggtcaggtgaaatattggattaccatcgacaatccctatgtcgtcgcttggcacgggtatgctacagggcggttagctccagggataagggggtctccccgactgggctacctggtggcccataacttgctgcttgcccacgccaaggtgtggcatttatacaatactagcttccgccccacacagggcggccaggtcagtatcgctctgagtagccattggatcaacccccgccggatgaccgatcattccattaaagagtgccagaaatctcttgactttgtcctgggatggttcgccaagccggtatttattgatggcgattaccctgaaagtatgaagaacaatctgtctagtatcctgcccgattttaccgaatccgaaaagaagtttattaaaggtactgccgacttctttgcactttgttttggacccactctctctttccagctgctcgaccctcacatgaagtttaggcagctggagtcgccaaatcttcggcagctgctctcatggattgacctggagttcaatcacccacagatcttcattgtcgagaatggttggtttgtctctgggactactaaaagagacgacgctaaatatatgtactatctgaagaaattcatcatggaaacccttaaggccataaagctggacggagtggacgtcattgggtacacagcctggtctctgatggatggcttcgagtggcatagaggctactccattagacggggactgttttatgtcgactttctgagccaggataagatgctcctgcctaagtctagcgccctcttctaccagaagctgatcgagaagaatgggttcccacctctgcctgagaaccagccactagagggaactttcccatgcgactttgcctggggagttgtggataattacatccaggtcagtcagcttaccaagcccatatctagtctgaccaagccttatcac

SEQ ID NO: 15231 - DNA, 1647 bp, Artificial Sequence; identical to SEQ ID NO: 15230
  Description of Artificial Sequence: Synthetic coding sequence

SEQ ID NO: 15232 - DNA, 1647 bp, Artificial Sequence
  Description of Artificial Sequence: Synthetic coding sequence
atgccggcatccgcgccaccgcgccgaccgcgcccaccacctccgtcactgagcctgctcctcgtcctcctgggacttggaggacggcggctccgggcggaaccgggagacggagcgcagacttgggcgaggttctcgcgcccccctgccccagaagcggctggtctgttccagggaactttcccagatgggtttttgtgggcggtgggatcggccgcttaccagactgagggcggatggcagcagcatgggaagggtgcaagcatctgggacacctttactcaccatcccctggctccgccgggtgacagccggaatgcttcgctgccacttggggcccctagcccactccagccagcaactggtgacgtggcctccgactcgtacaataatgtgttcagggatactgaagccctccgcgaactgggcgtgacgcattaccgcttctccatctcgtgggccagagtcctcccaaacggatcggcgggagtgcccaatcgggaaggtctgaggtactaccggcgcctcttggagcggctccgggagcttggcgtgcagcctgtcgtgactctgtaccactgggacctgccacagagactgcaagacgcctacgggggttgggctaacagggccctcgcagaccatttccgcgactacgcagaactgtgctttcggcacttcggaggacaggtgaaatactggattaccattgataacccgtacgtggttgcctggcacggatacgctaccggacgcctcgctcctggcatccggggaagtcccagactgggctacctcgtcgcccataacttgcttctggcgcatgctaaggtgtggcatctgtacaacacttcattcagaccgactcagggagggcaggtcagcatcgcgctttcgtcgcattggatcaaccctcgcagaatgactgatcactccatcaaggaatgccagaagtcgctcgacttcgtgctggggtggtttgcaaagccggtgttcatcgatggagactaccccgagtccatgaagaataacctctcctcaattctgccggacttcaccgagagcgaaaagaaattcatcaaggggaccgcggactttttcgcactgtgtttcggcccaactctgtcatttcagctccttgacccgcacatgaagttccgccagttggaatcgccgaacctcaggcaactcctgtcatggattgacctcgagttcaatcatccacagattttcattgtcgaaaatggctggttcgtgtcaggcaccactaagcgggacgacgcaaagtatatgtattacctgaaaaagttcatcatggaaaccctcaaagccatcaaacttgacggtgtcgatgtgatcggctacactgcatggtcgctcatggacggattcgagtggcaccgtggatattcgatccgccggggactgttttacgtggactttctgtcgcaggacaaaatgctcctgccaaaaagctccgccctcttctaccaaaaacttatcgaaaagaatggattcccgcctcttcctgaaaatcagcctctggagggaacgtttccgtgcgacttcgcgtggggggtggtggacaactatattcaggtgtcacagctcaccaagccgatctcatcactgactaagccgtaccac

SEQ ID NO: 15233 - DNA, 1647 bp, Artificial Sequence; identical to SEQ ID NO: 15232
  Description of Artificial Sequence: Synthetic coding sequence

SEQ ID NO: 15234 - DNA, 1647 bp, Artificial Sequence
  Description of Artificial Sequence: Synthetic coding sequence
atgcctgcctcagctccccccagacggccccggccacctccaccctcactctcactcctgcttgttttactcggactaggaggacggcggctcagagccgaaccaggagatggagcccagacatgggcacgattctccagaccccctgctcctgaagccgcaggacttttccagggaactttccccgatgggttcctctgggccgtgggatccgcagcctatcagacagaaggggggtggcagcagcacggaaagggagccagtatctgggatacatttactcatcatcctttggcccctcctggagattcgagaaacgcctctctgcccctgggggctccctcccctctccagcctgctacaggagatgtcgcaagtgattcttacaacaacgtgttcagagatacagaagccctgcgcgaactgggggttacacactacaggttttctatttcatgggccagggtactacctaatgggtcagccggggttcccaaccgggaagggctgcgttattacaggagactcctggaacgcctcagggaactaggagtgcagcccgtggttactctgtaccattgggatctgcctcagaggctgcaggatgcctatggggggtgggccaacagagctttggccgatcactttcgagactatgctgaactgtgctttcggcatttcggaggacaggtgaaatactggataactatagataacccgtatgtggtcgcatggcatggatatgccacagggcgtctcgctcccggaatacgggggagtcctagactcgggtaccttgtggctcacaatttactcctcgctcacgccaaagtttggcacctgtataatacatctttcagacctactcagggagggcaagtctctattgctctgagttcccactggattaatcctagacggatgacagatcattcaattaaagaatgtcagaaaagtttagatttcgtcttagggtggttcgctaagccagtgttcattgacggggattatcctgaatctatgaaaaataatctgtcatccattctccctgactttactgaatccgaaaagaaatttatcaaagggacagcagatttctttgcactttgtttcggacccactctttccttccagttacttgatccacatatgaaatttagacagcttgagtcaccaaatctgcggcagcttctgtcctggatcgatctggagtttaatcatccccagatctttatcgtcgaaaacgggtggtttgtatcagggactactaaaagagatgacgccaaatatatgtattatctgaaaaaatttattatggagacactgaaagcgattaaacttgatggagtggatgtaatagggtatacagcttggagtttgatggatggatttgaatggcatagagggtattctatacgacgcggattattctatgtggatttcctttcccaggataaaatgctactgcctaaaagtagtgctttattttaccagaaactcatcgagaaaaacgggttcccccccttgccggagaaccagccccttgaagggacatttccttgcgattttgcatggggggtcgttgacaactacatacaggtctcccagctgactaaacctattagttccctcactaaaccttaccac

SEQ ID NO: 15235 - DNA, 1647 bp, Artificial Sequence; identical to SEQ ID NO: 15234
  Description of Artificial Sequence: Synthetic coding sequence

SEQ ID NO: 15236 - DNA, 1647 bp, Artificial Sequence
  Description of Artificial Sequence: Synthetic coding sequence
atgccggcatcagcacctccacgccgacctaggccccctcctccttccctgtccttgctccttgtcctcctcggcctgggtgggagacgtcttagggccgagcctggagacggagcgcaaacttgggcacgattctcccgtccacctgcgcctgaggcggccggacttttccagggaacttttcccgatgggtttctttgggcagtcggatccgccgcataccaaactgaaggaggatggcaacaacatggtaagggggcgtcaatctgggacacttttacccatcatcccctggctcctccgggcgattcccgtaatgccagccttcctcttggagccccatcgcctcttcaacctgccactggtgatgtggcatcggactcctacaacaacgtgtttagagataccgaagcacttagagaacttggcgttacgcattaccgcttttcaatctcctgggcaagagtgctgccaaatggatcggccggagtgccgaaccgggagggacttagatactacaggagactgcttgaacgcctgcgcgaactcggtgtgcagcctgtcgtcacgctgtaccattgggatctgcctcagcggctgcaagacgcatacggcggttgggccaaccgagccctcgcagatcacttcagggattacgcagagctttgttttcgccactttggcggacaagtgaagtactggattaccattgacaacccttacgtggtcgcttggcacggctacgcaactggacgccttgcaccagggatccggggttcgccaagactgggatacctcgtggcacataaccttctgcttgcgcatgcaaaggtctggcacctttacaacacttcatttaggcccacccagggaggtcaagtctcaatcgcattgtcaagccactggattaacccaaggagaatgaccgatcactccattaaagaatgccagaagagtcttgatttcgtcctgggttggttcgctaagccagtctttatcgatggagactatccagaatccatgaagaacaatcttagtagcatccttcctgattttactgaaagcgagaaaaagttcattaagggaaccgctgacttcttcgctctttgcttcggccctaccctttcatttcagctcctcgatccacatatgaagttccggcaactcgaatcgcccaatctgcggcaacttctgtcgtggatcgatctggaattcaaccacccacagatcttcatagtcgaaaatgggtggtttgtctcaggaactaccaagcgtgatgatgcaaagtacatgtattatcttaagaagttcatcatggagactctcaaggcaattaagctggatggtgtggacgtcattggttacaccgcgtggtcccttatggatggttttgagtggcatcgaggctactccatccggagaggcctgttttacgtggattttctctcacaagataagatgctcctcccaaagagctccgcactcttttaccagaagctgatcgagaagaatggattcccccctctccccgaaaaccaaccccttgagggtaccttcccttgcgatttcgcatggggagtggtggacaattacatccaggtttcgcagctgaccaaacctattagctctttgactaagccttaccat

SEQ ID NO: 15237 - DNA, 1647 bp, Artificial Sequence; identical to SEQ ID NO: 15236
  Description of Artificial Sequence: Synthetic coding sequence

SEQ ID NO: 15238 - DNA, 1647 bp, Artificial Sequence
  Description of Artificial Sequence: Synthetic coding sequence
atgccggcatccgcacctccgcgacggcccagacctcccccaccatctctctcattacttctggtcttgctcgggctgggcggaagaagactgcgagccgagccaggtgatggagctcaaacgtgggccagatttagccggcctcccgcccctgaagctgccggactttttcagggaacattccccgacggttttttgtgggccgttggctcagccgcctaccagactgagggcggatggcagcagcatgggaagggagcatcaatttgggatactttcactcatcatcccctggcacccccaggggattcccgcaatgcgagcttaccactgggcgccccttctccactgcagcccgcaaccggggatgtagcctctgactcttacaacaacgtgtttcgcgatacagaggctctcagagaactgggagtgacgcattacaggtttagcattagctgggctcgggtgctgcctaacggatccgctggagtgccgaacagggagggccttcgttactatagacgtttactggagagactacgggaattgggagtgcagccagttgtcaccctctaccactgggacctgccacaacggctgcaggatgcttatggaggttgggcaaaccgagctcttgcggatcacttccgcgattatgcagagctatgttttaggcatttcggcggccaggtaaaatattggatcaccatcgacaacccctatgtggtggcttggcacggctatgccacaggaaggttggcaccaggaatccgggggagccccagactgggatatctggttgcccacaatctcctcctagcgcatgcaaaggtatggcatctgtataacactagcttcagacccacgcagggaggccaggtcagcatcgccttatcttcccactggatcaaccccaggagaatgaccgaccactcgattaaagagtgccagaaaagcttagatttcgtcctcggatggttcgcaaaacctgtgttcattgacggtgactatcctgagagtatgaagaacaacctcagcagcatcctgcccgacttcacggagtcagagaagaagtttataaaggggactgcggactttttcgcgctctgttttggaccaacactaagcttccagctgttagaccctcacatgaaatttcgtcagctggaaagcccaaacctccggcagcttttgagttggattgatcttgagtttaaccatccacagatctttatagtcgaaaacgggtggtttgtcagcggaactactaagcgcgacgatgcaaagtatatgtattacctgaaaaagtttataatggagacattgaaggccattaagctggatggagtggacgtcattggatacacagcttggagcctgatggatggatttgagtggcacagagggtattccatccgccgtggcctgttttatgtggacttcctatctcaggacaagatgttgttacctaagtcatcagccctattttaccaaaagttgattgagaagaatggattcccacctcttcccgaaaaccagcctctggaaggcacattcccctgcgatttcgcgtggggagtggtggataactatatccaggtgagccagctgaccaagccaatcagttcactcactaaaccgtaccac

SEQ ID NO: 15239 - DNA, 1647 bp, Artificial Sequence; identical to SEQ ID NO: 15238
  Description of Artificial Sequence: Synthetic coding sequence

SEQ ID NO: 15240 - DNA, 1647 bp, Artificial Sequence
  Description of Artificial Sequence: Synthetic coding sequence
atgcccgcaagcgcacccccacgacggccacgaccaccacctccatcactgtcgcttcttttggtgcttctcggactcggtggacgaaggctcagagctgaaccaggtgacggtgcacaaacttgggctcgcttttcaagacccccggcacctgaggcggcagggctgttccagggtaccttcccagacggattcctgtgggctgtgggttccgcagcctaccagactgagggaggatggcaacagcatggaaaaggtgcatcaatctgggatacctttacccatcaccctcttgcgccccctggagactctcgcaatgcgtctttgccactcggagcgccttccccgcttcagcctgctactggagatgtggcctcagattcgtacaacaacgtctttagggatacggaggcccttcgtgagctcggtgtgacccactaccggttctcgatttcctgggctagagtccttccaaatggcagcgctggagtgccaaaccgcgaaggattgagatactaccggcgccttctggaaagacttcgggaactgggtgtgcagccagtggtgacgctgtaccactgggatcttccacaacgcctgcaggacgcatacggaggatgggccaatcgagcactggctgaccactttcgggattacgcggaattgtgttttagacattttggtggccaggtgaagtattggattaccattgataacccgtacgtggtggcctggcatggttacgctaccggtagactcgccccaggcatcagaggttcgcctcgtcttggatacctggtggctcataacttgctcctggcccatgcaaaagtttggcatctttacaacacctcctttcggccaacccaaggtggtcaagtgagcatcgcgctctccagccactggataaaccccaggaggatgactgatcattcgattaaggaatgccaaaaaagcctcgattttgttctgggctggtttgccaagccggtctttattgatggagattaccctgaatcgatgaagaataatctttcgtcaatcctccctgatttcactgagtccgagaaaaagttcattaaggggactgcggacttttttgcactctgcttcggccctaccctttccttccaattgctggacccccacatgaagtttaggcaactcgaatcacccaacctgcgccagctgctctcgtggatagaccttgaattcaaccacccccaaatctttatcgtggaaaacggatggtttgtctccggtaccactaaacgcgacgatgcaaaatacatgtactatctgaagaaattcattatggagacgcttaaagccattaaacttgatggtgtggacgtgatcggctatactgcatggagccttatggatggcttcgagtggcatcggggatactccatccgccggggtttgttctatgtggactttttgagccaagataagatgcttcttccaaaatcaagcgccctgttttaccaaaaactgattgagaaaaacggattccctcctctgcccgaaaatcaacctctggaaggcacctttccgtgcgattttgcgtggggtgtggtcgacaattacattcaagtgagccagctgaccaagccgatctccagccttactaagccctaccac

SEQ ID NO: 15241 - DNA, 1647 bp, Artificial Sequence; identical to SEQ ID NO: 15240
  Description of Artificial Sequence: Synthetic coding sequence

SEQ ID NO: 15242 - DNA, 1647 bp, Artificial Sequence
  Description of Artificial Sequence: Synthetic coding sequence
atgccagctagcgcgccacccagacgacctagaccccctcctccatctctgtccttgctgcttgtgctgctgggcctgggcggacgacgtttaagggcagaaccaggagatggtgctcaaacttgggccagattctcgaggccaccggctcccgaagctgcggggctgtttcagggcacattcccggatggctttttgtgggctgtgggttcagccgcatatcagactgagggcggttggcagcagcatggtaaaggcgcgtcaatctgggatactttcacccaccatccactggctcctccaggcgattccagaaatgctagtcttcctttgggcgctccctcacctctgcagcccgccacaggagatgtggcctcagactcatataataacgtcttccgcgatacagaggccctgagagaattgggagtgacgcactacagatttagcattagctgggcgagggttctacccaatggatcagccggcgtaccaaacagagaaggcttacgatattacaggaggctgctggaacggttacgagaactgggagttcaacctgtggttaccctgtaccactgggacctaccacaaaggctgcaggatgcatatgggggttgggccaatcgagcacttgctgaccactttcgcgactatgccgagctctgtttcagacacttcgggggccaggtcaagtattggattacaattgataatccctacgtggtggcgtggcatggttatgctacgggacgactggcgcccggcatcagaggctcacctcgactaggatatctggttgctcacaatctactgctcgcccatgccaaagtgtggcatctctacaacacgtcgttccgtcctacccaaggcgggcaagtcagcatcgccctgtcttcccattggattaacccacgaaggatgaccgaccatagcatcaaagagtgccagaaaagtctggatttcgtgctcggatggtttgctaaacccgtgttcatcgacggtgattaccctgagtccatgaagaacaatctatcgtccatcctccccgactttaccgaatcggagaagaagttcatcaaaggaaccgctgatttctttgctctctgctttggtcctacactgtcatttcaactattggatccccatatgaaatttaggcagctcgaatcccccaatctgagacaactgctcagctggatcgatctggaattcaatcacccacaaatttttatagtagagaatgggtggttcgtgagtggcaccaccaagagggacgacgccaagtatatgtactacttgaagaaattcattatggagaccttaaaggcaatcaaactggatggcgttgatgtgatcggttacacagcttggagtctgatggatgggtttgaatggcaccgaggttattcgatacggcgaggcctcttttacgtggactttctgagccaggataagatgttattaccgaagtcttccgcgctcttctaccagaaattaatagaaaaaaatgggtttcctccgctgccagagaatcagccactggaaggaacctttccctgtgatttcgcctggggtgtggtggacaattacatccaagtatcccagctgactaagcctatatcatcccttactaaaccataccat

SEQ ID NO: 15243 - DNA, 1647 bp, Artificial Sequence; identical to SEQ ID NO: 15242
  Description of Artificial Sequence: Synthetic coding sequence

SEQ ID NO: 15244 - DNA, 1647 bp, Artificial Sequence
  Description of Artificial Sequence: Synthetic coding sequence
atgcccgcttcggctccaccacgtcggcctcgtcctccacctccctcactgtctctgcttttggttctactaggcctaggcggtcgacgtctgcgagcagaaccgggtgatggtgctcagacgtgggccaggtttagtagacctcctgctcctgaagctgccggtctgtttcaggggacctttcctgatggctttctatgggcagtcggttcagcagcgtatcagacagagggcggttggcagcaacacggtaaaggcgccagtatttgggataccttcacacatcatccattggcgccaccgggcgactctcgaaacgcgagtcttcctctgggcgcacccagcccgcttcagccagcaaccggcgatgttgcatctgactcatacaacaacgtcttccgggataccgaggccctcagagagttgggtgtcactcattaccgtttctcaatctcttgggcacgagtgctccccaacggttctgctggtgttcctaatcgagaggggctgcgatactaccgccgcctcctagagagactccgcgaactgggcgttcagccggtcgtgactttgtaccactgggacctgccgcagcgcctccaggatgcttatggcggttgggcaaaccgagcgctcgccgatcacttcagggattacgccgaattgtgtttccgccattttgggggccaggtcaagtattggattaccatcgataacccatacgtggtcgcctggcacgggtatgctacgggtcgtctggcgccaggtatccgaggttcaccccgactcggctacttagtcgcccacaacttacttcttgctcatgcaaaggtgtggcacctctataacacgtcattccgaccgacacagggtggacaggtcagcatcgctctcagcagtcactggataaacccaaggcgcatgacagaccactccatcaaggaatgtcaaaaatcactggatttcgtgctcgggtggttcgccaaacctgtcttcattgatggtgattacccagagtcaatgaaaaacaacttgagctccattctccccgacttcacggaatccgagaaaaagttcatcaagggcactgctgacttctttgccctctgttttggacctacgttatcgttccagctgcttgacccgcatatgaagttccggcaacttgagtccccaaacttgcggcagctgctgtcgtggattgacctcgaatttaatcatcctcaaatttttatcgttgagaacggttggtttgtgtccggcactaccaaacgagatgatgccaagtacatgtattatctgaaaaagttcattatggagacgctgaaagcgatcaagttagatggagtcgacgtgattggatataccgcatggtcattgatggacgggttcgaatggcatagagggtatagcattcgtcgtggtctgttttacgtagacttcttgagtcaagataagatgttgctcccgaagagcagcgctctgttttaccaaaagctgatcgaaaaaaacggtttcccgcctttaccagagaaccagccgctggaaggcacatttccctgcgacttcgcctggggcgttgttgacaattatatccaggtctctcagctgaccaaaccaatctcctcacttaccaagccttaccat

SEQ ID NO: 15245 - DNA, 1647 bp, Artificial Sequence; identical to SEQ ID NO: 15244
  Description of Artificial Sequence: Synthetic coding sequence

SEQ ID NO: 15246 - DNA, 1647 bp, Artificial Sequence
  Description of Artificial Sequence: Synthetic coding sequence
atgcctgctagcgcccctccacgacggccaagaccacctcccccgtctttgtcactgctcctcgtcctgctggggctgggaggtcgccgccttcgagcagaaccgggtgacggcgcccaaacttgggcccgcttctcgaggccaccggccccggaagcggcaggtctgttccagggaaccttccctgacggcttcctgtgggcagtgggttcggcggcctatcagactgaagggggatggcagcaacacggcaaaggggcgtctatctgggacacttttacccaccatcctctcgctccaccaggtgattcgcggaatgcctccctccccctgggagccccgtcgccgctgcaacccgcgaccggggacgtggcgagcgacagctacaacaacgtgtttcgcgacaccgaagccctgcgcgaacttggagtgacgcactaccggttttcaatctcatgggcacgcgtcctcccgaatggaagcgccggagtgcccaacagagagggcttgaggtactaccggagattgctggagcgcctcagagaactcggcgtccagcccgtggtcaccctgtaccactgggatctgccgcaacgcctgcaggatgcttacggaggatgggctaatagagctctggccgaccacttcagggactacgcggaactgtgtttccgtcacttcggcggacaggtgaagtactggattactatcgataatccatacgtggtggcatggcacggctacgccacgggacggctggccccgggcatccgggggtcgccacggctcggatatctggtggcgcacaacctgctgctggcgcatgcaaaggtgtggcatctgtacaacacttcgtttagaccgacccagggaggacaagtgagcatcgcgctctccagccattggattaacccgcgcaggatgactgaccacagtatcaaggagtgccagaagtcgctggacttcgttcttggctggttcgcaaagccggtgttcatcgatggagattacccggagtccatgaagaataacctctcctcaatactgcctgatttcaccgaatcggagaaaaagttcatcaagggaacggccgatttctttgcactttgcttcggccctaccctctccttccaactcctcgaccctcatatgaagtttcggcagctcgagtccccgaatctgcgccagctgctgtcctggatcgacctggaatttaaccacccacaaatcttcatcgtggagaacggatggttcgtgtcaggcaccactaagagagacgacgctaagtacatgtattaccttaagaaattcatcatggaaaccctcaaggccatcaagctggacggtgtcgatgtcattggatacactgcgtggagcctcatggatggattcgaatggcatcgggggtactcgatccgccggggattgttctacgtcgacttcctgtcccaggacaagatgttgcttccgaagtcatcggctttgttttaccagaaactgattgagaaaaacggatttcctccactgccggaaaatcagccgctcgaggggactttcccatgcgatttcgcctggggagtcgtggataactacatccaggtttcacaacttaccaaaccgatctccagcctgactaaaccctaccat

SEQ ID NO: 15247 - DNA, 1647 bp, Artificial Sequence; identical to SEQ ID NO: 15246
  Description of Artificial Sequence: Synthetic coding sequence

SEQ ID NO: 15248 - DNA, 1647 bp, Artificial Sequence
  Description of Artificial Sequence: Synthetic coding sequence
atgccggcatctgctccgcctcgacgaccaagacctcctcccccttccctctctctgctcttggtgctgttggggctaggtggaagaaggctcagagcagaacccggtgatggcgcccagacctgggcccgattctcaaggcctccggcccccgaggccgcgggactgtttcaaggaaccttccccgatggattcttgtgggccgtaggatctgctgcgtaccagaccgaaggcggatggcagcagcacggaaaaggcgccagcatctgggatacctttacccaccatcctttggcacctccaggcgactccaggaacgccagcctcccattgggggccccttctcctttacagcccgccactggggatgtagcatcagactcctacaataatgtcttcagggataccgaagcactgcgcgagctgggggtgacgcattacagattttcaatcagctgggcaagggtgcttccaaatgggtcggctggcgtacccaaccgcgaaggtctgcggtactacaggcggcttttggagagactgagggaactgggcgtgcagccagtcgtgacactgtatcattgggacctcccccagcgccttcaggacgcatacggtggctgggccaacagggcgttggccgaccacttccgggactacgcggagctgtgcttcagacactttggaggtcaggtgaagtactggattacaatcgataatccgtatgtcgtggcttggcacggttatgcaacagggcggctagcacctgggatccgggggagcccgcggctggggtacttggttgctcacaatttgctactggcacatgctaaggtgtggcatctgtacaacactagcttccgccccacccagggcgggcaggtgtccattgcgctttcctctcactggatcaaccctcgcagaatgacagaccattccatcaaggaatgtcaaaaatcactggattttgtgcttggctggtttgccaagcctgtgtttattgacggggactaccctgagtctatgaagaataacttgtcttcgattctccccgatttcacggagtcagagaaaaagtttatcaagggcactgccgactttttcgccctctgcttcgggcctacactgtcattccaactcctcgacccccacatgaagtttagacagttagagagtcctaacctgcggcagttactgagttggatcgatttggagttcaaccacccgcagatattcatagttgaaaatggatggtttgtgtcggggaccaccaagcgggatgatgctaaatacatgtattatctcaaaaaatttattatggagacactcaaggccataaaactggatggtgtggacgtgataggctatactgcgtggagccttatggacggattcgagtggcacaggggttactctatacggcgaggactgttctacgtcgactttctcagccaagataagatgttgctgcctaaaagcagcgccttgttttatcagaagctcatcgaaaagaatggtttccctcccctgcccgagaatcagccgctggagggaacatttccctgcgacttcgcctggggcgtggtcgataattacatacaggtgagccagctgacgaagcccattagcagtctgaccaagccctatcac

SEQ ID NO: 15249 - DNA, 1647 bp, Artificial Sequence; identical to SEQ ID NO: 15248
  Description of Artificial Sequence: Synthetic coding sequence

SEQ ID NO: 15250 - DNA, 1647 bp, Artificial Sequence
  Description of Artificial Sequence: Synthetic coding sequence
atgcctgcttcagcaccccccagaagaccaaggcccccacctccttcgctctcgctgttgttggttctgctgggcttgggcgggcgtcggctgagggccgaacctggagatggcgcccaaacctgggctcggttttccagacctcctgccccggaggccgctgggttattccagggcacatttcctgacggtttcctgtgggctgtcggatccgccgcttaccagaccgagggcggctggcagcagcacggcaagggcgctagcatttgggataccttcacacaccatcctctggctcctcccggcgactcgcgcaacgctagcctccctcttggggcaccttctcccctgcagccggcaacaggagatgtcgctagcgacagctataacaatgttttcagggatactgaggccttacgggagctgggagtgacccattaccgtttttctatctcctgggcgagagtactgcctaatgggagcgctggcgtccctaatcgtgagggtctgcgctattaccgcagattgctggaaaggttgagagagctcggcgtgcaaccggtcgtgacactgtatcactgggacctcccgcagaggttgcaagacgcttacggcggatgggcaaatcgtgcactggcggaccattttagggactacgccgagttgtgcttccgccactttggtggacaggtgaaatactggattaccattgataacccttacgttgtcgcttggcatggatacgcaaccggccggctggctcctggaatcagaggtagtccaaggctgggctacctcgttgcacacaaccttttgctggctcatgctaaggtatggcacctgtacaacacatcctttcggcccacgcagggtggacaggtcagcatcgctctgtcttctcactggattaacccacgcaggatgaccgaccacagtatcaaggagtgccaaaagtctctggattttgtgctgggctggtttgccaagcctgtttttattgacggggactaccccgagagcatgaagaacaacctgtcctctatcctgcccgacttcacggaaagtgagaagaagtttatcaaaggtaccgccgatttttttgctctgtgtttcggccctacgctgtcttttcagcttctggacccacatatgaagtttaggcagttggaatccccaaacctgcgccagctgttatcctggatcgaccttgaatttaatcacccgcagatctttattgtcgagaacgggtggtttgtgagcggcacaactaagcgcgacgacgccaaatacatgtattacttaaaaaaattcataatggaaactctgaaagcaatcaaactcgacggggtcgacgtgatcggctacactgcttggtcattgatggatgggttcgagtggcataggggttatagcattaggagaggcctgttctacgtggacttcctgagccaagacaaaatgttgctgcctaaaagcagcgctctgttttaccaaaagctgatcgaaaaaaatggcttcccccccctgcctgaaaaccaacctctggaaggcaccttcccttgtgatttcgcttggggagttgtcgacaattatatccaagtgtcacagctgaccaagccgatttcaagcctgaccaagccctaccac

SEQ ID NO: 15251 - DNA, 1647 bp, Artificial Sequence; identical to SEQ ID NO: 15250
  Description of Artificial Sequence: Synthetic coding sequence

SEQ ID NO: 15252 - DNA, 1647 bp, Artificial Sequence
  Description of Artificial Sequence: Synthetic coding sequence
atgcccgcttctgcgccaccgaggcgcccaagaccgccgccaccgtccctctcgctgctactggtcctcttgggtctgggaggacgccgcttgcgcgccgagccaggagatggagctcagacctgggccaggttttcacgaccgccagcgcccgaggccgctggtctgttccagggaacgttccctgacggcttcctgtgggctgtcggctcagcagcctaccagaccgagggaggatggcagcaacacggcaagggcgcaagcatatgggatacattcacccaccacccacttgccccgccgggagacagccgaaatgccagcttgccgctgggcgccccgtcgccgctgcagcccgccactggagacgtggccagcgactcctataataacgttttccgagacacggaggctctccgggagctgggcgttacccactaccgtttttctatctcctgggcacgcgtgctgcccaatggatccgcgggcgtgcctaatcgcgaggggttgcgttactaccgccgtttgctggagcgattgcgcgagctaggagtgcagccagtcgtaacgctttaccactgggacctgccccagcgtctccaggacgcctacggcggttgggcgaatcgtgctctggccgaccatttccgggattacgccgagctgtgcttccgacatttcggcggccaggttaagtactggataacaatcgacaacccctatgtagtggcgtggcatggatatgccacgggacgcctagcgccgggcattcgaggctcaccccggctgggttatttggtggcgcataatcttctgttggcccacgccaaggtatggcacttatataataccagtttccgtcccacccagggtggacaggtgtctatagcactgagctcgcactggattaacccgcgaagaatgaccgaccactctattaaggagtgtcaaaagtcgctggacttcgtgcttggatggtttgctaagccagttttcattgacggtgactacccagagtccatgaagaacaacctgtcctcaattctgccggactttacggagagcgagaagaagttcataaagggcacagccgattttttcgcgctctgcttcggccccaccctgagctttcaactgctggaccctcatatgaagttcagacaacttgagtcgccgaacctcaggcagcttcttagctggattgaccttgagttcaaccacccccaaatttttatcgttgagaacggctggttcgtgtcaggtaccacgaaacgcgatgacgcaaagtacatgtactatttgaaaaaattcataatggaaacgctgaaggccatcaaactcgacggcgtggatgtcattggctatacagcctggtcgctgatggatgggtttgaatggcaccgtggttacagcatccgacgaggattgttctatgtcgatttcctctcgcaagataagatgctactgccaaagagttccgctctgttctaccagaagctaatcgagaagaacggatttcccccgttgccagaaaaccagcccctggagggaacctttccctgcgactttgcctggggcgtggtggataattacatccaggtctcccagttgaccaagcccataagcagtcttaccaagccttatcac

SEQ ID NO: 15253 - DNA, 1647 bp, Artificial Sequence; identical to SEQ ID NO: 15252
  Description of Artificial Sequence: Synthetic coding sequence

SEQ ID NO: 15254 - DNA, 1647 bp, Artificial Sequence
  Description of Artificial Sequence: Synthetic coding sequence
atgccagcctccgcacctccaaggaggcctaggcctccccccccctctttgagtttactgctagtgttgctcggcctgggcggccgaagacttagagccgaacccggagacggggcgcagacatgggctcgttttagcagaccaccggccccagaggccgctggactcttccagggtaccttccctgatgggttcttatgggcagtgggttccgctgcctaccaaaccgagggggggtggcagcagcacggaaagggtgcttcaatctgggatactttcacacatcacccgttggcccctccaggggattcaagaaatgcctctctgcccctgggcgcgccttcccccctacaaccagccacgggggatgtcgccagtgattcttacaacaatgttttcagagatacggaggctcttagggaacttggggttactcactacaggttcagcatttcctgggctagggtgttgccaaatggaagcgcgggggtgccaaaccgggaaggcctccggtactatcggcgcctgctcgagcgcctccgcgaactgggagtccagcccgtggttacactgtatcattgggacttgccgcagcgactgcaggatgcgtacgggggatgggctaacagggcacttgccgaccactttcgcgattacgcagagctttgcttccgtcactttggggggcaggtcaagtactggatcactatcgataatccctacgtggtggcatggcatggctatgcaaccggcaggcttgctcctgggatcagaggcagtcctaggctgggctacctcgtggcgcataacctgttgctcgcccatgcaaaggtttggcatctgtataatacgtcgttcagaccaactcagggagggcaggtaagcatcgcactgagtagtcattggatcaatcctaggagaatgactgatcactcaatcaaggagtgccaaaagagcttggatttcgtgctgggctggtttgctaaaccagtgtttattgacggtgactatccagagagtatgaaaaacaacttgtcctctatcctgcctgatttcaccgagtcagaaaagaagttcatcaagggcacagctgatttttttgcattgtgtttcggcccgaccctcagctttcagctgctcgatccccacatgaagtttaggcagctcgaatccccaaatctgcggcagcttctgtcctggattgatctcgaattcaaccacccccagatcttcatagtcgaaaatggctggtttgtatctggtacaaccaagcgcgatgatgctaagtacatgtattaccttaagaagttcattatggaaacactgaaagctattaagctggatggtgtggatgtgatcggctacaccgcgtggtcactaatggacgggtttgagtggcaccggggctatagtatcaggagagggctgttctacgtggatttcctgtcccaggacaaaatgttgctgcctaagagctcagcgctgttttatcagaaattaattgagaagaacggttttcctccacttccggaaaaccagcctctcgagggtacctttccctgcgactttgcctggggagtcgtagacaattatatccaagtttcccagttaaccaagcctatcagttctctcacaaaaccctaccac

SEQ ID NO: 15255 - DNA, 1647 bp, Artificial Sequence; identical to SEQ ID NO: 15254
  Description of Artificial Sequence: Synthetic coding sequence

SEQ ID NO: 15256 - DNA, 1647 bp, Artificial Sequence
  Description of Artificial Sequence: Synthetic coding sequence
atgcctgcttctgccccaccgcgtcgtccaagaccgcctcctccgtcgttgagcctgttgttggttctgctcggactgggcgggcggcgtctccgagccgaacctggcgacggtgcacagacctgggcaaggttttcccgaccgccagctcccgaggccgccggcctctttcaaggcacttttcccgatggatttctgtgggccgtgggttcggcagcctaccaaaccgaaggagggtggcagcagcatggaaagggggcgtcgatctgggacacttttactcatcacccactcgctccgcccggcgactcccggaatgcttcccttccactgggcgcgcctagcccgttgcagcctgccactggtgatgtcgcctcagacagctacaacaatgtgttccgggataccgaagcccttcgggagctgggagtcactcattatagattttcaatctcatgggctcgcgtgctgccgaatggttcagcaggagtgccaaacagagagggactcagatactaccggcgcctcctcgagaggctgagagaactgggtgtgcagccggttgtgaccctctaccactgggatctgccacagcggctgcaggacgcatacggtgggtgggcaaacagagctctggcggatcacttccgtgactacgccgagctctgcttccgccattttgggggtcaagtgaagtactggataactatcgacaacccgtacgtggtggcctggcacggatacgcgacgggccgactggctccggggatccgcgggagcccgcgcctgggatacctggtggcgcataatctgctgctggcccatgccaaggtctggcacctgtacaacacttctttccgcccaacccaaggaggacaggtgtcaatcgccctcagctcacactggattaacccgcggcggatgactgaccactcgatcaaggaatgtcagaagtcgcttgactttgtgttgggatggttcgcaaaaccagtgttcattgacggagattacccggaatcgatgaagaacaacctctcatcgatcttgcccgacttcacggagtccgagaagaagttcatcaagggaaccgctgatttctttgcgctgtgtttcgggcccacgctttcgttccaattgttggaccctcatatgaagttcaggcagctcgaatcgccgaacctccggcagctgctctcctggatagatctggagttcaaccacccgcaaatcttcatcgtggagaatggatggttcgtgagcggaaccaccaaaagagatgacgctaaatacatgtactatctgaaaaagtttatcatggaaactctgaaagcgatcaaactggacggcgtggacgtgatcggatataccgcatggtccctgatggatggcttcgagtggcaccgcggatactcaatccgccgcggccttttctacgtggattttctttcgcaagataagatgctcctgccgaaatccagcgccttgttctaccagaaattgatcgaaaagaacggctttccgccgctgcctgaaaatcaaccccttgaaggaaccttcccatgcgacttcgcctggggcgtggtcgataactacatccaggtcagccagctcactaagccgatcagctcgctgaccaagccgtaccac

SEQ ID NO: 15257 - DNA, 1647 bp, Artificial Sequence; identical to SEQ ID NO: 15256
  Description of Artificial Sequence: Synthetic coding sequence

SEQ ID NO: 15258 - DNA, 1647 bp, Artificial Sequence
  Description of Artificial Sequence: Synthetic coding sequence
atgcctgcatccgcacctcccaggcgaccacggccaccgcctccctcgctttctcttctcttggtgctcctggggctcgggggcagacgccttcgggctgagccgggagatggagcacagacctgggcccggttctcccgccctcccgcaccagaagcagcaggtctgtttcaagggacgtttcctgatgggtttctgtgggcagtgggctcggcagcctaccagaccgagggtggctggcagcaacatggcaagggggcttcgatttgggatacttttactcatcatccccttgcgcctccaggtgatagccggaacgcctcgcttcccctgggcgctccttcaccactgcaaccggcgaccggagatgtggcttccgactcgtataacaacgtctttcgcgatactgaagcactgcgtgaactcggggtcactcactacagatttagcatttcctgggcgcgagtgctgcctaatgggagcgcaggcgttccaaatagagaaggactgagatactaccggagactgctggaaagactgagggaactgggagtgcagcctgtggtgactctttatcattgggaccttcctcagagactgcaggatgcatacggcggttgggccaatagggcactggcagaccattttcgggattacgccgagctctgttttcgacattttggagggcaagttaagtactggattacgatcgacaatccttacgtggtcgcttggcatggctatgcaacgggtcgtctggcccctggaattcggggatcccctagacttggttacttggtggcacacaacctgctgctcgcgcacgcaaaggtctggcacctgtataacacctctttccgcccaacccaaggcggacaagtgagcattgctctgtcctcccattggataaacccgcggcgaatgaccgatcactccataaaagaatgccaaaaatcccttgactttgtgctcggttggtttgccaaacctgtgttcattgatggagattaccccgagtcaatgaaaaacaatctgtcctcgattctgccagactttactgagtcggaaaagaagttcataaagggcaccgcggactttttcgcactttgcttcgggcctaccctgagctttcaactccttgaccctcacatgaagttcagacaactcgaatcccccaatctgcgtcaactgctgtcttggattgatctcgagttcaaccatccacagattttcattgtggagaatggatggtttgtgtcgggaacgactaagcgcgacgacgccaagtatatgtattaccttaagaagtttatcatggagactctcaaggcaattaagctggatggcgtcgacgtcatcggatacaccgcctggtcccttatggatggttttgagtggcatcgaggatactccattcgtagaggtcttttctacgttgacttcctttcgcaagataagatgctgcttccaaagtcgtcggcgcttttctatcagaaactcattgagaaaaacggattccctccgcttccagagaaccaacctctcgagggcacctttccctgtgatttcgcatggggcgtggtggataactacatccaagtgtcacagctcaccaagccaatttccagcctgactaagccctaccat

SEQ ID NO: 15259 - DNA, 1647 bp, Artificial Sequence; identical to SEQ ID NO: 15258
  Description of Artificial Sequence: Synthetic coding sequence

SEQ ID NO: 15260 - DNA, 1647 bp, Artificial Sequence
  Description of Artificial Sequence: Synthetic coding sequence
atgccagcgagtgcaccgcccaggcggccacggcctccaccaccatcactgtctctgctgttggtgcttctgggccttggcgggagacgcctgagagctgagccaggagatggcgcacagacgtgggcacgcttttcacggccacccgccccagaagcagcaggcctctttcagggcacctttcccgatgggttcttgtgggccgtcgggtctgctgcctatcagaccgaaggaggctggcagcagcacggcaagggcgccagtatatgggacacgtttactcaccatccgcttgcaccacctggcgactccagaaacgcctccctgcctttgggagcaccgagtccgttgcagcctgccacaggggatgtggcgagcgattcatataacaacgtctttagagatacagaagctttgcgggaattgggcgtgacccattataggttctctatatcatgggcgcgggtattgccgaacggttcagcgggcgtgccaaatcgggaaggacttagatactaccgcaggctgctagagagactccgggagttgggagttcagcctgtggtgactttataccactgggatctcccacaaaggctgcaggacgcatatggcggttgggcaaaccgggcattagctgatcactttagggactacgccgagctttgcttcaggcacttcggtggtcaggtgaaatactggatcacaattgataacccctacgtggtggcttggcatgggtatgctactggacggttagccccgggcatcagaggatctccgagactcggatacctcgtcgcacacaacctgctacttgctcatgccaaagtttggcatttatacaacacatcctttaggccaacacagggtgggcaggtctcaatagctctttcctcacactggattaacccacggcggatgaccgaccactcaattaaggagtgtcaaaagagcctggattttgtgctggggtggtttgcgaaaccagtctttatcgacggggactaccctgagtcaatgaaaaacaacctttccagcatactgccagattttacggaatcagagaagaaatttattaaggggaccgctgacttcttcgctttgtgctttggtccaaccttatcctttcagctgctagatccgcacatgaagtttcgccagcttgaatccccaaacctgagacagttgctctcctggattgatctcgaattcaaccaccctcaaatattcattgtcgaaaatggttggtttgttagtgggaccacgaaaagggacgacgccaagtatatgtactacctcaagaaatttattatggagactcttaaagccatcaaattagacggcgtggatgtcattggatatacagcctggagcctgatggacggcttcgaatggcatcgcggctacagtatcagacgcgggctgttctacgttgattttttgtcccaagataaaatgctgctgcccaagtccagcgcactcttctaccagaaactgatcgagaagaacgggttcccacctctgcccgagaatcagccgctcgaaggaacattcccatgtgattttgcctggggtgtggtggacaattatattcaggtgagtcaattgaccaagcctatatccagcctgactaagccgtatcac

SEQ ID NO: 15261 - DNA, 1647 bp, Artificial Sequence; identical to SEQ ID NO: 15260
  Description of Artificial Sequence: Synthetic coding sequence

SEQ ID NO: 15262 - DNA, 1647 bp, Artificial Sequence
  Description of Artificial Sequence: Synthetic coding sequence
atgcccgcgagcgcaccccccaggaggcccagacccccccccccgagcttgtccctgctgctcgtcctccttgggctgggtgggagacggctccgcgcagagccaggagatggcgcccagacctgggcaaggttcagtcgacccccagcccccgaagcagccggactgttccaggggactttccccgacggtttcttgtgggcagtagggagcgccgcataccagacagaagggggctggcagcagcatggcaaaggagcaagcatctgggataccttcacccatcacccccttgcgcctcctggtgacagccgaaatgcaagtttgccccttggcgcaccatcccctttgcagccagccactggtgacgtggcctccgattcatacaacaacgtgttcagagacactgaggcactgagagaactgggcgtgactcactacagatttagcatttcttgggctcgcgtcctgcctaacggcagcgcaggtgtacctaacagagagggcctgagatactataggcgacttctcgagcggctgcgagaacttggcgtccagcctgtggtgacactgtatcactgggacctcccccagagactccaggacgcttatggagggtgggctaatcgggccctggcagaccacttcagggactatgctgaactgtgctttaggcatttcggcggccaggtaaagtattggattaccatcgacaatccgtatgtggtcgcctggcacggctacgccacaggcagattggcgccagggatccgagggagtcccagactggggtatctggtggcccataatctgctcctggcacacgccaaggtctggcatctttacaacacatcattccggcccacccagggggggcaagtttccatcgcattgtcatcccactggattaatccacgaaggatgacggaccattctatcaaggaatgtcagaagagcttggatttcgttctgggttggttcgctaagcccgtttttatagatggtgactaccctgaatcaatgaaaaacaacttgtcctccatcctgcctgatttcactgagtctgaaaaaaagtttataaaaggcaccgccgattttttcgccctctgtttcggacctactctgtctttccagctgcttgatccccacatgaagtttaggcagctggagtctccaaacctgcggcagttgctgtcctggattgaccttgaattcaaccacccacagatttttatcgttgaaaatggttggtttgtgagtgggacaactaaacgggatgacgctaagtatatgtactacctcaaaaagtttattatggaaacactcaaggccatcaagctggacggcgttgacgtcatcggttatacagcttggtcccttatggatgggtttgaatggcatcggggatactctatacgcagaggactgttttacgtggattttctttcacaggataagatgttgctgcctaaatcctctgccttgttttatcagaaattgatcgagaagaatggattccccccactcccggagaaccagccgctggagggtactttcccatgcgattttgcttggggtgtggtcgacaattatattcaagtctctcagctgaccaaaccaattagctcattgactaaaccttaccat

SEQ ID NO: 15263 - DNA, 1647 bp, Artificial Sequence; identical to SEQ ID NO: 15262
  Description of Artificial Sequence: Synthetic coding sequence

SEQ ID NO: 15264 - DNA, 1647 bp, Artificial Sequence; identical to SEQ ID NO: 15254
  Description of Artificial Sequence: Synthetic coding sequence

SEQ ID NO: 15265 - DNA, 1647 bp, Artificial Sequence; identical to SEQ ID NO: 15254
  Description of Artificial Sequence: Synthetic coding sequence

SEQ ID NO: 15266 - DNA, 1647 bp, Artificial Sequence
  Description of Artificial Sequence: Synthetic coding sequence
atgccagcctccgccccccccagacggccgcgccctccccctccgtcgctctccctgctgttggtgcttctagggttgggaggtcggagattgcgcgcagaaccgggcgatggggcccagacatgggctaggttctcacgccctcccgcacctgaagccgccggactcttccagggaactttccccgatggtttcctgtgggccgtcggctccgctgcctatcagaccgaggggggctggcagcaacatgggaagggcgccagcatatgggacacattcactcaccatcccttagcaccccccggggattctcggaacgcaagcctgcctctcggcgcaccatctccactccagccagccacaggggatgttgccagcgatagctataataatgtatttcgggacactgaggcccttagagagctgggcgtgactcactatagattctcaatcagctgggcccgagtcctgccgaacgggagtgcgggtgtacccaacagagaaggactgcggtactataggagactgctcgagaggctcagagagctgggagtacagcccgtcgtcaccctgtaccactgggacctgccacagcgccttcaggacgcatatggcggctgggctaatcgagcgctggctgatcattttagagactacgccgaactatgcttcagacactttggcggacaggtcaaatattggattacaattgacaacccctacgtggtggcttggcacggatacgccaccggaagactggcaccagggattcggggctctccccggctcggctacctcgtggctcacaatttgctactggcccatgcgaaggtttggcatttgtacaacacttcttttcggcctacgcaaggcggccaggtctctatcgcattgtccagccactggattaatccacgccgtatgacagatcactcaatcaaggagtgccagaagagcctggattttgttctgggctggtttgctaaaccggtgttcatcgacggcgactatcctgaatctatgaagaataacctttctagtatcctgccggacttcactgagagtgagaagaagtttatcaaaggaacagcggactttttcgccttgtgcttcggacccaccctgtctttccaactgctcgatccccacatgaagttccgccagctggagagtcccaaccttcgtcagctcctctcatggattgatcttgaatttaatcatcctcaaatcttcatcgtcgaaaatggctggtttgttagcggcactaccaaacgcgacgatgccaagtatatgtactacctgaaaaagtttatcatggagactctgaaggccataaaattggacggcgtggatgtaatagggtatactgcatggtcactcatggatggcttcgagtggcaccgcggctatagcatccgcagaggcctgttctacgtggactttctgagtcaggataaaatgcttcttcccaagtccagcgcactattctatcagaagcttatcgagaagaacggattcccacctttgcctgagaatcagcccctcgagggtacctttccatgtgacttcgcatggggcgttgtggacaactacatccaggtcagtcaattgacaaagcccatcagctcccttactaagccttaccac

SEQ ID NO: 15267 - DNA, 1647 bp, Artificial Sequence; identical to SEQ ID NO: 15266
  Description of Artificial Sequence: Synthetic coding sequence

SEQ ID NO: 15268 - DNA, 1647 bp, Artificial Sequence
  Description of Artificial Sequence: Synthetic coding sequence
atgccggccagcgcccctccacgtcgaccacgccctccacctccatcgctctcgctgttgctggttctgctgggcctggggggaaggagactcagagccgaaccgggcgacggagcgcagacctgggccagattctcgcggccaccggcaccggaggctgccggactgtttcagggcacttttccagacggatttctctgggcagtcggctccgcggcataccagaccgaaggtggttggcaacagcatggcaaaggagcttccatctgggacactttcacccaccatccactggccccaccgggagactcaaggaacgcctcactcccgttgggtgctccgtcccctctgcagccagcaactggagatgtggcaagcgattcatacaacaacgtgtttagggatactgaagccctgcgggaactgggagtgactcactaccgcttctcgatcagctgggcacgggtgctgccgaacggttcggccggagtgccgaaccgggagggactgagatactacagacggctcctggagagacttcgcgaactgggagtccaacctgtcgtgactttgtaccactgggatctcccgcagcgcctgcaggacgcctacggaggctgggctaatagagcgctggcggatcactttcgggactacgcagagctgtgcttccgccatttcggtggacaagtcaaatactggatcaccatcgacaacccgtacgtcgtcgcctggcacgggtacgccactggacgcttggcccctggaatccgcggaagcccacggctgggctacctggtggcacacaatctgcttcttgcacacgctaaggtgtggcatctgtacaacacttcgttccggccgacccagggcggtcaggtcagcatcgcactttcttcccattggatcaaccctagacgcatgaccgaccactccatcaaagagtgtcaaaagtccctggactttgtcctgggttggtttgcgaagccagtgtttatcgatggagattacccggaatcgatgaagaacaacctttcgtcgatcctcccggatttcaccgaatccgagaaaaagtttatcaagggtactgctgacttttttgcgctctgcttcggaccgaccctcagctttcagctcctggacccgcacatgaaatttcgccaactcgaatccccaaatcttcggcaactgctcagctggatcgacctcgagttcaaccatccgcagattttcatcgtggaaaatggatggttcgtttctggtactactaaacgcgatgacgctaagtatatgtactacctgaagaagttcatcatggaaaccctgaaggccatcaaactggatggagtggacgtgatcggctacactgcttggagcttgatggacggattcgaatggcaccgcggatactccatccgccgggggctcttttatgtggacttcctgtcccaggacaaaatgctgcttccgaagtcgtcggctctgttctaccaaaaactgatcgagaaaaatggatttccgcccctccccgaaaaccaaccgctcgagggtactttcccctgcgacttcgcatggggcgtggtggacaattacatccaagtcagccagctcactaagccgatcagctcgctcaccaagccgtaccac

SEQ ID NO: 15269 - DNA, 1647 bp, Artificial Sequence; identical to SEQ ID NO: 15268
  Description of Artificial Sequence: Synthetic coding sequence

SEQ ID NO: 15270 - DNA, 1647 bp, Artificial Sequence
  Description of Artificial Sequence: Synthetic coding sequence
atgccagcctccgccccaccccgacgtcctcgaccaccgccgccgagtctctcgttattgctagttctcttgggattgggaggtagacgattaagggctgagccaggtgatggtgctcaaacttgggctcgattctcccggcctccagctccagaggccgccggactcttccaaggaacttttccagatggtttcctttgggccgttggaagcgccgcataccaaaccgagggaggctggcagcaacacggaaagggcgcaagtatttgggatacctttactcatcacccgcttgcgcctccaggagattcacgtaacgcgtcccttccattgggagcaccgagcccgttgcaaccagcaaccggagatgtggctagtgacagttataacaacgtctttagggatacagaggccttgagggagttaggagtaactcattataggttttcgataagctgggcacgtgtgctcccgaatggatccgctggagtgcccaatcgtgagggactacgatattatcgaaggctacttgaacgcttacgtgaattgggcgtgcaaccggtggtgactctttaccactgggatttgccacaacgtcttcaagatgcatatggaggatgggcaaacagggcattggcagatcactttcgtgactacgcggaattgtgcttccgacattttggagggcaagtgaaatattggattactatcgataatccatatgtggttgcctggcacggctacgcgaccggtagactcgctccaggtatccggggtagtccacgacttggatacttggtagctcataatcttcttctagctcacgctaaggtttggcacctttataatacatcgttccgaccaactcaaggaggacaggtttccattgcgctctcgtctcattggattaatcctagaagaatgacggatcactctattaaagaatgccaaaagtcgctagatttcgtgctggggtggttcgccaagccagtttttatcgacggtgactacccggaatctatgaagaataatctttcttcaattttgcctgatttcacagaaagcgagaaaaagttcattaaaggaacagcggacttctttgcgctctgctttggacccacactaagcttccaactgttggatccacatatgaagtttagacaacttgaatcaccaaatttgagacaattgctctcttggattgatttagaatttaaccatccacagattttcatagtggagaatggatggttcgtctcaggaacaacaaaaagggatgatgctaagtatatgtactatcttaaaaagtttatcatggaaaccctgaaagcaataaaattggatggagtagatgttattggatacacggcgtggtcacttatggatggattcgagtggcacagaggatattcgattcgtagaggccttttttatgttgatttcctatcccaggacaaaatgcttcttcctaaatcatcggctttgttctaccaaaagttgattgaaaagaatggatttccaccacttccggaaaatcaacctcttgaaggaacttttccttgtgatttcgcgtggggtgttgtggataattatattcaagtttctcaacttacaaaaccaatttcgtctttaacaaaaccataccat

SEQ ID NO: 15271 - DNA, 1647 bp, Artificial Sequence; identical to SEQ ID NO: 15270
  Description of Artificial Sequence: Synthetic coding sequence

SEQ ID NO: 15272 - DNA, 1647 bp, Artificial Sequence
  Description of Artificial Sequence: Synthetic coding sequence
atgccggcttctgccccaccgcgcagaccacggccccctccgccctcgctctccttgctgttggtgctcctcggactgggtgggcgcaggctccgcgccgaaccgggagacggagcacagacctgggctcgcttctcgcggccacccgcccctgaggcagccggtctgttccagggaacgtttccggacggatttctgtgggccgttggctccgcagcgtaccagactgagggtggctggcagcagcacggaaagggagccagcatctgggataccttcacccatcatccactcgcaccaccgggtgatagcagaaatgcgtccctgcctctgggagctccgagcccactccagccagcgactggagacgtggcgtctgacagctacaataacgtgtttcgcgacaccgaggctctgcgggaactgggcgttactcactacaggttctccatatcatgggcaagagtcctgccgaatggctcagctggagtgccaaatcgagaaggactgagatactaccgcagactcctcgagcgcctgagagaactgggggttcagcctgtggtgaccctctaccattgggatcttcctcagcggctgcaagatgcctatggtggatgggccaacagggctctcgccgatcactttcgggattacgccgagctttgcttccggcacttcgggggacaggtcaaatactggatcaccatcgataatccatacgttgtggcgtggcacggatacgcgacggggcggctggcgccggggattcgggggtccccgcgcctgggatatctggtcgcgcacaacctgctcctggcccacgcgaaggtgtggcatctctacaatacttccttccgccccactcagggcggacaggtgagcatcgccctctcgtcgcattggatcaacccgaggcggatgaccgaccactcgatcaaggaatgccagaagtcacttgattttgtgctgggatggtttgccaagcctgtgttcatcgatggagattacccggaatcgatgaagaataacctgtcctcgatcttgccggattttactgaatcggagaagaagtttatcaagggtactgctgacttcttcgcgctttgcttcggaccaaccctctcgtttcagctcctggacccgcacatgaagttcaggcagctcgagtccccgaacctgcgacagctcttgtcctggatcgacctcgagttcaaccacccccagatcttcattgtggagaacggttggttcgtgtctggtactaccaaacgcgatgacgcaaagtatatgtactatctgaaaaagttcatcatggaaaccttgaaggctatcaaattggacggcgtggacgtgattggatacaccgcatggtcgcttatggacggcttcgagtggcataggggctactcgattaggcgcggacttttctatgtcgacttcctttcgcaggataagatgctcctgccgaagtcgtccgctctcttttaccagaaactgattgagaaaaacggcttccctcctctgccggaaaaccagccattggagggtacctttccctgcgacttcgcctggggagtcgtggacaattacatccaggtgtcccaattgaccaaaccaatctccagcttgactaaaccgtaccat

SEQ ID NO: 15273 - DNA, 1647 bp, Artificial Sequence; identical to SEQ ID NO: 15272
  Description of Artificial Sequence: Synthetic coding sequence

SEQ ID NO: 15274 - DNA, 1647 bp, Artificial Sequence
  Description of Artificial Sequence: Synthetic coding sequence
atgccggcgtcggcgccgccgcgtcgaccgcgaccgccgccgccgtcgttatcgctattattagtactactaggtctaggtggtcgacgactacgtgcggaaccgggtgatggtgcgcaaacgtgggcgcgattttcgcgtccgccggcgccggaagcggcgggtttatttcaaggtacgtttccggatggttttctatgggcggtaggttcggcggcgtatcaaacggaaggtggttggcaacaacatggtaaaggtgcgtcgatatgggatacgtttacgcatcatccgctagcgccgccgggtgattcgcgtaatgcgtcgctaccgttaggtgcgccgtcgccgttacaaccggcgacgggtgatgtagcgtcggattcgtataataatgtatttcgagatacggaagcgttacgagaattaggtgttacgcattatcgtttttcgatatcgtgggcgcgagtattaccgaatggttcggcgggtgtaccgaatcgtgaaggtttacgttattatcgacgtctactagaacgtttacgagaactaggtgtacaaccggtagtaacgttatatcattgggatctaccgcaacgtttacaagatgcgtatggtggttgggcgaatcgtgcgttagcggatcattttcgagattatgcggaactatgttttcgtcattttggtggtcaagtaaaatattggataacgatagataatccgtatgtagtagcgtggcatggttatgcgacgggtcgtctagcgccgggtatacgtggttcgccgcgtctaggttatttagttgcgcataatttactactagcgcatgcgaaagtttggcatttatataatacgtcgtttcgtccgacgcaaggtggtcaagtatcgatagcgctatcgtcgcattggataaatccgcgacgtatgacggatcattcgataaaagaatgtcaaaaatcgttagattttgtactaggttggtttgcgaaaccggtttttatagatggtgattatccggaatcgatgaaaaataatctatcgtcgatactaccggattttacggaatcggaaaaaaaatttataaaaggtacggcggatttttttgcgttatgttttggtccgacgttatcgtttcaactattagatccgcatatgaaatttcgacaactagaatcgccgaatctacgtcaactactatcgtggatagatctagaatttaatcatccgcaaatatttatagttgaaaatggttggtttgtatcgggtacgacgaaacgtgatgatgcgaaatatatgtattatttaaaaaaatttataatggaaacgttaaaagcgataaaactagatggtgttgatgttataggttatacggcgtggtcgttaatggatggttttgaatggcatcgtggttattcgatacgtcgtggtttattttatgtagattttctatcgcaagataaaatgctactaccgaaatcgtcggcgttattttatcaaaaattaatagaaaaaaatggttttccgccgttaccggaaaatcaaccgttagaaggtacgtttccgtgtgattttgcgtggggtgtagtagataattatatacaagtttcgcaattaacgaaaccgatatcgtcgctaacgaaaccgtatcat

SEQ ID NO: 15275 - DNA, 1647 bp, Artificial Sequence; identical to SEQ ID NO: 15274
  Description of Artificial Sequence: Synthetic coding sequence

SEQ ID NO: 15276 - DNA, 1647 bp, Artificial Sequence
  Description of Artificial Sequence: Synthetic coding sequence
atgccggcgagcgcaccacctaggcgaccgcggccaccgccgccttccctgtccctcctcttggtgcttctcggactcggagggagacggttgcgggcagagcccggggacggagcccagacttgggcaagattcagtagaccgcctgcccccgaagcggccggtctgtttcagggtaccttcccagacggattcctctgggccgtgggctcggctgcctaccagaccgaagggggatggcagcaacatggcaagggagctagcatctgggacacgtttacgcatcacccactggccccgccgggggattcacgcaacgcatccctgccgcttggagctccgtccccactgcaaccggcaactggggatgttgcgtcagactcctacaacaacgtattccgcgacaccgaggcgctgcgggagttgggagtcacccattaccgcttctcgatctcctgggcccgggtcctccccaatggaagcgcgggagtcccaaatcgcgaaggcctgcgctattaccgcagactgttggagcggctgcgtgaactcggggtgcagccggtcgtgaccctctaccactgggatcttcctcagagactccaagatgcttacggtggatgggccaaccgggctctcgccgatcacttcagggattacgccgagctctgcttccggcatttcggcggacaggtgaagtactggatcactatcgacaacccgtatgtggtggcctggcacggatacgccactggacggctggcgccagggatcagaggttcaccgcgtcttggataccttgtcgcccacaacctgctgctggcccatgcaaaggtgtggcatctttacaatacctcatttaggccaactcagggaggccaggtgtcgatcgctctgtcgtctcactggatcaatcctcgccggatgaccgatcactccataaaggagtgccaaaagtcactcgacttcgtactgggttggtttgctaaaccagtgtttattgacggcgactaccccgaaagcatgaagaataatctgtcgtccatcctcccggattttaccgaatccgagaagaagttcatcaaaggtaccgccgactttttcgcactgtgctttggaccaaccctcagcttccagttgctggaccctcacatgaagttcaggcagcttgagtcgccgaacctccgacagcttctgagctggattgatctcgaattcaaccacccccaaatctttatcgtcgaaaacggctggttcgtgtctggcactactaagcgagatgacgctaaatacatgtactacctgaaaaagttcattatggaaactctgaaggcaatcaagctggacggggtggatgtaatcggctacaccgcctggtccctgatggacggattcgaatggcatcggggctacagcattcgcaggggactcttctacgtggatttcctgagccaagacaaaatgttgcttccaaagtccagcgcgctgttttaccagaaactgatcgaaaagaacgggttcccccctttgccggagaaccagccactggagggaacctttccctgtgacttcgcatggggagtggtggacaactatatccaagtgtcccagctgactaaaccgatctcgagcctcacgaaaccgtaccac

SEQ ID NO: 15277 - DNA, 1647 bp, Artificial Sequence; identical to SEQ ID NO: 15276
  Description of Artificial Sequence: Synthetic coding sequence

SEQ ID NO: 15278 - DNA, 1647 bp, Artificial Sequence
  Description of Artificial Sequence: Synthetic coding sequence
atgccagcgagcgcgccgccccggcgcccccgcccaccgccaccgtcgctgagcctccttctggtcctcctgggcctgggaggacgccgcctgcgggccgaaccgggggatggagctcaaacgtgggcgagattctcccgcccacccgcaccggaagctgcgggactcttccagggaacctttcctgacggatttttgtgggcggtcggatcggctgcgtaccagaccgagggagggtggcaacagcacggtaaaggagcgtcaatctgggacaccttcacccaccacccactggccccaccgggagattcccgcaacgcctctctgccactgggtgcgccttccccgctccaaccggcgacgggagacgttgcctcagattcgtacaacaacgtgtttcgagacaccgaagcactcagggagctcggagtgacccattacaggttctccatctcatgggctcgcgtcttgccaaatggatcagccggggtgcctaatagagaggggcttcgctactaccggaggctgctggaaagactgagggaacttggagtgcagcccgtcgtcactctttaccattgggacctgcctcagcgcctgcaagatgcttacggcggatgggccaacagagcccttgcagatcactttcgcgactatgccgaactttgcttccggcacttcggcggacaggtgaaatactggatcactatcgataatccttacgtggttgcgtggcatggatacgcgaccggtcggctggcccctggaattcgggggtcgcctcgcctgggttacctcgtggcacacaatctgcttctggcccatgcgaaggtctggcacctttacaacacctccttccggccgacccaaggaggacaagtgtcgattgccctgagctcgcattggatcaacccacggcgcatgaccgatcactccatcaaggagtgccaaaagtcattggatttcgtcctgggatggtttgccaagcccgttttcatcgacggcgactacccggaaagtatgaagaacaacctctcttccatcctgccagatttcactgaatcagagaagaaattcatcaaaggtaccgcagacttttttgcactgtgtttcggtccaaccctctctttccaactcctggacccgcatatgaaattcagacagctcgagtccccgaatctgcggcagctcctctcgtggatcgaccttgagttcaatcacccacaaatctttatcgtggaaaacggctggttcgtgagcgggaccactaagcgcgacgatgccaaatacatgtactatctgaagaagttcattatggaaaccctgaaggcaatcaagctcgatggtgtggacgtgattggatacacggcctggtcgcttatggacgggttcgagtggcacagagggtacagcatcagacgcgggctgttctacgtggactttctcagccaggacaaaatgctcctgcctaagtcatctgcgctcttctatcagaagctcatagaaaagaacggattcccgcctctccccgagaatcagcctctggaggggaccttcccgtgtgattttgcatggggggtggtcgacaactatattcaggtgtcgcaactcaccaaaccaatctcatcgctgacgaagccataccac

SEQ ID NO: 15279 - DNA, 1647 bp, Artificial Sequence; identical to SEQ ID NO: 15278
  Description of Artificial Sequence: Synthetic coding sequence

SEQ ID NO: 15280 - DNA, 1647 bp, Artificial Sequence
  Description of Artificial Sequence: Synthetic coding sequence
atgcctgctagcgcgccacctaggaggcccaggcctcccccccccagcctgtctctgcttttagtgcttcttggcctaggaggacgaaggttgcgagccgagcctggggacggcgcccaaacctgggccaggttctcccggcctccagccccagaggccgccggccttttccagggaacattccccgatgggttcttgtgggcggttggatctgccgcgtatcagactgaaggtggttggcaacagcatggcaaaggtgccagtatctgggacacgttcacccaccacccgttggcccctcctggcgatagcagaaatgcctctctgcctttgggagctccctctcccctccagcccgcaacaggggacgttgcaagtgacagttacaataacgtgttccgggacaccgaggctcttagagagttgggcgtcacgcattatagattctctatcagctgggcccgtgtgctgcccaatggcagcgcgggggtgccaaatcgcgagggcctacgctattataggcggctgctggaacgcttgcgggagctgggtgtacagccggttgtgaccctctaccattgggatctgcctcagcgacttcaggacgcatatggtggatgggctaatagagcactcgcagatcacttccgtgactatgcggagttatgtttccgtcatttcggaggccaggttaaatattggataacaattgacaatccatacgtggtggcctggcatggatatgccactgggcgattagcccctggcattaggggttctccaagacttgggtatctggtcgcacacaacctgctgctggcacacgccaaggtgtggcacctgtacaacacatccttccgccctactcagggaggacaggtgtccattgctctttccagtcactggatcaatccacgtcggatgacagatcactccatcaaagaatgtcaaaaaagcctcgattttgtgctgggctggtttgccaagcccgtcttcattgatggcgattaccccgagagcatgaaaaacaacttgagctcgatcctgcctgacttcacagaaagtgaaaagaaattcattaaggggacggctgacttctttgccttatgctttggacccactctttcatttcaattgctggatccacatatgaaatttcggcagctggagagtccgaatctgcgacaattactttcctggattgatttggagtttaatcacccacagattttcatcgtcgagaacggctggttcgtgtcggggaccacaaagagagatgatgcaaagtacatgtactatctgaagaaattcatcatggaaaccctgaaggcgattaagctggacggggttgacgtaattggatacaccgcgtggagcctgatggacggctttgaatggcaccggggctactccatcaggcgtgggctgttctatgttgatttcctcagtcaggacaagatgctgctgcctaagagttccgctctgttttatcagaaattgatagagaaaaatgggttcccacctttaccagaaaatcagccacttgaggggacctttccgtgcgattttgcgtggggtgtggttgacaactatatacaggtttcgcagctcacaaaacccatctctagtcttaccaaaccatatcac

SEQ ID NO: 15281 - DNA, 1647 bp, Artificial Sequence; identical to SEQ ID NO: 15280
  Description of Artificial Sequence: Synthetic coding sequence

SEQ ID NO: 15282 - DNA, 1647 bp, Artificial Sequence
  Description of Artificial Sequence: Synthetic coding sequence
atgccggcgtcagctccgccacgcaggcctcggccacctcctccgtcgctgtcgctgcttctggtcctgctgggactggggggaaggcggctcagggcagagccgggcgacggtgcgcaaacttgggcccgcttctcgcggccaccagctccagaggctgcggggctgttccaaggcacctttccagacggcttcctgtgggcggtgggaagcgcggcctaccagaccgaggggggctggcagcagcacggcaaaggagcctccatttgggataccttcacgcatcacccgctcgctcccccgggagactcacggaatgcatccttgccgctcggagccccgtcccctttgcaaccagcaactggagatgtcgcatccgatagttacaataatgtgttcagagacactgaagccctccgcgaactcggagtgacccactaccggttcagcatcagctgggcacgcgtgctgcccaatggatccgccggagtgcctaaccgcgaggggctgcgctactaccgccgcctgttggagcgcctcagggagctgggggtccagcccgtggtgaccctgtaccattgggacctcccgcagcgtctgcaagatgcttatggaggatgggcaaatagggcattggcggatcacttccgggactacgcggaactttgcttccgccacttcggaggccaggtcaaatactggatcacgattgacaacccttacgtggtggcctggcatggatacgcaaccgggcggctggcacccgggatccgtggatcccctcgcctgggatacctggtggcccataatctgctcctcgcccatgcgaaggtgtggcacctttacaatacctcgttccgccctactcaaggcggacaggtgagcatcgctctgtcaagccactggatcaatccgagacgaatgaccgaccacagcatcaaggaatgccagaaatccctcgatttcgtgctgggctggttcgccaagccggtgttcatcgatggagactaccccgaaagcatgaagaacaacctgtcatccattctgccggatttcactgagtctgaaaagaagtttatcaaggggactgccgatttcttcgcactgtgctttggtcctaccctctctttccaactgctcgatccacacatgaaattccggcagctggaatcacctaatctgcggcaactgctgtcctggattgacctcgagtttaaccatccgcagatcttcatcgtcgagaacggctggttcgttagcgggactactaagcgggatgatgctaagtacatgtattatctcaagaagttcataatggagactctgaaggccatcaagctcgacggagtggacgtcatcggatacacggcctggtcattgatggatggttttgagtggcacaggggctactcgattagaagaggactgttctacgtcgacttcctgtcccaagacaagatgcttctgccaaagtcctctgcgctgttttaccagaagctcattgagaagaatgggttcccgccactgccagaaaaccaaccgctggaggggaccttcccatgcgatttcgcatggggagtcgtggataactacatccaggtgtcgcagctgaccaagccaatctcgtctctgactaagccataccat

SEQ ID NO: 15283 - DNA, 1647 bp, Artificial Sequence; identical to SEQ ID NO: 15282
  Description of Artificial Sequence: Synthetic coding sequence

SEQ ID NO: 15284 - DNA, 1647 bp, Artificial Sequence
  Description of Artificial Sequence: Synthetic coding sequence
atgcctgcatctgctcctcctagacgcccaaggccgccccccccatctctgagcctgctgctcgtgctgctcggacttggcggcagaagacttcgtgcggagcccggggatggagcccagacctgggcccggttttcacggcctcccgcccctgaggccgcgggcctgttccagggcacgttccccgacggcttcctgtgggccgtgggctcagccgcataccagacagagggaggctggcaacagcacggcaagggcgcatccatatgggatacatttacacaccatccattggcaccgcccggtgatagcaggaacgcctctctgcctctgggagcacctagccccctgcagccggctaccggagatgtcgccagcgactcatataataatgtcttccgcgatactgaggcactgagggagcttggcgtaactcattatcgtttttcaatcagctgggccagagtactgcccaacggtagcgcgggggtgcccaatagggaaggtctgcggtactatcggcgcctcctggagaggctacgggaactgggggtacagcctgtggtgacactctatcactgggacctcccgcagaggctccaggacgcttatggtggctgggcgaatcgggccctagctgaccactttcgggattacgccgagctctgttttaggcactttgggggccaggttaaatactggatcacaatcgataacccctacgtagtggcttggcatgggtacgcaaccggtagactggcccctggtatccggggttctccacgcctcgggtacttggtagcccacaacctccttctggcccacgccaaagtgtggcatctgtataatacgtcgtttcgaccgacgcaaggagggcaggtgtctatagctctgtcatctcattggatcaaccctcgccgtatgacggaccattccattaaagaatgtcagaagagtctggactttgtcctaggttggttcgctaaacctgtattcatcgacggtgactacccagaatccatgaaaaataatctgtctagtattctgcctgatttcacggagtcagaaaaaaaattcatcaaaggtaccgccgacttctttgccctgtgtttcggaccgacgcttagcttccaactgttggatccacatatgaaatttaggcaactggagagtcctaacctccgtcagctcttaagctggatcgacttggagtttaatcatccccaaatttttatagttgagaatggctggttcgtgtctggtaccaccaaacgggacgacgcaaagtacatgtactacctgaagaaattcattatggaaacactgaaagccatcaaattagatggggtcgatgtgatcggatacaccgcttggtctctaatggatggctttgagtggcatcgcggatacagcatccgaagaggtctgttttacgtggatttcctgtctcaggacaagatgttgcttcctaagtcctcagccctgttctaccagaaattgatagaaaaaaatggctttcctccactccccgagaatcagcctctagaaggaacatttccttgtgacttcgcatggggcgtggtagacaattacatccaggtttcccagctgaccaagcctattagttctctgacaaagccataccat

SEQ ID NO: 15285 - DNA, 1647 bp, Artificial Sequence; identical to SEQ ID NO: 15284
  Description of Artificial Sequence: Synthetic coding sequence

SEQ ID NO: 15286 - DNA, 1647 bp, Artificial Sequence
  Description of Artificial Sequence: Synthetic coding sequence
atgcctgcatccgcaccacctaggcgtccccggccgcccccaccatcgctgtccctcctcctggtgctgcttgggctgggcggccgtagactcagagcagagcccggggatggtgcccaaacctgggcacgattttcccgacctcctgcacctgaggccgctgggctgtttcaaggcacctttcccgatggttttctctgggcggtgggatcggcagcgtaccagactgaagggggatggcaacagcacggtaagggagcatcgatttgggatacctttacccatcatccactggccccgcctggtgactcccgaaacgcgtctctgccacttggagcaccatcgcctctgcagcccgctactggagatgtcgcctcagatagctacaacaacgtgttccgcgataccgaagcactgagagaactgggcgtgacccattacaggttttcaattagctgggcgcgagtgcttcctaatggaagcgctggggtgcccaacagggaaggactgagatactatcggcggcttctggaacgtctgcgggagcttggcgtgcagcccgtggtcactctgtaccactgggatctgcctcaacggctccaggacgcctacggaggatgggcaaaccgcgctcttgctgatcactttcgagattacgcagaactgtgctttagacactttggtggacaggtgaagtactggattactattgataatccttatgtcgtggcctggcacggatacgcaacgggtagactggcaccaggcattcgcggctcgccccggctgggataccttgtcgcgcataatctgctcctcgcgcacgcaaaagtctggcatttgtacaacacttcgtttcgaccaacgcaaggtggtcaagtgtcgatcgcactttcaagccactggatcaatccccgacgtatgactgatcattccatcaaggagtgtcagaagtcccttgactttgtgcttggttggtttgcaaaacccgtgttcatagatggagattaccctgagagcatgaagaataacctttcaagcattctgcccgacttcaccgagtccgaaaagaagttcattaaaggcactgccgactttttcgccctgtgctttggtccaactctttcgttccaactgcttgatcctcacatgaagtttagacaactggaatctcctaacctgaggcaactgctttcatggatagacctggagtttaatcacccacagattttcattgtggagaatggctggtttgtctctggcactaccaagagagatgatgcaaagtatatgtactatctgaagaaattcatcatggaaaccctgaaagcaataaagctggatggggttgatgtcatcggctacactgcgtggagcctcatggatggtttcgaatggcatagaggttactcgattcgccgaggtttgttctacgttgatttcctctcccaagataagatgctgctgccaaagtcatcggccctgttctaccaaaaacttatcgagaagaacggatttcccccacttcctgaaaaccaaccgcttgagggaacctttccttgtgactttgcatggggagtggtggataactacattcaggtgtcacagctgactaagcctatatcgtctcttactaagccttaccat

SEQ ID NO: 15287 - DNA, 1647 bp, Artificial Sequence; identical to SEQ ID NO: 15286
  Description of Artificial Sequence: Synthetic coding sequence

SEQ ID NO: 15288 - DNA, 1647 bp, Artificial Sequence
  Description of Artificial Sequence: Synthetic coding sequence
atgccggcgtccgctccaccgcgccggcccaggcctccgccccctagcttgagcttgttgctggtcctgctgggactcggaggacggcggctcagagcagaaccgggcgacggggcgcagacctgggcgcggttctcacgcccgccggctccggaagctgcggggctgttccagggaaccttccctgacggctttctgtgggcagtcggttcagcagcctaccaaacggagggaggatggcagcaacatggaaaaggagcgtctatttgggacaccttcacccaccatccgttggcaccgccgggggactccagaaatgcctcactgccactcggggccccgtctcctctgcagccggccacgggggacgtggcctccgactcctacaacaacgtgtttcgcgacactgaagcactccgggagctcggtgtgactcactaccggttttcaatctcatgggcccgggtcctgccaaatggatccgcgggagtgccgaacagggaaggcctcagatactaccgcaggctgctggaaaggcttagggagctgggtgtgcaaccagtggtgaccctctaccactgggatctgcctcagcggctgcaggatgcgtacggcggatgggccaacagggctctggccgaccacttcagagattacgccgaattgtgcttccgacatttcggaggacaggttaagtactggatcaccatcgacaacccgtatgtcgtggcctggcatggatacgctacgggacggctggctccgggaatccgcggaagcccgcgcctgggttaccttgtggcccataacctgctcctcgcgcacgctaaggtgtggcatctgtacaacacgagcttccgcccgacgcaaggaggacaagtgtcgatcgcccttagcagccactggatcaatccgcgccggatgactgaccactcgatcaaggagtgtcagaagtcccttgatttcgtgctggggtggttcgccaagccagtgttcatcgatggcgactacccggaatcgatgaagaataacctgagctccattcttcctgattttacggagtcggagaaaaagttcataaaggggactgctgatttctttgccctgtgcttcggaccaactctttcgttccagctgttggatcctcacatgaaattccgccaactggaatcacccaaccttagacagctgctgtcctggatcgacctggagtttaaccacccccagattttcatcgtggagaacggttggttcgtgtcaggcactactaagagagatgatgccaagtacatgtattatcttaagaagtttatcatggaaaccttgaaggcaatcaaactggacggggtggacgtgatcgggtatactgcatggtcattgatggacgggttcgagtggcacagaggatattcgatccggcgcggcctcttctatgtcgacttcctgtcgcaggacaagatgctcttgccgaaatcgtcggccctcttctaccaaaagctgatcgaaaagaatgggtttcccccactcccggagaatcagcctctggaaggcaccttcccgtgcgacttcgcttggggagtggtggacaattacattcaggtgtctcagctgaccaaaccaatctcatcgctgactaaaccataccac

SEQ ID NO: 15289 - DNA, 1647 bp, Artificial Sequence; identical to SEQ ID NO: 15288
  Description of Artificial Sequence: Synthetic coding sequence

SEQ ID NO: 15290 - DNA, 1647 bp, Artificial Sequence
  Description of Artificial Sequence: Synthetic coding sequence
atgccagcttcggctccgcctcgacgcccaagacccccgccgccctcgctctcgttgcttctggtcctcctcgggctcgggggacgcaggcttcgcgctgaaccaggagatggggcacagacgtgggcccggttctcgaggccacctgcccccgaagcagctggcctgttccaaggaacgttcccggatggttttctctgggcggtgggaagtgctgcgtaccaaaccgagggaggatggcaacaacatggtaaaggggcgtcgatctgggatactttcacccaccatccgttggcgccgcccggagacagccggaacgccagccttccacttggagccccaagcccactccagccggcaaccggagatgtggcgtccgactcatacaataacgtgttcagagacactgaagccttgcgggaactcggagtgacccactacaggttttccatctcgtgggcccgggtgttgcccaatgggtcagccggcgtgccgaaccgcgaaggactgcgctactaccgcaggctgctggagcgcctgcgcgaactgggggtgcagccagtggtaactctgtaccattgggatcttccgcaacgactgcaagacgcgtacggtggatgggcgaacagagcactggctgaccattttcgggattacgcagagctgtgtttccgccacttcggaggccaggtgaaatactggatcaccatcgataatccgtacgtcgtggcctggcacggttacgctaccggccgtctggcaccaggaatccgcggaagcccgagactgggctacttggtagcacacaatctgttgctcgctcatgcgaaggtctggcacctgtacaacacttccttccgtcctacgcagggcggccaagtctcgatcgctctgtcgagccattggatcaacccacgcagaatgaccgatcacagcatcaaagagtgtcaaaagtcactggacttcgtgctgggctggttcgccaagcccgtgttcattgacggtgactaccccgaatctatgaagaacaatctgtcatcgattctgccagacttcactgagagcgaaaagaagtttatcaagggaaccgctgatttcttcgccctctgcttcggacccaccctttccttccagctcctcgacccacacatgaagttccggcaactcgagagcccgaacctcaggcagcttctgtcatggatcgacttggagtttaaccatcctcagattttcatcgtggagaacggatggttcgtttccggaactaccaaacgagatgacgccaagtatatgtactaccttaagaaattcattatggaaacccttaaggcaataaagctcgacggtgtcgacgtgatcggttacactgcatggtctttgatggatggattcgaatggcaccgggggtactctatccgcagaggattgttctatgtggactttctgtcccaagacaaaatgctgctgccaaaatcctccgcactcttttaccagaagctgatcgaaaagaatggattccctccgcttcccgagaaccagcctctggaagggacttttccgtgtgacttcgcgtggggagtggtggacaattacattcaggtgtcccagctgaccaagcccattagctcactgaccaagccgtaccac

SEQ ID NO: 15291 - DNA, 1647 bp, Artificial Sequence; identical to SEQ ID NO: 15290
  Description of Artificial Sequence: Synthetic coding sequence

SEQ ID NO: 15292 - DNA, 1647 bp, Artificial Sequence
  Description of Artificial Sequence: Synthetic coding sequence
atgcccgcttcggcacctccgcgcagacctcggcctccccctccttccctttccctgcttcttgtgttgctcggacttggcggccgcagactgcgggccgaacctggcgatggcgcgcaaacctgggccagatttagccgcccaccagcaccagaggcagccggactgtttcagggtacttttccagacggattcctttgggctgtgggttcggcagcttatcaaaccgaaggtggatggcagcaacatggtaaaggggcatccatttgggacaccttcactcatcaccccctcgcacctcccggggattcgcggaacgcctcacttccactgggagcacccagccctctgcagcccgcgactggagatgtggcctctgattcgtacaacaacgtgtttagagataccgaggcattgcgagaactgggcgttactcattacagattctcgatcagctgggctcgcgtccttcctaacgggtctgcaggtgtccctaatcgggagggtcttaggtattacagaagattgctggagaggctgcgggaattgggagtgcaacctgttgtcactctctatcattgggacctcccacagagactccaagatgcctacggtggttgggccaaccgggcactggcagatcatttccgtgattatgcagaactttgttttaggcactttggaggccaggtgaagtattggattaccattgataacccctacgtggtggcctggcatgggtacgcgaccggaagattggcgcctggcataaggggatcgcctcgactgggctatttggtggcacataacttgcttctggcccatgcaaaggtctggcacctgtacaacacttcgtttaggccaactcagggtggccaagtgtcaattgcactgagctcccactggattaatccgaggcggatgacggaccattccatcaaggaatgccaaaagagcctcgatttcgtgctgggctggttcgcgaagcctgtgtttattgatggggactaccctgagtctatgaagaacaacctgtcctcgattcttcccgatttcactgagtccgaaaagaaattcattaaaggaacggcagatttcttcgcactctgtttcgggccaaccctttcctttcaattgcttgatccgcatatgaagtttcggcaacttgagtcacctaatctgcgccaactcctctcgtggatcgatctcgagtttaaccatcctcagatattcatagtggagaacggttggtttgtgagtggaaccacgaagcgagacgatgctaaatacatgtactacctgaagaagttcatcatggagacgctcaaggcgatcaaacttgatggtgtcgatgtcattggatacaccgcatggtcactgatggatggatttgaatggcatagaggctactccatccgccgcgggctcttctatgtcgacttcctctcccaggacaagatgctcctcccaaagtccagcgcattgttttaccagaaactcatcgaaaagaacggtttcccaccactgcctgaaaaccaaccacttgaaggaacctttccttgtgattttgcatggggagttgtggacaattacattcaagtctcccagctcaccaagccaatctcgtcgttgaccaagccttaccat

SEQ ID NO: 15293 - DNA, 1647 bp, Artificial Sequence; identical to SEQ ID NO: 15292
  Description of Artificial Sequence: Synthetic coding sequence

SEQ ID NO: 15294 - DNA, 1647 bp, Artificial Sequence
  Description of Artificial Sequence: Synthetic coding sequence
atgcccgcttctgcgcccccgcgtcgccccaggccgcctccgccctccctgagcctgctgctcgtcctgctgggcttggggggccgccgcctgagggccgagccgggagacggagcccaaacgtgggccaggttttctcgaccgcccgcccctgaagcggcggggctttttcagggaactttcccagatggtttcctgtgggctgtgggttctgccgcataccagacagaaggggggtggcagcagcacggcaagggcgcttctatttgggatacattcactcaccatccactcgctcccccaggagatagccggaacgccagcctgcctctgggtgcgccgagccctctgcagccagctaccggcgatgtggcctctgacagctacaacaatgtcttccgcgatacagaggcattaagagagctgggcgtgactcattataggttttcgatctcctgggcccgcgtcctgcccaacgggagcgcgggggtccccaacagagagggtctcagatattaccgccggctgctcgagagattgagagagttaggagtgcagccggtagtcacactgtaccactgggacctgcctcagaggctacaggacgcttatggaggctgggccaaccgcgcgcttgctgatcattttcgcgattatgccgaattatgtttccggcacttcggaggccaggttaaatactggataacaatcgataacccttacgtggttgcctggcacggctacgctacgggtaggcttgctccggggatcagagggagcccgcgcttgggatatctggtggcacataatctactgttagcccatgccaaggtttggcatctgtacaacacgagtttcagacctacacaggggggtcaggtgtctattgccttatcctcccattggattaatcccaggcgaatgaccgatcacagtattaaggagtgccaaaagtccctcgactttgtgctcggttggttcgcaaagcctgtctttatcgatggagactatcccgagtccatgaaaaataacctgtcatcgatcctgcccgacttcacagagtccgagaagaaattcatcaagggcaccgcggacttctttgcactctgtttcgggccaaccctgagtttccaactactggatcctcatatgaagttccggcagctggagtcaccaaacctgagacagctgctgtcatggattgacttggaattcaaccatccccagattttcattgtggaaaatggctggttcgtttcagggaccacgaagagggatgatgctaagtatatgtactacctaaagaaattcatcatggagacgctgaaggcgatcaaactggacggcgtcgacgtgatcgggtacaccgcatggagccttatggatgggtttgagtggcatcggggctattccatccggcgaggcctattctacgtggattttctctctcaggacaagatgcttttgccaaagtccagtgcattgttctaccagaaactgatcgagaagaatggattccctccattacctgaaaaccagccactggagggcacctttccatgtgacttcgcttggggcgtcgttgataactacatccaggttagccagctgacaaagcctatatcctctctaacaaaaccgtaccac

SEQ ID NO: 15295 - DNA, 1647 bp, Artificial Sequence; identical to SEQ ID NO: 15294
  Description of Artificial Sequence: Synthetic coding sequence

SEQ ID NO: 15296 - DNA, 3036 bp, Artificial Sequence
  Description of Artificial Sequence: Synthetic coding sequence
atgccagcctccgccccgcctagacgcccacgaccgccaccgcctagcctgagtctgctcctggtcctgctgggactggggggtagacgcttgcgtgccgagccaggcgacggagcccagacatgggctagattctccaggccaccggcaccagaggccgcggggctctttcagggcacattcccagacggcttcctgtgggctgtcggctccgctgcctatcagaccgaaggcggctggcaacagcatggtaagggggcctccatttgggacacgttcacacaccacccactcgctcctccaggtgattcgcggaatgcctccctaccacttggcgcaccaagcccgttgcagccagccacaggcgacgttgcttccgatagttacaataacgttttccgagataccgaggccctgagggagctgggggttactcactacagattctcaatcagctgggcgagggttctaccaaacggcagcgcaggcgtgcctaatagggagggattgaggtattatagacggttgcttgagcggctgagagaactgggcgtccagcctgttgttacactgtatcactgggacctgccccagaggttgcaggatgcttacggggggtgggctaacagagctttagctgaccacttccgcgattacgcagagctgtgcttccggcacttcgggggtcaggtcaagtattggataactattgacaacccatacgtcgtcgcttggcacgggtacgcaaccggacgacttgctcccggtatccgcggctctccgcgtctcggctacttggtggctcacaatctcctcctcgctcacgcaaaggtatggcacctctacaacacctcttttagacccacacagggcgggcaggtgtccattgctttgtcctcccattggatcaaccctcgcaggatgaccgaccacagtatcaaggagtgtcagaagtcattggattttgttttgggctggtttgccaagcccgtgttcatagatggtgattatccagaatctatgaagaataacttgagctccatactgcccgattttacagaatcagaaaagaaatttatcaaagggacagccgatttcttcgccctgtgtttcgggccaaccttgagttttcaactactggatccccacatgaaattcagacagctggagtcccccaatctgcgccaacttctctcttggattgacctcgaatttaatcaccctcagatttttatcgtcgagaatggatggtttgtgtctggcaccactaagcgcgatgatgccaagtacatgtactatctgaaaaagttcattatggagactctgaaagctatcaagctggatggggtagacgtgatcgggtatacagcctggtccctcatggacggcttcgagtggcataggggctactccatccggcgaggcctcttctacgtggattttttgagtcaggataagatgctcctgccaaagtcctcagcactgttctaccagaaactgatcgagaaaaatggtttcccacctctgcccgaaaaccagccactggaagggacattcccttgtgactttgcgtggggagtagtggataattacatccaggtggacacaactctgagccagtttacggatttaaacgtgtatctctgggacgtccatcacagcaaacgcctgatcaaagtggacggagttgttaccaagaaaagaaaatcctactgcgtcgattttgcggccattcagccccagattgctttgttgcaggagatgcatgttacccacttcaggtttagcctggattgggcccttatcttgcccctgggtaatcaaagccaggtgaaccacactatcctgcaatattacagatgtatggcttcagaactcgtaagggtcaatatcacccctgtagtagcactgtggcagccaatggcccccaatcagggtctccctagacttcttgcacgacagggggcatgggaaaacccttatactgcactggccttcgcagagtatgcccgactgtgtttccaagagctcggccaccacgtcaagctgtggattactatgaacgagccatacaccaggaatatgacctacagcgctggccacaaccttctgaaggcccacgcgctggcgtggcacgtgtacaatgaaaagttcaggcatgcgcagaatggcaagatcagcattgctttacaggccgactggatagagccagcttgtcctttttctcagaaagataaagaagtggcagagagagtgctcgagttcgatattgggtggcttgccgagccgattttcggttccggcgactatccatgggttatgcgcgattggctgaatcagcggaataatttcctgcttccctatttcactgaagacgaaaaaaaactaattcagggaacgttcgattttttagcgctgagccattacacaacgatactggtggacagcgaaaaagaggaccccataaagtacaatgattatctcgaggtgcaggagatgacagatatcacttggctgaactcacctagccaggttgctgtcgtcccctggggattgcgtaaagttctaaactggctgaagttcaagtacggagacctccctatgtatattatttcaaatggcattgacgatggcctacacgcggaggacgatcagttgcgcgtttactacatgcagaattatattaatgaggcgctgaaggcacatattctcgacggcattaatctctgtggttattttgcctacagcttcaacgataggaccgctccacgatttggactctataggtacgccgccgatcagtttgaacccaaagcttcaatgaaacactatcgtaagatcatcgattccaatggcttcccagggccggagaccctcgaacgcttctgccccgaggagttcactgtatgtactgaatgttcttttttccacactcggaagagtctgctagcattcattgccttcctctttttcgctagcatcatctccctatccctcatcttctactattccaagaaaggcaggaggtcctataag

SEQ ID NO: 15297 - DNA, 3036 bp, Artificial Sequence
  Description of Artificial Sequence: Synthetic coding sequence
atgccagcttctgcacctccacgaagaccacgacccccaccaccgtccctgtccctcctcctggttttgctcggactgggtgggcgacggctgagggctgaaccaggcgatggcgcgcagacatgggcaaggttttctcgtccaccagcaccagaagccgcaggcctttttcagggtacgttccctgacggctttctgtgggccgttgggtcagctgcatatcagacagagggaggctggcagcaacatgggaaaggggcctccatctgggacacattcacacaccatcccttggctcctcctggtgattcccgcaacgcatccctgccgttgggagccccttctcctttgcagcctgctacaggggacgtcgcaagtgactcttataataacgtgttccgagatacagaagccttgagggagctgggggtgacgcattaccgatttagcataagctgggctcgagtactgccaaatgggagcgcaggagttcctaaccgagaaggtctgagatactacaggcgactgctcgaaagactgagagagcttggagtccagcctgtcgtcaccctgtatcattgggatttaccccagagactgcaggacgcatacggagggtgggcgaatagagcattggctgaccatttcagagactatgcagaactctgtttccgtcacttcgggggccaggtgaagtactggatcaccattgacaatccttacgtggtggcttggcatggatacgccaccggacgcttagccccagggattcgaggtagcccccgattgggctacctagtagcccataacctgctgcttgctcatgcgaaggtgtggcatctgtataacacctcattcaggcctactcagggcggacaggtgtccatagctttgtcctcacactggataaaccccagacgaatgacggatcactccatcaaggagtgtcaaaaaagtctggattttgtcctgggatggttcgcaaagcctgtttttattgatggcgactatcctgagtctatgaaaaacaacctttcttctattctacccgacttcaccgaaagcgagaaaaagtttatcaagggcaccgcagatttcttcgcgctttgttttggtcccacactttcatttcaattacttgatccacacatgaagttccgccagttggagagccccaacttgaggcagctgctgagttggatagaccttgagttcaatcacccacagatattcattgtggagaacggatggttcgtgtccggcacaacaaaaagagacgatgccaaatatatgtattatttgaaaaagttcatcatggaaactttgaaggcgattaaactagacggggtcgatgtcattggctacactgcatggtccctcatggacggctttgagtggcatcgaggatactctatccgtcgagggctattttacgtggacttcctctcgcaggacaaaatgctgcttccgaaatcctcagccctgttctatcaaaaactcatcgaaaaaaacggcttccccccactgcctgaaaatcaacccttggagggaactttcccctgcgattttgcttggggggttgtggataactacatccaagtggacaccacactgtcacagtttacagacctgaacgtatatctctgggacgtgcaccacagcaagaggctcataaaggttgatggagtagtgaccaagaagcgtaaaagctattgcgtggatttcgcagcgatacagccgcagattgccctgctgcaggaaatgcatgtcactcacttcagattcagccttgactgggctctgatcctgcctctggggaatcagagccaggtcaatcacacaatactgcagtattaccgatgcatggcttctgaactggtcagggttaatataacacccgtggttgccctttggcagcctatggcacccaaccaggggctgccgcgactattagcgagacagggcgcctgggagaacccatacaccgcactcgcttttgccgagtatgctcgcttatgctttcaagaattgggacatcatgtgaaattatggataactatgaacgagccttacacaaggaatatgacatatagcgccgggcacaacctcttaaaggcgcatgccctcgcctggcacgtctacaatgaaaaattccgacacgcgcagaacggtaagatctcgatcgcacttcaggcagactggattgaaccagcatgccctttcagccaaaaggataaggaagtggcagagagggttttggaatttgacatcggctggcttgctgaacctatctttggttccggggactatccatgggtgatgcgggactggcttaatcagagaaataactttctccttccctatttcaccgaggacgagaagaaactcattcaaggaactttcgactttctagcactgtcgcattatacaacgatcctagtggattctgaaaaggaagacccaatcaaatacaacgattacctggaggtgcaggaaatgacagacatcacgtggctcaacagcccaagccaggtggctgtcgtaccatggggtctgagaaaggtgctcaactggctcaagtttaaatacggagacctgcctatgtacatcattagcaatgggatcgacgacggattacacgcggaagatgaccagctgcgagtgtactatatgcagaactatatcaatgaagccctcaaagcacatattcttgacggaataaatctttgtggttactttgcttattcctttaatgatcggacagccccacgatttggtctgtacaggtatgccgcagaccagtttgagccaaaggccagcatgaagcactatcgcaagatcattgatagcaatgggtttcccggaccggagacacttgaacgattttgtccggaagaattcaccgtgtgtaccgaatgctccttttttcacaccaggaaatctctcttggcttttatcgcatttctcttctttgcgtctattatcagcctgtccctgatattctattactccaagaagggcagaagatcttataag

SEQ ID NO: 15298 - DNA, 3036 bp, Artificial Sequence
  Description of Artificial Sequence: Synthetic coding sequence
atgccagcctccgcaccccctcgacgtccgcggccaccccctccatccctgagcttactgttggtgttactgggattgggtggtcggcggctccgcgcagaacctggagacggtgcgcaaacatgggctcggttcagccgcccaccggcccccgaagcggcggggttatttcagggaaccttcccagatggattcctctgggctgtcggcagcgccgcttaccagactgagggcgggtggcagcagcacggaaagggagcatccatatgggacacttttacccaccatcctttagctcctccaggtgacagccgcaacgcatcactcccccttggtgccccaagtccactacaacccgctaccggagatgtggcttcagactcttacaacaatgtttttcgggacacggaggccctacgggagctgggtgtgacacactataggttttctatatcatgggcccgagtcctgccaaacggctctgccggtgtgccaaacagagaaggactgcgatattaccgacgtttgctggagcgtctgcgcgaattaggcgtgcagcccgtggttactctttaccactgggacctgccgcaacggctgcaagacgcttatggcggctgggccaacagagctttggctgaccactttcgggattacgcggagttgtgtttccggcacttcggaggacaagtgaagtactggattaccattgataatccctatgtggttgcttggcatgggtacgccaccgggcggcttgcaccaggaatccgaggctcccctcgcctgggatatttggtcgcccacaacctgctgttggctcacgcaaaggtctggcacctgtataacacttcatttcggccaacccagggtggccaggtgtctatcgccctcagctcacactggatcaacccccgaaggatgaccgaccactctattaaagagtgccagaaaagccttgatttcgtgctgggttggttcgccaagcctgtctttatcgatggtgattacccagagtctatgaagaataacctctcgagcattctgcctgacttcaccgagtctgaaaaaaaatttattaaaggcactgctgacttttttgctctctgctttggtcccacgctgagtttccagctccttgatccgcacatgaagttccgccagctcgagtcccccaatttgcgacagttgctgtcttggatcgacctagaatttaaccatcctcagatctttatcgtggaaaacggttggttcgtttctggcacaacaaagcgggatgacgccaagtacatgtactatctgaagaaatttataatggaaaccctgaaagccatcaaactggacggtgttgacgtcatcgggtatacagcctggtccttgatggatggctttgagtggcatcggggctactcgattaggcgaggcctgttctacgtcgactttctttctcaggataagatgctgctgccaaaatcctctgccctgttctatcagaaactaatagagaagaatgggttcccgccactccctgagaaccaaccactggagggaacattcccttgtgatttcgcttggggagtagtggacaactatattcaggtggacacgacattgtctcagtttactgacttgaatgtgtatctgtgggatgtgcaccactctaagaggctgataaaggttgatggtgtggtcactaaaaaacgcaagagctattgcgtggatttcgctgctatccagcctcagatcgcacttctgcaagaaatgcacgtcacccacttcaggttctcacttgactgggcccttattctgcccctcggaaatcagagccaggtgaaccacactatcctgcagtattaccggtgtatggctagtgagctcgtgcgggtgaacatcacccccgtcgttgcattgtggcagcctatggcacctaatcagggcctccctagactgctggccaggcaaggagcctgggagaatccctacactgccctggccttcgctgagtatgcccgtttgtgctttcaggagctaggccaccatgtaaaactttggataaccatgaatgaaccatatacgcgcaatatgacttactcagcgggacacaatttgctaaaagcacacgcgttggcatggcacgtatataatgagaaatttaggcatgcacagaatgggaagatttctatcgccttgcaggcggactggatagagccggcttgtcctttttctcagaaggacaaggaagtggccgaaagggtgctagaattcgacataggatggttggctgagccaatctttggttctggtgactacccatgggtgatgcgggactggctgaatcagaggaacaactttctcctcccctattttaccgaagatgagaaaaaacttatccagggcactttcgactttttggccttgtcccactatacgaccattctggttgattccgaaaaggaggatcccatcaagtacaatgactatctggaggtccaggagatgacagacataacctggctgaattcgcccagccaggtagccgtcgtaccttgggggttacggaaagtgctcaactggcttaaatttaagtacggagatctgcctatgtacattatctctaatggcatagacgacggactgcatgccgaggacgaccagctgagagtgtattacatgcaaaactatattaacgaagccttgaaggcccatatactggacggaatcaacctgtgcgggtacttcgcatactcgtttaatgatcgaacagcaccgagattcgggttgtataggtatgccgccgaccagtttgagccgaaagcgtccatgaagcactaccggaaaattattgactctaatggatttccaggacctgagacactcgagcgattttgtcccgaggaatttacagtctgtaccgagtgtagcttctttcatacccggaagtcactgctcgcgttcatcgcgtttctcttcttcgcatccatcattagcctgagcctgatcttttactatagcaagaagggcaggcggtcctacaag

SEQ ID NO: 15299 - DNA, 3036 bp, Artificial Sequence
  Description of Artificial Sequence: Synthetic coding sequence
atgcccgcgagcgcccccccgcgacgaccccggcctcccccccccagcttgagtcttctgctcgttctgttgggacttgggggtcgccgcttgcgggcagagcccggagatggtgcccagacctgggccaggttttcccggcccccagctcctgaagccgccggactctttcaggggacatttcccgacggctttctatgggctgtgggatcagccgcttaccagacggaaggtgggtggcagcagcacggaaaaggtgcgtcgatttgggataccttcacacaccatccgctggccccacccggagacagcaggaatgctagcctgcctctcggggctccctccccactgcagccagccacgggagacgtggcatctgactcatacaataacgtatttcgcgacaccgaggccttgcgcgagttgggcgttactcactacaggttcagcatcagttgggctcgggtgctgcctaacggcagcgcaggagttccaaaccgggagggcctgaggtactaccgcaggctgcttgaacgactgcgggagctaggcgtacagccagtggtgaccctgtaccattgggacctccctcagcgactccaggacgcgtacggagggtgggccaaccgggccctggcagaccatttcagagactacgctgaactctgctttcggcactttggagggcaggtcaagtactggataaccatcgataacccctacgtggtggcctggcacgggtatgccaccgggcggctggcacccgggataagagggagtcctcggctgggatacctggtggcccacaacctgttgctagcgcatgctaaggtgtggcatctatacaataccagcttccggcccacacagggtggccaggtaagcattgcactgtcgtcacattggattaacccaagaagaatgaccgaccactccattaaagagtgtcagaagtctttggacttcgtccttgggtggtttgcaaagccggtgttcatcgacggcgactatcctgaatcaatgaaaaataatctgtcaagcatccttcctgatttcaccgaatccgagaagaagttcattaaaggaactgccgacttcttcgcactctgtttcggacccactctttcctttcagctgttagacccccacatgaaattcaggcaactcgagagtccaaatctcagacagttactgtcctggatcgatttggagtttaatcatcctcagatttttatagtagagaacggatggttcgtgtcaggtaccacaaagcgtgatgatgccaaatacatgtattacctgaaaaagttcattatggagacactgaaagctataaaactagacggagtggatgtgatagggtacaccgcgtggtccctcatggacgggttcgagtggcatagaggctactctatccggaggggccttttctacgtggattttttgagtcaggacaagatgttattgcctaaatcttctgcactgttctaccagaaactgattgagaagaacggctttccacctctgccagagaaccagccattggagggaacatttccttgtgacttcgcctggggagtcgtggataattacatacaggtcgataccaccctctctcagttcaccgacctgaatgtgtacctgtgggatgtgcatcacagcaagcgcctaataaaggtggacggggttgtgacaaagaagaggaagagttactgcgtagactttgccgcaattcagccgcaaatcgcgctccttcaggagatgcacgttacacattttcgcttttcactggattgggctctgatcctacctctggggaaccaaagccaggttaaccatactatattacaatattatagatgcatggccagcgaactggttagggtcaacataacaccagtcgtcgcactgtggcagcctatggcgcccaatcagggactgccccggttactggctaggcagggggcatgggagaacccttataccgcccttgcctttgctgagtatgcaagactctgtttccaggaactcggccatcatgtgaagctgtggataacaatgaatgagccctatactcggaacatgacctactccgcaggacacaacctgctcaaggcgcatgctctcgcttggcacgtgtacaacgagaagtttcgacacgcgcaaaacggaaaaatatccattgcacttcaagctgactggatagagcctgcctgcccattttcccagaaagacaaggaggtggcggagcgggtgctcgagtttgatatcggatggctcgcggagcccatcttcgggtccggtgactacccttgggtcatgcgcgattggctgaaccagaggaacaattttctgctgccgtattttaccgaagacgaaaagaaacttatccaaggcacctttgactttctggcattatcacattatacgaccattcttgtcgattccgagaaagaagatcctataaagtacaatgactaccttgaggttcaggaaatgacagatattacctggctgaactcgccaagccaagtggctgtggtgccatggggcttgcgtaaagttctaaattggctgaagtttaagtacggtgatctaccgatgtatataatcagcaacggaatcgacgacgggctgcacgcagaggacgaccagttacgggtttattatatgcagaactacatcaacgaggccctaaaagcacacattttggacggcattaacctgtgtggctacttcgcttattcttttaacgaccgtaccgctcctagatttgggctgtatagatacgccgctgaccagttcgagcctaaggcctcaatgaagcactaccgtaagatcatagactccaatggttttccaggaccagaaacattggagagattttgtcctgaggaattcacagtttgtaccgaatgctccttctttcatacgagaaagagcctacttgcttttattgcattcctgtttttcgccagtattatttcgctgtctcttattttctattatagcaagaaaggaaggagatcatacaag

SEQ ID NO: 15300 - DNA, 3036 bp, Artificial Sequence
  Description of Artificial Sequence: Synthetic coding sequence
atgcctgccagtgccccgccaaggaggccccgcccaccaccgccttccctgtcactcctgcttgtgctcctgggtctcggtggcaggcggcttcgcgccgagccaggggacggtgcacaaacatgggctagattctcacgtccccccgctcccgaagcggcgggtctctttcaaggcaccttccctgacgggttcctgtgggcggtgggatctgccgcttatcaaaccgagggagggtggcagcagcacggtaagggcgcaagcatctgggacaccttcacccatcatcccttggctccgccaggggactctcggaatgcatctttacctctgggagccccaagcccccttcaacctgccacgggggatgtggcatcagatagctacaataacgtcttcagggatacagaagcactgcgggagcttggggtcactcactacaggttttctatttcctgggcccgagtgctgcctaacggttccgctggcgtgcctaatcgagagggactgcggtactaccgacggttgttggagaggttgagggagctcggagtccagcctgtggttacgctttaccactgggatctaccgcagaggctgcaggacgcctatggtggatgggcaaaccgagccctggcagatcatttccgggattatgcggaattgtgttttcgccatttcggaggccaggtaaagtactggataactatcgacaatccatacgtagtggcatggcatggatatgcgacagggaggctcgcgccgggcataaggggctcaccccgcttgggttatctcgtggcgcataacctgctcctggctcacgccaaggtgtggcacctgtataacactagcttccgacccactcagggggggcaggtgtccattgctctcagtagccattggatcaatcctcggaggatgactgatcattctattaaagaatgccagaagtccctggattttgtgctggggtggttcgccaagcccgtgttcattgatggagattaccccgaatcgatgaagaacaatctgtccagcatcttaccggactttactgaatccgaaaagaaattcatcaaggggactgctgactttttcgctctgtgtttcggccccactctatcatttcagctgctcgacccccacatgaaattccggcaactagaatctccgaacctgcgtcagctcctcagctggatcgacttggagttcaatcacccccagattttcatcgtggagaacgggtggttcgtgagtggtacaacaaagcgcgatgatgccaagtatatgtactatctgaagaaattcatcatggaaactctgaaagctataaaactggacggagtggatgttatcgggtacacggcatggtcacttatggacggctttgagtggcatagaggttactctatccgacggggtttgttctacgtggatttcttgagccaggacaagatgctccttcctaaatcctcagccttgttttaccagaaactgatagagaagaacggatttcctcccctgccggaaaatcagcctctggaggggacattcccctgtgacttcgcttggggagtagtcgacaactacatacaggtggacacaaccctaagccagtttaccgatcttaacgtctatctgtgggacgttcatcattccaaacggctgatcaaggtggatggcgtggtgactaagaaaagaaaaagttactgtgtggatttcgcagccatccaacctcagatcgccctgctgcaggagatgcatgttacccattttcggttttcgttggactgggctttaattctgccccttggaaatcaaagccaggtgaaccacaccattctgcagtattacagatgcatggccagtgagttagtgcgcgtgaacatcactcctgtggtggcgctgtggcagccgatggctccaaaccagggtcttcccagactactggccagacagggagcatgggaaaatccgtacactgcactcgctttcgctgagtacgcccgtctatgttttcaggagctggggcaccatgtgaaactgtggattacaatgaatgaaccatatacccgcaatatgacgtacagcgctggtcacaacctcctgaaggcacacgctctggcctggcacgtgtacaacgagaaattcagacatgctcaaaacgggaagatctcaattgcgcttcaggccgactggatcgagccagcctgtccctttagccaaaaggacaaagaggtagccgaacgtgttttagaatttgacattggatggctagccgagccaatctttggatctggggattacccttgggttatgagggattggctcaatcaacggaataatttcctgctgccatacttcaccgaagacgaaaagaaattgattcaagggaccttcgacttccttgccctatcccactacaccaccatcttggtcgactcagaaaaggaggatcccatcaaatacaatgactacctcgaagttcaggagatgactgatattacgtggcttaattctccatcccaggttgcagtcgtcccatgggggttgaggaaagtgttgaactggttgaagtttaaatacggcgacctgccaatgtacataatctccaatggcatagacgatggtttacacgccgaggatgaccagttacgggtctactatatgcaaaattacattaatgaggcactgaaggcccatatcttagatggcattaacctgtgcggttactttgcttatagctttaacgaccggactgcacccaggtttggtctgtatcggtacgcagccgatcagttcgagcccaaagcctcaatgaagcactaccgaaaaatcatcgattcaaatggatttcccggacccgaaaccctggagcgattctgtccggaagaattcacggtgtgcaccgagtgcagctttttccacacccgtaaatctttactggcatttattgcatttctgtttttcgcatctattatatcactttccctaattttttactactctaagaaaggtcggcgatcatacaaa

SEQ ID NO: 15301 - DNA, 3036 bp, Artificial Sequence
  Description of Artificial Sequence: Synthetic coding sequence
atgccagcatcagcaccacccaggcggccaagacctccaccgccttcattgagtcttctcctcgtgctgctgggcttgggcggcagacgactccgcgcagaacctggtgatggcgcccagacatgggccaggttttcgaggccacccgctcctgaagctgccggtctgttccagggaacattccctgacggttttttgtgggccgtaggaagcgccgcttatcagacagagggcgggtggcagcagcacggtaagggagcctcaatatgggataccttcacccaccaccccctggcccccccgggtgacagccggaacgcatcactgccgctgggggctcctagccccttgcaacctgctacaggggatgttgcaagcgatagctacaacaacgtgttcagagacacagaggcccttcgtgaacttggcgtcactcattaccgtttctcaatctcgtgggcaagagtactgccaaacggaagtgctggagtccctaatagggaagggctccggtactaccgtcgactcctggaacgtttgagggaactgggggtgcaaccagtcgtcaccctgtaccattgggacctccctcagcgcctgcaggacgcctacgggggttgggccaacagggcgttggctgaccacttcagggactacgccgaactctgcttcagacacttcgggggacaggtcaaatactggattacaatagacaacccttacgttgtggcctggcacggatatgccacagggagactggccccaggcatcagggggtctccacgtctcggatacttagttgcgcataacctcttgctggctcacgcaaaagtgtggcacttgtataacaccagcttccggcccacccagggcggacaggtatccatcgctctctctagccattggattaacccccggagaatgactgatcactcaattaaggagtgtcagaaatctcttgatttcgtgctgggctggtttgctaagcctgtcttcattgatggggattaccccgagagcatgaaaaataatttgtcctcaatcctaccggatttcacagaatcagagaaaaaatttattaaaggaactgcggatttctttgccttgtgttttggcccgacactctcatttcaactgctggaccctcacatgaaattccgacaactagaatctcctaacctgagacagctcctgagttggatcgatctagagttcaatcacccacagatttttatcgtggagaacggctggtttgtgtctggtactaccaagagggatgatgccaaatacatgtattacctgaagaaattcataatggaaactcttaaggccattaagctcgacggcgttgatgtgatcggctacaccgcgtggtccctgatggatggtttcgaatggcaccgcggatactccattcggcgaggtcttttctatgtagacttcctgtctcaggacaaaatgctcctaccaaaaagctcagcattgttctatcagaagcttattgaaaaaaatgggttccccccgctgcctgagaaccagcctttggaaggaacctttccctgcgacttcgcatggggcgtagtagacaattatattcaggtcgacaccactcttagccaatttacagatctcaatgtctatctgtgggatgtccatcatagtaagcgtttgatcaaggtcgacggcgtggtcacaaaaaagcggaagagctattgtgtggatttcgcggcgattcagcctcaaatcgccctgcttcaggaaatgcatgtgacacactttagattctctcttgattgggccttgattctgcctctgggaaaccaaagtcaggtcaaccacaccatcctgcagtactaccggtgtatggctagcgagttggtaagggttaacattacacccgtcgtggctctgtggcagccaatggcacccaaccagggtttaccaagacttctagcacgtcagggcgcttgggagaacccatatactgcgttggctttcgctgagtatgcccgcctgtgcttccaggagttagggcaccacgttaagctgtggatcactatgaacgaaccttacactaggaacatgacctattctgctggccacaatctgttgaaggcccacgccttagcatggcacgtctacaatgaaaaatttcggcacgcacagaatggtaagatctccatagcgctgcaggccgactggatcgagccggcctgtcctttctctcagaaagataaggaggtggcagagcgagtcctagagttcgacattggatggctcgcggaaccaatctttggatcaggggactatccttgggtgatgagggattggctgaatcaacggaacaacttcctgttgccgtacttcactgaggatgaaaagaaactgattcagggcacgttcgacttcctcgctctcagccattacaccactattctggttgactcggagaaagaggaccccatcaaatacaacgactaccttgaagtccaagagatgacagatataacctggttaaactccccctcccaagtagctgtggttccatggggtctgcggaaggtcctcaattggctgaagtttaaatatggtgaccttcccatgtacatcatctctaacggaatcgatgacgggctgcatgcagaggatgatcaattaagggtatattatatgcagaactacattaacgaggcactcaaggcgcacatactcgacgggataaatttgtgtggctattttgcatacagcttcaatgacagaacggcaccgcgatttggtctttaccggtacgcagcggaccagttcgaaccaaaggcgtccatgaaacactataggaagatcatcgactctaacggctttccaggtcctgaaacactggaaagattctgtcctgaagagttcactgtctgcacagagtgttcattcttccatacacggaagtccctccttgcttttatcgcattcttgttcttcgccagtattatttccctctctttaattttctattacagcaagaagggccgccgcagctacaag

SEQ ID NO: 15302 - DNA, 3036 bp, Artificial Sequence
  Description of Artificial Sequence: Synthetic coding sequence
atgcctgccagcgccccgccgagaagacctcgcccaccgccgccctccctaagccttttacttgtgttgttggggctcgggggccggagactgagagctgaaccgggtgatggggcacagacttgggcacgattctcaaggccgccagcgccggaagcagccgggttgttccagggcacttttccggatggcttcttatgggctgtcggatcagccgcataccaaacagagggcggttggcagcaacatggaaaaggtgcctctatctgggacacatttacgcatcatccattggcgccgccgggggatagcagaaatgcctcccttcctttaggtgctcctagtccgttgcagccggcaacaggggacgtggcgtcagactcttataataacgtgtttagggataccgaagccttgcgagaactgggtgtcactcattatcggttcagcatatcttgggcaagagtgttgcctaacgggagcgctggagttcctaatagagaaggcctaagatactatcgtagacttctcgaaagactgcgtgaactcggagttcagcccgtcgttacactttatcactgggatttaccccagagactgcaagacgcgtacggtgggtgggcgaacagggctcttgcggatcattttagagattatgcagaactgtgttttagacacttcggggggcaggttaagtattggatcaccatcgacaatccttatgtggtagcgtggcatgggtacgcgacgggtcggctagcgcctggaattcgggggagcccgagattgggatacctggtagctcataatttacttttagcgcatgcaaaagtgtggcatctgtataacacttcatttcggcctacgcagggtggacaagtctctatcgccttatcttctcattggattaaccctcgacggatgacagatcactctattaaagaatgtcagaaaagtcttgactttgtattagggtggtttgcgaaaccagttttcatcgacggcgattacccggaatcaatgaaaaataacctgtcttcaatattgccggattttaccgaatcggaaaagaaattcataaagggcacagctgatttctttgcattatgtttcggcccgacattgagctttcagcttctcgaccctcatatgaaatttagacaacttgagtcgcctaatttaagacaattgcttagttggatagatctggaattcaaccatccgcaaatcttcatagtagaaaacggttggtttgtgtcaggtacaactaaaagagatgatgcaaaatatatgtattatctcaaaaagtttatcatggaaaccctgaaagcgatcaaactagacggcgtcgatgttattggatatacggcgtggtctttaatggatggctttgagtggcatcgtggctattcaattcgtagagggctgttttatgttgactttttgtctcaagataaaatgttgcttcctaagtcctctgccttattctaccagaaattaattgaaaagaacgggtttccaccgttaccggagaatcaacctttagaaggcacctttccgtgcgacttcgcatggggagtagtcgataattatatacaggtcgacacaacattgtcgcaatttacggatctgaacgtctacttgtgggacgtccatcattctaaacgccttattaaagtggatggggtagtaacgaaaaaaagaaaatcatattgcgtcgactttgctgccatccagccccagattgctctcctgcaagaaatgcatgtaacgcattttcgctttagcttagactgggcacttatcctgccattaggcaaccagtcacaggtgaaccatacaattttacagtattaccgctgtatggcaagcgaactcgtgcgtgtaaatataactccggtggttgccctgtggcagccgatggcgccgaaccagggattacctagacttttagctagacagggcgcgtgggagaatccctatacagctttagcctttgcggagtacgcgcgtttatgtttccaggagcttggccatcatgtaaaactgtggatcactatgaacgaaccttacactaggaatatgacgtatagcgctggacataatttgttgaaagcgcatgctttagcatggcacgtatataatgagaaatttagacacgcccaaaacggcaagatatctattgcacttcaggcggactggatcgagcctgcttgcccgttttcacagaaggataaagaagtcgccgaacgggtgctggagtttgatatcggatggctggcagagcctatatttgggtccggtgactatccatgggttatgagggattggttaaatcagagaaataattttcttttaccgtattttacggaagacgagaaaaaactcattcagggaacgttcgattttttggctttgtcacattatacaacaattttagtggatagcgaaaaagaagacccaattaaatacaacgattacttagaggtgcaggaaatgacagatataacttggttgaatagcccttcacaagtagctgtggtgccgtggggtctgagaaaagtcctgaattggctcaagttcaagtatggagaccttccgatgtacataatatctaatgggattgatgatggcctgcacgccgaggatgaccaacttcgggtttactacatgcagaattatataaacgaggccttaaaggcgcatatactggatgggatcaatctgtgtggctacttcgcatattctttcaacgatcggaccgcgcctagattcggactgtaccgctatgcggcggatcaatttgaacctaaggcaagcatgaaacattacagaaaaattatagattcaaacggttttcccggccctgagacgttggaaaggttttgcccggaggaatttacagtttgcactgagtgctcattctttcatacgcgtaagtccttactcgcatttattgcttttttgtttttcgcctcaatcatatccctatcgttaatcttttactactccaagaaaggtaggcgtagctataag

SEQ ID NO: 15303 - DNA, 3036 bp, Artificial Sequence
  Description of Artificial Sequence: Synthetic coding sequence
atgcctgcatctgctccacccagaagaccacgtccaccacctccgtctctcagtctgcttcttgtcttgcttggtctagggggtcggagactccgtgcggagccgggagatggcgctcaaacctgggcacgattctcgcgtcccccagcaccagaagccgcgggattgttccaaggaacctttcctgatgggtttttgtgggccgttggttccgcagcttaccaaacagagggaggttggcagcaacatggaaaaggagcttccatctgggacactttcactcatcacccgcttgctcctcccggagattcccgtaatgcaagtcttccactcggcgcaccgtcaccattacagccagctaccggggatgttgcctcagatagctataacaatgtttttagagacacggaggctcttcgtgaactgggtgttacgcattatagattcagtatatcatgggctagagtgctccctaacggatccgctggcgtacctaacagggagggtctcagatactaccgtagattgctcgaaaggctcagagaactgggggttcagcctgttgttactctttatcattgggatctgcctcagcgtttgcaagacgcttacggtggatgggctaacagggcgctcgctgatcactttagggattatgccgaattgtgctttcgtcactttggtgggcaagtcaaatactggattacgatagataacccatatgtagtcgcctggcatggctatgctaccggtcggttggcaccaggaattcgagggtccccaagactcggatacttagttgcccacaacttattactagctcacgcaaaggtttggcatctttacaatacctctttcagacctacccagggtggacaggtctcaattgcactctcaagccattggataaatccaaggcgtatgaccgaccacagcattaaggaatgccagaagagccttgattttgttctcgggtggttcgcaaaacctgtgttcatagacggcgattatcctgagtccatgaaaaataacctgtcctcgatccttccagatttcacggagagtgagaaaaagtttatcaagggtacggctgattttttcgctctatgttttggtcctaccctttcattccaattgctggatccccacatgaaatttcgccaactcgagagtcctaatctgcggcagctactcagttggattgatctcgaattcaatcaccctcagatattcattgtggagaacggatggtttgtctccggcacaaccaagagagacgatgctaagtatatgtactatctaaagaaatttattatggagactctgaaggctataaaacttgacggggtcgacgtgattggctacactgcttggtctctgatggatggctttgaatggcatagaggttactcaatcaggcgcggactattctacgttgactttctctctcaggataagatgttgctgccaaagtcctcagcactgttttatcagaaattgattgagaaaaatggtttcccaccattgccggagaatcaaccgctcgaaggaactttcccatgcgattttgcttggggagtagttgataactacattcaggttgatactaccttgtcacagtttacggatttgaacgtctatttatgggacgtgcatcactccaaacgtttgattaaggttgacggagttgttacgaagaagcgtaagtcttattgcgtcgactttgctgctatccagcctcagattgctctgttgcaggagatgcatgttacacatttcaggttctcacttgattgggcactaatacttccccttgggaaccagtcacaagttaaccacactatacttcaatactataggtgtatggcctcagaattggtcagagttaatataaccccagtggttgctttgtggcagcctatggcaccaaaccaggggttaccaagacttctggctagacaaggagcttgggaaaatccttacacagctttggctttcgctgagtacgctagattgtgttttcaggaattgggtcatcatgttaagctatggatcacaatgaacgagccttatacccgcaatatgacttatagcgcaggacataatttattgaaagcgcatgccttggcttggcacgtttataacgagaagtttaggcacgcccagaacgggaagatttctatagctcttcaggcagactggattgaacctgcatgtccatttagccaaaaggataaggaggttgccgaacgtgtcctagaatttgatattggatggctggctgaacctatcttcggttcaggtgactatccttgggttatgagagactggttgaatcaacgtaataacttcctgctgccttactttacagaggacgaaaaaaaactgattcaggggaccttcgacttccttgcgcttagtcactacactaccatcttggttgattcggagaaagaagacccaattaaatacaacgattaccttgaagttcaggagatgactgatataacttggctcaattccccatctcaagtcgcagtcgtcccctgggggttgaggaaggtgctcaactggctgaaatttaagtacggagatcttccaatgtacataatttcaaacggtattgatgatggacttcatgcggaagatgatcagctgagagtgtattacatgcagaactacattaacgaagcacttaaggcacatattctcgacggaataaatttgtgtggttattttgcttattcttttaacgataggacagccccaagattcggactatacaggtacgctgcagaccagtttgaaccaaaggcatctatgaagcattataggaaaattatagattcaaacggctttcctggtcctgaaacattggagagattctgtccagaagagtttacagtctgcactgaatgctcgttcttccacactaggaaatcattgttggctttcattgcttttctctttttcgcttccattatttctctaagcttgattttctactattcaaaaaagggacgccgttcttataaa

SEQ ID NO: 15304 - DNA, 3036 bp, Artificial Sequence
  Description of Artificial Sequence: Synthetic coding sequence
atgcctgcttctgcaccaccccgccgccctcgcccaccaccaccttcgctgtctctactgctggttctactaggcctggggggtcgacggctacgagctgagcctggtgatggggctcagacttgggcgcgcttctcccgaccacctgcccctgaagccgctggtttgttccagggtacgttcccagatggttttctttgggcagtgggtagcgccgcatatcagacagagggagggtggcagcagcatggaaagggtgcaagtatctgggacacattcacccaccaccccctggctccccccggagacagccggaacgctagcctgccgttgggagcccctagcccactgcagcctgctactggtgatgttgcaagcgacagctacaacaacgtttttcgggacaccgaagcactgcgagaactaggggtgacccactaccggttttcaatctcctgggcccgagttctgcctaatgggtccgccggagtccctaatagagaaggcctccgttattacaggcgtcttctcgagcggctccgcgagctgggcgtgcagccagtcgttacactataccactgggatcttccccagcggctgcaggatgcttacggaggttgggcaaaccgagcattggccgaccactttcgtgattacgctgagctgtgtttcaggcatttcgggggtcaagtgaagtactggattacgatcgacaacccatatgttgtggcttggcacggttatgcaactgggaggctggccccaggcattcggggaagccccagactcggctacctggtggctcataatctcctgctggcacatgcaaaggtgtggcatctttacaacactagcttcagaccaacacagggcggacaagtgtcaattgccttgagttcacattggatcaacccccgccgcatgaccgaccacagtatcaaggagtgccagaagtccctggactttgttctcggttggttcgcgaaacctgtgttcatcgacggtgactatcctgagtccatgaagaacaacctaagcagcattcttcctgatttcaccgagtctgaaaagaagttcatcaagggcaccgccgacttcttcgcactgtgttttggccctaccttgtccttccagctcctggacccacacatgaaattccgacagctcgagtcaccaaacctacggcagctgttgtcttggatcgacctggagttcaaccatccccagatcttcattgtggagaacgggtggttcgtgtccggtacaacgaagagggacgatgcaaagtatatgtattacctgaaaaagttcattatggaaaccctgaaggccataaaattagatggtgtggacgtgattggctacaccgcatggagcttgatggacggatttgagtggcaccgcggctatagcattagaagaggacttttctacgtcgacttcctgagccaagacaaaatgctacttccgaaatcaagtgcgttattctaccaaaaactgatagagaaaaacggattcccgccccttcctgaaaatcagcccctcgaaggaaccttcccctgtgactttgcgtggggggttgtggataactatatccaagtggatactaccttgagccagttcacagatcttaacgtctacctctgggatgtgcaccacagtaaacggttaataaaagttgatggagtggtgacaaagaaacggaagtcttattgcgtggattttgccgcaatccagcctcagattgcactccttcaggagatgcacgtgacccacttccggtttagcctggattgggccctgatccttccattgggcaaccaatctcaagtgaatcacacgatcttgcagtattatagatgtatggccagcgagttagtgagggtgaacatcactccggtcgtggcgctgtggcagcccatggcccctaaccagggtctcccccggttgctggcccgtcagggggcatgggagaatccctatactgcactcgcctttgcggaatacgcgcgtctctgtttccaggagttagggcatcacgtgaagctgtggattaccatgaatgagccctataccagaaacatgacctatagtgcaggccataatctcttgaaggcgcacgccctcgcttggcacgtatataatgaaaaattcagacatgctcagaacggtaagatttcaattgcactgcaggcggactggatcgagcctgcctgtccattttcacagaaagacaaggaagtcgccgagagagtcctagagtttgatattggctggttagccgaaccaattttcggaagtggggattatccctgggttatgcgagactggctgaaccaaaggaacaacttcctattgccctacttcactgaagatgagaaaaaattaatccagggcacatttgattttctcgctctgtcccactacacaacgatcttggtggacagcgagaaggaagatcctataaaatacaacgactatctggaagtgcaggagatgaccgacattacatggctgaactctcctagccaggttgccgtcgtgccttggggcctcaggaaagtgctcaattggcttaaattcaagtacggtgatctgcccatgtatatcatcagcaatggcatagacgatgggctacatgctgaggacgaccagctcagagtgtactacatgcagaactatataaacgaagctctcaaagcccacattttggatggcattaacctgtgtggatatttcgcctattctttcaacgatcgaacagcgccccgcttcggactctatcggtacgctgcggatcagtttgagccaaaggcaagtatgaaacattatcggaagatcatcgattcgaatggcttcccaggcccagagactttggagaggttctgcccggaagagttcactgtgtgcacagagtgcagtttttttcatactcgcaagtcgctgttggccttcatagcatttctcttttttgcctcaataatttcactgagtttaattttttactactccaagaagggccggagaagctataaa

SEQ ID NO: 15305 - DNA, 3036 bp, Artificial Sequence
  Description of Artificial Sequence: Synthetic coding sequence
atgcccgccagtgcccccccgcgacgaccccggccaccaccacccagcctgtctcttttattggtgttgctcgggctgggcgggcggcggctgcgggctgagcctggtgatggcgcccagacctgggccaggttttcccgtcctcctgcacccgaggccgccggcctgtttcaaggcacgttccccgacggatttctgtgggccgtgggcagcgcggcctatcagaccgaggggggctggcagcagcacggcaagggggcatcaatttgggatacattcacacatcatccccttgccccccccggagattcccgcaacgccagtctgcccctcggggcaccctcccccctccagcctgccacaggagacgtggccagtgattcctataacaacgttttccgcgacactgaagctttgagggagcttggcgtaactcattacagatttagtatcagctgggcccgcgtgctcccaaatggatccgccggcgtgccgaaccgtgagggcctgcgctactaccgcagattgctggagcgcctgcgggaattaggagtccagccggttgtcactctctaccactgggatctcccccaacggcttcaggacgcctacggaggatgggccaatagagcactggccgaccacttccgcgactacgccgaactttgttttaggcatttcggggggcaggtgaagtactggatcacgattgataacccctacgtggtggcatggcatggctatgccaccggacgacttgctcccggtatccgaggctcccccaggctgggttacctcgtggcccataacctactgttggcccacgccaaagtgtggcatctgtacaacacatcttttcgccccactcaaggtgggcaggtgagcatagccctgtcctcacactggatcaaccctaggaggatgacagatcactccatcaaggagtgtcaaaaatccctcgatttcgtgctaggatggttcgccaagcccgtgttcatcgacggcgactaccccgagtccatgaagaataatctgagtagtattctccccgacttcaccgaatctgagaagaaattcattaagggtaccgccgattttttcgcactatgcttcggccctacactgtcctttcagctgctcgatccccacatgaaatttaggcagctagaatcgccaaacctgcgccaacttctctcgtggatagacttggaattcaaccaccctcagatattcatagttgagaatgggtggttcgtgagcgggacaaccaaacgggatgatgctaaatacatgtattacctgaagaagttcataatggaaacactgaaggccattaagctggacggtgtcgacgtgatcggatacacagcatggtccctgatggacggcttcgagtggcacagaggctacagcatccgcagggggctcttttacgtcgacttcctgtctcaggataaaatgctgctccccaagtccagcgccctgttttaccagaagctgatcgagaagaacggcttcccacctcttcctgaaaaccaacccctggagggtaccttcccatgtgactttgcctggggagtagtggacaactatattcaagtcgatactacactgagccaatttactgacctgaatgtctatctttgggacgtgcaccattcaaagaggctgatcaaggtggatggcgtagtgacaaaaaagcgcaagagttattgcgtcgactttgccgcgatccagccccagatcgccctgctgcaggaaatgcatgttacacattttcggttttctctggactgggccctaattttaccgctgggcaatcagagtcaggttaaccataccattctgcagtattaccgctgtatggcttccgaattagtgcgggtcaacattacaccagtggtggcactgtggcaacccatggcccctaaccaaggccttccccgactgctagctcgacagggagcgtgggagaatccgtacactgccttggcctttgccgaatacgctaggctgtgtttccaagaattaggacatcatgtgaagctgtggatcaccatgaatgagccttatactcgtaacatgacatactccgccgggcacaatctgctgaaggcgcacgccctggcatggcatgtgtacaatgagaaatttcgtcacgcgcagaatggtaagatcagtattgcattgcaggcggattggatagagccggcctgtccgttctcacagaaggacaaagaagttgcagagagagtacttgagtttgatatcggttggttggcagaaccaatcttcggcagcggagactacccttgggtgatgcgggattggctcaatcagagaaacaattttctgctaccctatttcaccgaggatgagaagaagctgatccagggcacatttgactttttggctctctcccattatacgaccattctggtcgactccgaaaaggaagatcccatcaagtacaatgattatcttgaagtccaggaaatgacggatatcacttggctaaacagccccagccaggtcgccgtcgtcccatggggtctgcgtaaagtattgaattggctgaaatttaagtatggcgatctgccaatgtatattatttctaacgggatcgatgatggactccacgcagaggacgatcaattacgcgtttattatatgcagaactacattaacgaggctctgaaggcccatattttggatggcatcaatctttgcgggtactttgcttattctttcaatgacaggacagcacccaggttcggcctctatcgttatgccgccgatcagtttgagccaaaggcctccatgaagcactatcggaagatcattgattctaatgggtttccaggcccagagacgctcgaacggttctgcccagaggaattcaccgtgtgtacagagtgcagcttcttccacacgcgcaagagtcttttggctttcatcgctttcctcttcttcgcgtctataatttccctgtctttaatcttttactactcaaagaaaggccgccggagctacaaa

SEQ ID NO: 15306 - DNA, 3036 bp, Artificial Sequence
  Description of Artificial Sequence: Synthetic coding sequence
atgccagcttcggccccgcctcgccggcctcggcctccgcccccatcactgtccctccttttggtcctcctcgggctcgggggcagacggctgcgggctgagccaggggacggagcccaaacgtgggcccgattcagccgcccaccagcacctgaggctgcaggcttattccagggaacattccccgatggctttctgtgggccgtgggatcggccgcttaccaaaccgagggtggttggcagcagcacggcaagggtgcttcgatttgggatacgtttacacaccacccactggcccctcccggagactctcgcaatgccagccttcccctgggcgcaccctcaccactacagcctgctaccggggacgtcgcttctgactcctataacaacgtgttccgagacaccgaggccctcagagaactgggagtgacccattaccgattctctattagttgggcgagggtgcttccgaatggaagcgcgggggtgcctaatcgggagggccttcggtattataggcgcctgttagagcggctaagggagctgggagtccagcctgtggtgacgttatatcactgggatctgcctcaaaggttgcaggacgcctacggagggtgggcaaatcgagctcttgccgaccattttagggactatgccgagctctgctttcgacacttcggcggccaagtgaaatactggataacaattgacaacccttatgtggtcgcttggcacggatatgcgaccgggcggctggccccaggcattcgaggcagccctagactgggatatttggtggcgcataacctgttgcttgcccacgcaaaagtgtggcatctctacaataccagctttcggccaacacagggcggacaagtctctattgctctgtctagccattggattaacccacgcaggatgacagatcattcgatcaaagagtgccagaaatcactggacttcgtactgggctggttcgctaagccagtattcattgatggcgactaccccgaaagtatgaagaataatctgagttccatccttcccgatttcaccgagtctgagaagaagttcattaagggcactgccgacttctttgcattgtgctttgggccaactctcagcttccagctcctggatccccatatgaaattcaggcagctagaatcgccaaaccttaggcaactgctgtcctggatagacctggagttcaaccatccacaaatttttattgtggagaacggctggttcgtctcaggcaccacaaagcgagacgacgccaagtacatgtattacctaaagaaatttataatggaaacactgaaagcaatcaagctcgatggagtggatgtcatcggttatacagcttggtcgctcatggacgggttcgaatggcataggggctatagcatcagacgaggactgttttatgtggactttctttcccaagacaagatgttgctgcctaagagtagcgcattgttttatcaaaaactgattgaaaaaaacggttttccaccgctcccagagaatcagcctctagagggtactttcccatgtgactttgcctggggagtggttgataactatatccaggtagacacgacactgtcccagttcaccgacctcaacgtgtatctttgggatgttcaccactcaaaacgtctaatcaaggtggacggagtggttaccaagaagcggaagtcctactgtgtcgacttcgccgccatccagccccagatagctctgttgcaggagatgcacgtgacacatttccgtttcagtctggactgggccctgattcttcctctgggaaaccaaagccaggtaaatcatacaatacttcaatattaccggtgcatggcaagtgaactcgttcgggtgaacatcactccggttgtggctctctggcagcccatggcaccaaaccaggggctcccgagattgctcgcacgtcagggagcctgggaaaatccttacactgcattggctttcgccgaatacgcacgcctctgtttccaagaactaggtcaccatgtgaagctgtggatcactatgaacgagccatacacacgcaacatgacctactccgcgggccacaacttgctgaaggcacacgctctggcatggcacgtttacaatgaaaaatttcgacacgcacaaaatgggaagattagtatcgctttacaggccgactggatcgagcccgcttgcccgttctcacagaaagataaagaagtcgctgagcgagtgctggaatttgacattgggtggctggctgagcctatatttggtagcggtgattatccctgggtgatgagagactggctcaaccaacggaacaatttcctactaccttattttacagaagatgaaaagaagctgatacaaggcaccttcgactttctagctctctctcattacacaaccatcctggtggacagtgaaaaggaagaccccatcaaatataacgactatttagaagtgcaggagatgactgatatcacctggttgaattctccgtcacaggtggcggtggttccttggggcctccggaaagtcctgaactggcttaagttcaagtatggtgacctgcccatgtacataatctcaaacggcatcgatgacggactgcatgctgaagacgatcagttgagagtgtactacatgcagaactacataaatgaagccctgaaagcacacatattagacggaatcaatctttgtggatacttcgcatacagctttaacgatcggaccgcacctaggttcgggctgtataggtatgccgcagaccagtttgagcccaaagcttccatgaagcattaccgcaagattattgactccaatggattcccaggtcctgaaacactggaacggttctgtcctgaagagtttaccgtatgcactgagtgcagctttttccacactagaaagtcattgttggcgttcatcgcgttcttgttcttcgccagcattatttcactgtccctcatattttactattccaaaaaaggcaggcgcagctacaag

SEQ ID NO: 15307 - DNA, 3036 bp, Artificial Sequence
  Description of Artificial Sequence: Synthetic coding sequence
atgccggcctccgcaccacccagacgccccagacccccccccccatctctttcactgcttctggtcctgctaggtcttggtgggagacgactccgcgcagaacctggtgatggagctcagacttgggcacgcttttctaggcccccagctcccgaagcggcaggactgtttcaagggacatttccagatggcttcctgtgggccgtcggatcagcggcataccaaacggagggaggatggcaacagcacggaaagggcgcttctatttgggataccttcacccatcaccccctggctcctccaggagacagcagaaatgcttccctgcccctgggggccccatcccccctccagcctgcaacaggagacgtcgcttccgactcttacaataatgttttcagagatactgaagcactgcgagaactgggagtgacccactaccgtttctctattagttgggcacgagtgcttcccaacggctcagctggcgtgcccaatcgggaaggtctgcggtactatcgtcggctcctggaacgccttagggaactgggggtacagccagtggtcaccctgtaccactgggacctgcctcagcggctccaggacgcctacggtggctgggcaaaccgcgctttggccgaccactttcgcgactatgccgagctgtgtttcaggcactttggcggacaggttaaatattggatcaccattgataacccatacgtggtggcctggcacgggtacgctacaggacggttagcccccggaatccggggctcgcctcgcctgggatacctcgtcgcacacaacctgcttctggctcacgctaaagtttggcacctttacaatacttcttttaggccgactcagggaggtcaagtgtcaatcgccctttcaagccattggatcaacccacgaaggatgaccgatcactccatcaaagaatgccaaaagagcttggatttcgttctgggttggttcgccaaaccggtctttatcgatggagactaccccgaatccatgaaaaataacctcagcagcatattgccggactttacagaaagcgagaagaagtttataaagggtaccgccgacttttttgccctgtgtttcggcccgacactgtcattccagcttttggacccccacatgaagtttcgacagctggagagtccaaatctgaggcagcttctgtcgtggatcgatcttgagttcaaccatccccaaatcttcatagtggaaaacggttggtttgtctctggcacgaccaagcgcgacgatgccaaatacatgtattatctgaaaaaatttattatggaaaccctaaaggctatcaagctggacggagtggacgtcatcggatacacagcctggtcactcatggatgggttcgaatggcatcgcggctactcgatccgccgaggcttgttttatgtggatttccttagccaggataaaatgctcttgcctaaaagcagcgctctgttttatcagaaactgatcgagaagaacggattccctccgctccctgaaaaccaaccactcgagggaacctttccctgtgacttcgcctggggagtagttgacaactacatccaggttgacaccaccttgagccagttcacagatctgaacgtgtacttatgggacgtccaccatagcaagaggctcatcaaagttgacggggtagttacaaaaaaacgcaagtcttactgcgtcgacttcgctgcaattcagccccaaatcgctttgcttcaagagatgcacgttacacacttccgcttcagtctggattgggcacttatcctgcccctggggaaccagtctcaggtgaaccacactattcttcagtactacaggtgcatggcaagcgagctggttagggtcaacatcacaccggtggtggccttgtggcagccaatggccccaaaccaaggcctgcctaggctgcttgctagacaaggagcttgggaaaacccctacacagcactggcctttgccgagtacgcacgcctgtgttttcaagaattgggccaccatgtgaagctgtggatcaccatgaacgagccctataccagaaacatgacatatagtgccggacataacctcctgaaagcacatgcgctcgcctggcacgtatataacgagaagttcaggcatgctcagaatggaaagataagcattgctctgcaggccgactggattgagcctgcttgtccttttagccaaaaggacaaggaggtcgctgagcgggtccttgaattcgacatcgggtggttggcagagcccatattcgggagtggcgattacccttgggtaatgcgcgactggctgaaccaaaggaacaacttcctcctcccatacttcactgaggatgagaaaaagctgatacaaggcacgttcgactttctcgcgttaagccactacaccacaattctggtggattcagagaaggaggatcctattaagtataatgattacctggaggttcaggaaatgactgatatcacatggctcaactcgccttctcaagtggccgttgttccatgggggcttaggaaggtgttgaactggttgaagttcaaatacggagacttgcctatgtacatcataagcaatggaattgacgacggactgcacgcggaagatgatcaactgagagtgtactacatgcagaactacatcaacgaggcccttaaggctcatatcctggatggaataaacctgtgtggatacttcgcctattcattcaatgatcgcactgctccaagattcggactttatagatacgctgccgaccagttcgagccaaaggcctccatgaagcattatagaaaaatcatcgattccaacggctttcccggcccggagacactcgaaaggttctgtccggaagagttcacagtttgcaccgagtgtagctttttccataccagaaagtcactgttggccttcattgcatttctttttttcgcaagcattataagcctctccctgatcttttactatagtaaaaaaggacgccggtcctacaaa

SEQ ID NO: 15308 - DNA, 3036 bp, Artificial Sequence
  Description of Artificial Sequence: Synthetic coding sequence
atgcccgcgtcggctccccctcgcagacccaggccccctcctcctagtctgtccctcctactagtgctgctgggccttggagggcggcgtctaagagcggagccaggcgatggtgctcagacatgggctcgattctctagacctcctgcccctgaggccgccgggctgtttcagggcaccttcccggatgggttcctctgggctgttggctccgcagcatatcaaaccgaaggaggatggcagcagcacggcaaaggggcttctatctgggataccttcacacaccatcctctggctccgcctggtgactcccgtaacgcgtccttgccacttggagccccctctccgcttcagccagccaccggtgatgtcgcatcggacagctacaacaacgtgtttcgagacactgaggcattgcgggagcttggggtcacacattatcggttcagcatctcctgggcccgggttcttcccaatgggtcggccggcgtgcccaaccgtgagggtctgcggtactaccggcggctgttggagagactgcgggaactgggtgtgcagcccgtggtaaccctctatcattgggatctgccccagcgcctacaagatgcatatggaggctgggctaacagggcactggccgaccactttagagactacgccgagctgtgctttcgccacttcgggggacaggttaaatattggattaccattgacaacccttatgtggtcgcctggcatggatacgccaccggcaggctagctcccggcataagagggtctccaaggctcggctacttagttgctcacaacctcctgttagctcacgctaaagtctggcatctgtacaacacctccttccgacccacccagggcgggcaggttagcatagccctgagctcacattggataaaccctagacgtatgaccgatcactccatcaaagaatgtcagaagtctctggattttgtcctaggatggtttgccaagcccgtctttattgacggggattaccccgagagcatgaagaataatcttagctccattttacctgacttcaccgagtccgagaagaaattcattaaagggactgcggatttttttgcgctgtgttttggacctacattgtccttccaactcctcgaccctcatatgaagtttcggcagcttgagtctccgaatctgagacaattgctgtcgtggatcgatctggaattcaaccatccccagatcttcatcgttgagaacggctggtttgtcagcggcacgaccaagcgtgatgacgccaagtatatgtactacctcaaaaaattcatcatggagactctcaaagcaattaagcttgatggggtggacgttatcggttatacagcatggtccctcatggatgggtttgaatggcacagggggtacagcatcagacggggcctcttttacgtcgacttcctcagccaagacaagatgttgttgcccaaatcctctgccttgttttaccaaaagctgattgagaagaacggattccctcccctgccagagaaccagccgttggaaggcacattcccctgtgacttcgcctggggagtggtggacaattatattcaggtggatactacactatctcagttcacagatctaaacgtctatttgtgggacgttcaccactccaaaagactgatcaaagtcgacggggtggtgaccaaaaaaaggaagtcgtactgcgtggatttcgctgccatccagcctcagattgccctcctccaggaaatgcacgtgacccactttcgatttagcctggattgggctctaatccttcccctgggcaaccagtcgcaggtcaatcacacgattctgcaatactatagatgtatggcatcagagctggttagagtaaacatcacccccgtcgtcgcattgtggcagccgatggcccctaatcagggcctcccccgcctgctggcgaggcaaggggcctgggagaatccctatactgccctcgcgttcgccgagtacgcgcggctttgcttccaggaactcggtcatcatgtgaagctgtggatcacgatgaacgagccatatacgcgcaacatgacatactccgcagggcataatctgctgaaagcacacgccctggcctggcatgtttataacgaaaagttccgccatgcacagaatggaaaaattagcatcgcattgcaagctgattggatcgaacccgcctgtcccttctctcagaaagataaggaggtggcagaaagggttttggagttcgacattggctggcttgcagaaccaatcttcggtagcggcgactacccatgggtgatgagagactggcttaaccagcggaacaactttctactgccctatttcacggaagacgagaagaaactcatccaaggtacgttcgattttctggccctaagtcattatactacaattcttgtagactctgagaaagaagatcccattaagtacaacgattatcttgaggttcaggagatgacagacattacctggctcaactccccaagccaggtggccgttgtgccatggggactgcggaaagtattgaactggctaaagttcaaatacggagatctaccgatgtatatcatctctaatgggatagacgacggcctccacgccgaggacgaccagctgcgggtgtactacatgcagaattatattaatgaagctctaaaagcccacattttggacggcatcaatctatgtggctatttcgcctattctttcaatgacagaaccgccccaaggttcgggctgtatcgttacgctgcagatcagttcgaacctaaagcttccatgaaacattacaggaaaatcatcgactcgaacggatttcccggaccagaaacgttggaacgcttctgccccgaagaattcactgtttgcaccgaatgctctttttttcatactaggaaatccctgcttgcctttatagctttccttttcttcgccagcatcatcagtctgtccctgatcttttattactcgaaaaaagggaggagaagttacaag

SEQ ID NO: 15309 - DNA, 3036 bp, Artificial Sequence
  Description of Artificial Sequence: Synthetic coding sequence
atgcccgcttcggctcctccccggcgtccccgtcccccacccccgtcactctctctgttactagttctgctcggtcttggaggtcgacgacttcgagcagagcctggcgacggtgctcaaacgtgggcccgcttttccaggcccccagccccagaggccgcgggactcttccaaggcacgttcccagatggatttctttgggctgttgggtcagccgcatatcagacagagggcggatggcagcagcacggcaaaggcgcctcgatatgggacactttcacacaccaccctttagcgccgcctggtgattcgcgcaacgcaagcttaccactgggggccccatctccactacagcccgccaccggggacgtcgcctcagattcgtacaataatgttttccgcgatacggaggccttgcgtgagctaggcgtaacccattaccgattctcgatttcatgggccagagtgcttcccaacgggtcagccggtgtacctaacagagaaggcctgagatactacaggcgtctactggagcggttgagagaactgggagtccagcccgtcgtgacattgtatcattgggatcttccacagaggctacaggatgcgtacggaggatgggctaatagagcacttgctgaccattttcgtgattacgcggagctttgttttcggcacttcggtggtcaggtcaaatactggatcacaattgataatccttatgtagtggcttggcacggctacgccaccggcaggttggcaccaggtattagagggagtccccgccttggctacttggtggcacacaacctcctactggcgcacgcaaaggtatggcacctgtataacacttcatttaggcccacacaaggtggccaggtgagcattgcgttgagcagccactggatcaacccccggcggatgaccgaccactccatcaaggagtgccagaaatcgcttgattttgtgcttggttggtttgctaagcccgtgtttatcgacggtgattatccggagtccatgaaaaacaacttgtcctcaatacttccagatttcactgaaagcgagaagaaatttatcaagggaacagcagattttttcgctttgtgtttcggccctaccctgagtttccagttgttggatcctcatatgaagttccgccagcttgagtcaccgaacctccggcagcttttgtcatggattgacttggagtttaaccatccgcagatcttcatcgttgaaaacggatggtttgtgtccggtaccacgaagcgcgatgacgctaagtatatgtactaccttaagaagtttataatggaaactcttaaggcgatcaagctcgacggcgtggatgtcattggatatactgcgtggtcactcatggatgggttcgaatggcaccggggctatagcataagacgtggtctattctacgtggatttcctgtctcaagacaagatgctgctgcccaaaagctcggccctgttttatcagaagcttattgaaaagaacggcttccctccattgcctgaaaaccaacctctcgaagggacatttccttgtgatttcgcatggggcgttgtagataattatatacaggtagatacgacactgtctcagttcacagaccttaatgtatacttgtgggatgtgcatcactctaaaagattgatcaaagttgatggggtcgtcactaagaagcgcaagtcatattgcgttgattttgcggccattcagccgcaaatcgccttgcttcaggagatgcatgttactcacttccgattctcattagattgggcgcttattttgcctttgggtaaccagtctcaggtgaaccacactatcttgcagtattatcgatgtatggcttccgaactcgtcagagttaacatcacacctgtagtcgctttgtggcagcctatggctcctaatcaggggctgcctagacttcttgcccggcaaggcgcgtgggaaaacccatacacagcgctagccttcgccgaatacgcgcgtttgtgtttccaggaacttggtcatcacgtgaaactatggatcaccatgaacgaaccatatacacgaaacatgacgtactcggcaggacataacctgctgaaggcgcatgctctcgcttggcatgtttataatgaaaaattcaggcacgctcaaaacggtaagatatcaatagccttgcaggccgattggattgaaccggcgtgcccgttcagccagaaggacaaagaggtggcggagcgtgtcttagagttcgatattggctggcttgccgagcctatcttcggaagtggagattacccatgggtgatgcgtgactggctcaaccagaggaacaactttttactcccttacttcacggaggacgagaagaagcttatccaaggtacttttgactttctcgctctgtcacattacacgacaatccttgtggactctgagaaggaagatccgatcaagtacaacgattatctggaggttcaagaaatgacagatattacctggcttaacagtccgagccaggtggcagtggtgccctggggtctcaggaaggtactaaactggttaaagttcaagtacggcgacctccccatgtatatcatttctaacggcatagatgacggtctccatgcagaggatgatcaactccgtgtgtattacatgcaaaattatattaatgaggcacttaaggcgcacatcctcgacggcattaatctgtgtggatattttgcatacagttttaacgaccgaaccgcgcctaggtttggcctctaccgctacgccgctgatcaatttgagcccaaggcatctatgaaacattaccgaaaaatcatcgactcaaacggtttcccaggccctgaaacgctcgagaggttttgtccggaggagtttacagtgtgtactgaatgctcatttttccatacgcggaaatctcttttagcatttatagcgtttctattctttgcttctataatctccctcagtcttattttctactattcaaagaaaggtcgtagatcttataag

SEQ ID NO: 15310 - DNA, 3036 bp, Artificial Sequence
  Description of Artificial Sequence: Synthetic coding sequence
atgccggcttctgcacctccgcgacgcccacgaccacctccgccgtcgctttctcttttgctagtattactagggttgggaggtcgcagattgagagctgaacccggggatggagcccaaacttgggcgcgttttagcaggccaccggctccggaggcagccgggttgtttcaaggaacttttccggatggatttttgtgggccgtcggttctgctgcataccaaacagagggtggctggcaacaacatggcaaaggcgcctcaatttgggacacgtttacccatcatccacttgctccgccaggagattcaagaaatgcttctcttccattgggagccccatctccactgcagccagcgactggagatgtcgcttctgattcttacaacaatgtgttccgagatactgaagcgttgagggagcttggagtaacacactatagatttagcatttcctgggcaagagttttgccaaatggatcagctggtgtgccaaacagagaaggactgcgttactatcggagactactggaacgattgcgtgaacttggagtccaacctgttgtaacattgtatcattgggacttgccacaacgattacaagatgcttacggcggatgggccaaccgggctctggcagatcactttcgggattatgccgagctgtgtttccgtcactttggtggacaagttaagtactggatcaccatcgacaatccatatgtcgttgcatggcatggatatgcaactggaaggctagctccgggtattcgaggttcgccccgtctggggtatttagttgctcacaatctgttgttggctcacgctaaagtttggcacctttacaatacttctttccgtccaactcagggaggacaagtttctatcgcattatcttctcactggattaatccacgacgaatgacagaccactcgatcaaggaatgccagaagtctcttgactttgtgttgggatggttcgctaaaccagtgttcatcgatggggactatccggaaagcatgaaaaacaatctctcatcgatccttcctgatttcacggagtctgaaaaaaagtttatcaaagggactgcggatttcttcgctctatgttttgggcctacactctcttttcaacttctagatccccatatgaagtttagacaacttgaatcacctaatttgagacaattactatcatggattgatctcgaatttaatcatccgcaaatatttatagtcgaaaatggatggtttgtttctggaacaactaaacgtgatgatgcaaagtatatgtactatttgaagaagttcattatggaaactcttaaggctataaagttagatggtgttgatgtcattggttatactgcatggtccttgatggatgggttcgagtggcataggggatactctatcagacgtggactcttctatgtcgatttcctgtcacaggacaaaatgcttttaccaaagtcgagtgcattgttttaccaaaaacttatcgaaaaaaatggattcccaccgttgccagagaaccaaccactcgaaggtacctttccatgcgattttgcctggggagttgtggataactacatacaagtggacaccactctgagtcagttcaccgaccttaatgtatacctttgggatgtgcatcatagtaagaggctcattaaagttgatggtgtggtcactaagaagcgcaagtcttactgcgtggattttgccgcgattcaaccacaaattgcattgcttcaagagatgcacgtaactcatttcagattttcccttgactgggcacttatcttgccgctgggaaatcaatcacaagtaaatcacacaattctgcagtactatcgctgtatggcatcagaactcgtacgggtgaacatcaccccggttgtagcactgtggcaacctatggctccaaaccagggactccctcgcttactggctcgccaaggagcctgggagaatccatacaccgctttagcatttgcagaatacgcgcgtctctgttttcaggaattagggcaccatgtcaagttatggataacaatgaatgagccttacacacgtaacatgacttactctgctggacataacttattgaaagctcatgcgttggcttggcatgtctataatgagaaatttcgtcatgctcaaaatggcaagatatctatcgccctacaagcggactggattgaacctgcgtgcccattcagtcaaaaagacaaagaagttgcagaacgcgtcctggagtttgatatcggctggttggcagagccgatatttggttctggtgattacccgtgggtgatgcgagactggttaaaccaaagaaacaatttcttattaccgtatttcactgaggacgagaaaaagttgatccagggtacattcgactttcttgcactatcccactatacgaccatcttagttgattcagagaaggaagacccaataaaatacaatgattatctagaggtccaggagatgactgatatcacttggctcaatagtccaagccaagtggccgtagtcccatggggacttcgcaaagttctcaactggctcaagttcaaatacggagacttgccgatgtacatcataagtaacggtatagatgatggcttgcacgcggaagatgatcagcttcgcgtatattatatgcagaattacattaatgaggctcttaaagcacatatccttgatggtatcaatctatgtggctacttcgcttacagtttcaacgataggacagctcctcgttttggactttacaggtacgcggccgatcaatttgaacctaaagcatcaatgaaacactaccgaaagatcattgacagcaatggattcccgggaccagagacgctagaaaggttttgtccagaggaatttacagtgtgtactgagtgttctttctttcacactcgcaagtcgctgctggcctttatcgcattcttgttcttcgccagtattataagtcttagcctgattttttattattcaaaaaagggaagacgtagctataag

SEQ ID NO: 15311 - DNA, 3036 bp, Artificial Sequence
  Description of Artificial Sequence: Synthetic coding sequence
atgccggcctctgctccaccccggaggccgaggcccccccccccatctctgtctctgttgttggtcctcctgggcctgggggggagaagactccgcgccgagcctggcgatggagcccagacttgggcccgcttttcacgccctccagctcccgaggccgcagggttgtttcagggaacattccccgacggattcctgtgggctgtggggtctgcggcataccagaccgaaggggggtggcagcagcacggaaaaggagcctccatctgggacaccttcactcaccatcctctggcacccccgggggatagtcggaacgccagcctcccgctgggggccccttcccctcttcagcccgccacgggggatgtcgcatcagattcatataacaacgtgttccgggatacagaggcgctgagagaattgggcgtgactcactacagattcagcattagctgggcccgggtgctgcccaacggttccgctggcgtgccaaaccgggaggggctccgctattatagacgcctgctggaaaggctgcgcgagttgggtgttcagcccgtcgtcaccctgtaccattgggatctgcctcagcgcctccaggatgcgtacggcggttgggctaaccgagctctcgccgaccatttcagagattacgccgaactctgtttcaggcattttggagggcaagtgaaatattggatcacaatcgataacccatacgtagtggcttggcatggctatgcaactgggagactggctcccgggattagagggagcccacggctcggctatctcgtggcgcataatctgctgctggcccacgctaaagtgtggcatctgtacaacacctcattcaggcctactcagggtggccaggtgtcaatcgccctctctagtcactggatcaatcctcgccggatgaccgaccattccataaaggaatgccaaaagtctctcgacttcgtcctgggatggttcgccaaacctgtctttatagatggggactaccctgagtccatgaaaaataatctctctagcattctgccagattttacagaaagcgagaaaaagttcattaaagggactgcggacttcttcgcactttgtttcggccctacgctgagctttcagttgctggacccacacatgaagtttagacagctggagagtcccaacctccggcagctgctctcttggattgacctcgagttcaatcacccccagatcttcattgtggagaacggatggttcgtgtcaggtacgactaagcgggacgatgctaagtacatgtactacttgaaaaagttcatcatggaaactctgaaggccattaagctggacggagttgatgtcattgggtacactgcctggtcactcatggacggatttgaatggcatcgcggctattccattcggcggggcctcttttatgtcgactttctgtctcaagataaaatgctcctccctaagtccagtgcccttttctatcagaaacttatagaaaaaaacggctttccccccctgccagagaaccagcctctggagggcacattcccctgtgatttcgcatggggcgtggtcgacaactacattcaagtagataccacgctttctcagtttactgatttgaacgtgtacctgtgggacgtgcatcattccaagcgcctcattaaggtagatggtgtcgtgacgaaaaagaggaagagctattgcgttgatttcgctgccatacagccacagatcgcgctcctgcaggagatgcatgttacgcatttccggttctccctggactgggccctgattctgccactcggaaaccagtctcaggtgaatcacaccatacttcaatactaccggtgcatggcgtcagagctggtgcgcgtgaacattacacccgtggtggcactgtggcaaccgatggcacctaatcaagggctcccacgcctgctggccaggcagggagcatgggaaaatccctataccgctctggccttcgccgagtatgcacggctgtgtttccaggaactgggccatcacgtcaagctgtggatcactatgaatgaaccatacacccgcaacatgacctattcagccgggcacaacttgcttaaggcccatgcccttgcctggcatgtgtacaatgaaaaatttagacacgcccagaatggaaagatttcaatcgccctgcaggccgactggatagagccagcatgccccttcagccagaaagacaaagaagtggccgagcgagtgctggagtttgacatcggctggctggctgagcccatcttcggctcaggtgattacccctgggtcatgcgggactggttgaatcaacgcaacaacttcctgttgccatacttcacagaagacgagaagaaattgatccagggtacgttcgactttctcgctctgtctcactacaccacgatccttgtggactccgaaaaggaggaccctattaagtacaacgactacctggaagtgcaggagatgaccgacattacatggctgaactctccatcacaggtcgccgtcgtgccgtggggactgcgcaaggtgctcaactggcttaagttcaagtatggcgatctcccgatgtacataatctctaacgggatcgatgacgggcttcacgcagaagacgaccagctgagggtgtattacatgcagaattacattaatgaggcactgaaggcacacatcttggatggcatcaacctgtgcggatatttcgcctactcttttaacgacaggaccgccccgcgcttcggcctctatagatatgccgccgatcaattcgagcccaaagcttccatgaagcactaccgcaaaataatcgacagcaatggtttccctgggcctgaaacgttggagcggttttgccccgaggagtttaccgtgtgcacagagtgcagcttctttcatacaaggaagtcattgttggccttcatagcattccttttctttgccagtataatcagtttgagcctgatcttctactacagtaagaagggacgaagaagctacaag

SEQ ID NO: 15312 - DNA, 3036 bp, Artificial Sequence
  Description of Artificial Sequence: Synthetic coding sequence
atgccagcctcagctccccctcggcggcccagaccccctcccccctctctttctctgttgctggtcctgctgggcctgggcggcaggcgcctgcgggctgagcctggcgatggggcacagacctgggctcgcttcagtaggcccccggcgcccgaggcagctgggcttttccaaggaacctttcctgacggattcctttgggcagttggatctgccgcttaccagaccgaaggaggctggcaacagcacggcaagggtgcctcgatctgggacaccttcactcaccaccctcttgctcccccgggcgactcgaggaacgctagcttaccactcggagctcctagtccacttcagccagcaaccggggacgtcgcttctgatagctacaacaacgtgttcagggataccgaggccctgcgagaactgggtgtgacccactatagatttagtatctcttgggcccgcgtgctccccaacggctctgctggcgtgccgaaccgagaaggtctcaggtactacaggcgtttgcttgagagactacgagaattaggggtacagcctgtcgtgacgttgtatcactgggaccttccacaaagactgcaggacgcttatggtggatgggccaaccgggccctggctgaccactttcgcgactatgccgagctgtgctttagacacttcggcggccaggttaaatactggattacaatcgataatccctacgtggtggcatggcacgggtacgcaacgggccggctagcccccggcattcgtgggagccctcgcctcggatatttggtggcgcacaaccttctgcttgcacacgccaaggtttggcacctttacaacactagctttcgccccacacaagggggccaagtttcaatcgccttatctagccactggatcaatccccggcgcatgaccgatcacagtatcaaggagtgtcagaagagcctcgattttgtgcttggatggttcgccaaacccgttttcatcgatggagactaccccgaatctatgaaaaataatctttcgtctatcttgcctgatttcacagaatccgaaaaaaaatttattaagggcacagccgacttcttcgcactctgttttggacctacactttcatttcaactcctcgatccacacatgaagtttagacagcttgaaagcccgaatctgaggcagcttctgtcctggatcgacctcgagttcaaccatcctcagatatttatagtagaaaacggctggttcgtctctggcacgacgaaaagagatgacgctaagtacatgtactaccttaaaaagttcataatggaaacgttaaaagctatcaagctggacggagtggacgttatcgggtacaccgcttggtcactgatggatggctttgaatggcataggggctattcaattcggagaggtctgttctatgtggatttccttagtcaagataagatgttacttcccaagtcatcagctttgttctatcagaaattgatagagaaaaatggattccctccattgcctgagaaccaacccttagaagggaccttcccctgcgattttgcttggggagttgttgacaactacatacaagtagacaccactctgagccagttcactgatctcaacgtgtatctctgggacgtacaccattctaagcggttgataaaagtggacggcgttgttactaagaagagaaagtcatactgcgttgattttgctgccatccagccccaaatcgcattactgcaggagatgcatgtgacccatttcagattctctctcgattgggccctcattctgccacttgggaatcagagtcaggtgaaccacacaattctgcagtactatagatgtatggcctcagaattggtacgcgtcaacattacacccgtcgtggcactgtggcagcccatggcccctaaccagggcttaccccgcctgcttgcccggcagggagcgtgggagaatccttatacagccctggcttttgctgaatatgcgcgcctctgcttccaggagcttggccatcacgtgaagctgtggatcaccatgaatgaaccctatactcgcaatatgacatactctgccggccataacctgctgaaagcccatgccctggcctggcacgtgtacaacgagaaattccgtcacgcccaaaatggcaagatttccatcgctctgcaggccgattggattgagccagcctgtcctttctctcaaaaggataaggaggttgccgaacgggtccttgaattcgacatagggtggctggccgagccgatctttggaagcggagactatccttgggtaatgagggattggctgaaccagaggaataacttcctgctgccatatttcacagaggatgaaaagaagttaatccaaggtacctttgacttcctggcgttgtcccactacaccactatcctggttgatagcgaaaaagaggatcccatcaagtacaatgactacttggaggtgcaggaaatgaccgatattacgtggctgaattctccatctcaggtagctgtggtcccctgggggctaaggaaggtgctgaattggttgaagttcaagtacggagatctgcctatgtacatcatatctaacggaattgatgatggactgcacgcggaggatgaccaactgagggtgtactacatgcagaattatattaatgaggcccttaaagcacacatcctggacgggatcaatctgtgcgggtactttgcctactccttcaatgaccgcactgccccaaggttcggactgtatcggtacgccgctgaccagttcgaacctaaggccagcatgaagcattataggaagattatcgattctaatgggtttcctggcccagaaacactggagaggttctgcccagaggaatttaccgtgtgcacagagtgtagcttttttcacactcggaagagccttctggccttcattgcctttttgttttttgctagcattattagcctcagcttgatcttttactactctaagaaggggagacgtagttacaaa

SEQ ID NO: 15313 - DNA, 3036 bp, Artificial Sequence
  Description of Artificial Sequence: Synthetic coding sequence
atgccagcctccgctccgcctcgtagaccccggccacctccaccatcactttcgcttcttctcgttctgctgggtcttggcggcagacggttacgggctgagccaggtgatggagcccagacctgggcccgcttttctaggcccccagccccagaagcagccggcctctttcaggggaccttcccggatggatttttgtgggccgttggaagcgccgcatatcaaacagaaggtggctggcagcaacacggtaagggagctagcatttgggacactttcacacaccacccactggcgcccccaggagatagtagaaacgcctctttacccctgggagccccctcccctttgcagccagcaaccggggatgtcgcaagcgactcgtataacaacgttttccgcgacacagaggcattgcgagaactgggtgtgacccactaccgcttctctatctcctgggcccgcgtgcttcctaatggctccgcgggtgtccccaatcgggagggattgcgatactatcggcggttactggagcggttaagagaactcggcgttcagcccgtcgttaccctgtatcattgggacctgccccaacgcctgcaggacgcctacggagggtgggccaaccgggctctggccgatcattttcgtgactatgcggagctgtgtttccgccacttcggcgggcaggtgaaatattggatcaccatcgacaatccatacgttgtggcctggcatgggtatgccacaggccgcctcgctcccgggattaggggcagtccccggctgggctatctggtcgctcacaacttgctcttagcccatgctaaagtgtggcacctgtataacactagttttcgccctacacagggcggacaggtgtcaattgctttgagcagtcactggattaacccaaggcgaatgaccgatcactctataaaggagtgtcagaaatcccttgacttcgtgctgggctggtttgccaagccagtgtttatcgacggcgactaccctgaatccatgaaaaataatttgtctagcatattgcccgattttacagagtccgagaaaaagtttataaagggcacggctgacttcttcgctctctgcttcggaccgaccctctcatttcaattactggatcctcatatgaagttccgacagctcgaatcgcccaacctcaggcagctgctttcgtggatcgatctagaattcaatcacccccaaatatttatcgtcgagaatggctggtttgtgtccgggacaacgaagcgcgacgacgccaagtatatgtactatttgaagaagttcattatggaaactctaaaggctatcaaactagacggcgtggatgtcattggttacactgcatggtctctcatggacggctttgagtggcacaggggatattctatccgacggggattgttttatgtagatttcttatcacaagacaaaatgctcctgccaaaaagttctgccctgttttatcaaaagctcattgaaaaaaatggtttccctcctttaccggagaaccagccactggaaggcacctttccgtgtgacttcgcctggggggtggtagataattacattcaggtcgatacaacattgagtcagttcactgacttaaatgtatatttgtgggatgttcaccacagtaaacgactaattaaggtggacggggtggtaacaaagaaaagaaagtcttactgcgtggacttcgccgctatccagccccagatcgccttactgcaggaaatgcatgttacacacttcaggttttcactcgactgggctttaattctgcccctgggaaaccaaagccaggtgaatcacacgatcttgcaatattaccgctgtatggcgagcgagctcgtgcgggtgaatattaccccagtggtggcactttggcagccaatggcacctaatcaaggactgcctcgcctgttggctcgccagggggcttgggagaacccttacacagctctggccttcgcagaatacgctagactgtgctttcaggagctgggtcatcatgtgaagctttggattacgatgaatgagccctacacaaggaacatgacttatagcgcaggccacaaccttcttaaggcccatgcactagcttggcacgtgtacaacgaaaagttccgccatgcccaaaatgggaaaatctcaattgcactccaggccgactggatagaaccagcctgtccttttagccagaaagacaaggaggttgctgagcgagtgttggaattcgatattggttggttagccgagcctatctttggctccggggactacccctgggtaatgagagactggctcaaccagcggaacaattttctattgccatacttcaccgaagacgagaagaagttgattcaaggcacgtttgactttttggcactaagccactacacaaccatactggtggattctgaaaaagaagaccccattaagtataacgattatttagaggtgcaggaaatgaccgacatcacatggctgaattcaccctcccaggtggcggtcgtgccatgggggttacgaaaggttctgaattggctgaaattcaagtacggcgatctgcccatgtatatcatctcaaatgggatagacgatgggctgcacgccgaggacgaccagctccgggtttattatatgcaaaattatatcaatgaggccctcaaggcgcacatcctggatggaatcaatctgtgcggttattttgcctatagtttcaatgatagaaccgctccaagattcggactgtaccggtacgccgctgatcagttcgaacctaaagcctctatgaagcactatcggaagatcatcgactctaacggctttcctggacccgagactctggagcgcttctgcccagaggagtttactgtatgcacagagtgcagcttctttcatacgcgcaagtctcttctggcctttattgctttcctcttcttcgcatccattatctctttgtccctcatattctattattcaaagaaggggcgccgatcctataaa

SEQ ID NO: 15314 - DNA, 3036 bp, Artificial Sequence
  Description of Artificial Sequence: Synthetic coding sequence
atgcctgcttcagctcctcctaggcggccaagacctccacctccttcccttagtctccttctggtgttattggggttaggaggcaggagactgagggctgagccaggagatggcgcacaaacttgggcacggttctctcgcccaccagcccctgaggccgcaggtttgtttcaagggaccttccccgatggatttttgtgggctgtcggcagcgccgcgtaccagacagaaggcggatggcagcagcacgggaaaggcgcctctatttgggatacttttacccatcatcccctggctcctcccggtgattcccggaacgcttctttacctctgggtgctccttccccactccagccagccaccggcgacgtcgccagtgactcatacaataacgtgtttcgggataccgaggcactgcgggaactcggggtgacccattaccgtttttcgattagctgggcacgggttctgccaaatggttccgcgggggtgcccaaccgtgaaggcctgcggtactaccgaaggcttttggaaagattaagagagttgggagttcagccagtggttaccctttatcactgggatttgccccagcggttgcaggacgcttacggtggttgggctaatcgagctctggctgaccacttcagggactatgctgaactgtgttttcggcacttcggaggacaggtcaagtactggattacaatagataacccctacgtcgtggcctggcatggctatgcaacgggacggttggcgcccggcatccgcggatcccccagactgggctacctagttgcacacaatctgttgttggcccacgctaaggtctggcacctgtataatactagttttaggcctacacagggcggacaggtatcaattgccctctcttctcactggatcaacccacgacggatgaccgatcactctattaaggagtgtcagaagagcctggactttgtgctcggctggttcgctaaaccagtattcatcgacggagactatccggagtcaatgaaaaataacctgtccagtatcctcccggattttacggaaagtgaaaagaagttcatcaaaggtaccgctgacttctttgccctctgcttcggccccacgttatcctttcagctgctagatccccatatgaagttccggcagctggagtcacccaacctcaggcagcttctcagctggatcgacttggagtttaaccatcctcagatttttatcgtcgagaatgggtggttcgtgagtgggaccacaaaacgcgatgatgccaaatatatgtattatctgaagaagttcatcatggagaccctgaaagctattaaactggatggcgtggatgttatcggctacacagcatggagcctgatggacggatttgaatggcatcgtggatattctattcggaggggcctcttttatgtggatttcctgtcccaggataaaatgcttctgccaaagagttccgcactgttctaccaaaaattgatcgagaaaaacggattcccacccttgcccgagaatcagcctctggaggggaccttcccatgtgactttgcttggggcgtagtagataactacatccaagtcgacacgacattgagccagtttactgacttgaacgtctacttgtgggacgttcaccactcaaagaggcttatcaaggtcgatggagttgtgaccaaaaaacgcaagtcctattgcgtcgacttcgccgccatccagccccagatcgcccttttacaggagatgcacgtaacgcactttcgcttttcccttgactgggcattaatcctgccgctggggaatcaatcccaggtgaatcatactatcttgcagtactacagatgtatggcgagtgagctggttcgcgtcaacattactcctgtggtggctctatggcagccaatggcaccgaaccaaggtctacctagacttctggctcgccagggcgcgtgggaaaatccttacactgccctggctttcgccgagtatgctcggctgtgttttcaagagttgggccatcatgttaaattatggatcactatgaatgaaccctacacccggaatatgacatacagcgctggtcacaatttgctgaaggcacacgctttggcatggcacgtgtacaacgagaaatttcggcacgcacagaatggaaagatctcaattgcgctgcaggcagattggatcgagccagcctgcccttttagccagaaagataaagaggtcgccgaacgtgtcttagaattcgacatcggctggctcgccgagcccatcttcggctccggagactacccttgggttatgagggactggctgaatcagcgcaacaacttcctgttaccatactttaccgaggatgagaaaaagctgatacagggcacctttgactttcttgcattatctcattatacaaccattcttgtcgattctgagaaggaagatcctataaaatacaatgactatctagaagtgcaggaaatgacagacatcacgtggctaaattcccccagccaggtcgccgttgtgccatgggggctaagaaaggtgttgaattggctgaaattcaagtacggcgatctgcctatgtatattattagtaatggtatcgatgacggcctgcacgccgaagatgatcagctgcgagtgtattatatgcagaactatatcaacgaggctctaaaggcccatattcttgacggaatcaacctctgtggttacttcgcctactcattcaacgaccggactgcacctaggttcggcctgtatcggtatgcggctgaccagtttgaacctaaggcttctatgaaacactatcggaagatcatagacagcaatggatttcccggcccggaaactcttgaacgattttgtccagaagaattcacagtttgtacagagtgttccttctttcacactagaaaaagtttattagccttcatcgcattcctgttctttgccagcatcattagcctgtcactgatcttttattatagtaaaaaaggaaggaggtcgtacaag

SEQ ID NO: 15315 - DNA, 3036 bp, Artificial Sequence
  Description of Artificial Sequence: Synthetic coding sequence
atgccagcctccgctcctccccgtagaccaaggccaccccctccaagtctaagtctgctactggtattgctcggcctcggcggccggcgcctacgggccgagcctggggatggtgcccagacttgggcaagatttagccgcccaccagctcctgaagccgcgggtctgtttcagggtaccttcccagacgggttcttgtgggcggtggggagcgccgcttatcagaccgagggtgggtggcagcagcatgggaaaggcgcttccatttgggatacgtttactcatcatccgttagcacctccaggtgacagcagaaatgcctccctcccgcttggtgcaccatctcctttacagccggcaacgggggacgtggcctcggattcctataataacgtcttccgagatactgaggccctgagggagttgggggtaactcactacaggttctccatttcctgggcaagagtgctgccaaatggatctgccggtgtcccaaaccgcgagggcttaaggtactatcgccggctcctggaaaggctgagagaactcggcgtccaacctgttgtgaccttgtaccactgggatctcccccagcgcttgcaggatgcatacggaggctgggcgaatagagccctcgcagatcattttagagattacgcagagctgtgttttcgccactttggaggccaggttaaatactggattactatcgacaacccttacgtcgtggcctggcacggctatgcaacgggccgccttgcaccgggcatacgaggatcacctagattgggctaccttgttgcgcataacctgctgctcgcgcatgccaaggtctggcatctctacaatacatcatttcgccccacgcagggcggccaggtctccattgcgctgagctcacactggataaatccccggcgtatgacggaccattctattaaggagtgtcagaagtcactcgatttcgtgctgggctggttcgccaagcccgtcttcattgatggcgattaccccgagagtatgaaaaacaacctctctagcatattgcctgattttaccgagtcagagaaaaagttcattaaaggcacagccgatttcttcgccctctgcttcggccccacactatcgtttcagttactagaccctcacatgaaattccggcaactcgaatcacctaaccttagacagctcctgtcgtggattgaccttgagttcaatcaccctcagatctttatcgtagagaacgggtggtttgtttccggcacgacaaagagggacgacgctaagtacatgtattatctgaaaaagtttataatggagaccctcaaagctatcaaactcgacggagtcgacgtcattggatataccgcctggtctctgatggatggatttgaatggcatcgaggttatagcattaggcggggactgttttatgtggatttcctctctcaggacaagatgctactccccaaatcctctgctctgttctaccaaaaacttatcgagaaaaatggcttcccacccctccccgagaatcagcccctcgagggcacttttccctgtgacttcgcatggggcgttgtcgacaactatatccaggtggacaccacgctctcccagttcacagacctgaatgtgtatctgtgggacgttcaccactccaagagactgatcaaggtggacggcgtggtgactaaaaaacgaaaatcgtattgcgtggatttcgcagccattcagcctcagatagctctcctgcaggaaatgcacgtgacccattttaggttttctctcgactgggctttgatcctgccactgggcaatcaaagtcaagttaatcatacaatacttcagtactacagatgtatggcctcagagctggtgagagttaacataaccccagtggtggcgctctggcagcccatggcccccaaccagggcttaccgcggctgctggcccgacagggggcttgggagaacccgtacacagctctcgccttcgccgaatatgcccggctgtgcttccaggagctgggacaccacgtgaagctctggataacaatgaatgagccctacactcgcaatatgacttattcggccggacataacctgctgaaggcccatgccctcgcttggcatgtgtacaatgaaaaattccgccatgctcaaaacgggaagatctcaattgcgctacaggcagactggattgagcccgcctgccctttctctcagaaagacaaagaggttgccgaacgggttctagaatttgatataggatggctggccgagcctattttcggtagcggagactatccttgggtcatgcgggattggctgaatcagagaaataactttctgctgccctacttcaccgaagacgaaaaaaagctcattcagggcacctttgatttcttggccctgtcacattatactaccatcttggtggactccgagaaggaagatccaataaagtataacgattatctggaagtccaagaaatgacagacatcacctggcttaacagtccttcacaggtggctgtggtgccatggggtcttaggaaggtattaaactggctcaagttcaaatatggcgacctgcccatgtacattatttcaaatggcatcgatgatggcctgcatgccgaagacgaccaactgagggtgtactacatgcagaactacatcaacgaggccctgaaggcccacatcctggatggcataaatctctgtggttattttgcctatagctttaatgacaggaccgcaccacgattcggcctctataggtacgccgccgatcagttcgagccaaaagcctctatgaaacattatagaaaaattattgacagtaacggcttcccggggcccgaaacactggagaggttctgtcctgaagagttcactgtgtgcaccgaatgctcttttttccacactaggaaatctctgctggcttttattgccttcctcttttttgccagcataatctccctgtccttgatattttattattcaaaaaagggccggagaagttataag

SEQ ID NO: 15316 - DNA, 3036 bp, Artificial Sequence
  Description of Artificial Sequence: Synthetic coding sequence
atgccagccagtgctccacctagacgcccacgcccacctcctccatctctcagtcttttgctagtgctgttagggctcggaggccgcagactgcgcgcagagcccggggatggagcccagacatgggcaaggttctcccggcctccggcccccgaggctgcggggctgttccaaggaactttccctgatgggttcttgtgggccgttggctctgccgcttaccaaaccgaggggggttggcagcagcatgggaagggggcctctatctgggatactttcacacaccacccactagctccaccaggcgactctaggaacgcttctctgccactcggggcacctagcccccttcagccagctaccggagacgttgcctctgattcatataacaacgtcttccgggacacggaagcactgcgtgagctaggggttacacattatcgcttcagcatctcatgggcgcgcgtcctgcctaatggttctgctggagtcccaaacagggagggtctgaggtactaccggcggctgctcgaaaggctccgagagctaggcgtgcagcctgtcgtcacactctatcactgggacctgccacagcggctccaggacgcctacggcgggtgggctaaccgcgctctcgcggatcacttcagagactatgccgagctgtgcttcagacattttggtggacaggtcaaatattggatcaccattgacaacccctacgtggtggcttggcatggctacgctaccggtcggctggcccccgggattaggggctcaccccgcctggggtacctggtggctcataatctcctcctcgcccatgccaaggtctggcatctgtataacactagctttcgacccacccagggaggccaagttagtattgccctgagctctcattggatcaacccacgccggatgacggatcactctatcaaggagtgccaaaaaagcctggattttgttttgggctggttcgccaagcccgtctttatagatggcgactacccggaaagcatgaaaaacaatctgtcctcaatcctgcctgattttacagagagcgagaaaaagttcataaagggcacagccgattttttcgctctgtgctttggccctacactttcgttccaattgcttgaccctcacatgaaattccgacaactagagtcccccaaccttaggcagctgttatcctggatcgaccttgagtttaaccacccacaaattttcattgtggaaaacggctggtttgtgagcgggacaacaaagagagacgatgccaagtacatgtactatcttaaaaaattcattatggaaactcttaaggccatcaagctcgatggcgtcgacgtgatcggctatacagcctggtcactgatggacggctttgagtggcaccgcggttactcaatccgaagaggtcttttctatgtagactttctcagccaggacaaaatgctcttgcccaagagtagtgcactgttctaccagaagcttattgagaaaaatggcttcccccccttgcccgaaaaccaacctctggaaggaacatttccctgtgattttgcgtggggcgtggtagacaattatatccaggtggacacaacactgagccaattcaccgatttaaacgtgtatctgtgggacgtgcaccacagcaaaaggctgattaaggtcgatggagtggtgactaagaagcgcaaaagctattgcgtcgactttgccgccatacaacctcaaatagcactactgcaggagatgcacgtgactcatttcagattctcccttgattgggctctaattctccctcttggcaatcagtctcaggtgaatcacaccatcctacagtactacaggtgcatggctagcgaacttgtgcgcgtgaatatcacgcccgttgtggctttgtggcagccaatggcacccaatcagggactgcctcggctgctggcccgccagggcgcttgggagaacccctacacagctctggcctttgcggagtacgcaagattgtgcttccaggagctaggccaccatgtgaaactgtggataactatgaacgagccttacactcgaaacatgacatactccgctggccacaacctgttaaaagcccatgcgctggcatggcatgtgtataacgagaaattccggcacgcccaaaacggcaagattagcatcgccctgcaagccgactggatcgagccggcttgtccattcagtcagaaggataaggaggtggccgagcgcgttctagaattcgacataggctggctagccgaaccaatctttggtagtggggactatccttgggtaatgcgcgactggttaaaccagcgaaataactttctcctgccatattttactgaagatgaaaagaaacttattcagggtacatttgacttcctcgctctctcacattacacaactatcctggtagattcagaaaaagaagacccgataaagtacaatgattacctggaagtccaggaaatgacagacatcacgtggttgaactctccttcacaggtggctgtggttccttggggcctcagaaaggtacttaattggctgaaatttaaatacggtgatctgccgatgtacatcatcagcaatggcatcgatgatggcctgcatgctgaagacgatcagctgcgagtctactacatgcaaaattatataaatgaagccttgaaggcacatattctggatggaatcaatctgtgtggctactttgcctactccttcaatgaccgcacggctcctcggtttggtctttaccgatacgctgccgaccagttcgaacccaaagctagtatgaaacactatagaaagattatcgatagcaacgggttccctgggcccgaaactttggaacggttttgtcccgaggaattcactgtgtgtaccgagtgcagctttttccatacgaggaagtccctcctggctttcatcgcttttcttttcttcgcaagcatcatttccctctcactcatcttctattattccaaaaagggtcgaagatcttataaa

SEQ ID NO: 15317 - DNA, 3036 bp, Artificial Sequence
  Description of Artificial Sequence: Synthetic coding sequence
atgcccgctagtgctccgcctagaaggcccaggccccccccaccgagtctatcgctcttgctggtcctcctgggcctaggaggccgccgactacgcgctgagcctggggacggtgcgcaaacatgggccaggttttcgaggccccccgcgcccgaggccgcagggctcttccagggaacatttccagatggatttctctgggctgtgggaagcgcagcctaccagactgagggaggctggcagcagcacggaaaaggcgcttcaatctgggacaccttcacccatcacccactcgctcctcccggagactcaaggaacgcgtcgctccccctgggagccccctctcccctacagcccgctacgggcgatgtggcatccgacagttacaataatgtgtttagggacactgaggctttaagagagttgggagtgacgcactaccgctttagcatctcctgggcccgggtgcttccgaacgggtcagcgggcgtgcccaatcgggagggcttgcgctactatcgccgtctgttggaaaggctgagagagctgggagtgcagcccgtggttactctgtatcattgggacttacctcagcgcttgcaggacgcgtacggaggatgggccaaccgcgcactggctgaccacttccgcgattacgctgaattgtgttttcgccatttcggcggccaggtgaaatactggattaccatcgataacccttacgttgtggcttggcatggctacgctacgggccggcttgcccctggaatacgaggaagtccgcgcctggggtatctcgtcgctcacaaccttctgctcgcacacgccaaggtatggcacctctacaatacatctttcaggccaacgcagggtggccaggtcagcatcgcgctgagttcacactggattaatccccgccgcatgacagaccactccatcaaggaatgccaaaagagccttgactttgtcctgggctggttcgcaaagcctgtctttatagatggcgattaccctgaatccatgaagaacaatctgtcctctatattgcctgattttaccgagtccgaaaaaaagtttataaaggggacagctgacttcttcgcactttgtttcggccctaccctgagtttccaactcctagatcctcacatgaagttccgccagctcgagtcgcccaatctcaggcagcttctgtcttggatagatctcgaatttaatcacccacaaatcttcattgtggagaatggttggtttgtatctggcacaactaagcgggatgatgcgaaatatatgtactacctaaaaaagttcatcatggagacacttaaggctattaaactggatggcgtggacgtgattgggtacacagcttggagtctgatggacggattcgaatggcacaggggatacagcatccgacgcgggctattttatgtagatttcctgtcccaggacaagatgcttctacctaagagctcggcgctcttttaccagaagctgatcgaaaagaacgggtttccaccacttccagaaaaccagcctcttgagggaacgttcccctgcgacttcgcctggggggtagtggataactacattcaggtggataccacattatcacaatttactgatttgaatgtctacctttgggatgtgcatcattctaagagattgattaaagtcgacggagtggtgacaaagaaacgcaaaagttactgcgtagattttgccgcaatccagccacagattgccttgctacaggagatgcacgtgacacactttcgatttagtctggattgggccctgattctgccactggggaatcagtcccaggtgaaccacacaatcttacagtactatcggtgcatggcctctgagttggtcagggttaatatcacaccagtcgttgctttgtggcagcctatggctcccaatcaagggttaccaagacttctggcacggcagggggcctgggaaaatccttatacagcccttgccttcgctgaatatgcccgtctgtgtttccaggagttggggcaccacgtgaagttgtggatcaccatgaatgagccctacaccagaaatatgacctactccgcaggacacaacctactgaaggcacacgccctcgcatggcatgtgtacaacgaaaagttcaggcacgcacagaatgggaagatatcaatcgctctgcaagctgattggatcgaacctgcttgcccgtttagtcaaaaggataaggaggtggcagaacgcgtgctggagttcgatatcggctggcttgccgagcctatttttggctccggcgattatccatgggtgatgcgtgactggttaaaccagcgcaacaactttcttttaccatattttaccgaggatgagaaaaagttgatccagggcacattcgattttctggccttgagccactatactacaatcctggttgactcagagaaagaggatcctattaagtacaacgactatttggaggtgcaggaaatgacggatatcacctggctgaattcaccgagtcaggtagccgtagtcccatggggcttgcggaaagtgctaaactggctcaagttcaagtacggcgacctccccatgtatattatctccaacggaatagatgatggactgcatgccgaagacgaccagttaagggtttactacatgcagaactatataaatgaggctctgaaagcccacatcctggatggtatcaatctctgtggctatttcgcatactcttttaatgaccgaaccgctcctcgcttcgggctgtacagatatgccgcagaccagttcgagcctaaagccagtatgaaacactaccgcaaaatcatcgactctaacgggtttccggggcccgagaccctcgagcggttttgccccgaggaatttactgtctgtaccgagtgctctttcttccacactcgaaaatcgctgctagcttttatcgccttcctgttctttgcttccattatatcactcagccttattttctactactcgaagaagggtaggcggtcttacaag

SEQ ID NO: 15318 - DNA, 3036 bp, Artificial Sequence
  Description of Artificial Sequence: Synthetic coding sequence
atgcctgcaagcgcgcccccacgccgaccccgccctccaccaccatccctgtctttacttctggtcctcttaggcctgggtggccgccggctgcgcgctgagcccggcgacggcgcacagacctgggcacgattctcccgcccccctgctcctgaggcagccggcctcttccagggaaccttcccagacggtttcctctgggccgttggctcagcagcttatcagacagaagggggatggcaacagcatgggaaaggcgcctctatatgggatacgttcactcatcatccactggcaccacccggcgattcacgcaatgccagtctccctctgggggcgccgtcccccctgcaaccggccacaggcgacgtggcctcggacagttacaacaatgtatttagggatactgaggccctgcgggagttgggggtaacacactaccgcttttcaatctcctgggcccgggtgctgcccaatgggagcgctggtgtgcccaaccgcgagggtctgagatattacagaaggctgttagaaagactaagagaattaggtgtgcagccagtggtgacattataccactgggacctgccccagcgcctgcaggatgcgtacggaggctgggcaaatcgcgcgctggctgaccactttagggactacgcagagttatgctttcgccacttcggtggccaggtgaaatactggattacgattgataatccgtacgtggtggcatggcatgggtacgctacaggccgattagcccctggtattcggggcagcccgcggctgggctacttagtcgcacataacctgcttctcgctcacgccaaagtttggcatctctacaatacctcattccgcccaacacagggggggcaggtgtcaattgcgctgtcctcacactggattaaccctaggaggatgactgatcattccattaaagaatgccagaaatctttggattttgtactgggctggttcgccaagcccgtgttcatcgacggggactaccccgagtccatgaagaacaacctgagcagtatcctcccagacttcactgagagcgagaagaagttcatcaagggcaccgccgactttttcgctctttgtttcggacctactctgtctttccagctgctagacccgcatatgaagttccggcaactggagtcacctaacctgaggcagctcctgagctggattgacctagagtttaaccacccccaaatttttattgtcgaaaatgggtggtttgtgagcgggaccactaagcgcgacgatgccaaatatatgtactacctcaagaagtttattatggagaccctgaaagccattaaactggatggagttgacgtcatcgggtataccgcatggtcactgatggacgggtttgaatggcaccgcggatactccatccgccgcgggttattctacgtggatttcctatcacaggataagatgttgctgcctaagtcctccgccttattttaccagaaactaattgaaaagaacggattcccccccctgcccgaaaaccagcctctggaaggcacatttccctgcgattttgcatggggagtcgtcgataactatatacaggtggatactaccctgtcccagttcaccgatctaaatgtctatttatgggacgtccaccactcaaaacgactgataaaggtggacggggtggtcacaaaaaaaaggaaatcatactgtgtggattttgccgccatccagccccagatcgccctccttcaggagatgcacgttactcacttccggtttagcctcgactgggcgctgatcctgccactggggaatcagtctcaggtaaaccacaccatcctgcaatactataggtgcatggcttccgagctggtcagagtcaatattacccctgttgtggctctctggcaacctatggcacctaatcagggactgccaagactgctggccaggcagggggcctgggaaaacccctacaccgccctcgctttcgcagagtatgctagactctgctttcaggagttggggcatcatgtgaaattgtggattaccatgaatgaaccatatacccggaatatgacctatagtgcgggccataacctcctgaaagcccacgctctggcttggcatgtttataacgaaaaattcaggcacgcccagaatggaaagatatccattgctcttcaagcagattggatagagcccgcctgcccctttagccaaaaggataaagaggttgcagaacgtgtgcttgaatttgacatcggttggcttgcggaaccaatcttcggctccggagattatccttgggtaatgcgtgactggctgaatcagaggaacaactttcttctgccctatttcacagaagacgagaaaaaactgatccagggaacatttgatttcctggcactcagccactacaccacaatcttggtggactcagaaaaagaagaccccattaagtataacgattacttggaggtgcaggagatgaccgatatcacttggctaaacagcccatcacaggtggccgtggtgccatggggcttgcgtaaagtgctgaactggctgaagtttaagtatggagatttgcccatgtatatcatctcaaatgggattgacgacggactgcacgctgaagatgaccagctcagggtgtactacatgcagaactatattaacgaggcgctgaaggcccatattctagatgggattaatttgtgtgggtacttcgcttactccttcaacgatcgcacggcacccagatttgggttgtataggtatgcggccgaccagttcgagcctaaggcttctatgaaacactatcggaagataatcgatagcaacggattccctggcccagagacattggaaagattctgcccagaggagttcacagtctgtaccgagtgttccttcttccacacacggaagtcactcctggctttcatcgctttcttgtttttcgccagcatcatctccctgtctctgattttctattattctaaaaagggacgaaggtcctataag

SEQ ID NO: 15319 - DNA, 3036 bp, Artificial Sequence
  Description of Artificial Sequence: Synthetic coding sequence
atgccagctagcgctcctcctcggcgccctaggcctcctccaccgtctttgtcattgctgctcgtgctgctggggctggggggccgaaggctgagagcagagcccggcgatggggcccaaacttgggcaaggttctcacgtccccccgctccggaagctgccgggctgtttcagggcacattcccagatggtttcctttgggctgttggcagtgccgcatatcaaacagagggcggatggcagcaacacggtaaaggagcgtccatctgggacacatttacacatcaccccttggcaccacctggagactctaggaacgctagtctcccacttggggcacccagtccactccagccggccaccggcgatgtagctagcgatagctataataacgttttcagggataccgaggctctcagagaactcggggtgacgcattaccgattttccatctcctgggcacgggtgctgcctaatggatctgctggagtgccgaaccgtgaggggttgcgttactacagaagactgctggagaggcttcgggaactgggcgtccagccagtggtcaccctttaccattgggacttacctcagcgactccaggacgcttatggcggctgggcgaatcgggccttggccgaccactttagggattacgcggaattgtgttttagacactttggtggacaggttaagtactggataacaatcgacaatccttacgtagtcgcctggcatggctacgcgaccgggcgcctggcacccgggatccgcggaagcccaaggctcggttacctggtggcccataatctgctgctcgcgcacgcaaaggtctggcacttgtacaacacctcgtttcgaccgacacagggcgggcaagtgtctattgccctctcctcacactggataaacccaagacggatgacagaccatagtattaaggaatgccagaaaagtttggatttcgtgctgggctggttcgcgaagccagttttcatcgacggagactaccccgagtcaatgaagaacaacctgagcagtatcctgccagatttcacagagagcgagaaaaagttcatcaaagggaccgccgacttttttgccctgtgttttgggcccacgttgagttttcaacttctcgatccacacatgaagtttaggcaattagagagcccaaacctccggcagcttttatcctggatcgatctggaattcaatcatcctcagatctttatagtcgagaatggctggtttgtgtccggaaccaccaagcgtgacgatgctaagtacatgtattatttgaagaagtttatcatggaaaccctgaaggcgatcaaactggacggtgtggacgtcatcggatatacagcatggagcctaatggacggcttcgagtggcaccggggatacagcatccgtcgaggtctcttctacgtggactttctgtcccaggacaaaatgctcctacccaagtcctctgccctcttttatcagaaactgattgagaagaatggctttccgcctctgccggagaatcagccccttgagggaacatttccatgcgatttcgcctggggcgttgtggacaactatatccaagtggacacgacccttagccaatttactgacctcaatgtctacctctgggacgtgcatcactccaagcggctgatcaaggtcgacggcgtcgtgaccaagaaaagaaagtcctattgtgtagatttcgctgcgattcaaccacagatcgcactcctccaagagatgcatgtgactcacttccggttctccctagactgggccttaatccttcctttaggcaaccagagccaggtgaaccacactatactgcagtattatcggtgtatggcctctgaactcgttcgcgtcaatatcacccctgtggtcgcgctgtggcagccgatggccccgaaccaggggttaccaagacttctggccagacaaggtgcctgggaaaacccatatactgcactggcattcgccgagtacgccaggctctgtttccaggagctgggacatcacgtgaagctgtggatcacgatgaacgagccatacaccaggaacatgacatatagcgcagggcacaatctcctgaaagcccatgcccttgcatggcatgtgtacaacgagaaattcaggcatgcacaaaatggcaagatcagtatagccctccaggccgactggattgagccagcgtgccctttctcccaaaaggataaagaggtcgcagagagagtgctcgagttcgacatcggctggctcgcagaacctatattcggctcaggggactacccttgggtgatgcgggattggctgaatcagcgtaacaacttcctcctcccatattttactgaggacgagaaaaagctgatccagggtacctttgatttcctcgccctttcacactacactaccatcctggtggacagcgagaaagaggatcccatcaaatacaatgattatctagaggtgcaggaaatgacagatattacttggctcaactcaccctcccaggtggccgtggtgccctggggcctacgcaaagtgctgaattggttgaaattcaaatacggcgatctgccaatgtatattattagtaacggaatcgatgatggtctgcacgcagaagacgatcaattgagggtgtattatatgcagaactatattaatgaggcccttaaggcacacattttggacggtatcaatctgtgtggctacttcgcctattcattcaacgatagaactgccccacgattcggcctatataggtatgcagctgatcaattcgagcctaaagcatcaatgaagcactacaggaagattattgatagtaacggtttcccgggtccagagacactggagcgtttttgccctgaagagttcacagtctgcactgagtgctctttcttccacaccaggaagtctctgctcgcttttatcgcctttctgttttttgcatcaatcatttccctctccctgatcttctattattccaagaaaggccgcagaagttacaag

SEQ ID NO: 15320 - DNA, 3036 bp, Artificial Sequence
  Description of Artificial Sequence: Synthetic coding sequence
atgcccgcctcagccccgcctagaagacctagaccaccccccccttcgctgagcctcttactggtcctgcttggtctgggcgggcggcgactccgcgctgaaccgggcgacggcgctcagacctgggccagattttcccgtccaccggccccggaagctgcaggcctcttccagggcacatttcctgacggatttttatgggcggtgggtagcgccgcctatcaaaccgaaggaggatggcagcagcacgggaagggagcgagcatttgggacaccttcacacatcatcccctggctccacccggcgattccagaaatgcatctctccccttaggtgcaccttcgccgctccaacctgctacaggggatgtcgctagcgactcatataacaacgtgttcagagatacagaggccctgagagaactgggtgtcacccattatcgcttttccatcagttgggcccgagtgctgcctaatgggtcagctggcgttccaaatcgcgagggcctaaggtactaccggcggcttttagaacggctgcgcgagcttggggtgcagccggtggttaccttgtaccactgggacttaccccaaagactgcaggacgcatacggcggatgggccaaccgagccctggccgatcactttagggactacgcagagctctgcttcagacacttcggagggcaggtaaaatattggataaccattgacaacccgtacgttgtcgcctggcacggttacgccacaggcagactggcgccaggcatccgcgggtctccccgacttggctatctggttgctcataatctgttgttggcgcatgcaaaggtctggcacctctacaacacctcctttaggcccacccagggtggacaggtgtccatcgccctgtctagccactggataaacccgcgacgcatgacagatcacagtattaaggagtgtcagaagtcactcgatttcgtcctcggatggttcgctaaacctgtcttcattgatggggactaccccgaatctatgaagaacaacctgtcatccattttaccggatttcaccgagtctgaaaaaaaatttatcaaaggtactgccgacttcttcgcactgtgcttcggacccaccctgagcttccaactcctcgaccctcatatgaaattccggcagctagaatctccgaatcttaggcagttgctttcttggatagatttggagttcaatcaccctcagatcttcattgtggagaatggttggtttgtgagcggtaccacaaagagagacgacgcgaagtatatgtactacctaaagaaatttatcatggagaccctgaaggccatcaagctggacggcgtggatgttataggttataccgcttggagcctgatggatggattcgagtggcatagaggctatagtatcagacgtggcctattttacgtggacttcctgtcccaggacaagatgcttttgccaaaaagtagtgccttgttttatcagaagctcatcgagaagaatggattcccacctctgccagagaaccagccattagagggaacatttccttgtgatttcgcttggggcgtggttgataattacatacaagtggacactaccctgagccaatttacagacctcaacgtgtatctatgggacgtgcaccattcgaaaagacttataaaggtggacggagttgtcacaaaaaagaggaaatcatattgtgttgacttcgctgctatccaaccacaaatagctctgcttcaggagatgcacgttacccacttccgcttttcgctcgattgggcactcatcttgcccctcggcaaccagtcacaggtgaatcacacgatcctgcagtactataggtgcatggcaagtgaactggtccgcgttaacatcacccccgtggtggcactttggcagcctatggctccgaaccagggcctgcccaggctccttgcgcgacagggcgcatgggagaatccttataccgcactagccttcgccgaatacgctaggttgtgctttcaggagctgggtcaccacgtcaaactatggatcactatgaatgagccgtacaccagaaacatgacctactcggcgggtcataacctcctgaaggcccacgccttggcgtggcacgtgtacaacgagaaatttagacatgcccaaaacggtaagatcagcatcgccctccaggcggactggattgaaccagcttgtccgttttctcaaaaggacaaggaagtggcggagcgggtgctggagttcgatattggttggctcgccgaacccatcttcggcagcggcgattatccttgggtgatgcgcgactggttgaatcagcgaaacaacttccttctgccatattttaccgaggacgaaaaaaagctcattcaggggacctttgactttttggcgctgtctcactacaccaccatactggtggacagtgaaaaggaggatccaataaagtacaatgattacctggaggttcaggagatgacggacatcacctggttgaatagccccagtcaggtggcagtagtaccctggggccttcgcaaagtgctcaattggctgaaattcaagtatggagatctgcctatgtatattatttctaatggcatagacgacgggctacacgctgaggacgaccagttgcgggtttattatatgcagaattacattaacgaggctctgaaagcccacatcctcgatggcatcaacctttgcgggtactttgcatactccttcaacgaccggactgccccaaggttcggactgtacaggtacgcggctgatcagttcgaacctaaggccagcatgaagcactataggaagatcatcgactctaatggtttccctggccccgaaaccctggaacgcttctgtcctgaggaattcaccgtgtgtaccgaatgcagcttcttccatacccgcaagagcctcttggccttcatagctttcctgtttttcgccagtattatttctctgtcccttatattttactactccaaaaaaggacggcgctcatataag

SEQ ID NO: 15321 - DNA, 3036 bp, Artificial Sequence
  Description of Artificial Sequence: Synthetic coding sequence
atgccggcgtcggcgccgccgcgtcgaccgcgaccgccgccgccgtcgctatcgctattactagtattattaggtctaggtggtcgtcgactacgagcggaaccgggtgatggtgcgcaaacgtgggcgcgattttcgcgtccgccggcgccggaagcggcgggtctatttcaaggtacgtttccggatggttttctatgggcggttggttcggcggcgtatcaaacggaaggtggttggcaacaacatggtaaaggtgcgtcgatatgggatacgtttacgcatcatccgttagcgccgccgggtgattcgcgaaatgcgtcgttaccgttaggtgcgccgtcgccgttacaaccggcgacgggtgatgtagcgtcggattcgtataataatgtttttcgagatacggaagcgttacgtgaactaggtgtaacgcattatcgattttcgatatcgtgggcgcgagttctaccgaatggttcggcgggtgtaccgaatcgagaaggtttacgatattatcgtcgactactagaacgtctacgagaattaggtgtacaaccggtagtaacgctatatcattgggatttaccgcaacgtttacaagatgcgtatggtggttgggcgaatcgagcgctagcggatcattttcgagattatgcggaactatgttttcgacattttggtggtcaagttaaatattggataacgatagataatccgtatgttgtagcgtggcatggttatgcgacgggtcgtttagcgccgggtatacgaggttcgccgcgactaggttatctagttgcgcataatttactattagcgcatgcgaaagtatggcatttatataatacgtcgtttcgaccgacgcaaggtggtcaagtttcgatagcgttatcgtcgcattggataaatccgcgacgaatgacggatcattcgataaaagaatgtcaaaaatcgttagattttgtactaggttggtttgcgaaaccggtttttatagatggtgattatccggaatcgatgaaaaataatttatcgtcgatattaccggattttacggaatcggaaaaaaaatttataaaaggtacggcggatttttttgcgttatgttttggtccgacgttatcgtttcaattactagatccgcatatgaaatttcgtcaattagaatcgccgaatttacgtcaattactatcgtggatagatttagaatttaatcatccgcaaatatttatagtagaaaatggttggtttgtatcgggtacgacgaaacgagatgatgcgaaatatatgtattatttaaaaaaatttataatggaaacgttaaaagcgataaaattagatggtgtagatgttataggttatacggcgtggtcgttaatggatggttttgaatggcatcgtggttattcgatacgacgtggtctattttatgtagattttttatcgcaagataaaatgctattaccgaaatcgtcggcgttattttatcaaaaactaatagaaaaaaatggttttccgccgttaccggaaaatcaaccgctagaaggtacgtttccgtgtgattttgcgtggggtgttgtagataattatatacaagttgatacgacgttatcgcaatttacggatttaaatgtatatttatgggatgtacatcattcgaaacgtttaataaaagtagatggtgttgttacgaaaaaacgtaaatcgtattgtgttgattttgcggcgatacaaccgcaaatagcgctactacaagaaatgcatgttacgcattttcgtttttcgctagattgggcgttaatattaccgctaggtaatcaatcgcaagtaaatcatacgatactacaatattatcgttgtatggcgtcggaactagtacgtgttaatataacgccggtagtagcgttatggcaaccgatggcgccgaatcaaggtttaccgcgattattagcgcgtcaaggtgcgtgggaaaatccgtatacggcgttagcgtttgcggaatatgcgcgtctatgttttcaagaattaggtcatcatgtaaaattatggataacgatgaatgaaccgtatacgcgaaatatgacgtattcggcgggtcataatctactaaaagcgcatgcgttagcgtggcatgtttataatgaaaaatttcgacatgcgcaaaatggtaaaatatcgatagcgctacaagcggattggatagaaccggcgtgtccgttttcgcaaaaagataaagaagttgcggaacgagtactagaatttgatataggttggctagcggaaccgatatttggttcgggtgattatccgtgggtaatgcgtgattggttaaatcaacgaaataattttttactaccgtattttacggaagatgaaaaaaaattaatacaaggtacgtttgattttctagcgttatcgcattatacgacgatattagttgattcggaaaaagaagatccgataaaatataatgattatctagaagtacaagaaatgacggatataacgtggttaaattcgccgtcgcaagttgcggtagtaccgtggggtctacgtaaagtattaaattggttaaaatttaaatatggtgatttaccgatgtatataatatcgaatggtatagatgatggtctacatgcggaagatgatcaactacgtgtttattatatgcaaaattatataaatgaagcgctaaaagcgcatatattagatggtataaatctatgtggttattttgcgtattcgtttaatgatcgaacggcgccgcgttttggtttatatcgatatgcggcggatcaatttgaaccgaaagcgtcgatgaaacattatcgtaaaataatagattcgaatggttttccgggtccggaaacgctagaacgattttgtccggaagaatttacggtatgtacggaatgttcgttttttcatacgcgaaaatcgctattagcgtttatagcgtttttattttttgcgtcgataatatcgctatcgttaatattttattattcgaaaaaaggtcgacgatcgtataaa

SEQ ID NO: 15322 - DNA, 3036 bp, Artificial Sequence
  Description of Artificial Sequence: Synthetic coding sequence
atgcctgcctctgcgcccccccgacggcccagaccaccacccccatctctgagtctattgctggtgctcctaggtctcggtggcaggcgtctgcgagccgagcctggggacggcgctcaaacatgggctagattctcaagacctcccgcccctgaggccgccggcctgttccagggcacttttcccgacgggtttctgtgggcggtaggttccgccgcctatcagacagagggagggtggcaacagcatggcaaaggcgcatcaatttgggatacttttacacaccaccctttggcacctccgggagacagtaggaatgcatctctacctctcggcgcaccttcccccctgcagcccgccacaggcgacgttgcgagcgactcctacaacaatgtcttccgagatacggaagctctgcgtgagctgggcgtgacacactatcgcttctctatcagctgggccagggttctgcctaatgggagcgctggggtcccgaatcgagagggtctgagatattatcgaaggttactggagaggctgagagagcttggcgttcagcccgtcgtcacactctatcactgggatctgccacagagactgcaggatgcttatggggggtgggcgaaccgagctctggctgatcattttcgagactatgccgagctgtgcttccgacattttggagggcaggtcaaatactggatcacaatagacaacccatatgtggttgcttggcacggatatgctacaggccgactggctcctggaattcgaggctcacccagattgggctatctggtcgcccacaacctgcttctcgctcacgcaaaggtgtggcatctctacaatacgtcattccgacccacacagggggggcaggtgtctatcgcattatcttcacactggatcaatccgagaaggatgaccgatcactccattaaagagtgtcaaaagagcctggacttcgtgcttgggtggttcgccaagcctgtgttcatcgatggagattatccagagtctatgaagaacaacttatcttcaattctgcccgactttaccgaaagcgagaaaaaattcataaagggcaccgctgatttctttgctctgtgttttggccccaccctgtccttccagctacttgatcctcacatgaagtttcgacaactcgagagtcctaatttaagacaactgctgtcctggatagatctggagttcaatcatccacagattttcattgtggagaacggatggtttgtgagcggtacgactaaaagggacgatgctaagtatatgtactacctgaagaagttcatcatggaaacactcaaggccattaagctggatggagtagacgtcatcggatacacagcatggtcactgatggatggtttcgaatggcaccgaggctacagtattaggaggggtctcttttacgtggactttctgagccaggacaagatgctgctgccaaaatcttccgctctgttctaccagaagctcattgaaaaaaacggcttcccacctctgcccgaaaaccagcctctcgaagggaccttcccctgcgatttcgcatggggcgtggtcgataactatatccaagtcgacacaacactgtcccagttcactgaccttaatgtatacctgtgggacgtgcatcattcaaaacggctcataaaagtcgacggcgtcgtcactaagaaaaggaagtcctactgtgtagacttcgccgcaattcagcctcaaatagccctgctccaagaaatgcatgtgacacacttcaggtttagtctggactgggccctcatcttgcctctgggtaatcagtcacaagtaaatcataccatcctccagtattacagatgcatggccagtgaactagtgagggtaaatataacacctgtcgtggcgctgtggcagcctatggcccccaaccaaggattgccacgactcctagcacggcagggagcatgggaaaacccttataccgctttagccttcgccgaatatgcccgactgtgcttccaggagctgggacatcacgttaaactgtggatcactatgaatgaaccgtataccaggaacatgacatattccgccgggcataatcttttgaaagctcacgccttagcttggcacgtgtacaacgagaaattccgacacgcccagaatgggaaaatctccatagcccttcaggccgactggattgagccagcctgcccttttagccaaaaagataaagaggttgccgagcgcgtgttagaatttgatattggctggctagcagagcctatcttcggcagcggcgactatccctgggtgatgcgagattggctgaatcagcggaataatttccttctgccatatttcacggaggacgagaaaaaactgattcaggggactttcgacttcctggcactttctcactacaccaccatcttggtggattcagagaaagaggatccaatcaaatacaacgactatctggaagtccaggaaatgacagacattacttggctgaattcacctagccaggtggccgtcgtaccctggggcttgagaaaagtgttgaactggctcaaatttaagtacggcgatctgcccatgtatatcatatctaacgggatcgacgacgggctgcatgctgaagatgatcagctcagggtatattatatgcagaactatatcaatgaggcattaaaagcccacattctggatggcatcaatctctgcgggtactttgcttattccttcaatgaccgcacagcacctcgctttggattgtataggtatgcagcggatcagtttgaacccaaagcatccatgaagcattatcgaaaaatcatcgactctaatggattccccgggcccgagaccttggagagattttgcccagaagaatttactgtgtgtacggagtgcagcttttttcataccagaaagtctttactcgcctttatcgcgtttctgttcttcgcatctataatcagtttaagcctcatcttttattactctaagaagggaagaaggtcctataaa

SEQ ID NO: 15323 - DNA, 3036 bp, Artificial Sequence
  Description of Artificial Sequence: Synthetic coding sequence
atgcccgcctcggccccgcctagaaggcctcggccaccaccgccctcactgtctctgctgttggtgctcctagggttgggaggcagacgcctgcgtgccgagccgggagatggtgcgcagacctgggctcggttctccagaccccccgcaccggaagcagcgggtctattccagggcactttccctgacggttttctgtgggctgtgggaagcgctgcctatcaaactgagggtggttggcagcagcacggcaagggggcgtccatctgggacaccttcactcaccatccccttgcgccccctggcgattcaagaaatgcctcgctcccccttggcgctccatctcccctccaaccagcaacgggtgacgtcgcatctgactcctataataatgtatttcgcgacacagaagccctcagagaattgggcgtaactcactataggttttcaatttcttgggcacgggttctcccaaacggatctgctggcgtgccgaatagagaaggactgcgttattatagacggctgctggagcgcctgagggaactgggagtccagccggtggtgacgctttatcattgggacctccctcagaggctccaggatgcctacggtggatgggcgaacagggcgttagcggatcatttccgagactacgctgagttgtgctttaggcattttggcgggcaggtgaagtattggattactatcgataacccgtatgttgttgcatggcacggttatgccacagggcggttggctcctgggatccggggtagcccccgcctgggttatttggtcgcccataatctgctcctcgctcacgccaaggtgtggcatctgtacaatacttcttttaggccaacgcagggaggccaagtgtcgatcgcattgtcctcccattggattaaccctagaagaatgactgatcacagcataaaagagtgccagaagtccctggacttcgtccttgggtggtttgccaaacccgtcttcatcgatggtgactaccctgagtcaatgaaaaacaacctttctagtatcctgccagacttcacagagagcgagaagaagttcatcaaaggaaccgccgacttttttgcactgtgctttgggcccacgctaagtttccagttgctggatccgcatatgaaattcaggcagctcgagtctccgaatctccgccagctcctcagctggattgatttggaatttaatcaccctcaaatcttcatcgtggagaatggttggtttgtctcaggaacaaccaagcgggatgacgcgaagtacatgtactatctgaagaagtttattatggagacactaaaggccatcaaactggatggcgttgacgtgattggctatacagcttggagccttatggacgggttcgaatggcacagaggctatagcattcgtcggggtctgttttacgtcgatttcctgagtcaggataagatgctgctgccaaagagctccgccctgttctatcaaaaactaatcgagaagaatggcttcccgcccttacctgaaaatcaacccttagaggggacttttccttgtgattttgcctggggagtcgtggataattacatccaagtggacaccactttgagccagtttaccgaccttaatgtctatctgtgggacgtgcatcattcgaaaaggctgataaaagtcgacggcgtggttaccaaaaaaaggaagagctattgtgtcgacttcgccgcaatccagccacagattgccctcctgcaggagatgcacgtgactcatttcaggttctcgctggattgggctctgatactgccactgggaaatcaatcccaggtgaaccacacaatcctccagtactacagatgcatggcttcagagcttgttcgggttaacataacccccgtggttgcactatggcagcccatggccccaaaccaggggctgccgcggctgttggcaaggcagggagcgtgggaaaatccctatactgccctcgcgtttgcggagtatgcacgtctgtgttttcaggaactggggcaccacgtgaagttgtggataacaatgaatgaaccatataccagaaatatgacatactcggcagggcacaacctgcttaaagcacacgcgttggcgtggcacgtttacaacgagaaatttcgtcacgctcagaacgggaagatatctatcgccctgcaggccgattggattgagcctgcgtgcccattctcccagaaagataaggaagtcgccgaaagagtgctggaatttgacatcgggtggttggcggagcccatatttgggtctggtgactacccatgggtgatgcgggattggctcaatcaaagaaacaacttcctcctgccttattttactgaagatgaaaaaaagctcatccagggaacctttgacttcctggccttgtctcactacaccaccattcttgtggacagcgaaaaagaggatcccattaagtacaatgactatctcgaagtgcaagagatgactgacatcacctggctcaacagtcctagccaggtggcggtcgtgccatggggtctgcgaaaggtgctaaactggttgaaatttaagtatggcgacctccccatgtatataatatctaatggcatcgacgacggcctccatgccgaggatgaccagctgcgtgtgtactacatgcagaattacattaacgaagcccttaaggcgcatatactagacggtatcaatctgtgtgggtatttcgcctactcgttcaatgaccggacagcgcctaggtttgggctgtatcgatatgcggcagatcagttcgaacccaaagcttcaatgaaacactatcgcaaaatcatcgacagtaacggttttcctgggccggagacactggaaagattctgcccggaagagtttactgtctgtaccgagtgttccttttttcatacgcggaagtcactgttggcgttcatcgccttccttttcttcgcgagcattattagtctcagcctgattttctattatagcaaaaaggggcgccggtcatacaag

SEQ ID NO: 15324 - DNA, 3036 bp, Artificial Sequence
  Description of Artificial Sequence: Synthetic coding sequence
atgccagcctccgcccccccccgccggcccaggcccccaccaccctctctttccttattgctggtgctccttggccttggtggacgtcgactacgggctgaacctggagatggtgcccagacctgggcaagattttcacgccctcccgcccccgaagccgccggcctatttcaaggaacttttcccgacggttttctctgggctgttggctccgcagcctatcagacagagggagggtggcaacagcacgggaagggagctagcatttgggacacattcacccaccacccgcttgcacccccaggcgactctcgaaatgcctcactccccttgggtgctcccagcccactgcagcccgcaacaggcgacgtggcttctgatagttacaacaacgtctttcgagacacagaagctcttcgagaactcggcgttactcattaccgtttttctatttcatgggctcgggtcctgccaaatggtagcgccggagtgccgaatagagagggactccgctattatcggcgacttttagagaggttgcgcgagctcggcgtccagcctgttgtcacgttatatcactgggatttgccacagagactgcaagatgcttacggcggttgggccaaccgtgcactggcggatcatttccgggactatgctgagctgtgtttccgacacttcggaggtcaggtgaagtactggatcactattgataacccctacgtggtggcgtggcacggctatgccactggcagactcgctcctggtatccgtgggtctccacgtctgggctacctggtggcacacaatctgctgttggcccacgcaaaggtgtggcatctttacaatacttccttcaggcccacgcagggagggcaggttagcatcgccctcagcagtcactggataaacccccggcggatgactgaccactccatcaaggaatgtcagaagtccctggatttcgtcttgggctggttcgcaaagccagtgttcattgacggtgactaccctgagtcgatgaagaataacctgtctagcatcctccccgattttactgaatcagaaaagaagttcatcaaggggacagcagatttcttcgcgctgtgttttggacccactttgagcttccagctgctggacccccatatgaagtttaggcagcttgagtcacccaacctgcgccagctgctgagctggatcgacctggaatttaatcacccacaaatttttattgtcgaaaacggctggttcgtctcaggcaccacaaagcgcgatgatgccaagtatatgtactacttaaagaagtttataatggagacactaaaggccattaagcttgatggtgtggatgtgatcggctacaccgcttggagcctcatggatggtttcgaatggcaccgtggttactcaatacggcgggggctgttctacgttgactttctaagccaggacaagatgctgctacctaaaagcagtgcattgttctatcagaagctcattgagaagaatgggtttccccccctgcctgaaaatcagcccttggaagggacctttccatgcgacttcgcctggggggtcgtggacaactacatccaggtcgatacgaccctttcccaattcacagacttgaacgtgtatttgtgggatgtgcaccattccaaaaggctgattaaagtcgacggtgtggtcaccaaaaagaggaagtcatattgcgtggactttgccgcaattcagcctcagatcgctctcctgcaagagatgcatgtgactcacttcagatttagtctggattgggccctgattctgccacttggaaaccagtcccaggtgaatcataccatcctccagtactacagatgtatggcttctgagcttgtccgcgttaatataacccccgtggtggccctgtggcagcctatggcacccaaccagggattaccccgcctactcgctcggcaaggggcttgggagaacccttatacggcattggctttcgcagagtacgcccggctgtgcttccaggagctaggccaccatgtcaaactgtggataacaatgaacgaaccatatacccggaatatgacttattccgcaggacacaacctcctgaaggcccacgcattggcatggcacgtgtacaacgaaaagtttagacatgcccaaaacgggaagatctccattgccctgcaggccgattggatcgaacccgcttgcccgtttagtcagaaggacaaagaggtcgcagaaagggtactggagtttgacattggctggctggccgaaccgatttttgggagcggtgactatccatgggtgatgagggactggttgaaccagaggaacaattttcttctaccttacttcacagaagacgagaagaaattgatccaggggacgttcgacttcctggcactcagtcactataccactattctggtggactcagaaaaggaggatccaatcaagtacaatgattatctggaagtgcaggaaatgaccgacattacctggttaaattctcctagccaggtggcggtcgtgccttgggggctcagaaaggtcctgaactggctcaaatttaagtacggggatttaccaatgtacattattagcaatgggatagatgacggcctgcacgcagaagatgatcagctgcgcgtctactatatgcagaactacatcaatgaagctctcaaggcccacatcttggatggcatcaatctgtgcggatacttcgcttactcttttaatgaccggaccgcgccgcggttcggtctgtatcgctatgcggccgaccagttcgagcccaaggctagcatgaagcactatcgcaagattattgatagtaatggttttcccggcccggagacgcttgagcggttttgccctgaggaatttactgtgtgtactgagtgctcctttttccatacaaggaagtccctgttggcctttatcgctttcctcttctttgccagtataatttcccttagcctgatcttctattactcgaagaaagggaggcgctcctataaa

SEQ ID NO: 15325 - DNA, 3036 bp, Artificial Sequence
  Description of Artificial Sequence: Synthetic coding sequence
atgcctgcttcagcaccacctcgaagaccaagaccaccaccaccaagtttatcacttcttttagttcttttaggattaggaggaaggagacttcgtgctgagccaggggacggagctcaaacttgggcaagattttctagaccaccagcaccagaagcagctggacttttccaaggaacttttcctgatggttttctttgggcagtaggtagtgcagcttatcaaacagagggaggatggcaacaacatggtaagggagcatcaatttgggacacgtttacacaccatccattagcacctcctggtgatagtcgaaatgcttctttaccattaggtgctccatctccattacaaccagcaacaggagatgttgcatcagattcatataacaacgtttttagagatactgaagctttaagagaattaggagtaacacattacagattttccatttcatgggcaagagttcttccaaatggatccgcaggtgttccaaatagagaaggattaagatattatagacgattacttgaaagacttagagaattaggtgttcaaccagtggttacactttatcattgggatcttcctcaaagattgcaagatgcttacggaggttgggcaaatcgtgctcttgcagatcattttagagattatgctgagttatgctttagacattttggaggacaagtgaaatattggattactattgataatccatatgtagtcgcatggcatggatatgctactggaagattagctccaggaattagaggatctccaagattaggatatttggtagctcataatcttttacttgctcatgctaaagtgtggcatctttataatacaagttttagaccaacacagggaggacaggtatcaatagcattaagttcacattggattaatccaagaagaatgactgatcattcaattaaggaatgtcaaaaatctttagattttgttttaggttggttcgcaaaaccagtttttattgacggagattatccagaaagtatgaagaataatttaagtagtattttacctgactttacagaatcagaaaagaaatttattaagggaactgcagatttctttgctttatgttttggtccaacacttagttttcaacttcttgatcctcatatgaaattcagacaattagaatcacctaatttaagacaattactttcatggatagatttagaatttaatcatccacaaatcttcattgtagaaaatggttggtttgtttcaggaaccacaaagagagatgatgctaaatatatgtattatcttaagaaatttattatggaaacattaaaagctattaaacttgatggagtcgatgtcatcggatatactgcctggtccttaatggatggatttgaatggcatagaggttatagtattagaagaggattattttatgtagattttttatctcaagataagatgttattacctaagtcatcagctttattttatcaaaagttaattgaaaaaaatggttttccaccacttccagaaaatcaacctcttgaaggaacttttccatgcgattttgcatggggagtagttgataactatattcaagttgatactactcttagtcaattcacagatcttaatgtttatttatgggatgttcatcactctaaaagattaattaaagttgatggtgtcgttacaaagaaaagaaaatcatattgtgtggattttgctgcaattcaaccacaaattgcattgttacaagaaatgcatgttacacattttagattttcattagattgggctcttattcttccacttggtaatcaatctcaagttaatcatactattcttcaatattatagatgtatggcttccgaattagtacgtgttaatattactccagttgtggcattgtggcaacctatggctcctaatcaaggtcttccaagacttttggctagacaaggagcttgggaaaatccttatactgctttagcatttgctgaatatgcacgtttatgttttcaagaattaggacatcatgttaaattatggattaccatgaatgaaccatatactagaaacatgacatattcagcaggacataatttattgaaagctcatgcactagcatggcatgtttataatgaaaaatttagacatgcacaaaatggtaaaatttctattgctttacaagctgattggattgagccagcttgcccatttagtcaaaaagataaggaagtagctgagagagttctcgagtttgatattgggtggttagcagaaccaatttttggttctggagattatccttgggttatgagggattggcttaatcaaagaaataattttcttttaccttattttactgaggatgaaaaaaaattaattcaaggaactttcgattttcttgctttaagtcattatacaacaattcttgtagactcagaaaaagaagatccaattaagtataatgattatcttgaagtacaagagatgacagatattacttggttaaactcaccaagtcaagttgcagttgtaccatggggattaagaaaagttttaaattggcttaaatttaaatatggagacttaccaatgtatatcatctcaaatgggattgatgatggtttacatgctgaagacgaccaactaagagtttattatatgcaaaattatattaatgaagcattaaaagcacatatccttgatggaataaatttatgtggatattttgcatattcatttaatgatagaacagctcctagatttggactttatagatatgcagctgatcaatttgaaccaaaagcatcaatgaaacattatagaaaaattatcgatagtaatggatttccaggaccagaaacattagaacgattttgtccagaagaatttactgtttgtactgaatgttcattctttcatacaagaaaatcattacttgcttttattgcatttttattttttgcatcaattataagtctttctcttattttttactatagtaaaaaaggacgaagaagttataag

SEQ ID NO: 15326 - DNA, 3036 bp, Artificial Sequence
  Description of Artificial Sequence: Synthetic coding sequence
atgccagcatccgcaccgccacgcagacctcgccctcccccgccctcactaagtctcctgctggtactgctgggcctgggaggtcggcgcctgagggccgagccgggggatggcgcgcaaacgtgggcgcggttctccaggccgcctgccccagaagccgcaggattgttccagggaacatttcccgatggctttctctgggcagttggatcagccgcttaccagacagaggggggatggcaacagcacggcaaaggtgcatccatctgggacacgtttacacatcaccccctggcacctccaggcgacagtagaaacgccagccttccactcggtgccccaagccccctacaacctgcgactggcgacgtagcatccgattcttacaataatgtgtttagggatacggaggctcttagggaactaggtgtaactcactacaggtttagtatctcgtgggctagggtactacccaatggcagcgctggggttccaaaccgcgaaggactcagatattatcgccgtctgctcgaaaggttacgggagttgggggtacagccagtggtgaccctgtatcattgggatttgccacagagactccaggatgcctatggaggctgggctaatagagctttggcagatcattttcgcgactacgcagaactgtgctttcggcacttcggcggacaggtgaaatactggatcacaatcgacaatccgtacgtggtcgcttggcacggatatgccacaggtcgactcgcaccgggtatacgcggcagcccccggcttggatacctggttgcccacaacttattattggcccatgcgaaggtctggcacctgtacaacacaagcttcaggccaacacagggaggtcaggtgagcattgccttgagtagtcattggattaatccaaggaggatgaccgatcattcaattaaagagtgtcagaaaagcctggattttgtgcttggttggttcgctaaacctgtcttcattgatggcgattaccccgagagcatgaagaacaatcttagcagtatcctgcctgacttcactgagagtgagaaaaagttcataaaggggaccgcggatttcttcgctttatgctttggccccaccttatcttttcagctgctcgaccctcacatgaaatttcggcaactggaaagtcctaacttgaggcaactgctcagttggatcgacctggagtttaatcatccccagatttttattgtggagaacggctggttcgtttcaggaacgaccaaacgtgatgatgcaaagtacatgtactatctaaagaaatttataatggagactctaaaagccattaagttggatggcgtcgacgtcattggttacacagcttggtcactgatggacgggttcgagtggcatagaggctatagtatcaggagaggcctgttttatgtcgattttctgagccaggataagatgctcctgcccaaaagttcagctcttttctatcagaagttgattgagaaaaatgggttccctccattgcctgagaaccaacctctggaaggtacatttccctgcgatttcgcatggggtgtagtggacaattacattcaggtggacaccaccctgtcccagttcactgatctcaacgtatacctctgggacgtgcaccatagcaagcggctaataaaagtcgacggagtggtgactaagaagcggaagagctattgcgtggactttgccgcgattcagccacagattgctctcctgcaggagatgcatgtgactcacttcaggtttagcctcgattgggccttaatactgcccttgggtaaccagagccaagtgaatcacacaattctacagtactaccgttgtatggctagcgaattggtacgcgtaaacataactccagttgtcgccctgtggcagcctatggcccctaatcagggacttccaagactgctcgcacgccaaggagcatgggaaaatccttacaccgccttagcattcgctgagtacgcaaggctgtgttttcaggagctaggacatcacgttaaattgtggataacaatgaatgaaccatatacgcggaacatgacatactccgctggacacaatctactgaaggcacacgccctggcatggcatgtatacaatgaaaagttccgtcacgcacagaatgggaaaatcagcatcgccctgcaggctgactggatcgagccagcctgcccgttttctcagaaagataaagaagtagcggagcgagtacttgagttcgacatcgggtggctagcagagcctatctttggcagtggtgactatccttgggtcatgagagactggctcaaccaaaggaataactttttgctcccatacttcaccgaggacgagaaaaaactgattcagggaacattcgacttcttggccctgagccactataccaccatcttggtagactctgagaaagaagatcctataaaatataatgattacctggaggtacaagaaatgaccgacatcacgtggctcaacagcccttcacaggtcgccgttgtgccttggggactccgtaaagtcctgaattggcttaagttcaagtacggtgatcttccaatgtacataatatccaatggaatcgatgacggcttgcacgcagaggacgaccagctacgtgtgtattatatgcagaattatatcaacgaagcactgaaggctcacattttagatggtatcaacctctgcggctacttcgcctactcattcaacgatcggaccgctcccaggttcggcctatatcgttatgccgcggaccagtttgagcctaaagcaagcatgaagcactacaggaaaataatcgattccaacggattccccggcccggaaactttggagcgcttctgccctgaggaattcactgtctgcacagaatgctcattctttcataccaggaagagcttactggcattcatcgctttcttgtttttcgccagcataatcagcttaagccttattttctactacagtaaaaagggcagacggtcgtataag

SEQ ID NO: 15327 - DNA, 3036 bp, Artificial Sequence; identical to SEQ ID NO: 15318
  Description of Artificial Sequence: Synthetic coding sequence

SEQ ID NO: 15328 - DNA, 3036 bp, Artificial Sequence
  Description of Artificial Sequence: Synthetic coding sequence
atgccagccagcgccccacccaggagaccccgtcctccccccccctccctgagcctgctcctggttctgcttggcctgggaggacgtcgcctcagggccgagccaggagacggcgcccagacttgggctcgtttttcacgcccacccgctcccgaggccgctggcctgttccagggcacatttcccgatggattcttgtgggctgttggttctgctgcctaccaaacagaaggaggctggcagcagcatggtaagggtgcaagcatctgggacacattcactcaccacccccttgcaccaccaggcgactcacgtaacgcctctttgcccctcggagccccatcaccactgcagcccgccacaggagatgttgctagcgacagctataacaacgttttcagggatactgaggctctgcgcgagctcggagtgacacactacagatttagtatctcttgggcacgtgtcctgcccaacggtagcgcaggtgtacctaatagggagggtctccgctactacaggcgtctcctggagcgcctcagagagctgggtgtgcagcctgtggtaactctctaccactgggacctgcctcagaggctccaagacgcatatggcggctgggcaaatagggcactggctgaccactttagggactacgctgagctgtgtttccgccactttggcggacaggtcaaatactggatcaccatcgacaatccctatgtggtagcttggcacggctacgctacaggtagactcgcaccaggcatccgcggtagtccacgccttggctacttggtggcccacaatctgctgctggcccacgccaaggtttggcacctttacaacacttccttccgccctactcagggaggtcaggtttctatagctctttctagtcactggatcaatcccagaaggatgacagaccattccatcaaggagtgtcagaagtccttggattttgtgctgggttggtttgcaaagccagtctttatcgatggcgattacccagagtcaatgaagaacaatttgtcttccatcctgcctgacttcaccgagtccgaaaaaaagtttattaaaggaactgccgacttttttgccctttgcttcggacctactctgagcttccaactgctggacccacatatgaaattcagacaactggaaagtcccaacctgcgccagctcctgagctggattgacctcgagttcaatcacccacagattttcattgtagagaatggatggttcgtgagcggaacaactaagcgtgacgacgctaaatacatgtattacctgaagaagttcatcatggaaacactcaaagctattaaattggacggcgtggatgttatcggttacaccgcttggtctctgatggatggtttcgagtggcatagaggctattctattagaagaggactgttctacgtggatttccttagccaggataagatgctgctgcccaaatcctccgcacttttctaccagaagctgatcgagaagaatggttttccacccctgcctgagaaccaaccacttgaaggtacctttccctgcgacttcgcctggggtgtagttgataactacatacaggttgacactactttgagtcaattcactgaccttaacgtatacctctgggacgttcaccactctaagagactgattaaggttgacggagtcgtcaccaagaaacgtaaatcttattgtgttgatttcgctgctatccaaccacagatcgccttgcttcaggaaatgcatgtaacacatttccgtttcagtcttgactgggcattgattctgcccctgggcaaccagagtcaagtaaaccataccatactgcagtactaccgctgcatggcttcagaactggtacgcgtgaatattacaccagtcgtggctttgtggcagcctatggcccccaatcaaggactcccacgtctgctggcacgccagggagcttgggagaacccatacacagccctggccttcgctgagtatgcaagattgtgcttccaagagcttggccatcacgtgaagttgtggattaccatgaacgagccatacacacgtaatatgacctattccgctggccacaacctgctgaaggcacacgctcttgcctggcatgtctacaatgagaagttcaggcacgctcaaaacggtaagatttccattgctctgcaggccgattggatcgaacctgcttgtcccttcagccagaaggataaggaagtagctgagcgcgtgctggaattcgacatcggctggcttgcagaacccatctttggatctggagactacccttgggtaatgagagactggctcaaccagcgtaacaatttcctgctgccatactttaccgaggacgagaagaagcttatccagggaaccttcgactttctggccctttctcactacacaacaatccttgtagactctgagaaggaagacccaattaaatataacgactatctggaagtgcaggagatgactgacattacatggctgaacagtccctctcaggtagctgtcgtgccctggggtctccgcaaggtgcttaactggttgaaatttaagtacggagacctgcctatgtacatcatctctaatggaatagacgacggactccacgcagaggatgaccagctgagagtgtactacatgcagaactatataaacgaagctcttaaagcccacatcctggatggtatcaacctgtgtggctacttcgcctattcattcaacgacaggactgcccctaggtttggtctttatcgctacgcagccgaccagttcgaacccaaagcttcaatgaagcattaccgcaagatcatagattctaacggctttccaggacccgaaacattggaaaggttctgccctgaagagttcaccgtctgtacagaatgcagctttttccataccaggaaatctcttctggctttcattgcttttttgtttttcgccagcatcatctcactctctctcattttctattatagtaaaaagggtagaagatcatataaa

SEQ ID NO: 15329 - DNA, 3036 bp, Artificial Sequence
  Description of Artificial Sequence: Synthetic coding sequence
atgcctgcctctgccccacctaggcgacccaggcctccaccgccgtcactttctctgctgttggttttgctgggcctcggtggccggcgtctccgagccgagcccggggatggcgcgcaaacatgggccaggttttcacgcccccctgcacccgaagccgctgggctctttcagggaactttcccagatggcttcttgtgggcagtcggatccgccgcttaccagaccgagggtggctggcagcagcacggcaagggcgcatcgatttgggacacatttacccaccatccgctggccccgccaggcgactcccgaaatgcctcacttcctctgggcgccccgtcaccacttcagccggccaccggggatgtggccagcgattcctataacaatgtgtttcgtgacacggaggccctgcgggaactgggcgtgactcattataggtttagcatttcctgggcgcgtgtactcccgaacgggtcggcaggcgtgccgaaccgtgagggccttcgatattaccgacggctcctggagcgtctgcgcgagttaggtgtgcagccggttgttacgctgtaccattgggacctgccgcagcgactccaagacgcttacgggggttgggcaaatagggccctggccgatcatttccgcgattacgctgagctctgttttcgtcactttggtgggcaggttaagtactggatcaccatcgataatccatacgtggtggcatggcacggctatgctactggccggttggctccaggaatacgaggtagtccacgcctgggctacttagtggctcacaatctgttactggcccatgctaaggtctggcacttatacaatacgtcgttccgaccgacgcaaggcggccaggtatcgatcgccctgtcgtcccattggatcaacccgcgaagaatgacggaccacagtatcaaggaatgccagaaatcgctggattttgttctgggttggtttgccaagcccgtcttcatcgatggcgattaccccgaaagcatgaagaataatctgagctccatcctaccggacttcaccgagagcgagaagaagttcatcaagggcaccgccgatttttttgccctgtgctttggcccaacgctttctttccaattgctggacccccatatgaagtttcgacaacttgagagcccaaacctacgtcagctactcagctggatcgacctggagttcaaccatccacagatctttatcgttgaaaatggctggttcgtttccggcactaccaagcgagacgacgcaaagtacatgtattacctaaagaagttcattatggaaaccctgaaagccatcaagctcgatggtgtagacgtgattggatacaccgcctggagtctgatggacggatttgagtggcacagaggttacagtattcgacgcggcttgttctacgtggatttcctgtcccaggataagatgctgcttccaaagagctccgcgttattctatcagaaattgattgagaagaacggattcccccccctccctgagaatcagccactcgagggcacgtttccgtgtgatttcgcctggggcgtcgttgataactacattcaggtggacacgacgctcagccagtttaccgacttaaacgtgtacctatgggacgtacaccattcgaagcgactgattaaggttgatggcgtggttaccaagaagcgcaaatcttactgtgtggatttcgcggctatacaaccgcagatagctctactgcaggagatgcacgtgacccactttcgtttcagtttggattgggccctcatcctcccactaggcaatcagagccaagtcaatcacacaattctccagtattaccggtgcatggcatcagagctggtgcgagtgaatattaccccagtggtggccctgtggcagccaatggcccccaaccagggactgccgcgactcctggcccggcaaggagcctgggagaacccctacacggccctagcctttgccgagtacgcccgcctgtgtttccaggagctgggccaccacgtgaagctctggattaccatgaatgagccctacacccgcaatatgacatactcagccggtcacaacctgctcaaagctcacgctttggcttggcatgtgtacaatgagaaattccgccacgcgcagaacggaaagattagcattgcgttgcaggccgactggatcgaaccggcctgtccgttcagccagaaagacaaggaagtcgcggaacgtgttctagagttcgacatcggatggctcgccgaacccatattcggaagcggagactatccctgggttatgagggattggttgaaccagagaaataattttcttttgccatacttcactgaggatgagaagaagctgatccagggaactttcgatttcctggccctctcgcattatacaactatactggttgattccgagaaggaggatccgattaaatataacgattatctggaagttcaggagatgacagacataacctggttgaattctcctagtcaggtggctgtggtcccgtggggtctgcgcaaggtcctgaactggctaaagtttaagtacggtgacctaccaatgtacataatttccaatggcattgacgacggtctacacgccgaagatgatcagctgcgtgtgtattatatgcaaaattatataaatgaggccctaaaggcccacattctcgatggcatcaacctgtgcgggtacttcgcatacagttttaacgatcgaacggcgccaaggttcggtctgtatcgctacgctgcagatcagttcgaaccaaaggcctcaatgaagcactatcgtaagataatcgattcgaacggcttcccaggaccggagacgctagaacgtttttgtccggaggaattcaccgtgtgcactgagtgctctttttttcatacccgcaagtcgctgctggccttcatcgccttcctgttctttgcgtccataatctcccttagtttgatattctactattccaagaagggccgccgaagctataaa

SEQ ID NO: 15330 - DNA, 3036 bp, Artificial Sequence
  Description of Artificial Sequence: Synthetic coding sequence
atgcccgcatcagcccccccacgaaggcctaggccaccaccaccaagtctatccctgcttttggtgctcttaggattgggcggtaggaggctgcgcgcggagcctggcgatggagctcagacttgggcacgcttttctcgccccccagcgcctgaagccgctggactgttccagggcacttttccagatgggttcttgtgggcagttggttccgcagcatatcagactgagggcggctggcagcagcacggcaagggggcaagtatctgggatacttttactcatcatccattggcaccgcctggggattcacgcaatgcctctcttcccctcggcgccccctccccgctccagccagccactggcgatgtggcaagtgactcatacaacaacgtgtttcgcgacactgaggcgcttcgagagcttggcgtgacacattacagattcagcatcagttgggcccgcgtactgcccaatggcagcgcaggggtgcccaatagagaaggactgaggtactaccggagactcctggagcgcctacgggagctgggggtgcagccagtggtgacactgtatcactgggatttaccacagcggttgcaagatgcctatgggggatgggcgaacagggcattagcagatcactttcgcgactatgcggagttatgttttagacatttcggtgggcaggtaaaatactggatcactatcgacaacccctatgtcgtagcctggcatggctatgcaactggccgcctggccccggggatacgtggcagccccagactggggtacttggttgcccacaacctccttttagcgcacgcgaaggtttggcacttgtacaacacctcgttccggccaacccaaggcggccaggtgagtatagcacttagctctcattggatcaaccctaggcgaatgaccgatcactcaattaaggagtgtcaaaaatctctggactttgtactcgggtggttcgccaagcccgtgtttattgacggcgattatcccgagtcaatgaaaaataatctttcctcaattctgccagactttacggagtcagaaaaaaaatttattaagggtacagctgacttctttgccctatgctttggtcctaccctgagttttcaactgctggacccgcacatgaagtttcgccaattagaaagtccaaatctgagacagttgctcagctggattgatcttgaatttaatcacccccagatcttcattgtggaaaatggttggttcgtatctggcacaactaaaagggatgatgctaagtatatgtattacctgaaaaagtttataatggagacgctgaaggcaatcaaactggacggagtggacgttatcggctacaccgcttggtcactgatggatggtttcgagtggcacagggggtactccatccgtcggggactattctatgttgatttcctttcccaagacaaaatgttgctcccaaaatcttctgcgctcttttatcagaaattgattgagaagaacggatttcctccactgccagagaatcaacctttggaaggtacgttcccatgtgacttcgcttggggcgtcgtggacaactatattcaagtcgatacgacgctgtctcagtttaccgacctcaacgtgtatctgtgggatgtgcaccactctaagaggctcataaaagtcgatggagtggtaacaaaaaagcgcaaaagctactgtgtggattttgccgccatacagccacagatagccctcctacaggagatgcatgtaacccattttcggttttctctggactgggccctgatactgccgttgggaaaccagtctcaggttaaccatacaatactgcagtattatcgatgtatggcgagcgaattggtgcgtgtgaacattacccctgtggttgctctgtggcagcctatggcgcccaatcaaggcctaccacgtctgctggcacgccaaggggcctgggagaatccttacacagccctggccttcgcagagtatgctcgactgtgctttcaggaactcggccatcatgtgaagctatggatcactatgaacgaaccatatacccgcaatatgacctactctgctggccataatctcctgaaagcacatgcactggcctggcacgtgtataacgagaagtttcggcatgcgcagaatggaaaaatctcgatagccctccaggccgactggatagagcctgcttgccccttcagtcagaaggacaaagaagttgcagagagagtgttggagttcgatatcggttggcttgctgaaccaatctttgggagtggagattacccatgggtcatgcgggattggcttaaccagcggaataacttcctattgccctatttcacagaagacgagaaaaagctcatacagggtacatttgattttctggcactcagtcattacactaccatccttgtggactccgagaaggaggacccaattaagtacaatgactacttggaagtgcaggagatgaccgacatcacatggctaaacagccccagccaagttgcggtggttccctggggactccggaaagtgctaaactggctgaaatttaagtacggggatttaccaatgtatataattagtaatggcatcgatgatggcttgcacgccgaagatgaccagctccgtgtctattatatgcagaattacataaatgaggctctgaaagctcacatactagacggcatcaacctttgcggctatttcgcatattcttttaacgaccggaccgccccgcgattcgggttatacaggtacgctgcagatcaatttgaacccaaggcgagcatgaagcactatcgcaagatcatagatagcaacggtttccctggccctgaaacgttggaaagattttgccctgaggaatttactgtgtgtaccgaatgctcctttttccatactagaaagagcctgcttgccttcattgcttttctcttttttgctagtattatcagcctgtcacttatcttttattactcaaaaaaggggcgccggtcttacaag

SEQ ID NO: 15331 - DNA, 3036 bp, Artificial Sequence
  Description of Artificial Sequence: Synthetic coding sequence
atgccagcatccgccccccctcggcggcctcggccacccccaccttccttaagtcttcttctggttcttctgggcttaggaggacgcaggctgcgcgcagaacccggtgatggcgctcagacttgggcaagatttagtagacctcccgccccagaagctgccggcctcttccaaggaaccttccctgacgggttcctatgggccgtaggatctgctgcatatcaaactgagggaggttggcagcagcacggcaaaggcgcctcaatatgggatactttcacccaccaccccctggctccccccggcgacagcaggaacgcaagcctgcctctgggggctcctagtccactgcaacccgcaaccggagatgtcgccagcgatagttataacaacgtttttcgagatacagaagcactaagggaactgggtgtgacacactatcggtttagcattagctgggcccgggtattaccaaacggctccgccggcgtgccaaaccgggaagggctgagatattaccggcgtctgctggagcgcttaagggagctcggcgttcagcccgtggttacactctatcattgggatttaccacagcgcctgcaggacgcctacggcggctgggccaaccgtgcattggctgatcacttccgcgattatgctgaattgtgcttccggcactttgggggccaagtcaagtactggatcactattgataacccttatgtggtggcctggcacggatatgcaaccggtcggcttgcacctggtattcgcggcagtccgcgactcggctacctggttgcccacaatctgctgctggcacacgccaaggtgtggcacctctataacacttccttcaggcccacccaaggcgggcaggtttcaattgcactgagcagccactggatcaatccacgcagaatgaccgaccattctattaaggaatgccagaagtccctggactttgttctgggttggtttgctaagccagtgtttatcgacggagactacccagaatcaatgaaaaacaatctgagcagcatcttacctgactttacagaatccgagaagaagttcatcaaaggcactgccgacttcttcgctttatgctttggccccacactgtcattccagctcttagacccacacatgaagttccggcagctggagtctcctaatctacggcaactcctgagttggatcgacctggaattcaatcacccacagatattcatagtggagaacgggtggtttgtcagcggcaccactaaacgggatgatgccaaatacatgtattatctaaagaaattcattatggagacactaaaggctatcaagctcgacggagtggacgtgatcggctacactgcctggagcctgatggatggcttcgagtggcaccgtggctactctatacgccggggcctcttctacgtggatttcttatctcaggataagatgctgctgcctaagagttctgctttgttctatcagaaattaatagagaagaacggctttccaccactgccagagaatcagccactggagggaacattcccttgtgactttgcctggggagtggtggacaactacattcaggtggatacaacactctcccagttcactgacttgaacgtgtacctctgggatgtgcaccatagcaaaagattaataaaggtggacggggtggtgaccaaaaaaagaaaatcttactgtgttgattttgccgctatacagccacagatcgccctgctgcaggaaatgcatgtcacccatttccgcttctccctggactgggcactgatcctgcccctggggaaccagtctcaggttaatcacacaattctacaatactaccgctgcatggcctccgagctggtccgtgtaaacattacaccagtggtcgctctctggcagccaatggcccccaatcagggtctgccacgcctacttgctcgccaaggtgcatgggaaaatccatataccgctctagcctttgctgagtacgcccggctctgtttccaggaactcgggcaccacgttaagttgtggattacaatgaacgaaccctatactcggaacatgacttacagcgctggccacaatttactgaaagcacacgcccttgcctggcatgtttataacgaaaaattccgacacgcccagaacgggaaaatatcaattgccctccaggccgattggatcgagccagcttgcccattcagccagaaagacaaagaagtggccgagcgggtcctggagttcgatatagggtggctcgccgagcccatcttcgggtccggggactatccctgggtcatgcgtgactggttaaatcagcggaacaactttcttcttccatacttcaccgaggacgaaaagaagctaatccaaggtaccttcgattttctggctctgtcccactacaccactatcctggtggattctgagaaggaggaccctatcaagtacaacgactacctagaggtgcaagagatgactgacattacctggctgaactcaccaagccaggtggccgtagtcccatggggcctgcgtaaggtcctgaactggctcaagttcaagtacggtgacctccccatgtatataatcagcaacgggatagacgacgggctgcatgctgaggacgatcagctacgcgtgtattatatgcagaattacataaacgaagccctgaaagcccatatcctggacggcattaacctgtgtggctactttgcttatagtttcaacgacaggactgctcctcgctttgggctctatcgatacgcagcagatcaatttgagcctaaggccagcatgaagcattatcgaaagataatagacagcaatggttttcccgggcctgaaaccttagagcggttttgcccagaggagttcaccgtgtgcacagagtgttcctttttccacactagaaagtcactactggcttttattgcatttctattttttgctagtataatatctctcagtttgatattctactactccaaaaagggcaggcgaagctataag

SEQ ID NO: 15332 - DNA, 3036 bp, Artificial Sequence
  Description of Artificial Sequence: Synthetic coding sequence
atgcctgccagtgccccccctagaagaccccgaccccctcctccaagtctctccctacttttagttctcctgggactgggaggaagacgcctaagggccgaaccaggagatggagcacagacatgggcccgattttctagacctcccgcccccgaggccgccgggctgttccaggggacattccccgatgggttcctttgggctgtaggaagtgcagcctatcagactgagggaggatggcagcagcacgggaaaggagcgagtatttgggatactttcacacatcatcctttggctccccctggggattctagaaatgcttcattaccacttggagctccttcacccctccagcctgccacaggagacgtcgcgtccgattcctacaataacgtgtttcgagatacagaagccttgagagaactcggagtgacacactatcggttttctatatcttgggcaagagttcttcctaacggatctgctggagtgcctaaccgagaagggcttaggtactaccggaggttattggaacgattacgggagttgggggtacagccagtagttacactgtatcactgggatctcccccagcggctccaggatgcctatgggggatgggctaacagagcactggccgatcactttagagattatgccgagctttgctttcgccattttggaggacaagtgaaatactggattactatcgacaatccatacgtcgtggcctggcatggatacgctacagggagactggcacccgggattcgggggtcacctagacttgggtaccttgtagctcataatctgctgctagctcatgccaaagtgtggcacctatataacacatctttcagacctactcagggaggacaggtatccatagccctgtcgtcacactggatcaatccacgccgcatgactgatcattccataaaagaatgtcaaaagtctctcgacttcgttcttgggtggtttgccaaaccagtttttatcgatggggattatccagaatctatgaaaaacaatctatcttctatcctgcccgatttcacggagtcagagaaaaaatttatcaaaggaacagccgacttcttcgccctttgttttgggcctactctctcctttcagctactagaccctcatatgaaatttaggcaactcgaatcaccaaacctcagacagctgctcagttggatcgacctcgaattcaaccatccccaaatttttatagtcgagaacggatggtttgtatctgggactacgaaacgcgatgacgcgaagtatatgtactatctgaaaaagtttattatggaaacattaaaagctataaagctggatggggtggatgtaattgggtatactgcttggtctctgatggacgggtttgaatggcatagggggtattctatcaggcgaggactcttttatgtggatttcttaagtcaggacaaaatgctcctgccaaaatcgtccgctctcttttatcagaaactgatcgaaaaaaacgggttccctcccctgccagagaaccagccccttgaagggacatttccgtgtgattttgcttggggagttgtcgataattatatccaggtcgatactacactgtctcagtttactgatcttaatgtgtacctttgggatgtccatcattcaaagcggttgatcaaagtggacggagttgtaacaaagaaaagaaaatcctattgtgtggatttcgctgctatacagccccagattgccctgctgcaggaaatgcatgtaacacactttcgcttttcattagattgggccttaatcctaccccttggaaaccagtctcaggtcaaccacacaatcctccagtattataggtgcatggcctcggaactcgtacgcgtaaacatcactccagtggtcgccctatggcagcctatggccccaaatcagggattgccccgacttctcgctcggcagggggcctgggagaacccttatacagctttagcgtttgccgaatatgccagactctgcttccaggaactgggacaccatgtgaaactgtggattactatgaatgaaccttatactaggaacatgacttattctgcaggacacaatctcctgaaagctcacgccttggcatggcacgtgtacaatgaaaagttcaggcacgcccagaacgggaaaatctccatagccctacaggccgattggatcgagcctgcatgtcctttctcccagaaagacaaagaagtagcagagagagtcctagaatttgatattgggtggttggcggaacctatatttggatctggagattatccctgggtaatgagggattggttgaaccaaaggaacaatttcctactcccatatttcacggaagacgaaaaaaaactgatccaggggacttttgatttcttagccctttcccattacactacaatccttgtagatagtgaaaaagaagatcccatcaagtataacgattatcttgaagtccaggaaatgacagatattacttggttgaacagtcctagtcaggttgctgtcgtgccttggggactgcggaaagtgttaaactggctgaaattcaaatacggggatcttccaatgtatatcatcagtaatggaattgatgatgggttgcacgctgaagatgatcagctgcgggtgtattatatgcagaactatataaatgaagctctgaaggctcatatcttagatgggatcaacctctgtgggtactttgcatattccttcaacgatcggactgccccacggttcgggctctacaggtacgcagcagaccagtttgaaccaaaagcatctatgaagcactatcggaaaatcattgattctaacggattccccggaccagaaacactcgagaggttttgtcctgaagaatttacagtgtgtacagaatgttccttttttcatactagaaaatcattattagcttttatcgcgtttctattcttcgcctccataatctctttgtcacttatattttactattcgaaaaaagggcggcgctcctacaag

SEQ ID NO: 15333 - DNA, 3036 bp, Artificial Sequence
  Description of Artificial Sequence: Synthetic coding sequence
atgcccgcctccgcacctcctcgccgaccccgcccaccacccccgtccctcagtctgttgctcgtcctgctggggttagggggaagaagattgcgtgccgagccaggagacggagctcagacgtgggcgagattttccaggcctcccgcaccagaggccgctggtctttttcagggcacttttccagatggcttcctctgggctgtgggttctgcggcttatcagacagagggcggatggcagcagcacgggaagggggcaagcatctgggacaccttcacccaccatcccctggctcctccgggagacagtaggaatgccagtcttccgctgggcgcaccatcgccattacaaccagccactggcgacgttgctagtgactcttacaataacgtgttcagagatactgaggctttgcgcgaattaggggtgacgcattaccgcttctccatttcttgggcccgggttctcccaaacggaagcgctggcgttcccaaccgggaaggacttaggtattataggcggttgctggaaaggttgagagaactcggcgtccaacctgtggtgacattgtatcactgggaccttcctcagcgactgcaggacgcatatggaggctgggctaatcgcgctctggccgaccattttagggactacgccgaactttgttttagacattttggaggccaggtcaagtattggatcaccatagataacccatacgtggtggcttggcatggttacgctacggggagactggctccggggattagaggatcaccccgcttaggatatctggtcgctcataacctgctcttagcccatgccaaagtgtggcatctgtataatacctccttcagaccgacgcagggaggccaggttagtattgccctgtctagccactggattaatccgcggaggatgacagatcacagtatcaaagaatgtcagaaatcactggacttcgttctggggtggtttgccaagccagttttcatcgatggcgattaccccgagtccatgaagaataacctctcttcgatcctgcccgacttcactgaatcagagaagaaatttattaagggaacagccgacttcttcgctctctgcttcggccctaccctctcatttcagctgcttgatccgcatatgaaattcagacagctcgagagccccaatttgcggcaactgcttagctggatcgacctcgagttcaatcatccgcagatatttatcgtggagaacggctggttcgtgagtggtacgaccaagcgggatgacgccaagtatatgtattaccttaagaagttcatcatggaaaccctgaaggccataaagctcgacggagtagatgtaattggctacacagcttggagtctcatggatggcttcgagtggcacaggggttattccatacgccgtggcctgttctacgttgacttcttgtcgcaggataagatgctgctccccaagtcctcagcccttttctaccagaaactgattgagaaaaatggattccctccccttcctgagaatcagcccttagagggcacctttccctgcgatttcgcctggggtgtggtcgacaactacattcaggtcgacacaacgctgtcacaatttacggacttgaatgtatatctctgggacgtgcaccactcaaagcgcctgatcaaagtggatggcgtggtaaccaagaaaaggaaatcctactgtgttgacttcgccgctatccaacctcagatcgcgctgctgcaagagatgcatgtcacgcatttcaggttttctttggactgggctctgatactgcccttgggtaaccaatcgcaggtgaatcacaccatcctgcagtactaccgctgcatggccagtgaactggtgcgagtgaacattacacccgtagttgccctatggcaacctatggctccaaaccagggacttcctaggctgttggcccgccaaggcgcatgggagaatccatataccgcgcttgcgttcgctgaatatgcaaggctttgttttcaagaactggggcaccacgtgaaactctggatcaccatgaacgaaccttacacacggaacatgacgtactccgccggacataacttgcttaaagctcacgccttagcatggcacgtatataatgagaaatttcgccatgcccagaacggtaagatctcaatcgcccttcaggctgattggatagagccggcctgtccgttcagccaaaaggataaagaagtggcagagagggtactggaattcgatatcggatggttggccgaacctatctttgggagcggggattacccatgggtgatgcgagactggttaaatcagcggaacaacttcttactcccctatttcactgaggatgagaagaaactgatccagggtactttcgatttccttgcattgagtcattacaccaccattttggtcgatagcgaaaaagaggatccaattaagtataatgattatctggaggtacaagagatgaccgacattacctggcttaatagcccatcccaggtggcagtggtcccttggggcctgagaaaggtgcttaattggctgaagttcaaatatggggacctgcctatgtatatcatctcaaatggcatcgatgacgggctgcacgctgaagacgatcagcttagggtttactatatgcaaaactatattaatgaggcattgaaagcccacatacttgacggcattaacctctgcgggtacttcgcatatagcttcaatgaccggaccgcgccaagattcggcctgtatcgatacgcggcggaccaatttgagcccaaggcgtcaatgaagcactaccggaaaataatcgactcaaatggattccctggcccagaaactttggaaagattttgtcccgaggaatttaccgtctgtaccgagtgctcattctttcacacacgaaaatcattgctggcctttatagccttcctgttctttgctagtattatatctctatctctcatcttttactacagcaaaaaagggaggagatcttataag

SEQ ID NO: 15334 - DNA, 3036 bp, Artificial Sequence
  Description of Artificial Sequence: Synthetic coding sequence
atgcccgcaagtgcaccaccacgtagaccacgaccaccacccccttcgctgtccctcctgctagtattactcggcctggggggccggagactgcgtgccgaacccggtgatggtgcgcaaacctgggccagattcagtaggccaccagcccccgaggcagctggtttgtttcagggcacgtttccagacgggtttctctgggcggtaggcagcgccgcttatcagaccgaaggcgggtggcagcaacacggaaagggggcctccatttgggacacattcacccatcaccctctcgcacccccgggggattcccgcaacgcgtccctgcccctaggtgccccatcacccttgcagcctgctaccggtgacgtggcctcagactcctacaacaacgtgttccgcgacacagaggctctacgcgagcttggcgtgacccactatcggttctctatcagttgggcccgggttctccccaacgggagtgccggggtgccgaatagagaaggcctccgatattatagacgcctgctcgaaaggcttagagaactgggcgtgcagcctgtagttacgctgtatcattgggatttgccgcagcgtctacaggatgcctacggtggttgggcaaatcgcgccctggcagaccatttccgcgactacgcagaactctgcttccggcatttcggtgggcaggttaaatattggattactattgataacccgtacgtggtggcttggcacgggtatgctactggtagactggcgcctgggatccgaggatccccacgcctcggatatctcgtggctcacaatctcctgctggcgcacgccaaggtatggcacctgtacaacacttccttcagacccacccagggaggacaagtgtccatcgcactgtccagccattggataaaccccagaaggatgacagaccatagcattaaggaatgccagaagtctctagactttgtactgggttggttcgccaagccggtcttcatagacggtgattaccctgaaagtatgaaaaacaatctctcctccatactcccagattttaccgagtccgagaaaaagttcattaagggaaccgccgatttcttcgccctgtgcttcggaccgactttgtctttccaattactagatccacacatgaaatttcggcagttggagtctcccaacctgcgccagctgctctcgtggatcgatctcgagtttaaccacccccagattttcattgttgaaaatgggtggtttgtgtccgggactacaaagagggacgatgcgaagtacatgtattacctaaaaaaatttatcatggaaaccttgaaggccattaaactcgatggagtggatgttatcggttacactgcttggtccctgatggatgggttcgaatggcatcgcggctattctatccgtcgcggcctgttttacgtcgattttctgagtcaagacaaaatgctcttgcctaagtcttccgccctcttttatcaaaaattaattgagaaaaacgggttcccacccttgcccgagaatcagcccctggagggcacatttccttgcgattttgcctggggtgtggtggataattacattcaggttgatacgaccctttcacagtttacggatcttaacgtctacttgtgggatgtgcaccatagcaagaggctgatcaaggttgatggcgttgttactaagaaaagaaaaagttattgcgttgacttcgccgctatacagcctcagatcgcactgctgcaggagatgcacgtaacacacttccgcttttctcttgattgggcccttatcttgcccctgggtaatcagagccaggtgaaccatactattctgcaatattatcggtgtatggcctctgaacttgtccgggtcaacattacaccagtcgtggctctctggcagccaatggctcccaatcaaggcctaccaagactgcttgcacgacaaggtgcctgggagaatccctacaccgctctagcttttgcggagtatgctcgcctctgcttccaggaactcggccatcacgttaagttgtggatcacaatgaatgagccgtatactaggaatatgacttattccgctggacataacctgctcaaagcccacgccttagcttggcacgtttacaatgagaagttccgccacgctcagaatgggaagatctcaatagccttgcaggcggattggatcgaaccggcttgccccttctctcaaaaggataaggaagtggcagaacgcgtgctcgaatttgacattggttggctcgcagaaccgatattcgggtcaggcgactacccttgggtcatgcgggattggctgaaccagcgtaacaattttctccttccatactttaccgaagacgagaagaaattaattcagggcacatttgattttcttgcattgagccattataccactattctggtcgacagtgagaaggaagacccaatcaaatataacgattacctcgaagtgcaggaaatgaccgacataacctggctgaatagtccaagtcaggtcgccgttgtcccctggggcctacgcaaggtgctcaactggctgaagttcaagtatggcgacctgccaatgtatatcatctcgaacggaattgatgacggcctgcacgccgaggatgatcagctgcgagtgtactacatgcaaaactacattaatgaggctctaaaggcccacatcctagatggcatcaacctatgcggctacttcgcatactcattcaatgaccgtaccgcccctaggtttgggctttatcgttacgcagccgatcaatttgaacccaaagccagtatgaaacactaccggaaaatcattgactcaaatggattccctggtcccgaaacacttgaaaggttctgccctgaagagtttaccgtgtgcactgagtgttctttctttcacacccgaaaatctttactcgcgttcattgctttcctttttttcgcctccataattagtctctcgctgattttttattactccaagaaggggcggcggagctacaaa

SEQ ID NO: 15335 - DNA, 3036 bp, Artificial Sequence
  Description of Artificial Sequence: Synthetic coding sequence
atgccggcttcggccccaccgaggcgcccacgtcctccgcctcctagcctcagcttgcttctagtgttgcttggcctaggtggtagaagattgagagccgaacctggagacggagcacagacctgggccaggttcagccgcccccctgcacctgaggccgccggtctgtttcaagggacctttcctgatggatttttatgggctgtcggctctgcagcctatcaaacagagggaggatggcaacaacatggaaagggagcctctatctgggacaccttcacgcaccaccctcttgcacctcctggggactccaggaacgccagccttcccttgggcgcccccagtcctctgcaacctgctaccggagatgtagccagcgatagctataacaacgtgtttcgggacacagaggcgcttcgggagcttggagtgacacattaccggttttccatctcatgggctcgggttctgccaaacggctcagcaggagttcctaacagagaaggcctgaggtactatagaagattgcttgagagattgagggaactcggcgtccagcccgtggtgacgctttatcattgggacttgcctcagagacttcaagatgcttatggcggttgggccaaccgcgcacttgccgatcacttccgggattacgcagaactatgttttagacactttggaggccaagtgaagtactggattacaattgacaatccatacgttgttgcctggcatggatacgctaccggcagactggctccaggcatcagagggtctccgaggctcggatacctggtggctcacaacctcctgctggctcacgctaaagtttggcatctgtacaacacttcatttaggcctacccaaggaggacaggtttccatcgccctgtcaagtcattggattaacccaaggcgtatgaccgaccacagcatcaaggagtgccagaaatctttggacttcgtgttgggctggtttgccaaaccagtgtttattgatggggattaccctgagtccatgaaaaataacctgagttcaatcttgcccgacttcacagagtcagagaagaagttcatcaagggcaccgctgattttttcgcgctttgttttggccccacacttagcttccaactgttagatccacatatgaaattcagacagttggaatcgcctaatttgagacagctgctgagttggatcgacctggagtttaaccacccacagatcttcatcgtggaaaatggatggttcgtgtctggaactacaaaacgcgacgatgccaaatacatgtactacctcaagaaatttattatggaaaccctgaaagctatcaagttggacggagtagatgttattggctacacggcatggtctttgatggatggctttgaatggcaccggggctattccatccgcaggggtctattctacgttgactttctaagccaggataaaatgcttctccccaaaagcagtgccctcttttaccagaagttaatcgagaaaaatggctttcctccccttccggagaatcagccacttgagggaacatttccctgtgattttgcttggggcgtcgtcgataactatattcaagtggacaccacactgtcacaattcacggatctgaatgtgtacctgtgggatgtgcaccattccaagaggcttataaaggtggatggggtggtcaccaagaaaaggaagtcttactgcgtcgacttcgcagcgatacagccacagattgctctcctgcaggaaatgcacgtaacacattttaggttttctctagactgggctctgatactgcctcttggaaatcaatcccaagttaatcacaccatcctccagtattacaggtgcatggcttcagaactggtgagagtaaacattacaccagtggtagcactgtggcaaccaatggctccaaatcagggactcccgagattactggctcggcagggcgcttgggagaacccttataccgctttagctttcgccgaatacgccagactgtgcttccaagaactgggccaccacgtgaaactgtggatcactatgaacgagccatataccagaaatatgacttatagcgccggccacaatctgctcaaagcacacgcgctggcttggcacgtctacaacgagaaattcagacacgcgcagaatgggaagatctcaatcgcccttcaggccgattggatcgagccagcatgtccctttagccagaaggataaggaagtggctgagcgggtcctggagttcgacatcggctggctggccgaacccatcttcggatccggtgactacccttgggttatgagagattggctgaaccaacgcaacaactttctcctgccctactttaccgaggacgagaagaagctgattcagggaacctttgatttcttggctctttctcattatactaccattctcgtagactcagagaaggaagaccctattaagtacaacgactacctggaggttcaggaaatgaccgacataacttggctgaacagccctagtcaagtcgccgtggtcccttggggattgcgcaaggtcctgaactggctgaagttcaaatatggggacttgccgatgtacattattagcaacgggatcgatgacggtctgcacgcagaggatgaccagttgcgggtttattacatgcaaaactacattaacgaggctctgaaggcacatatcctcgacggaattaacctctgcgggtattttgcgtacagctttaacgaccggacagcgcctaggttcggcctctaccgctacgcagccgatcagttcgagccgaaagccagcatgaagcattacaggaaaatcatagattccaatggattcccgggcccagaaacccttgagagattttgtcccgaggagttcacagtctgcaccgaatgcagttttttccacaccaggaagagcctgctggcatttattgcttttctcttttttgccagcattatcagcctcagcttaatcttttactacagcaagaaaggcaggagaagctacaaa

SEQ ID NO: 15336 - DNA, 3036 bp, Artificial Sequence
  Description of Artificial Sequence: Synthetic coding sequence
atgcccgcttctgcccctccacgccgcccgcgccccccaccgccttcactgtcccttctactcgtactcctggggctaggaggcagacgcctccgtgccgaaccaggcgacggcgcccagacatgggctcgattctccagacctcccgctccagaggcggccgggctttttcaggggacgtttccggacggttttctttgggccgtggggtccgccgcctaccagacggaaggagggtggcagcagcacggaaaaggagcgtctatttgggacacctttactcaccatcctttggccccgccaggagattcccggaatgcttctctccccttgggtgccccttcaccactgcagcccgccactggggatgtggccagcgactcttataataacgtgttcagagatacggaagcactcagggagcttggtgtcacccattaccgcttttctatttcatgggctagggttttgcctaatgggtccgcaggggtccctaatcgcgagggactgagatattatagacggctactcgagcggcttcgagaactgggcgtacagccagtggttacattgtatcattgggatttgccacaaaggttacaggacgcatacggtggctgggcgaacagagccctggccgatcacttcagagactatgccgagctgtgttttcgccacttcggcggacaggtcaaatactggataactatcgacaacccgtatgttgtcgcgtggcatgggtacgccaccggccggctggctccaggcatccggggcagtcctaggctgggatatttggtggctcacaatctgctcctggctcacgcaaaagtctggcacttgtacaatacgagcttccgtccgacgcaaggagggcaggtctccatcgccttgtccagccactggatcaatcctagaagaatgactgatcattcaatcaaagagtgtcaaaagtctctggactttgtgttgggctggttcgccaaacctgtgttcatcgacggcgactacccagagtctatgaaaaacaatctctcatcaatcctacctgacttcaccgaatccgaaaaaaagttcatcaagggaacagccgattttttcgctctgtgctttggacctacattgtccttccagttgctggacccgcacatgaaattccgccagctggagtccccaaatttgaggcagctgttaagctggatcgacctagaatttaatcacccgcagatcttcattgtagaaaacggttggtttgtctcgggcaccacaaaacgagatgacgccaagtacatgtactatctgaaaaaattcatcatggagacactcaaggccatcaagctggacggcgtcgatgtgatcggctatacagcctggtctctgatggatggcttcgaatggcaccgggggtacagcattcgacgcgggcttttctatgtggatttcctgtcccaggataagatgcttctgccaaaatccagcgccctgttttaccagaagcttatagagaagaacggttttccccctctccccgagaatcaaccacttgagggcacttttccctgtgactttgcgtggggagtcgtagataactacattcaggttgatacgacgctgagtcaattcactgacctcaacgtctatctgtgggatgtgcaccatagcaaacggctgatcaaagtggatggggtagtgacgaaaaagcggaagagctattgtgtagacttcgccgctatccagccacagatcgctctcctccaagagatgcatgtcactcatttcaggttcagcttagactgggcactgatactgcccctcgggaaccaatctcaggtcaatcacactattctccagtactaccgctgcatggcttcagaacttgtgagggttaacattactcctgtggtggctctgtggcagccaatggcgcccaaccagggactccctcgcttgctggcccggcagggggcgtgggagaacccttatacggcactggccttcgcagagtacgctcgactgtgttttcaggagcttggtcaccacgtgaagttatggatcacgatgaatgagccctacaccaggaacatgacttactctgcgggacacaacctgttgaaggcgcacgccttggcgtggcacgtgtacaatgagaagtttcggcacgcccaaaacgggaagattagtatcgccttacaggccgactggattgaacctgcatgcccatttagtcagaaagacaaggaagtggctgagcgcgtcctggaattcgatatagggtggctagcagaacctatatttggcagcggagattatccttgggttatgcgagactggctgaatcaacgtaataatttcttgctgccgtacttcacagaagacgagaagaaactgatccaaggaacgtttgatttcctcgccctgtcccactatacaaccattttggtcgatagcgagaaagaagaccccatcaagtacaacgactaccttgaagttcaggagatgacggacattacctggctgaattccccttcccaagtcgccgtagtgccatggggcctgcgaaaggtgttaaactggctcaagttcaagtatggagatttgcccatgtacatcatcagcaatggaattgacgatggactgcatgctgaagacgaccagctgcgagtgtattatatgcaaaactacataaacgaagccctgaaggcacatatcttggacggcatcaatctgtgcggctacttcgcctactcttttaacgacagaaccgcgcccaggttcggactgtacagatatgccgcagaccagttcgagcccaaagcttctatgaaacattaccgcaaaatcatcgattcaaacggctttcctgggccagaaaccctggaacgcttctgccccgaggagtttactgtgtgcaccgagtgcagttttttccacacccgcaagtctctgctggcctttattgctttcctattctttgctagcatcatatccctgtcactgatattttattattcaaaaaagggtcggagaagttataag

SEQ ID NO: 15337 - DNA, 3036 bp, Artificial Sequence
  Description of Artificial Sequence: Synthetic coding sequence
atgccagccagtgcgccccctcgcaggccacgccccccccctccctcactcagtctccttttggtgctgttgggtctcggcggcagaaggcttagagctgagcctggggatggggcacagacctgggccagattttctaggcctccagcaccagaagccgcgggactctttcaggggacatttccggatggttttctgtgggccgtcgggtcagcagcctaccagactgagggaggttggcagcagcatggcaagggcgccagtatttgggatacatttacacatcatccgctcgcgccacccggggacagtagaaacgctagtctgcctcttggtgctcccagtcccctgcagccggctaccggtgacgtcgcgagcgacagttacaacaatgttttccgggatactgaggcactccgcgagctgggggtgacacactatcggttctcaatctcttgggcccgggtgctcccgaatggctccgccggcgttccaaaccgagaaggccttagatattataggagactccttgagaggttgagagaactgggtgttcagccagtagtgacactgtatcattgggacctcccacagaggctgcaggacgcctatgggggatgggcaaaccgggctctggccgaccacttccgggattacgctgaactgtgtttccgccactttggcggccaggtgaaatactggattaccatagataacccatacgttgtggcctggcatggctacgctaccgggcggctggcccctggcatcagaggatcaccgagattggggtatcttgtggcacacaatcttctgctggcacacgccaaggtgtggcatctgtacaataccagcttccggccgacacaggggggtcaggtgtctattgcactcagctcccactggattaatccaagacgcatgactgaccacagtattaaggaatgccaaaagtccctcgattttgttctggggtggttcgccaaacccgtgttcattgacggagattaccccgaatctatgaagaataatctgagcagcattctgcctgatttcaccgaatccgagaaaaagttcatcaaggggacagccgattttttcgctttgtgttttgggccaacgttgtcatttcagctgctggatcctcacatgaagtttcgccaactggagtcccccaatttgaggcagctgcttagctggatagatttggaatttaatcacccccagatttttatcgtagaaaatggctggttcgtcagtgggaccactaagagagacgatgccaagtacatgtattaccttaagaagttcatcatggaaaccctgaaggcaatcaagctcgacggcgtagatgttattggctacacagcatggagcctgatggatggcttcgagtggcaccgaggttacagtattcgccggggattgttttatgtggattttcttagtcaagacaagatgttgctgcccaagtcctccgccttgttctaccaaaagctcatagagaaaaacggtttccccccactccccgagaatcagccactggaagggacctttccctgtgattttgcctggggagtggtggataactatatccaagtcgatactacgctgagccagtttacagacctcaatgtgtacctctgggacgtccaccacagcaaaaggctgattaaagtggatggagttgtaaccaagaaaagaaagagttactgtgtggatttcgctgcgatccaaccgcaaatcgcattgttgcaggagatgcacgtgactcattttaggttttctctggactgggccctgattctccctttggggaatcagagccaggtcaaccacaccatactccaatattacaggtgtatggcttctgaacttgtcagggtgaatattacaccagtcgtggccctgtggcagccaatggcccctaaccagggcctccctcggctgttggctcgccagggggcatgggaaaacccatacacagctcttgctttcgcagagtacgctcgactgtgtttccaagaactgggacaccatgttaaactctggatcaccatgaacgaaccatataccagaaatatgacgtattcagctgggcataatctgctgaaggctcatgcactggcttggcatgtgtataatgagaaattccgccacgcccagaatgggaagatcagcatcgctttgcaggccgattggatcgagcctgcctgcccattcagccagaaggacaaggaggttgccgaacgcgtgctcgagtttgacatcggatggctcgctgagcctatttttggttctggggattacccatgggtgatgagggattggctgaaccaaaggaataactttctcctgccttactttactgaggacgaaaaaaaactcatccaaggaacatttgacttcctcgccctgtctcactataccaccattctggtggactctgaaaaggaggaccccattaaatacaatgactacctcgaggtgcaggagatgaccgatattacgtggttgaacagtccatcacaggtcgccgtggtaccatggggacttagaaaggtgctcaattggctgaagtttaaatacggggacctgcccatgtacatcatttcaaacggaatagacgatggcctccacgcggaggatgatcagttgagggtgtactatatgcagaactatataaacgaggccctcaaggcgcatatcctggacggtataaatctctgtggctacttcgcatattcttttaatgaccggactgccccccgcttcggtctctatcgctacgccgcagaccagtttgaacccaaagcaagcatgaaacactacagaaaaatcatagacagcaatggatttcccggcccggagaccctggaaagattctgccccgaggaatttacagtgtgtacggaatgttcctttttccataccagaaagtctctgctggcattcatcgcttttctgttttttgcatctattatcagtctctccctcatcttttactacagtaagaagggaaggcggtcttacaaa

SEQ ID NO: 15338 - DNA, 3036 bp, Artificial Sequence
  Description of Artificial Sequence: Synthetic coding sequence
atgcccgccagtgcccctccgagacgtcccaggcctcctccgccctcactgagcctccttctcgttttgctgggcctgggtggcaggcgcctgcgcgccgagcccggcgatggcgcacagacatgggcccggttcagccgcccaccagcccctgaagctgctggactgttccaggggactttcccagatggctttctgtgggccgtgggcagcgctgcctatcagacggaggggggttggcagcagcacgggaaaggcgcaagcatctgggatacttttacacaccacccactggccccaccgggagattcccggaacgcatccctccctctcggcgccccctccccgctccagcctgctacgggggatgttgcgtctgatagctataataatgtctttcgggataccgaggctctccgcgagcttggggtcactcactatcgcttcagcatcagttgggcgcgcgtattgcctaacggatccgctggtgtcccgaaccgggaaggcctgcgctattaccggaggcttcttgagcgactgcgagaactaggcgtgcagcctgtggtgaccctctatcactgggatctcccacagcggctacaggacgcttatgggggatgggccaacagagctctggcagaccatttccgggattatgccgaactctgttttcggcacttcggaggccaagtgaagtattggatcacaattgataacccatacgtagtggcctggcacggatacgccactggcagattggcaccgggaatccggggcagtccccgcctaggctatctggtcgctcacaatctgctgcttgcccacgccaaggtgtggcatctgtacaacacaagttttcgacccacccagggtgggcaggtgtctatagctctgagttcgcactggataaacccaagacgcatgaccgaccattcaattaaggagtgtcagaaatctttggatttcgtgctgggttggtttgccaagcctgtgttcatcgatggggattaccccgaatcaatgaaaaataacctaagttctatactccctgattttactgaaagcgaaaaaaagttcataaagggcaccgctgatttttttgccctgtgcttcggacccacactcagtttccagctgttggacccccacatgaagtttcggcaactggaatcacctaatctccgtcaactcctcagttggatcgatctggaattcaaccacccacagatttttatagtcgaaaacgggtggttcgtgtccggcacaactaagagggatgacgctaagtatatgtactacctgaaaaaatttattatggagacgctcaaggcgattaaactggatggcgtggacgtgatcggatatacggcatggagtttgatggatggattcgaatggcaccggggttatagtatccggagaggcctgttttacgttgactttctgtcccaggataagatgttactcccaaagagctccgccctcttttaccagaaactgatagaaaaaaacggctttccgcctctccctgaaaaccagccattggaaggcaccttcccctgcgatttcgcttggggcgtggtcgataactatattcaggtggacaccacactgtcgcagttcacggaccttaatgtttacctatgggatgtgcatcattcgaagaggctgatcaaggttgatggagttgtgaccaagaagcgcaagtcttactgcgttgactttgcagcaattcagcctcagatcgccctacttcaggaaatgcacgtaactcattttaggttctctttggactgggccctgattttgcccctcggtaatcagagtcaggtgaatcacaccatccttcagtactaccgatgtatggctagcgaacttgtgagggtgaatattaccccagttgtcgctttatggcagcctatggctccaaaccagggcctcccacggctgctggcccgccagggcgcttgggagaacccctataccgctctagcgttcgccgagtacgcgcggttgtgctttcaagaacttggacatcatgtcaaactctggattacgatgaacgaaccatatactcgtaatatgacttacagtgccggccataacctgttaaaggcccatgcacttgcctggcatgtgtacaatgaaaagtttagacacgctcagaacggcaaaatttccatcgccctgcaggctgactggatagaacccgcgtgccctttcagccagaaggataaagaggttgctgaacgggttctcgaattcgacatcgggtggctagctgagccaatattcggctctggcgactatccctgggtaatgcgagactggttgaaccagagaaacaactttctgctgccctattttactgaagacgagaaaaaactaatccagggcacctttgatttcttggccctttcacattacaccaccatcttggtcgatagtgagaaagaggacccaatcaagtacaacgattatctcgaggttcaggaaatgaccgacatcacctggctgaatagtccctctcaagtggcagtggtcccctggggactgagaaaggttctgaactggctaaaattcaagtatggcgacttgccaatgtacatcatttctaacgggatcgatgacgggctacacgcggaggatgaccagctgagagtgtactacatgcagaactatattaatgaggccctaaaagcccatatcctggatggaatcaacctctgcgggtattttgcctattcgttcaatgaccgaacagcgccaaggttcgggctttatagatatgcagctgatcaattcgagcctaaagctagcatgaagcattatagaaagatcatcgactctaatggttttccgggacccgaaaccctggaacgcttctgcccagaagagtttacagtgtgcacggagtgcagtttctttcacacccgcaaatctctgcttgcttttattgcctttctctttttcgcgagcattataagtctgtctctgatattttactattccaagaaaggccggcgctcgtataag

SEQ ID NO: 15339 - DNA, 3036 bp, Artificial Sequence
  Description of Artificial Sequence: Synthetic coding sequence
atgccagcatccgcccctccccggaggccccgcccgccccccccatctttatccctattgttagtgttgcttggactaggagggcggaggctgagggccgaacccggggacggggcccagacatgggcccgcttttctcggcctccagctcccgaggccgcaggactatttcaggggactttccctgatgggttcctttgggccgtcggatcagccgcatatcagacagaaggagggtggcaacaacacggaaaaggggcttcaatctgggatacatttactcaccatcccctcgccccccctggagattcacgtaacgcatccctgcctctaggggccccctcacctctccagcccgcaacaggagatgtggcttctgactcatataacaacgtgttcagggatacagaagctctccgggaacttggggtgacacactatcggttctctatctcatgggcgcgggtcctcccaaacgggtcagccggagtacctaacagggaagggctacggtattatcgaagactccttgaaagactgagggaactcggggtccagcctgtagtgacactttatcactgggatctccctcagcgcttacaggatgcttatgggggatgggcaaaccgggccctcgctgatcatttcagagattatgcagaattatgctttcgacatttcggaggacaggtgaaatattggatcacaatagataacccatatgtcgtggcatggcatgggtatgccacaggaaggctagcacctgggatacgagggtccccacggcttgggtaccttgtggctcacaatctcctcttagctcatgcaaaagtgtggcacttgtataatacttctttccgccccacacagggagggcaggtgtccatagctctatcctcgcattggattaatccaagacgcatgacagaccattctatcaaagagtgtcagaaatcattggactttgtgctggggtggtttgctaaaccagtcttcattgatggagattaccctgaatccatgaaaaataatctttcttcaattcttccagattttacggaatctgaaaagaaattcataaaaggaactgccgactttttcgcactatgcttcggacccacactgtcgttccagctgctggatccacatatgaagtttaggcagctggaatctccaaatctgcgccagcttctctcctggatcgaccttgagtttaatcatccccagatctttattgtagagaatggatggttcgtatcagggactacaaagcgagatgacgcgaaatatatgtactatcttaaaaagttcatcatggagacactgaaagctatcaaactggacggggtcgatgtgatcggatatacagcttggtctctcatggatggattcgaatggcatcgagggtatagtataagacgggggctgttctacgtagattttcttagtcaggataagatgctcttgccaaagtcttccgctctgttctatcagaaactaatcgaaaaaaacggatttcctcctctgcccgaaaatcagccacttgaagggactttcccctgcgatttcgcatggggagttgttgacaattacatccaggtggatacaactctaagtcagtttacagatctgaacgtctacttgtgggatgtacatcactctaaacggctcataaaagtggacggagtggtgacaaagaaaaggaaatcgtattgtgttgatttcgccgctatccagccacaaatagcccttcttcaggaaatgcacgtgacacattttcggttcagtcttgattgggccctgatcctgcccctaggaaaccagtcacaggtcaatcacactatcctccagtactatagatgtatggcctcagaactggtaagggtgaacatcactccagtggtggctttgtggcaacctatggctcctaaccagggactccctagacttctagcccggcagggagcttgggaaaatccttatacagcccttgccttcgcagagtatgccaggctttgcttccaagaattgggacaccacgtgaaactctggatcactatgaacgaaccctatacacgcaatatgacttattccgcaggacacaatctcctaaaagctcatgctcttgcatggcacgtttataatgaaaaattcagacatgcacagaacgggaaaatttctatagccctccaggcagattggatcgaacccgcttgtccattttctcagaaggataaggaggtggccgaaagagtactggaattcgatataggatggctagcagaaccaatctttggatctggggattatccttgggtaatgagggactggcttaaccagcgcaacaacttcttgttgccttattttactgaagatgagaaaaaattgatacaggggacattcgacttccttgccctctcacactacactacaatattagtcgattcggagaaagaggatcctatcaagtataatgattatctagaagtccaagagatgacagatatcacatggttgaactctccctcccaggtagccgtggtcccttgggggctacggaaagtcctcaattggctcaagttcaaatacggggatctgcctatgtatataatatctaacgggatagatgacggactacacgccgaggacgatcagctcagggtatattacatgcagaactacatcaatgaggccctgaaggctcacattctcgatggaattaacttatgcggatattttgcgtattcgtttaacgatcggactgcccctcgctttgggctgtatcggtacgctgcagatcagttcgaacccaaagcttcaatgaagcattacaggaaaatcatagattctaacgggtttccagggccagaaactctcgaaaggttctgtcccgaagaatttacagtatgtactgagtgttccttttttcatacacgcaaaagtctcctcgccttcatcgcgttcctcttcttcgcgtctattatcagtctgtcactgatcttctattattctaaaaaagggcggcggtcctataaa

SEQ ID NO: 15340 - DNA, 3036 bp, Artificial Sequence
  Description of Artificial Sequence: Synthetic coding sequence
atgccagcctctgctccgccgagacgcccaaggccacccccgccgagcctgtcgctgctcctcgttctgctaggcctgggcggtcgcaggttacgtgccgaaccaggtgatggggcccagacttgggctaggttttcacgccctccggcaccagaggcggcaggtcttttccagggtactttcccggatggttttctgtgggctgttggtagcgcggcataccagacagagggaggctggcagcagcatgggaagggggcatccatctgggatacttttactcaccacccgctggcgccgccaggagactcacgcaacgctagcctgccgctgggcgcaccgagcccgctgcaacctgcaaccggcgacgtggcctctgactcatacaacaacgtatttagagataccgaagcactgcgcgagctgggcgtgactcattaccgtttttccatttcctgggcacgcgtactgccgaacgggtcagcgggcgtaccgaatagagagggactacgttattacaggcgcctgttagaacgcctgcgggagctgggcgttcagccggtagtcacactatatcactgggacctgccacaacgcctgcaggacgcctatggcgggtgggcgaatcgcgcactggcagatcacttccgcgactatgcggagctgtgttttagacactttggtggtcaggtgaagtactggataactattgataatccatatgtggtggcatggcatgggtatgccacgggtcgactggctccaggcatcaggggatccccacgactggggtaccttgtggcacacaatctactgctggctcacgctaaagtgtggcacctctataataccagtttccgtccaacgcaaggaggacaagtgtcgatagcgctgtccagccactggattaacccgagacgcatgaccgaccattccattaaagaatgccagaagagcctcgatttcgtcctgggttggtttgccaagcctgttttcatcgacggcgactacccggaaagcatgaaaaacaatctgagctccattcttccagatttcaccgaaagcgagaagaagtttattaaaggtactgccgatttcttcgcgctctgtttcgggccaaccctgagcttccagctgctcgacccgcatatgaagtttcgacaactggaatccccgaacctacgacagctgctaagctggatcgacctagaattcaaccatcctcagatctttatagtggagaacggttggttcgtgagcggcaccactaagagagacgacgccaaatatatgtactatctcaagaagtttatcatggaaactctgaaagcaataaaactggacggcgtggatgttatcggctataccgcatggagcttaatggacggctttgaatggcaccgcgggtatagcatccggcgggggctgttttacgtcgacttcttgtcccaggacaaaatgttgctgccgaaaagcagcgccctcttctatcagaaactgattgagaaaaacggttttccaccactgccggaaaaccaaccgctcgaagggacctttccatgtgattttgcatggggtgtggtggacaactatattcaagtggacaccaccctgagtcagttcactgacctgaacgtttacctgtgggatgtgcaccatagcaagcgcctgataaaagtagacggcgtggtcaccaaaaaacgcaagagctactgtgtcgactttgccgcgatccagccgcagatcgcccttttacaggaaatgcatgtcacacacttccgcttcagcctcgactgggccctgatcctaccactgggtaaccagtctcaagtcaaccacaccattctgcaatattaccggtgcatggcaagcgagttggtccgagttaacatcacaccggtagtggcgctgtggcagcctatggcgcctaaccaaggtctgccaaggcttctggcaagacagggtgcttgggagaatccctataccgcattggctttcgcggagtatgccaggctgtgctttcaggaattgggccatcacgtgaagctgtggatcaccatgaatgagccttatacccgtaacatgacgtactcagctggccacaatttgttgaaagcacacgcactggcatggcacgtgtacaacgagaagttccgccacgcacagaacggaaagattagcattgcactgcaagcagactggatcgagccagcttgcccattttctcagaaggataaggaggtggccgagcgcgtgcttgaatttgatatcggctggctggctgagccaatttttggtagcggcgactacccttgggtcatgcgtgattggctgaaccaacgcaataactttctgctcccgtactttacggaagatgaaaaaaagctcatacagggcactttcgattttctggcgctgtcgcattacaccacgattctggtcgacagcgaaaaagaggatccaattaagtataatgactaccttgaagtccaggaaatgacggatatcacttggctgaatagcccaagccaagttgcagtcgtcccctggggtctgcgcaaggttctgaactggctgaaatttaagtacggggatctcccaatgtacatcatcagcaatgggattgacgacgggcttcatgcagaagatgatcaactgcgcgtctattacatgcagaactatatcaacgaggccctcaaggcccacatcctggatggcataaacttatgcggttattttgcctatagcttcaacgacagaaccgcgcctcgctttggtctctatagatatgcggccgaccaatttgagccaaaagcgagtatgaaacactatcgtaagataattgatagtaacggattcccaggcccggagactctggaacgcttctgtcctgaggagttcaccgtctgcaccgagtgctccttcttccataccagaaaaagcctgttggcattcattgcgtttctgtttttcgctagcatcatttcactgtcactcattttctactactccaagaagggccgccgctcttacaag

SEQ ID NO: 15341 - DNA, 3036 bp, Artificial Sequence
  Description of Artificial Sequence: Synthetic coding sequence
atgcccgccagtgcccctccgaggcgacctagaccgccacctccttccctgtccttgctgctggtcttgctgggtctggggggccggcgcctcagggcagagccaggtgatggtgctcagacttgggccaggtttagcaggcccccggctccagaagccgctgggctgttccaaggtacattccccgatggcttcttgtgggctgtgggaagcgcggcttaccagacagaggggggctggcagcaacatgggaagggtgcatctatctgggacaccttcacccaccaccccctcgctccacccggcgacagtcgaaacgcaagcctgcccttgggtgcccccagccccctgcagcctgccacaggcgatgtggccagcgactcttataacaacgtgtttcgggatacagaggccctgagagaactcggggtgactcactatcgctttagtatctcctgggcacgcgtccttcccaacggatccgccggagtcccaaacagagaggggctgcggtactatagacggctgttggagagacttagagagctcggggtccagccagtggtaaccctgtatcactgggacctcccacagcgactgcaggacgcctacggaggctgggcaaatcgcgccctggccgatcacttccgggactacgccgagttgtgcttcagacactttggtgggcaagtgaaatactggatcaccatcgataacccgtacgtggtcgcctggcacggatacgcgacggggaggctggccccgggcattcgcggttccccgcgcctggggtatctggtagcccacaacttgctcttggcacacgctaaagtgtggcacctgtacaatacgtcatttcgacctacacagggagggcaagtctctattgccctgtcctctcactggataaatccaagacggatgaccgatcactccattaaggaatgccagaaatcattggacttcgtcctgggctggttcgccaagcccgtattcattgacggagattatcctgaaagtatgaaaaacaatctgtcttccatcttgcccgattttacagagagtgagaagaaatttattaagggaacagccgatttcttcgcactgtgtttcggtcctactctctctttccagctgctggatccccacatgaaattccggcaactggagagccctaatctgcggcaacttttgtcatggatagacttggaatttaatcatccacaaatatttatcgtggagaacggttggttcgtgtcagggacaacaaaacgcgacgatgctaagtatatgtactacctcaagaaattcattatggagaccctcaaggcaatcaaattggacggagtggacgtgatcgggtatacagcgtggtcactgatggacggcttcgagtggcataggggatacagcatccggcgggggttgttctatgtggacttcctctcccaggacaagatgctgctgcctaaatccagtgccctgttctatcagaagctcatcgagaagaatggattcccaccgcttccagagaatcagccgctggaggggacattcccatgtgactttgcgtggggggtggtagataattacattcaggttgataccacactgtctcagttcaccgatcttaatgtatacctgtgggacgtgcaccattccaaacgactgattaaggttgatggcgtggtcacaaagaaacggaaatcatattgcgtggacttcgcagcaatccagcctcagatcgccctgctgcaggagatgcacgttactcacttccgattttcactggactgggccctgatcctgcccttggggaatcagtcccaggttaaccacacgatcctgcagtattataggtgcatggcctctgagctggtacgggtgaatattacacctgtggttgcactctggcagcccatggctcctaatcaggggctgcctagacttttggcccgacagggggcttgggagaatccctatacggctctcgctttcgctgagtatgctcgcctttgctttcaggaactcggccaccacgtgaaactttggatcacgatgaatgagccctatacaaggaacatgacgtatagcgcgggccacaacctcctcaaagctcacgctctggcctggcatgtctacaacgagaaattcagacacgcccagaatgggaaaatctccattgcattgcaggccgattggatagagcccgcatgcccgttcagccagaaagataaggaggtagccgaacgggtcttggagtttgacattggctggctggccgagccgatcttcgggtctggcgattatccttgggttatgagggactggctcaaccaacgcaataatttcttgctgccctacttcacagaggatgagaagaaactcatccaaggaacattcgacttcttggcactttcccactataccacaatcctggtcgattcagagaaggaggatcctatcaaatacaacgactacctcgaggttcaggagatgaccgacatcacctggctgaattccccgtctcaggtcgctgttgtgccctggggcctgaggaaggtactgaattggttgaaatttaagtacggcgatctgcccatgtatataatctctaacgggatcgacgatggcctgcacgcagaggatgatcaactgagggtgtattacatgcagaactatattaatgaggccctgaaggcccatatcttggatgggattaacttgtgcggatacttcgcctactcatttaatgatcgaactgccccccgctttggcctgtacaggtatgctgctgatcagttcgaacctaaggctagcatgaagcattacaggaagataatcgacagcaacgggtttcccggacctgagacattggaaaggttctgtccagaggagttcactgtttgcacggagtgcagcttcttccatacccgaaaaagcctgctggcgtttatcgcttttctgttttttgcttctataatatctctcagtttgattttctactattctaagaagggaaggcgctcatacaaa

SEQ ID NO: 15342 - DNA, 3036 bp, Artificial Sequence
  Description of Artificial Sequence: Synthetic coding sequence
atgccggccagcgctcctcctaggaggccccgacctccacccccctctctgtcactgctcctcgtgctgctcggattgggtggacggcgtctccgggccgagcccggcgacggggcccagacatgggccaggttttccagaccacctgccccagaagctgctggactttttcagggaacgtttccagacggctttctatgggctgtgggcagcgcagcttatcagacagagggcggctggcagcagcatggtaagggagcctccatttgggatactttcacccatcaccctctggccccgcctggcgactctcgaaacgccagtctaccactgggcgctccatctcccttgcagccagccactggggatgtggcctccgatagctataacaacgttttcagagacacggaagcattgcgggaactgggggtgactcattaccgcttctcgattagctgggcaagagtgctcccaaacggaagcgctggagtacccaatcgtgagggtctgagatattaccggaggttgctggagcggcttcgggaactgggggtccagccagttgttacactgtaccactgggacctgccacagcggcttcaagatgcctacggcgggtgggctaatcgcgcgctagctgatcacttccgggactatgctgaactttgctttagacacttcggggggcaagtgaaatattggattacgattgataatccttacgtggtcgcctggcacggctatgccacaggccggctggcccctggaattagaggttctcctcgactgggctatctcgtagctcacaatctcctcctggcgcacgctaaagtatggcacctctacaataccagcttcaggccaacccagggaggacaagtgagcatcgcactgtccagccactggatcaatccacgtcgtatgaccgaccactcaatcaaagagtgccagaagagtttggacttcgttctaggttggtttgccaaaccggtctttatagacggggattatcctgagagtatgaagaataacctttcctccattctgcccgactttacagagagcgagaagaagtttataaaggggactgctgacttttttgctctctgttttggccccacactgagttttcagctgctagatcctcacatgaaatttcggcagctagaaagccctaatctgagacagctgttaagctggatagacctggaatttaaccacccgcagatctttatcgtcgagaacggatggttcgtaagcgggacgacaaagcgcgatgacgcgaaatatatgtattaccttaagaagtttatcatggagacactcaaagcgataaagttggacggggtggacgtcataggatatactgcctggtcattgatggacgggttcgaatggcaccgcggttattccatccgccgaggcttgttctatgtggatttcctgtctcaggacaagatgctccttcccaaaagctccgcacttttttaccagaaattgatagagaagaacggatttcccccactgccagaaaatcagcccctcgagggtactttcccctgcgacttcgcctggggggtagttgataactacatccaggtcgataccacacttagccagtttaccgatctaaatgtatacctctgggacgtgcaccattcaaaaaggttgatcaaggtagacggagtcgtaaccaaaaagaggaagagttactgcgtggatttcgctgccatacaaccccagatcgcattactgcaggaaatgcacgtgacgcacttcagattcagcctagactgggctttaatccttccccttggaaaccagtcacaggttaaccatactattctacagtactatcgctgcatggcaagcgaactggtacgagtcaacatcaccccagtggtagctctctggcagcctatggctcctaatcagggtctcccaagactgctggcccggcagggtgcctgggaaaatccctatacagcactggcatttgctgagtacgctagattgtgtttccaggaattagggcaccacgtcaaattgtggatcacgatgaatgagccttatacaaggaacatgacctactcggccggccacaaccttctcaaggcccatgccttggcatggcatgtttataacgagaagttccggcacgcgcaaaacgggaagatctctattgccctgcaggcggactggattgaacctgcatgtccctttagtcagaaagacaaggaggtcgcggaacgggtgctagagtttgatattgggtggctggcggagcccattttcggatccggagactacccttgggtgatgagagattggcttaatcagaggaataactttctcctcccttactttactgaggatgagaagaaactgatccagggaacctttgacttcttagcactgagtcattatactacaatcctggtcgattctgagaaggaagaccctatcaagtacaatgattacttggaagttcaggaaatgaccgatattacctggttaaactcacccagccaggtcgccgtcgtgccttggggacttcgaaaagttttaaattggctcaaatttaagtacggggatcttcccatgtacatcattagcaacggcattgatgacggcttgcacgcagaagacgatcaactcagagtgtactatatgcagaactacatcaacgaagctcttaaggcacatattttggacgggattaacctatgcgggtattttgcgtactctttcaatgatcgcaccgcgccaagatttgggctgtacagatacgcagctgaccaattcgaacctaaggccagcatgaagcactaccggaagattattgactccaacgggttccctggacctgaaactctggagaggttctgccccgaggagttcacagtctgcactgaatgttcttttttccatacgcggaagagtttgctcgcgttcattgcttttctgttctttgccagcatcatcagcctctcactgatcttttattatagcaagaaagggcggcgaagttacaaa

SEQ ID NO: 15343 - DNA, 3036 bp, Artificial Sequence
  Description of Artificial Sequence: Synthetic coding sequence
atgccggcgagcgccccgccgcgtcgcccgcggccaccaccgccgtccctgtccctgctcctcgtgctccttggtctgggaggcagacggctgcgcgccgaaccaggagatggcgcacagacttgggcgagattctccagaccgccagccccggaagcggcgggactgttccagggcacctttccggacggattcctgtgggccgtcgggtcggcggcttaccagactgagggaggatggcaacagcacggcaagggcgcctcgatctgggatacttttacgcaccatccacttgctcccccaggagacagcaggaacgcatcattgcccttgggagccccttcgccgttgcaacccgccactggtgacgtcgcgtcggatagctataacaacgtgtttcgcgacactgaagcactcagggaactcggagtgactcactaccgcttcagcatctcgtgggctcgggtcctccccaacggctcggccggagtgcctaatcgcgaagggttgcggtactaccggcggctcttggagcggctgcgggagcttggggtccaaccggtggtgaccctgtaccattgggacctgccgcagaggctccaggatgcctacggtggttgggctaaccgggcactggcagaccacttccgggattacgcggaactctgctttcggcatttcggaggacaagtgaagtactggatcaccatcgacaatccatatgtggtcgcttggcacggttacgccaccggtaggcttgcgccgggaattagaggatccccgcggctgggatacctggtggcgcataatctgctgctggcccacgcaaaggtgtggcatctgtacaataccagctttcgccctacccaggggggacaggtgtcaatcgctctgtcgtcgcattggattaacccaagacggatgaccgaccattccatcaaggagtgccagaagtctctggacttcgtgctcggatggttcgccaagccggtgttcatcgacggagactaccctgagtcgatgaagaacaatctcagctcaatcctcccggactttaccgaatccgagaaaaaattcatcaagggaaccgccgatttcttcgccctgtgcttcggaccgactctgtcattccagctgcttgaccctcacatgaagtttagacagctggagtcaccaaacctgagacagttgctgagctggatcgacttggagtttaatcacccgcagatcttcatcgtggaaaacgggtggttcgtgtcaggaaccaccaaacgggatgatgccaaatatatgtactatctcaagaagttcattatggaaaccctgaaggccatcaagctcgatggcgtggacgttatcgggtacactgcctggtcgctgatggacggatttgaatggcatagaggttactcgatccgaagaggcctgttctacgtggacttcttgtcgcaggataagatgctgctccctaagtcgtctgcgctgttctaccaaaagttgatcgaaaagaacgggttcccaccgcttcccgagaatcagcctctggagggcactttcccatgcgacttcgcgtggggtgtggtggacaactacatccaggtggacactacgctctcccaatttacggacctgaacgtgtacctgtgggacgtgcaccactccaagcgcctgatcaaggtggacggcgtcgtcactaagaagaggaaatcctactgtgtggatttcgctgcaatccaaccacagatcgcactgctgcaggaaatgcatgtgacccacttcaggttcagcttggattgggcgctcattctgccgctcggaaaccagtcccaagttaatcataccatcctccaatactatcgctgcatggcgtcagagctggtacgcgtcaatatcaccccggtcgtggcgctgtggcaaccgatggcaccgaaccaaggactgccacgcctgttggcccgccagggggcatgggagaacccctacacggcgctggccttcgccgaatacgccagactttgtttccaagaactgggccatcacgtcaaactgtggatcactatgaacgagccttataccaggaacatgacttactccgcaggccacaacctcctgaaagcacacgccctggcttggcatgtctacaacgaaaagttcagacacgcccagaatggaaagatcagtattgctctccaggctgactggatcgaaccggcctgccctttctcacagaaggacaaagaagttgccgagcgcgtgctcgagtttgatattggatggctcgcagagccaatattcggatcgggggactacccttgggtgatgagagattggctgaaccagcgcaataattttctcctcccttacttcactgaggatgaaaagaaactgatccaaggaactttcgacttccttgctctttcacactacaccaccatcctggtcgattcggaaaaggaagatcccattaaatacaacgactacctcgaagtccaagaaatgactgatattacctggctgaactccccatcccaggtggccgtggtgccttggggcctccgaaaggtgctgaattggctcaagttcaaatacggagatcttcccatgtacatcatcagcaacggcatcgacgatggcctgcacgccgaggatgaccagctgcgcgtctactacatgcaaaactacatcaatgaggcgctgaaagcccacatcctggacggtatcaacctgtgcggatacttcgcgtacagctttaacgaccgcaccgccccgcgctttgggctctaccgctacgctgcggaccagtttgaaccgaaagcatccatgaagcattaccggaaaattatcgatagtaatggcttcccgggccctgagactctcgaacgcttctgtccagaagaattcaccgtctgcacggagtgctccttcttccacactcgcaaatcccttctggctttcattgccttcctctttttcgcatcaatcatctcgttgagcctgatcttttactacagcaagaagggacgacggagctacaag

SEQ ID NO: 15344 - DNA, 3036 bp, Artificial Sequence
  Description of Artificial Sequence: Synthetic coding sequence
atgcccgcatccgcccccccgcgccgccctagacctccgccccccagtctctcgttgttgttggtcctgctcggactcgggggtcgccggctccgagcagaacccggcgacggtgctcagacctgggcacggttctcccgcccacctgcccccgaggccgcaggactgttccagggcaccttccctgacggcttcctttgggcagttgggagcgcagcctaccagaccgaaggcggatggcaacaacacggtaagggtgctagcatctgggatacattcactcatcatcccctcgcaccccccggggattcccgtaatgcttctttgcctctcggcgcgcccagtccgctccagcccgccactggggatgtcgcaagcgactcttacaataacgtcttccgtgacactgaggctctccgcgagctgggtgttacccattaccggttctccatcagctgggctcgagttcttcctaacggctctgccggtgtcccgaatcgtgaaggcctgcgctactatcggcgtcttctggagcgcctccgtgagcttggcgtccaacccgtggtcaccctttaccactgggacttgccccagcgtctgcaggatgcttacggcggttgggccaatcgggctctggcggaccatttccgtgactatgctgagctatgcttccgccatttcggtggacaggtcaagtactggatcaccattgacaacccgtacgtggtcgcctggcatggctacgctacaggccgactagctcctggtatccgtggctctccccgcctcggctacctcgtcgctcataatctccttctggctcacgccaaggtatggcacctctacaatacaagtttccgccctactcagggtggccaggtctcgatcgcgctgagctctcactggatcaaccctcgtcgcatgaccgatcactctatcaaggagtgtcaaaagtccctcgatttcgtcctcggctggttcgcaaagcctgtgttcattgacggcgactaccccgagtccatgaagaacaacctgagctccatcctcccggacttcaccgaatcagagaagaagttcatcaagggaaccgccgatttctttgccctctgctttggccctactctgagcttccaacttctggacccacatatgaagtttagacaactggaatcgccgaacctgcgtcaactgctctcttggattgatctggagttcaaccacccacaaatcttcattgtcgaaaacggctggttcgtcagcggcaccaccaagcgggacgatgctaagtacatgtactatctcaaaaagttcatcatggagacccttaaagcgattaagcttgacggtgtcgacgtcatcggctacactgcttggtctttgatggacggcttcgaatggcacagagggtacagcatccggcgaggcctcttctacgtggatttcctgagccaggataagatgttgctgcccaaatccagcgccttgttctaccaaaagctgatcgaaaagaacggatttccgcctttacccgagaatcagccgctcgagggtacgttcccctgtgacttcgcttggggagtggtggataactacatccaagtcgatacgaccttaagccagttcactgacctcaacgtgtacctttgggacgtccaccactctaagcgtctcatcaaggttgacggcgtcgtcaccaagaagcgcaagtcgtactgtgtggactttgcggcgattcagccccagattgccctgctgcaagagatgcacgtcacccacttccgcttctctcttgattgggctcttattctgcccctcggcaatcagtcgcaggtcaatcatacaattttgcagtactaccgctgcatggcctcggagctcgtgcgggtaaacatcacccccgtcgtcgcactgtggcaaccgatggcgcctaaccagggcctcccccggttgctcgcccggcagggcgcttgggaaaacccctacaccgccctagccttcgccgagtacgcccgtctgtgcttccaggagctggggcaccatgtgaagctttggatcacgatgaacgagccctacacccgtaatatgacgtactccgcaggccacaacctgctgaaggctcacgctcttgcctggcacgtatacaacgagaagttccgtcacgctcaaaacggtaagatcagtattgcgctccaggctgactggatcgagccagcgtgccccttctctcagaaggataaggaggtggccgaacgcgttctggaattcgatattggatggctcgcagagcccatcttcggatccggtgactacccgtgggtgatgcgtgattggctgaaccagcgtaacaattttcttctgccctacttcaccgaagatgagaagaagcttatccagggcacctttgacttcctcgctttgtcccattatactactatcttggtagattcggagaaggaagatcctatcaagtacaacgattacttggaagtgcaggaaatgacagatataacctggctcaattcgccctcccaggtcgccgtcgtgccctggggactgcgtaaggttctcaattggctcaagttcaagtacggcgaccttcccatgtacattatctccaatggtatcgatgatggcctccatgcagaggacgaccaactgcgcgtttactacatgcaaaactatattaatgaagcacttaaggctcacatcctcgatggcatcaatttgtgcggatacttcgcctacagcttcaatgacagaactgcaccccgctttggcctctaccgttacgccgccgaccagttcgagcctaaggcctccatgaagcattaccgcaagatcatcgatagcaatggattccctggacccgagaccctcgagaggttttgcccggaggaattcacagtttgtaccgaatgctccttcttccacacccgtaagtctctgctagcatttattgccttcctcttctttgcgtccataatctccctgtccctgattttctactattctaagaagggcaggagaagttataag

SEQ ID NO: 15345 - DNA, 3036 bp, Artificial Sequence
  Description of Artificial Sequence: Synthetic coding sequence
atgccagctagcgcaccaccgcggcggcctcgacccccacccccaagccttagcctgctgctggtgctcctgggtttaggaggtcggcggctgagagcggaacccggcgacggcgctcagacatgggcgcgcttttcacgaccacctgcccccgaggcagcaggattgttccagggaacctttcctgatgggtttctgtgggcggtcggaagcgcagcttatcagacggagggaggatggcagcagcacggtaagggggcctctatttgggacacgttcactcaccatccattggcccccccaggggactctcgtaatgcgtcactgccgctgggcgcccctagtcccctgcagcccgcaacaggggacgttgctagtgactcatacaacaatgtatttagggataccgaggcactgagggagctgggcgtcacacattacaggttctcaatcagctgggccagggtcctgcctaacggctccgctggagtcccgaatcgggaaggactcaggtactaccggcgcctactggaaagacttagggagctgggcgttcagcctgtggtgactctctaccactgggaccttccccaacgcttgcaggacgcttatggcggatgggctaaccgcgcattggccgatcactttcgagattacgcggagctctgctttcgtcactttgggggccaggttaaatactggattacgatagataatccctatgtggtcgcctggcacggttatgcaaccgggaggcttgcaccgggaattagaggctcgccgagacttggctatctggtggcacacaatctgcttctggcccacgctaaggtctggcacctgtataacacaagctttcgtccgacacagggcggtcaggtgtctatcgctctatctagtcactggattaaccctcgcaggatgaccgatcacagcattaaggagtgtcagaagtcattggacttcgtgctcggatggttcgccaagcctgtgtttatagatggtgactaccctgagtcaatgaagaacaatttaagtagtattcttccggacttcaccgagtcagagaagaaatttattaaagggacagctgactttttcgccttatgcttcggaccaactctcagcttccagttgctggatcctcacatgaagttccgacaactagagtcccccaatctgcgtcagctgctgtcgtggatagacttagagttcaatcatccccaaattttcattgtcgagaacggatggttcgtatctggaaccaccaagagggacgatgcaaagtacatgtactacctgaaaaagtttatcatggaaaccttaaaggcaatcaagctggatggtgtggatgtgataggttatacagcatggtccctgatggacggctttgagtggcaccgtgggtatagcatccgtcggggattattttatgtggactttctgtctcaagataaaatgctgctgccgaagtccagtgccctgttttatcagaagttgattgagaagaacggattcccacctctgcctgagaaccagcccctggaaggtacatttccatgtgatttcgcgtggggcgtagtggacaactatatccaagttgataccaccctgtcccaattcacggacctgaatgtttatctgtgggacgtgcatcactccaaacggcttatcaaagttgatggggtggtgacaaagaaaaggaaaagctattgtgtggacttcgccgctatccaacctcaaatcgctttgcttcaggagatgcacgtgacacacttccgattctctctggattgggccctcatcctcccactgggaaaccaatcccaagttaaccatactattttacagtattatagatgcatggctagtgagctggtaagggtgaacataactcctgtggtggcattgtggcagccaatggcccccaaccagggcctgccccgcctgctcgcccggcagggtgcctgggagaacccttacaccgcccttgcttttgctgagtacgctcgcctgtgctttcaggagcttggccatcacgtgaagttgtggattactatgaatgaaccgtacacacgcaacatgacctactccgctggacataatttgctgaaggcccacgctctcgcctggcacgtgtataatgagaagttccggcatgcgcagaatggcaagatcagcattgcattgcaagctgactggattgagcccgcctgtccattttcccaaaaagacaaagaggtcgctgaacgagtactagagttcgacataggatggcttgccgaacctattttcggctcaggcgattacccatgggttatgagagactggctgaaccaaagaaacaatttcttgctcccctacttcaccgaagatgagaagaagttgatccagggcaccttcgatttcctggctctgtcacattacaccaccatactcgttgactcagaaaaagaagatcctatcaagtacaacgactatctggaggttcaggagatgacagacatcacctggctgaatagtccttcacaggtggctgttgttccttggggattgagaaaagtgctgaattggttaaagtttaaatacggtgatctccccatgtacattatatccaacgggattgatgatggcctgcacgccgaggatgaccagctcagggtttattatatgcagaactacattaacgaagcattgaaggctcacatcctggacggcatcaacttatgtggatattttgcctattcttttaacgatcgcacggctccacgctttgggctctacagatatgccgcagatcagttcgaaccgaaggcctcaatgaaacactaccgcaaaatcattgactccaacggatttcctggacctgaaacccttgaacgtttttgcccagaagagtttacagtgtgtaccgagtgttcattctttcacacccggaagtccttattggcttttattgcattcctctttttcgccagtatcatcagcctgtccctgatattttactattcaaagaaggggagacgctcctataag

SEQ ID NO: 15346 - DNA, 3036 bp, Artificial Sequence
  Description of Artificial Sequence: Synthetic coding sequence
atgcctgcgagcgccccccctcggagacccaggccccctccccctagcctgagcctattactggtgcttcttggccttggcggcagaaggcttcgcgccgagcctggcgatggagcccagacgtgggcccggttctcgcgacccccagcccctgaggccgccgggctgtttcagggtacctttccagacggtttcctctgggccgtgggctccgctgcttatcagaccgagggaggctggcagcaacacgggaagggcgcctccatatgggacacattcacacaccacccactggcccccccaggagactctcggaacgccagtttaccgctcggggctcccagccccctgcaacccgccacgggcgatgttgcaagcgactcttataacaatgtgtttagggatactgaggctctgcgcgagctcggggtgactcattatcgcttctccatctcatgggctagggtcctgcccaatgggtctgccggagtcccaaatcgagaagggttacgctattaccgccggctgctcgagaggttaagagaattgggtgtgcaacccgtggttactttatatcattgggacctaccccaacgactgcaggatgcctacggagggtgggcaaatcgggctcttgcagaccactttagggattatgctgaactttgctttagacattttggaggacaggtaaagtattggataaccatcgataacccctacgtggtggcctggcatggatacgccacaggccggctcgctccggggatccggggcagccctagactcggttacctggtggctcacaacctcctgctggcccacgctaaagtctggcatttatataacacgagctttcggccaacacagggcggccaggtgtcaatcgcactgtcctcccattggatcaatccaaggcggatgaccgaccactccatcaaagagtgtcaaaagtctctcgactttgtgctggggtggttcgcaaagcctgtgtttatcgatggcgattaccccgaatccatgaaaaataacttgagctctattttgccagactttacagaaagcgagaaaaaattcataaagggcacagcggacttctttgcactgtgctttggccctaccttaagctttcagctgctggatccacacatgaaattcaggcagctggagtcccccaacttgcggcaactccttagctggatcgacttagagtttaatcacccccagatcttcatcgtggagaatgggtggttcgtatcaggaactacgaagcgagatgacgcaaagtatatgtattacctgaagaaattcatcatggaaacactcaaggccataaaattggacggagttgatgtcatagggtatactgcatggagtctgatggatgggttcgagtggcacaggggatactctattcgacgtggccttttttatgtcgattttctgtctcaggacaaaatgctgcttcctaaatcatctgcacttttttatcagaagttgatcgaaaaaaacggctttcctccccttcccgagaaccaaccgctggagggtacattcccatgcgactttgcctggggagtggtagataattacatacaggtcgacacaacactttcccaattcacagacctcaatgtgtacttgtgggatgtgcaccacagcaagcgccttattaaagtggatggcgtagtgacgaaaaagcgaaaatcgtactgtgtggatttcgcagcgatccaaccccagatcgcccttctgcaagaaatgcatgtgacacactttcggttcagcctggactgggctttgattttgccccttgggaatcagtctcaagtgaaccatactatcctgcagtactatcgctgcatggcatcagagctggtgcgagtgaacataacgccggtcgttgctctgtggcagcccatggcccccaatcagggcttgccaagactgcttgccaggcagggagcctgggagaatccatataccgccctggcattcgcagaatatgcaagactctgttttcaagagttgggccaccatgttaagctctggattacaatgaatgagccgtatacccgcaatatgacgtatagtgctggccataaccttttgaaagcccacgccctggcgtggcacgtctacaacgagaaatttcgccatgcccaaaacggcaagatatcaatcgcgctacaggcagactggattgaaccagcatgtcccttttcccagaaggataaagaggtggcagaacgggttcttgaattcgacatcggatggctggccgagccaatctttgggtcaggggattacccatgggtgatgcgcgattggctcaatcagcggaataacttcctgttgccctatttcacagaggacgaaaagaagcttatacaggggacttttgattttctggctctctcccattacactaccattctcgttgatagcgagaaggaggatcctatcaaatataacgactatctggaggtccaggagatgacagacatcacgtggctgaattccccgagccaggtcgccgtagtcccctggggcttgcgcaaagtactcaactggctaaagttcaaatatggcgatctgcctatgtatataatttctaacggaatcgacgacgggctgcacgccgaggacgatcagctcagggtgtattatatgcagaactacatcaatgaggcgttgaaagcccacatactggacggcatcaatctgtgcggctatttcgcatacagtttcaatgaccgaaccgcacctcgctttggcctgtaccggtatgcagccgaccagttcgagcctaaggcatcgatgaagcactataggaaaatcatcgacagcaacgggttcccaggtcctgagactctggagcgcttttgccctgaagaattcacggtctgcacggagtgctcattctttcacacacgcaagtcattgctggcgttcatcgccttcttgttcttcgccagtattatttccctttccttgatattctactattccaagaagggaagacgctcctacaaa

SEQ ID NO: 15347 - DNA, 3036 bp, Artificial Sequence
  Description of Artificial Sequence: Synthetic coding sequence
atgccagcatccgcccctccgaggcgcccccgcccgccacccccgtcacttagtctcctgctggtgttgttgggacttggtggaagacgccttagagccgagccgggcgatggcgcacagacctgggctcgcttcagtaggccaccggccccagaggctgctggcttgttccagggtactttcccggacggcttcctgtgggcagtgggctccgctgcataccaaacggagggaggctggcagcagcacggaaaaggcgcctctatttgggataccttcacgcatcatccccttgccccccccggtgacagcaggaatgcttctctcccgctgggcgctccgtctcccctgcagcccgccaccggcgacgtggcctccgattcctataacaatgtgttccgcgacacagaggcattgagggagcttggcgtgacgcactacagattcagcattagttgggctcgcgtgctgcccaacggcagcgcaggcgttccgaatagagaaggcctgaggtactatcgcagactgctggagagactgagggaacttggcgtacaacctgtggtaactctgtaccattgggatttgccacagcgcctgcaagacgcctacggcggttgggccaatagggcacttgccgaccattttagagactacgccgaattgtgctttcgccattttggaggacaggtgaaatactggataacaattgacaacccatatgtggtcgcatggcacggttacgctaccggacgcctggctcctggcatcaggggttcacccagactgggttacctggtggcgcataacctgttgctggcgcatgctaaggtgtggcatctctacaatacatcatttagacctacccagggaggacaggtcagcatagccttgtccagccactggataaaccccaggcgcatgaccgaccacagcatcaaggaatgccagaagtccttggactttgtcctgggttggtttgccaagcctgttttcatcgacggtgattatcccgagagtatgaaaaacaatctctcctctattctgcccgactttacggaaagtgagaagaaatttattaagggtacggcagatttttttgccctttgcttcggacctactttgtctttccaactcttggatccacatatgaaatttaggcagcttgagagcccaaacctgcgccagctcctctcctggatcgacttggagttcaaccatccccagatcttcattgtcgaaaatggttggttcgtgtctggaaccaccaagagagatgacgctaaatacatgtactaccttaagaagttcatcatggaaactctcaaggccataaagctggacggcgtcgacgtgattggttacactgcatggagcctcatggacggatttgagtggcacaggggctactctataaggagaggactgttttacgtcgattttttgtcccaggacaaaatgctcctccccaagtctagcgccctcttctatcagaaactgatcgagaagaacggtttcccccctcttccagagaatcagcccctcgagggaacgtttccatgtgacttcgcgtggggtgtcgtcgataactacatccaagtagacacaacactgtctcagttcactgatcttaacgtctacctgtgggatgtccatcatagtaaacgcctgataaaggtggacggtgtggtgacaaagaaaaggaagtcctattgcgtggactttgctgccatccagcctcagattgccttgttgcaggaaatgcatgtcacgcactttaggttctcccttgactgggctctgatcctgccgcttggtaaccaaagccaggtgaatcataccatcttgcaatattaccgctgcatggcctcagagctcgttcgcgtgaatattaccccagtagtggccttgtggcagccaatggcccctaatcagggccttccaagacttctggctcgccagggagcctgggagaatccctacacagcactcgctttcgcggagtacgccagactgtgctttcaggaactgggtcatcacgtgaaactctggatcactatgaatgagccatacactaggaacatgacctactctgctggccataacctgctgaaagctcacgccctggcctggcatgtctataatgagaagttcaggcacgcgcagaacggtaagatatcaattgctctgcaagcggattggatagagcccgcatgtccgttttcacagaaagacaaggaggttgcagagcgcgtcctggaattcgatattggttggctggcagagccgatcttcggaagtggtgactacccttgggttatgcgcgattggctgaaccagaggaataacttcttgttgccttacttcaccgaggatgagaaaaagctgatacagggcactttcgacttccttgcgctgagccactatacaacgattctcgtggactccgagaaggaggaccctataaagtacaacgactacctggaagtgcaggaaatgactgacatcacatggctcaattctccctctcaagttgcggtcgtgccctggggactcagaaaagtgctgaactggcttaagttcaagtatggtgatttgcctatgtacatcatcagtaatggcattgacgatggcctccacgccgaggacgaccagttgcgcgtgtattacatgcaaaattacatcaacgaggctctcaaagcgcacatcctggatggaatcaacctgtgcggctatttcgcatattcctttaacgatagaaccgccccccgctttggtttgtaccgctacgctgctgaccaatttgagcccaaggcctctatgaagcactacaggaaaatcatcgatagcaacggttttcctggtcccgaaactctcgagcgcttctgccccgaggagtttacagtgtgtaccgagtgctcctttttccacacaaggaagtctttgctcgcttttatagcgttcctcttctttgcttctattattagcctgtctttgatcttctactactcaaagaaaggtaggagaagctacaag

SEQ ID NO: 15348 - DNA, 1320 bp, Artificial Sequence
  Description of Artificial Sequence: Synthetic coding sequence
atgggacccccaggatccccctggcagtgggtcactctgctgctgggactgctactgccaccagctgcccctttctggctcttgaacgtgttgttccctcctcacactacccccaaagccgaactgtccaatcatactcggccagtgatcttagtgccgggctgcctcggaaaccagctggaggcgaaactggataagcctgatgtggtgaattggatgtgctaccgcaaaacagaggacttttttacaatatggctcgatctcaatatgtttctgccacttggagtcgactgctggatcgataacacacgggttgtgtacaaccgctcttccggactggtgtctaacgcccctggggtgcaaattagggtccccggctttggtaagacctattctgtcgagtacctggacagcagcaaattggccggatacctgcataccctggttcaaaacctcgtgaacaacggctacgtcagagacgagacagtcagagccgctccatacgactggcgcctcgaaccgggacagcaagaggaatactatagaaagctcgctggtctggtggaggagatgcatgcggcctacggtaaacctgtcttcctgattggacactccttgggatgtctccatctgctgtacttcttactccgacagccacaagcatggaaagatcggtttattgacggatttataagtctgggtgccccatggggcggcagcatcaaaccaatgttggtgttggcatcaggagacaaccaaggcataccaataatgtcctcgatcaagttaaaagaagaacaacggattacgacgacatcgccttggatgtttccctcccggatggcgtggcctgaagaccacgtgttcatatcaacacccagttttaattacactggaagagacttccagaggttcttcgctgacttgcacttcgaggagggttggtacatgtggctgcagtcaagagatctactagctggccttcctgcccccggagtcgaggtgtattgtctctatggtgtcggcctgcctacaccacgaacatacatatatgatcacggttttccatacacagatcctgtcggtgttctttatgaagacggggatgatactgtggctacacggtccaccgagctgtgtggcctgtggcaggggcggcaaccccaacccgtccacctgcttcccttgcatggcattcaacatctcaacatggtattttcaaatctcactttggaacacataaacgctattcttctcggagcctaccgccaggggcctcccgcaagtcccacagcaagtcccgaaccacccccccctgaa

SEQ ID NO: 15349 - DNA, 1320 bp, Artificial Sequence
  Description of Artificial Sequence: Synthetic coding sequence
atgggaccgcctggaagcccttggcagtgggtgactcttcttctgggccttcttctgccgcccgcagcacctttctggctgcttaacgtcctttttcctcctcacacgacccctaaggcagaactgtcgaatcatactcgaccggtgattctggtgccgggatgtttgggcaaccaactcgaggccaagctggacaagcccgatgtggtgaactggatgtgctatcgtaagaccgaggacttctttactatctggctggaccttaacatgttccttcctcttggagttgattgttggattgataacactagagtcgtgtataatcgctcatctggcttggtcagcaacgctcctggtgtgcaaattcgagtgccgggctttggtaagacttactcggtggaatacctggactcctcaaaactggccgggtacctgcatactctggtccaaaatctggtgaacaacggttacgtgcgggacgaaactgtccgcgcggcgccatacgattggcgtctggaaccaggtcagcaagaagaatactatcgaaagctggcaggcctggtggaggagatgcatgccgcctacgggaagcccgtgtttcttattgggcattccctgggctgcctgcatctcctctactttctgcttagacagcctcaggcctggaaggatcggttcattgatggcttcatttctcttggagccccatggggagggtcgataaaaccaatgctggtccttgcgtcgggagacaatcagggcatccctatcatgtcatcgatcaagctgaaggaggagcaaaggattaccaccactagcccatggatgtttccgtcccggatggcatggcctgaggatcatgtattcatctcaactccttcgtttaactacactggccgtgattttcaaagatttttcgcagatcttcacttcgaagaggggtggtacatgtggctgcagagcagggacctgctcgcaggtctgcccgcacccggggtcgaagtgtattgtctttacggagtcggactccctaccccacggacctacatctacgatcatggatttccctatactgatccagtcggagtgctctacgaagatggagatgataccgtggcaactagatcgactgaactgtgtggtctttggcaagggaggcagccacagcctgtgcatcttctgcctctccatggcattcagcacctgaacatggtgttctcaaacctcaccctcgaacatatcaacgcgattcttttgggtgcttaccggcaaggaccccccgcctcgcccaccgcatcacccgaaccgcccccacctgaa

SEQ ID NO: 15350 - DNA, 1320 bp, Artificial Sequence
  Description of Artificial Sequence: Synthetic coding sequence
atggggccccctggaagcccgtggcaatgggttacacttctcctgggtttgctgcttcctccggcagctcctttctggctcctgaacgtactctttcccccgcacaccacccccaaggccgagctgagcaatcatacgcgccctgtgattctggtcccggggtgtctgggaaatcagctagaggccaagctggacaagcctgacgtggtgaattggatgtgctacaggaagaccgaggacttctttactatttggctggacctgaacatgttcctgccactgggtgttgactgctggatagataacaccagggtggtatacaaccggtccagcggcttagtctctaacgcccctggagtccagatcagggtgccaggtttcggtaagacctatagtgtagagtatcttgatagcagcaaattagctgggtacctgcataccctggtgcagaatcttgtcaataacgggtatgtccgagacgaaacagtgagagcagccccctatgactggagactcgaacccggccagcaggaagaatactatagaaaactggccgggctagtcgaagagatgcacgcagcttatgggaaacccgtgtttctgattggacatagtttggggtgtctgcatcttctgtacttcctcctccggcagccgcaagcctggaaggatcgttttatcgacggcttcatttcactgggcgctccctggggaggcagcattaagcctatgctcgtactggccagtggtgacaaccagggaattcccattatgtcgtcaattaaactgaaggaagagcaacgtattactactacaagcccgtggatgttcccaagccgcatggcctggcctgaggaccacgtgttcatcagtacgccctcttttaattataccgggcgggactttcagcgcttcttcgctgatctccatttcgaggaaggttggtacatgtggctgcagagtagagatctgctggcgggcctgccagcaccgggcgttgaagtctattgcttatatggagtcggtctacccacccctagaacctatatttacgaccatggcttcccctacacagacccagtaggtgtcctgtacgaagacggagacgatacagtggctactcggtccactgagctttgcggtctttggcaaggccgtcagcctcaacccgtccacctgttgccgttgcacggaattcagcatctgaacatggtctttagcaaccttacactcgagcacattaacgcgatcctgctgggggcttatcgacagggcccccccgctagcccaacggcgtctcctgagcctcctccacctgag

SEQ ID NO: 15351 - DNA, 1320 bp, Artificial Sequence
  Description of Artificial Sequence: Synthetic coding sequence
atgggacctcccggcagtccgtggcagtgggtgaccctgctacttggactgctgctccctcctgcagcacccttctggctcctcaacgtcctgtttccccctcacacgacccctaaggccgagctctctaaccacacgcggccagtcatcctcgtgccgggatgtctcggcaaccagctggaggcaaagctcgacaaaccagatgtggtcaattggatgtgttatcggaaaacagaggactttttcaccatttggctggatctgaatatgtttctccccctgggcgtcgattgctggatcgacaatacacgagtggtttataaccgctcctcaggcctcgtgtcgaatgcaccaggggtgcaaattagggtgcctggctttggaaaaacttatagtgtcgagtacctagattctagtaaacttgccggatatctccatacactggtgcaaaacctagtgaacaacggttatgtgagagacgagactgttcgcgctgccccttatgattggcgcctggagccaggtcagcaggaggagtactacagaaaactcgccggtttggtcgaagagatgcatgctgcgtacggaaagccggtgttcctgattggccacagcttggggtgcctgcatttattatacttcttgctaaggcagcctcaggcatggaaggacaggttcatagacggattcatctccctcggcgcaccctgggggggcagcatcaagccaatgctggtgctggcctccggcgataatcaagggattcctataatgtcatccataaagctaaaggaagagcaaagaattacaacaacctccccatggatgtttcccagccggatggcttggccagaggatcatgtattcataagcaccccctcctttaattatacgggacgagatttccaacgttttttcgcggacctgcatttcgaggaaggctggtatatgtggcttcagtcgcgcgacctcctcgctggtctcccagccccaggagtggaagtatactgtctgtacggcgtgggtctcccgactcctcggacctatatctatgaccacgggtttccatataccgacccagttggggtgctttacgaagacggtgacgacaccgtggctactaggagtaccgaactctgcggtctttggcaaggccgccaaccacagccagttcatctcttacccctgcacggtatccaacatctgaacatggtattctctaacctcactctggaacatattaatgccattttgcttggggcttataggcaaggcccacctgctagtcctacagcatctcccgagcccccccctcccgaa

SEQ ID NO: 15352 - DNA, 1320 bp, Artificial Sequence
  Description of Artificial Sequence: Synthetic coding sequence
atgggcccaccaggcagcccatggcaatgggtcaccctgttgcttggccttctgctgccccccgctgctccattctggttgctgaatgtgctgtttccaccccacacaacccccaaggccgagctctctaatcacacaagacctgtaatcctggtgccagggtgcctggggaaccaactggaggcaaagcttgacaagcccgacgtggttaactggatgtgttaccgcaagacggaagatttcttcaccatctggctggatctgaacatgtttctgcctcttggcgttgactgctggatcgacaacacacgagtggtgtacaacaggagctcgggtctcgtgagtaatgctcccggcgtgcagatccgggtcccagggttcgggaaaacatacagcgtggaatacctggactccagcaagctggcagggtacttgcacacactggtccagaatctcgtgaataacggctatgtgcgggacgaaacagtgcgagccgccccctacgattggcgactggaacccggccagcaggaggaatactatcgcaagcttgcgggcttggtggaggaaatgcatgccgcctacgggaaacccgtgttcctgatcggacacagcctgggatgccttcatctcctgtatttcttattacggcagccccaggcctggaaggatcgtttcattgatggattcatctccttgggggccccatggggcggatctatcaaacccatgctcgtcctggcctctggggataaccagggcatacctataatgtcatccatcaaattaaaagaggagcagcggattactactaccagcccatggatgtttcctagccgcatggcctggccagaggaccacgttttcataagcactcccagtttcaattacactgggcgagacttccagcgcttcttcgccgacctgcatttcgaggaaggttggtacatgtggctgcagtcccgagaccttttggcgggattgccagcccccggcgtcgaggtgtattgcctttatggtgtcggcttgccaacaccgcgcacctacatatatgatcatggctttccctacaccgaccccgtcggggtgctctatgaggatggtgatgacacagtcgctacaagaagcaccgagctatgcggtttgtggcagggcaggcagccccagcctgtgcacctgctccccctgcatggaattcaacatctgaacatggtgttcagcaacctgactcttgagcacattaacgcgattcttctgggtgcttaccgccaggggccccccgcgtctcctacagcttcgcccgaacctcccccaccagaa

SEQ ID NO: 15353 - DNA, 1320 bp, Artificial Sequence
  Description of Artificial Sequence: Synthetic coding sequence
atggggcctccaggctccccgtggcaatgggtgacgttgctcctcggactgctgctcccacctgctgccccattctggttgctgaacgtcctgttcccaccccataccactccgaaagcagagctgtcgaaccatactcgtcccgtcattctggtcccgggatgcctgggcaaccagctcgaggccaagctcgacaagccggatgtcgtgaactggatgtgctaccggaaaactgaggatttctttaccatctggttggaccttaacatgtttctgccattgggagtggattgctggatcgacaacactagagttgtgtacaaccgatcttcagggcttgtgtccaatgcacctggagtccaaattcgcgtgccgggattcggaaaaacttattctgtcgagtacctggactcatctaagctggccgggtacctccacacgcttgtgcagaatctcgtgaataacggatacgttagagacgagactgtgcgggcagcgccatatgactggagactcgaacctggacagcaagaagaatactacagaaagctggcggggttggttgaagaaatgcacgctgcgtacgggaagccggtgttcttgatcggacatagcttgggttgcctgcacttgctgtactttctccttcgccaaccccaagcgtggaaggaccggtttatcgacggtttcatcagccttggagccccgtggggaggatcgatcaagcctatgctggtgctcgcttccggggacaaccagggtatcccgataatgagctccattaaactcaaggaagaacagcgcatcaccaccaccagcccttggatgtttccatcccggatggcttggcccgaggaccacgtgttcatctcaaccccttcgttcaactacactggacgggacttccaaaggttcttcgcagacctgcacttcgaagaaggatggtacatgtggctccagagccgcgatctgctcgcagggctgccagctccgggagtcgaagtgtactgcttgtacggtgtcgggcttccaactccccgcacgtacatctatgaccatggttttccgtatactgatcccgtgggcgtcctgtacgaggatggagacgatactgtcgcgacccgctcaacggagctctgcggactctggcagggccgccagcctcaacctgtgcacctgcttccgctgcacggaatccagcacctcaatatggtgttctcgaaccttactctcgagcatatcaatgcaattctcctgggagcctaccgccagggtccacctgcctcacccacggctagcccggaaccacctccaccggaa

SEQ ID NO: 15354 - DNA, 1320 bp, Artificial Sequence
  Description of Artificial Sequence: Synthetic coding sequence
atgggtccacctggttcgccatggcaatgggttaccctgcttctggggctcctgctgcctccagcagcaccattttggctcctcaatgtcctgtttcctcctcatactaccccaaaagccgaactgtcgaaccatactcgtcctgtcatcttggtccccggttgtctcggaaatcagttggaagcgaagctggacaaaccagacgtggtgaattggatgtgttaccgtaagaccgaggatttctttaccatttggctcgacctgaatatgttccttcctcttggggtggactgttggattgacaatacgcgcgtggtgtacaatcgatcgagcgggcttgtttccaacgcccccggagtgcagattcgtgtaccaggttttggaaagacttactcggtggaatacctggatagctcaaagttggcggggtacttgcataccctggtgcaaaatcttgttaacaacggttacgtgagagacgaaacggtgcgtgcagcaccgtacgattggcgcctcgaaccaggacagcaagaagaatactaccgaaaactggctggccttgtggaagagatgcacgcagcatacggcaagccggtgtttctcatcggtcacagcctgggatgcctgcatcttctttactttctccttagacagccacaggcttggaaagaccggtttatcgatggattcatttcacttggagcgccatggggtggttcgattaaacccatgcttgtcctggcgagcggcgacaaccaagggatccccatcatgtcctccattaagttgaaagaagaacagagaataactaccacctcgccttggatgtttccatctcgaatggcctggccagaggatcatgtctttatctcaaccccctccttcaattacaccggcagggattttcaacggttcttcgcagatcttcattttgaagaaggctggtatatgtggctgcagtcgcgtgatctcctggcgggtttgcctgcacctggagtggaagtgtactgtttgtatggtgtggggcttcctacccctcgcacctacatttacgatcatggtttcccatacaccgaccccgtgggggtcctgtacgaagatggagacgacaccgtcgcgactagaagcacggagctgtgtggactgtggcaagggagacaacctcagccagtgcatctcctgcctctccatggaatacaacaccttaacatggtcttttccaaccttaccctggaacacataaacgcaatcctgctgggagcctacagacagggcccaccggcatcgcctactgcttcgcctgaacctcctcccccggag

SEQ ID NO: 15355 - DNA, 1320 bp, Artificial Sequence
  Description of Artificial Sequence: Synthetic coding sequence
atgggaccgccgggatcgccctggcagtgggtcactttgctgctgggattgctgcttcctccggcagcgccgttctggttgcttaacgtcctgtttcctcctcatacgactcccaaggcggagctgtcgaaccataccaggccggtgatcctcgttccaggctgcctgggcaaccagctggaggcgaagctggataaaccggacgtggttaactggatgtgttacagaaagactgaagatttcttcactatctggctcgacctcaacatgttcctgcctctgggtgtggactgctggatcgataatacgagagtggtgtataaccgcagctcgggactcgtgtcaaacgctccgggcgttcagattagagtcccaggattcggaaagacctactccgtagagtatctcgattcgtccaagctggcaggatatctccacactctggtgcagaaccttgtgaataacgggtacgtccgggacgagactgtgcgcgcagcgccgtacgattggcgcctcgaacccgggcaacaggaagaatactaccggaagctggccggactggtcgaggaaatgcatgctgcgtacggaaagccggtctttctgatcggacatagccttggttgtctgcacctgctgtatttcctgctgcgccagccacaggcctggaaagatcgcttcatcgatggtttcatatcactgggagctccgtggggcggatccatcaaaccgatgctggtgctcgcttcgggtgataaccagggcatcccgatcatgtcgagcattaaactgaaggaagaacaacgcatcactaccacctccccgtggatgttcccgtctcgcatggcatggccggaggaccacgtgttcatttccactcctagctttaactacaccggtagggacttccagagattctttgccgatctgcatttcgaggagggctggtacatgtggcttcagtcgcgggacctgctcgcgggcctccccgcgcccggagtcgaagtgtactgcctgtacggggtcggcttgcctacgccgcggacttacatttacgaccacggatttccgtacactgacccggtgggagttctgtacgaggacggagatgatacggtggcgacgagatcaaccgaactttgcggactgtggcaaggccgccaaccgcaaccagtgcatctgctgcctctgcatgggatccagcatctgaacatggtgttctctaacttgaccctggagcatatcaacgcgatcctgttgggagcttacaggcaggggccaccagcctccccgaccgcctcgccggagcctccaccacctgaa

SEQ ID NO: 15356 - DNA, 1320 bp, Artificial Sequence
  Description of Artificial Sequence: Synthetic coding sequence
atggggccgcccggtagtccatggcaatgggtgacacttctcctgggacttctgttgccacctgcagcccccttctggctgctcaatgtgctgttcccaccgcacactacccctaaagccgaacttagtaaccacacccgcccagtaattcttgttcctgggtgcctgggcaatcaactcgaggccaaactggacaaaccggacgtagtgaactggatgtgttatcggaagacggaagatttcttcacaatttggcttgatctcaacatgtttctcccgttgggggtggactgctggattgacaacactcgcgtggtgtataatagaagcagcggactggttagtaacgcgccaggtgtacagattcgggtgcccggcttcggaaagacctactccgtggagtaccttgacagcagcaaactggctggttacttgcacaccctggtgcaaaatctggtgaacaacggatatgtgcgggatgagacagttcgcgccgcgccctacgattggaggctcgagcctggccaacaggaggagtactacaggaagcttgcagggctggttgaggagatgcacgccgcgtatggcaaacccgtgttcctcatcggccacagcctaggctgcctccatctgctctactttctcctgaggcaaccgcaggcctggaaagataggttcatcgatggttttatctcacttggagccccctggggcggaagcattaaacccatgttggttctggcgagcggagataaccaagggattcccattatgtcctccattaaactgaaagaggagcagagaattaccaccacctcaccttggatgtttccatcaagaatggcctggccagaggatcacgtgttcatctcaacccccagcttcaattataccgggagagatttccaacgcttctttgctgatctgcattttgaagaaggttggtacatgtggttgcagtccagagatcttctggccgggctccctgctcccggagtcgaagtttactgtctgtatggagtcgggctacctactccgagaacctacatttacgaccatgggttcccatataccgatcccgttggtgtcttgtacgaggacggagatgacactgttgcgactagatctaccgaactgtgtgggttgtggcagggaagacagccacaacctgttcatctgctgccattacatgggatccagcaccttaacatggtcttctctaatctgaccctggaacatatcaacgccattcttctgggggcataccgccaaggaccgccggcgagcccaactgccagtcccgaaccaccaccacccgaa

SEQ ID NO: 15357 - DNA, 1320 bp, Artificial Sequence
  Description of Artificial Sequence: Synthetic coding sequence
atggggccccctggcagtccgtggcagtgggtcactcttctgcttggtctgcttcttccacctgccgcccctttttggcttcttaacgtgctcttcccccctcatactacacccaaagccgaattgtcaaatcataccagacctgtaatcttggttccaggttgtttgggtaaccagcttgaggctaagctagataaacctgatgttgtgaactggatgtgctatagaaagacagaggactttttcaccatctggttagacttaaacatgttcctgcctcttggggttgattgctggatcgacaatacacgagtggtctacaaccgaagcagtgggctagtcagcaatgcaccgggggtgcagatccgcgtgcccggcttcggtaagacgtattccgtcgagtacctggatagctctaaactcgctggatacttgcatacattggtacagaacctggtaaataacgggtacgtaagggacgagacagtacgggcggcaccttacgattggcgcctggaacccggccagcaggaagagtactacaggaaacttgccggcttggtggaggagatgcacgccgcttatgggaaacctgtcttcctgattgggcacagcctgggatgtttgcatctgctctatttcctgctgaggcagcctcaggcctggaaggatcggttcattgatggattcataagcctaggggctccttggggggggtcaattaaacctatgcttgttttggcatcaggcgacaatcagggcatccctatcatgtctagtataaaattaaaagaggagcagcggataaccacaacaagcccatggatgtttccatctcgcatggcctggcctgaagaccacgtctttatcagcacaccatctttcaactataccggccgagatttccaacgcttttttgctgatctccactttgaagagggatggtatatgtggctgcaatccagagatcttctggccggcctaccggcaccaggagtcgaggtgtattgtttgtatggcgtgggactgcccacaccgcgtacatatatatacgaccacggatttccatacacagatcctgtaggcgtgctttacgaggacggagacgatacggtagccaccaggtcgactgagttatgtggtctctggcagggacgacagccccagcccgtgcatttgctcccgctgcatggtatccaacatttgaatatggtcttctccaacctgaccctggaacacattaatgcaatactgcttggagcatatcgccagggaccgccagcctccccaaccgcctcaccggagccaccccctcctgag

SEQ ID NO: 15358 - DNA, 1320 bp, Artificial Sequence
  Description of Artificial Sequence: Synthetic coding sequence
atgggacctccaggtagcccttggcagtgggtgactctccttcttggactcctgcttcctcccgcagcaccattttggctgctgaatgtgctttttcctcctcataccactcctaaggcggaactgtctaaccatacccggccagtgattcttgtgccaggttgccttggcaaccagcttgaagcgaagctggataaaccggacgtcgttaattggatgtgctaccgtaaaactgaagatttctttaccatttggctggatttgaacatgtttttgccgctcggagtggactgttggattgataacacccgggtcgtgtacaaccgatcttccggtctggtgagcaatgcccctggagtccagattcgcgtgccaggattcggcaaaacttactcggtcgaatacctggattcctcaaagctggctggctaccttcatactctggtgcaaaatcttgtgaataacggatacgtgcgagatgagacggtcagggcagcgccttacgattggagactggaaccaggacagcaagaggaatactaccgcaaactggcaggacttgtggaagagatgcatgcagcctacggaaagcctgtgtttctcattggacattccctgggctgtctccatctgctgtactttctcctgaggcaaccgcaagcctggaaggatcggtttattgatggtttcattagcctgggggccccgtggggtggttcaatcaagcccatgctggtgctggcatccggtgataaccagggcattccaataatgtcgtccatcaaattgaaggaggaacagagaatcactaccacctcaccttggatgttcccttccaggatggcctggccggaagatcatgtgttcatcagcactccttcgtttaactatactggaagggactttcagcgtttctttgcggatctgcattttgaagaaggctggtacatgtggctccagagtagagatctccttgcagggctccccgcaccaggtgtggaagtgtactgcctctacggcgtcggactccctacgccacgcacctacatctacgatcatggattcccttacactgaccctgtgggcgtgctgtacgaggatggcgatgatactgtggcaaccaggtccaccgaactttgtggcctgtggcagggacggcagcctcaacctgtgcacctgctgccacttcacggaatccagcatctcaatatggtcttttcgaatcttactctggaacacataaatgcgatccttttgggtgcatacagacaaggaccacccgcaagccctactgccagcccagaaccacccccgcccgaa

SEQ ID NO: 15359 - DNA, 1320 bp, Artificial Sequence
  Description of Artificial Sequence: Synthetic coding sequence
atgggaccaccaggatccccttggcaatgggtgaccctgctccttgggctgctgctgccgccagcggccccgttctggctgctgaatgtgctctttccaccgcacacgacccctaaggccgaattgtcgaaccatacccggccagtgattctggtgcccgggtgcctgggaaaccagctcgaggcaaagctcgacaaaccggacgtcgtcaactggatgtgctaccgcaagactgaggatttctttaccatttggctggatctgaacatgttcctgccactgggtgtcgactgttggatcgataacacgcgggtggtgtacaaccgctcgtcaggattggtgtcaaacgcaccaggagtgcagattcgagtgccgggttttggcaagacgtactcggtggaataccttgactccagcaaactggcgggatacctgcacactctggtgcagaatctcgtgaataacggttatgtgcgggatgaaactgtgagggccgcgccctacgactggcgcctggagccgggacagcaagaggagtactaccgcaaactggcaggactggttgaagaaatgcatgcggcctatggaaaacccgtattcctgatcggacactccctgggttgcctgcatctcctctacttccttctgcggcaaccgcaggcgtggaaggaccggttcattgacggattcatctccctgggcgccccgtggggaggatcaatcaagccgatgctcgtgctggcatccggtgacaaccagggaatcccgatcatgtcgagcatcaagctgaaggaggaacaacggatcactactacgtccccgtggatgttcccgagccgcatggcctggccggaggaccacgtgttcatctcaactccttcgttcaattacaccggacgcgactttcagcgcttttttgcagatctccactttgaagaaggttggtacatgtggctgcagagccgggacctcctggcaggattgccggctccgggagtggaggtgtactgcctgtacggcgtcggtttgccgacccctcggacctacatctacgatcacggcttcccgtacactgatccagtgggcgtcctctacgaggatggcgatgacaccgtggccactagatcaaccgagttgtgcggattgtggcagggacgccagccgcaacctgtccacctgctcccactccatggcatccaacacctgaacatggtgttctcaaacctgactctggagcacatcaacgccatcctcctgggagcctaccgccaaggaccaccggcttcgccgactgcatccccagaacccccgccaccagaa

SEQ ID NO: 15360 - DNA, 1320 bp, Artificial Sequence
  Description of Artificial Sequence: Synthetic coding sequence
atgggtcccccaggatcaccctggcagtgggtcaccctgctgctcgggctgctgcttcctccggcggccccgttctggctgttgaacgtgctgttcccgccgcataccaccccgaaggcagagttgtccaaccacactcgcccggtgattctggtgccggggtgtctgggaaaccaactggaagcaaagctggacaagcctgacgtggtgaattggatgtgttaccgcaagaccgaagatttcttcactatctggctggacctgaacatgtttctccctctgggagtggactgctggatcgacaatacgagagtggtgtacaaccgctcgtcagggctggtgtcaaatgcgccgggcgtccagatccgcgtgccaggtttcgggaaaacctactccgtcgagtaccttgattcctccaagctggctggatatctgcacactcttgtgcagaatctggtcaacaacggatacgtgcgcgatgaaactgtccgagccgctccctacgactggcggctggaaccaggacagcaggaggaatactatcggaagctcgcaggactcgtcgaggaaatgcacgccgcgtacgggaaaccggttttcctgatcggacactcgctggggtgcttgcacctcctctacttcctgctgcggcaaccgcaagcctggaaggataggttcatcgacgggttcatctcgctgggagctccgtggggagggtcgatcaagcccatgctcgtgttggcatcgggagacaaccagggcatccccattatgtcatcaatcaaactgaaggaggaacagcggatcaccaccaccagcccgtggatgttcccgtcacgcatggcgtggccggaggaccacgtgttcatttcgacgccgagctttaactacaccgggcgagatttccaacggttcttcgcagacctccatttcgaagagggttggtacatgtggctccaatcacgggaccttctggcgggactgccggcgccaggagtggaagtgtactgcctgtacggtgtgggtttgccaactccacggacgtacatctacgatcacggtttcccatacaccgatccggtgggcgtgttgtacgaggatggagacgataccgtggcaaccaggtccactgaactgtgcggcctgtggcaaggccggcagcctcaaccggtgcacctcctccctctgcatgggatccagcacctgaacatggtgttctcgaacctgactctcgaacacatcaacgcgatcctcctcggagcctaccgccaaggaccaccggcctcacccaccgcctcaccggaaccgccgcctccggaa

SEQ ID NO: 15361 - DNA, 1320 bp, Artificial Sequence
  Description of Artificial Sequence: Synthetic coding sequence
atgggacctccaggatctccctggcagtgggtgactctgctccttggtctgctcctgccgccagcagcccctttctggttgctgaatgttttgtttccaccgcacacgaccccgaaagccgagctcagcaaccacactagaccagtgattctggtgccgggctgtcttggaaaccagttggaggccaaactcgacaaacctgatgtggtgaactggatgtgctacagaaaaaccgaggatttctttaccatttggctcgacctgaacatgttcctgcctctcggggtggactgctggattgataatactcgcgtggtgtacaatcggtcatcaggccttgtcagcaacgcgccgggagtccagatccgggtgccagggttcgggaaaacgtactcagtcgaatacctcgattccagcaaattggcaggctacctccacactctggtgcagaatctggtgaacaacggttacgtgcgggacgaaaccgtgcgcgcagctccatacgactggaggctggagcccggccagcaagaggagtactacagaaagttggctggactggtggaagaaatgcatgctgcttacggaaagccggtgtttctgatcggtcactcgttgggctgcttgcatctcctttactttctgctccggcaaccgcaagcgtggaaggatcggttcatcgacggctttatctcccttggcgccccatggggaggtagcattaagcctatgctggtgttggcgtccggagacaatcaggggatcccaattatgtcgtcgatcaagctgaaggaagagcagcgcatcaccactaccagcccgtggatgttcccgagccgcatggcctggcctgaagatcacgtctttatctcgaccccttcattcaactacaccggtcgggacttccaaaggttcttcgctgacctgcatttcgaggagggttggtacatgtggcttcagtcgcgggacctgttggccgggttgccagccccgggtgttgaagtgtactgcttgtatggtgtcggattgcccacgccgcgtacctatatctacgaccatggtttcccgtacactgatcccgtcggcgtgctgtacgaggatggcgacgacactgtggcaaccaggtccactgagttgtgcggactctggcagggccggcaaccacagcctgtccatcttctcccactccacggcatccagcatctgaatatggtgtttagcaacctgaccctggaacatatcaacgccatcctcctgggagcctacagacaaggcccgcctgcatcgccgactgcttccccggagccgccgccgccggaa

SEQ ID NO: 15362 - DNA, 1320 bp, Artificial Sequence
  Description of Artificial Sequence: Synthetic coding sequence
atggggcctcccggaagtccgtggcagtgggtgacgctactgctggggctcttactgccaccggctgcaccattctggctcttgaatgtgctcttcccaccacataccacgcccaaagcagagctttctaatcatactaggcctgtgattcttgtgcccggctgcctgggaaaccagctggaagcgaaactggacaagcccgacgtggtgaattggatgtgctataggaaaactgaagactttttcaccatatggctggacttaaatatgtttctgcccttgggcgtggactgttggattgataacacaagagtggtgtacaatcgcagctccggactggtgagcaatgcccctggtgttcaaatccgcgtgcctggattcggaaagacatactccgtggaatatctggactcatcaaagcttgctgggtatctgcacactctcgtgcagaacttggttaacaatggctatgtgcgagacgagacagtgagagctgcaccttacgattggcgcctcgagccgggccagcaagaagaatactatcgcaagttagccggtttggtagaggagatgcacgccgcatatggaaagccagtgtttctgatcggacactctctaggttgcctgcatctcctgtactttctcctgcgccagccccaggcttggaaggaccgctttattgatggctttatctcactaggcgccccatggggagggtcaatcaagccaatgctggtcctggccagtggggacaatcagggtataccaatcatgagctcgattaagcttaaagaggagcagaggataactacaacatctccatggatgttcccctctcggatggcttggccagaagaccacgtgttcatcagcactccttccttcaattacaccggacgggatttccagcgtttctttgccgatcttcacttcgaggagggctggtacatgtggcttcagtctcgtgatctgctggccggcctgccggcaccaggagtagaggtttattgcctgtatggcgtcggccttcccacacccaggacctatatctacgatcatggctttccatatacagatcccgtgggcgtcctgtacgaagacggggacgatacagttgccacacggtctaccgaactttgcggcctgtggcagggaaggcagcctcagcctgtacatttgttgcccttgcacgggatccagcatctcaatatggtgttcagtaacctaacgctagagcatatcaacgccatcctccttggcgcataccggcaggggcctcctgcatcacccaccgctagcccagaaccccctccgccagaa

SEQ ID NO: 15363 - DNA, 1320 bp, Artificial Sequence
  Description of Artificial Sequence: Synthetic coding sequence
atgggacctccaggctccccctggcagtgggtaacactgctgttgggccttctcctgccacccgctgctcctttctggctacttaacgtattattccccccccacacaaccccaaaagccgagctttctaaccacactaggcctgttatccttgtccccggctgtcttgggaatcagctggaggccaagctcgataagcctgatgtcgtcaactggatgtgctatcgtaaaactgaagacttttttacaatctggctggacctgaacatgttcctccctttgggcgtggattgctggattgacaacacgcgcgtagtatataaccgcagctcaggtcttgtttcaaatgctccgggggtccagatccgcgttccgggcttcggcaagacatatagcgtggaatatttggactcctctaaactggccggctacctgcataccctggtccagaacctcgtgaataatggttacgtgcgagacgagaccgtgcgggccgcgccgtatgattggaggctggagcctggacagcaggaggagtattatcggaagctggccggtctggtggaggagatgcatgcggcttatggaaagcccgtcttcttaattggacatagtctgggctgtttgcatttgctatattttctattgcgtcagccccaggcctggaaagaccgctttattgatggcttcatctctcttggcgcaccttggggcgggtccattaaacccatgctcgtgctggcctcaggggataaccaggggataccaattatgagcagcattaaactgaaggaggagcagcgcatcaccacgacctctccatggatgtttccatctaggatggcatggccggaagaccatgtcttcattagcacgccttccttcaactataccggaagagacttccagaggttttttgccgatctgcatttcgaagagggttggtatatgtggctgcagagtagggacctgctggcggggctcccagctcccggagttgaagtctactgcttgtacggggtggggctacccacgcctagaacgtatatctacgatcacgggttcccatacaccgaccccgtcggtgtgctctacgaggacggcgatgacacagtggcaacccgatccaccgagttgtgcgggctgtggcagggtagacagcctcagccggtacatctcctgcccctacatgggatccagcacctcaatatggtgttcagtaacctgacacttgaacatatcaacgcaatcctgttgggagcctaccggcaggggccgcccgcaagtccaaccgcatcgccagagccaccaccccctgaa

SEQ ID NO: 15364 - DNA, 1320 bp, Artificial Sequence
  Description of Artificial Sequence: Synthetic coding sequence
atgggaccccctgggtccccttggcaatgggtcaccctccttctgggactcctccttcctcctgcagccccattttggcttctcaacgtgctgttccctccgcataccactccaaaagcagaacttagtaaccatactaggccggtgatcttggtgccagggtgtctgggcaaccagcttgaagccaagttggacaaaccagatgtggtcaactggatgtgttacaggaaaacggaggatttctttaccatttggctggatctgaacatgtttctgccgctgggagtggattgctggattgataatacgagagtcgtctacaaccgttcatcagggctggtgtccaatgcgcctggagtgcagatccgggttcctggctttggtaaaacctactccgtcgaatatctggattcttcaaaactggcagggtaccttcatactctggtgcaaaacctggtcaataacgggtacgtgcgcgacgagactgtccgtgcagcaccttacgattggcgcctcgaaccaggccagcaagaagaatactatcgtaagctggcaggccttgtggaagaaatgcatgccgcttatggcaagcccgtgtttctcatcggccatagccttggatgtctgcatctcttgtactttttgctcagacagcctcaggcctggaaggatcgattcattgatggtttcatcagcctcggggcgccttggggaggctcgattaagccaatgcttgtgctggcatccggggataatcagggcattcctattatgtcgtcgattaagctgaaagaagagcaacggattactacgacttccccctggatgtttccttcgagaatggcgtggcctgaagatcatgttttcattagcaccccctccttcaattacactggacgggattttcaaaggttctttgcagatttgcactttgaagaaggatggtacatgtggctccaatcgcgtgaccttctggcagggcttcctgcccctggagtggaagtgtactgcctgtacggagtgggactgcctactcctagaacttacatttatgaccatggattcccgtacaccgatcccgtcggagtgctgtacgaggatggtgatgacacggtggcaacccgatcaactgagctctgcggactctggcaaggtcggcagccacagcctgtgcatcttcttcctctccatgggattcaacacttgaatatggtgttttccaacctgactcttgagcacattaacgcaatacttctcggagcatatagacagggacccccagcatcccctaccgccagcccggagcctccacccccagag

SEQ ID NO: 15365 - DNA, 1320 bp, Artificial Sequence
  Description of Artificial Sequence: Synthetic coding sequence
atgggcccaccaggctccccctggcaatgggtgactttgctcctgggactgctcctgccgcccgcggcgcctttctggctgctcaacgtgctgttcccaccgcacaccactccaaaggccgagctctccaatcatacccgacctgtcatcctggtgcctggctgtctgggaaatcagctcgaagcgaaactggataaacctgatgtggtgaactggatgtgctaccgcaagactgaggactttttcacgatctggctcgatctcaatatgtttttgccgctcggagtcgactgctggatagacaatacgcgcgtggtgtacaacagaagcagcgggctcgtctcgaacgcacccggagtgcaaatcagagtgccggggtttggcaaaacctactcagtggaatacctggatagctcgaagctcgctggctacctgcacaccctggtgcaaaatctggtgaacaacggatacgtgagggacgaaacggtgcgggcggccccatacgactggcgcctggagcccggacagcaggaggagtattatcgcaaattggccggactggtggaagaaatgcacgcagcctacggcaaaccagtttttctgatcgggcactccttggggtgcttgcatttgctgtactttctgctccgtcaaccccaggcctggaaggataggttcattgatggattcatctccctcggagcaccttggggaggtagcatcaagccgatgctggtgttggcctcaggtgataaccagggcatcccaatcatgtcgtccatcaagctgaaagaggagcagcggatcactactacctccccgtggatgttcccatcccgcatggcctggcctgaggaccacgttttcatctcgaccccgtcatttaactacaccgggcgtgattttcagcggttctttgctgatctccattttgaagaaggatggtacatgtggctgcagtcccgagatcttctcgctggacttcccgcgccgggggtggaggtctactgcctgtacggtgtgggcctcccaactccgcggacctacatttacgaccacggattcccgtacaccgacccggttggcgtgctgtacgaagatggtgacgacactgtggcgacccggtctaccgagctctgtggcctgtggcagggccgccagccccagccggtgcacctgttgccgcttcacggaatccagcacctgaatatggtgttctcaaacctcactctcgagcacatcaatgctattctgctgggtgcatacaggcaggggccgccggcctccccgaccgcttccccggagccgccacctccagaa

SEQ ID NO: 15366 - DNA, 1320 bp, Artificial Sequence
  Description of Artificial Sequence: Synthetic coding sequence
atgggtcccccaggctccccctggcagtgggttaccctgctccttggattgttgctcccacccgctgctcccttttggcttctgaacgtgctgttcccacctcacaccaccccaaaggccgagcttagcaaccacaccagaccagtgatccttgtacccggctgcctgggcaaccagttggaggccaagctggacaagcccgatgttgttaattggatgtgctatagaaaaacagaagatttctttactatctggttggacctgaacatgtttcttcccctgggagttgactgttggattgataacacacgtgtggtctacaacaggtcttccggacttgtcagtaacgctcccggtgtccaaattagagtgcccggatttggtaaaacctattctgttgagtacctggattcttctaagctggccggctatttgcacactttggtgcagaacctggtgaacaatggctatgtaagagacgagaccgtccgcgcagctccttacgattggagactcgagcccggtcaacaagaggagtactaccgtaaattggctggtttggtcgaggagatgcatgccgcttatggaaaacccgtctttctgatcggccattctctcggttgtctccaccttttgtattttctgcttaggcaaccccaggcttggaaggaccgtttcatcgatggcttcataagtttgggtgccccctggggtggatctatcaagccaatgctcgtcctcgcatctggagacaaccaaggcatccctattatgtcctccattaagctcaaggaggagcaaagaatcaccaccacctcaccttggatgttcccatcacgcatggcctggcctgaggaccatgtattcatctccacaccatcctttaactacaccggtagggatttccagaggtttttcgcagacctgcacttcgaagaaggttggtacatgtggttgcaatcacgcgacctgctcgcaggccttcccgccccaggtgtggaagtttattgcctttatggcgtcggcctgcctacaccccgtacttacatctatgatcatggctttccctacaccgaccccgtcggcgtcctctatgaagatggtgacgatacagtcgctactagatccactgaactctgtggcctctggcagggaaggcagcctcaacctgtccacttgctcccattgcacggtatccaacacctcaacatggtcttctctaacctgaccctggaacacataaatgcaattcttctgggtgcttataggcagggccctcctgcttctcctaccgcttctcctgagcctcctcccccagaa

SEQ ID NO: 15367 - DNA, 1320 bp, Artificial Sequence
  Description of Artificial Sequence: Synthetic coding sequence
atgggtcctccaggatccccctggcaatgggttacattgttgctcggcttgctgctgccccctgccgccccgttctggctgttaaacgtcctgttccctcctcacacgacccccaaagctgaattaagtaaccacacccgacctgtgatcttggtgcctggatgtctcgggaatcagctcgaggcaaaactcgacaagcccgacgtagtgaattggatgtgttaccggaaaaccgaagacttttttacaatctggctggacttaaacatgtttctgcctctgggcgtggattgttggatagacaacacgagggtggtctacaacaggtccagcggtctggtgtcaaatgccccgggcgtccagattcgtgtccccggattcgggaagacatacagcgttgagtacctggacagtagcaagttggctggatacctccacacactggttcagaacctagtgaataatggatacgtgcgggatgaaacagtacgcgccgccccttacgactggagactagagccagggcagcaagaagagtactaccggaagctagccggcctggtggaagagatgcacgctgcgtacgggaaacccgtcttccttataggccactcgctaggctgcctccacctgctatatttcctactcaggcagccacaggcatggaaagacaggttcattgacggcttcatctcactgggcgccccatggggtggctcgatcaagccgatgctggtgctggcctccggagataaccaaggcataccaataatgagcagtatcaagctgaaggaggagcagcggattactacaacaagcccgtggatgttcccaagcagaatggcatggcctgaggaccatgtgtttatctctaccccatcttttaactacaccgggagggactttcagcgcttctttgccgacttacacttcgaggaaggatggtacatgtggctgcagagcagggatctgctcgccgggttacctgctcctggtgtagaagtgtattgcctttacggcgtcgggctgcctactccaaggacctacatttatgaccacggatttccctacaccgatcctgttggcgttctgtacgaagacggcgatgatacggtggccacccgatccaccgagctgtgcggactgtggcaggggagacaaccacaacctgtccacttactgcctcttcacggtatacagcaccttaacatggtcttctcgaacttaacactggaacacattaacgccattctcctgggagcctataggcagggtcctccagcctcgcccactgcctcgcccgagccacctccgcccgaa

SEQ ID NO: 15368 - DNA, 1320 bp, Artificial Sequence
  Description of Artificial Sequence: Synthetic coding sequence
atgggcccccccggatccccctggcagtgggtcactctcctcctcggtcttctgctccccccggccgccccgttttggctactcaatgtcttgttccccccccacacaacacctaaagcagagctgagtaaccacactaggcctgtgattctggtgccaggctgtttagggaaccaactcgaagccaagttggacaagcccgatgttgtgaattggatgtgttatagaaagactgaggacttcttcactatctggctggacctgaatatgtttctccccctcggagtagattgctggatcgataacacaagggtggtgtacaatcgaagctccggtttggtatccaatgctcctggggtgcaaatccgcgtgccgggtttcggcaagacctattcggtggagtatctggactcgtcgaagctggccgggtatttacatacactggtccagaatctggtcaataacggctacgtacgagatgagactgtgagggctgcaccctatgattggcgccttgaacccgggcagcaggaagagtattataggaaattggccggcctggtggaggagatgcacgcggcatacggtaagcccgtgttcttaatcgggcatagcctgggatgcctacatttgctttactttctgctgcgacagccacaagcctggaaggatcgattcatcgacggatttatctctctgggcgcgccttggggcggctcgatcaagcccatgctcgtgttggcttcaggagataatcaggggattcctatcatgagctccataaagctcaaggaggaacagaggataaccaccaccagcccttggatgtttccgtccagaatggcttggccagaggaccatgtgttcatttcgacaccatcctttaactacaccggacgtgactttcagcgattctttgcagacctccactttgaggagggttggtacatgtggcttcagtctagggacctcctggctggcctcccagcacctggagtagaggtgtattgtttgtatggagtgggactgccaacacctcgaacctacatctatgaccacggttttccgtacacggatcccgttggcgtcctgtacgaagatggcgatgatactgtggccaccaggtcaaccgaactgtgtggactgtggcagggacgccagcctcagcccgtccaccttttaccactgcacggaattcaacacctgaatatggtgttcagcaatctgaccctggagcacatcaatgctatcctccttggcgcctacaggcagggccctccagccagccccacagcctcccccgagccacctcccccagaa

SEQ ID NO: 15369 - DNA, 1320 bp, Artificial Sequence
  Description of Artificial Sequence: Synthetic coding sequence
atgggaccccccggaagtccatggcaatgggtgactttactgttaggcctgttgttgcctccagccgcccccttctggctgctcaatgtgctgtttccccctcatactacaccgaaagccgaactcagtaatcacactcgaccagttatccttgtgccaggctgcctaggcaatcagttagaagctaagctggataaacctgacgtggtaaactggatgtgctataggaaaactgaagatttctttaccatttggctcgacttaaatatgtttctcccactgggcgtggattgttggatcgacaacacacgagtggtatataacagatcatctggacttgtctccaatgcacccggggtccagatcagagtgcccggatttggcaagacatattccgtggaatacctggactctagcaaactcgccgggtacctgcacactcttgtgcagaacctggtaaacaatggctacgttcgagatgaaaccgtgcgagctgcaccctacgattggaggttagagccggggcagcaggaagagtattacaggaagttggcggggctggtggaggagatgcacgccgcctacgggaagcctgtctttctcattgggcattcactcggatgcctgcatttgctctatttccttcttcgtcagcctcaggcttggaaggacagatttatcgatggttttatctctcttggtgcaccatggggaggctccatcaaaccaatgctggtgctggcaagtggcgacaatcaagggatccctatcatgtcctcaattaagctcaaagaggaacagcgcatcacaaccacctccccctggatgttcccgtcccgaatggcatggcctgaggaccatgtgtttatctccactcctagctttaactacaccggccgtgatttccagcgattcttcgccgacctgcactttgaagagggatggtacatgtggctgcagtccagggacctgctggcaggactgcccgctcctggggttgaagtgtattgcctttatggggtggggctgcctaccccaaggacctacatatacgatcatggcttcccgtatactgatcccgtaggagtgttgtacgaggatggtgacgatactgtggctacccgcagcaccgaattgtgcggactgtggcagggcaggcaaccacagccggttcacttactcccccttcacgggatccaacacctgaacatggtgttcagtaatcttacattagaacacatcaatgccattctgttgggtgcttaccgccaaggcccacctgctagtccaacagcctcacccgagccacccccgcctgaa

SEQ ID NO: 15370 - DNA, 1320 bp, Artificial Sequence
  Description of Artificial Sequence: Synthetic coding sequence
atgggacctcctggatccccgtggcagtgggtgacccttctgttggggctgctccttccaccggcagcgccgttttggttgctgaacgtgcttttccctcctcataccacgcccaaggccgagctgtcgaaccatactcgccccgtcatacttgtgcctggctgtttgggtaatcaattggaggcaaagctggacaagccagatgtggtgaattggatgtgctaccgtaagaccgaagatttctttacgatttggcttgacctgaatatgttcctgccccttggagtcgactgttggatcgataacaccagggtggtttacaatcgctcgtcgggtctggtatccaacgcccccggtgtgcaaatacgcgtcccaggttttggcaagacctactcggtagaatatctggattcatcgaaactcgcaggatatctgcacacccttgtccagaacctggtgaacaatggttacgttcgcgatgaaaccgtgcgggctgcaccatacgattggcggcttgaaccaggccagcaggaggaatactacagaaaactcgcaggtcttgtcgaagaaatgcatgcagcttacggcaagcccgtatttcttattggccactccctgggttgtttgcatctcctgtactttctgctcagacagcctcaggcttggaaagataggtttatcgatggcttcatttcactcggcgccccttggggaggatctatcaagcccatgctcgtgttggcatctggagacaaccagggtattccgattatgtcctcaatcaaattgaaggaggagcaaagaatcactactactagcccatggatgttccccagcagaatggcatggcctgaggaccacgtgttcatttcgaccccatcatttaactacaccgggcgggacttccaaaggttttttgccgaccttcattttgaagaaggttggtacatgtggcttcaatcgcgggaccttcttgcgggactcccagcacctggcgttgaagtgtattgtctgtacggagtgggacttccaactcctaggacttacatctacgatcatggtttcccctacactgatcctgtgggggtgctctacgaggatggggatgacactgtcgcaacccgttcgaccgaactttgcgggctctggcaaggaaggcaacctcagcctgtgcacctcctgccgcttcatgggatacaacatctgaatatggtgttttcgaaccttactctcgaacacattaacgcgatactcttgggagcgtaccgccaaggacctcctgcttctccaaccgcgtccccagaacctcctcctccggaa

SEQ ID NO: 15371 - DNA, 1320 bp, Artificial Sequence; identical to SEQ ID NO: 15356
  Description of Artificial Sequence: Synthetic coding sequence

SEQ ID NO: 15372 - DNA, 1320 bp, Artificial Sequence
  Description of Artificial Sequence: Synthetic coding sequence
atgggcccacccggttctccttggcaatgggtgactctgctgcttgggctacttctcccaccggcagctccattctggctcctcaacgtgttgtttccccctcacacgactccaaaggccgaactgtccaaccatactcgacctgtgattttagtgcccggatgccttgggaaccagctggaggcaaaattagataagcccgatgtcgtcaactggatgtgttaccgaaagactgaggatttttttaccatatggcttgacctgaatatgtttttgcctcttggagttgattgttggatcgataatactagagtggtgtacaatagaagttcgggcctggtatctaacgccccaggtgtacaaattagggtgcccggttttggtaagacctacagtgtggagtacctggatagcagtaagcttgccggctacctgcacactctcgtgcagaacctcgtaaacaacgggtatgtgagagatgagacagtgcgggcggccccctatgactggcgcttggaacccggccagcaggaggagtattatagaaagttggcagggcttgtggaggagatgcatgctgcatacgggaagcccgtgtttctaatcgggcactccctcggttgcttgcatcttctgtattttctcttgaggcagccccaagcctggaaggaccggttcatcgatgggtttatctccttaggggcaccctggggcggctctattaagcccatgttagtgctagcctcaggtgacaatcagggtatcccgattatgtcttcaatcaagctgaaagaggagcagaggatcaccacgacatccccttggatgttcccctccagaatggcttggcctgaggaccacgtttttatatccactccatcgttcaactatactggccgggacttccagagattcttcgcagacttacacttcgaggaaggctggtacatgtggctgcagagtagagacttgctcgccgggctgccggcccctggcgtcgaggtgtattgcctgtacggggtgggactgcccacaccacggacctacatctatgaccatggtttcccttataccgaccccgtgggcgtgctttatgaggatggtgatgacacagtggcaacaaggagtacggaactgtgcggactatggcaaggcaggcagccgcaaccggtccatcttcttcctctgcatgggatacagcatctgaatatggtgttttctaatctgactcttgagcatataaacgcaatcttactcggagcctaccggcaggggcctccggccagccccaccgcaagtccagaacctcctccacctgag

SEQ ID NO: 15373 - DNA, 1320 bp, Artificial Sequence
  Description of Artificial Sequence: Synthetic coding sequence
atgggcccgccaggaagcccgtggcaatgggtcaccctgctcctcggactcttgctcccgccagccgccccgttttggctgctcaacgtgttgttcccgccgcacaccacccctaaggcagaattgtccaaccacaccaggccggtgattttggtcccgggctgcctgggcaatcagcttgaagccaaacttgacaagccagatgtcgtgaattggatgtgttatagaaagacggaagatttcttcaccatctggttggacctgaacatgttcctgcctttgggcgtggactgctggatcgacaataccagagtcgtctacaaccggtcgtccggtctggtcagcaatgcaccgggagtgcagatacgggtgccaggattcggaaagacttacagcgtcgagtacctcgactcatcgaagctggcgggttaccttcacactttggttcaaaacctggtcaataacggatacgtcagagacgaaaccgtgcgggccgcaccctacgattggcggctggagccgggccagcaggaagaatactaccgcaaactggcgggtctggtcgaagaaatgcacgcggcttacggcaagccagtgtttcttatcggccactcgctcggatgcctgcacctgctgtacttcctgctgcgccagccacaagcgtggaaggaccggttcatcgatggattcatctcactcggagccccgtggggaggctcgatcaagccgatgcttgtcctggcctccggtgataaccagggaattcctattatgtcatctattaagctgaaagaagaacaaagaattaccactacctccccctggatgtttccctcgaggatggcgtggccggaggaccacgtgtttatcagcactccatcattcaattacactggacgggatttccagaggttcttcgccgatctgcattttgaagaaggctggtacatgtggctccagtcgcgcgatctgttggctggtttgccggccccgggggtggaagtgtactgcctttacggggtcggtttgcccaccccgagaacttacatctatgaccacgggttcccgtatactgaccccgtgggagtgctgtatgaggatggagacgataccgtggcgacccgatccacggagctctgcggcctgtggcaagggagacaaccacaaccagtgcatctgctgcccctgcacggaatccagcaccttaacatggtcttttcaaatcttactctggaacatatcaacgccatcctcttgggagcataccgccagggaccgccggcctcgcctaccgcttccccggagcctccacccccggaa

SEQ ID NO: 15374 - DNA, 1320 bp, Artificial Sequence
  Description of Artificial Sequence: Synthetic coding sequence
atgggtcctccaggatccccctggcagtgggtgactcttctgctgggcctgctactgcctcccgcggcccccttctggctattgaacgtgctcttccctccacacacaaccccaaaggccgagctgtcgaatcatactagacccgtcatcctggtgccgggctgtctcggaaaccagttggaggccaagctagataagccggacgtagtgaactggatgtgttacagaaagacggaggacttcttcaccatctggctcgatttgaacatgttcctgccgctgggcgtggattgctggatcgacaatacacgagtcgtctacaatcgcagcagtggccttgttagcaacgcccccggtgtgcaaatacgtgttcccgggtttggcaaaacctacagtgtcgagtacctagacagtagcaagctcgccggctacctacataccctcgtgcaaaatctagtgaataacgggtacgtccgagacgaaacagtacgcgctgctccctacgattggcggttggaaccgggccagcaggaagagtattaccgtaagctggccggcctggtcgaggagatgcacgccgcctacggtaagcccgttttcttaattggtcactccctcggatgcctccaccttctttatttcctgttgcgccagccgcaggcttggaaggataggtttatcgacggctttatcagcctcggtgccccctggggaggaagtatcaagccaatgctggtcctggccagcggggataaccaaggaataccaatcatgtcctcaataaagctaaaggaggagcagcgaattaccaccacgtccccctggatgttcccctcacggatggcttggccagaggaccacgtgtttatatcgactcccagttttaattacacgggacgagactttcagcgattcttcgccgatttgcacttcgaggaaggctggtacatgtggctgcagtcccgggacctcctggctggcttgcccgcacctggcgtggaggtctactgtctgtacggtgtgggcttgcctactccgcgcacctacatctatgaccatggctttccttatacggacccggttggagtgctgtatgaggatggcgatgatacggtagccacacgcagcacagagctgtgcgggctgtggcaaggtcgccagccccagcccgtgcacctactgcccctgcatgggatccagcacctgaacatggttttcagcaacctgacgctcgagcacatcaacgctattttgcttggagcctaccgacagggtccgccggctagtcccaccgcgtccccggagcctcctccccctgaa

SEQ ID NO: 15375 - DNA, 1320 bp, Artificial Sequence
  Description of Artificial Sequence: Synthetic coding sequence
atggggccccccggctcaccctggcaatgggttaccttgctcctcgggttgctgctgcctccagccgccccgttctggctgcttaacgtgctcttcccaccgcacaccacacccaaggctgagctgtcaaatcatacaaggcccgtgatcttggttcctggctgcctgggcaatcagcttgaagccaagctcgacaaaccggatgttgttaactggatgtgctacagaaaaactgaggattttttcacaatttggctggacttgaatatgtttctgcctcttggtgttgactgttggattgataacacaagagtcgtgtacaaccggagttcaggactggtgtcaaacgccccaggtgtgcagatcagggtgccgggtttcggtaaaacctattcagtggaatatctggacagctcaaagctcgccggatatctacacacactggttcaaaacttggtgaacaatggctatgtacgagatgagaccgtgagagcagccccatacgactggaggttggagcctggacagcaggaagagtactacagaaagctcgccggactggtggaggaaatgcacgctgcctacggcaaacccgtcttcctcatcggacattcattaggctgccttcatctcttatattttctgctgcgccaaccccaggcctggaaagatcgcttcattgacggcttcatttccctgggggctccttggggaggctctataaagcctatgcttgttctggcttctggagataatcaaggaatccctatcatgagctctatcaaactaaaggaggaacagagaatcaccacaacgagcccatggatgtttccttctcgcatggcgtggcccgaggaccacgtgtttatctcaactccttcgttcaactatacaggacgggactttcaacgattttttgccgaccttcacttcgaggaggggtggtatatgtggctgcagtcgcgagacttgttggctgggctgcctgcccctggagtggaagtttactgcctgtatggcgtggggcttcctactccaagaacttatatctatgatcatgggttcccatacacagacccagttggtgtgctctatgaggacggtgacgacactgtggcgaccagatccaccgaactctgcgggctatggcaaggcaggcagccccagcctgtccacctgctgccactgcacggcatccagcacctgaatatggttttcagtaacctgacactagagcacatcaacgctattctactgggcgcgtacagacagggccccccagcaagccctaccgcttctccagagcctcctccccctgaa

SEQ ID NO: 15376 - DNA, 1320 bp, Artificial Sequence
  Description of Artificial Sequence: Synthetic coding sequence
atgggaccacctgggtcgccttggcaatgggttactctcctgctgggtctgttgcttccgccagcagctccgttctggcttctgaacgtgctgttccctccgcataccaccccaaaggcggaactctccaaccacacgcgaccggtcattcttgtgccggggtgtctcggtaaccagcttgaagcaaagctcgataaacctgatgtggtcaactggatgtgttatcgcaagactgaggactttttcaccatatggctcgacctgaatatgttcttgccccttggagtggactgctggatcgataacacccgtgtggtctacaaccgatcgtccggccttgtctcaaatgcaccaggggtgcagatcagggtccctgggtttggaaaaacttactcggtagagtaccttgactcaagcaagttggcaggctacctccacacccttgtgcagaatcttgtgaacaacggatacgtgcgggacgaaaccgtgcgagcagctccctacgattggagacttgaaccaggacagcaagaggaatactacagaaaacttgcgggactggtggaggagatgcacgcagcatacggaaagcctgtgttcctgattggccattcccttggttgccttcatctcttgtactttcttcttcggcaaccacaagcgtggaaggatcgattcattgacggcttcatttccctcggagccccttggggaggatcgatcaaaccaatgcttgtgctcgcatccggtgataaccaaggtattcccataatgtcgtcaattaagctcaaggaggaacagagaatcaccacgacctcaccatggatgttcccctccaggatggcgtggcccgaagatcacgtctttatctctactcctagctttaactatactggtagagatttccaacgctttttcgcagaccttcactttgaggagggctggtacatgtggctgcagtccagagatttgctcgcgggactccctgcacctggcgtggaggtgtactgtctctacggcgtcgggcttccaactcctaggacttatatctatgatcacggctttccgtacactgaccctgtgggtgtcctgtatgaagatggtgatgacactgtggcgacccgttcgaccgaactgtgtggactgtggcaaggacgccaacctcaaccagtgcacctgcttcccctccatggcattcaacacctcaatatggtgttctccaatctgacccttgagcatatcaacgcaatcctcctcggagcatacagacaaggtcctccggcgtcgccaactgcaagccccgaaccacctcctccagaa

SEQ ID NO: 15377 - DNA, 1320 bp, Artificial Sequence
  Description of Artificial Sequence: Synthetic coding sequence
atgggacctcctgggagcccgtggcagtgggtgacgctgctgctcggactgctccttccgccggctgctcccttctggctgcttaacgtgctgttccctccccacactaccccaaaggcagagctgtcgaatcacacccggcctgtcatacttgtgccgggttgcctgggcaaccagttggaagccaagctcgataagcctgatgtcgtgaattggatgtgctacagaaaaactgaggacttctttaccatctggcttgatttgaatatgtttctgccattgggagtggactgctggattgacaacacccgtgtggtgtataatcgctcttccgggctcgtgagcaacgcccccggcgtccagatcagggtaccgggattcggcaagacctactccgttgaatacctggactcctcgaagctcgcaggctacctgcatacgctggtccagaatctggtcaataatggctacgtccgcgacgaaaccgtcagggcggctccttacgattggcgcctcgaacccgggcagcaagaagaatactatcggaagctggcggggcttgtggaggaaatgcatgcggcctacggtaagccggtattcctgattggccactcgcttggatgtctccacctcctgtactttctccttcgtcagcctcaggcctggaaagaccgcttcatcgacggatttatctcactgggagccccatggggaggaagcatcaagccaatgttggtcctggcgagtggcgacaaccaaggaatcccaattatgagctcaatcaaactcaaggaagaacagagaatcaccacgactagcccctggatgttcccgagccggatggcatggccggaggatcacgtgttcatctcaaccccgtcgttcaactacactgggcgggacttccagcggtttttcgctgacctgcattttgaagaggggtggtacatgtggcttcaatcacgcgacctgctggccggccttccggcgcctggcgtggaagtctactgcctgtacggcgtgggactgccgactcctcgcacctacatttacgatcacggcttcccgtatactgaccctgtgggtgtgctctacgaggacggggatgataccgtggctacccgatcgaccgagctgtgtggactttggcagggacgccagccgcagccggtgcatctcctgccgctgcacggaatccaacatctgaacatggtgttcagcaacttgactctggagcacatcaacgcgatcctcctcggagcgtacagacaagggccccccgcctcaccaactgcctccccagaacccccgccgccggag

SEQ ID NO: 15378 - DNA, 1320 bp, Artificial Sequence
  Description of Artificial Sequence: Synthetic coding sequence
atgggaccgccagggtccccttggcaatgggtcactctgctcctcggactgctgctcccgccagctgccccgttttggctcttgaacgtcttgttcccgccgcataccaccccaaaggcggagttgtcgaatcatactcggcctgtgatcctcgtgccgggatgtctgggaaaccaactcgaggcaaaactggataagccagacgtcgtgaactggatgtgctataggaaaactgaagatttcttcacgatctggctggatctcaatatgtttctgccgctgggagttgattgctggatcgacaatacccgcgtcgtgtacaaccggtcctccggcttggtgtcgaacgcgcctggcgtgcagatcagagtgccggggtttggaaagacttacagcgtcgaatacctggattcaagcaagctggcgggctacctgcacaccctggtccagaaccttgtgaacaacggatacgtgcgcgatgagactgtcagggccgcgccgtacgattggagattggagccgggtcagcaggaagaatactaccgcaaactggcagggctcgtggaagagatgcacgctgcatacggcaagcccgtgtttctgatcggccatagccttggatgccttcacctcctgtactttctgctgcgccaacctcaggcgtggaaggaccggttcatcgacggattcatctcacttggcgcaccctggggcggcagcatcaagcccatgcttgtgctggcgtccggggacaatcagggaatccctatcatgtcctcgattaaactcaaggaagaacagagaatcaccaccacctccccctggatgttcccaagcagaatggcatggccggaagatcatgtgttcatatcaactccttcctttaactacactggaagagatttccagagatttttcgcggatctgcacttcgaggaaggatggtacatgtggcttcaatcaagggacctcctggcgggactcccggccccgggagtggaagtgtactgcctttacggcgtcggcctccccaccccgcggacctacatctatgaccatggatttccgtacactgacccggtgggcgtgctctacgaggacggcgacgataccgtggcaacccgctccaccgaactctgcggcctgtggcagggaaggcagccgcaacctgtccatttgctgccgctgcatggcattcaacacctcaatatggtcttttccaacctgacccttgagcacatcaacgctatcctgctgggggcgtaccgccagggacctccggcttcacctacggcttcgccggaaccccctccacctgag

SEQ ID NO: 15379 - DNA, 1320 bp, Artificial Sequence
  Description of Artificial Sequence: Synthetic coding sequence
atgggaccccctggctctccttggcagtgggtaactctgctgctgggattgctgctgccccccgcagcacccttttggctgttgaacgtactctttccacctcacacgacacctaaagctgagctgtctaatcatacccgcccagtgatcctcgtaccaggttgtttgggcaatcaactggaagccaaactggacaagccggatgtggtaaactggatgtgttatcgcaagacggaagacttctttactatttggctggacctgaatatgtttctccctctcggggtagattgctggatcgacaataccagggtggtctacaatagatccagcggtcttgtcagcaatgcgccaggagtccagatcagagtccctggtttcggaaagacgtactctgtagagtatttggattcaagtaaacttgccggctatttgcatacactcgtgcagaatctggtgaacaatgggtacgtccgggatgagacggttcgagccgccccttacgactggaggctggagcccggtcagcaggaggagtactacaggaagctggctgggctcgttgaggagatgcacgctgcctatggaaaacctgtgttcctcatcggccacagccttggatgtcttcacctgctctattttctgctgcggcaaccgcaggcctggaaggaccgattcattgatggattcattagcctcggggcgccatggggcggcagtatcaaacccatgcttgtgctcgcatctggagacaatcaaggaatacctatcatgtcttctattaagcttaaggaggagcaaagaatcaccaccacctcaccgtggatgttcccttcacgaatggcttggccagaagaccatgtattcatttctacccccagcttcaactacactggccgagatttccaacgattttttgctgacctccatttcgaggaaggctggtatatgtggcttcagtctcgcgatcttctcgcaggacttccagcccccggagtagaggtttattgcctttacggagttggcctgcccaccccaagaacatatatctacgatcacggattcccttacactgatccagtgggggtcctgtacgaagacggcgacgataccgttgccacccggagtaccgagctgtgtggtctgtggcagggccgccaacctcaacccgtgcacctgcttcctctccacgggatccaacacctgaatatggtgttttcaaacctgacactcgaacacattaatgcgatcctcctgggcgcttacagacaggggccccctgccagcccaacagctagtcccgaacctccaccgcccgag

SEQ ID NO: 15380 - DNA, 1320 bp, Artificial Sequence
  Description of Artificial Sequence: Synthetic coding sequence
atgggaccgccgggcagcccatggcagtgggtgaccctgttgctgggccttctcctgcccccagcggcccctttctggctgttgaatgtactgttccctccacatacgacgccaaaagctgagctgtcgaatcacactagacctgtgatactggtacctggttgcctgggcaaccagctggaggccaagctcgacaaacccgacgtcgtgaactggatgtgttacaggaaaactgaagatttcttcactatctggttggatctgaatatgttcctgcccctgggggtggactgttggatcgacaacaccagagtcgtctacaaccggtcatcaggcctggtgtcgaacgcgccgggtgtccagatccgcgtgcctggattcggaaaaacctactcggtcgagtacctggactcgtcgaagctggccggctatctccacacgctcgtgcagaacctggtgaacaatggttatgtgcgggacgagactgtgagagctgccccgtacgattggcgcctcgagcccggacaacaagaagagtactaccgaaagttggcgggacttgtggaagaaatgcacgcggcctacggaaagccagtctttctgattggacactctttgggctgccttcacctcctgtactttctgctcagacagccgcaggcatggaaggatcgctttattgacggctttatctccctgggggccccatggggaggatcgatcaaacctatgttggtccttgcttccggtgataaccagggaatcccgatcatgtcaagcatcaagctgaaggaagaacaacgcatcaccactacgagcccgtggatgtttccgagccggatggcctggccggaagatcatgttttcatctccactccgtcgttcaactatactggaagggacttccaacgttttttcgcagacctgcatttcgaggaaggatggtacatgtggctccagtccagagatcttctggcaggcctcccagctccgggggtcgaagtgtactgcctctacggagtgggcctccccacccctcgtacttacatctacgatcacggattcccgtacaccgacccagtgggtgttctctacgaggacggagatgacaccgtggctactaggtctaccgagctttgcggcttgtggcaaggacgccaacctcagccggtccatttgcttccgctgcacggaattcagcatctcaacatggtgttttcgaatctgaccctggaacacatcaatgcgattctcctcggtgcttatcggcaggggccccctgcctcccccactgcgagccctgagccacctccgccggag

SEQ ID NO: 15381 - DNA, 1320 bp, Artificial Sequence
  Description of Artificial Sequence: Synthetic coding sequence
atgggacctcccgggtccccatggcagtgggtgacactactgctgggcctactgttgcctcctgccgctcccttttggctgttgaacgtgctcttccccccccacaccaccccaaaggccgaattatcaaaccacacacggcccgttatcctcgttcctggctgcctaggcaatcagctagaggctaagctggacaaaccagacgtggtaaactggatgtgttaccggaaaacagaagacttctttactatttggttggacttgaacatgttcctccctctgggggtcgactgttggattgataatactcgagtcgtatacaatcgctcgtcgggtcttgtgagtaacgcccctggggtccagatccgggtaccaggcttcggcaaaacgtattctgtggagtatctggactcctcaaagctggcaggttacctgcacactctggtgcagaatctagtgaacaatggatatgtgagagacgagaccgtgcgagccgccccctatgattggagacttgaacctgggcagcaggaggagtactataggaaactggccgggctggtagaggagatgcacgccgcttacggcaagccggtttttctgattgggcatagtcttggatgtcttcacttactctatttcttactccgccaacctcaagcatggaaggacagattcatagatggattcatcagcctaggtgccccctggggggggtcaatcaaacctatgctggtgctggcctccggcgataaccaaggcatcccaatcatgtcttctatcaagctcaaggaggaacagagaattacaacgacctctccttggatgttccctagccggatggcatggccagaagaccatgtgttcattagtactccctcatttaactacacaggcagagacttccagcgcttcttcgcagatctgcacttcgaagaggggtggtacatgtggttacagtctcgcgacctgctcgccggactccccgcgcctggagtggaggtgtactgcctatacggcgtgggactgccgacaccaaggacttatatctatgatcatgggttcccctacacagaccccgttggcgtcctgtacgaagatggcgatgataccgtcgcgacaagatcaactgaactgtgcggcctatggcaggggagacagccccagcccgtccacctgctgcccctgcacgggattcagcacttgaacatggtgtttagcaaccttactctagagcacatcaacgccatactcctgggggcataccggcagggcccccctgccagcccaaccgcctcccccgagccaccaccaccggaa

SEQ ID NO: 15382 - DNA, 1320 bp, Artificial Sequence
  Description of Artificial Sequence: Synthetic coding sequence
atgggcccgccaggcagcccatggcaatgggtcaccctgctactgggtctgctgttgccaccggccgcgccgttctggctgctgaacgtgctgttccctccgcatactacccctaaggctgagctgagcaaccatacccgcccggtgatcctggtgccgggctgtcttggcaatcagctggaggcaaagctggacaagccagacgtcgtgaactggatgtgttaccgtaaaaccgaggatttcttcactatatggcttgacctcaacatgtttctgccgctgggtgtcgactgttggatcgacaatactcgcgttgtgtacaataggtcctccggcctggtcagcaacgcccccggtgtccagatcagagttccgggtttcggaaagacgtacagtgttgaatatctggatagctcgaagctagcgggttacctccacactctggttcaaaacctggtgaataatggctacgtgagggacgagaccgtgcgagccgccccgtatgactggcgtctggagcctggccagcaagaagagtattaccgcaagctggcggggctcgtagaagaaatgcatgcagcttacggaaagccggtcttcctgattggtcatagcctgggttgcctgcatctcttgtatttcctgctgcgccagcctcaggcatggaaagaccgatttatcgatggctttatttctctgggggcaccatgggggggatccattaagccaatgctggtcctggctagcggggacaaccagggcattccgattatgagctccattaagctgaaagaagagcagcgcattaccaccacgtccccgtggatgttccctagccgcatggcttggccggaggatcacgttttcatttctacccctagctttaattataccggcagggatttccagcgcttcttcgcggacctacacttcgaggaaggatggtacatgtggttgcagagccgcgaccttctggctggcttaccggcgccgggtgttgaggtgtactgtttatatggcgtgggcctgccgactcctaggacctatatctacgaccacggcttcccttacaccgacccagtgggtgtcctctacgaagacggcgatgatactgttgctacgagatctaccgaactgtgcggcctgtggcagggtcgccaaccgcagccggttcacttgctgcctctgcacggcatccagcacctgaacatggtgtttagcaaccttacccttgagcatattaatgcaatcctgttgggggcataccgtcaaggccctccggcaagccccactgcctcccctgagccgccgccaccggag

SEQ ID NO: 15383 - DNA, 1320 bp, Artificial Sequence
  Description of Artificial Sequence: Synthetic coding sequence
atgggtcctcctggttctccctggcagtgggtgactttgttgctgggcctgctgctgcccccggccgcaccgttctggcttctgaacgtgctcttccccccacacaccactccgaaagctgagctgtcgaaccatactcgtccagttatcctggtgccgggatgtctggggaaccaactcgaagccaaactggataagccggacgtcgtgaactggatgtgttaccgtaagaccgaagatttcttcaccatctggctcgatctgaatatgtttctgcccctgggagtggactgctggatcgacaacactcgggtcgtttacaaccgctcttcgggcctggtgtcaaatgcgccgggagtccagattcgggttcccggatttggcaaaacctactcggtcgaatacctcgatagcagtaagctggcgggttacctccacaccctcgtgcagaatctggtaaacaatggttacgtccgagacgaaaccgtgcgggcagccccctatgactggcgcttggagccaggacagcaagaggagtactatcgcaagctggccggcctcgtggaagagatgcatgcggcctacgggaaacccgtgttccttatcggacactcactcggttgcctccacttgctctacttcctgttgcgccaaccgcaggcctggaaggatcggttcatcgacggattcatctcgctgggggctccttggggaggcagcatcaagcctatgttggtgcttgccagcggagacaatcagggaattccgatcatgagctccatcaagctgaaggaagagcagcggatcaccactacttccccttggatgttcccatcccgcatggcttggccagaggatcatgttttcatctccactccgagctttaactacacggggagggactttcaacgatttttcgcggacctgcatttcgaagaaggatggtacatgtggctgcagtcgcgcgatttgctggcaggattgccagcacctggagtggaagtctactgcctctacggggtcggactgccgacgccaaggacctacatatacgatcacggcttcccttatactgatcccgtcggggtgctttacgaggacggagacgacacggtggccacgcgttccactgaactgtgcgggctttggcaggggcgccaacctcaaccggtgcacctgctcccattgcatggcatccagcaccttaacatggtgttttcgaacctcaccctggagcacatcaatgcgattctgctgggcgcctaccggcagggcccgccggcgtcaccgactgcgtcgccggagcctccgccgccagaa

SEQ ID NO: 15384 - DNA, 1320 bp, Artificial Sequence
  Description of Artificial Sequence: Synthetic coding sequence
atgggcccacccggcagcccctggcagtgggtgacgttgctgcttggtttgctgctgcctccagccgcacccttctggctcctgaacgtattgtttccaccccatacaacaccaaaggcagagctgtcaaaccacactagacctgtcattctcgtgcccggctgtttggggaaccaactggaagccaagttggataaacccgatgttgtgaattggatgtgttaccggaagacagaggactttttcaccatctggctggaccttaacatgttcctgcctctcggggttgactgttggatcgataacacccgggtcgtttacaacagatcttcaggactcgtatcaaatgcccctggagtgcagattcgggttcccggttttggtaagacctactctgttgaatacctcgactcctcaaaactcgcgggctatctgcacacacttgttcagaatctggtgaacaacggctacgtgcgggatgagacagtccgagctgcaccttacgactggagactggagccggggcagcaagaagagtattatcgcaagttggcaggcctggtggaggagatgcacgctgcctacgggaaacccgtgttcctgatcggccatagcctgggttgcctgcacctgctgtatttcctcctgagacagccacaagcttggaaagatcggtttattgacggtttcatttcactcggcgcaccctggggcggctctattaagccaatgctggtcctggccagcggcgataaccagggcatccccattatgagttctattaagctcaaagaggagcaaaggattactactacaagtccgtggatgttcccctcaaggatggcatggcccgaggatcatgtctttatctctaccccgagcttcaactataccggcagagacttccagcggttctttgccgatctccactttgaggagggttggtatatgtggctgcagagccgggaccttctcgctggactgccagcccccggagtagaagtgtactgcctttacggcgtggggctgccaaccccccgcacatacatctatgaccatggcttcccttacaccgaccctgttggagtgttgtacgaagacggcgacgacaccgtggccaccaggtccacggaattgtgcgggctgtggcagggtaggcagccccagccagtccatctgctgccgctgcatgggattcagcacttgaatatggtgttctctaatctgacccttgagcatattaacgctattctgcttggtgcataccggcaggggcctcccgctagcccgactgccagcccagaaccgcctcctcctgag

SEQ ID NO: 15385 - DNA, 1320 bp, Artificial Sequence
  Description of Artificial Sequence: Synthetic coding sequence
atgggaccaccaggatcaccttggcagtgggtgactctcttgcttggcctcttgcttcccccagccgccccgttctggcttctgaatgtgctcttccctccgcataccacgccgaaggccgagctgagcaaccacaccagacctgtgatcctcgtgccaggatgcctcgggaaccagctggaggccaaactcgacaaaccggatgtcgtgaattggatgtgctaccgcaaaactgaagacttctttactatctggctcgaccttaatatgtttctcccgttgggcgtcgactgctggatcgataacacccgggtggtgtacaaccgctctagcggactggtgtccaacgcccccggggtccagatccgcgtccccggcttcggaaaaacttactcggtggagtacctcgactccagcaaactggcaggatacctgcacaccctggtgcaaaatctggtgaacaacggctacgtgcgggacgaaaccgtgagagcggctccgtacgactggcgcctggaaccgggacagcaagaggaatattaccgcaagctggccggactggtggaggagatgcacgctgcttacggaaagcccgtgttcctgatcggacattcactgggatgtctccatctgctgtattttctgctgcgccagccgcaagcctggaaagaccggttcattgacggattcatctccttgggagcgccgtggggaggatccatcaaaccgatgcttgtgctggcgagcggagacaaccagggcatcccgatcatgtcctccatcaagctcaaggaggaacagagaatcacgaccacttcgccgtggatgtttccatcaagaatggcttggcctgaggaccacgtgtttatctcgaccccatccttcaactacaccgggagggatttccaacgctttttcgccgatctgcacttcgaggaaggatggtacatgtggctgcaatcgcgggatctcctcgccggactgccggctccaggtgtcgaagtgtactgtctgtacggagtcggactgccgactcctcgcacgtacatttacgaccacggattcccatacaccgatccggtcggggtgctctacgaggacggagacgacactgtggctacccggtctactgaactgtgcggactctggcagggccggcaaccgcaacccgttcaccttctgccgctgcacggtatccagcacctcaacatggtgttctcgaaccttacccttgagcacattaacgccatcctgctgggcgcatacagacaagggcctccggcgtcacctaccgcgtcgcctgaaccgccaccacccgag

SEQ ID NO: 15386 - DNA, 1320 bp, Artificial Sequence
  Description of Artificial Sequence: Synthetic coding sequence
atgggcccgcctgggagcccctggcaatgggtgacattgcttctgggtctcctcctgcctccagccgcccccttctggctcctcaacgtcctctttccgccccatacgacccccaaagccgagctgtctaaccatactcgcccagtcatcctggtgcccggttgcctaggtaaccaacttgaagcaaaacttgataagccggacgtcgtgaattggatgtgttaccgaaagacagaagatttcttcacgatttggttggatttgaacatgttcttgccgcttggtgtcgactgttggattgataacactcgagttgtgtacaatcgctccagcggtcttgtctctaatgcgccaggcgtccagatcagagttcccgggttcgggaagacctactccgtcgagtatctggactcctctaagctcgctggttacttacataccctcgtgcagaatcttgtcaacaatggatatgtcagagatgagactgttcgggcagcaccttatgactggcgattggagccggggcagcaagaggaatactacaggaaactcgcgggactcgtcgaggagatgcacgctgcatacgggaagccagtttttttgattgggcacagtctgggatgcttgcatttgttgtacttcctcctccgccaaccccaggcatggaaggaccgtttcattgatggatttatttctttgggcgcgccatggggagggtcgattaaacctatgctggtgttggcgtctggagacaaccaaggtattcccatcatgtcgtccatcaagctgaaggaagagcaaagaataacaaccactagcccttggatgttcccgtcacgtatggcgtggccagaagatcatgtattcatctcaaccccatcattcaactatactggtcgggactttcaacgtttcttcgctgatctgcatttcgaggagggatggtatatgtggttgcagagccgcgatctcctagccggcctaccagccccaggagttgaggtctactgtctgtatggtgtaggcctcccgacgcctcgtacttacatctacgaccatggcttcccttatactgatccagttggagttctctatgaggacggtgatgacactgtcgctacacgctctaccgagctgtgcggactctggcagggccgccaacctcagccggttcatctgctgcccctgcatgggatccagcaccttaatatggtgttctcaaacttgacactagagcacattaacgcaatcttactcggtgcatatcgccaaggccccccggcttctcctaccgcttcacctgagcccccaccacccgaa

SEQ ID NO: 15387 - DNA, 1320 bp, Artificial Sequence
  Description of Artificial Sequence: Synthetic coding sequence
atgggcccacctggttccccttggcaatgggtgaccctgttgctggggttacttctgcctcctgctgctcctttctggctcctgaatgtcctctttccccctcatactacccctaaagcagaactgtccaaccacactaggcccgtcatcttagtgcccggctgcctcggcaaccaattggaggctaaactggacaagcctgacgttgtgaattggatgtgctacagaaagactgaggacttctttacgatatggcttgatcttaacatgttcctcccccttggggtcgattgttggatcgataataccagagtggtctacaataggtctagtggcctagtgagcaacgcacccggcgtccagatccgggtccccggctttgggaaaacctacagcgttgagtatttagatagctcaaaactcgctggctatttgcacacactcgtgcagaatctggtaaacaacgggtatgtgagagatgaaacagtgagggccgctccttatgactggcgccttgaacctggccagcaggaggagtattaccgaaaattggccggactggttgaggagatgcatgccgcgtacggtaagccggttttcctgatcgggcatagtttggggtgcctgcatcttctgtattttcttcttagacagccacaagcttggaaagacagatttattgatggatttatttcattgggagctccctggggcggaagtatcaaaccaatgctcgtcctggccagcggagataaccagggcatacccatcatgagctcaatcaagttgaaagaggaacagcgcatcaccaccacttccccttggatgtttcccagtcgtatggcctggcctgaggaccacgtcttcatttcaaccccttcttttaactacacaggaagggactttcagagattttttgctgacttgcactttgaagagggctggtatatgtggctccaatcccgcgaccttttggcaggcctgcctgcacctggcgtggaagtgtattgtttgtatggcgtcggcttgccgaccccccggacctacatctatgaccatggattcccttataccgaccccgtgggcgtgctctacgaagatggcgacgacaccgtggccacaagatcaacggaactctgcggcctttggcaaggcagacaacctcaacctgttcacctgctgcctttgcacggcatccaacacctcaacatggtgttttccaatctgactctggagcacatcaacgctatcctcctgggggcttataggcagggccctccggcaagtccaactgccagccctgaaccgccacctccagag

SEQ ID NO: 15388 - DNA, 1320 bp, Artificial Sequence
  Description of Artificial Sequence: Synthetic coding sequence
atgggacctccggggtcgccttggcagtgggtgaccctgctcttgggacttctcctgccaccggcagctcccttctggctgcttaatgtcctgttccccccgcataccaccccgaaggcggagctctcgaaccacactcggccggtgatcctggtgccgggatgtctcggcaaccaactggaagccaagctggataagccagacgtggtgaattggatgtgctacagaaagaccgaggactttttcacgatctggctcgatctcaatatgttcctgcctctcggagtggactgttggatcgacaatactcgcgtggtgtacaaccgaagctcaggactggtgtccaacgctccaggtgtccagattcgcgtcccgggttttggtaagacctacagcgtggagtacctcgactcctccaagctggcgggatacctgcatactctggtgcagaacctcgtgaacaacggttacgtgcgggatgaaactgtcagggcagccccgtacgattggcggctggagccgggacaacaggaagaatactaccggaagctggcaggactggtcgaggaaatgcatgcggcctacgggaaaccggtgttcctcattggccactccctcggatgtctgcacctgctctactttctgctccgccaaccacaggcttggaaggatagattcatcgacggttttatctcacttggcgcgccttggggaggatcaatcaaaccaatgctcgttcttgcctccggcgacaaccaaggaatcccaattatgtcctcgatcaaactgaaagaagaacaacggattaccactacttcaccttggatgtttcccagccggatggcctggccggaggatcacgtctttatctcgactccatcgttcaactatactgggagggatttccagagattcttcgcagacctgcacttcgaggaagggtggtacatgtggctgcagtccagagacttgcttgccgggctgccagctccaggggtggaggtctactgcctgtatggggtgggactcccgaccccgcggacctacatttacgaccacgggtttccctacaccgaccccgtcggagtgctctacgaggatggtgacgacactgtggcaaccagatccactgagctgtgcggcctgtggcagggacgccagcctcaaccggtgcatctgctgcctctccacggaatccagcacttgaacatggtgttttcaaacctgactttggaacacatcaatgccatcctgcttggagcgtaccgccagggaccacctgccagcccgaccgcgtcccccgaaccaccaccgccggag

SEQ ID NO: 15389 - DNA, 1320 bp, Artificial Sequence
  Description of Artificial Sequence: Synthetic coding sequence
atgggaccgccaggttcaccctggcaatgggtgacgcttctgcttggtctgcttcttcccccagctgcccctttttggctgttgaatgtgctgtttccaccccataccacccccaaagccgaactgtctaatcacacgaggccggtcatcttggtgcctggttgtcttggcaaccagctggaggcaaaactagacaagcctgatgtggtgaactggatgtgttaccggaaaacagaagatttttttaccatatggctagacctaaatatgtttttgcccctaggcgttgattgttggattgataatacccgcgtggtgtataatcgctcctcaggcctagtgtcaaatgctccaggcgttcagattagagtacctggtttcggaaagacctattctgttgaatatctggactcatccaagttggcaggttatctacacaccttagtgcaaaacttggtgaataacggatacgttcgagatgaaaccgttcgagctgcaccttacgactggaggctggaacctggccagcaggaagaatattatagaaagcttgctgggctggtggaagagatgcatgccgcttatggaaagccagtgtttctcataggacactcactgggttgcctccacctactgtactttctattgaggcagccgcaagcctggaaggacagatttatcgatggattcatatctcttggagccccctggggggggtcgataaagccaatgctcgtccttgcatcaggcgataatcaaggaattcctataatgagcagcattaagctgaaggaggaacagcggatcaccacgacgagcccctggatgttcccctctagaatggcttggcctgaggatcacgtcttcatcagcactccctcttttaactacaccgggagggacttccagaggttcttcgctgatcttcatttcgaagaggggtggtacatgtggttgcagagtagggatctgctcgctgggctgcccgccccaggcgtggaagtgtattgtctgtacggggtcggcctgccaaccccaaggacatacatttacgaccacggatttccttatacggatcccgtaggcgtgctctatgaggatggcgatgacacggtcgctaccaggtctacagagctgtgcggtctgtggcaaggccgccaacctcaaccagttcatctgctgcctctccacggtattcagcatctcaatatggtattttcaaatttaaccctggaacacatcaatgctatcctcctgggtgcttaccgacagggccccccagcctcacctaccgcctcccccgagccccctccccccgaa

SEQ ID NO: 15390 - DNA, 1320 bp, Artificial Sequence
  Description of Artificial Sequence: Synthetic coding sequence
atggggcctccgggctccccttggcagtgggttacgcttctcctgggcctccttctgcctcccgcggcaccgttttggctgctgaacgtgttgttcccgccacacaccaccccgaaagctgaactcagcaatcatacccgtcccgtgatcttggtgcccgggtgcctgggaaatcaacttgaggcaaagctggataagcccgacgtggtcaactggatgtgttaccggaaaaccgaggactttttcaccatttggcttgatctgaacatgtttctgcctcttggtgtggattgttggattgataacactagagtggtttacaaccggagcagcggactggtgtcaaacgcacccggagtgcaaatcagagtgcccggttttggtaagacttacagcgtcgagtacctggacagcagcaaactggcaggttacctccatactctggtgcaaaatctcgtgaacaacggatacgtcagggacgaaaccgtgcgggcagcaccatacgattggagactggaaccagggcaacaggaagaatactacagaaaacttgcaggtcttgtggaagaaatgcatgcagcatacggaaagcctgtctttctgattggtcattcactcggatgtctccacctgctttacttcctgttgcgccagcctcaggcctggaaggatcggttcatagatggctttatctcactcggagcaccatggggcggttcgattaagcctatgctcgtgctggcatcgggcgataaccaaggcatcccaattatgtcatcgatcaagctcaaggaagaacaacgcatcaccaccacttcaccctggatgttcccgagcagaatggcatggccagaggaccacgtgtttatctctacccctagctttaactatacgggccgcgattttcagcgtttctttgcggacttgcactttgaagaggggtggtatatgtggcttcagtcccgagatctgctcgccggactgcctgccccaggcgtggaggtgtactgcctgtacggagtggggcttcctactccacgcacctacatttatgaccatggatttccatacacggacccagtgggagtgctgtacgaagatggagatgacactgtggccacccgctcaactgagctctgcggtctttggcaggggaggcagccccaaccagtgcatctccttcctctgcacggcatccaacaccttaacatggtgttttcgaaccttacccttgaacacattaacgccattctgcttggtgcatacaggcagggacctcctgcaagcccaactgcatccccggaacctccaccacctgag

SEQ ID NO: 15391 - DNA, 1320 bp, Artificial Sequence
  Description of Artificial Sequence: Synthetic coding sequence
atgggtccgcccgggagtccatggcagtgggtgaccctgctcctgggcctcttgctgcctcccgcagcgcctttctggctgctcaatgtgctgtttccaccgcacacaacccccaaggccgagttgagcaatcacacaagacccgtcattctggttccaggttgcctagggaaccagcttgaagcaaaactggataaaccggatgtcgtcaactggatgtgttatagaaagactgaggacttttttaccatatggctggacctgaacatgttcctaccactaggggtggactgttggattgataatacacgagtggtgtacaatagatcgtctggcctcgttagcaatgctccaggggtccagattagagttcccgggttcgggaagacatattctgtggagtatttggacagttcgaaattggccgggtaccttcacacgctcgttcagaatctagtaaacaacggttatgtgagagacgaaaccgttcgcgcagcaccctacgactggagactggagccagggcaacaggaggagtattacagaaaactcgcgggacttgtggaggaaatgcatgccgcctacgggaaacccgttttcttgattggccacagtctcgggtgtctgcatctcttatactttctcttgagacagccacaggcctggaaagataggtttatagatgggttcattagtttgggggccccatggggcggttccatcaaacctatgctggtgctggcgagtggcgataaccaaggcatcccaataatgagcagcattaaactgaaggaggagcagcgcattaccaccacaagcccttggatgttcccatcgagaatggcctggccggaagaccatgtgtttatctctacaccttccttcaactataccggccgcgactttcagagattcttcgccgacctgcactttgaggaaggttggtatatgtggctccagagtcgcgacttgctggcgggattgcccgcaccaggagtcgaggtgtactgcttgtatggagtcggcttgccaacacccaggacttacatctatgatcacggttttccgtacacggaccctgttggcgtactttatgaggatggggacgatacagttgccacacgatcaacagagctatgcggcctgtggcaaggccggcagcctcagcccgtgcacctactgcctttgcacgggattcaacacctgaacatggtatttagcaacctgacgctggagcacatcaatgctatcctgctgggcgcttatagacagggcccccctgcctcaccgactgccagcccggaaccacctccacctgag

SEQ ID NO: 15392 - DNA, 1320 bp, Artificial Sequence
  Description of Artificial Sequence: Synthetic coding sequence
atggggcccccagggagcccgtggcagtgggtcacgctgctcctgggattgctccttccgccagcagcaccattttggctgcttaacgtcttgtttccacctcataccactcctaaggctgaacttagcaaccacaccaggcctgtgatacttgtcccagggtgtcttggaaaccaacttgaggcaaaacttgataaacccgatgtcgtgaactggatgtgctaccgcaagactgaagatttcttcactatttggttggatctgaacatgttcctcccacttggcgttgattgttggattgataacacgcgtgtcgtgtacaaccgctcatcaggcttggtatccaacgcaccaggcgtgcagataagagtcccaggatttggaaaaacttactccgtcgagtacctggattcctcaaagctggcaggttacctccacaccctggtgcaaaatctcgtgaacaacggttacgttcgggatgagactgtcagagccgccccttacgactggcgactggaacctggtcaacaggaagaatactaccgcaagctggcggggctggtggaggaaatgcatgcggcttatggaaaacctgtttttcttatcggacattcgcttggatgtctgcatcttctttactttcttcttcgtcagcctcaagcatggaaggatcgtttcatcgacgggttcatttcactgggagctccttggggaggttccattaagccaatgctcgtgttggcatccggggataatcaaggcattcctattatgtcgtcgattaagctgaaggaagaacagcgaatcaccactaccagtccatggatgtttccatcgcgaatggcatggcctgaagatcatgttttcataagcaccccttcgttcaactacaccggcagggactttcaacgcttttttgcagacttgcatttcgaggagggatggtacatgtggttgcaaagcagggacctgcttgccggacttcctgcacccggcgtcgaagtgtactgcctttacggggtgggacttcctacccctcgcacgtacatctacgatcacggttttccctacactgacccagtgggagtcctgtacgaggacggagatgacaccgtggcaactaggtcaaccgaactttgcggactttggcaagggcgtcagccacaacctgtgcatctgctgcctttgcatggcatacaacacctcaatatggtgtttagcaacctgactcttgagcacattaatgcaattctcctcggtgcatatagacagggaccacccgcaagccctaccgcctcgcctgaaccgccccctccagaa

SEQ ID NO: 15393 - DNA, 1320 bp, Artificial Sequence
  Description of Artificial Sequence: Synthetic coding sequence
atgggcccccccggctcgccatggcagtgggtaaccctgttgttgggacttcttctgccaccggccgcaccattctggttgctcaacgtcctgtttcccccccatactacaccaaaggccgagttgtctaaccacactcgaccagtaattttggtcccaggatgtctcgggaaccagctggaagccaaattggataaacccgacgttgtgaactggatgtgttataggaaaacggaggactttttcacaatatggctagacctgaatatgtttcttcccctgggcgtggactgctggatcgataacactcgtgtagtgtataatcgctccagcggcctggtctccaatgctcctggcgtacagatccgggtgcccgggttcggcaaaacgtacagcgttgaatatctcgactcctctaagctggccggctacctccatacgctggtgcaaaaccttgtgaacaacggatatgtgcgggatgagacagtcagagcagccccttacgactggcggctggagccaggacagcaagaagaatattacagaaagcttgctgggttagttgaagagatgcacgctgcatatgggaagccagtcttccttatcgggcattcattgggctgtctgcatctcctctatttcctattgcggcaacctcaagcctggaaggacaggttcattgatgggtttatatcactcggggccccctgggggggaagcataaaacccatgttagtactagcctctggtgacaaccagggtataccaatcatgtcatccattaaattgaaggaagagcagcggataacaaccacaagtccatggatgtttcctagccgcatggcctggcccgaggaccatgtcttcatttctactccatcctttaactatactgggcgggactttcagaggtttttcgctgacctgcacttcgaggagggctggtacatgtggctgcagtccagggatctgctagctggactccctgcccccggagttgaggtctactgtctctacggggtaggactgcctacccctcgcacctacatatacgatcatggcttcccttatactgaccccgttggggtcctgtacgaagacggggacgatacagttgccactagatctacggagctctgtgggctgtggcagggacgccagccacagcccgtgcacctcttgcctttgcatggtatccaacatctcaacatggtgttcagcaacttaactctggagcacatcaatgccatcctcctgggagcttaccgtcaagggccgccagcctcacctacagcatccccggaacccccgcctcctgaa

SEQ ID NO: 15394 - DNA, 1320 bp, Artificial Sequence
  Description of Artificial Sequence: Synthetic coding sequence
atgggtccacctggatcgccctggcagtgggtgaccctcctgcttggactgctgctgccgccagcagcgcctttttggcttctgaatgtgctgtttcctccacatactaccccaaaggcagaactctcgaaccacactagaccagtgatccttgtgcctggctgtctgggcaaccaactggaagcgaaacttgacaaacctgacgtggtgaactggatgtgttacagaaagaccgaggactttttcactatctggctcgatctcaacatgtttctgccacttggggtggactgctggattgacaatactcgcgtggtctacaaccgctcgtccggtcttgtgtcaaacgcgcccggcgtccaaattagagtccctggctttggcaagacctactcagtggagtacctcgatagcagcaagctggcgggctaccttcatacccttgtgcagaacctggtgaataacggttacgtccgggatgaaacggtccgggccgcaccttacgattggcgcctggagcccggacaacaggaagaatactatagaaagttggcgggattggtggaagaaatgcatgcggcctacggaaagcccgtctttctgattggacactcgcttggatgtctccatctgctgtactttctgctgcgtcaacctcaagcctggaaggatcgcttcattgacgggttcatctcgctcggagccccttggggaggaagcataaagcctatgcttgtcttggcctcgggagacaaccagggtattccgattatgtcctcgataaagctgaaggaagagcaaagaattaccactacttcgccttggatgtttccttcacgaatggcatggccagaagatcacgttttcatctcgactcctagctttaactacaccggaagagattttcagaggttcttcgcagatctgcattttgaagaaggttggtacatgtggttgcagtctcgcgatcttctggcaggacttcctgctcctggggtggaagtgtactgtctgtacggggtcggtctgccaactccacgtacctacatctacgatcatgggttcccttataccgatccagtcggagtgctctacgaggacggggatgacacggtcgcaacccgatcgaccgagctttgcggcctctggcagggccgtcagccccagccagtccatcttcttcccctgcacgggatccaacacttgaacatggtgtttagcaacctcaccctcgagcacattaacgccattctcttgggagcgtaccggcaagggccaccggcgagtcccaccgccagccctgagcctcccccaccagag

SEQ ID NO: 15395 - DNA, 1320 bp, Artificial Sequence
  Description of Artificial Sequence: Synthetic coding sequence
atggggccacccggatctccttggcagtgggtcacgctgctgctgggactgctgctccctcccgcggctccattttggctactcaacgtactgtttcccccccacactactcccaaagccgagcttagcaatcatacccgtcctgtgatcctggtgcctgggtgtttggggaaccagctggaagccaagctggataaacccgatgtggtcaactggatgtgttaccgaaagactgaagatttctttacaatatggttagatctgaatatgtttctccctttaggcgtcgattgttggatcgacaacacccgcgtcgtgtacaatcgatcctccggcctggtgtctaatgctcctggtgtccagatcagggtcccagggttcggcaagacctacagcgttgaatatctggacagctcaaaattggcagggtatttgcacaccctagtccagaacctcgtcaataatggctacgtgagggacgaaacagtacgggcagcaccttatgactggaggctggaacctgggcagcaggaagaatactaccggaagctcgctgggttggtggaagagatgcacgccgcctacggcaaaccggtgtttctgatcggacattccctcgggtgcctacacctcctgtattttcttctccggcaaccacaggcctggaaggaccgatttatcgatggtttcatttcactgggcgcaccatggggaggctcaattaaacccatgctagtcctcgccagcggagacaaccaggggatccccataatgtcctcgataaagctcaaggaggagcagcgaataaccaccacaagcccttggatgttccccagcaggatggcttggcccgaggatcatgtttttatctccaccccctccttcaactataccggcagggactttcagcgatttttcgcggacctgcactttgaggagggatggtatatgtggttgcagtccagagacctgctcgccggtctcccagccccaggtgtggaggtatactgtctctacggggttgggctccctactccgcgaacctatatctacgaccatggctttccgtacactgaccccgtcggtgtgctctacgaagatggagacgataccgttgctacacggtccacagagctgtgcgggctttggcaggggcgtcagcctcaacccgtgcacctgctgcctctgcatggaattcagcatcttaacatggtattctcaaacctcactttggagcacatcaacgccattcttctcggtgcttaccgacagggccctcccgcatcgccaacggcctctccagaacccccccccccagag

SEQ ID NO: 15396 - DNA, 1320 bp, Artificial Sequence
  Description of Artificial Sequence: Synthetic coding sequence
atgggtccgccaggaagtccatggcaatgggtgacattactattgggcctgctcctaccaccagctgcaccgttttggttgcttaatgtcttgttcccaccccacaccacgccaaaggcagaactctccaatcataccagaccggttattttggtcccaggttgtcttggcaatcaacttgaagccaaactcgataagccagacgtggttaactggatgtgctaccgaaagacagaggattttttcacgatttggcttgatctcaatatgttccttccacttggagtggactgctggattgataacacgcgagttgtgtacaatcgatcgtcgggacttgtgtcaaatgctccaggcgtccaaatcagagtaccgggattcggaaagacctactccgtcgaatacttggattccagcaagctcgcgggatatctgcacacacttgttcagaacttggtgaataacggatatgtccgtgacgaaacagttcgggctgctccttacgactggaggcttgagccaggacaacaagaagagtactacagaaagctcgctggacttgttgaggagatgcacgctgcatatggaaaaccagtgtttcttatcggacattcgctaggctgtctacacttgctttattttttgcttcgacaaccgcaagcttggaaggacagatttattgatggattcattagccttggagcaccatggggtggatccattaaacctatgctggttctagccagtggggataatcaaggaattccgatcatgtccagcatcaaacttaaagaagagcagcgaatcactactacatctccctggatgttccctagtagaatggcctggcctgaagaccatgtctttattagtactccatccttcaattatacaggaagagatttccagcgattttttgcggatcttcatttcgaggaaggatggtacatgtggttacagtcaagagacttgcttgcgggattgcctgcaccgggagttgaggtctactgtctttacggagtaggtcttcctacccctcgtacatacatatatgatcatggatttccatacaccgatcctgtcggggttctttatgaggatggtgacgatacagtagcgaccagatctacagagctctgcggattgtggcaaggtcgccaaccccaaccagtccatttgttgccactccatggtattcagcatttgaacatggttttcagtaatcttaccctagaacacataaacgcgatcctcctgggagcatacagacagggtcctcccgcatctcctactgcttctccagaaccgccaccgccagag

SEQ ID NO: 15397 - DNA, 1320 bp, Artificial Sequence
  Description of Artificial Sequence: Synthetic coding sequence
atgggccctccaggtagtccatggcagtgggtaaccctgttgcttggactgctccttccccccgcagccccattctggctcttgaacgtgttgttccctccacacacgaccccaaaagccgagctgtccaaccataccagaccagtgattctcgtgccaggctgtctgggcaaccagctcgaagctaaactggataaaccagatgtcgttaactggatgtgttacaggaagacagaggacttcttcaccatatggcttgatctgaatatgttccttcctctgggcgttgattgctggatagataacaccagggtcgtttacaataggagcagcggactggtctccaacgcgccgggagttcagattagggtgccgggattcggtaagacgtatagcgtggagtacctggattcctctaagctcgctggctatctgcatactctggtgcagaaccttgttaataatggctacgtgagagacgaaactgttagggccgccccgtacgactggaggttggagccaggccagcaagaggagtactaccgcaaactggccggtcttgttgaggaaatgcatgccgcctacggaaagccagtgttccttataggtcactcactcggctgtttgcatcttctctactttctcctgaggcagccccaggcttggaaggatagatttatcgacggctttatatccctcggagcaccatggggaggaagcattaagccaatgctggtgctggcctctggcgataatcaaggaattcctatcatgtcttccataaagctcaaggaggaacagaggatcacgacgacgagcccgtggatgtttcccagcagaatggcctggcctgaagaccatgtctttatctccaccccgtcctttaattacacaggccgcgatttccaacgcttctttgcagacctgcattttgaagaaggttggtacatgtggctccagagtcgcgatttgctcgccggcctcccagcgcccggtgtggaagtttattgtctgtacggagtaggtttgcctactccaaggacatacatatatgaccatggttttccatacacagaccccgtgggagtgctttacgaggacggagacgacactgtcgcaactaggtccacggagctctgtggcctttggcagggccgccagccccaacccgtccacctgctgcctctccacggcatacagcacctgaacatggttttctccaacctgactttggagcacattaacgccatccttctgggcgcttacaggcaaggacctcctgcttctccaacagcctctcccgaaccaccaccacccgaa

SEQ ID NO: 15398 - DNA, 1320 bp, Artificial Sequence
  Description of Artificial Sequence: Synthetic coding sequence
atggggcctcccggcagtccctggcagtgggtcaccctgctcttaggcttgctgctccctcccgcggcgccattttggctgctgaacgtgctcttcccacctcacacaacacctaaggctgaactgagcaatcacacgcggcctgttattctggtcccaggctgtctgggcaaccagttggaggctaagctcgacaaacctgatgtggtgaattggatgtgttatagaaagacggaagatttcttcactatctggctcgacttgaatatgtttctccctctcggcgtggactgttggatagacaatacccgcgtggtttataatagaagcagcggcctcgtatctaacgcccctggggtgcaaattcgggtacccggcttcggtaaaacgtattctgtggagtatctggattcatccaaattagccggctacctacacaccctggtacagaacctggttaacaacggatacgttcgcgacgagacggtcagggctgctccatatgattggcgcctggaacccggccagcaggaagaatactataggaagctggcggggctggtggaggaaatgcatgccgcttatggaaaaccagtgttcttgatcggacatagcctgggttgcttgcatttgctgtatttcctgcttcggcagcctcaggcttggaaagaccgcttcattgacggctttatctcgctaggagccccctggggtggatctatcaaaccaatgctggtgttggcctcgggagacaatcaaggcattccaataatgagttccatcaaacttaaagaagaacagaggatcaccaccacttctccatggatgtttccttcgcggatggcctggccggaagatcacgtgtttatttcaactccttcattcaattacacaggcagagacttccaacggtttttcgctgacttgcatttcgaagaaggctggtatatgtggctgcaatctcgggatctactggcgggacttcctgccccaggcgtagaggtttactgcctgtatggggtgggactccctacaccccgaacgtacatatatgatcatgggtttccatacacagatccagtgggcgttctgtacgaggatggcgatgatacagtagccacaagaagcactgaactttgcggactgtggcagggccgtcaaccccagccagtgcacctactgcccctccacggcatccagcatttgaatatggtcttctctaacctaactctcgaacatatcaatgcaatcctcctgggcgcttaccgacaggggcctcccgccagtccaacggcttctccagagcctccacctcctgag

SEQ ID NO: 15399 - DNA, 1320 bp, Artificial Sequence
  Description of Artificial Sequence: Synthetic coding sequence
atgggacctccaggttctccttggcaatgggtgactcttcttctcgggctgctgcttcctcctgcagcaccattttggctgctcaacgtcctttttcctccccacaccactcctaaggctgaacttagcaatcatacccgccccgtgattcttgttcctggatgtctcgggaaccaactcgaagcaaagctggacaaacctgacgtggtgaactggatgtgttacagaaagactgaggactttttcaccatttggctggatttgaacatgtttcttccccttggagtggactgttggatcgataatacgagggtcgtgtataaccggagttcgggactcgtctccaatgcacctggagtccagattagagtgcctgggtttggtaaaacctattccgtggaatacttggatagtagcaagttggcgggttacctccatacccttgtgcagaaccttgtgaacaatggttacgtgcgcgacgagactgtgcgcgcggctccgtacgattggagacttgagccgggccagcaagaagaatactacaggaagttggcaggcctcgtggaagagatgcatgctgcttacggaaaacccgtgtttctcattggtcactcccttggatgcctgcatttgctttacttccttctgcggcagccacaggcctggaaggatcggttcattgatggattcataagccttggtgcaccgtggggcggctcaatcaagcccatgctggtgctcgcatccggtgacaatcaaggaatccctatcatgagctcgataaaactgaaggaagaacaacggattaccaccaccagcccctggatgtttccttcgagaatggcatggccagaggaccatgtctttatctccacgcctagctttaactacactggacgggattttcagagatttttcgctgatcttcactttgaggagggatggtatatgtggcttcaatcgcgagatctcctggccggcctcccggccccaggagtggaggtttactgtctctacggtgtgggacttccgaccccgaggacctacatttacgatcacggcttcccctatactgatcctgtgggagtcctttacgaagatggagatgataccgtggcaactagatcgactgaattgtgtggtctttggcagggacgccaacctcaaccagtgcatttgctgccgcttcatggtattcaacatctgaacatggtgttctcgaatctcacgctggagcacattaacgcaatcctcttgggcgcttacagacaggggcctccggcgtcaccaaccgcatcaccagaaccgcccccacccgag

SEQ ID NO: 15400 - DNA, 1320 bp, Artificial Sequence
  Description of Artificial Sequence: Synthetic coding sequence
atggggccaccaggaagtccctggcagtgggttacattgctccttggactcctcctcccaccagccgcgccattctggctgctgaatgttctctttccccctcacacaacacccaaagccgagcttagtaaccacacacggccagtgatcctggtcccagggtgtctgggaaaccagcttgaagcaaaattagataaaccagatgtcgtcaactggatgtgttatcgcaagacagaagatttcttcacaatatggctggacctcaatatgttcctcccactgggggtggactgctggattgataatacaagagtggtgtataaccggtcctcagggctagtgtctaacgccccaggggtgcagataagggtgcccggattcgggaaaacatattcagttgaatatcttgattcctccaaacttgcaggatatctacacactttggtacagaatctagtaaataacggatacgtcagggatgaaacagtgagggccgcaccctatgactggagattagagcctggacagcaggaagaatattaccggaaactagctggattagttgaagagatgcatgccgcctacggaaaacctgtgttcttaatcgggcattccctcggatgccttcatcttctatacttcctcctccggcagccacaggcatggaaagatcgttttatcgatggatttatctccttgggagcaccctggggagggtctattaaacctatgctagttctagctagtggggacaaccaagggatccctataatgtccagtataaaacttaaagaagaacaaaggattactacaacttcgccttggatgttcccctcaaggatggcatggcctgaagaccatgtgttcatctcaacaccaagtttcaattatacagggagagattttcagcggttcttcgccgatcttcatttcgaagaaggatggtacatgtggttacagtcaagagatctgctagccggactccctgcccctggagtggaagtatactgcctctacggagtgggacttcctacaccacgaacatacatatacgatcacgggttcccctatactgatccagtcggggtgttatacgaagatggggacgatacagtggctacacggagtactgaactatgcggactgtggcagggacgccagccccagccagttcatcttcttccactccacggaatacagcaccttaatatggttttttctaacctcacactcgaacacataaacgccatcctccttggggcatatcgccagggaccccctgcttctcctacagccagtcctgagccaccacctccagaa

SEQ ID NO: 15401 - DNA, 1320 bp, Artificial Sequence
  Description of Artificial Sequence: Synthetic coding sequence
atgggaccgcccggctcgccgtggcaatgggtgaccctgctgctggggctgctcctcccgccggcggcccccttctggctgctcaatgtgctgttccctccgcacaccacccccaaagcggaactctccaatcatactaggccggtgattctcgtgccaggatgcttgggcaaccagctcgaggcaaagctcgacaagccggacgtggtcaactggatgtgctaccgcaagaccgaagatttcttcactatctggctcgatctcaatatgtttctcccgttgggagtcgattgttggattgacaatacccgggtggtctacaatcgcagctcaggactggtgagtaacgcgccgggggtgcagatccgcgtgccgggcttcggaaagacctactccgtggagtacttggactcgtcgaaacttgcgggttacctccatactcttgtgcagaacctcgtgaacaacggatacgtgcgcgacgaaactgttcgcgctgccccgtacgactggcgcctcgagccgggacaacaggaagagtactacagaaaactcgccggtctggtcgaggaaatgcacgcagcttacggaaagccggtgttcctcatcggacattcattggggtgcctccatctgttgtacttcttgctgcggcaacctcaggcctggaaggacagattcatcgatgggttcattagcctcggtgccccgtggggagggtcaatcaagccaatgctcgtgctggcctcgggagataaccaaggtattccgatcatgtcctccatcaaactgaaggaagagcaacgcatcaccaccacgtcaccatggatgttccccagcagaatggcgtggccggaagatcacgtctttatcagcacgccatcctttaactacactgggagagacttccagagattcttcgcagacctgcacttcgaagaagggtggtacatgtggttgcagtcgcgtgatctgctcgcaggcctcccagcgcctggagtcgaagtgtactgtctgtatggggtgggtctgccgaccccgaggacctacatttacgaccacggcttcccatacactgatcccgtgggagtcctgtacgaagatggagatgatacggtggctactcggagcaccgagctgtgtggactctggcagggtcgacagccgcagccggtgcacctcctgccgctgcatgggatccagcatctgaacatggtgttctcaaatctgaccctggaacacatcaatgctatcctgctgggagcctaccgccagggaccccctgcttccccgactgcctcaccagaaccgccgcctcccgaa

SEQ ID NO: 15402 - DNA, 1320 bp, Artificial Sequence
  Description of Artificial Sequence: Synthetic coding sequence
atgggaccaccgggttctccatggcagtgggtgacgttactgttgggactcctcctgcctcctgctgcccccttctggctcctgaatgtgttattccctccgcatacaacacccaaagcagagcttagtaatcacacccggcctgttattctcgtgccagggtgcttgggtaaccagttagaagccaaactggataagcctgatgtcgtgaattggatgtgctataggaagacagaagattttttcacgatctggctggacctgaatatgttcctgcccctgggggtcgactgttggattgacaatacgcgagtggtctacaatcgatcgtcaggccttgtcagtaatgcaccgggggtacagattcgggtgccgggctttggcaagacctactcagttgagtacctggactccagtaagcttgccggatatctgcatacactcgtccagaatttggtgaacaatggatatgtgagagacgagaccgtgcgggccgccccttacgattggcgcctggaaccagggcagcaggaggaatattaccgcaagctggccggccttgtcgaggaaatgcatgccgcctacggaaagcctgtcttcctgattggacattctctgggctgtctgcacctgttatactttctgctgcgacagccacaggcttggaaggacagattcatcgacggattcatctctctgggagcgccctggggggggtcaataaagcccatgctggtcctcgcctcgggagataaccagggcattcctattatgagcagtatcaagttgaaagaggaacaacgtattacgacaaccagtccatggatgttcccgtcccggatggcctggcccgaggaccacgtgtttatctctacaccttcctttaactataccggacgggacttccagcgcttctttgctgacctccatttcgaagaagggtggtatatgtggcttcagagtagggatctcctggctggccttcctgccccaggtgtggaggtatactgcctttatggggtgggcctgcccacgccaaggacctacatctacgatcatggttttccgtacacagatcctgtcggcgtgctgtatgaggacggcgacgacaccgtggctaccaggagtacagaattgtgcggcctgtggcagggaaggcagccccagcctgttcacctactcccgctccatggcatccagcacctgaatatggtcttctctaatctgacactggagcatataaacgcgatcttactgggagcatataggcagggacccccggcgtccccgaccgcatcccctgagccacctccgcccgaa

SEQ ID NO: 15403 - DNA, 1320 bp, Artificial Sequence
  Description of Artificial Sequence: Synthetic coding sequence
atgggaccccccggctctccttggcagtgggtgacactgctgctgggtctgctgctgcccccagccgctccattttggctgcttaacgtgctgttcccacctcacaccacccccaaggctgagctctcaaatcacactcgacccgtcatcctggtcccagggtgtctgggtaaccaactggaggccaagctggataaacctgatgtggtcaattggatgtgctaccggaagacagaagacttctttaccatctggctggatcttaacatgtttctgcccttgggagtggactgttggatcgataacactagagtggtgtacaataggtccagcgggctggtgtccaatgctcctggagttcagattcgagtgccaggctttgggaagacctactctgtcgagtatctggacagttctaaactggccgggtacttgcacactctggtccagaatctagtcaacaatggttacgtacgtgatgagacagtgagagccgcaccttacgactggagactggaaccaggtcagcaggaagagtattatagaaaactggctgggcttgtagaggagatgcacgccgcatatgggaaaccggtttttttgatcggccactctctaggctgtctgcatctgctatactttcttctgcgccaaccacaggcctggaaggaccgctttatagacggatttatctcactgggcgccccatggggaggaagtattaagccaatgctggtactggcgtccggcgacaatcaaggcatccccattatgagcagcattaaattgaaagaagagcagaggatcaccacaacaagtccttggatgttcccttctagaatggcctggcctgaggatcatgtgttcatcagtacgcccagctttaactacacggggcgggatttccagcggttttttgccgatttgcatttcgaggaagggtggtacatgtggcttcagagccgggacctgctcgccgggctccctgctccaggcgtggaggtttactgcctgtatggcgttggacttcccactccgcggacttacatttacgatcacggattcccatacactgaccctgtcggtgtcttgtatgaagatggggacgacaccgtggccactagaagcacagaactttgcggtctgtggcagggccggcaaccccagcccgtacatttacttcctttgcacggcattcagcatttaaacatggtcttctcaaatttaaccctggagcacatcaacgcaatcctcctcggagcataccgccaggggccgccagccagtcccaccgccagcccagagcctcctcccccggag

SEQ ID NO: 15404 - DNA, 1320 bp, Artificial Sequence
  Description of Artificial Sequence: Synthetic coding sequence
atggggccaccagggtctccctggcagtgggttaccttgctgcttggccttttgttgccacccgctgctcccttctggctgttaaacgtcctttttccgccccacacaacgccgaaggcagaactatcaaaccacacaagacccgtgatcctggtaccaggttgtcttggtaaccaactagaagcaaagctggacaaaccagacgtggtcaactggatgtgctatagaaagactgaggactttttcactatctggttagacttaaacatgttcctgcccctcggagtggattgctggattgacaacactagagttgtgtataatcgaagctcaggactggtcagcaatgcccctggggtgcagatcagggtgcccggctttgggaagacatattccgtcgagtacctggacagcagcaaactggctggctatctgcacacactcgtgcaaaaccttgtgaacaatggatacgtgcgcgacgagaccgtgcgcgccgctccttacgattggcgccttgagccaggccagcaggaggagtactacagaaagctagctggacttgtggaagagatgcatgccgcatacggcaagcccgtgtttctgatcggacattctcttggctgtctacatctcttatacttcctgttgcggcagccccaggcatggaaggatcgatttatcgatggatttatcagcctcggcgccccttggggaggctctatcaagcctatgctggttctcgcttccggcgacaaccagggcatccctatcatgtccagtatcaagctgaaggaagagcagcgcatcaccaccacctctccttggatgtttcctagccgaatggcctggccagaggaccacgtttttatatccacaccgagttttaactataccgggagagactttcaacgttttttcgccgacctgcacttcgaggaaggttggtatatgtggctgcaatctcgggacctgctcgccgggctgccagcaccgggagttgaggtgtactgcttgtatggcgtaggactgccaacccctagaacgtatatttacgatcacggattcccctatacagaccccgtgggtgtgctgtatgaggatggcgacgacaccgtcgctacgagaagcaccgaactctgtggcttatggcaaggcagacagcctcagccagtgcatttactgccactccatgggatccagcatctgaatatggtgttttcgaatctcacgctcgagcacattaacgccatcctgctgggagcgtacaggcagggcccacctgcctctccaaccgctagcccagagccaccgcctccagag

SEQ ID NO: 15405 - DNA, 1320 bp, Artificial Sequence
  Description of Artificial Sequence: Synthetic coding sequence
atggggccgcccggttcaccttggcagtgggtgacgctcctattgggcctgctgttgccaccagcagcgccgttttggcttctgaatgtcctgttcccccctcatacaactcccaaggcagaattgtccaatcacacccgtcctgtaattcttgtgcccggctgtctggggaatcagcttgaggccaagctcgacaagcccgatgtcgtgaactggatgtgttacaggaagacagaggattttttcacgatctggctcgatctgaacatgttcctgccccttggggttgattgttggatagataatactagagtcgtctataatcgatccagcggactagtttccaacgctcctggggtgcaaatcagagtgcctggatttggtaagacctactccgtggagtatttggatagcagcaaattggcgggatatctccacacactggtgcaaaacctagttaacaacggctatgtacgcgacgagaccgttcgggctgctccatacgactggcgactagagcctggacagcaggaggaatattaccgcaagttggcaggactcgtggaggaaatgcacgccgcgtatggcaaaccggtgtttctgatcggtcacagcctgggctgtctgcacttattgtattttctacttcgccagccacaagcctggaaggatcgattcatcgatgggtttattagcctcggcgccccatgggggggctcgatcaagcccatgttggtcctggcctctggcgacaatcaaggtattcccatcatgtccagcatcaagttaaaggaggaacaacgcatcacaactacgagcccgtggatgtttccctcacgcatggcctggcctgaggatcatgtttttattagcactccttccttcaactatactggtcgggattttcagcgctttttcgcagatctgcattttgaggagggttggtatatgtggcttcagagccgtgatcttctggccggactacctgcccccggagtcgaagtgtactgcctctatggggtgggcctgcccaccccccgcacctatatctatgaccatggtttcccttacacagacccggttggcgtgctttatgaggacggggacgacaccgtggcaactagatccaccgagctgtgtggtctgtggcagggaaggcagccgcagcctgtccacctgctgcctctccacggcatccagcacctgaatatggtttttagtaatcttactctcgaacacattaacgccatactgctcggagcttacagacagggtcctccagcctccccaacagcttcacctgagccccctcctccagaa

SEQ ID NO: 15406 - DNA, 1320 bp, Artificial Sequence
  Description of Artificial Sequence: Synthetic coding sequence
atgggacccccaggatccccctggcaatgggtgacgctcctgctggggctgcttttgcctcctgcagccccattttggcttctgaacgtcctgtttccaccccatacgaccccgaaggcggaactttcgaaccatactcgtcccgtgatactggtgcctgggtgtcttggcaatcagcttgaagccaagctggataagccagatgtcgtgaactggatgtgctaccggaaaaccgaggacttcttcactatctggctggacctcaacatgtttctccctctgggtgtcgattgctggatcgataacactcgagttgtgtacaacagatcctcgggccttgtctctaacgcaccgggggtccaaatcagagtcccaggatttggtaagacctactccgtggaataccttgatagctcgaagctcgcaggctacctccacactctcgtgcaaaatcttgtgaacaatggatacgtgagagatgaaaccgtgagagcagcaccatacgactggcgactggagccaggtcagcaagaagagtattaccggaaacttgcaggtttggtcgaagaaatgcatgctgcgtacggaaaacctgtgtttctgattggccatagcctcggatgtctgcatctgctctatttcctcctgcggcaaccgcaggcatggaaggaccgtttcattgatggtttcattagcctgggcgcaccatggggtggatctataaagccgatgctcgtgcttgctagcggtgacaaccagggaatcccgattatgagctccataaaactgaaggaagaacaacgaattactactacttccccatggatgtttccatcccgtatggcatggcctgaggatcatgtgtttatctccactccgtccttcaattacacgggtagggattttcagagatttttcgcggatctgcattttgaggaaggctggtacatgtggctgcaaagtagagatcttctggcaggtctgcccgctcccggagtcgaagtttactgcctctacggcgtgggcctccctactcctcgtacttacatttacgatcacggctttccttacaccgaccctgtgggagtgctgtacgaggacggagacgacactgtcgccaccagatccacggagctctgcggtctgtggcaagggagacaaccacagccagtgcacctgttgccactccatggtattcagcatctcaatatggtgttctcaaacttgactctggaacatatcaatgctattttgttgggcgcatatcggcaaggtccccctgcgtcaccgactgcatcgcctgagcctccacctccagaa

SEQ ID NO: 15407 - DNA, 1320 bp, Artificial Sequence
  Description of Artificial Sequence: Synthetic coding sequence
atgggcccacctggatcaccgtggcaatgggttaccttgctgctgggactgttgttgccccccgcagcccctttttggcttctcaacgtgctgtttccaccacacaccactccaaaggcagaactgtccaaccacacgcggcctgtgatccttgtgccaggctgtctgggaaaccaactcgaagcaaaactcgataagccggatgtcgtgaattggatgtgctaccgcaagactgaggacttcttcacgatttggctggatctcaacatgtttttgcctctcggagtcgattgctggattgacaacaccagagtcgtttacaaccggtcgtcgggtcttgtgtcaaacgctcctggtgttcagattcgcgtgcctggttttggtaagacctactcagtggagtacctggattcctcgaaactggctggataccttcacacccttgtgcaaaatctggtgaacaatggctacgttagagatgaaaccgtgagggcagcgccttacgactggagacttgaaccaggacagcaggaagaatactatcggaagctggcaggacttgtggaagaaatgcacgccgcgtacgggaagcccgtctttctgattggccactccctcggctgcctccacctgctctactttctgctgcgtcagccacaggcatggaaagacagatttatcgatgggtttatctcccttggagcgccttggggaggttccatcaagccgatgctggtccttgcgagcggcgataatcagggtattccaattatgtcatcgataaagctcaaggaagagcaacgaattacgactaccagcccctggatgtttccatccaggatggcttggccagaagatcatgtgtttatcagcactccatcctttaactacaccgggcgtgattttcaaagattcttcgcagacctgcattttgaggaaggatggtacatgtggcttcaatcacgggacctcctggcaggattgccagcaccaggtgtggaggtttactgtttgtacggtgtgggactgcccactcccagaacctacatctacgaccacggattcccttatactgacccggtgggggtgctgtacgaggatggagatgatactgtggcaacccgttctaccgaactgtgtggtctgtggcagggcagacaaccccaaccagtgcaccttctgcctttgcatggcatccaacatctcaacatggtgttctcgaatctgactcttgaacatatcaacgcaattctcctgggtgcatataggcaagggcctcctgcgtcgccgactgcatcgccagagccgcctcctcctgag

SEQ ID NO: 15408 - DNA, 1320 bp, Artificial Sequence
  Description of Artificial Sequence: Synthetic coding sequence
atgggcccaccgggatccccttggcagtgggtgacgctcctgctgggacttttgctgcccccagccgcgcccttttggctgcttaatgtgctgttcccgcctcataccactccgaaagccgagctctccaatcatacccgccctgtgatcctggtcccaggatgcttgggaaaccaactggaggctaagctcgacaagccagacgttgtgaactggatgtgctacaggaaaacggaggatttcttcactatatggctggatctcaatatgtttcttcctctcggcgtggactgctggatcgacaatactcgggtggtgtacaaccggtcgagcgggctggtgtcaaatgcgcctggtgtgcagattcgcgttccgggcttcgggaaaacttactccgtggaatacctggattcgtcaaaacttgcaggatatctgcacacccttgtacagaaccttgtgaacaacgggtacgtcagagacgaaaccgtgcgcgctgccccttatgactggcgcctcgaaccaggacaacaggaggaatactacagaaagctcgcaggactggtggaggaaatgcatgccgcgtacggcaagcctgtctttctcatcggccattcccttggatgtctgcaccttctgtacttcctgctgagacaaccgcaggcatggaaagacagatttatcgatggattcatctctctgggagcgccatggggagggtcgattaagccgatgctggtgttggcatctggtgacaaccagggaatcccaatcatgtcatcgatcaaattgaaggaagaacagagaatcactaccacttcgccgtggatgttcccgagtcgcatggcgtggccagaagatcacgtgtttatctcaaccccgtctttcaactataccggccgcgacttccagagattcttcgcagaccttcacttcgaggaaggatggtacatgtggttgcagtcaagagacttgctggcggggcttccagctcctggtgtggaagtttactgcctctacggcgtcggactgcctactccccgcacctacatctacgatcacggattcccatacaccgatccggtgggcgtcctttacgaggatggagacgataccgtcgcaactcgttcgacggaactgtgtggactgtggcaaggacgccagccacaaccagtgcacctgctccctcttcacggtatccagcatctcaatatggtgttcagcaacctcaccctcgagcatatcaatgccatcttgctcggagcctaccggcagggtccgcccgcctcgccgaccgcctccccggaaccaccaccgcctgaa

SEQ ID NO: 15409 - DNA, 1320 bp, Artificial Sequence
  Description of Artificial Sequence: Synthetic coding sequence
atgggcccccctggatcaccctggcagtgggtgacactcttactcggccttctacttccacccgccgctccattttggctgctgaatgtgctattcccccctcacacaacacccaaagccgagcttagcaaccatactaggccagttattcttgtgcccggttgtctggggaaccagttagaggccaagctcgacaaacctgatgtggttaattggatgtgttatcgaaagacggaggacttctttaccatctggctggatctgaatatgtttttgccacttggggtcgattgctggattgataatactcgtgttgtctataaccgcagctcaggccttgtgtctaacgccccaggtgtgcagataagggtgccaggctttggcaagacttactcagttgagtacctggacagtagcaaactggctggttaccttcatacccttgtgcagaatctggtgaacaatggctatgtgagagatgaaactgtgagagcggctccatacgattggcggctggagcccgggcagcaggaggagtattatcgaaagctggccggcctcgtggaggagatgcacgccgcatacggcaagcccgtgttcctgattggacattcgttgggatgcctgcatttgctatatttcttgcttagacagccccaggcttggaaggataggtttatcgacgggttcatttctctgggcgccccttggggggggagcattaagcctatgctggtgctcgcttccggcgataaccaggggattcccatcatgagctctattaagctcaaagaggagcagcgaatcacaacaacctccccctggatgtttccatcccggatggcgtggcctgaggaccatgtgttcatttcaaccccttctttcaactacaccggcagagactttcaacgcttttttgccgacctgcactttgaggaagggtggtacatgtggttgcagtctagggatttgctggcaggcctacccgccccaggggtagaggtttactgcctttatggagttgggttgccgacccccagaacatacatttatgatcacggctttccctacacggatccggtcggagttttatacgaagatggcgacgacacagtcgccactcgctccaccgaactgtgtggcttgtggcagggtaggcagccacagccagtccacttactgccactccacggtattcaacacctcaatatggtgtttagcaatctaactttggaacatataaatgctatcctcctcggagcctatcgacaagggcccccggcctctcccacggcttccccggaacccccaccccctgaa

SEQ ID NO: 15410 - DNA, 1320 bp, Artificial Sequence
  Description of Artificial Sequence: Synthetic coding sequence
atgggcccgcctggtagcccatggcagtgggtcaccctgctccttggcctgctgctcccccccgccgcccccttctggctgcttaacgttctcttcccaccccataccacacccaaagcggagctgtccaaccacacacggccagttatcctggtacccggatgtttggggaaccagctggaggcaaagctggataagcccgacgtagttaattggatgtgttacagaaagaccgaagatttcttcaccatctggctggatcttaacatgttcctccctctgggtgtcgactgttggattgacaacaccagagtcgtgtataacaggagctctggccttgtgagtaatgcacccggcgtgcagattagagttccagggttcggcaagacctattccgtcgagtacctggactccagcaagcttgcgggctatctgcacacgctggtacagaacctcgtgaataatgggtacgtgcgagacgagacggtgcgggctgcgccttatgattggcggctcgagccagggcaacaggaggagtattacaggaaactggccgggctggtggaggagatgcacgccgcatatggaaagcccgttttcctcattggccactccctgggatgcttgcacctgctgtacttcctcctcagacagccgcaagcttggaaggaccggtttattgacgggtttatatcattgggtgcgccatggggaggctccattaagcctatgctggtgctggcttccggagataaccagggcatacctattatgtcctccataaaactgaaggaggaacagcgcattaccacaacgtctccctggatgttcccctctcgcatggcttggcccgaagaccacgtgttcatatctaccccaagcttcaactatactggtagagatttccaaagattcttcgcagatctccacttcgaggagggctggtatatgtggctgcagagtagggatctgttggctggactgcccgcccctggagtggaggtgtattgcttgtacggggtgggactgccgactcctcggacctatatctatgatcacggattcccttacaccgaccccgtgggagtcctctatgaggatggagacgacaccgtcgcaactcgatccactgagctttgcggtctctggcaggggaggcaaccacaaccagtccaccttcttcctctgcatggcatccagcatctgaatatggtgtttagcaacttgacgctggagcatatcaacgctattctgctcggagcgtatcgacagggtcctcccgcatctcctactgcctcacctgagccacccccccctgaa

SEQ ID NO: 15411 - DNA, 1320 bp, Artificial Sequence
  Description of Artificial Sequence: Synthetic coding sequence
atgggcccaccaggcagcccctggcagtgggtgacactgctgctgggcctgctgctgcctccagctgcacctttttggctgctcaatgtgctgtttcctccacatacaacccccaaagctgagctgtctaatcacaccagaccagtgatactcgtgcctggctgtctcgggaaccagctggaagctaaactggacaagccagacgtggtgaattggatgtgctaccggaagaccgaagactttttcaccatttggctggatctgaatatgttcctacccctaggcgtcgattgttggattgataatacccgagtggtgtataacaggagcagcggcctagtcagtaatgctcccggggtgcagattcgggtccctggttttgggaagacctacagcgttgaatacctagacagcagcaagctggccggatacttgcataccctggtccagaacctcgtgaacaatggttatgtccgcgacgagacagttcgggccgccccctacgactggcggctagaaccaggccaacaagaggaatactatcggaagctggcaggcctagtggaggagatgcacgccgcttatggcaagcctgtgttcttaattggccactccctcggatgcttacatctactgtattttctgctgaggcagcctcaagcttggaaggacaggtttatagacgggttcatatccctgggcgctccttggggcggttctataaaaccaatgctggtgctggcctccggagacaaccagggcattcctataatgtcaagcatcaagttaaaggaagagcagaggataactactacctccccttggatgttcccatccaggatggcctggcccgaggaccatgtgtttataagcaccccatctttcaactacacagggagggactttcagcggttcttcgctgacttgcactttgaagagggatggtacatgtggctgcagtctcgggacttgctggccggtctgccagctcctggcgtcgaagtttattgcctatatggcgtgggcctgcccacccctagaacctacatttacgaccacggctttccttatacagatccagtaggcgtgctttacgaagacggcgatgacacagtggcaaccaggtctaccgaactgtgtgggctgtggcagggcagacaacctcagccagttcatctgctccccctgcacggaatccagcacctgaacatggtgttttccaacctcaccttagaacacataaatgcaattctactgggcgcatacaggcagggcccacccgctagcccaaccgcctctcctgaacccccaccacctgaa

SEQ ID NO: 15412 - DNA, 1320 bp, Artificial Sequence
  Description of Artificial Sequence: Synthetic coding sequence
atgggtccacctggctcaccatggcagtgggtaaccctcctactgggacttttgctcccacctgcagcccccttctggttgctgaatgtgctttttcccccgcacacgactccaaaggctgagttgagcaatcatacgcggccggtcatcctggtacctggatgtctgggcaaccagctagaggccaagctcgacaagcctgacgtggtgaactggatgtgttacaggaagacggaggatttctttacgatctggctggatcttaatatgttcctcccgctaggcgttgattgctggatcgataatactagggtggtatacaaccggtcgagcggtttggtcagcaatgcccccggggtgcaaatccgtgtaccgggattcgggaagacttatagtgtggagtatttggatagctccaagctcgcaggatatctccacaccctggttcagaacctcgtaaacaatggatacgtccgggacgaaacagtccgagcggctccgtacgactggagactcgagccggggcagcaggaagagtactaccggaagctcgcgggcctcgtcgaggagatgcacgctgcctatggtaaaccggtattcttgatcggacatagcctgggttgtctgcacctactgtattttctgctcagacagccgcaggcgtggaaagatcggtttatcgacgggtttattagcctcggcgctccttggggcggatctataaagcccatgctggtactggcatctggagataatcagggtatcccaatcatgtcctctataaaactgaaggaggaacaacgaataaccactacctcaccctggatgtttccctcacgtatggcttggcccgaagatcatgtgttcatatccacgcccagcttcaactacactggccgggactttcagagattcttcgcggatttacattttgaggagggctggtacatgtggctgcagagtagggatctgctcgctggccttcctgcacccggtgttgaggtgtattgtctgtacggcgttggattaccaacgccaagaacatatatatatgaccatggcttcccctataccgacccagttggggttctgtatgaagacggagacgatactgttgccactagatcaaccgagttatgcggattatggcagggacgccagccacagcccgtccaccttctgcccttacacggcattcaacacctgaatatggttttctctaacttgactttggagcacatcaacgccattctcctgggtgcatataggcagggaccccctgccagccccacagccagtcccgagccccctccccccgag

SEQ ID NO: 15413 - DNA, 1320 bp, Artificial Sequence
  Description of Artificial Sequence: Synthetic coding sequence
atgggacctccaggatctccatggcagtgggttactttacttttaggacttcttttacctccagctgctcctttctggttattaaatgttttatttcctccacatactactccaaaagcagaattatctaatcatacaagaccagttatcttggttccaggttgtttaggaaaccaattagaggctaaattagataagccagatgttgttaattggatgtgttatagaaaaacagaagatttttttacaatttggcttgacttaaatatgtttcttccactaggagttgattgttggatagataatactcgtgttgtttataacagaagttcaggacttgtatctaatgctccaggtgttcaaataagagttccaggatttgggaaaacttattcagtcgaatatcttgattcttctaaattagcaggatatttgcatacacttgttcaaaatttagttaacaatggatatgtaagagatgaaacagttagagcagcaccatatgactggagattagaaccaggacaacaagaagaatattatagaaaattagcaggattggtagaagaaatgcatgcagcatacggaaaacctgtttttcttattggtcattcacttggatgtcttcatcttctttatttcttgttaagacaaccacaggcatggaaagatagatttattgatggatttatttcattaggtgctccatggggaggatctatcaaacctatgttagttttagcatcaggtgacaaccaaggaattccaatcatgtcatctattaaacttaaggaagaacaacgtattactacaacaagtccatggatgtttccatcaagaatggcttggccagaagatcatgtttttatttctactccatcttttaattatactggtagagattttcaaagattttttgcagacttacattttgaagaaggatggtatatgtggttacaaagtcgtgatcttttagcagggttaccagctccaggtgtagaagtttattgtttatatggagttggacttccaactcctcgaacatatatttatgaccatggatttccatatacagatccagttggtgttttatatgaagatggtgatgatacagttgccacaagatccacagaactttgtggtctttggcaaggaagacaaccacaaccagtccatttacttcctttacacggaattcaacatctaaatatggttttttcaaacttaactttagaacatattaatgcaattctattaggggcttatagacaaggaccaccagcttcaccaacagcaagtccagaaccacctccaccagaa

SEQ ID NO: 15414 - DNA, 1320 bp, Artificial Sequence
  Description of Artificial Sequence: Synthetic coding sequence
atggggccaccaggatccccctggcaatgggtgactctgctcttgggacttcttctgcctcccgccgcgcccttttggctcctcaatgtgctgtttcccccacacactacccctaaagcggagctttccaaccacaccagaccagtgatccttgtgccgggatgtcttggaaaccaacttgaagctaagttggataaacccgacgtggtgaactggatgtgttatagaaagactgaagatttctttactatttggctcgatctgaacatgtttttgccccttggtgtggattgctggattgacaacactcgcgtggtctacaatagatcctcgggactcgtctcgaacgcgcctggcgtgcaaattagagtccctggttttggcaaaacctactccgtggagtatctcgattcgtccaagctggcaggttaccttcataccctggtccagaacttggtcaacaatggatacgtgagagatgaaacggtgcgcgctgcgccttacgactggcgtcttgagccgggtcaacaagaggaatactacagaaaacttgccggtttggtcgaagagatgcatgcggcctatgggaaacctgtgtttctgattggccacagcctgggatgtctccatctcctctactttctgctgcggcaaccccaggcttggaaggatagattcattgacggatttatcagcctcggcgctccatggggtggatcgatcaaacccatgcttgtgttggcttctggggataaccaaggtattcctataatgtcatcgattaagctcaaggaagagcaacgaattaccaccacttccccgtggatgttcccttcacgcatggcatggccagaagatcatgtgttcatatcaactccatccttcaactacactggaagagatttccaacgcttcttcgcagacttgcactttgaagagggttggtacatgtggcttcagtcaagggatctgctggcaggactcccagcacctggagtggaagtgtactgcctttacggagtcgggcttccgacgccccgcacctacatttacgatcatggatttccttacaccgacccagtgggtgtgctctacgaagatggtgatgatactgtggcaaccagatccaccgaactctgcggactgtggcaaggcagacaacctcagcctgtgcatctgctgcctctgcacggtattcaacatctcaacatggtgtttagcaatttgacgctggagcatatcaacgccattcttcttggggcatacagacagggtcctccagcctcgcctactgcgtcgccagaacctcccccaccggaa

SEQ ID NO: 15415 - DNA, 1320 bp, Artificial Sequence
  Description of Artificial Sequence: Synthetic coding sequence
atgggaccgcccggctctccctggcagtgggttaccctgcttctgggattgctcctgccaccagccgcccccttttggctgctcaatgtcctctttcctcctcacacaacacccaaggctgaactttccaaccatacgcgcccagtaatcctcgtcccaggttgtctgggtaaccagctggaggctaaactggataagcccgatgtcgttaattggatgtgctatagaaaaactgaggattttttcacaatttggctggatcttaatatgtttctgcccctgggtgttgactgttggatcgacaacacccgcgttgtctacaacagatctagcggactagtgagtaacgcgcccggagtgcagatccgggttcctggcttcggtaagacctactccgtagagtacctggactcttctaaattagctggctatctacataccctggtccaaaacctggtgaacaatggatatgtcagggatgaaacagtgcgagccgcgccatatgactggagattggaacctgggcaacaggaagagtactatcgcaaactggcagggctggtggaagaaatgcatgccgcctacggaaagcccgtattcttgatcgggcattctctgggatgtctgcacttgctatatttcctcttacgccaacctcaggcatggaaagaccgcttcattgatgggttcatatctttgggggcgccctggggcggctcgattaagcctatgctggtactggcatcaggagacaatcagggcattccgatcatgagcagcataaaactgaaggaggagcagcgaatcactacaaccagcccctggatgttcccatcccggatggcctggcccgaagatcacgttttcatcagcactccttctttcaactacacaggcagagacttccagcggttctttgctgacctgcacttcgaggaagggtggtatatgtggctacagtctcgggatttactggccggtctcccggcccctggagtggaggtgtactgcctgtacggtgtgggcttgcccactcctcgcacatatatctacgatcatggcttcccttacacagatccagtgggcgtattgtatgaagacggcgatgacactgtcgccactcggagcactgaactgtgtgggttgtggcaggggagacaaccgcagcctgttcacctgctgccactgcatggcatccaacatctgaacatggtgttttctaatctaacacttgagcacatcaacgctatattgctgggcgcctaccgccaggggccaccagcatcgcctaccgcatctcccgaacctccgcctccggaa

SEQ ID NO: 15416 - DNA, 1320 bp, Artificial Sequence
  Description of Artificial Sequence: Synthetic coding sequence
atgggacccccaggaagtccctggcagtgggttaccctgttactgggccttctactgccacccgctgccccattttggttgttgaatgtgcttttccctccacacaccaccccaaaggccgagctgagcaaccatactcgacccgtcatcttggtgcccggatgcctgggcaaccagctcgaggcaaaactcgacaagcccgatgtggtcaattggatgtgctaccgtaagaccgaagacttcttcacaatctggctcgacctgaatatgttccttcctctgggcgtcgattgctggatcgacaatacacgagtggtttacaacaggtccagcggtctcgtttctaacgcaccaggagtgcaaattcgtgtgcctggctttggaaaaacttattccgtcgagtacctggatagctcaaagctcgccggctacctgcatacccttgtgcagaacctcgtcaacaacggttatgtgcgagatgagaccgtacgagctgcgccttacgattggagactcgaacctggccagcaagaagagtactatcggaagcttgccggactcgttgaggaaatgcatgcagcatacgggaaacccgtttttctgataggccacagccttggctgtctgcatttgttgtatttcctcctaagacagccacaggcctggaaggatagattcatagacggcttcatatccctcggtgcaccgtggggtggatctattaaacccatgctggtcctcgccagcggggataaccagggaattcctattatgtctagcatcaaacttaaagaagagcaaagaatcaccactacctccccatggatgtttccttcaaggatggcttggccagaagaccatgtctttattagcacacccagcttcaattacacaggtcgagattttcagcgattctttgccgatttgcatttcgaggaggggtggtatatgtggctgcagtctagagatttactggcaggcttgcctgcccccggcgtggaggtttactgtctgtatggggtgggcctgcccacccctcgaacatatatctacgatcacggctttccgtataccgatccggtgggcgtactgtatgaggatggtgatgatacggtcgctactagatcaaccgaactgtgtggtctgtggcagggccgacagcctcagcccgtgcacctcttaccactgcatggcattcagcacttgaacatggtctttagcaacctcaccttggagcatataaacgccattctgctgggagcttatcgacaagggcccccagcctcccccacagcatcaccggaacccccccctcctgaa

SEQ ID NO: 15417 - DNA, 1320 bp, Artificial Sequence
  Description of Artificial Sequence: Synthetic coding sequence
atgggacctccggggagcccgtggcagtgggtgaccctgctgctcggtctgttgctcccgccagccgccccgttctggttgctcaacgtgctttttccgccgcacaccacgccaaaggcagagctgtcgaaccacacccggccggtgatcctcgtgccgggatgcctgggtaaccagctggaagcgaaactggacaagccagacgtggtcaactggatgtgctacagaaagaccgaggatttcttcaccatctggctggatctgaatatgtttctcccgctgggtgtggattgctggatcgataacactcgggtggtgtataaccgctcttccggactggtgtccaacgccccgggagtgcagataagggtgccaggattcggaaagacctacagcgtcgaatacctggactcctcgaagctggccggctacctccacactctggtccaaaacctggtgaacaacggctacgtgagagatgaaactgtgcgggccgcaccgtacgattggagactggagccgggacaacaggaagagtactaccgtaagttggccggactggtggaggagatgcatgcagcctacgggaagccggtctttctgatcggacattcgctcggctgtctgcacctgctgtacttcctcctgcgccagccccaggcgtggaaggaccgatttatcgatggcttcatctcgctgggggccccttggggtggctccattaagcctatgctcgtgctggcttcgggcgacaaccaaggtatcccaatcatgtcatcaatcaagctgaaggaggaacagcgcatcactaccacgtccccctggatgttcccgagcagaatggcatggccggaggaccacgtctttatctcgacgccatcctttaactacaccggacgggatttccaacgcttctttgccgatctgcacttcgaggaaggatggtacatgtggctgcaatcacgggacctgctggcaggactgcctgcgccgggagtggaagtctattgcttgtacggagtgggactgccaactccgcgcacctatatctatgatcacggttttccatacaccgacccggtcggagtgctgtacgaggatggagacgatactgtggctaccaggagcaccgagctctgcggattgtggcaagggagacagcctcagccggtccatctcctgcctctgcacggaatccagcatctgaacatggtgttcagcaatcttaccctcgagcacattaacgcaattcttctgggtgcctaccggcagggcccgcccgcttccccaactgccagccctgaacctcctccaccggag

SEQ ID NO: 15418 - DNA, 1320 bp, Artificial Sequence
  Description of Artificial Sequence: Synthetic coding sequence
atgggcccgccgggatctccttggcaatgggttacgcttctgctgggccttctgcttccgccggctgctccgttttggttattgaatgtcctttttccgccgcatacaactcctaaagcggaattatcaaaccatacacggccggtcattttagtgcctggctgccttggtaatcaattggaagctaaacttgacaaaccggatgttgtaaattggatgtgttatcgtaaaactgaggatttttttaccatctggttagatctcaatatgtttttgcctcttggtgtcgactgctggattgacaacacacgggtcgtgtacaaccggtcatctggactggtctcaaatgcacctggcgttcagatccgagtgcccggttttggaaaaacatactcagtagagtacttggactcttcaaaactggctggctacttacacacactggtccaaaaccttgtaaataacggctatgttagagatgaaacagttcgggcggcgccatatgattggcgccttgaacctggacaacaagaggaatattatcgtaaattagctggactcgtcgaagaaatgcatgctgcgtatggcaaacctgtctttttgattggacattcacttggttgtttgcatctcttgtatttccttcttagacagccacaagcttggaaggatcgctttattgatgggtttatttctctgggggctccgtggggcggcagcataaaaccgatgttggtgcttgcgtcaggcgacaatcaggggattccgattatgtcatctattaaacttaaagaagagcaacgcatcacaactacatctccttggatgtttccttcacgcatggcgtggcctgaggatcatgtatttatttccacaccatcattcaactacacgggaagagattttcaacgttttttcgcggatctacacttcgaagagggatggtacatgtggcttcagtccagagatttgttagccggcttgcctgctcctggcgtggaagtctactgcctttacggcgttggactaccgactccgcgcacctatatttatgatcacggttttccctatactgatccggtgggcgtgctttacgaagacggtgatgatacagttgctacccgtagtacggaactgtgtgggttatggcagggtcgccagccacaacccgtccatttattgcctctccatggcatccagcatctcaatatggtcttctctaacctcacgctggaacatattaacgcaattcttctcggcgcatatcgacaaggtcctcccgcgagccccacagcctcacccgaacctcctcctcccgaa

SEQ ID NO: 15419 - DNA, 1320 bp, Artificial Sequence
  Description of Artificial Sequence: Synthetic coding sequence
atgggacccccaggttcaccgtggcaatgggtgacgctgcttctgggtctgctcttgcccccggctgcgccgttctggctgctgaacgtcctgttccctccgcacactaccccaaaggcggagctgtcgaaccatactcgcccagtcatcctggtcccaggatgcctcggaaaccaacttgaagctaaactggacaaaccagacgtggtgaattggatgtgctatagaaagaccgaggacttcttcaccatctggcttgacttgaatatgtttctgccgctcggggttgactgctggatcgacaacacccgagtggtctacaatagatcatccgggctggtttcaaacgccccgggagtgcagattcgggtcccgggatttggaaagacttactcggtggaatacctggactcgtcgaagctggcgggatacctgcacactctggtgcagaatctggttaacaacgggtatgtgcgagatgaaaccgtcagagctgcaccctacgactggcggctggagccgggccagcaagaggagtactaccggaagttggcaggcctggtcgaagaaatgcacgccgcctatggaaagccggtgttcctcattggacattcccttggatgcttgcatcttttgtacttcctgctgaggcagccacaagcatggaaggatagattcattgacggatttatctctctgggagcgccatggggcggctcgatcaagccaatgctcgtcttggcgtcgggcgacaaccagggtatccctatcatgagctccatcaagctcaaggaagaacagcgcataaccacgacctccccttggatgttcccatccagaatggcgtggccggaagatcacgtgtttatctccacgccgtcgttcaattacactggacgcgacttccagaggttcttcgcggacctgcacttcgaagaagggtggtacatgtggttgcaatcacgggacctgctcgccggactcccggcgcccggcgtggaagtctactgcctgtacggagtcggcctgccgacgcctcggacttatatctacgatcacggatttccgtacaccgaccctgttggggtactctacgaggacggcgatgatactgtggccacgcgcagcaccgagctttgcggcctctggcagggtcggcagccgcaaccagtccacctcctcccgttgcatggaatccaacaccttaacatggtcttttcaaatctcacccttgaacacatcaacgctatcctgttgggagcctacagacaaggtcccccggcgtcaccaacggcctccccggagccgccgccgcctgag

SEQ ID NO: 15420 - DNA, 1320 bp, Artificial Sequence
  Description of Artificial Sequence: Synthetic coding sequence
atgggtccgccgggttcgccgtggcaatgggtaacgttactattaggtctactattaccgccggcggcgccgttttggctattaaatgttttatttccgccgcatacgacgccgaaagcggaattatcgaatcatacgcgtccggtaatattagtaccgggttgtctaggtaatcaactagaagcgaaattagataaaccggatgtagttaattggatgtgttatcgtaaaacggaagatttttttacgatatggctagatttaaatatgtttttaccgttaggtgtagattgttggatagataatacgcgtgttgtttataatcgttcgtcgggtttagtatcgaatgcgccgggtgtacaaatacgagtaccgggttttggtaaaacgtattcggtagaatatctagattcgtcgaaattagcgggttatttacatacgttagtacaaaatttagtaaataatggttatgttcgtgatgaaacggttcgagcggcgccgtatgattggcgattagaaccgggtcaacaagaagaatattatcgtaaactagcgggtttagtagaagaaatgcatgcggcgtatggtaaaccggtatttttaataggtcattcgctaggttgtctacatttattatattttctactacgtcaaccgcaagcgtggaaagatcgttttatagatggttttatatcgctaggtgcgccgtggggtggttcgataaaaccgatgctagtactagcgtcgggtgataatcaaggtataccgataatgtcgtcgataaaactaaaagaagaacaacgtataacgacgacgtcgccgtggatgtttccgtcgcgtatggcgtggccggaagatcatgtttttatatcgacgccgtcgtttaattatacgggtcgtgattttcaacgattttttgcggatttacattttgaagaaggttggtatatgtggttacaatcgcgagatttactagcgggtctaccggcgccgggtgttgaagtatattgtttatatggtgttggtttaccgacgccgcgtacgtatatatatgatcatggttttccgtatacggatccggttggtgtactatatgaagatggtgatgatacggtagcgacgcgatcgacggaattatgtggtctatggcaaggtcgtcaaccgcaaccggtacatctattaccgctacatggtatacaacatctaaatatggtattttcgaatctaacgctagaacatataaatgcgatactattaggtgcgtatcgacaaggtccgccggcgtcgccgacggcgtcgccggaaccgccgccgccggaa

SEQ ID NO: 15421 - DNA, 1320 bp, Artificial Sequence
  Description of Artificial Sequence: Synthetic coding sequence
atgggcccaccgggctctccttggcagtgggtgacccttcttttgggtctgcttctccctcccgccgcaccattctggctgctgaatgtgctctttcctcctcacacgacccccaaggcggagctctccaaccatacgaggcccgtcattcttgttcctggatgtctgggaaaccagctcgaggcaaagctcgacaagccagatgtcgttaattggatgtgttaccgaaaaaccgaggacttctttactatatggctggatctgaacatgtttctcccccttggagtggactgctggattgataacacccgggtggtgtacaatcgtagctcgggacttgtgtcaaacgcgccgggggtgcagatccgcgtccctggttttggtaagacttactccgtggaatacctcgattcaagcaaacttgcggggtacctccacaccctcgtgcagaacttggtcaacaacggttacgtgagagacgaaacggtcagagccgcaccgtacgattggcgtctcgaacctggacagcaggaggagtattacagaaaactggccggtctggtcgaagaaatgcacgctgcttacggcaagccagtgttcctcattggccattcgcttggttgcctgcatcttctctactttttgcttaggcaaccacaagcatggaaggacaggtttatcgacggatttatctctctgggggcgccttggggaggatcaattaagcccatgttggtgcttgcaagcggcgataaccaaggcattccgattatgtcatcgatcaaacttaaggaagaacagaggattaccactacttccccgtggatgtttccttcccgtatggcgtggcccgaagatcatgtgttcatctccactcctagctttaactatacgggaagggattttcaacgctttttcgccgatctgcatttcgaagaaggttggtacatgtggctccaatcccgagatcttctcgccggactgcctgcacctggcgtcgaagtgtattgtttgtacggcgtcggactccccacccccagaacctacatctacgaccacgggttcccttacactgaccctgttggagtcctgtacgaagatggtgacgatactgtggccaccagatccacggaactgtgtgggctttggcaagggcgtcaaccccagccggtgcaccttctgcccttgcatgggattcaacatctgaacatggtgttcagcaatctgaccttggagcatatcaacgcaatactgctgggcgcataccggcaagggcctccagcatcaccaactgcatcaccagagcctccacccccggag

SEQ ID NO: 15422 - DNA, 1320 bp, Artificial Sequence
  Description of Artificial Sequence: Synthetic coding sequence
atgggtcctcctggtagcccttggcagtgggttacactattgttgggtttacttctccctcctgctgcacctttttggttactcaatgttctgtttccaccgcatacaactcctaaggctgagttgtctaatcatactaggcctgttattttggtacctggttgcttgggaaaccaattagaggccaaacttgataagccagacgtcgttaactggatgtgttatcgaaagaccgaggattttttcactatatggcttgatctgaatatgttcttgcctttgggtgttgattgctggatagataacacgagggtagtttacaatcgctcctctggtttggtctcgaacgctccgggagtacaaatccgagttcctggcttcggtaagacttattccgtggaatatttggattcctctaagctggcaggttatctgcatactttggtacaaaatcttgtgaacaatggatacgtgcgggatgaaactgtcagagcggcaccttatgattggcgtttggagcctggtcaacaagaggagtattataggaagctggcaggattggttgaggaaatgcatgctgcttatggtaagccagttttccttattggacattcacttggatgccttcaccttctatatttcttacttcgtcaaccacaggcttggaaggatcggttcattgacggatttatttcacttggtgcgccatggggaggaagcattaagcctatgttagttctggctagtggagataatcaaggaatacccatcatgagctctatcaagctaaaggaagagcaaagaatcacgaccacctccccctggatgttcccaagccggatggcctggcctgaggaccatgtgtttatctctactcccagtttcaactataccggacgtgactttcaacgattcttcgctgacttgcactttgaagaagggtggtacatgtggttgcaaagtcgtgatttgcttgctgggctacccgccccaggtgtcgaggtgtactgtctttatggtgtcggattacccacccctcgtacttatatttacgatcatggtttcccatataccgatccggtgggagtgctttacgaggacggagatgatactgttgcgacacgctcgacagagctttgcggcctgtggcaggggcgacagccgcaacctgtacacttgctcccactccatgggatccagcacctcaatatggtgttctcgaatcttacactagaacatattaatgctatattattgggagcatacaggcaaggccctccagcttcgcctactgcgtctccggaaccccctcccccagag

SEQ ID NO: 15423 - DNA, 1320 bp, Artificial Sequence
  Description of Artificial Sequence: Synthetic coding sequence
atgggccccccgggaagcccttggcagtgggtgacgctcttgctcgggctcctgctgccgccagcggcgccgttctggctgcttaatgtgctgtttccgcctcatactaccccaaaggcggaactgtcaaaccatactcgcccagtcatcctggtgccgggatgcctgggcaatcagctggaagccaagctggataagcctgacgtcgtgaactggatgtgctacagaaagaccgaggacttctttactatttggctggacctcaacatgttcctgccgctgggagtggactgttggatcgacaatactcgagtggtctacaatcgctcgtcggggctggtgagcaacgctccgggcgttcaaattcgggtgccgggcttcggaaagacctattccgtggagtacctggattccagcaaacttgccgggtacctgcacaccctggtgcagaacttggtgaacaacggttacgtcagagacgagactgtgcgggccgctccgtacgattggcggctcgaaccggggcaacaggaggaatactaccgcaagctcgcaggactcgtggaggaaatgcacgccgcttacggaaagccagttttcctgatcggccacagcctcggatgcctgcacttgctgtacttcctcctgagacaaccgcaggcctggaaagacagattcatcgacggtttcatctctctcggagcaccctggggagggtcaatcaaacctatgctggtgctcgcatcaggagacaaccaaggtatcccgataatgtcgtccatcaagctgaaagaggagcaacgcatcaccaccacctcgccctggatgttccctagccgtatggcctggcctgaagatcacgtgtttatctcgactcccagttttaactacaccggacgggacttccaaaggttcttcgcagatcttcatttcgaagaaggatggtacatgtggttgcagtcacgcgatctccttgcgggattgccagccccgggagtagaagtctactgtctctatggagtcggcctccctacgccacggacctacatctacgaccacggattcccatacactgacccggtgggagtcctgtacgaagatggtgacgataccgtcgcaacgcggtccaccgagctctgcggcctgtggcagggaaggcagccgcagcctgtgcacctgttgccgcttcacggcatccagcatctgaacatggtgttttccaatctgactctcgaacatatcaatgccattctgcttggcgcctaccgccagggtccaccagcgtcgccgactgcttcccccgaaccgccacccccagag

SEQ ID NO: 15424 - DNA, 1320 bp, Artificial Sequence
  Description of Artificial Sequence: Synthetic coding sequence
atgggaccacctggttcgccctggcaatgggtcaccctcttgctcggactgctgctgccgccagcagcgcctttttggctcttgaatgtgctctttccaccacataccacgcctaaggccgaactgtcgaaccacacccggcctgtgatcctggtgcctggctgtcttggtaatcaattggaagcaaaacttgacaagccagacgtggtgaactggatgtgttaccgcaagactgaggacttcttcaccatatggctggatctgaacatgttcctgccacttggtgtggattgttggattgacaacacccgcgtcgtgtacaaccggtcatccggactggtgtcgaatgctcctggggtgcaaatccgagtcccgggatttggaaagacctattccgtggaatacctggacagctcgaagctcgcggggtacctgcacacgttggtccagaacctcgtgaataatgggtacgtgagggatgaaacggtgcgggcggccccatacgattggagactggagccgggacaacaggaagagtactacagaaagctcgcgggactggtggaagagatgcacgccgcttacggtaaacccgtatttctgattggtcattcacttggatgtctgcatctgctgtattttctcctgcgccaaccccaggcgtggaaagatcgctttatcgatggtttcatcagccttggagccccatggggagggtccattaaaccaatgttggtgcttgcaagcggagataaccagggtataccaattatgtcgagcatcaagctcaaggaggagcaacggattacgactactagcccatggatgtttccttctcgaatggcctggccagaagatcatgttttcatttctactcctagcttcaactacactggtagagacttccaaaggtttttcgcggatcttcattttgaagaaggatggtacatgtggctgcagtcgagagatcttcttgccgggctccccgctcctggtgtagaggtgtattgcctctacggcgttgggctcccaacccctaggacttacatctacgaccacggatttccatacactgaccccgtcggcgtgctctatgaggacggagatgatactgtcgcaaccagatcgactgagctgtgcggcctttggcaaggtcgtcaaccacagcccgtgcatcttctgcccctgcatggtattcaacatttgaacatggtattttccaatctcactcttgaacacattaatgcaatccttctgggcgcttaccggcagggcccaccagcatcccctaccgcatctcccgaacccccaccgcctgaa

SEQ ID NO: 15425 - DNA, 1320 bp, Artificial Sequence
  Description of Artificial Sequence: Synthetic coding sequence
atgggaccccctgggtcaccatggcagtgggtgactcttcttctcggactactcctgccacccgccgcccctttctggctactcaatgtcctcttccccccccacacaacacctaaggcagaactctcaaaccacacacggcccgttatcttagtgcccggatgtctcgggaatcagctggaggctaaactcgataaacctgatgtagtgaattggatgtgttacaggaaaacagaggacttctttacaatatggctcgatctgaacatgttcctcccactgggggtggactgctggatagataatacacgggtcgtgtacaaccggtcttcagggctagtttcaaacgccccaggagttcaaatacgggtcccagggttcggaaagacttactccgtagagtatttagattcctctaaactcgctgggtatctccatacactcgtccagaacctagtcaataatggatatgtacgggacgaaacagtccgggcagcaccatacgattggcggctggaacccggacagcaagaggagtattatcggaaactcgctggactagtggaagaaatgcacgcagcctatggaaaacccgtgtttctgatagggcactctcttggatgtcttcacctgctatattttctactccgtcagcctcaggcttggaaagacagattcattgacggatttatttccctgggagccccttggggaggaagtataaaaccaatgttggtgctcgcaagtggagataaccagggaattccaataatgtcttccataaaactcaaagaagaacagcggatcactacaacatctccttggatgttcccctctaggatggcctggcccgaagatcatgtattcatctctactccctctttcaactatactggacgggattttcagaggttcttcgccgatctgcattttgaagaagggtggtatatgtggctgcagagtcgggacctactcgctggactcccagcacccggagtggaagtctactgtttatatggagttggactcccaacacctaggacttatatctacgatcatggattcccttatacagatcctgtgggagtgctgtatgaagatggggatgatacagtcgctacaaggagtactgaactatgcgggttgtggcagggaagacagccccagcccgtacacttattaccacttcatgggatccagcacctgaatatggtgttctcaaaccttactttggagcacattaacgccatcttactcggagcctatcgccaggggccccccgcctcccccactgcctccccagaacccccaccacctgaa

SEQ ID NO: 15426 - DNA, 1320 bp, Artificial Sequence
  Description of Artificial Sequence: Synthetic coding sequence
atgggaccgccagggagcccctggcagtgggtcacgcttctgctgggattattgctcccccctgcagcccccttctggttattgaatgtcctgttccctcctcacacaactcccaaagccgagctctctaatcacactcgtcccgtcatactggttcccggttgtctagggaaccagctggaggcaaagttggataagcccgacgtagtgaactggatgtgctaccggaaaactgaagatttcttcaccatatggctcgacttgaacatgtttttgcccttgggtgtggactgctggatcgataacacccgcgtagtgtacaatcgcagttcgggtctggtgtctaacgctccgggagtgcagatcagagtgcctggcttcggaaaaacctatagcgtggaatacctggactccagtaaactggcaggttatctccacaccctggtccagaacttggtgaataatggctacgttcgggacgagacggtgcgggcagcgccctatgactggcgattagaaccgggccagcaagaagaatattaccgtaagctcgccggcctagtggaagagatgcatgccgcctatggaaaacctgtctttctgatcggacattcactcggctgcctgcatctattgtacttcctgctgagacagccacaggcctggaaagaccggtttatagacgggttcatatccctcggcgccccatggggggggtccataaagcccatgctggtgttagcttcgggtgataatcaggggatacctattatgtccagcatcaaacttaaggaagaacagcggattaccactacctctccatggatgtttcctagcaggatggcgtggcctgaggaccatgtcttcatctcgaccccctcttttaactatacagggagggattttcagagattttttgcagaccttcactttgaggagggctggtacatgtggcttcagtcgcgcgatttactcgccgggcttccagccccaggagtggaagtgtactgtctttatggggttgggctgcccacccctcgtacttacatttacgaccacggctttccctatacagaccccgtgggggtcctttacgaggacggcgatgacactgtggccacccgttccactgagttgtgcgggctgtggcagggaagacagccccaaccagtccacctgctgcccctccatggcattcaacacttaaatatggtgttcagcaatctgacccttgaacacattaatgccatcttattgggtgcttaccggcaagggccccccgcatccccgacagcctccccggaacccccccctccagag

SEQ ID NO: 15427 - DNA, 1320 bp, Artificial Sequence
  Description of Artificial Sequence: Synthetic coding sequence
atgggtcctcccggctccccctggcaatgggttaccctgctgcttggacttctcctccctccggcagcaccgttttggcttttgaacgtgttgttcccaccacacactacccctaaggcagagctgagtaatcacactcgtcctgttattctggtgccaggttgtctgggtaaccagctggaagccaagctggataagccagatgtagtgaattggatgtgttacagaaaaaccgaggacttcttcacgatttggctggatctgaacatgtttctgccactgggagtggactgttggattgacaatacccgagtggtgtataacagatcgtccgggctggtgagcaacgctcctggtgtgcagattagggtgccaggttttggtaagacctactcagtggagtacctggattcgtcgaaactggccggctacctgcatacccttgtgcaaaaccttgtcaataatggatacgtgcgggacgaaactgtcagagccgcgccatacgattggcgcttggaacctggtcaacaagaggaatactacagaaaactcgcgggactggtcgaagaaatgcatgcagcgtacggcaagcctgttttcctgataggtcattctctgggatgccttcatctgttgtatttcttgcttcgtcaaccccaggcctggaaagataggttcattgacggttttatctcactcggtgccccatggggaggatctatcaagcccatgctcgtcctggcaagcggtgacaaccaagggatcccgattatgagctcgatcaaacttaaggaggagcaaagaatcaccacgacttccccctggatgtttccttcgagaatggcctggcctgaagatcacgtgtttatcagcacccctagctttaactacactggaagagattttcaacggtttttcgccgatctgcattttgaggagggatggtacatgtggcttcagagccgcgatctcctggcagggctccccgccccaggggtggaagtctattgcctgtacggagtcggcctccctactccacggacttacatctacgaccacgggtttccatacacggatcccgtgggtgtcctttacgaggatggcgatgatactgtagccacccgcagcaccgaactctgtggcctttggcagggccgacaaccccagcccgtccaccttcttcccctccacggaatccagcatttgaatatggtcttttcgaacttgaccctggaacacattaatgcaatcctgcttggtgcctacagacaaggacccccagcatccccgactgcatcacctgaaccaccaccacccgag

SEQ ID NO: 15428 - DNA, 1320 bp, Artificial Sequence
  Description of Artificial Sequence: Synthetic coding sequence
atgggcccacccggatcgccgtggcagtgggtgaccttgctcctcggcctgttgctcccaccggccgccccattctggttgctcaatgtcctgttcccaccgcacaccaccccgaaagctgagctgtcgaaccatacccgcccagtgatccttgtgccgggatgcctcggaaaccaactggaagcgaagctggacaagccggatgtcgtgaactggatgtgctaccgcaagactgaggatttctttaccatctggctcgacctcaatatgtttctgccactcggagtggactgttggatcgacaataccagagtggtctacaatcgcagctcaggactcgtctccaacgcacctggagtgcaaatcagggtgcctggattcggaaagacttattccgtcgaatacttggacagcagcaagctggccgggtacctccataccctcgtgcagaacttggtgaacaacggatacgtgcgcgacgagactgtcagagccgctccctatgattggcgcctcgaaccgggacagcaagaagaatactaccggaagctggcaggactggtggaggaaatgcacgcggcctacggcaagccggtgttccttatcggtcactccctcggctgcctccaccttctgtacttcctcctccgccagccacaagcatggaaggatcgctttattgacggcttcatttcgcttggagcgccatggggtggctcgatcaaaccgatgttggtcctcgcctccggcgacaaccagggtatcccaatcatgtcgagcattaaactgaaggaggagcaacggatcactaccacttcgccatggatgttcccatcgcgtatggcgtggccagaagatcacgtctttatcagcactccatcgttcaattacactggcagagatttccaaagattcttcgcagatctgcattttgaagaaggatggtatatgtggttgcaatcgagggatctcctggccggactgccagcgccaggcgtggaggtctactgtttgtacggcgtgggactgccgacgccgcggacgtacatctacgatcacggatttccctacaccgaccccgtgggtgtgctctacgaagatggcgatgatactgtcgccactagatccactgaactttgcggtctgtggcaggggagacagccgcagccggtgcatctgttgccgctgcacggaatccagcacctcaacatggtgttttccaatctgactctggagcacatcaatgctatcttgctgggagcctacaggcagggaccgccggcttccccaactgcctcgccggagccgcctcccccggaa

SEQ ID NO: 15429 - DNA, 1320 bp, Artificial Sequence
  Description of Artificial Sequence: Synthetic coding sequence
atgggccctccgggaagcccctggcaatgggtcactctgcttctggggctgctgcttcctcctgcagcacctttttggctccttaacgtgttgttccctcctcacactacccctaaggcagagttgtccaaccatactcgccctgtgatccttgtgcctggctgtcttgggaatcaacttgaagcaaagttggacaagccggacgtggtgaactggatgtgttaccgtaaaactgaggacttctttactatttggctggatctcaacatgtttcttccgcttggagtcgattgctggatagacaacactagggtggtctacaaccgatcgtcaggacttgtcagcaatgcacctggtgtgcaaatcagggtgcccggattcggtaagacgtacagcgtggagtacctggattcatccaaactggcaggatacctgcacaccctggtgcaaaatctcgtcaataacgggtacgttagagatgaaacggttcgcgccgcaccctacgattggcgcctggaacctggtcaacaggaagaatactacagaaagctcgccggcctggtggaggaaatgcatgcagcgtacggtaagccggtgtttcttattggacactcactcggatgtctccatctcctgtattttctgttgaggcaaccgcaggcgtggaaggaccggtttatcgatgggtttatctcgctgggggcaccgtggggcggttcgattaagccgatgctggtgcttgcttctggtgataatcagggtattcctattatgagctccattaagctgaaagaagagcaacgtattaccaccacctccccgtggatgttccctagccgcatggcttggcctgaagatcatgtgttcatatcgactccgtccttcaattacaccggtagagacttccagcggttctttgcggatcttcattttgaagaaggttggtacatgtggctccaaagccgcgacctgctggcagggcttcctgcaccaggtgtcgaggtctactgtctgtacggggtcggcctgccaacgccacgcacctacatatatgaccacggattcccttacaccgatcccgtgggggtgctctacgaggacggtgatgataccgtagccactagaagcactgaactttgcgggttgtggcagggtcggcagccacaacctgtccaccttttgccgcttcatggaatccagcacctcaatatggtctttagcaaccttactcttgagcatatcaacgcaattctgctgggagcataccggcagggaccccctgcatctccaactgcatcccccgaaccaccgcctcctgag

SEQ ID NO: 15430 - DNA, 1320 bp, Artificial Sequence
  Description of Artificial Sequence: Synthetic coding sequence
atgggaccgcccggatccccgtggcaatgggtgacgttactgctgggtctgttgttaccgccagccgctcccttctggttgttgaatgttctgtttccgccccataccacgcctaaggccgagctatctaaccacacccgtcctgtgatcctcgtccccggctgcttgggcaaccagctcgaggcgaagctcgataagcccgacgtcgtcaactggatgtgctaccgcaagacggaggacttcttcaccatctggctcgatcttaacatgttcctcccactcggtgttgattgttggattgacaacacgcgtgtagtgtacaaccgctcctcgggcctcgtttctaacgcccccggcgtacagatcagggtccccggatttggtaagacttattctgtcgagtatctcgattcatccaagcttgcgggatacctgcataccttagtccaaaatctggtcaataacggctacgtgcgggacgagaccgtccgtgccgccccctacgactggaggttagagcccggtcagcaagaggaatactaccgtaaacttgccggcttggtcgaggagatgcatgccgcctacgggaagccggtcttcctgattgggcattccctgggttgcctacacctgctgtacttcctactacgccagcctcaggcatggaaggaccgcttcatcgacggcttcatttcgctgggcgctccctggggcggctcgatcaagcccatgctagtcctggcaagcggagacaaccagggcatcccaatcatgagctctatcaaattgaaggaggagcagcggatcaccaccaccagcccctggatgttcccgtccaggatggcatggcctgaggaccatgtctttatctcgacaccgtccttcaattacaccggtagagactttcagaggttcttcgctgacctccacttcgaagaggggtggtacatgtggctccagtcgcgtgatctcctggcgggcctgcccgcgcccggagtggaggtttactgcctttatggcgtaggcctaccgaccccccgtacctacatttacgaccatggtttcccttataccgaccctgtcggtgtcctttacgaggacggcgacgatacggtcgcgacccggtctacggaactgtgtggcctgtggcagggacggcagcctcagcctgttcaccttctgcccctacatggcatccagcacttgaacatggtcttctccaacctgactcttgagcacatcaatgcaatcttgttgggcgcctaccgccagggccctcccgcgtcgcccactgcctccccggaaccgcctccacctgag

SEQ ID NO: 15431 - DNA, 1320 bp, Artificial Sequence
  Description of Artificial Sequence: Synthetic coding sequence
atggggccacctggaagcccctggcaatgggtcacattgctcctcggtttgctactcccacccgccgccccattttggctgctcaacgttctgttccctccacacaccactcccaaagctgaactgagcaatcacacccgccctgtcattttagtgccaggctgtcttggaaaccagttagaggcaaagctagacaaacctgacgtcgtcaattggatgtgttaccgtaagaccgaggacttttttactatctggctcgatctaaacatgttcctacccctgggggtagattgttggattgacaacaccagggtagtgtataaccgctccagtggtctagtctctaatgccccaggagtccagatacgggtcccgggctttggaaaaacctattccgtggagtatctggacagttctaaactcgcgggttacctgcatactcttgtccagaatctcgtgaataacgggtacgtgcgtgacgagaccgtgcgagccgccccctacgattggcgcctggagccaggacagcaggaagagtactaccgcaagctcgcaggtctggtcgaggagatgcatgctgcatatggcaaacccgtttttctcattgggcacagtttagggtgccttcacctcctatattttttgctgcgccaacctcaggcgtggaaggacagattcatcgatggtttcatctccctcggagccccgtggggcggcagtatcaagcccatgctggtacttgcctcaggggacaaccagggtattccaattatgtctagtattaagctgaaggaggagcagcgcataactaccacctctccttggatgtttccctcccgtatggcctggccggaggatcacgtgttcatcagtacgccatcattcaattacacgggccgggatttccagagattcttcgctgatttgcacttcgaggagggctggtatatgtggctgcagagcagggatctgctagctgggttgcccgcgcctggcgtcgaagtttactgcctgtacggggtgggactcccgacgcccagaacatacatctatgatcacgggttcccctacaccgatcctgtcggcgtgctctatgaagacggagatgacactgtagcaactaggtcaactgagctgtgcggtttgtggcaaggtcgccagccccaacctgttcatctgcttcctctacatggaatacaacatttaaacatggttttttccaatctgacccttgagcacattaatgctattttactgggggcctacagacagggaccgccagcatctccaacagcgtcacccgagccccccccgcctgag

SEQ ID NO: 15432 - DNA, 1320 bp, Artificial Sequence
  Description of Artificial Sequence: Synthetic coding sequence
atgggccctcccggatctccctggcagtgggtcactctgctcctcggtctgttgctgcccccggctgctcctttctggcttcttaatgtactgtttccccctcataccacaccaaaggccgagctcagtaaccatactcggcccgtgatcctggtccctggatgtctgggcaatcagcttgaagccaagcttgacaagccagatgttgtcaattggatgtgctaccgaaaaacagaggacttcttcacaatatggctggatctgaatatgttccttcctctaggggtagattgctggatagacaataccagagtggtgtacaacagatctagcggcctcgtgtctaatgctcccggcgttcagataagggtgccagggttcgggaagacgtactcagttgaatacctggatagttctaagctcgccggatacctgcacaccctggtccagaatctggtaaacaacggatacgtcagggacgagaccgtgcgggcggcaccttacgattggagactcgaaccagggcaacaagaagaatactatagaaagctggcgggcctggtggaggaaatgcacgctgcctatggcaaacctgtttttcttattggacactcactgggctgcctgcatctattgtatttcttgttgaggcaaccccaggcgtggaaggatagattcatcgacggctttattagcttaggcgcaccctgggggggttcaattaagcctatgctcgtcctcgcctccggcgataatcagggaatcccaatcatgtcatctattaaactgaaggaggagcaacggattaccaccaccagtccctggatgtttccaagccgcatggcatggccagaggaccacgtatttatttctacaccttcattcaactacactgggcgcgactttcagaggttcttcgcggatctgcattttgaggaagggtggtacatgtggctgcagtcgagggacctcctggccgggcttcccgctccgggagtcgaagtgtattgtctgtacggtgtcggcctgccaaccccacgcacatatatctacgaccacggatttccatacacggacccagtaggtgtcctatacgaggatggtgatgacacagtggccacaaggtcaaccgaattatgtggcctgtggcaggggcgccaaccgcaaccagtccaccttctgcctctgcacggaatacagcatctaaacatggtgtttagcaacctgactctcgagcacattaacgccatactcctaggagcctaccgccagggcccacccgccagccccaccgctagccctgagccgccccctcccgaa

SEQ ID NO: 15433 - DNA, 1320 bp, Artificial Sequence
  Description of Artificial Sequence: Synthetic coding sequence
atgggccctccaggcagtccatggcagtgggtgacactgctgctgggcctcctcttgccacctgccgccccattttggctgctaaatgtgctgtttcccccccacactacacccaaggctgaactgtccaatcacacgcgcccagtgatcctggtgccggggtgcctcggcaatcagctggaggcaaagttagacaaacctgatgtcgtcaattggatgtgctaccgaaaaaccgaggacttttttacaatttggttggatttgaacatgttcctgcccttaggcgtggactgctggattgataacactagggtcgtttacaatagatctagcggactcgtgagcaatgccccaggggtgcagatccgtgtccctgggtttggcaagacttattccgtggagtatctcgactcaagcaaacttgcaggatatctgcacacattggtgcagaacttagttaacaacggttacgtgagagacgagactgtccgcgccgcgccttacgactggcggctggaacctggccagcaggaagaatattatagaaagctggccgggctcgtagaagagatgcacgctgcttacggcaagcccgtcttcctgattggccattctctcggctgcttgcacctgctgtactttcttctgcggcagccacaggcctggaaggacaggtttatcgacggattcatcagcttgggcgctccatggggagggagtattaaacctatgctcgtactcgcttcaggagacaaccagggaatccccataatgtcttctatcaagctgaaagaggagcaaaggattacaaccacctcgccatggatgttccctagccgaatggcctggcccgaagaccatgtgtttatctctaccccctcatttaactacacaggccgcgactttcagcgatttttcgcggatctgcattttgaagagggatggtatatgtggttgcagtctagagacttgctggccgggcttcctgcgcctggcgtcgaagtgtattgtctgtatggtgtcggtttgcctactccacgcacctatatatacgatcacggatttccgtatacagatcctgtgggtgtcctctatgaggatggagacgacacagtggctactagaagcacagagctgtgtggattatggcagggccgccaacctcagcctgtccacctgctgcccctgcatggcattcagcacctaaatatggtcttcagcaaccttactctcgaacacataaatgccatactgctgggtgcctaccgccaaggaccccctgctagccctacagcctcccccgaaccccccccgccggaa

SEQ ID NO: 15434 - DNA, 1320 bp, Artificial Sequence
  Description of Artificial Sequence: Synthetic coding sequence
atgggccctcccggctctccctggcagtgggtcacacttctacttgggctgctgcttcccccagccgcacccttctggctgctcaacgtactctttcccccgcataccacccccaaagccgaactctctaatcatacccggcccgttatcctggtgcccggctgcttaggaaaccagctggaggccaagctggataaaccagacgttgtaaattggatgtgctacagaaagacagaggatttctttacaatttggctagacttgaacatgtttttgcccctcggcgttgactgctggatagacaacacgagagtcgtgtataaccgtagttcgggattggtgagtaacgccccaggggtgcagattagagtgcccggatttgggaaaacgtattcggtcgagtatcttgacagcagcaaactcgcgggctatttgcacactctggtacagaacctcgtaaacaacggatatgttagggacgaaaccgtgcgggcggctccgtatgattggcggctcgagcctgggcaacaggaagaatactacaggaagcttgccggcttagtggaggagatgcacgcagcctacgggaaacccgttttcttaataggtcattctctgggttgcctccacctgctgtacttcctcctgcggcagccacaggcgtggaaggaccggtttattgatggatttatctccctgggagctccttggggaggatcgatcaagccgatgctcgtactggcttcaggagacaatcaaggcattcctataatgagtagtattaaattgaaggaggagcagcgaataacaaccaccagtccgtggatgttccctagtaggatggcatggcccgaagaccacgtcttcattagtactccgagcttcaattacacagggcgggacttccagcggttcttcgctgatcttcattttgaagaggggtggtatatgtggctccagtcccgcgaccttctagcgggcctgcccgccccaggtgtcgaggtgtattgtttatacggggttggcctcccaactcctcgtacgtacatttatgaccacggatttccctataccgatcctgtgggggtcctctacgaagatggggatgacactgtggccacacgatccaccgagctgtgtgggttgtggcagggccgacagccacaaccggtgcatctgctgcctctgcacggaatacagcatctgaatatggtgttttctaacctgaccctggaacatattaacgcgatcctgctcggggcataccgccagggcccccctgccagccctacagcttcaccagagccaccccctcccgag

SEQ ID NO: 15435 - DNA, 750 bp, Artificial Sequence
  Description of Artificial Sequence: Synthetic coding sequence
atggcagataactttagcctccatgatgcactgagcgggtcaggtaaccccaacccccaaggatggccgggtgcttggggcaaccagcccgcaggcgccggcggttaccctggagcatcgtacccaggcgcatatcctggtcaggcaccgcctggggcataccctgggcaagcacctccaggagcctaccctggcgctcctggtgcatacccaggtgcgcctgcaccgggtgtctaccccgggccgccatcggggcctggcgcatacccctcgtcaggccaaccatccgcaacgggagcctaccccgccacgggaccatacggcgcaccggcaggcccactcatagtgccttataacttgcctctccccgggggcgtggtgccacgcatgctcattaccattcttggaaccgtcaaacctaatgcaaaccgtatagcgcttgatttccagagaggaaatgacgtcgcgttccatttcaatcccagatttaacgaaaacaacagacgcgtgatcgtgtgtaatactaagctggataacaattggggccgggaggaacggcagtcggtgtttccttttgaatcgggaaagccgttcaagatacaagtgcttgtggagcccgatcatttcaaggttgcggtcaacgatgcacaccttcttcaatacaaccatcgagtgaaaaaactgaacgaaatttccaaacttggtattagcggcgatatcgacctgactagcgcatcatatacgatgatt

SEQ ID NO: 15436 - DNA, 750 bp, Artificial Sequence
  Description of Artificial Sequence: Synthetic coding sequence
atggccgataacttttccttgcacgacgcactgagcggatctggcaatcccaatcctcaaggttggcctggcgcgtggggaaaccaacccgctggtgctgggggctacccaggggccagttatccaggtgcgtacccaggccaagccccgcctggggcctatcccggtcaggcaccaccaggcgcttatcccggagcccctggtgcatatcccggggccccagctccaggggtgtaccctgggcctccttccggccccggtgcctacccatcctcaggccagccgtccgccactggagcctatcccgccaccggaccctacggagctccagcgggaccactgattgtgccttacaatctccccctgccaggcggcgtggtgcctcggatgcttatcacgattctgggcaccgttaagcccaacgcaaaccggatcgctcttgatttccaacgggggaacgacgttgctttccactttaaccctagattcaatgaaaataaccgccgcgtcatcgtgtgtaatacgaagttggataacaactggggaagggaagaaaggcagagcgttttcccttttgagagcggtaaaccctttaagatccaggtgcttgtggagccagatcactttaaggtggccgtgaatgatgcacacctccttcaatataaccaccgggttaagaagctcaatgagatctcaaagctcggaatcagtggagacatagatctcacctccgccagctacaccatgatc

SEQ ID NO: 15437 - DNA, 750 bp, Artificial Sequence
  Description of Artificial Sequence: Synthetic coding sequence
atggcagacaacttctctcttcatgacgccctctcaggatcgggcaaccctaacccgcagggatggccaggcgcatggggaaatcaaccggctggagcaggtggttaccctggtgcctcctaccccggggcgtacccaggacaggcccctccaggcgcatacccaggtcaggcgcctcctggcgcgtatccgggagcccccggcgcttacccgggggccccggctcctggagtgtaccctggtccgccctcgggacccggagcctacccatcatcagggcaaccatccgcgacgggggcataccccgcgaccggcccgtacggagccccggccggaccgctcatcgtcccgtataatctgccattgccaggaggtgtcgtcccgcgcatgttgatcaccattttgggtactgttaaaccaaacgccaaccgaatcgccctggactttcagcgcggcaacgatgtggcgttccacttcaatccacgcttcaacgaaaataaccggcgggtcattgtgtgcaacactaagctggacaataactggggacgggaggaaagacaatcggtcttcccattcgagtcgggtaaaccgtttaagatacaggtgctggtggagcctgaccactttaaggtggccgtgaatgatgctcatcttctgcaatacaatcaccgcgtgaagaagctcaacgaaatatccaagctcggaatctcgggagacatcgatctcaccagcgcaagctatactatgatc

SEQ ID NO: 15438 - DNA, 750 bp, Artificial Sequence
  Description of Artificial Sequence: Synthetic coding sequence
atggctgataacttctctctccacgacgctttgtcaggctcaggaaaccccaacccacagggttggcccggagcctggggcaaccagcccgccggcgctggaggctaccccggcgccagctatccaggtgcttaccctggtcaggcccctcctggagcctaccctggacaagccccacccggcgcttaccctggtgctcctggagcttacccaggagctcctgccccaggcgtctaccccggccctccctctggccctggagcttatccttctagcggacaaccttccgccaccggtgcctaccctgctaccggtccctacggcgctcccgcaggtcccttgatcgtcccatacaatctccctttgcctggcggcgtggtaccccgcatgctcatcacaatactgggcacagtgaaaccaaatgcaaaccgcatcgccctggattttcaaagaggtaatgatgttgccttccattttaaccctagattcaatgaaaataatcgccgcgttattgtttgcaatactaaactcgataataattggggcagagaggagcgccaaagcgttttcccattcgaatctggcaagccattcaagattcaggttctggtcgagcccgaccacttcaaagttgcagtaaatgatgctcatctcttgcagtataatcaccgcgttaaaaagctcaacgagatctccaaactgggcatctctggcgacatcgaccttacttccgcctcctatactatgatc

SEQ ID NO: 15439 - DNA, 750 bp, Artificial Sequence
  Description of Artificial Sequence: Synthetic coding sequence
atggctgataacttttccctccacgatgcgctgtccggttcggggaacccgaacccccaagggtggccaggagcgtggggtaatcaaccggccggagcaggcggatacccgggagcgagctacccgggtgcctatcccggccaggcacccccgggtgcttaccccgggcaggcccctccaggtgcgtacccgggcgccccaggagcctacccaggagccccggccccgggggtgtacccaggcccgccctcgggccctggagcgtacccgtcctcaggccagccatccgcgactggagcctaccctgccaccgggccttacggagcaccagccgggccgctgatcgtcccgtacaacctgcctctgcccggcggcgtcgtgccaaggatgctgatcacgatcctcggcaccgtcaaacctaacgctaaccgcatcgcgctggacttccagcgcggaaatgatgtcgccttccatttcaatcctaggttcaacgaaaacaaccgcagggtgatcgtgtgcaacactaagctggacaataactggggaagggaggaaaggcaatcagtctttcctttcgaatccggcaagccgtttaagattcaggtgctggtggagccggatcactttaaggtggcagtgaatgacgcccatctgctgcaatacaatcacagagtgaagaaactgaacgagatttcaaaactgggaattagcggggacattgatttgacctcggcctcgtacactatgatc

SEQ ID NO: 15440 - DNA, 750 bp, Artificial Sequence
  Description of Artificial Sequence: Synthetic coding sequence
atggctgacaatttctcgctgcatgacgcactttcgggatccggcaacccaaaccctcaaggatggccaggagcttgggggaaccagcccgcaggagctggaggttacccgggtgcatcctatccgggggcttaccctggtcaagcaccacccggagcataccctggacaggcacctcctggtgcatatccaggggcaccaggagcataccccggagcgccagcgcccggcgtgtacccgggtcctccttcgggtcctggagcatatccgtcctccggacagccatcggcgaccggggcataccctgcgaccggcccatacggagcaccagcgggtccattgatcgtcccatacaacctccctctcccggggggtgtcgtcccacgcatgctgataaccatacttgggactgtgaagccaaacgcgaatcgcatcgcgctggactttcagcgaggaaacgatgtcgcgtttcactttaatccaaggtttaacgagaataacagaagagtcatcgtctgtaacaccaagctggacaacaactggggtagagaagaacgccaatccgtttttccattcgagtcaggaaagcctttcaaaattcaagtgctcgtggaaccagatcactttaaagtcgcagtgaacgatgcgcatcttcttcagtacaatcaccgtgtgaaaaaacttaacgagataagcaagctgggcattagcggggacattgatcttaccagcgcctcttacactatgatt

SEQ ID NO: 15441 - DNA, 750 bp, Artificial Sequence
  Description of Artificial Sequence: Synthetic coding sequence
atggccgacaatttctcccttcatgatgctctctctggctccggcaatccaaaccctcaaggatggcccggagcatggggtaatcaaccagcaggagctggtggttaccctggtgcttcttaccccggagcttatcccggtcaagcacctcccggcgcttatcctggtcaagccccacctggggcttaccctggtgcccctggagcttatcccggtgccccagcccctggagtgtatccaggtccaccgtccggaccaggagcttatccgtcgtctggccagccctcagctaccggagcttatccagcaaccgggccttatggagcacctgctggtccgcttatagttccatataatctcccattacctggtggtgtggtacctcgtatgctaattactatattgggcaccgtcaagcctaacgccaataggatcgctttggactttcaaaggggtaatgatgttgcttttcatttcaatcccaggtttaatgaaaataacaggcgagtgatcgtttgcaacactaagttggataacaattggggacgggaagagcgccagtcggtttttccattcgaatctggtaaaccattcaaaattcaagtccttgttgaaccggatcattttaaagttgcagttaatgatgcccacttactccagtacaatcatagggtcaaaaagctgaatgagatctctaagctcggaatatcaggagatatcgatttaacttccgcatcgtataccatgata

SEQ ID NO: 15442 - DNA, 750 bp, Artificial Sequence
  Description of Artificial Sequence: Synthetic coding sequence
atggcagacaatttctcactgcatgacgctttgtccggctcggggaacccaaacccgcagggatggccaggagcttggggcaaccaaccggcaggagcgggagggtaccctggtgcttcgtaccccggagcctacccgggacaggccccgccgggcgcttacccaggccaggccccaccgggggcatacccgggagccccgggagcataccccggagcacccgcccccggggtgtatccgggaccaccatccggaccaggagcgtacccctcgtctggacaaccgtcagcgaccggcgcgtaccccgccaccgggccatacggagctccggccggaccactcatcgtcccttacaacctgccgctccccggtggagtggtgccgcgcatgcttatcactatcctggggactgtgaagcccaacgccaacaggatcgcgctggattttcagcggggcaacgacgtcgcgttccatttcaatccacgcttcaatgaaaacaatcgcagggtgatcgtgtgcaacactaagctggataacaattggggaagggaagaacgccaatctgtgtttcctttcgagtcaggaaaacctttcaaaattcaagtcctcgtggagccggaccatttcaaggtggcggtgaatgacgcgcacctgctgcagtacaaccaccgtgtgaagaagctgaacgagatctccaaacttggaatctcgggtgacatcgacctgacctccgcgtcgtatactatgatt

SEQ ID NO: 15443 - DNA, 750 bp, Artificial Sequence
  Description of Artificial Sequence: Synthetic coding sequence
atggccgataacttctcgcttcacgacgccctgagcgggtcgggaaatccgaatcctcagggttggcctggggcctggggcaaccagcccgccggcgctggtgggtatcctggagcaagctacccaggcgcgtaccccggccaggcacctcctggggcatatccaggccaagcccctcctggcgcctatccaggcgcccccggagcctatccaggcgcccctgccccaggcgtgtaccccggtccccctagtgggccgggcgcatatcccagcagcggacagccaagtgctactggggcttatcccgccactgggccatacggcgctccggccggccctcttattgtaccgtacaacctcccactgcctggaggcgtggtgcccagaatgttgataaccatcttgggaaccgtgaagccgaacgccaaccggatcgcgctggactttcagagaggaaacgacgttgcgttccactttaacccacggttcaatgagaacaaccggcgtgtgatcgtctgcaacactaagttggataataactggggaagagaggagcggcagtctgtcttcccgttcgagtctggaaagccctttaaaatccaggttctcgttgaaccggatcactttaaagtggcggtcaatgacgcacacctcttacagtataatcatcgagtgaaaaagttgaacgagatcagtaaactagggatttctggcgatatcgacctgacctccgcttcttacaccatgatc

SEQ ID NO: 15444 - DNA, 750 bp, Artificial Sequence
  Description of Artificial Sequence: Synthetic coding sequence
atggcagacaatttctccctgcacgacgccctgtctggtagtggaaatcccaacccccaggggtggcccggggcttggggcaaccagccagcgggcgccgggggatatccaggggccagctatcctggggcataccccggtcaggcccctccgggcgcctaccctggtcaggctccacccggcgcatacccgggcgctcctggtgcataccccggcgcacctgcacctggagtctatccaggtccaccatcggggcctggcgcttaccctagctctggccagcctagcgcgacaggtgcgtaccccgctacgggaccctacggggcccccgcaggacccttaatcgtcccttataatcttccgctgccagggggcgtggtccctcggatgttgattaccattctgggcacggtgaagccaaacgccaaccgaattgccttggatttccagaggggtaacgacgttgccttccacttcaatccccgttttaatgaaaataatcgcagagttatcgtttgtaatacaaaattggataataactgggggagagaggagcggcagtccgtgtttccattcgagagtggtaagccgttcaagatacaggtgttggtggaacctgaccacttcaaggttgcagtgaacgacgcccaccttttgcagtacaaccatagggtgaaaaagctgaatgagatcagcaagctgggaataagcggcgatattgatctcacatctgcttcttatacgatgata

SEQ ID NO: 15445 - DNA, 750 bp, Artificial Sequence
  Description of Artificial Sequence: Synthetic coding sequence
atggccgacaatttcagcctccacgacgccctttccggatcaggcaaccctaacccacagggctggccgggtgcatggggaaaccaacctgccggggcaggaggttaccccggcgcatcatacccgggggcatatccgggacaagcgccacctggggcctaccccggccaagctccgcctggagcatacccgggcgcaccgggagcgtacccgggagcaccagcccctggagtctacccagggccgccctccggacctggagcgtatccatcttccggccagccgtcggccaccggagcttacccagccactggaccatacggagcaccagcaggcccgttgatcgtgccgtacaacctgcccctccccggaggagtggtgccacggatgctgatcaccattttgggcactgttaagcccaacgctaaccgcatcgcactcgacttccagcggggtaatgatgtggcattccacttcaatccaagattcaacgaaaacaaccgcagagtgatcgtgtgcaacactaaactcgataacaactgggggcgggaggagcgtcaaagcgtgtttccgttcgaaagcgggaagcctttcaagatccaggtgctggtggagccggatcactttaaggtcgccgtgaatgatgcacatctgttgcagtacaatcaccgggtgaagaagctcaacgaaatcagcaaactgggcatttcgggagacattgacctgacctcggcttcatacaccatgatc

SEQ ID NO: 15446 - DNA, 750 bp, Artificial Sequence
  Description of Artificial Sequence: Synthetic coding sequence
atggcagataacttctctcttcacgatgcattgtccggatctggtaacccgaatccgcagggctggccaggcgcttggggaaatcaacctgcaggcgctgggggctatcccggcgctagctatcctggagcatatcccggacaagcaccgccgggagcttatccgggacaggcgccgccgggagcatatccgggagcgcctggagcctatccgggcgcgccggcgcctggagtctatccaggcccgccttcgggtcctggcgcatacccttcctcgggccaaccttcagcgacgggagcatacccggcgacaggaccgtatggggctccggccggacctttgattgtgccttataacttaccgctccctggtggagttgtcccaagaatgcttataacaatccttggtacagtcaaaccgaacgctaatagaattgccctggattttcaacgagggaatgatgtggcattccattttaacccgagatttaacgaaaacaaccggcgcgtaatcgtatgtaatacaaagctggacaacaactggggccgcgaagagcgccagagcgtctttccgttcgaatcgggcaagccttttaagatccaggtccttgtagagccggaccactttaaagttgcggttaatgatgctcatctattacaatataatcacagagtgaaaaaactgaatgagatcagcaaacttgggatatcaggggatattgacctgacgagcgcatcatatacaatgatt

SEQ ID NO: 15447 - DNA, 750 bp, Artificial Sequence
  Description of Artificial Sequence: Synthetic coding sequence
atggccgataacttctcactgcatgacgccttatcgggatccggtaaccccaaccctcaggggtggccaggcgcctggggcaaccagccggccggagcaggaggttatcctggggcctcttatcccggggcttatccagggcaagctccacccggagcctacccagggcaagctccgcccggcgcgtacccaggggccccgggggcctacccaggggcaccagcgcccggcgtataccctggtccgccttcggggcctggcgcttatccttcttcagggcagccgtctgcaaccggcgcatatcccgcaactggcccgtacggcgcacctgccggccccttaattgttccctataacctcccactgcctgggggggttgttccccggatgctcatcaccatattggggaccgtaaagccaaacgcaaacagaatagccctggatttccagagaggtaatgatgtggcctttcactttaaccctaggtttaatgaaaacaaccgccgtgttattgtgtgtaataccaaattagacaacaattgggggagagaagaaaggcagtctgtatttccttttgaatccgggaaacccttcaagattcaggttctcgtagaaccagaccatttcaaggtagctgtcaacgatgcccacttactccagtataaccacagggtgaaaaaactgaatgaaatctcgaaactggggattagcggcgatatcgatttgacctcagcaagttacaccatgatt

SEQ ID NO: 15448 - DNA, 750 bp, Artificial Sequence
  Description of Artificial Sequence: Synthetic coding sequence
atggccgacaacttcagcctacacgacgctctgtctgggtcaggcaaccccaatccccagggatggcccggagcttggggaaatcagccagcgggggctggtggttacccaggagcatcctaccccggcgcttatccggggcaggcgcctccaggggcctatccagggcaggcacctccaggggcttacccaggtgctccgggcgcttatccaggagcgcccgcccccggggtttaccccggccctccttccggtcctggggcttacccctctagcggacagccctcagccaccggcgcataccctgcgaccgggccatatggggctcctgccggacccctcatagtgccatataatctacccctgcccgggggcgtcgttcctcgcatgctgatcaccatactgggaaccgtaaaacccaatgctaatcggattgcactcgacttccagcgggggaacgacgtcgcctttcatttcaacccaagattcaacgagaataatcggagagttatcgtctgcaacaccaagctggacaataattggggtagagaagagagacagtccgtgttccctttcgaatctggcaaaccatttaagatacaggtgttggtggagcccgaccacttcaaagtggccgtgaacgacgcccacttactccagtacaaccaccgggttaagaaactgaatgagatctcgaaactgggtatctctggcgacatcgatctgacaagcgcctcttacactatgatc

SEQ ID NO: 15449 - DNA, 750 bp, Artificial Sequence
  Description of Artificial Sequence: Synthetic coding sequence
atggcagataatttcagtcttcatgacgcactcagcgggtctggcaatccgaatcctcagggctggccgggcgcctgggggaatcaaccggccggggcaggcggctaccctggcgcctcttatcctggggcctaccctgggcaggccccccccggcgcctacccaggacaagccccaccgggcgcctatcctggagcacctggagcttatcccggagcccccgctcctggggtgtatcccggccccccttctggacctggcgcatacccctccagtggacagccatccgcgaccggagcctatcccgccaccggaccatatggggcccctgccgggcccctcattgttccctataatctgccactgccaggaggcgtggttcctcggatgctcattaccattctgggcaccgtgaagccaaacgctaatcggatcgcactggactttcagcgtgggaatgatgtggcctttcacttcaaccctcgctttaatgagaacaatcgtcgcgtcatcgtgtgtaatacaaagcttgataataactggggccgagaggagcgccagtccgtgtttccattcgaaagcggaaagcctttcaagatccaggtgctggttgaacctgaccatttcaaggtggctgtgaacgatgcacatctgctgcaatataatcaccgggtaaagaaactcaatgagatcagcaagttgggcatttctggcgacatcgatctcaccagtgcatcatacactatgatc

SEQ ID NO: 15450 - DNA, 750 bp, Artificial Sequence
  Description of Artificial Sequence: Synthetic coding sequence
atggctgataacttctctttgcacgacgccttgagcggatcaggaaacccaaatcctcaaggatggccgggagcctggggaaaccagccagcaggcgctggcggttacccaggggcaagctacccaggtgcgtaccccggacaagcgcctcctggggcatatccgggtcaggcaccacctggggcgtacccaggagcaccaggtgcatatcccggagcacctgcaccgggcgtttaccctggaccaccttcggggccaggagcatatccctcctcagggcaaccgagcgcaactggcgcatacccagccaccggaccttatggtgcgcctgccggtccactgatcgtgccctacaacctccctctgccgggaggagtggtccctcgcatgttgatcactatcctcggtactgtgaaacctaatgctaacagaatagctcttgattttcagcgcggcaacgatgtggcatttcatttcaacccccggtttaatgaaaacaatagacgggtgattgtgtgtaatacgaagctggataacaattggggacgcgaagagagacaaagcgtattcccttttgagtccggaaaaccatttaagattcaagtgctcgtggaacctgatcactttaaggtggcagtgaatgacgcacatttgctgcagtacaaccatcgagtgaagaagctgaacgagatttcgaagttgggaatctcaggcgatatcgatcttacttcggcttcctacaccatgatt

SEQ ID NO: 15451 - DNA, 750 bp, Artificial Sequence
  Description of Artificial Sequence: Synthetic coding sequence
atggctgacaatttctccttgcacgatgcactttctggatcgggtaatccaaatcctcagggctggcccggagcatggggcaaccaaccggctggagccgggggatacccgggtgcatcgtaccctggagcataccccggacaagccccacctggtgcctacccaggtcaagcccctcctggtgcatacccaggcgcacccggagcttacccaggagcaccggcccccggtgtgtaccctggacctccatccgggccgggtgcttacccttcctcaggacaaccttccgcaactggcgcctaccctgcaaccggaccttacggggcacctgccggccctcttattgtcccctacaaccttcctctcccaggaggagtggttcctagaatgctgatcaccattcttggaactgtgaagccaaacgcaaacagaattgcactggactttcagcgaggcaacgatgtggcgttccatttcaaccctcggtttaatgaaaacaaccgtagagtgattgtgtgtaacactaagctggataacaactgggggcgggaggaaagacagagcgtgttccctttcgaatccggcaagccattcaagattcaggtgctggtggaacctgaccactttaaggtcgccgtgaatgatgcacacctgctccaatacaatcatcgcgtcaagaagctcaacgagatctccaagctgggcatttcgggtgacatagatcttacttcggcaagctacactatgatt

SEQ ID NO: 15452 - DNA, 750 bp, Artificial Sequence
  Description of Artificial Sequence: Synthetic coding sequence
atggcagacaacttctcgttgcatgatgcactgtcgggaagcggtaatccaaatccccaaggatggcccggcgcgtggggcaatcaaccagccggcgcagggggctaccccggggcaagctaccccggtgcataccctggtcaggcaccaccaggggcatatccagggcaagcgccaccaggtgcatacccaggagctccaggtgcgtaccctggagcaccagcgcctggtgtgtacccaggaccccctagcggtccgggagcatacccctcgtcgggtcaaccgtcggccactggcgcatacccagccactggaccctacggtgccccggccggtccactgattgttccctacaatcttcctcttccaggtggtgtggtgcctcgcatgctgattactattctgggtactgtgaaacctaacgccaacagaattgccctggactttcaaagaggaaatgatgtcgcattccatttcaatccacggttcaatgaaaacaacagaagagtgatagtgtgtaacactaagctcgacaacaattgggggcgtgaagagcgccaaagcgtgtttccttttgagtccggaaaaccgttcaaaattcaagtcctggtggagcccgatcatttcaaggtggcagtgaacgacgcacaccttcttcagtacaaccatcgggtcaagaagttgaatgaaatctccaagctgggaatttccggcgacatagaccttacctccgcatcttacacgatgatc

SEQ ID NO: 15453 - DNA, 750 bp, Artificial Sequence
  Description of Artificial Sequence: Synthetic coding sequence
atggcagataacttctcgctgcatgatgctttgagcggaagcgggaaccctaaccctcaaggatggccgggagcctggggcaatcagccagccggcgcaggaggctacccgggagccagctacccaggagcttaccctggacaggcaccgcccggagcctacccgggacaagccccgcctggagcgtaccctggagctcccggcgcttacccgggagcgccagccccaggcgtgtacccgggaccgccatcgggtcctggcgcatatccgtcatcgggccaaccgtcagcgacgggcgcgtacccagctaccggaccctatggcgctccggctggcccattgatcgtgccatacaatctgccgctgccgggcggagtggttccacgcatgcttatcactatcctgggcacggtcaagccgaatgcaaatcggattgcactggactttcagcggggtaatgatgtcgctttccatttcaacccacgctttaatgagaacaaccgcagagtgatcgtctgcaacaccaagttggacaacaactgggggcgggaagagcgccagagcgtgttccctttcgagtccgggaagccatttaagattcaggtgcttgtggagcccgaccacttcaaagtcgccgttaatgatgcacacctcctgcagtacaatcacagggtcaagaaactcaacgaaatctcgaagctcggaatctccggagacatcgacctgacttcggcttcctacaccatgatc

SEQ ID NO: 15454 - DNA, 750 bp, Artificial Sequence
  Description of Artificial Sequence: Synthetic coding sequence
atggcagacaattttagcctgcatgatgctttgagcggttcggggaaccctaatcctcaggggtggccaggggcatggggcaaccagccagctggagcaggcgggtacccaggagccagttatcccggagcgtacccgggccaggcccccccaggggcgtaccccggccaggcgccaccaggtgcttatccgggcgctccaggagcctacccgggggctcccgcaccgggcgtgtatcccggtccccctagcggaccgggagcctacccctccagcggacaaccatcagccaccggagcataccccgccaccggtccatatggcgctcctgccggtccattgattgtgccttacaatttgccattgcccgggggtgtggtaccccgcatgttgattaccattctgggtacagtgaaacctaacgccaatagaattgcccttgactttcagcggggcaatgacgtggccttccattttaacccacgttttaatgaaaataatcgcagggtcattgtctgcaacaccaagctcgataataactggggtcgagaggagaggcagagtgtcttccctttcgaaagcggaaagcccttcaaaattcaggtcctagtggagcctgaccactttaaggtggctgtgaatgacgcacatcttttgcaatataaccatcgggtgaaaaagttgaacgagatctcgaagctcggcatctctggggacatcgacctcacatctgcgtcttataccatgatc

SEQ ID NO: 15455 - DNA, 750 bp, Artificial Sequence
  Description of Artificial Sequence: Synthetic coding sequence
atggcggacaatttcagcctccatgatgcactttccggatcgggaaaccctaaccctcagggttggccgggcgcctggggaaaccaaccagcaggcgcaggtggttaccctggagcttcctacccgggcgcctacccaggccaagcacctccaggagcctacccaggtcaagccccgcctggagcataccctggtgccccaggagcttacccaggcgcacctgcccctggggtgtaccctggacccccgtcggggccaggagcatatccctcttcgggtcagccatctgctactggtgcatacccagccaccggaccctacggcgcacccgcaggacctttgatagtgccctacaatcttccactgccaggcggagtcgtgccccgcatgttgattactatcctgggcaccgtgaagcccaacgctaatagaatcgcactggactttcagaggggcaatgacgtcgcttttcactttaaccctagattcaacgaaaacaatcgacgagtcatcgtgtgcaacactaaacttgacaataactggggtagggaagagcggcagtcagtctttccatttgaatccggaaagccatttaagatccaagtcctggttgaacctgatcactttaaggtggccgtgaacgatgcccatctgctccagtacaaccaccgggtcaagaaactcaacgagatttctaagctcggtatttcaggtgacattgatctcacctcagcctcctacaccatgatc

SEQ ID NO: 15456 - DNA, 750 bp, Artificial Sequence
  Description of Artificial Sequence: Synthetic coding sequence
atggctgacaacttttccctgcatgacgccctctctggttcaggaaacccaaatccgcagggatggcctggagcctggggtaaccagcctgccggggccggaggctacccgggagcttcgtacccgggagcgtacccaggacaagcgccgccgggcgcatacccgggacaggcccctcccggggcgtatccgggcgcgccgggcgcgtacccgggggcgccggctcccggcgtgtacccaggtccgccgtcgggaccaggtgcttacccgtcatcaggacagccttcggccacgggcgcctacccggcgaccggtccgtacggtgcgccagccggaccgctgatcgtgccatacaacctcccactccccggaggagttgtcccaagaatgttgatcaccatccttggcacggtcaagcccaatgccaataggattgcgctggacttccagcggggcaacgacgtggcgttccatttcaatcctagattcaacgagaataaccggcgcgtcattgtgtgcaataccaagctggacaacaattggggacgcgaagagagacagtccgtctttcctttcgaaagcggaaagcctttcaagatccaggtgctggtggaaccggaccactttaaggtggctgtcaatgacgctcatctcctgcaatacaaccaccgggtcaagaagctgaatgagatctcaaaactgggtatctcgggcgacatcgacctgacttcagcctcgtacactatgatt

SEQ ID NO: 15457 - DNA, 750 bp, Artificial Sequence
  Description of Artificial Sequence: Synthetic coding sequence
atggcggataacttctctctgcacgatgccttgtccggctcaggaaatccaaacccccagggatggccgggagcctggggtaaccaacccgccggggccggcggataccctggggcctcctatccgggtgcttatccagggcaggcaccccccggcgcgtatccaggtcaagctcccccaggggcctatccaggggcccccggtgcctatcccggcgccccggctcctggcgtgtatcccgggccaccttcagggccgggtgcttatcccagctctggacaaccatctgcaaccggcgcctatccagccaccgggccatacggcgccccagccggacctctgattgtgccttataacttgccactccctggaggcgtggtgccccggatgcttatcacaatcctggggaccgtgaagcctaacgcaaatagaatcgctctggactttcaacgagggaacgacgtcgccttccacttcaatccccgcttcaacgagaataacagacgggtaattgtatgcaatacaaagttggataataactgggggcgggaggagcggcaatccgttttccctttcgagagcggtaagccctttaaaatacaggtgctggtggagcccgaccacttcaaggttgcagtgaacgacgcccacctcctacagtataaccaccgagtgaaaaaactgaatgaaattagcaagctgggaatttctggcgacatcgatctgactagtgcgtcctacacaatgatc

SEQ ID NO: 15458 - DNA, 750 bp, Artificial Sequence
  Description of Artificial Sequence: Synthetic coding sequence
atggccgacaacttttccctgcatgacgccctttcgggaagcggcaacccaaaccctcaaggctggccaggagcatggggaaatcagccggccggggccgggggttacccaggcgcatcttacccaggggcttaccctggacaggcaccgccaggagcatacccgggtcaggctccaccgggggcctacccgggggcgccaggtgcttaccctggcgcgcccgcccctggagtgtaccccgggccgcctagcggcccaggcgcgtacccctcctcgggacagccgtcggccactggcgcctatcccgccactggaccgtacggagcgccagcaggtcccctcatcgtgccatacaacctccccctgcctggtggagttgtcccgagaatgctgatcaccattttgggtacggtgaaacccaacgccaaccgcatcgcccttgacttccaacgcggaaatgacgtggcttttcacttcaatcccaggttcaacgaaaacaacagacgggtgatcgtgtgcaatactaagctcgataacaattggggccgagaggaaagacaatcggttttcccgttcgagtcaggcaagccgttcaagatacaagtcctggttgagcctgaccatttcaaggtcgccgtgaacgatgctcacctcctgcagtataaccaccgggtgaaaaaactcaacgaaatcagcaagctcgggatctcgggcgacatcgatctgacctcggcatcctataccatgatc

SEQ ID NO: 15459 - DNA, 750 bp, Artificial Sequence
  Description of Artificial Sequence: Synthetic coding sequence
atggccgataatttcagcctccacgacgcactttccggtagcggcaatcccaacccacaggggtggccaggggcctggggcaaccagccggcaggagccggaggttaccccggtgccagctatcctggtgcttatcctggccaggctcctcctggcgcataccctggacaggcccctcctggtgcgtacccaggcgctccaggagcatacccgggcgctcccgctccgggagtgtatcctggccctccctctggaccaggagcctatccttctagcggccagcctagtgccaccggggcgtacccagcaactggaccttacggcgctcccgcaggtcctcttattgtcccatataatctgccacttccaggcggagtggtgccaaggatgctgatcaccatactgggcaccgtaaaacccaacgccaacaggatagctctggattttcagcggggaaatgacgtggctttccacttcaacccaaggttcaatgaaaataaccggcgggtgatcgtttgtaacaccaagctcgacaataattggggtcgcgaggaaagacagtctgtgtttccatttgagagtggaaaaccgttcaaaatccaagtgcttgtcgagccagaccattttaaagttgccgtgaacgatgcacaccttcttcagtacaatcacagggtgaagaagttgaatgagatctccaagctgggtatttccggggacatcgaccttactagtgcctcctacactatgatt

SEQ ID NO: 15460 - DNA, 750 bp, Artificial Sequence
  Description of Artificial Sequence: Synthetic coding sequence
atggcggacaacttctcgttgcacgatgcccttagcggtagtggcaacccgaatccacagggctggcccggagcttgggggaaccagccagccggcgccggagggtacccaggggcctcttatcccggggcctacccagggcaggcccctcccggggcctatccagggcaagccccacccggggcttatcctggtgcgcctggggcataccccggggcccccgcgccaggcgtctatccgggcccccctagtggacccggggcatatccaagttctggtcaacccagcgccacaggagcatacccagctactgggccgtacggcgcgcccgctgggcccctcatcgtcccttataatctacccctgcccggtggggtggttccacggatgctcatcacgatcctaggcactgttaaaccgaatgcgaacagaatcgccttggattttcaaaggggtaatgacgtggcctttcactttaacccccggtttaacgaaaataaccggcgcgtgatcgtctgcaacaccaagctggacaataactggggacgagaggaacggcagtccgtttttcccttcgagagtggaaagccattcaagatccaggtgctcgtcgagccagaccacttcaaagtggctgtaaatgatgcccacttgctgcagtataatcatcgagttaagaagctcaacgagataagtaaactcggcatctccggcgatattgacttaacaagtgccagttatactatgatc

SEQ ID NO: 15461 - DNA, 750 bp, Artificial Sequence
  Description of Artificial Sequence: Synthetic coding sequence
atggctgacaacttctccctgcacgatgccctgagcggatcagggaaccccaacccacagggctggcccggtgcctgggggaaccaacctgcaggagccgggggataccccggagctagctatccgggagcctacccgggccaggcgccaccaggagcctatccaggccaggccccaccaggcgcttaccctggagctcccggcgcatatccaggagcacctgctccaggcgtctaccccggaccacccagcggtccaggagcttaccccagcagtggccagccctcggccaccggggcctaccctgcaaccggcccctacggcgctcctgccggcccactgattgtaccctacaatctccccctccctggaggcgtggtccctcgaatgctaattacgatactgggcactgttaaacccaacgccaaccgaatagcacttgactttcagaggggcaatgacgttgcatttcattttaacccacgcttcaacgaaaataaccgccgtgtgatcgtgtgtaacaccaagctcgacaacaattggggcagagaagaacgccagtctgtgttccctttcgaatcaggaaagcccttcaagatccaggttctggtcgagcctgaccatttcaaggtggcagtgaacgatgcccatcttctgcaatacaatcatcgggtgaagaagctgaatgaaatcagcaagctgggtatcagtggtgacatcgatctgacttcagcttcttacacaatgatt

SEQ ID NO: 15462 - DNA, 750 bp, Artificial Sequence
  Description of Artificial Sequence: Synthetic coding sequence
atggccgataatttttctctccacgacgccctaagcgggtcaggcaaccccaacccccagggatggcctggggcctggggcaatcagcccgcaggcgcaggcggttatcctggggctagctacccaggcgcctaccctggtcaagctccacctggcgcttacccaggtcaggcccccccaggcgcataccccggggcaccgggcgcctacccgggcgccccagcgcctggggtgtaccctggcccacctagcgggcccggcgcctacccttcaagtggacaaccaagtgcaacgggcgcctaccccgccacaggcccatatggtgcccctgccgggccccttatcgtgccatacaatctgccgctgccaggcggcgtggtgccgcggatgctgatcacaattctgggaacggtcaaacccaacgcgaatcggattgctttagactttcaacgtggcaacgacgttgcctttcacttcaatccaagatttaatgagaataaccggcgtgttatcgtgtgtaataccaaacttgacaacaactggggtcgtgaagaacgtcagtctgtattcccatttgagtcaggcaagccatttaaaatccaagtgttggtggaaccagaccatttcaaggtggctgtaaacgatgctcacctcttgcagtacaaccaccgggtgaaaaaacttaatgagatctctaaactgggcattagcggagacatagatctgacgagtgctagctatacgatgatc

SEQ ID NO: 15463 - DNA, 750 bp, Artificial Sequence
  Description of Artificial Sequence: Synthetic coding sequence
atggcggataatttttcgctacatgatgcgttatcgggttcgggtaatccgaatccgcaaggttggccgggtgcgtggggtaatcaaccggcgggtgcgggtggttatccgggtgcgtcgtatccgggtgcgtatccgggtcaagcgccgccgggtgcgtatccgggtcaagcgccgccgggtgcgtatccgggtgcgccgggtgcgtatccgggtgcgccggcgccgggtgtttatccgggtccgccgtcgggtccgggtgcgtatccgtcgtcgggtcaaccgtcggcgacgggtgcgtatccggcgacgggtccgtatggtgcgccggcgggtccgctaatagtaccgtataatttaccgttaccgggtggtgtagtaccgcgtatgttaataacgatattaggtacggtaaaaccgaatgcgaatcgtatagcgttagattttcaacgtggtaatgatgtagcgtttcattttaatccgcgttttaatgaaaataatcgtcgtgtaatagtatgtaatacgaaattagataataattggggtcgtgaagaacgacaatcggtatttccgtttgaatcgggtaaaccgtttaaaatacaagtattagttgaaccggatcattttaaagtagcggtaaatgatgcgcatctattacaatataatcatcgtgttaaaaaattaaatgaaatatcgaaactaggtatatcgggtgatatagatttaacgtcggcgtcgtatacgatgata

SEQ ID NO: 15464 - DNA, 750 bp, Artificial Sequence
  Description of Artificial Sequence: Synthetic coding sequence
atggctgataatttttctctacatgatgccttatccgggtcagggaatcctaaccctcaggggtggcctggagcgtggggaaaccagcctgctggggccggagggtatccaggagcttcctatcccggagcgtatcctgggcaggcccctcccggagcctaccccggacaggccccacctggagcctatcctggggcaccaggggcttatccaggggcccccgctccaggggtgtatcccggaccacctagtggaccgggggcctatccaagttccgggcagccctcagccactggagcttaccctgccacagggccttacggggcgccagccggaccactgattgtgccatacaatttgcccctacccgggggagtcgttccacgaatgctaataactatactggggacagttaaacccaatgcaaaccggattgccttagatttccagagagggaacgatgttgctttccattttaaccctaggttcaacgaaaacaatcgccgggtcatagtgtgcaatacgaaactggataataactggggaagggaagaacgtcagtcagtcttccctttcgagtctgggaagcctttcaaaatccaggttctggtcgaacccgatcatttcaaagtagcagtgaacgacgcccatctgttacagtataatcatagagttaaaaaactgaacgaaataagtaaactggggatcagtggagacatagatctgacatctgcgtcatatactatgatc

SEQ ID NO: 15465 - DNA, 750 bp, Artificial Sequence
  Description of Artificial Sequence: Synthetic coding sequence
atggctgacaatttctcattgcatgatgccctctctgggtccgggaaccctaatccccaggggtggccaggtgcctggggaaaccagcctgcgggggccggcgggtatccgggggctagctacccgggagcttacccagggcaggccccacccggcgcttatcccggacaggcccctcctggagcctatcccggggctccaggcgcctatcccggggcaccggcccccggggtttaccccggccccccttcaggccccggagcctatccttccagcggtcagccatcagcaaccggcgcgtaccccgctacggggccgtacggcgcgccagctgggcccttaattgttccttataacctgccgctaccaggcggggtggttccacgaatgctcatcactatcctaggaacagtcaaacccaacgccaacagaattgcgctggattttcagagggggaatgacgtggcattccactttaaccccagatttaacgagaataataggcgcgtgatcgtatgcaatacaaagctagataataattggggacgcgaggagcggcagagtgtgttcccctttgaatcaggaaaaccattcaaaatacaggtgctggtggaacctgaccacttcaaagtggcagtgaacgacgcgcacctcttacagtataatcatagggtgaagaaactgaatgagattagcaagctgggcatttctggcgacatcgaccttacctcagcctcctacacaatgatc

SEQ ID NO: 15466 - DNA, 750 bp, Artificial Sequence
  Description of Artificial Sequence: Synthetic coding sequence
atggcggataatttttcactccacgatgcattgtcgggatctggcaacccaaatccacagggctggcccggcgcatggggcaaccagccagctggagctgggggttatcccggcgctagctatccaggggcctaccctgggcaagctcctcccggcgcttaccccggacaggcaccccctggcgcttatccaggcgccccaggagcttatcctggcgcgcccgcacctggagtctaccccggtccaccatcgggacctggcgcttacccttcaagcggacagccatccgccaccggagcgtaccctgccaccggcccctacggggcccctgccggtcccttgattgtcccctacaacctgccattgcccgggggcgttgtgccaaggatgcttattactatcctgggaacagtcaagccaaacgcaaatagaatcgccttagactttcaacgggggaatgatgttgcgtttcactttaacccacgctttaatgaaaacaacagacgcgtcatcgtctgcaatactaagctggacaataactggggacgcgaagaacgacagtcagtcttcccattcgaaagcggaaagccattcaaaattcaggtgctcgttgagcctgaccatttcaaagtggccgtcaatgatgcgcatcttctacagtacaatcatcgggtgaaaaaacttaatgaaatcagtaaactggggatttcaggtgacatagatcttacctctgcctcctacacaatgatt

SEQ ID NO: 15467 - DNA, 750 bp, Artificial Sequence
  Description of Artificial Sequence: Synthetic coding sequence
atggccgacaacttcagccttcatgatgccttgtctggtagcggtaatcccaatcctcaaggctggcctggtgcatggggcaatcaacccgcaggagcgggcggttaccctggggcctcataccctggagcatacccaggccaggcacctccaggagcataccccggacaagcacctcctggcgcatacccgggagcgcctggcgcctatcctggagcaccagctcctggcgtctacccaggaccaccttcaggacccggtgcctacccatcgtcagggcaaccatccgccaccggcgcgtacccggctactggaccctacggtgcacctgcaggaccgctgatcgtcccatataacttgcctcttccaggcggtgtggtccctcgaatgctcatcaccatactgggtactgtaaagccgaacgcaaatcgtattgcgctggattttcagagaggaaatgatgtggcatttcactttaaccctcgttttaacgagaataaccggagagtgattgtgtgtaatactaaacttgacaacaattggggacgcgaggaaagacagagcgtgtttccattcgagagtggtaagccattcaaaatacaggtgttggtggaaccagaccatttcaaggtagctgtgaacgatgctcaccttctgcaatacaaccatagagtcaaaaaacttaacgaaatttcgaaacttggaatttccggcgacatcgatctcacctccgcttcctacacgatgatt

SEQ ID NO: 15468 - DNA, 750 bp, Artificial Sequence
  Description of Artificial Sequence: Synthetic coding sequence
atggcagataatttctcactccatgatgccctgagtgggtctgggaatcccaatcctcagggatggcccggggcatggggaaaccagccagcgggggcaggagggtaccccggagcatcatatcctggagcgtaccccggacaggccccacccggggcctaccccggacaagcccctcctggagcataccctggggcgcctggagcctatcccggggcacccgcacccggggtgtatcctggaccaccgtccgggcccggggcctatccttcctctgggcagccttcagcaacaggagcatatcccgcgacagggccctatggagcccctgccgggcccctcatcgtgccttacaatttgccccttccagggggggtggttccccgcatgctcatcacaatcctggggacagtcaaacccaacgccaaccgaattgccctggatttccagcgcgggaatgatgtagcttttcatttcaatccacggttcaatgagaacaatcggagagttatcgtctgtaatactaaacttgataataactggggaagagaagagagacagtctgtttttccttttgaatcagggaaaccatttaaaatacaggtgctcgtggaacccgatcattttaaagtggcggtgaacgatgctcatcttctgcagtacaaccacagggtgaaaaaacttaatgaaataagtaagcttgggatttccggagatatagatctgacatctgcttcctatacaatgatc

SEQ ID NO: 15469 - DNA, 750 bp, Artificial Sequence
  Description of Artificial Sequence: Synthetic coding sequence
atggcagataacttctcacttcacgatgccctgtcgggcagtggaaaccctaaccctcagggctggccgggagcttggggaaaccagccagccggggcaggcggataccccggggccagttacccaggggcctaccccggacaagccccgccgggtgcatatcctggtcaggccccgccgggggcctatcctggcgcccctggagcgtatcctggagccccggcccccggggtatatccaggaccgccgagcgggcccggagcatacccatctagcggacaaccaagtgcaacaggggcctaccctgcaaccggcccttacggcgcgccagcaggccctctgatcgtgccctataaccttccccttcctggcggagtagtcccaaggatgctgattaccattctgggcacagttaagcccaacgctaacagaatcgccctggacttccagagggggaacgatgtcgcctttcattttaaccctcggtttaacgagaacaatagaagggtgattgtttgtaatacgaagctggataacaactggggccgcgaagaaaggcagtctgttttcccatttgagtcgggcaagccctttaagattcaggtcctggtggaaccggatcacttcaaggttgcagttaacgacgcccacctgctgcagtacaaccacagagtgaaaaaattgaatgaaatctccaagcttggcatctctggggatattgatttgaccagtgcctcctatacgatgatt

SEQ ID NO: 15470 - DNA, 750 bp, Artificial Sequence
  Description of Artificial Sequence: Synthetic coding sequence
atggccgacaacttttctcttcacgacgccttgtccggttccggcaaccccaatccacagggatggcctggagcatggggaaaccaaccagctggagccggcggctatcccggagcttcatacccaggcgcttatcccggacaggctcctcccggagcatacccaggtcaagcacctcctggcgcctaccctggtgcccccggagcttaccccggagcccccgcacccggcgtctaccccggtcccccctcaggtcctggagcttatccatcctcaggccaaccttccgcaaccggtgcctaccccgccacgggaccatacggtgccccagcgggacccctcatcgtgccttacaacctgccactgcctggtggcgtcgtacccaggatgctgatcaccatcctcggaactgtgaagccaaatgcaaataggatagcactggacttccaacgcggtaacgacgtcgccttccactttaacccaagattcaatgaaaacaataggcgcgtgattgtgtgtaacactaagctggataataactggggaagggaggaacgccaatcagtgttcccgttcgaatctggaaaaccatttaaaatccaggtactggtcgagcccgatcactttaaggtggccgttaatgacgcgcacctcctgcagtacaaccatcgcgtgaagaaactgaatgagatatcaaagctgggtatcagcggcgatatagacttgacttccgctagctacacaatgata

SEQ ID NO: 15471 - DNA, 750 bp, Artificial Sequence
  Description of Artificial Sequence: Synthetic coding sequence
atggctgataactttagcctccacgatgccctgtccggctcagggaatccaaatccccagggatggcctggcgcctggggtaatcaacctgccggagccggagggtatcctggggcctcatatccgggagcgtaccccggtcaggcgccccctggcgcgtaccctgggcaggcaccgcccggtgcgtacccaggcgccccaggcgcttaccccggagcaccagccccaggtgtgtaccccggacctccctccggaccgggggcttatccttcatctggtcagccctctgccacaggagcttacccagctacaggcccatacggcgctcccgcaggcccgctcatagtcccgtataacctgcccctccccggaggagtggtgcctagaatgctgataaccatccttggcacagttaagcccaacgctaacagaatcgcattggacttccagcggggcaacgatgtagcctttcacttcaacccccgatttaatgaaaataaccgccgggtgattgtatgtaacaccaagctggacaataactggggacgcgaagaacgacagtccgttttccctttcgagtcgggcaagcccttcaagattcaggtactggtggagccagatcacttcaaagtcgcggtcaacgacgctcatctgctacagtacaaccaccgggtaaagaaacttaatgagatctctaaactcggcatttccggcgacattgacctgacaagcgctagctacaccatgatt

SEQ ID NO: 15472 - DNA, 750 bp, Artificial Sequence
  Description of Artificial Sequence: Synthetic coding sequence
atggcagacaatttctctctccatgacgccctgtccggctctggtaacccaaaccctcaaggttggccaggtgcatgggggaatcagccggccggagcaggaggctatcctggggcatcctatccaggtgcatacccgggacaggcaccaccaggcgcttatcccggccaggcaccaccaggcgcctaccctggagcgcccggggcttaccccggcgcccctgcgcccggggtctaccccgggcccccatccggtcctggtgcatacccatcttccggacagccgtccgcgaccggcgcatacccggcaaccggcccttacggggctcctgcagggcccctgattgttccgtataatctccctctcccggggggcgtggtgccccgaatgctgatcacaatcctcggtacggtgaagccgaacgctaacagaatcgctctggatttccagcggggaaatgacgtggctttccatttcaatccacggttcaatgagaataaccgacgggtgattgtatgcaatacaaaactcgataacaactggggccgggaggagaggcagtccgtgttcccctttgagtcggggaagccttttaagattcaggtcctggtggagccagatcatttcaaagtcgctgtgaacgacgcgcacctgctgcagtacaatcaccgagtgaaaaagctgaatgagatttccaagctcggtattagcggagacatcgaccttactagcgcatcctacaccatgatc

SEQ ID NO: 15473 - DNA, 750 bp, Artificial Sequence
  Description of Artificial Sequence: Synthetic coding sequence
atggccgacaacttctctttgcatgacgctctaagcggaagcggcaatccaaacccacagggatggccaggcgcgtggggcaaccagccagcgggagccgggggttatcctggtgcgtcttatcccggtgcttaccccggacaagcccctccgggtgcgtaccctggtcaggcgccacctggcgcttaccctggcgcgccgggtgcgtatccgggcgcgccagcaccaggggtgtaccctggcccaccatccggtcctggtgcatacccaagctccggccagccgtctgcgactggtgcttatccggctaccggtccttacggtgcgcctgctggacccctcatcgtaccgtacaacctgccgctccccggtggtgttgttccgcggatgctgattactatcctgggaactgttaaaccaaatgcgaaccgcattgcactggacttccagcgcggcaacgatgtcgcttttcacttcaacccgcggtttaacgagaacaaccgccgcgtgattgtttgcaacactaaactggataacaattgggggcgcgaggagcgtcaatctgtatttccgttcgagtcaggtaagcctttcaagattcaagttctggttgaacctgaccatttcaaagtggctgtgaacgacgcccacttgctgcaatacaatcatcgagtcaagaaactgaatgaaatcagcaagctgggtatttccggcgatattgatctgacgagcgccagctacaccatgatt

SEQ ID NO: 15474 - DNA, 750 bp, Artificial Sequence
  Description of Artificial Sequence: Synthetic coding sequence
atggcagacaacttttcattgcacgatgcactgtcgggatcgggcaacccaaaccctcagggatggccaggagcttgggggaatcaaccagccggggcaggaggataccctggagcctcgtacccgggagcgtatccaggtcaggccccgccgggtgcctaccccggacaggctccgccaggagcgtaccccggagccccaggcgcttacccaggagccccggccccgggggtgtaccctggccctccatctggccctggagcctacccgtcctccggccagccaagcgccaccggcgcctaccccgccaccggcccatacggcgcccctgcaggccctttgatcgtgccatacaaccttccgctgcctggtggagtcgtccccagaatgctgatcactatcctggggactgtgaagccgaacgccaacaggatcgcgcttgactttcagcgcggaaatgacgtggcattccactttaatccgcgcttcaacgaaaacaacaggcgggtgatcgtctgtaacactaaactggacaacaattggggccgggaggaacgccagtcagtgttcccgtttgagtctgggaaaccattcaagatccaagtgctggtcgagccagaccacttcaaggttgcagtgaatgacgctcacctgctgcaatacaatcacagagtcaagaagctcaatgagatctccaagctgggcatctcaggagatatcgacctgacttccgcctcgtacaccatgatc

SEQ ID NO: 15475 - DNA, 750 bp, Artificial Sequence
  Description of Artificial Sequence: Synthetic coding sequence
atggcagataacttctctctgcacgacgcgctgtccggaagtggtaatccaaaccctcagggctggccgggggcttggggcaatcagcctgccggagccggtggttatcccggagcctcttatccaggcgcgtatccgggacaggcgccaccaggtgcgtaccccgggcaagcaccgcctggcgcctacccaggtgcgccgggcgcgtacccaggagcaccagcaccgggagtctacccgggaccgccgtcaggcccaggagcttacccatcaagcggacagccctcagctactggggcttacccggccaccggtccgtacggtgcacctgcgggccccctcattgtgccttacaacttgccactccctggaggagtcgtgccccggatgctcattactatccttggaaccgtcaaaccgaacgcgaatagaatcgccctggacttccagcgtggaaatgatgtcgcctttcacttcaacccacggtttaacgaaaacaacagacgcgtgatcgtgtgcaacaccaagctggacaacaattggggcagggaggaacgccaatcggtgttcccgttcgagtccgggaagccattcaaaatccaggttctggtagagccggatcactttaaagtagctgtcaacgatgctcacttgctccaatacaatcaccgagtgaagaagctgaatgaaatctcgaagctcggcatctccggagacatcgacctgaccagcgcgtcatacactatgatc

SEQ ID NO: 15476 - DNA, 750 bp, Artificial Sequence
  Description of Artificial Sequence: Synthetic coding sequence
atggcagacaacttctcgctgcatgacgcactttccggatccggtaatccgaacccacaaggatggcctggcgcatggggaaaccagccagcaggagccggaggttaccctggagccagctacccaggagcatacccgggccaagctcccccaggggcctaccccggacaggcgccccccggagcttaccctggcgcaccgggagcgtatccaggagcgccagcacctggagtctacccaggacccccgagcggacctggcgcgtacccttcttctggacagccttcagccaccggtgcgtacccagcaaccgggccttacggagcccctgctggacctctgatcgttccttataacctgccactgcccggtggcgtggtcccaagaatgctgataactattctcggtactgtgaagccaaatgcaaacaggattgctctcgactttcagcggggtaacgatgtggccttccacttcaaccctaggtttaacgagaataacagacgagtgatcgtctgtaacactaaacttgataacaactgggggcgtgaggaacgtcagagcgtgtttccatttgaatccggaaagccattcaagatacaggtgcttgtcgagcccgaccatttcaaggtggctgtgaatgatgctcatctcttgcaatacaaccacagagtgaagaagctgaacgaaatctcaaagctgggcatctccggcgatatcgacctgacgtccgcatcctacaccatgatc

SEQ ID NO: 15477 - DNA, 750 bp, Artificial Sequence
  Description of Artificial Sequence: Synthetic coding sequence
atggcagataactttagcctgcatgatgcactgagtggatctggcaacccaaatcctcagggctggcccggggcctggggaaatcagccggccggtgccggcggctacccaggcgcatcctaccctggtgcctatccgggccaagcaccgccaggtgcgtatcctggccaggcgccgcctggagcctaccctggagcccccggagcgtacccgggagcacctgcgccgggtgtgtacccaggtcccccctccggtccgggagcttatccctcctcggggcagccatcggccaccggagcatacccggctactggtccgtacggggccccagccgggccactcattgtgccgtacaacttgccgcttccgggtggagtggtgccgcgcatgctgatcaccattttgggtactgtgaagcccaatgcaaacagaatagccctggacttccaacgggggaatgacgtggccttccactttaatcctagatttaacgagaataaccgccgcgtgatcgtgtgcaataccaagctcgacaacaactggggcagggaggaacggcagtcggtctttcctttcgagtcaggcaagcccttcaagatccaggtccttgtcgagccggaccatttcaaagtggccgtgaacgatgcgcacctccttcagtacaaccacagagtgaagaaattgaacgagatctccaagctgggaatctccggcgatatcgacctcacgtcagcttcgtacactatgatc

SEQ ID NO: 15478 - DNA, 750 bp, Artificial Sequence
  Description of Artificial Sequence: Synthetic coding sequence
atggctgacaacttctctttgcacgatgccttgtctgggagcggcaatcctaacccacagggctggcccggagcgtggggcaatcagccggccggcgcggggggctaccctggggcctcctatcccggggcgtatccgggacaggcgccacccggagcataccctggccaggcccccccaggcgcgtatccaggcgcaccaggtgcctaccccggcgcgcccgcccccggcgtgtatcccggacccccctcaggtcccggggcatacccaagttcgggccagccctctgccactggcgcctacccagctactggtccttatggggctccagccggtcctctgatcgttccatataatttgcccctacccggaggcgttgtcccccgtatgttgatcactatcctggggactgtcaagcccaacgcaaatcgcatcgctttggacttccagcggggtaacgacgtggccttccatttcaaccccagatttaacgagaacaaccgacgggtgatcgtgtgtaacacaaagctggacaacaattggggccgcgaagagagacagagcgtgttcccttttgagagcggaaaaccctttaagattcaggtgctggttgagcccgatcacttcaaggtcgccgtgaacgacgcccatctgcttcagtacaatcaccgcgtgaaaaagctgaatgaaatcagcaaactggggataagcggagacatcgacttaacatctgcctcatataccatgatt

SEQ ID NO: 15479 - DNA, 750 bp, Artificial Sequence
  Description of Artificial Sequence: Synthetic coding sequence
atggcagataacttctcactccacgacgcgctgtcgggatctggcaatcccaacccgcagggatggcctggagcctggggtaatcaaccagccggggcaggcggatacccgggagcgtcctacccaggagcatacccagggcaggcgcctcctggcgcttaccctggacaagcgccgcccggagcctatccaggagccccaggagcctaccctggggcaccagcaccgggggtgtacccaggaccgccgtcaggaccaggcgcttaccccagctctgggcagccatcagcgactggagcatacccggccactggcccgtacggcgcgccagccggcccgctcatcgtgccctataacctgcctttgccgggtggggtcgtgccgcgaatgctcattaccatcttgggcaccgtgaagcctaacgcaaaccggatcgccctggacttccaacgtggaaacgacgtcgccttccatttcaacccgaggttcaacgagaataaccgcagagtgatcgtgtgcaatactaagttggacaacaactggggccgcgaggaacgacagtcagttttcccgttcgagtcgggaaaacctttcaagatccaggtactggtcgaacccgatcatttcaaggttgccgtcaatgacgcgcacctgctgcagtacaaccaccgcgtgaaaaaactgaatgaaataagcaagctcggaatctccggagacatcgatctgacttcggccagctacactatgatt

SEQ ID NO: 15480 - DNA, 750 bp, Artificial Sequence
  Description of Artificial Sequence: Synthetic coding sequence
atggcagataacttctcgctgcacgatgccctctcgggatctgggaatcccaatccccaggggtggccgggggcttggggcaaccaaccggccggtgctggcggataccctggggccagctacccgggtgcttatccgggacaggcgccgccgggcgcgtaccccggccaggctccacccggcgcctacccgggagccccgggtgcgtacccgggcgcacctgcgcccggtgtgtacccgggtccgccttccggccccggtgcatacccatcgtccggacagccaagcgccactggggcgtacccggcaactgggccttacggtgcacctgccggcccactcattgtcccgtacaacttgccgttgcctggaggagtggtcccacggatgctgattaccattctgggaacggtcaaaccgaacgctaaccgcatcgcactggactttcaacgcggcaacgacgtggcctttcatttcaacccaaggttcaatgagaataatcgtagagtgattgtgtgtaataccaaacttgacaacaactggggaagggaggaacgccagtccgttttcccgttcgaaagcggtaagccgtttaagattcaagtgttggtggagccggatcacttcaaggtcgccgtgaacgatgctcacctcctccagtacaaccatagagtgaagaaactgaacgaaatatcaaagctgggtatctcgggagacatcgacctcacctcggcgtcgtatactatgatc

SEQ ID NO: 15481 - DNA, 750 bp, Artificial Sequence
  Description of Artificial Sequence: Synthetic coding sequence
atggccgacaacttttctctgcatgatgctctgtcagggagcggaaatcccaacccacagggatggcccggagcatggggtaatcagccagcaggggcaggtggctacccaggagcttcatatcctggcgcttatcccgggcaggccccccctggagcctatcctggccaagcccctccgggcgcctaccctggagcccctggagcatatcccggcgccccggctcctggcgtgtatcctggaccaccaagcggcccaggtgcttacccaagtagcgggcaaccatcggctactggagcctacccggccaccggaccttatggcgcccctgcaggcccacttatcgttccatacaaccttccccttcccggcggagtcgtgccacgcatgctgattaccatcttagggactgtgaagccaaatgccaaccgcatcgctttggattttcagaggggaaacgacgtcgcattccatttcaaccctaggttcaacgagaataacagaagagtgatcgtatgtaacacaaagcttgataacaactggggtagagaagagaggcagagtgtgttcccctttgaatcgggtaagcccttcaaaattcaagtgctggtcgaacccgaccactttaaggtggcagtcaacgatgcacacctgctgcagtacaatcatagagtgaagaaactcaacgaaatctcaaagctggggatatcaggagacattgacctcaccagcgcttcgtacacaatgatc

SEQ ID NO: 15482 - DNA, 750 bp, Artificial Sequence
  Description of Artificial Sequence: Synthetic coding sequence
atggccgacaacttttcccttcatgacgctctctctggttcagggaacccaaacccacaaggatggcctggcgcttggggaaatcaaccagcaggtgcaggaggctacccaggagcctcgtacccaggtgcctaccccggtcaagcgcctcccggtgcataccctggtcaggcccctccaggagcttacccaggggcaccaggcgcgtaccctggggcgccagcaccaggagtgtatcccggacccccctcagggccaggcgcatacccttcatcgggacaacctagtgctaccggggcataccccgcaactgggccttacggggcacctgcaggacccctcatcgtcccttacaacctcccactcccgggaggagtggtgcctcgtatgcttattactattctcggaaccgtgaagccgaacgcaaaccgaatagcacttgatttccaacgaggaaacgatgtggcatttcactttaatcctaggtttaacgagaataatcgaagggtgatcgtttgtaacactaaactcgacaacaactggggtagagaagaaaggcagtcggtgttcccttttgagtccggtaagcccttcaagattcaggtgctggtcgaacctgatcactttaaggttgcggtgaacgatgcccatcttctgcagtacaaccatagagtgaagaagctcaatgaaatctcaaaactgggtatctcaggtgatattgacttgacgagcgcgtcgtacaccatgata

SEQ ID NO: 15483 - DNA, 750 bp, Artificial Sequence
  Description of Artificial Sequence: Synthetic coding sequence
atggccgataacttcagtttacatgatgctttatctggtagcggcaatcccaacccgcaaggctggccaggagcctgggggaatcaacccgccggggctggcggctacccaggagcttcatacccaggggcttatcctggacaagctcctcccggagcatatcctggtcaagctccacccggagcctaccccggtgcccccggagcataccctggagcaccggcacccggcgtctacccaggccccccctccgggcctggcgcatatcctagtagcggacagccgagcgcgaccggagcctatccagccacaggaccatatggcgcacccgcaggcccactgatagtgccttataatctgccccttcccggaggggtggttcctcgcatgttaattacaattctgggaacagtgaagccaaatgccaacagaatcgctctcgattttcagaggggaaacgacgtggcctttcactttaatccccgttttaatgagaacaataggcgcgtgatcgtatgcaatacaaagctggacaacaactgggggagggaggagcgccagtcagtatttcctttcgagtccgggaagccatttaaaatccaagtgctggtggaacccgaccattttaaagtagcggttaatgacgcccatctgctccagtacaaccacagagtaaagaagctgaatgagatctccaagctgggaatttcgggagacatagacctcacctccgcttcctacactatgatc

SEQ ID NO: 15484 - DNA, 750 bp, Artificial Sequence
  Description of Artificial Sequence: Synthetic coding sequence
atggccgacaatttttctttgcacgacgccttatcaggatcgggtaatccaaatccccaaggttggccgggagcttggggcaaccagcctgcaggggcaggtggttaccccggtgcaagttaccccggcgcatacccagggcaagcccctccgggtgcgtaccctgggcaggcgcctcccggggcttatcccggcgctcccggtgcatatcccggtgcgcccgcgccgggtgtctacccaggacctccgagtgggcctggagcgtatccgtctagcggacagccttcggctactggcgcatacccggccaccggtccctatggggccccggccggtcctctaatcgtcccatacaatttgcccctgcccggaggagtcgtcccgcgaatgctaatcactatactaggtacggtcaagcccaatgcgaaccgcatcgcacttgatttccaacgaggtaacgacgtcgccttccactttaatcctcgcttcaacgaaaataatcgacgagtgatcgtttgcaatacgaaactggataacaactggggtagggaagagagacaatcagtctttcccttcgaaagcggtaagcctttcaaaattcaagtcctcgtggaaccagatcactttaaggttgcagtgaatgatgcccatcttctacaatacaaccatagagtaaaaaagcttaatgaaattagcaagctcggtattagcggcgacatcgatcttacgtctgctagctatactatgatt

SEQ ID NO: 15485 - DNA, 750 bp, Artificial Sequence
  Description of Artificial Sequence: Synthetic coding sequence
atggctgataatttcagtttacatgatgcattatctggtagtggaaatccaaatcctcaaggatggccaggtgcttggggaaatcaacctgctggagctggaggatatccaggagcttcatatccaggtgcttatcctggacaagcaccaccaggagcttatcctggacaagcaccaccaggagcttatccaggtgctccaggagcttatccaggtgcaccagcaccaggagtttatccaggaccacctagtggaccaggagcttacccatcatctggtcaaccatctgctactggtgcttatccagctacaggaccttatggagcacctgcaggtccattaattgtaccatataatttaccattaccagggggagttgtaccacgtatgttaatcactatcttgggtactgttaaaccaaatgctaacagaattgctttagatttccaaagaggaaatgacgttgcttttcatttcaatccaagattcaacgaaaataatagaagagttattgtatgtaatacaaagttggataataattggggacgagaagaaagacaatctgtttttccatttgaatcagggaaaccattcaaaatccaagtattagttgaaccagatcattttaaagttgcagttaatgatgcacacttgcttcaatataatcatagagttaaaaagttaaacgaaatttcaaaacttggtatttctggtgatatagatttaacttcagcttcatatacaatgatt

SEQ ID NO: 15486 - DNA, 750 bp, Artificial Sequence
  Description of Artificial Sequence: Synthetic coding sequence
atggcagacaatttttcactccatgatgcgctttctggctccggcaacccaaacccccagggctggcccggagcttggggcaaccagcctgccggcgctggcgggtacccaggcgcaagttacccaggcgcttaccccggccaggctccccctggcgcataccctggacaagccccccctggagcatatccaggggctcccggagcttatcccggagcgcctgcaccgggggtgtatcctggtccaccttcaggaccaggcgcgtatcctagttccggtcagccctcggctactggagcatatcctgccaccggcccatacggtgctcccgcgggtcctctgatcgtaccttataatctaccattgccgggcggggtcgttccccgaatgctgatcaccattctgggaaccgtaaaaccaaatgccaaccgtattgccctggatttccaaagaggaaacgacgtcgcctttcacttcaacccccggttcaatgaaaacaacagaagagtgattgtttgtaataccaagctcgataacaactgggggagggaagagcggcaaagcgttttcccatttgagtcggggaaaccatttaagatacaagttctcgtagaacccgatcacttcaaagtcgctgtcaacgatgcacacctgctgcagtataaccatcgcgttaaaaaacttaacgaaatctctaagttaggcatctccggagacatcgatctcacttccgcttcgtataccatgatt

SEQ ID NO: 15487 - DNA, 750 bp, Artificial Sequence; identical to SEQ ID NO: 15462
  Description of Artificial Sequence: Synthetic coding sequence

SEQ ID NO: 15488 - DNA, 750 bp, Artificial Sequence
  Description of Artificial Sequence: Synthetic coding sequence
atggccgacaatttctcactgcatgacgcgctgtcgggatccggcaatcccaacccacaaggttggcctggcgcctggggaaaccagccagctggagccggaggataccctggagcatcttacccaggggcatatcccggtcaggcccctcccggtgcctacccaggtcaggcaccacccggggcttacccaggcgcacctggggcataccccggtgcgcctgctcccggagtctaccccgggcctccctctggcccaggagcctacccctctagcgggcagccgagcgccaccggagcttatccagctaccgggccctacggcgcgcctgcaggcccactaattgttccatacaatctgcccctgcctggaggggttgtcccccgcatgctgatcaccattctgggcaccgttaaacctaatgcgaacaggatcgcgttagacttccagcgaggtaatgatgtggcctttcactttaacccgcgattcaatgaaaacaacaggcgggtcattgtgtgcaataccaaattggacaacaactgggggcgcgaggagcgtcagtccgtgttcccattcgagtccggaaagccatttaagattcaggtccttgtggaaccagatcattttaaagttgcagttaatgacgcacatctgcttcaatacaaccatagagtgaaaaagctcaacgagatctctaaactgggtatctcaggagacattgatttgaccagcgcatcatacactatgatt

SEQ ID NO: 15489 - DNA, 750 bp, Artificial Sequence
  Description of Artificial Sequence: Synthetic coding sequence
atggccgacaacttttcgcttcatgacgcgctttcgggaagcggtaaccccaacccacagggatggcctggagcatggggtaatcaacccgcaggcgccgggggctaccctggggcatcctatcctggtgcataccctgggcaggcgccgccgggggcctaccctggccaagcacctccaggcgcatacccgggcgcaccaggagcataccccggagcccctgcaccgggagtgtaccccgggccacctagcgggccgggagcatatccttcctcaggccagccaagcgcaaccggggcttaccccgcgactggtccttacggagcaccagcaggacctctcattgtcccctacaacctgcctcttcccggtggggtcgtgccacggatgttgatcactatacttggcaccgtcaagccaaacgcgaatagaatcgcactcgattttcaacgtggtaatgatgtcgcatttcatttcaatcctagattcaacgagaacaacagacgcgtgattgtctgtaataccaaactggacaacaattggggtcgagaagagagacagagcgtgttcccatttgagtccggcaagccttttaagatccaggtcctggtggaacctgatcacttcaaggtggcagtgaacgatgcacacctgctgcaatacaatcatcgggtcaagaagctcaacgaaattagcaaactggggatctcgggtgatatagatcttacttcagcctcgtacaccatgata

SEQ ID NO: 15490 - DNA, 750 bp, Artificial Sequence
  Description of Artificial Sequence: Synthetic coding sequence
atggcggataattttagcctgcatgacgctctgtccggcagcggtaaccccaatccacagggatggccgggtgcctggggcaaccagcctgccggagctggaggttatcctggcgctagttaccctggtgcctaccccggacaggcccccccgggagcgtaccctgggcaggccccccccggagcgtatcccggcgcaccaggcgcatacccgggagccccggcacccggtgtctatcccgggcctcctagcgggccgggtgcctacccttcctcaggccaaccttcagcaacgggagcctaccctgcaacgggaccgtacggggctccggcgggacccctgatcgtgccatataatctcccacttccaggtggagtggtgccccgcatgctcatcacgatcctaggcactgtgaagcccaatgcaaacagaatcgcgctcgatttccaacgggggaatgacgttgccttccatttcaatcctaggttcaacgagaacaatagacgcgtaattgtgtgcaacactaagctagacaataattggggccgagaggaacgccagagtgtgttcccttttgaatcgggaaaaccctttaaaatccaagtccttgttgaaccagaccacttcaaagtagccgttaatgacgcccaccttctgcagtacaaccaccgggttaaaaagttgaacgaaatatctaagcttggaatcagcggtgacatcgatctaacctccgccagctatactatgatc

SEQ ID NO: 15491 - DNA, 750 bp, Artificial Sequence
  Description of Artificial Sequence: Synthetic coding sequence
atggcagacaatttctctctgcatgacgcgctgtcagggtcgggtaatccgaacccccagggatggccgggtgcatggggcaatcagccagccggagccgggggctacccaggggcgtcatatccaggagcatacccaggacaagcacctccaggtgcttacccagggcaagcacctcctggcgcctatccaggagcgcctggtgcctatccgggcgcccctgcgcctggcgtctacccaggaccaccgtcaggaccaggagcctacccaagcagcggccaacccagcgctactggagcgtacccagcaacggggccttacggagcgccagccggtccactgattgttccctacaacctccctctgcctggaggcgtggtcccaagaatgcttattactatcctgggcactgtgaaacccaacgcaaacaggatagcactggatttccagagaggtaacgatgtcgcgtttcactttaacccaagatttaacgagaacaatcgacgggtgattgtgtgtaacacgaagctcgataacaattggggtcgggaagagcgccagtccgtgtttcctttcgagtcgggaaagcctttcaagatccaggtcctggtggaaccagatcactttaaggtcgcagttaacgatgcgcatcttcttcaatacaaccatagggtcaagaaattgaatgagatatcgaaacttggtatttctggtgatattgacttgaccagcgcgtcctacaccatgatt

SEQ ID NO: 15492 - DNA, 750 bp, Artificial Sequence
  Description of Artificial Sequence: Synthetic coding sequence
atggctgacaacttttcgctccatgatgcactctcgggcagcggaaatccaaatccacagggttggccaggcgcatggggaaaccaacctgcaggtgcaggaggataccctggtgcaagctacccaggagcatacccaggccaagcccctccaggcgcatacccgggacaagctcctcccggggcataccctggggcacccggcgcataccccggcgcacctgccccgggagtctaccctggacctccttcaggtcccggagcgtacccgtcctcaggacaaccatcggctaccggagcataccctgccactggaccatacggagcgccagccggaccacttatcgtgccatacaacctgccactccctggaggtgtcgtgcccaggatgcttatcaccattctcgggaccgtgaagcctaacgctaaccggattgcccttgatttccagaggggtaatgatgtggccttccacttcaatccacgttttaacgagaataaccggagagtgattgtgtgtaataccaagctggataacaattggggtcgagaggagcggcaatcggtctttccttttgagtcgggtaagccatttaagattcaggtgcttgtcgagcctgatcactttaaggttgcagtgaatgacgcacacttgttgcagtacaatcatagggttaagaagctgaacgaaataagtaaactgggaatctccggagacatagaccttacctccgcaagctacactatgatt

SEQ ID NO: 15493 - DNA, 750 bp, Artificial Sequence
  Description of Artificial Sequence: Synthetic coding sequence
atggctgacaatttttcgctgcacgatgcactgagcgggtcaggtaacccgaaccctcagggatggccgggtgcatggggaaatcagcccgccggcgcgggagggtacccgggagcctcctacccaggagcctatccaggacaggcgccaccaggcgcgtaccccggtcaagcgcctccgggtgcctatccgggtgctccgggggcgtaccctggagcacctgcccctggagtgtacccgggcccgccctcagggcccggagcctacccgtcgtctggccaaccgtcagccacgggagcttacccagctaccggaccgtacggagccccggccggcccgctgatcgtgccatacaatctgccgctccctggcggagtcgtgcctcggatgctcatcactatcctgggcactgtcaagccaaacgcaaatcgcatcgccttggatttccagcgcgggaatgatgtcgctttccacttcaacccgcggtttaacgagaacaacaggagagtcattgtgtgcaataccaaacttgacaataactggggaagagaagagcggcaatccgtgttcccattcgaaagcggaaagccatttaaaatccaggttctggtggagcccgatcacttcaaggtggccgtgaacgacgcgcatctgctccagtacaaccatcgcgtgaagaagctgaacgaaatctcgaagctcggaatttccggcgacatcgacttgacttcggcaagctacaccatgatc

SEQ ID NO: 15494 - DNA, 750 bp, Artificial Sequence
  Description of Artificial Sequence: Synthetic coding sequence
atggcagataatttctccctgcacgacgctctcagcgggtccgggaatcctaatccgcaaggctggccaggcgcatggggaaaccaacctgctggcgcaggcggctatccaggcgccagctatccgggagcctacccgggacaggcccctcctggagcctaccctggccaagccccacccggggcttacccaggggccccaggcgcctatccaggggccccagccccaggggtttatcccggacctccttctggccctggggcctacccctctagcggacaaccgtccgccaccggagcctaccccgctaccgggccatatggtgcccccgctggacccctgatcgtcccttacaatctgccgcttcctggtggcgttgtgccgagaatgctgataaccattctcgggaccgtcaagcctaacgcaaaccgcattgcactcgacttccagcgaggaaacgacgtagcattccacttcaaccccagattcaatgagaacaatcggcgagtaattgtgtgcaacactaaactggataataattgggggagagaggagagacaatccgtgttcccctttgagtcaggaaagccatttaagattcaggtacttgtcgagcccgaccacttcaaggtggccgtcaatgacgctcatctactccagtataatcatagggtgaagaaactgaatgaaatctccaagctgggaattagtggcgacattgatttgacttccgcaagttacacaatgatt

SEQ ID NO: 15495 - DNA, 750 bp, Artificial Sequence
  Description of Artificial Sequence: Synthetic coding sequence
atggccgataacttctccctgcatgacgccctttcgggaagtggtaaccctaacccacaaggatggccaggtgcttgggggaatcaaccagcaggagctggcggctaccctggcgcatcctaccccggcgcctaccccgggcaagcgcctccgggcgcatacccaggccaggccccacccggagcttaccctggggcaccaggagcataccctggagctcctgctcctggagtgtacccgggaccaccttcggggcccggtgcgtatccttcatcgggacagccctcggcgactggtgcatacccagcaaccggaccttacggtgcccctgcaggcccactgattgtgccatacaatctgcctcttcctgggggagtggtgccccgcatgcttataactatccttggtaccgtgaaaccaaacgcaaatcgcattgccctggattttcaaaggggtaacgacgtggcatttcatttcaacccccgttttaacgagaataacagacgcgtgattgtgtgtaatactaagttggacaataactggggtagagaagaacgccagtcggtgttccctttcgaaagcggcaaaccatttaagattcaagttctggtggagcccgaccactttaaggtggccgtaaacgatgcgcatctccttcaatacaaccacagggtgaagaaacttaatgagatctcaaagctgggtatctccggcgatattgaccttacttcagcgtcctataccatgatc

SEQ ID NO: 15496 - DNA, 750 bp, Artificial Sequence
  Description of Artificial Sequence: Synthetic coding sequence
atggccgacaatttttcactgcatgatgctttgtcaggctctggaaatccgaatcctcaggggtggcctggcgcatggggtaatcagcccgctggagctggaggttacccgggagcttcatatcccggcgcttaccccgggcaagcgccgcccggggcataccccgggcaggcaccccccggcgcctatccaggtgcacctggggcgtaccctggtgcacctgctccgggagtatacccgggaccaccatcagggccaggcgcttaccccagttctggccaaccgtcagccaccggggcctaccctgcgactggcccgtatggggccccggccggacccttgatcgtgccctacaacctgccactgccaggcggcgtcgtacccaggatgcttattacgatcctcggcacggttaagcctaatgctaatcgcatcgctctggatttccagagagggaacgatgtcgcattccacttcaaccccagatttaacgagaacaaccggagagtgattgtgtgcaataccaagctggataacaattggggccgcgaggagagacaaagtgtgttccccttcgagagtgggaagccatttaagatccaggtgctcgtggaaccagatcattttaaagtcgcggtgaacgacgcacacctgttgcagtacaatcatcgagtcaaaaaattgaatgaaattagtaagctcgggatttctggggacatagacttgacctccgcaagttacaccatgatc

SEQ ID NO: 15497 - DNA, 750 bp, Artificial Sequence
  Description of Artificial Sequence: Synthetic coding sequence
atggctgataacttttccctgcacgacgccctgagcggctccggaaatccgaacccgcagggctggccgggggcgtggggtaatcagccagcaggagcaggcggatacccaggcgcgtcgtatcctggcgcgtacccagggcaagctcctcctggcgcatacccgggacaggctcctccaggcgcctacccaggcgccccaggcgcttaccccggagcaccagcacccggagtgtatccagggcccccctccggaccgggcgcctacccgtcatccggacagccgtccgccaccggagcctatccggcgaccggcccatatggagcccctgccgggcctcttatagtcccttacaacctgccactgccaggcggcgtcgtgcctcgcatgctgatcactatcttgggtaccgtgaagcctaacgcgaacagaatcgccctggacttccaacgcggaaatgacgtggccttccatttcaacccgcgcttcaatgaaaacaatcgccgcgtgatcgtgtgcaataccaaactggataacaactggggtcgggaagagcggcaatccgtctttccgttcgaatcaggaaaaccgtttaagatccaagtcctggtggaaccagaccacttcaaagtggccgttaacgatgctcatctgctgcagtacaatcaccgcgtgaagaagctgaatgaaatttcgaagctcggaatttcaggagacatcgatcttacctccgcatcatacactatgatc

SEQ ID NO: 15498 - DNA, 750 bp, Artificial Sequence
  Description of Artificial Sequence: Synthetic coding sequence
atggccgacaacttttctctgcatgacgcgctttctgggagcggcaacccaaatccccaaggctggcccggggcctgggggaaccagcctgcgggcgcaggagggtatcctggggcctcctaccccggcgcgtatcctggacaagcaccccccggtgcatatcctggccaggctccccccggggcctatccaggagccccaggcgcttacccgggcgcgcccgctccgggcgtctatccaggtccccctagtgggccgggggcatatccgagctccggccagccaagtgccacaggagcctatccagccaccgggccttatggcgctcctgcaggacccctcatcgtcccttacaacctgccgctgccaggcggggtggtgccaaggatgcttataacaattttgggcactgtgaagcccaacgccaaccgaatcgctctggactttcaacggggcaacgacgtagccttccactttaaccctaggtttaatgaaaataaccggcgggtgatcgtgtgcaataccaaactggacaataattggggccgggaggagagacagagtgtttttcccttcgagtctgggaaacctttcaaaatccaggtgctggtggagccagaccacttcaaggtggctgtgaacgacgcacacctgcttcagtacaaccatcgggtcaagaaactgaatgaaatcagtaagctcgggattagcggtgatattgacctgacttccgcttcctatacaatgatc

SEQ ID NO: 15499 - DNA, 750 bp, Artificial Sequence
  Description of Artificial Sequence: Synthetic coding sequence
atggccgacaatttctcactgcatgacgccctgtccgggtctggaaaccctaatcctcagggatggccgggagcatggggcaaccaaccagcaggcgcaggcgggtaccctggggcatcgtaccccggagcataccccgggcaagcacctcctggagcatatccgggacaagcgcccccaggggcatacccaggggcaccaggtgcatatcccggagctcccgcacctggagtgtatccagggcctccctccggcccaggtgcgtatccgagctcgggtcaaccctcggcaactggtgcttaccccgcgaccggaccatacggtgcacctgccggcccccttatagtgccttacaacctgccgctgcctggaggcgtcgtgccaaggatgcttattaccatcctgggtactgtgaagcctaatgcaaataggattgcattggatttccagagaggaaacgatgtggcttttcacttcaatcctaggtttaacgagaacaatagacgcgtgatcgtgtgtaacaccaagttggacaataactgggggcgcgaagaaagacagtccgtgtttcccttcgaatcgggtaaacctttcaaaattcaagtgctggtcgagcccgaccatttcaaggtggcagtcaacgatgcacacctcctccaatacaaccatagagtcaaaaagctgaatgaaatctcaaagctgggtatttccggtgatatcgaccttacctcagcgtcctatacgatgatt

SEQ ID NO: 15500 - DNA, 750 bp, Artificial Sequence
  Description of Artificial Sequence: Synthetic coding sequence
atggccgacaatttttccctccatgacgctctctccgggtcgggtaaccctaatcctcaaggttggcctggcgcttggggaaaccagcccgctggggctggcggataccctggagctagttatccaggcgcctatccaggccaggccccccccggagcctaccccggtcaggctccacccggggcttacccaggagcccccggtgcgtatcctggcgctcctgcgccaggcgtctaccctggtccacccagtggccccggagcctaccctagttctggccagccatctgcaactggagcatatccggcaaccggcccgtacggcgcaccagcagggcctctgattgtgccctacaacctgccactgcctggcggagtcgtgcctcgtatgttgataacaatcctggggacagtcaagcccaacgctaatagaattgcactggacttccagcgcggaaatgacgtcgctttccacttcaaccccaggtttaatgaaaacaaccggcgagtgattgtttgtaacacaaagctggacaacaactgggggagggaggaaaggcagtctgtttttccatttgagtccggcaagcctttcaagattcaggtactggttgaacccgaccatttcaaggtagcagtgaatgacgcacacttgttgcagtacaaccaccgcgtgaaaaaactgaatgaaatttccaagcttggaatctccggcgatattgatctgacttcagcatcttacaccatgatc

SEQ ID NO: 15501 - DNA, 750 bp, Artificial Sequence
  Description of Artificial Sequence: Synthetic coding sequence
atggctgacaacttttcgcttcacgacgccctcagcggatcggggaacccgaatcctcagggatggccgggggcttggggcaatcagccagccggagccggcggatacccaggagcgtcgtacccaggcgcgtaccccggccaggctccgccgggagcttaccctggacaagcaccgccgggcgcctacccaggtgcgccaggcgcctacccgggcgccccagcacctggcgtctatcctggaccaccaagcggaccgggagcctaccccagctcgggacagcctagcgcgactggagcgtacccggcgaccggcccctatggagcacctgcaggccccctcatcgtcccgtacaacctgccgctgcccgggggagttgtgcctaggatgctgatcaccattctgggaaccgtgaagccaaacgcaaaccgcattgcactggacttccagagagggaatgatgtggcattccactttaacccgcggttcaacgagaataaccggagagttatcgtctgcaacaccaagttggacaataactgggggcgcgaggagagacaatcggtctttccgttcgaatccggtaagcctttcaagattcaggtgctggtcgagccagaccactttaaggtcgctgttaacgacgcacaccttttgcaatacaaccaccgggtgaaaaaactgaatgaaatctcaaagctgggcattagcggggacatcgatctgacgtccgcgtcgtacactatgata

SEQ ID NO: 15502 - DNA, 750 bp, Artificial Sequence
  Description of Artificial Sequence: Synthetic coding sequence
atggccgacaacttctcgttgcatgatgccctctcagggagcggtaacccaaacccccagggctggcccggagcttgggggaaccagccggcaggagcggggggctatcccggcgcttcctaccccggagcgtaccccggccaagctcctcctggcgcctaccccggacaggcgcccccaggcgcatatcccggggcaccaggcgcttatcccggggccccagctcctggcgtatatccaggaccacccagcggccctggcgcctatccatcatccggacagccgtctgcaaccggggcgtaccccgcgaccggaccatatggcgcccctgcaggccccctcatcgtcccttataatcttcccctccctggtggagttgttcctagaatgctcattacgatccttggtactgtgaagccaaacgcgaatagaatcgctttggattttcagcgcggaaacgacgtcgcttttcatttcaatcctcgcttcaatgaaaataaccgccgagtgattgtctgcaatacgaaactcgataacaattggggacgggaggaaaggcagtcagttttcccatttgagagcggtaagccctttaagatccaggttttggtcgaacctgatcatttcaaggtcgctgtcaacgacgcccacctactgcaatacaatcaccgcgtaaaaaaactaaatgaaatctcaaaactcggcataagtggggatattgatcttacttctgcgagttataccatgata

SEQ ID NO: 15503 - DNA, 750 bp, Artificial Sequence
  Description of Artificial Sequence: Synthetic coding sequence
atggccgataacttttccctacacgatgctttatccggttccgggaaccccaacccccagggttggccgggggcctggggtaaccagcctgccggagcaggagggtaccctggagcctcctaccccggcgcttatcctggtcaggcaccaccgggagcctatcctgggcaagctcctccgggcgcatatccaggggccccaggggcatatcctggggcgcccgcacccggggtttaccctgggcctcccagtggcccaggtgcgtacccatccagcgggcaaccttcagccacaggtgcatatcccgccaccggcccttacggagcccctgctgggcccctgatcgttccttacaatcttcccctgcccggaggagttgttccccggatgctgattaccatcctgggcacagtcaaaccaaatgcaaacaggatcgcgctggatttccagcgaggaaatgatgtagccttccactttaaccccaggttcaatgaaaacaataggcgcgtcatagtttgcaatacaaagctagataataactggggtagagaagaacggcagagtgtattccctttcgagagcgggaagccctttaagatccaggtgctagttgaaccggaccacttcaaggtcgcagtgaacgatgctcatctcttgcagtacaaccatcgggtaaagaagctcaatgagatttccaaactcggtatctctggagacatcgatctcactagcgcctcatacactatgatt

SEQ ID NO: 15504 - DNA, 750 bp, Artificial Sequence
  Description of Artificial Sequence: Synthetic coding sequence
atggccgataacttctccctccacgacgcactgtctggaagtggcaatcccaaccctcaaggatggccaggagcctggggaaatcaacccgcaggcgccggaggctaccctggagcaagttatcctggggcgtacccaggtcaggctccccccggagcatacccagggcaggcaccccctggcgcctatcctggcgcccccggagcctatcccggagcccccgcgccaggagtataccccggcccaccatctgggccaggtgcatatccatcttcgggccaaccgtccgcgactggcgcttatcctgccacaggcccctacggcgctccagcaggacccctgatcgtgccgtataatctcccactgccgggcggggttgtgccgcgaatgcttataaccattctcggaaccgtgaaacctaatgcaaaccgcatcgcccttgactttcagagaggaaatgacgtggccttccacttcaatccccgttttaatgagaataatcgaagagtgatcgtgtgcaatacgaagctggataataactgggggcgtgaagaaagacagtcagtatttccgtttgaatccggaaaacctttcaaaatccaggtcctcgtagagccagatcatttcaaagtggcggtgaatgacgctcacctgctacagtacaaccacagggtgaaaaagttaaacgagatatccaagcttgggatatccggagacatcgaccttactagcgcctcatataccatgatt

SEQ ID NO: 15505 - DNA, 750 bp, Artificial Sequence
  Description of Artificial Sequence: Synthetic coding sequence
atggctgacaatttctcgctgcacgatgctctctcgggcagcggcaacccgaacccacagggctggccgggagcctggggaaaccaaccggcaggcgccggaggataccctggtgcgtcttacccgggcgcctacccaggacaggcgcctccgggtgcctatccgggtcaggccccaccaggagcgtatccgggcgccccgggtgcgtacccaggggcgccggccccaggcgtgtacccgggaccgccgtcaggacccggcgcttatccgtcgtcaggccagccatcagccaccggagcttacccggctactggaccatatggtgccccggcggggccccttattgtcccgtacaacctgcccctgccaggcggagtcgtcccaagaatgctgatcaccatcctcggaactgtgaagccaaatgcaaatcgcatcgctctcgatttccagcgcggtaacgacgtcgccttccatttcaacccgcggttcaatgagaacaaccggcgggtgatcgtgtgcaataccaagctcgataacaattggggacgcgaagaacggcaatccgtgtttccatttgagtccggtaaaccattcaagatccaagttctggtcgagcctgatcatttcaaagtggccgtcaacgacgcacacctcttgcaatacaatcaccgcgtaaagaagctgaatgaaatctcgaagttggggatttcgggagacatagacttgacctcagcctcctacactatgatt

SEQ ID NO: 15506 - DNA, 750 bp, Artificial Sequence
  Description of Artificial Sequence: Synthetic coding sequence
atggcagataacttttctctccacgacgcactcagcgggagcgggaatcccaacccccaaggctggcctggcgcctggggaaaccagccagcaggcgcagggggctatccaggcgccagctatccaggagcatatcctgggcaggcacctcctggggcctacccaggccaggcccctccgggcgcctatcctggggcccccggtgcttatcctggagctccggcgccaggcgtttatccaggaccgccaagtggaccaggagcctacccctcaagcggacaacccagcgcgacaggcgcttaccccgctacggggccctacggggcccccgcagggcccttgattgtgccttataaccttccattgcccggaggggtggtgccgcgtatgttgatcaccatattgggaacagtgaaaccaaacgccaacaggattgccctggatttccagcggggcaatgatgtggcttttcactttaacccaagatttaatgagaataatcgacgtgtaatcgtgtgcaatacaaaattagataacaattggggacgcgaggagagacaatccgtgtttccattcgagagtgggaagcccttcaaaatccaggttctagtggagcccgatcactttaaagtcgcagtcaatgatgcccacctactccaatataaccaccgggtgaagaaattgaatgagatatccaaactggggatcagtggggacatcgatctgacatcagcctcttataccatgatt

SEQ ID NO: 15507 - DNA, 750 bp, Artificial Sequence
  Description of Artificial Sequence: Synthetic coding sequence
atggcagataacttttcgcttcacgacgcgctgtcgggttcgggtaaccccaacccacagggatggcccggagcatggggcaaccagccagcaggagcaggaggctaccccggtgcctcatacccaggagcgtaccccggccaagcgcctccgggagcctatcccggccaagcccctcctggagcgtacccaggcgctccaggtgcataccctggagcaccggcgcccggagtgtaccctggtccaccttcaggccctggtgcttacccgtcatccggccagcctagcgcaaccggagcatacccagctaccgggccttacggtgcacctgccggtccacttattgtgccgtacaatctgccccttcccgggggtgtcgtgcctcgaatgctgattactattctggggacggtcaagcccaacgcgaatcgtatagccctggactttcaacgcgggaacgacgtggcatttcatttcaatcctaggtttaatgaaaacaacagaagagtcatcgtctgtaacactaaacttgacaataactggggacgtgaggaacgccagtcggtctttccttttgaatcgggtaaacctttcaaaatccaagtccttgtcgagcccgatcacttcaaagtcgccgtcaacgacgcccatcttcttcaatacaatcaccgagtgaagaagttgaatgaaatctcgaagctgggaatttcgggggatatagatctgacttccgcatcgtacactatgatc

SEQ ID NO: 15508 - DNA, 750 bp, Artificial Sequence
  Description of Artificial Sequence: Synthetic coding sequence
atggccgataacttctctcttcatgacgccctctcgggttccggcaaccctaaccctcagggctggcctggcgcatggggcaaccagccggccggtgccgggggttatcctggggcatcctacccaggtgcctaccctggccaggccccccctggagcataccccggccaggcgccccctggagcctatccaggtgcgcccggagcctaccccggcgcgcctgctcccggtgtctaccctggcccaccttctggcccaggagcctatccgtcttcgggtcagcccagtgctacgggcgcgtacccagccaccggtccgtacggcgcccccgccggtccccttattgttccatacaacctcccgcttcccggtggcgttgtcccgcgaatgctcatcaccatcttgggcactgtcaagcctaacgcaaaccgtatcgccctcgacttccagcgtggcaatgatgtggcattccatttcaatccccgcttcaatgagaacaatcgccgggttatcgtgtgcaacactaagttagacaataactggggacgcgaggaaaggcaaagcgtcttccccttcgagtctggtaagcccttcaaaattcaggtccttgttgagcccgatcacttcaaagtcgccgttaatgatgcccacctgctccaatataaccaccgcgtcaagaagctcaatgagatcagtaagcttggtatctcgggtgacattgacttgacatctgccagctataccatgatc

SEQ ID NO: 15509 - DNA, 750 bp, Artificial Sequence
  Description of Artificial Sequence: Synthetic coding sequence
atggccgacaacttcagcttgcacgatgcactcagcggctcagggaaccccaaccctcaaggctggcccggggcctgggggaaccagccagcaggcgccggcggatatcccggggcaagctatccgggagcctaccccggtcaggccccacctggcgcctaccccgggcaggctccgccgggggcatatcctggagcgccaggggcatatcctggagcccccgcccctggggtatatcctggaccaccttcaggcccgggagcttaccccagcagcggccaaccatccgcaaccggcgcatatcccgctaccgggccgtacggtgctcccgcaggacccctcattgtgccgtacaatctgccattacccggcggagtggttcccagaatgttaatcacaatcttggggacagttaagccaaacgccaaccggattgctcttgatttccagcgagggaacgatgtggcctttcattttaaccccaggttcaatgagaacaatcggagagtgattgtgtgtaatacaaaactggataataactggggaagagaagaaagacagtctgttttccctttcgagagcgggaagcccttcaaaatacaagtccttgtggaacctgatcacttcaaggttgctgttaatgacgcacacctgctgcagtacaaccaccgagttaagaagctgaacgagatctccaagctggggatttccggagatatcgatttgacttcggcatcctatacaatgatc

SEQ ID NO: 15510 - DNA, 750 bp, Artificial Sequence
  Description of Artificial Sequence: Synthetic coding sequence
atggcagacaacttctcgctccacgatgccttgagcggatcaggtaatccgaatccacaaggttggcccggagcttggggtaatcagccagccggggcgggcggatacccaggcgcatcttaccccggagcctatcccggccaagcgcccccaggtgcttatccgggtcaggctccaccgggcgcatacccgggggctccaggcgcatatcccggggcgccggccccgggagtgtacccaggccccccatccgggcctggggcatacccttcttccgggcaaccctcagccacgggcgcttacccggcgacaggcccgtatggggcccctgccggtccactcattgtcccctacaacctgccgctcccaggaggagtggtgccacgcatgctgattaccattctcgggaccgtcaaacctaacgctaacaggattgccctagacttccagagggggaacgatgtggcattccactttaatccccgcttcaatgaaaacaataggcgggttattgtgtgcaataccaaattggataataattggggaagggaagaacgccaaagtgtgttccctttcgagtccgggaaacctttcaagatccaggtgttggtggaacctgaccacttcaaagtagccgtgaatgatgcacacctgctgcagtacaaccatagggtaaagaagctcaacgagatctctaagctggggatctcaggcgatatcgatctaacatcagcatcctacacaatgatc

SEQ ID NO: 15511 - DNA, 750 bp, Artificial Sequence
  Description of Artificial Sequence: Synthetic coding sequence
atggcagataacttttctctccatgacgccctgtcaggcagcgggaaccccaacccacagggctggcccggtgcatgggggaaccaacctgccggtgccggaggataccccggcgctagctatccaggggcttatcctggccaagctcctcccggagcatatcccggccaggctccacccggcgcctatccaggagccccgggcgcttatcctggagctccagcccccggagtgtaccccgggccccccagtggacctggagcctacccatcttccggccaaccttctgctaccggtgcctatccagcaaccgggccatacggcgcccccgctggccctttaatcgtgccctacaacctaccactcccaggcggtgtggtgccccgcatgctgattacaattctgggaacagtcaaaccaaacgcaaatagaatagccctcgattttcaaaggggtaacgacgtggctttccacttcaatcctaggttcaatgagaataaccggcgcgttatcgtttgcaacacaaaactggataacaactgggggagagaggaacggcagtccgtcttcccattcgagtccggcaagccttttaaaattcaggtgttggtcgaaccagatcacttcaaagtagccgtgaatgacgctcatttgctgcagtacaaccacagggtaaagaagctgaacgagatttccaagctcgggatcagtggcgatatcgacctgaccagcgccagttatactatgatt

SEQ ID NO: 15512 - DNA, 750 bp, Artificial Sequence
  Description of Artificial Sequence: Synthetic coding sequence
atggcagataacttctcccttcatgatgcactgtccggatcaggaaacccaaacccacaagggtggcccggggcttgggggaaccagcctgccggagcgggtggctatcctggcgcaagctaccctggtgcataccctgggcaagcgcctccgggtgcctacccgggtcaggccccacccggagcgtacccgggcgcccccggagcatacccaggtgcccctgcaccaggagtctacccggggcctcccagcggtccaggagcgtacccctcatcaggacagccttcggcaacgggagcatatccagccaccggcccttacggagccccagcaggcccacttatagtgccgtacaacctgccactgcctggtggagtcgtccctcgaatgctgatcaccattctgggaaccgtcaagcctaatgcgaaccgcattgcactcgatttccaacgtgggaacgatgtcgcgtttcacttcaacccacggtttaatgagaataatcgacgggtgattgtgtgtaatacgaagctcgataacaattggggtcgcgaggaaagacaatccgtgtttcctttcgaaagcggtaaaccattcaagattcaagtgctcgtcgaacccgatcactttaaggtggccgtgaatgatgctcatttgcttcagtacaatcatcgggtgaaaaagctcaatgagatcagcaagttgggaatttcaggcgacatagaccttacctccgcttcctatactatgatc

SEQ ID NO: 15513 - DNA, 750 bp, Artificial Sequence
  Description of Artificial Sequence: Synthetic coding sequence
atggccgacaacttctctctgcacgacgcactgagcggttctggtaatcctaatccccaaggctggccgggggcgtgggggaatcagcctgcgggggcggggggttatccaggagccagctacccaggggcttacccaggtcaagccccacccggcgcctatcccggacaagcgccacccggggcctaccccggagcacccggagcatacccaggcgctcctgccccaggcgtctaccctggtccacccagcggcccaggagcttatcccagttcggggcagcctagtgccactggagcgtaccctgcgacagggccctacggcgcccccgctggaccactgattgtgccatataatttgcctttgcccggtggcgtggtgcccagaatgctgattaccatcctgggcacggttaagcctaatgccaaccgaattgcattagatttccagagaggcaacgacgtagcatttcacttcaatccaaggtttaacgagaataatcgccgcgtgattgtgtgcaacactaagttggataataattgggggcgagaggaaagacagagcgtcttcccctttgagtccggcaagccatttaagattcaggtactggttgaaccagatcattttaaagtggcagtgaacgatgcacatctgctgcagtacaatcatcgggttaagaagctgaacgagatttctaaactaggtatttctggcgatatcgacctcaccagcgcaagctataccatgatc

SEQ ID NO: 15514 - DNA, 750 bp, Artificial Sequence
  Description of Artificial Sequence: Synthetic coding sequence
atggccgacaacttcagcctacatgacgcgcttagtggcagcggaaacccgaacccccaaggttggcccggagcatggggtaaccaacccgctggggctggaggctaccccggagcaagctacccaggcgcctacccgggtcaggcgccacccggggcttaccccggacaggcccctccaggagcttatccaggcgctcctggcgcttatccaggcgctcccgcacccggagtatatcccgggcccccctcagggcctggggcgtatcctagtagcggacaacccagcgccaccggcgcataccctgctaccggcccgtatggagcaccagcgggccccctgatagttccgtacaatctgcccctgccggggggtgttgtaccgaggatgctgatcaccatcctcggaactgtgaaacccaacgccaataggatagcacttgatttccaaaggggcaacgatgtcgcctttcactttaacccaagatttaatgagaacaacaggagagtgatcgtctgtaatacaaaactggacaacaactggggcagagaagagcgccaatcagtctttcctttcgagagtggaaagcctttcaagatacaggtgttggttgaacctgatcatttcaaagtcgcagtgaatgatgcccacctgctgcagtataatcatagggttaaaaaactgaacgagatctccaagctgggcatctccggcgatatcgatctgacctccgcaagctataccatgatc

SEQ ID NO: 15515 - DNA, 750 bp, Artificial Sequence
  Description of Artificial Sequence: Synthetic coding sequence
atggcggataactttagccttcatgacgccctttcgggttccggtaaccctaaccctcaagggtggccaggcgcatggggtaaccaaccggccggagcaggtggatacccaggtgcttcgtacccgggggcgtacccgggccaggcaccccccggcgcataccctgggcaagctcctcctggcgcttacccaggcgcccctggtgcttaccctggggcacctgcacccggggtgtatccaggacctcccagcgggcccggagcctacccatctagcggacagcctagcgcaactggagcatacccggccaccggtccatacggggcaccagcaggaccactgatcgtgccctacaaccttccattgccgggtggtgtggtcccgcggatgctcataactattctgggcacggtgaagcctaacgcaaatcgaattgcgcttgattttcaacggggaaacgatgtggcattccatttcaaccctaggttcaatgagaataaccgcagagtgattgtctgtaataccaaactcgataacaattggggaagggaagagaggcagtcagtgtttccatttgagtcgggcaagccattcaagattcaggtgctggtcgaaccggatcactttaaggtcgcagtgaacgacgcacatctgctgcagtacaaccaccgggtcaagaagttgaatgagatatccaagctgggtatttcaggggacattgatcttacctcggcatcctatactatgatt

SEQ ID NO: 15516 - DNA, 750 bp, Artificial Sequence
  Description of Artificial Sequence: Synthetic coding sequence
atggccgataacttcagtttgcacgatgctttaagtggaagtggaaatcctaatccccaagggtggcccggggcgtggggaaaccagcccgcaggcgctggaggatacccaggggcttcctacccgggtgcctacccaggccaggccccccccggagcatatcccgggcaggctccgcccggggcctatccaggtgcccccggggcctaccccggcgcccctgctcctggggtctatcctgggcccccatctgggcccggcgcttatccctcttcaggccaacccagtgctactggtgcctaccccgcaacaggcccctacggcgcccccgccggccccctgatagtgccatataacctcccactgcctggcggggtggtccccaggatgctcatcaccattcttggcactgtgaagcccaacgcgaacaggatagccctggatttccagcgaggaaatgatgtcgcgtttcacttcaacccccggtttaatgaaaataacagacgagtcatagtctgcaacaccaaacttgacaacaattgggggcgcgaagagcgtcaatccgttttcccctttgagtctggcaaaccatttaagatccaggtattggtggagccagatcatttcaaagtagcagtgaacgacgcccacttgttgcaatacaaccatcgcgtgaaaaaactcaacgagataagcaaactggggatttctggcgatatcgatctgactagcgcatcctacaccatgatt

SEQ ID NO: 15517 - DNA, 750 bp, Artificial Sequence
  Description of Artificial Sequence: Synthetic coding sequence
atggccgacaacttcagtcttcatgatgcacttagtggatcaggaaacccaaatccacagggatggcccggcgcttggggaaaccaaccggctggagcaggagggtatccaggagcctcatatccgggagcttaccctggacaggccccccctggcgcctatccaggccaagctccacccggcgcctatcccggcgcgccaggagcgtatccaggtgcaccagctccaggtgtttaccctggtccaccatcgggcccgggtgcttacccaagctcgggacaaccaagcgcaactggagcatacccagcaacaggaccctatggtgcaccagccggaccacttatagttccatacaatcttcctttgccaggaggtgttgtgccgcgaatgcttatcacgattctgggaacagttaagcctaatgccaatcgtattgctctcgacttccagagaggcaatgacgtagcttttcattttaacccgcggttcaacgagaataataggagggtgatcgtctgtaatactaaactggacaacaattggggcagggaagaacgtcaatctgtgttcccattcgaatctggaaaaccgttcaaaatacaggttctcgttgaaccggaccattttaaagtcgccgtcaatgatgctcacttgttgcaatataatcatcgagtaaaaaaattgaatgagatctcgaagctaggaataagcggagatattgatctaacctcagctagctatacaatgatt

SEQ ID NO: 15518 - DNA, 750 bp, Artificial Sequence
  Description of Artificial Sequence: Synthetic coding sequence
atggcggacaacttcagcctccacgacgcactgtcgggcagcggaaaccccaaccctcagggatggccaggcgcttggggcaaccagcctgctggcgccggaggatacccaggagcgtcatacccgggagcctaccctggccaggcccctccgggcgcctatcccggacaggcgccgcctggtgcatacccaggtgcaccaggggcctaccccggcgctccagcaccgggagtgtaccccgggccaccgtcgggaccaggagcctatccctcctcagggcaaccgtcggcgacgggtgcctacccggcgaccggaccgtacggagcccccgctggtccgctcatcgtgccgtacaacctgccgctccctggaggagtcgtgccgcgcatgctgatcactatcctgggcaccgtgaagccgaatgctaatagaatcgcccttgatttccaacgggggaacgacgtcgccttccacttcaacccgagattcaatgagaataatcggcgcgtgattgtgtgcaacaccaagctggacaataactggggaagagaagagcgccagtcggtgtttccatttgagtccggaaaaccattcaaaatccaagtgctggtagaaccagaccactttaaggtagctgtcaacgatgcgcatctccttcagtacaatcatcgggttaagaagctgaacgaaatttcaaaattggggataagcggtgatatcgatctcacttcggcgagttacaccatgatc

SEQ ID NO: 15519 - DNA, 750 bp, Artificial Sequence
  Description of Artificial Sequence: Synthetic coding sequence
atggctgacaacttctccctgcatgatgcactaagcggctcaggaaacccgaacccccaaggctggccaggcgcgtggggcaaccaaccagctggtgccggcggatatccaggtgcctcgtacccaggggcctacccaggacaggcacctccgggtgcgtaccccggtcaggcgccgccaggagcttaccccggagctccaggcgcctaccctggtgcgccagctcccggggtttacccaggccccccaagcggaccaggcgcgtatccgtcgagtggtcaacccagcgcaactggagcctatccggccacgggcccgtatggcgcaccagcgggacccttgatcgtcccatataatctcccgctgccaggcggcgttgtaccacggatgctgatcacgatactgggcaccgtcaagcccaatgcaaatcggattgcccttgactttcagcgcgggaacgacgtggcattccacttcaaccccagattcaacgagaacaaccggagagttattgtttgcaatacaaagcttgataataattggggccgagaggagcgccaaagcgtgttcccattcgaatcaggcaagccattcaaaatccaagtactagtggaacctgatcactttaaggtagctgtcaacgatgcacacctactgcagtacaaccatcgcgtcaaaaaactgaacgagatcagcaagctagggatatccggagacattgatttgacctcggcaagttacacgatgatc

SEQ ID NO: 15520 - DNA, 750 bp, Artificial Sequence
  Description of Artificial Sequence: Synthetic coding sequence
atggccgataacttctccctgcacgacgccctgtccgggtctggcaatccgaacccccaagggtggcctggtgcttgggggaatcagccggcaggtgccggaggatacccgggagcatcttacccgggcgcttacccaggtcaggcacctcctggcgcgtaccctggacaggccccgcccggagcctatccgggtgccccaggagcatacccgggtgcaccggcacctggagtgtacccgggaccgccgtcgggccctggagcttacccgtcgagcgggcagccgtcggcaaccggagcatatcccgctactgggccgtacggcgccccggcgggacctctgattgtcccgtacaacttgcccctgcccggaggtgtggttccgcgaatgttgatcaccatactggggaccgtcaagcccaacgccaaccggatcgcgcttgatttccagaggggaaatgatgtggcgtttcactttaacccacggtttaacgagaacaatagacgcgtgatcgtgtgcaacaccaaactggacaataactggggaagagaggagcgccaaagcgtgttcccattcgaatcgggaaagccgttcaagatccaagtcctcgttgagcctgaccatttcaaggtggcggtcaacgatgctcacctgctccaatacaaccaccgcgtgaagaagctgaatgagatctcaaaacttgggatttccggcgatatcgatctgacctcggctagctacaccatgatc

SEQ ID NO: 15521 - DNA, 750 bp, Artificial Sequence
  Description of Artificial Sequence: Synthetic coding sequence
atggcagacaatttcagcctccacgacgccctttccgggtccggaaatccaaatcctcaagggtggccgggtgcgtggggaaatcagccggctggagccggtggctaccctggtgctagctatcctggcgcctaccctggacaagcgccgccaggggcttacccggggcaggcacctccaggagcctatcccggcgccccgggggcctaccctggcgccccggctccgggagtctacccaggaccaccatcgggtcctggagcatacccgtccagcggacaaccatccgcgaccggagcgtatccggccactggtccttacggcgctcccgcgggaccactcatcgtcccgtacaacctgccgctccctggaggagtcgtgccgcggatgttgattactatcctcggaaccgtgaagccaaacgccaacagaattgctctcgattttcagagaggcaacgacgtggcgttccatttcaacccgagattcaacgagaataacaggcgcgtcatcgtctgcaataccaagctggacaacaactggggacgcgaggagcggcagtccgtttttccgttcgaaagcggaaagccgttcaagattcaggtgctggtggagcctgaccacttcaaagtcgcagtgaatgatgcacatctcctgcagtacaaccaccgcgtcaagaagctgaatgaaatcagtaaactggggatttccggagacatcgatctcacttccgccagctacaccatgatc

SEQ ID NO: 15522 - DNA, 627 bp, Artificial Sequence
  Description of Artificial Sequence: Synthetic coding sequence
atgggttcagtgagtaatcagcaattcgctggaggttgcgcgaaagctgccgaagaagcccctgaggaggctcccgaagacgccgcccgcgctgcagatgaacctcagctcctgcatggcgccggtatatgcaagtggttcaatgtccgcatgggcttcgggtttctcagcatgactgctcgcgctggagtggccttggatccgccagtagacgtgttcgtgcatcagagcaaattgcatatggaggggttccggtccctaaaagaaggcgaggccgtggagttcacctttaagaagtccgctaaagggctcgagagtatccgcgtgacaggaccaggcggcgtgttctgtataggctctgagcgtcgccctaagggaaaatctatgcaaaaacggaggagcaagggcgaccgatgctacaactgtggcgggctggaccatcatgctaaggagtgtaagttgcctccccaacccaaaaaatgtcatttttgtcagagcataagccacatggtggcatcctgtccccttaaggcgcagcaaggtcccagcgctcaaggaaagcctacttattttagagaagaggaagaggaaattcatagcccaacgttactgcccgaagcacagaat

SEQ ID NO: 15523 - DNA, 627 bp, Artificial Sequence
  Description of Artificial Sequence: Synthetic coding sequence
atgggttccgtcagcaaccaacaatttgcaggtggttgcgcaaaggcagcagaagaggcccctgaagaagccccggaagatgcagcacgagccgcggatgaaccacaactccttcatggagcaggcatctgtaaatggttcaacgtgaggatggggttcggatttctctcaatgacggcccgcgcgggagtggccctggatcctcccgtggacgtctttgtgcatcagagcaagctccacatggagggtttcagatcacttaaggagggcgaggctgtggaatttacttttaagaaatcagcgaagggactggaatctatcagagtcaccggtcctggtggagtgttctgtatcggatccgaacgcagaccaaagggtaagtcaatgcaaaagcggcggtccaagggcgatagatgctacaactgtggtgggttggatcatcatgcgaaggagtgtaaactgcctcctcagcctaagaaatgtcatttttgtcaatcgatatcgcatatggtggcctcctgccccctgaaggcacagcaaggcccatcagcacagggaaaacctacctactttcgcgaagaggaagaagagattcattcccccactctgcttcctgaggcgcaaaac

SEQ ID NO: 15524 - DNA, 627 bp, Artificial Sequence
  Description of Artificial Sequence: Synthetic coding sequence
atgggcagtgtgagcaaccagcagttcgcgggaggatgcgccaaggctgcagaggaagctcctgaggaggcaccagaagatgccgcccgggctgctgacgaaccacaactgctccacggtgcaggaatttgcaaatggtttaatgtgcgcatggggttcggattcctgtccatgaccgcacgggcgggggtggcactggacccacccgtagacgtgttcgtgcatcaatccaagttgcacatggaggggttcagatccctgaaggagggtgaggccgtggagttcaccttcaagaagagcgctaagggactggaatccatccgggtgacgggaccgggaggcgtgttctgtatcgggagcgagaggcggcctaagggtaaatcaatgcagaagagacgctcgaagggagatcgctgctacaattgcggaggactcgatcatcacgccaaggagtgtaagctcccaccacaaccgaaaaagtgccacttttgccagtcgatctctcacatggtcgcatcgtgtccgctcaaggcccagcaaggcccatcagcgcagggcaagccgacctacttccgcgaagaagaagaggagatccactctccgactctgcttccggaggctcaaaac

SEQ ID NO: 15525 - DNA, 627 bp, Artificial Sequence
  Description of Artificial Sequence: Synthetic coding sequence
atgggtagcgttagtaatcagcagttcgccggaggctgtgcaaaggcagcagaggaagccccagaggaggctcctgaagacgctgccagagccgccgatgagcctcagctcctacatggggcgggcatatgcaagtggttcaacgtgcgcatgggtttcgggttcttgagtatgactgctcgagccggcgtggcgctggaccccccagtggatgtgtttgtgcaccaatcaaagctgcacatggaggggttcaggtcattgaaggagggagaggccgtagagttcacattcaagaagagtgccaaagggctcgagtccattcgggttaccggcccgggaggagtgttttgtattgggagtgagcggcgacccaaaggcaagtccatgcagaaacgtagaagcaagggtgacagatgctacaattgtggtggcctggaccatcacgctaaggagtgtaaactgccaccacagcccaagaagtgccatttttgccagtccatatcacatatggtggcgtcctgcccgttgaaagcgcagcaagggccctcagcccagggcaagcccacatacttccgcgaagaagaagaggaaatccattccccaaccctcttacccgaagctcagaac

SEQ ID NO: 15526 - DNA, 627 bp, Artificial Sequence
  Description of Artificial Sequence: Synthetic coding sequence
atggggtctgtttccaaccagcaattcgcagggggatgcgccaaggctgccgaggaagcacctgaagaggctccggaagacgctgcccgcgcagccgacgaacctcagctcctgcacggagccgggatatgtaagtggtttaacgtgaggatggggttcgggtttctgagtatgaccgcccgagccggtgtcgcactagatccacctgtagatgtgttcgtgcaccagtccaagcttcatatggaaggttttagatcccttaaagagggcgaggcagtggagttcacatttaagaagagcgcaaaggggctggaaagcataagggtgaccggtccaggtggtgtgttctgcatcggaagtgaacgcagacccaagggcaagtccatgcaaaaacgccgttccaaaggagaccgatgttataattgcggaggcctcgatcaccatgcaaaagaatgtaagctccccccacagccaaaaaaatgccatttctgtcaatcaatctcacacatggtggcgagttgccctttgaaagctcagcaggggcccagcgctcagggaaagcccacctatttcagagaggaggaggaggagattcatagccctaccctgctgcctgaagctcagaat

SEQ ID NO: 15527 - DNA, 627 bp, Artificial Sequence
  Description of Artificial Sequence: Synthetic coding sequence
atggggagtgtcagcaatcagcagttcgcaggtgggtgcgcaaaggcagcggaggaagcacccgaagaagcccccgaggacgcagcccgggcagccgacgagccccagctactccacggagccggcatctgcaagtggttcaacgtccgcatggggttcggcttcttgagtatgacagcgcgggctggagttgcgctcgacccccccgttgatgtattcgtccatcagtcaaagctgcatatggagggtttcagatcactcaaggaaggagaagccgttgaattcacattcaagaaatctgctaagggcctcgagagtataagggttaccggtcctgggggcgtgttctgcatcggaagcgaaagacgccctaaaggaaaatcgatgcagaagcggagatctaagggtgaccggtgctacaattgcggtggacttgatcatcatgctaaggaatgcaagctgcctccgcagcccaagaagtgtcacttttgtcagtccattagccatatggttgccagctgtccgctgaaagcccaacaaggccctagcgctcagggtaaaccaacctatttccgggaagaagaggaggaaatccattcccccacactgctgcctgaggcacagaat

SEQ ID NO: 15528 - DNA, 627 bp, Artificial Sequence
  Description of Artificial Sequence: Synthetic coding sequence
atgggatcagtatctaaccagcagtttgccggggggtgcgccaaagccgctgaggaagcccccgaggaagcacccgaagatgccgcccgagccgctgacgagccacagcttttacacggagcagggatatgtaagtggttcaatgtgaggatggggtttggatttttgagtatgacagcacgcgccggggtcgccctagatccccctgtggacgtgttcgtacaccaatccaaactgcacatggaaggatttcggagtctcaaagagggagaagccgttgagtttacttttaagaaatccgctaaagggcttgaatccatacgggtgacaggacccgggggggtcttctgcatcgggagtgaaaggcggccaaaagggaagtccatgcagaagcggaggtctaagggggatcgatgctataactgcggagggctcgatcatcatgccaaagaatgcaaactgcctccacaacccaagaaatgccacttctgtcaatccatcagtcatatggtggcctcatgtccactcaaagcacagcaggggccttccgcccagggaaaacctacttattttcgagaggaagaagaggagatccactcacctactcttctgcctgaagctcagaat

SEQ ID NO: 15529 - DNA, 627 bp, Artificial Sequence
  Description of Artificial Sequence: Synthetic coding sequence
atgggaagtgtgtctaatcagcagttcgccggtggatgcgcaaaggccgcagaggaggctcctgaagaagcccctgaagacgctgctagagcagctgatgagcctcagctcctgcacggtgccggcatatgcaagtggttcaacgtgcgtatgggtttcggatttttgagcatgactgccagagcaggcgtagcactcgatccaccagttgacgtttttgtgcaccaaagtaaactgcacatggaaggcttccgctctttgaaggagggagaggccgtggaattcacattcaaaaagtctgccaagggcctcgaaagcatcagggtgaccggtcccggtggtgttttctgcatcggtagtgagcgccgtccaaaaggtaagtccatgcaaaagcgtaggagcaaaggcgaccgctgctacaactgcggtggccttgaccatcacgccaaggagtgtaaactgccaccacagccaaagaagtgccacttttgtcagagtatatctcacatggtcgcttcctgtcccctcaaagctcagcagggtccctcagcccagggtaagccaacatacttcagggaggaagaagaggagatccactcccctactcttctgcctgaagcccagaac

SEQ ID NO: 15530 - DNA, 627 bp, Artificial Sequence
  Description of Artificial Sequence: Synthetic coding sequence
atgggctcggtatcgaaccagcagttcgccgggggatgcgcgaaagccgccgaagaggccccggaggaggcccccgaggatgcggcaagggccgcggatgagccgcagttgctgcatggagcgggcatctgtaagtggtttaacgtgagaatgggattcggattcctttcgatgacggcacgggccggcgtcgccctcgacccaccagtcgacgtgttcgtccaccagtccaaactgcacatggagggattcagatctctcaaggaaggtgaagcagtcgaattcacttttaagaaaagtgctaagggcctcgagagcattcgcgtgactggaccgggaggggtgttctgcatcggatcagaacgtcgccccaagggcaaaagcatgcagaagcggagatcaaaaggagatcgctgttacaactgtggaggattggatcaccacgcaaaggaatgcaaattgccccctcaacctaagaaatgccacttttgccaatccatctcgcatatggtggcgtcctgcccgctgaaggctcagcagggtccgtctgctcaggggaagccaacctacttcagagaagaggaggaagagatccatagccccaccctgctgcctgaagcgcaaaac

SEQ ID NO: 15531 - DNA, 627 bp, Artificial Sequence
  Description of Artificial Sequence: Synthetic coding sequence
atgggctctgtgtccaatcagcaattcgcaggcgggtgcgccaaggctgccgaggaagcccctgaagaggcgcctgaagacgccgcacgggccgccgatgagcctcagctactgcatggtgctgggatttgtaagtggtttaatgtgcggatggggtttggtttcctctccatgacggccagagccggcgtcgccctggatcctccagtcgatgtattcgtgcaccagtccaagctccatatggaggggttccggagtctaaaagaaggtgaggcggtggagtttacatttaagaaatcagccaaaggattggagagcattcgcgtcaccggtcccggtggagtcttctgcatcggcagcgagcgacgacctaaagggaagagcatgcagaaaagacgctccaaaggcgaccgctgctacaattgcgggggtctcgaccatcatgcaaaggaatgcaagctcccgcctcagcctaaaaaatgccatttttgccagagcattagtcatatggtagccagttgcccgctgaaggcccagcagggacccagcgcacagggtaaaccgacatatttccgcgaggaggaagaagagatccactcgcctactctgctccccgaagcccaaaac

SEQ ID NO: 15532 - DNA, 627 bp, Artificial Sequence
  Description of Artificial Sequence: Synthetic coding sequence
atgggaagcgtgtccaaccagcaattcgcgggaggttgcgccaaggctgctgaggaggctccagaggaagcccccgaagatgcggcacgggcggcagatgaaccgcagcttctgcacggggcgggaatctgtaagtggttcaatgtccgcatgggattcggattcttgtccatgactgcaagggccggagtcgcactggaccctccagtggatgtattcgtgcatcagagcaagttgcacatggaaggatttcggtcattgaaggaaggagaagcagtggaattcactttcaagaaaagcgcgaagggtctggagtcaatccgggtcactggtccaggaggagtgttttgcattggcagcgagagacgcccaaagggcaagtccatgcagaaaaggagatccaagggggaccggtgctacaattgcgggggactggatcatcatgctaaggaatgtaagttgccacctcagccgaagaaatgccacttctgccaatcgatttcacacatggtggcctcatgcccgctcaaggcccagcagggaccttccgctcagggcaaacccacttacttccgagaagaggaggaagaaatccatagcccgaccctgctgcccgaggcgcaaaac

SEQ ID NO: 15533 - DNA, 627 bp, Artificial Sequence
  Description of Artificial Sequence: Synthetic coding sequence
atggggtctgtcagcaatcagcaattcgccggcggttgtgcaaaggccgcagaagaagctcccgaagaggcccccgaggatgccgcccgggccgctgacgagccacagctgctgcacggagctggcatctgtaagtggtttaatgtgcgcatgggctttgggtttctctccatgacagctagggccggggtagccctggatccacctgtagatgtgttcgtccaccagagcaagctccatatggaggggttcagatcattgaaagaaggtgaggccgtggaatttacatttaaaaaatctgctaaaggactggagtctatccgggtcacgggacccgggggtgtgttctgcatcgggagtgaacgccgccccaaaggtaagagcatgcagaaacgcaggtctaagggtgatcggtgttataattgcggtgggctcgaccatcatgctaaagagtgcaagttgccaccccagcctaaaaaatgtcatttttgccagagtattagccacatggtcgctagttgtccactcaaggctcaacagggcccgtccgcccaaggcaaaccgacgtacttcagagaggaggaggaggagatacactcacccaccttgcttccggaagcacagaac

SEQ ID NO: 15534 - DNA, 627 bp, Artificial Sequence
  Description of Artificial Sequence: Synthetic coding sequence
atgggatcagtctcaaatcagcagttcgcaggcggatgcgcaaaagccgcggaggaggcacccgaagaggccccagaagatgccgctcgcgccgcagatgaaccacagttgcttcatggggcagggatttgtaagtggttcaacgtgcggatgggattcggcttcctgtccatgacagcccgcgcaggcgtcgccctggatcctccggtggatgttttcgtgcatcagtctaaacttcatatggagggattccgttccctgaaagagggggaggccgtggaattcactttcaagaagagcgccaagggcctagaatccatccgcgtgaccggtccagggggggtgttctgtattgggtcagagcgccgtccaaaagggaagtctatgcagaagaggcgttctaagggagatagatgttataactgtggaggtttggatcatcatgctaaggagtgcaagttacctccccagcctaagaagtgtcatttctgccaaagcatctcgcacatggttgctagctgccctctgaaggcgcagcaggggccttccgcccaaggcaaacccacctatttccgagaagaggaggaagaaattcactctcctactctgctccccgaggcacaaaac

SEQ ID NO: 15535 - DNA, 627 bp, Artificial Sequence
  Description of Artificial Sequence: Synthetic coding sequence
atgggtagtgtgtctaatcagcagtttgctggcggctgtgctaaggccgcggaggaggcacctgaggaagctccagaggacgcagcgagagccgctgacgaaccccaacttctgcacggcgccggaatttgtaagtggtttaatgtcagaatgggcttcggcttcctgagcatgactgcccgagccggcgtggcgttggatcctcccgtggacgtgttcgtacaccagtccaagctgcatatggaaggatttcgtagcctgaaagagggcgaagcagttgagtttacatttaaaaagtctgctaagggactggagtccatccgagtgactggaccgggtggagtcttttgcatcggttccgagcggcgacctaagggaaagtccatgcagaagagaaggagcaagggggacaggtgctataattgcggtgggctcgatcaccacgccaaggagtgtaagctcccacctcagccaaaaaaatgtcacttctgccaaagcataagccacatggtagcttcctgtcccttaaaagcacagcagggcccctctgcccaagggaaacctacttactttagggaggaggaggaggagatccactcccctacactgctgcctgaagcacagaac

SEQ ID NO: 15536 - DNA, 627 bp, Artificial Sequence
  Description of Artificial Sequence: Synthetic coding sequence
atgggctccgtctccaaccagcagtttgctggtggctgcgccaaggccgccgaggaggcccccgaggaagcacctgaggacgcagcacgggcggctgacgagcctcaactgttacacggtgccggcatttgcaaatggtttaatgttcggatgggcttcggcttcctgtcaatgaccgctagggcaggcgttgctctggaccccccggttgacgtgtttgtgcaccaaagcaagttacatatggaaggcttcagatccctcaaagagggggaggccgtggagtttacattcaagaaatctgctaagggcttggaatctatcagggtcaccggaccgggaggagtattttgcataggcagtgaacgtcgccccaagggtaaaagtatgcagaaacggcgcagcaaaggggacaggtgttacaactgtggcggtctagaccatcacgcaaaagagtgcaaactcccgcctcagcctaagaagtgccatttctgtcagtcaatctctcatatggtggccagttgtcctctgaaggcacagcaggggccctccgcgcagggcaagccaacatactttagagaggaagaagaagagatccattctcccaccctgctgcccgaagcacaaaac

SEQ ID NO: 15537 - DNA, 627 bp, Artificial Sequence
  Description of Artificial Sequence: Synthetic coding sequence
atgggtagtgtgagcaaccaacagttcgcaggagggtgcgctaaagccgcggaggaggccccggaggaggcgcctgaggatgccgcgagggccgccgacgagccacagcttctgcacggagccggaatctgtaagtggttcaacgtaagaatgggatttggctttttgagcatgactgctagggccggcgttgccctggacccacccgtggatgtgttcgtgcaccagtctaagcttcacatggaaggcttcagatccctgaaagagggagaagccgtagagttcactttcaaaaaatcagcgaaaggactggagagcattagagtgaccggaccaggtggcgtgttttgtatagggagtgagagaagaccgaaaggcaagtctatgcaaaagcgaagaagtaaaggggatcggtgttataactgcggagggttggaccaccacgcaaaggaatgtaaactgcctccccagccgaaaaaatgccatttttgtcagtccatatcacatatggttgctagttgcccactgaaggcccagcagggtccctctgcccagggcaagccaacctactttagggaagaagaggaagagatccattcgccaacacttcttcctgaggcgcaaaac

SEQ ID NO: 15538 - DNA, 627 bp, Artificial Sequence
  Description of Artificial Sequence: Synthetic coding sequence
atgggatccgtgtcgaatcaacagttcgcaggaggctgcgcgaaggcggcagaagaagcacctgaggaggctcctgaagatgccgccagagctgcggacgaacctcagctcttgcacggcgccgggatctgtaagtggttcaacgtgcggatgggattcggtttcctctctatgaccgcccgcgccggagtcgccctggatccgccagttgacgtgtttgtgcatcagtcaaagctgcacatggagggatttcgctcccttaaggagggagaggcggtggagttcactttcaagaagtcagccaaaggactcgaatcgatccgggtcaccggtccgggaggcgtgttctgcatcggctcggaaagacggccgaaggggaagagcatgcaaaaacgacgctccaagggcgacaggtgctacaactgcggaggactggaccaccatgccaaagagtgtaaactcccgccacagccgaagaagtgccatttctgtcaatcgatttcccacatggtcgcgagctgccccctgaaagctcagcaagggccatcagcacagggtaagccgacttactttcgcgaagaagaagaggagatccacagcccaacgctgctgcccgaagctcagaac

SEQ ID NO: 15539 - DNA, 627 bp, Artificial Sequence
  Description of Artificial Sequence: Synthetic coding sequence
atgggaagtgtgtctaaccagcagttcgcaggcggctgcgcaaaggctgccgaagaggcaccggaggaagctcctgaagatgccgcacgcgctgctgacgaaccacagctcctgcacggagccgggatttgcaagtggttcaacgtgcgcatgggttttgggttcctttccatgactgcgcgcgccggagtggcgctggaccccccagtggacgtgtttgtgcaccagagcaagttgcatatggagggatttagaagcctcaaggagggagaggctgtggagtttacttttaagaagtcggccaaagggctcgaatcgatccgggtgacgggaccaggaggagtcttttgcatcgggtcagaacggcggcccaagggtaagtcaatgcagaaaagacggtcaaagggcgatcggtgctataactgcggaggactcgatcaccacgccaaagagtgcaagctgccgccacaacctaagaagtgccacttctgccagtccatcagccacatggtcgcgtcgtgcccgctcaaggcccaacaggggccatccgcccagggcaagccgacttacttccgcgaggaagaagaagaaatccattccccgaccctcctgccagaggcccaaaac

SEQ ID NO: 15540 - DNA, 627 bp, Artificial Sequence
  Description of Artificial Sequence: Synthetic coding sequence
atgggtagtgtttcaaaccaacagttcgccggtggctgcgctaaagctgctgaggaggcaccagaggaggccccggaagatgcagcaagagctgcagacgagccacaattgctccatggcgctggcatttgcaagtggttcaacgttagaatgggattcggtttcctttcaatgactgcccgggcaggagttgcccttgaccccccagttgatgttttcgtgcatcaatccaagttgcatatggaggggttcagaagcctcaaggagggtgaagcagtcgagttcacctttaaaaagtctgcaaagggtctagaaagcattagggtcaccggccctggaggtgtgttttgtataggttctgagcgtagaccaaagggcaaaagcatgcagaagcggagatccaagggtgacagatgttataactgcggtggccttgatcaccatgccaaggaatgtaagcttccaccgcaacctaagaagtgtcatttctgtcaatccattagccatatggtcgctagctgcccattgaaggctcagcaagggccatctgctcaggggaagcccacttatttcagggaagaggaagaagagatccactctcctacattgttaccagaagctcaaaat

SEQ ID NO: 15541 - DNA, 627 bp, Artificial Sequence
  Description of Artificial Sequence: Synthetic coding sequence
atggggagtgtgagcaaccagcagttcgcaggtgggtgcgccaaagcggcagaggaggctcccgaagaagcacctgaagatgcggcaagggcagcagatgaaccacaactcctgcacggggcaggaatctgcaagtggtttaatgtgcgcatgggatttggcttcctttcgatgactgccagagccggcgtggcgcttgatccccctgtcgacgtctttgtccaccaatccaaactgcatatggaaggctttaggtcactgaaagagggggaagcagtggaattcacctttaagaagagcgcaaagggacttgaaagcattagagtgaccggaccagggggagtgttttgcattggttcggaaaggcggccaaagggaaagtcaatgcagaaaaggagatcaaagggtgaccgctgttacaactgcgggggacttgatcatcatgcaaaggaatgtaagctccctccccaaccaaagaagtgtcatttctgccaatccatttcccatatggtggcatcctgtccactcaaggcccagcagggaccttctgcgcaaggaaagccaacttactttagagaagaagaggaggaaatacatagccccacccttctccctgaagcacagaac

SEQ ID NO: 15542 - DNA, 627 bp, Artificial Sequence
  Description of Artificial Sequence: Synthetic coding sequence
atgggcagtgtgtctaatcagcaattcgccggcggatgcgcaaaggctgcggaggaggcgcctgaggaggctcctgaggacgccgccagagctgccgatgaacctcaactgcttcacggagccggcatatgtaaatggttcaacgttcgcatggggttcggttttttgagcatgacagcaagggccggcgtggcacttgatcctccggtagacgtctttgttcatcaaagcaagttgcacatggagggattcagaagtttaaaagagggggaagctgttgagttcacctttaaaaaaagtgcaaaaggcttagagagtatccgtgtcacaggccccgggggagtcttttgcattggatcagaacgcaggcccaaaggcaagtctatgcagaaacgtcgcagcaagggagatagatgttataactgtggcggcctggaccaccacgcaaaagaatgcaagctcccccctcagcccaaaaaatgtcacttttgccaatctatcagccatatggtggcttcatgtccactcaaagcacaacagggacccagcgcgcagggcaagccaacttatttccgggaggaggaggaagaaatccattctcctactctcttgcctgaggcacaaaat

SEQ ID NO: 15543 - DNA, 627 bp, Artificial Sequence
  Description of Artificial Sequence: Synthetic coding sequence
atgggatccgtctccaaccaacagttcgcaggaggctgcgcaaaggcggcagaagaggcaccagaggaagcgcctgaagacgcagcgcgggctgccgacgagcctcagctgctgcacggagccggaatctgtaaatggtttaatgtgcgaatgggatttggattcctttctatgaccgctagggccggcgtcgccttggacccgcctgtggatgtctttgtgcatcagtcaaagctgcacatggagggcttccggagcctgaaagaaggggaagccgtagaatttacatttaaaaagtctgcaaagggactggaatcaattagggttaccggccccgggggagtattttgcatcggtagtgagcggcgtcccaaggggaagagcatgcagaaacggcgcagcaaaggagaccggtgttacaattgcggcggcctagaccaccacgccaaggaatgcaagctgccccctcaacctaagaagtgccacttttgccagagcataagtcatatggtggcctcctgcccactgaaagcacagcaaggtccttctgcccagggcaaacctacatactttcgggaggaggaagaagagatacattcacctaccctgctgcccgaagcccaaaac

SEQ ID NO: 15544 - DNA, 627 bp, Artificial Sequence
  Description of Artificial Sequence: Synthetic coding sequence
atgggatcggtgtccaatcagcagttcgccggcggctgtgcaaaggctgcagaggaggcccccgaggaagctcctgaggatgccgcaagagcggctgatgaaccacagctgctgcatggggcgggcatatgtaaatggttcaatgtacggatggggttcggttttctcagtatgactgcgcgagccggcgtggccctggatcctccggtggatgtgtttgttcaccagtcgaaactccacatggagggttttcgttctcttaaagagggcgaggcagtggagtttacctttaaaaagtcagcgaaaggtcttgagtcaatcagagtcactggaccagggggtgtgttctgcatcggttcggagcgccggccaaaagggaagtcaatgcagaagaggcgctccaaaggtgaccggtgttacaattgcgggggcctggaccaccacgccaaagagtgcaagctgcctcctcagcctaaaaagtgccatttctgtcagtcaatctcccatatggtggcctcttgcccacttaaggcccaacagggacccagcgcccagggaaagccaacatacttccgcgaggaagaagaggagatccatagtcctactctgctgccagaggcccagaac

SEQ ID NO: 15545 - DNA, 627 bp, Artificial Sequence
  Description of Artificial Sequence: Synthetic coding sequence
atgggttcggtctcaaaccagcagttcgctggtgggtgtgcaaaagccgccgaggaggcaccagaggaagctcccgaggatgcggcccgtgcggcggacgaaccccagttgctgcacggggcagggatttgtaagtggttcaacgtgcgaatgggatttggattcctctcaatgacggcccgtgcgggagttgcgctggacccccctgttgatgtgttcgtccatcagtctaagctgcacatggagggatttcgatctcttaaggaaggagaagctgtggaattcacgtttaagaagagtgctaaggggttagagtctatccgcgtcacgggccctggtggagttttttgtatcgggtccgagagaagacctaagggcaaaagcatgcaaaagagacgatccaaaggcgaccggtgctacaactgcggtggcctcgatcaccacgctaaagagtgtaagctaccccctcagcctaagaagtgccatttctgtcagtcaatttcgcacatggtcgcgtcgtgtcctctgaaggcgcagcagggtccgagcgcacaggggaaacccacttacttccgagaggaggaggaggagatacacagccccacactactgccagaagcccagaac

SEQ ID NO: 15546 - DNA, 627 bp, Artificial Sequence
  Description of Artificial Sequence: Synthetic coding sequence
atgggatcggtgagcaatcaacaatttgcaggcggttgtgcaaaggcagcagaagaagccccagaggaagcaccagaggacgcagctcgcgcagcagatgagcctcagctgctgcatggagcaggaatctgtaagtggtttaatgtgcggatgggtttcggtttcctttcgatgaccgcacgggcaggggtggctcttgatccgccggtggacgtgttcgtccaccagtcgaaacttcacatggaaggatttcggtcccttaaggaaggcgaggcggtggagtttacctttaagaaatcagcaaagggtctggagagcatcagggtgactggccccgggggagtgttctgtatcggctccgaacgtcgacccaaggggaagtcaatgcaaaagaggcggtcgaagggtgacagatgctacaattgtggaggattggatcatcatgctaaggaatgtaagctccctcctcagcccaagaagtgccatttttgccagtcaatttcccatatggttgcttcgtgtcctcttaaagctcaacaaggaccttccgcacaggggaagcctacgtactttcgcgaagaagaggaagaaatccattcgcccactcttctgccagaagcacagaac

SEQ ID NO: 15547 - DNA, 627 bp, Artificial Sequence
  Description of Artificial Sequence: Synthetic coding sequence
atggggtccgtctccaatcaacagtttgccggcggctgcgctaaggccgccgaggaagcccctgaggaagctcctgaggacgccgcaagggcagctgacgagccacagttgcttcacggggccggaatttgcaagtggttcaacgtacgcatgggtttcggttttctctctatgaccgcacgcgcaggcgttgcactggacccccccgtggacgtcttcgtgcaccagagcaaactgcacatggagggttttaggagcctgaaggaaggggaggcagtcgaattcacgtttaagaagagcgccaaagggcttgaaagtatccgtgtgaccggccccggtggggtcttttgtatagggtccgaacgaagacccaagggaaagagcatgcaaaagagacgcagcaaaggagacaggtgctacaactgcggaggcctggatcatcacgccaaagagtgcaagctgcccccccagcctaagaagtgccacttctgtcagtcgatcagccacatggttgccagctgtcctctgaaggctcagcagggtcccagcgctcagggcaagcctacgtactttagggaggaggaggaagagatccattccccaacacttttgcctgaagcgcagaat

SEQ ID NO: 15548 - DNA, 627 bp, Artificial Sequence
  Description of Artificial Sequence: Synthetic coding sequence
atgggcagtgtttcaaatcagcagttcgctggaggatgcgcaaaggcagccgaagaggctcccgaagaagcgcccgaagacgctgctagggccgctgacgagcctcagttgcttcacggcgctggcatctgcaagtggtttaatgttagaatgggatttggctttctctctatgactgctagggccggcgttgctcttgatcccccagtggatgtgtttgttcatcaatccaaactccacatggagggtttcaggagtctgaaggaaggcgaggctgttgaattcactttcaaaaaaagtgccaaggggttggagtctatccgcgtgaccggccctggaggagtgttctgcatcggaagtgagcgtaggcccaaaggaaagtctatgcaaaaacggaggagcaagggggatcgctgttataattgcggtgggctagatcaccacgctaaggagtgtaaactgccaccccaacccaagaaatgtcacttttgccaaagcatcagccatatggtggcctcctgccccttgaaggctcagcagggccccagcgcgcaggggaagccgacctactttcgcgaggaggaggaggagatccattccccgaccctgctccctgaagcgcagaac

SEQ ID NO: 15549 - DNA, 627 bp, Artificial Sequence
  Description of Artificial Sequence: Synthetic coding sequence
atgggatcagtgagtaaccagcagttcgccgggggctgcgcaaaggcggctgaagaggcccctgaagaggctcctgaggatgctgcaagagccgctgacgaaccacaactgctgcatggcgccggaatctgtaagtggtttaatgtgcggatggggtttgggtttctgtctatgaccgccagagctggagtagccctggatcccccagtggacgtcttcgttcaccaatccaagctgcacatggaagggtttcgctccctgaaggagggggaggctgtcgaattcacctttaagaaatctgccaaagggctggagagtatccgcgtgacaggtcctggcggcgtgttttgtatcggctctgagagaaggcccaagggcaaatccatgcagaaacggcgttccaaaggcgatagatgttataattgcggcgggctggatcatcacgctaaggaatgtaaactgcccccgcagcccaagaagtgccacttctgccagagcatcagtcatatggttgccagctgcccactaaaggcccagcaaggcccctctgctcagggcaagcccacttactttcgggaagaggaggaggaaattcactcccccactcttctgcccgaagcacagaat

SEQ ID NO: 15550 - DNA, 627 bp, Artificial Sequence
  Description of Artificial Sequence: Synthetic coding sequence
atgggatccgtgtcaaatcaacagttcgcaggcggttgtgccaaggccgccgaagaggcgccggaagaggctccagaggatgccgcacgcgctgcggatgagccgcagttgcttcacggcgcaggaatctgtaaatggtttaatgtacggatgggattcgggttcctgtcaatgactgccagggcgggtgttgcactggatcctcctgtcgacgtgtttgtgcaccagtcaaaactccacatggaaggcttccgctccctgaaagagggggaggctgtcgaatttacgttcaaaaagtcggccaagggcctggaatccatacgcgtcactggacctgggggagttttttgtatcggttcggaaagacggccaaaaggaaagtcaatgcaaaaaaggcggtccaagggcgaccgatgctacaactgcggagggctcgaccatcatgctaaggagtgcaagctgccgccccagccgaagaagtgccatttctgccagtcgatcagtcacatggtggcgtcgtgcccactcaaggcccaacagggtcctagcgcgcaaggaaagccaacctacttccgagaagaggaagaagaaattcactcgccgactctgctgcccgaagcccagaac

SEQ ID NO: 15551 - DNA, 627 bp, Artificial Sequence
  Description of Artificial Sequence: Synthetic coding sequence
atgggttcggtgtcgaatcagcagttcgctggtggctgtgctaaagctgccgaagaagcccctgaggaagctccggaggacgccgctcgggccgcggatgaaccccagctgctgcatggagccggaatttgtaagtggtttaacgtgcgcatgggatttggctttctcagcatgaccgcgcgcgcaggagtggctctggatccgcccgtggacgtctttgtgcatcaatcgaagctgcacatggagggattccggtcgctgaaggaaggagaagcagtggaattcaccttcaagaaatctgctaaaggcctggaatcaatcagagtgaccggaccgggtggcgtcttttgcatcggaagcgagcgccggccgaaaggcaaatccatgcaaaagcgccgcagcaagggcgaccgatgctacaactgcggaggactcgatcaccacgccaaggagtgtaagctgcccccacagcctaagaagtgtcatttttgccagagcatctcccacatggtcgcttcgtgtcctctgaaggcacagcaggggccctcagcccaaggaaagccaacttacttccgcgaggaggaagaggagatccactcacctaccctcctgcctgaagcgcagaac

SEQ ID NO: 15552 - DNA, 627 bp, Artificial Sequence
  Description of Artificial Sequence: Synthetic coding sequence
atgggttccgtgtccaaccaacagtttgcaggaggatgcgctaaggcagcagaggaggcaccagaagaagcacctgaagatgctgcgcgtgctgcagatgaacctcaactgctccatggtgcgggaatctgcaagtggtttaatgtgcgtatggggttcggatttctctctatgaccgctcgagccggggtcgcactggaccctcccgtggacgtctttgtccaccagtctaaacttcatatggaagggtttagatcccttaaggaaggagaggcagtggaattcacttttaagaagagcgccaagggcctggagtcgattagggtcactggaccaggaggcgtgttttgtatcggatccgaacgcagacctaagggaaagtcaatgcaaaaaagacggtccaagggcgaccgctgttacaattgtggaggactggatcatcacgcaaaggagtgcaagttgcccccacaaccaaagaagtgtcacttttgtcaatcaatttcacatatggtcgcatcatgtccccttaaagcacagcagggacccagcgcacagggaaagcctacctactttcgcgaagaagaagaggaaattcatagcccgaccctgctgccagaggcacagaat

SEQ ID NO: 15553 - DNA, 627 bp, Artificial Sequence
  Description of Artificial Sequence: Synthetic coding sequence
atggggagcgtctctaatcaacaattcgcgggcggatgcgccaaggctgccgaggaggccccagaggaggcccctgaggacgccgctcgtgcggcagatgagcctcagctgctgcatggggctgggatttgcaaatggtttaacgtgcggatgggattcgggtttttgagcatgacagcgcgcgccggcgtggctctggacccgcccgttgatgtgttcgtccaccagagtaagctccacatggaaggctttcgttcactgaaggaaggcgaggcggtggagtttacgtttaagaaaagtgcaaaagggctggagagtatccgggtgacgggccccggcggggtcttctgcatcgggagcgaaagacggccgaagggaaagagtatgcagaagcggcgcagcaagggcgacaggtgctacaactgcggcggcttggatcaccatgccaaagagtgcaagctacctccccagcctaagaagtgccatttttgccagagcattagccatatggtagcctcttgtcctttgaaggcacagcaggggcctagtgcgcaaggcaagccaacttatttccgagaagaggaggaggaaatccattcccccacgcttctcccggaagcccagaac

SEQ ID NO: 15554 - DNA, 627 bp, Artificial Sequence
  Description of Artificial Sequence: Synthetic coding sequence
atgggtagtgtctcgaaccaacagttcgctggcggttgtgcaaaggcggccgaggaggcccccgaggaagcccctgaggacgcggcccgcgccgctgacgagcctcagctgcttcacggcgctggaatctgcaagtggttcaacgtgcgcatgggtttcggattcctgagtatgaccgctcgcgccggcgtggccctcgatccgcccgtcgatgtctttgtgcaccagtccaaattgcacatggaaggcttccgtagtcttaaggagggtgaggccgttgagtttacatttaagaagagtgcgaagggacttgagtctatcagggtgaccggtccggggggcgtgttctgcatcgggtctgagcgccgcccaaagggcaagtctatgcaaaagcgtaggtcgaagggagacaggtgctacaactgcggaggactcgatcaccacgcgaaggagtgcaagttgccaccccagccgaagaagtgccacttctgccagtcgatctcccacatggtcgcttcctgccctctgaaggcccagcagggaccctccgcgcaggggaagccgacatacttccgtgaggaggaggaggagattcactcacccacgctccttcctgaggcccagaat

SEQ ID NO: 15555 - DNA, 627 bp, Artificial Sequence
  Description of Artificial Sequence: Synthetic coding sequence
atgggatctgtcagcaaccagcaatttgccggaggctgtgctaaagcggcagaagaagctcctgaggaagcacccgaagatgcagcgagagctgcagatgaacctcaactgctgcacggggctggcatttgtaaatggttcaatgtgaggatgggttttgggttcctttccatgactgccagagccggagtcgctctggacccaccggtggatgtgttcgtccatcagtcaaagctccacatggagggtttcagatcccttaaggaaggagaagcagtcgaatttaccttcaagaagagtgcaaaaggactcgaatccatcagggtgaccggtccaggcggtgtgttctgtattgggagcgaaagacgcccaaaaggcaagtcaatgcagaagcgaagatcgaagggcgatagatgttacaactgcggaggactcgaccatcatgcaaaggagtgcaagctcccaccacagcccaagaaatgtcatttttgtcagtccatctcgcacatggtcgcaagctgcccacttaaagctcaacaaggaccctccgcccagggaaaacccacctactttagagaggaagaggaggaaattcatagccctactcttctgccagaagcccagaat

SEQ ID NO: 15556 - DNA, 627 bp, Artificial Sequence
  Description of Artificial Sequence: Synthetic coding sequence
atgggttcggtatcaaaccaacagtttgcaggcggatgcgcaaaagccgcggaagaagctcctgaggaagccccggaagatgccgcccgagccgcggatgagcctcaattgcttcacggggcagggatttgtaagtggtttaacgtgaggatgggattcggttttctgtcgatgactgctcgggcaggtgtggccctggatcctcccgtggacgttttcgtccatcaatccaagttgcacatggaaggatttagaagcctgaaggaaggcgaagccgtcgaatttactttcaagaaatccgcaaaggggctcgaatcgatccgagtcaccggacccggcggggtgttctgcataggatcggaacgccgcccaaagggaaagtcgatgcagaaacgccgatccaagggagacaggtgttacaattgtggcggacttgatcatcacgcaaaagagtgtaagctccccccacaacctaagaagtgtcatttttgtcagtcgatttcccatatggtggcatcctgccccctgaaagcacagcaagggccttcagcacaagggaaaccaacttacttccgcgaagaggaagaggaaattcactcccccaccctcctccctgaagcacagaac

SEQ ID NO: 15557 - DNA, 627 bp, Artificial Sequence
  Description of Artificial Sequence: Synthetic coding sequence
atggggagcgtttcgaaccagcagttcgcaggggggtgtgccaaagccgccgaggaggcacccgaggaagctccagaagacgccgcaagggcagccgacgagccccagctgctccacggcgcaggtatctgcaaatggtttaatgtgcgaatgggattcggcttcctgtctatgactgcgagagctggggtggccttagaccccccagtggatgtatttgtgcatcaaagcaaactgcatatggaaggcttcaggtcgctcaaagaaggggaagccgtggagttcaccttcaagaaaagcgcaaagggcttggagtctatccgagtgacaggcccgggcggagtgttttgcattggaagtgaacggcgaccaaaaggcaaaagcatgcaaaaacgtcggagcaagggtgatcgatgttacaattgcggagggcttgaccatcatgccaaggaatgtaaactgcccccccaacccaagaaatgtcacttttgccagtcaatctcacatatggtcgcgtcttgtcctctgaaagcacagcagggcccaagcgcgcagggcaagcctacttactttagggaggaagaggaggagatacacagtccgaccctactgccggaggctcagaac

SEQ ID NO: 15558 - DNA, 627 bp, Artificial Sequence
  Description of Artificial Sequence: Synthetic coding sequence
atgggctcagtcagtaaccaacagttcgccggtggatgtgccaaagccgctgaagaggctccagaggaggcccccgaggatgccgcccgagccgccgacgagccacaactccttcacggcgccggaatttgtaagtggtttaacgtgcgtatgggcttcggattcctctctatgacagccagggccggcgtggccttagatccccctgtggatgtgttcgtgcaccagtcaaagctgcatatggagggcttccgtagcctgaaagaaggagaggccgtagagttcactttcaaaaagtctgctaagggactggagtcgatccgagtcacaggacccgggggcgttttttgtattggaagcgagaggcggcccaaggggaagagcatgcagaagcgacggagcaaaggagaccgttgttataactgtggcgggttggaccatcacgcgaaggaatgtaagctacccccgcagccgaaaaagtgccatttttgccaatccatcagccatatggttgcttcgtgtccattaaaggcgcagcaggggccatcggcgcagggtaaacccacctatttcagagaggaagaagaggaaattcacagtccaactctgctcccagaagcccaaaac

SEQ ID NO: 15559 - DNA, 627 bp, Artificial Sequence
  Description of Artificial Sequence: Synthetic coding sequence
atgggaagcgtcagcaaccagcaattcgccgggggatgcgccaaggcagcagaagaagcacccgaagaagcaccggaagatgcggctcgggcggctgatgagccacaattgcttcatggggcaggtatttgcaaatggtttaatgtgcggatgggtttcggattcctttcgatgaccgcacgggccggagtcgcgctcgaccctcctgtggatgtctttgtgcaccagtcaaaactgcatatggaaggatttagatccctgaaagaaggtgaggcagtggaattcactttcaagaagtcggccaaagggctcgaatcgatccgtgtcactggaccaggtggtgtcttttgcatcggatccgagcgcagaccgaaaggcaagtcaatgcaaaaacgtcggtccaagggagacagatgttacaattgtggtggtcttgatcatcatgccaaggaatgcaaacttccgcctcaacctaagaagtgccacttctgtcaatcaatttcacatatggtcgcatcctgtcccctgaaggcacaacagggcccttccgcacagggaaagccaacctacttcagagaggaagaggaagaaatccattcgcctactcttctgcctgaggcacaaaat

SEQ ID NO: 15560 - DNA, 627 bp, Artificial Sequence
  Description of Artificial Sequence: Synthetic coding sequence
atgggctcggtatcgaaccaacagttcgctggaggatgtgctaaggctgcggaagaggctccggaagaagcccctgaggatgccgcacgggcggccgatgagccccagctcctgcacggagccggaatctgcaagtggttcaacgtcaggatgggttttggattcctgagcatgacggcacgggccggagtcgcactggatccacccgtggacgtctttgtgcaccagtccaaactgcatatggagggcttccggtcccttaaagaaggtgaggcggtcgaattcacttttaagaaatcggcaaagggactcgaaagcatccgcgtgaccggcccaggaggtgtgttctgcatcggaagcgaaagacgcccaaagggaaagtcaatgcaaaagaggcggtccaagggtgacaggtgttacaattgcggcgggctggaccaccacgccaaggaatgcaaactccccccacagccgaagaagtgtcacttctgtcagtcaattagccatatggtggctagctgccctcttaaagctcaacagggtccatcggctcaggggaagccgacctacttccgcgaagaggaagaggagattcattcccctaccctgctgccggaggcacagaac

SEQ ID NO: 15561 - DNA, 627 bp, Artificial Sequence
  Description of Artificial Sequence: Synthetic coding sequence
atgggcagcgtgtctaaccagcaattcgcgggaggttgcgcgaaggccgcggaagaggctcctgaagaggcccctgaggacgccgctagggcagccgacgaaccacaactcctgcacggcgcaggaatttgcaagtggttcaatgtgcgtatgggatttggcttcctttctatgactgcgcgggcgggtgtcgctctcgatcctccagtggatgtgttcgtccatcaaagtaaactccacatggaaggcttcaggtcactgaaagagggtgaggcagtcgaatttaccttcaaaaagtccgccaaaggattggagtcgatcagagtaactggtccgggcggggtgttctgcatcgggtcggaacgccggccgaagggaaagtctatgcagaagcggcgctccaagggagacagatgttacaactgcgggggactggaccatcatgcaaaggaatgtaagctcccgccacagccgaagaaatgtcacttctgccagagcatctcgcacatggtggcctcatgcccgctgaaggcccagcaggggccgtccgcccaaggcaaacctacctactttagagaggaagaagaggaaatacactcccctacgctgttgcccgaagctcagaat

SEQ ID NO: 15562 - DNA, 627 bp, Artificial Sequence
  Description of Artificial Sequence: Synthetic coding sequence
atgggaagcgtgagtaatcagcagttcgcaggaggatgcgccaaggctgccgaggaagctccagaagaggcacccgaggacgcagcgcgcgctgccgacgaacctcagctgctccatggtgcagggatttgcaagtggttcaacgttcgcatgggatttgggttcttgagcatgaccgcccgcgcgggcgtcgctctggacccgcctgttgacgtgtttgttcatcagtccaagttgcacatggaggggttcaggtcattgaaagaaggagaggcggtggagttcacattcaaaaaatccgccaaagggcttgagtctattcgcgtcacagggcctggtggagtattttgcatcgggagtgaacgaaggcctaagggaaagagcatgcagaagagacggtccaagggtgataggtgctacaattgcgggggactcgaccaccatgcaaaggagtgtaagttaccaccccagccgaaaaagtgtcacttctgtcagtctatatcacacatggtcgcgagttgccctctgaaggctcagcagggcccctctgcgcagggtaaacctacctacttccgcgaagaagaagaggagatccattctcccacgctgctgccagaagcccagaat

SEQ ID NO: 15563 - DNA, 627 bp, Artificial Sequence
  Description of Artificial Sequence: Synthetic coding sequence
atggggtctgtctcgaatcagcaattcgctggcggctgtgccaaggctgccgaagaggcgcctgaagaagcccccgaggatgcggcccgagccgccgatgagccccagctcctgcatggagctggtatctgtaagtggttcaatgtgcgaatgggattcgggttcctgagcatgactgcaagagctggtgtggcgctggacccccccgttgacgtgttcgtgcaccagtcgaagctgcacatggagggctttcgatctctgaaggagggcgaggccgtagagtttactttcaaaaaatctgccaaaggtttggaatcaataagggtaacaggacccggcggagtgttctgtatcgggtcagagaggagaccaaagggtaagtccatgcagaagcgaagaagcaagggtgaccgctgttataactgcggagggcttgaccaccacgcgaaggaatgtaaactgcctcctcagcccaagaaatgtcacttctgtcagagcattagtcatatggtcgcaagttgtcccttgaaagcccagcaggggcctagcgcccagggtaagcccacttatttcagagaagaggaagaagaaatccacagtccaaccctgcttccagaagctcagaat

SEQ ID NO: 15564 - DNA, 627 bp, Artificial Sequence
  Description of Artificial Sequence: Synthetic coding sequence
atggggagtgtgagcaaccagcagttcgccgggggatgtgccaaggccgcagaggaagcacccgaggaagcccctgaggacgctgctagggcagctgatgaaccccagctgctacacggagctggcatctgtaaatggtttaatgtcaggatgggattcggattcctaagtatgaccgcgagggccggcgtcgcgttggaccctcctgttgacgtgttcgtccaccagtccaaactccatatggaagggtttaggtctttgaaggagggggaggctgttgagttcacatttaagaagtcagccaaaggcctggagagcatcagggttacaggtcccggcggtgtgttttgtattggatccgagaggcgccccaagggtaagtccatgcaaaaaagacgctcaaaaggcgatcgatgctataactgcggcggactggaccatcacgccaaggaatgtaaactgcccccacaacctaagaaatgtcatttttgtcagtctatctcccacatggtggcttcatgtccacttaaagcccaacagggtccatccgcccaagggaaacctacatactttcgcgaggaagaggaggagatacacagtccaactttgctaccggaggctcagaac

SEQ ID NO: 15565 - DNA, 627 bp, Artificial Sequence
  Description of Artificial Sequence: Synthetic coding sequence
atgggctccgtctcgaaccaacaatttgccggcggatgtgcaaaggcagccgaagaagcgccagaagaggcccctgaggatgcggcaagagcagccgatgagcctcaactcctccacggtgcagggatctgcaaatggtttaatgtccgaatgggctttggatttctctcgatgaccgctagggcaggagtggcgctcgatcctccagtcgacgtttttgtgcatcaatccaagctccatatggaaggatttcgctcgcttaaagaaggtgaagcagtggagttcacctttaagaagagcgcaaaaggactggagtcgattcgggttaccgggccaggaggagtcttttgtatcggatccgaacgccgccctaagggcaagtcaatgcagaagcggcggagcaaaggtgatagatgttacaactgtggaggcctggaccaccacgcaaaggaatgcaagctgcctccacaacccaaaaagtgtcacttctgccagtcgatatcgcatatggtggcctcgtgtcctctcaaggcccaacaaggtccctcagcccagggaaagcctacctactttcgtgaagaggaagaagagattcactcacccactctgctcccagaggcccagaac

SEQ ID NO: 15566 - DNA, 627 bp, Artificial Sequence
  Description of Artificial Sequence: Synthetic coding sequence
atgggctctgtttccaatcagcaatttgctggaggctgcgcaaaagccgctgaggaggcgcctgaagaggcacctgaagatgctgcccgcgccgcagatgagccccaactcctgcacggcgctggaatctgtaagtggtttaacgtaagaatgggattcggtttcctttccatgacagcccgcgccggtgtggctctggacccacctgtcgacgtgttcgtccaccaaagtaagctccatatggaaggttttcgcagtctgaaggagggtgaagccgtcgagtttacttttaagaagagcgccaagggactggaaagtataagagtcactggacctggtggtgtattctgtatcggatccgaacgccgccctaagggaaagtccatgcaaaagcgcaggtccaagggtgaccgctgttataactgtggtggtctcgaccaccatgccaaggagtgcaaactgcctccacagcccaagaagtgccacttttgccaatccatcagccacatggtcgcgtcttgtcctttgaaagcccagcaaggaccatctgcgcagggtaaaccgacctacttcagggaggaggaggaggaaatacactctcctaccctcctccctgaggctcagaac

SEQ ID NO: 15567 - DNA, 627 bp, Artificial Sequence
  Description of Artificial Sequence: Synthetic coding sequence
atgggttctgtctccaaccagcaattcgcgggtggttgcgccaaggcagcggaggaagctccagaggaagcccctgaggacgcagcgcgcgcggctgacgagccgcagctgttgcatggcgccggtatttgcaaatggtttaacgtccgaatgggcttcgggtttctgtcgatgactgcacgcgcgggcgtcgcactggatccgcctgttgacgtattcgtgcaccagagcaaactgcatatggaaggcttccgcagccttaaggagggcgaggccgtggagttcacttttaaaaaatccgctaagggtctggagtcaattcgcgttaccggtcctggtggagtgttctgtatcggatccgagcgccgtccgaaaggcaagagcatgcaaaagagacgtagcaagggggaccgctgttacaattgcggaggattggaccaccatgcgaaggagtgcaaactgcccccgcaaccaaaaaagtgccatttctgccagtccatcagccatatggtggccagctgcccgctgaaggcgcagcagggtccatcagcccagggaaagccgacctatttccgagaggaagaggaagagatccatagcccgactctgttgccggaagcccaaaac

SEQ ID NO: 15568 - DNA, 627 bp, Artificial Sequence
  Description of Artificial Sequence: Synthetic coding sequence
atgggatcagtttcaaatcaacaatttgctggaggttgtgctaaggctgctgaagaagcaccagaagaagcacctgaagatgcagcaagagctgcagatgaaccacaattattgcatggagcaggtatttgtaaatggtttaatgttaggatgggttttggatttttatcaatgactgctagagcaggagtggctttagatccaccagttgatgttttcgttcatcaatcaaaattacatatggaaggattcagaagtctaaaagaaggtgaagcagttgaatttacttttaaaaagagcgctaaaggattagaatcaattcgtgttacaggtcctggaggtgttttttgtataggaagtgagagaagaccaaaaggtaaatcaatgcaaaaaagaaggagtaaaggagatagatgttataactgtggaggacttgatcatcatgcaaaagaatgtaaattaccaccacaaccaaaaaaatgtcatttttgtcaatcaatttctcacatggtggcaagttgccctttaaaagctcaacaaggtccatctgctcaaggaaaaccaacttattttagagaagaagaagaagagatccattctccaacgttgcttccagaagcacaaaat

SEQ ID NO: 15569 - DNA, 627 bp, Artificial Sequence
  Description of Artificial Sequence: Synthetic coding sequence
atgggctcggtttcaaaccaacagtttgccggagggtgcgcgaaagccgccgaagaagctccagaagaagcccctgaggacgctgcgagagcggctgacgagcctcagctgctgcacggtgccggaatatgtaagtggttcaacgtgagaatgggtttcggatttctctctatgacagcacgggcaggggttgctctggaccctccagtggacgtgtttgtgcaccagagtaagctgcacatggagggattcaggagcctgaaagaaggcgaggcagtcgaatttactttcaaaaagtccgctaaaggactcgagagcatccgggttacgggccctgggggcgtgttctgtatcgggtccgagagaaggcctaaagggaagagtatgcaaaagaggcgtagcaagggggatcgctgttacaattgtggtggccttgatcatcatgctaaggaatgcaaactccctcctcagcctaaaaagtgtcatttctgccagtctatttcccacatggtggcttcgtgccccttaaaggcccagcagggtccatctgcacagggcaagcctacctatttccgtgaggaggaggaggagattcattctccaaccttgctgccagaagcccagaat

SEQ ID NO: 15570 - DNA, 627 bp, Artificial Sequence
  Description of Artificial Sequence: Synthetic coding sequence
atgggatcagtctccaatcaacaattcgccggtggctgcgcgaaggcagcagaggaggctccggaagaagctccagaagatgcagcaagagccgcagacgaaccgcagctcctccacggcgccggaatctgcaagtggtttaacgtccggatggggttcggcttcctctcaatgactgcccgcgcgggggtggccctcgacccccctgtggacgtgttcgtgcaccagtcgaagctgcatatggagggctttcgtagcctgaaggagggagaggccgtggagttcacctttaagaaatcagccaaggggctggagtctatccgggttacgggccctggtggagtgttctgcatcggatcagagcgccgccctaagggaaaaagtatgcagaagagacgatctaaaggcgatcgatgctacaactgtggaggcctggaccatcatgccaaagaatgcaaacttccgccgcaaccaaagaagtgccacttttgtcagagcatatcccacatggtcgcatcgtgtccactgaaagcgcagcaggggccttcggcgcagggtaagccgacctactttagggaagaagaagaagagattcacagccccactctgttgcccgaagcgcaaaat

SEQ ID NO: 15571 - DNA, 627 bp, Artificial Sequence
  Description of Artificial Sequence: Synthetic coding sequence
atgggatcagtgtcgaaccaacaatttgcgggaggatgtgccaaggcggccgaggaggccccggaagaggccccggaggacgccgcacgcgccgcggacgagccgcagctgctgcatggagcgggaatctgtaagtggttcaatgtcagaatgggatttggattcctctcaatgacggctagagcgggtgtcgcgctcgatccacccgtggatgtgttcgttcaccaatcaaagctgcacatggaaggatttaggtcactgaaggagggggaagccgtcgaattcaccttcaagaagagcgccaagggattggaatccatccgggtgactggaccgggcggggtgttctgcatcggatcagaaaggcgcccaaaggggaagtcgatgcagaaaagacgctccaagggggacaggtgctacaactgtggaggactggaccaccatgccaaggaatgtaagctgccaccgcagccgaaaaagtgccacttttgccagtcaatttcacacatggtcgcatcctgcccactgaaggctcagcagggaccctccgctcaagggaagcctacttacttccgcgaagaggaggaggaaatccattctccaaccttgctccccgaggcccagaat

SEQ ID NO: 15572 - DNA, 627 bp, Artificial Sequence
  Description of Artificial Sequence: Synthetic coding sequence
atgggttcggtctcaaaccaacaattcgccggaggttgcgcaaaagccgcggaggaggcgcccgaggaggccccggaagacgctgcccgtgcagcagatgagccgcaactcttgcacggcgcaggcatctgtaagtggttcaatgtgcgtatgggatttggctttctttcgatgacagcgcgggccggcgtggctctggatccgcccgtggacgttttcgtgcaccaaagcaagctccacatggaaggcttccgaagtctgaaggaaggcgaggcggttgagtttacgttcaaaaagtcggctaaaggccttgagagtatcagggtgactggccccgggggtgtcttttgcatcggcagcgagcggcgcccgaagggcaagtctatgcagaagcgtcgaagtaagggcgatagatgctacaattgcggtggtctggatcaccacgccaaggaatgcaagctccctccgcaacccaagaagtgccacttttgccaatcgatttcccacatggtggctagttgcccattgaaggctcagcagggacctagtgctcagggaaaacccacctactttagggaggaggaggaagagattcactcgccgaccctgctgcccgaggcccagaat

SEQ ID NO: 15573 - DNA, 627 bp, Artificial Sequence
  Description of Artificial Sequence: Synthetic coding sequence
atgggaagcgtttctaatcagcagtttgcaggcggctgtgctaaggccgcagaggaagcacctgaggaagctcccgaggatgcagcacgggctgccgacgaaccacagcttctacacggagcagggatctgtaaatggttcaacgtaaggatggggttcggcttccttagcatgacagcccgcgcaggcgtggctctggatccccccgttgatgtctttgttcaccaaagcaaactacacatggaaggctttcgcagccttaaagagggggaagcggtggaattcacttttaaaaagagtgcaaagggccttgaatccatccgtgttacaggacccggcggagtcttttgcatcgggagtgagcgtcgcccaaagggaaagagcatgcagaagcggcggtccaagggagaccgatgttacaattgcggaggcctcgatcatcacgctaaggaatgtaagttgccgcctcagcccaagaagtgtcacttctgccagagcatctctcatatggtcgcctcgtgccctctgaaagcccagcagggaccctcagcgcaagggaagccaacttacttccgcgaggaggaggaggaaattcacagccctactcttctcccagaggctcagaat

SEQ ID NO: 15574 - DNA, 627 bp, Artificial Sequence
  Description of Artificial Sequence: Synthetic coding sequence
atgggctctgtctccaatcagcaatttgccggcggttgtgccaaagctgctgaggaagcccctgaggaagccccagaggatgccgcgcgggccgcagacgagccacaactgctccatggggcaggcatatgtaaatggtttaatgtgaggatgggcttcgggtttctttctatgacagctagggcaggcgttgcactcgatcctcccgtggacgtctttgtacaccaaagcaagttgcacatggaaggcttccgcagtctgaaggagggcgaggccgtcgaattcacattcaaaaaaagtgccaagggactcgagtcaatccgggtaaccggcccagggggagtcttctgtattggaagtgaacgccggcccaagggcaaatcaatgcaaaagcggcggagcaagggagatcgatgctataactgtggcggcctggatcatcacgcaaaagaatgcaaactgcccccccagcccaagaaatgccacttctgccaaagcatcagccatatggtcgcttcttgccccctcaaagcccagcaggggccttccgcgcaggggaagcccacatacttccgcgaggaggaggaagagattcacagccccacactcctccccgaggctcagaac

SEQ ID NO: 15575 - DNA, 627 bp, Artificial Sequence
  Description of Artificial Sequence: Synthetic coding sequence
atgggatctgtctccaaccaacaatttgccggaggctgcgccaaagctgcagaagaggccccagaagaagctcccgaggacgccgccagggctgcggacgagccacaactcctgcacggtgctgggatctgcaagtggttcaatgtgcggatgggattcgggttcctgtccatgactgcccgagcgggtgtagcgcttgaccctcctgtcgatgtgttcgtgcatcagtcaaagctccacatggaaggatttaggtcactcaaggagggagaggcagtggaattcaccttcaagaagtcggccaagggacttgagagcatccgcgtgactggcccagggggcgtgttctgcatcggatcggagcgccggccaaaaggaaagagcatgcagaaacgcagatcaaagggagacagatgttacaattgcggaggcttggatcatcatgcgaaagaatgtaagctgccccctcagccaaagaagtgccacttttgtcagagcatctcccacatggtcgccagctgtccgctcaaagctcagcagggacctagtgcacaggggaagccaacctactttcgcgaggaagaggaagagatccactcaccgacgctgcttcctgaggcccaaaat

SEQ ID NO: 15576 - DNA, 627 bp, Artificial Sequence
  Description of Artificial Sequence: Synthetic coding sequence
atgggctctgtctccaatcagcagttcgccggagggtgcgccaaggcggccgaggaggcaccggaggaagcgcctgaagatgctgcccgggcggcagacgagccacagctgctgcatggtgctggaatctgcaagtggttcaatgtcagaatgggattcggttttctgtcgatgactgctcgggccggagtggctctggacccgcccgtggacgtgttcgtgcatcagtccaaactccacatggagggcttcagatccctcaaggaaggagaggcagtggagttcactttcaagaaatccgccaagggacttgaatccatccgggtgaccggcccgggaggggtgttctgtatcggatcagaacgtcggcctaaggggaagtcgatgcagaaaagaagatctaagggggacagatgctacaattgcggcggattggaccaccacgcgaaggaatgtaaactgccgccccagcctaagaagtgccatttttgccaatcaatcagccatatggtggcatcgtgccccctgaaagcccagcaaggaccttcagcacagggaaagccgacttacttcagggaagaagaagaggaaattcatagcccgactcttctgccggaagcgcagaac

SEQ ID NO: 15577 - DNA, 627 bp, Artificial Sequence
  Description of Artificial Sequence: Synthetic coding sequence
atgggaagtgtgagcaaccaacaatttgcgggtggttgtgcaaaagcagccgaagaagcacctgaagaggcacctgaggatgcagcgagggcggccgacgagccacagctgctccacggagcaggtatctgtaagtggttcaacgtgagaatgggatttggttttctcagcatgaccgcgcgtgccggcgtggcgttggatcccccggtggacgtgttcgtgcatcagagtaagctgcatatggaagggttccgtagccttaaggaaggggaggccgtggaattcactttcaagaaaagcgctaagggactggaatccattcgagttactggcccaggtggcgtattttgcattggatctgagagaaggcccaagggtaaatcgatgcaaaagaggcgttccaagggcgacagatgttacaattgtggagggcttgatcatcacgccaaggaatgcaagctgccaccccaacctaaaaagtgtcatttttgccagtccatctcacacatggtcgcttcatgtcctctgaaggcacaacaaggaccctcggcccagggtaaaccgacctactttcgcgaagaggaagaggagatacattcacctacccttctccccgaagcacaaaac

SEQ ID NO: 15578 - DNA, 627 bp, Artificial Sequence
  Description of Artificial Sequence: Synthetic coding sequence
atgggcagtgtctcgaaccagcagttcgcgggcggttgcgcgaaagccgcagaggaagccccggaggaggccccggaggatgcagcacgcgccgcggacgagccacaacttctccatggtgcaggaatctgcaaatggttcaacgtgagaatgggatttgggttcttgtcaatgaccgcgagggcgggcgtcgctctggacccgccggtggatgtgttcgtgcaccagtcaaagctgcacatggaagggttccggagtctcaaggagggagaagccgtggaattcaccttcaagaaatcggcgaagggcctggaaagcatccgggtgactggaccaggcggagtgttttgtatcggctcagaacgtcggccaaaaggaaaatcaatgcaaaaaagacgaagcaagggagatcgctgctacaattgcggtggactggatcaccatgcgaaggagtgcaagctgcctccgcagcctaagaagtgtcatttttgtcaatccatttcccatatggtcgcttcctgcccgctgaaggcacaacagggaccaagcgcccaaggtaagccgacctacttccgggaagaagaagaggaaatccactccccgacgctccttccagaggctcagaat

SEQ ID NO: 15579 - DNA, 627 bp, Artificial Sequence
  Description of Artificial Sequence: Synthetic coding sequence
atgggttcggtgtccaatcaacagtttgcaggaggctgtgcaaaagctgccgaggaggcacccgaggaagcacccgaggatgcagcccgcgcagcagatgaacctcaacttcttcatggagccggaatttgcaagtggtttaacgtgagaatgggttttggatttttgtccatgaccgcgagagcaggagtcgccctcgatcctcctgtggatgtgttcgttcatcaaagcaaacttcatatggaaggttttcgttcgttgaaggaaggggaagcggtggaatttactttcaagaaatccgcgaagggactggaaagcattagggtcactggaccgggaggcgtcttttgtatcgggtcggaaagacgtccgaagggaaagtcgatgcagaagagacgttcgaaaggagataggtgttacaactgtggtggtcttgaccatcacgcaaaggagtgtaaactgccacctcagcctaagaaatgccacttctgtcagagcatttcacacatggtcgcatcgtgccctcttaaagctcaacaaggtccttccgcgcaaggtaagccaacttactttagagaagaggaagaagagatacattcccctacgctgcttcccgaggcacagaac

SEQ ID NO: 15580 - DNA, 627 bp, Artificial Sequence
  Description of Artificial Sequence: Synthetic coding sequence
atggggtcggtgtccaatcaacaatttgcaggaggatgcgcaaaggccgcagaagaagcacctgaagaagcaccggaagatgcagccagagcagcagatgagccccagctcctccacggagcaggaatatgcaagtggttcaatgtccgaatgggttttggtttcctctcaatgaccgcacgggccggtgtggcgcttgacccgccagtggatgtctttgtgcatcagtcgaaactgcatatggaaggttttagatcacttaaggaaggagaagctgtggaatttaccttcaaaaagtcggcgaagggtctggagtccattcgcgtgacgggtcccggtggtgtgttctgtatcggttccgaacggcggccaaaaggaaagtccatgcaaaaaaggagatccaaaggcgaccgctgttacaactgcggcggacttgatcatcatgccaaggaatgtaagctgcctccgcaacccaaaaagtgccatttttgtcaatcgattagccacatggtcgcaagctgtccactcaaggcgcaacagggcccaagcgcacaaggtaaacccacttactttagggaggaggaagaagaaattcactcacctacgctgttgcctgaggcccagaac

SEQ ID NO: 15581 - DNA, 627 bp, Artificial Sequence
  Description of Artificial Sequence: Synthetic coding sequence
atggggtccgtgtcgaatcaacagttcgccggtggatgtgcaaaagcggctgaggaagcacccgaagaagcgcctgaagatgcggcccgcgcagcggacgaaccgcagcttttgcacggcgccgggatctgtaaatggtttaatgtccgcatgggtttcggcttcctgagcatgaccgcaagagcaggggtggcgctcgatccgcctgttgatgtgttcgtgcaccagagcaaattgcacatggaaggattccggtcgctgaaggaaggagaggctgtggaattcactttcaagaagtccgcaaagggcctggagtcgatccgggtgaccggaccagggggagtgttctgcatcggctccgaaagacgcccaaaaggcaaatcaatgcaaaaacggagaagcaagggtgataggtgttataactgtggaggactggaccatcatgcgaaagaatgcaagctgccaccgcaaccaaagaagtgccatttttgccaatccatcagccatatggtggcgtcatgcccactcaaagcccagcagggaccgagcgctcagggcaagccgacctacttccgggaggaagaagaggagatccattcaccgacgctgctcccagaagcgcagaac

SEQ ID NO: 15582 - DNA, 627 bp, Artificial Sequence
  Description of Artificial Sequence: Synthetic coding sequence
atggggtcggtgagcaatcaacagttcgccggaggatgcgcaaaagcagccgaagaagcaccagaggaagcacctgaagatgctgctcgggccgcagatgagcctcaactgttgcatggcgctggaatttgcaagtggttcaacgtgcggatgggcttcgggttccttagcatgactgcaagggcaggggtggccctggatcctccagtcgatgtgtttgtgcaccagtcgaaactccacatggaaggttttaggtcgcttaaggaaggcgaagcagtcgaattcacctttaagaagagcgcaaaggggctcgagtccattcgcgtgaccggtccaggcggagtgttttgtattggctcggaaaggcgccctaagggaaagtcaatgcagaagcgcagatccaagggagacagatgctataactgtggaggactcgaccatcatgcgaaagagtgcaagttgccgccgcaaccaaaaaagtgtcatttttgtcaatccattagccatatggtggcgtcgtgtccactgaaggcacagcagggcccctcggcgcaaggaaaaccgacctactttcgcgaagaagaagaggaaatccattcccccaccctgcttcccgaggctcagaat

SEQ ID NO: 15583 - DNA, 627 bp, Artificial Sequence
  Description of Artificial Sequence: Synthetic coding sequence
atgggttcggtcagtaatcagcaattcgcaggagggtgtgcgaaagcagcagaagaagccccagaggaggcacccgaggacgccgcgcgcgccgctgacgaaccacagctgcttcatggagccggaatctgtaagtggttcaacgtgcggatgggatttggtttcttgtccatgactgctcgcgcaggtgtcgcactggatcctcctgtcgacgttttcgtgcatcaaagcaagctccacatggaggggttccggagcctgaaagagggagaggccgtggaatttacttttaagaaatcagcaaaaggcctcgaatcaatcagagtgactggaccgggtggagtgttttgcatcggatcggaacggcgccctaagggtaagtccatgcaaaagaggcgatcaaaaggtgatcggtgctacaactgcggaggcctggatcatcatgcgaaggaatgtaagttgccacctcaaccgaagaagtgtcatttttgtcagagcatttcccatatggtggcctcctgcccactcaaagcacaacaagggccttcggcacaaggtaagcccacctactttagggaagaggaagaggaaattcatagcccaactcttcttcccgaagcacaaaat

SEQ ID NO: 15584 - DNA, 627 bp, Artificial Sequence
  Description of Artificial Sequence: Synthetic coding sequence
atgggctcggtgagcaatcagcagtttgcgggagggtgtgcaaaggccgcggaagaggctccagaagaagctccggaggacgccgcgagggccgccgacgaaccgcagctgctgcacggcgctggaatttgcaaatggttcaacgtgaggatgggattcggttttctctcgatgaccgcccgggctggcgtcgcactcgatccgccagtcgacgtgtttgtgcaccagtcgaagttgcacatggaaggatttcgctccctgaaagagggcgaagccgttgagttcacgtttaagaagtcagccaagggactggaatcgattagagtgactggacccggaggggtgttttgcatcgggtcggagcggcgaccaaagggcaagtcgatgcaaaaacgcagatcgaagggagataggtgctacaactgtggaggactcgaccaccatgcgaaggagtgcaagctgccgccgcaacctaagaagtgccacttctgtcagtccatctcacatatggtggcatcatgcccgttgaaggcccaacaaggaccgagcgcccaaggaaagcctacctacttccgcgaagaagaggaagagatccacagcccaaccctccttccagaggctcagaat

SEQ ID NO: 15585 - DNA, 627 bp, Artificial Sequence
  Description of Artificial Sequence: Synthetic coding sequence
atgggttccgtcagcaaccaacagttcgctggggggtgcgcaaaagcagccgaagaggctcccgaagaagcgccagaagacgctgccagagccgctgacgagccacagctgctgcatggcgccggaatctgcaagtggtttaatgtcaggatgggattcggctttctatctatgaccgccagagccggggtcgccctggatcctcctgtcgacgtcttcgtccatcaatctaaactgcatatggaggggttccgatctctgaaagaaggggaagctgtggagttcactttcaaaaagtctgccaaaggactggagtctattagggtgacaggaccagggggtgtgttctgcatcggttctgaaaggcggcctaagggaaagtctatgcagaaaaggagatctaagggggataggtgctataattgtggtggattggaccaccatgcaaaggagtgtaaattgccaccccagcccaagaagtgccacttctgtcagtccatctcccatatggtcgcatcatgcccactgaaggcgcaacagggccccagcgcccagggtaaaccgacgtacttccgggaagaggaagaagaaattcactcacccacactgctcccagaggcacagaac

SEQ ID NO: 15586 - DNA, 627 bp, Artificial Sequence
  Description of Artificial Sequence: Synthetic coding sequence
atgggcagcgtaagcaatcaacaattcgcaggcgggtgcgcaaaggccgccgaggaggctcctgaggaggccccagaggacgctgcacgggctgccgacgagccccagctgttacatggcgcaggaatctgcaaatggttcaacgtaaggatggggtttggcttcctctcaatgacagccagagccggagtggccctggaccccccagtggatgtcttcgtccaccaaagtaagctgcacatggagggatttcggagcctcaaggagggggaagccgtcgagtttacattcaaaaaatctgccaaggggctggagtccattagagtgaccggccccgggggggtgttttgcatcggctcagagaggcggcctaagggaaagagcatgcagaagaggcgtagcaagggagacaggtgttacaattgtggaggactggaccaccacgctaaggagtgcaaattacctcctcagccaaagaaatgtcatttctgtcaaagtatcagtcatatggttgccagttgcccactcaaagcccagcagggcccatccgctcaaggcaaacccacttatttccgggaggaagaggaagagatacattccccaaccctgctccccgaagcccaaaat

SEQ ID NO: 15587 - DNA, 627 bp, Artificial Sequence
  Description of Artificial Sequence: Synthetic coding sequence
atggggtcagtgtccaaccagcagtttgctggcggttgcgctaaagccgccgaggaagccccggaagaagctccggaggacgcagcccgcgcagccgatgagccccagttgctgcatggtgctggcatctgcaagtggtttaatgtgcggatgggattcggatttttgtcaatgacggctagggcaggcgtcgcgctcgatccacccgttgatgtcttcgtgcatcagtctaaactgcacatggagggatttcggtctttgaaagagggtgaggcagtggaatttacctttaaaaaaagtgctaagggcctcgaaagtatacgcgtgactgggcccggtggagttttctgtatcggcagcgaaaggcgtccaaaaggcaaatccatgcaaaagcggaggtccaagggcgataggtgctacaattgcggcggtctagatcaccacgccaaggagtgcaagctgccgccccagccaaagaaatgtcacttttgccagagcatctctcacatggtggcatcttgcccattgaaagcccagcagggaccttcggctcagggcaagccaacctatttccgtgaggaagaggaagaaatccatagccctacccttctgccagaggcgcaaaat

SEQ ID NO: 15588 - DNA, 627 bp, Artificial Sequence
  Description of Artificial Sequence: Synthetic coding sequence
atgggaagcgtgagcaatcagcagtttgcaggagggtgcgcaaaggctgccgaagaggctcctgaggaagcacctgaagacgccgcccgggctgctgacgagcctcagctcctacatggtgccggaatctgcaagtggtttaacgtgcgcatgggatttggcttcctgagcatgacggcacgggccggtgtggcactcgatcctccggtcgatgtcttcgtacatcagtcaaaacttcatatggagggcttcaggtctttgaaagagggcgaggcggtggaattcacgtttaagaagtccgccaaaggactggaatccataagagtcactggcccggggggtgtgttctgtattggcagtgagagacgccccaaaggaaagtcaatgcagaaacgtagaagtaagggagaccgttgttataactgcggtggcctcgatcaccatgcaaaagagtgcaaactgccgcctcagcccaaaaaatgccacttttgccagtccatttctcatatggtagccagctgtccgttgaaagctcagcagggacccagcgctcagggcaagcctacgtatttccgcgaagaggaggaagagatccactctcccacccttctccctgaagcccagaat

SEQ ID NO: 15589 - DNA, 627 bp, Artificial Sequence
  Description of Artificial Sequence: Synthetic coding sequence
atgggttcagtgagcaatcagcagttcgccggaggatgcgctaaagcggcggaagaagcccccgaggaagcgcccgaggatgcggcccgggcagcagatgaaccgcagctgttgcacggagcggggatctgcaaatggttcaacgtccggatgggatttggattcctctcgatgacggcacgcgctggagtggccctggatcctccagtggacgtgttcgtgcatcaatcgaaacttcacatggaagggttcagatcgctgaaggagggagaagccgtcgagttcacgttcaagaagagcgccaaaggactggaatcaatccgggtgactggaccgggaggagtgttctgtatcggatccgaacgcaggccaaaagggaaatccatgcaaaagcggcgatccaagggggaccgctgctacaattgtggcgggctggaccaccacgcaaaggaatgtaagctccccccacagccgaagaagtgccacttttgccagtccatttcgcatatggtcgcctcgtgcccactgaaggcccagcagggcccaagcgcccaagggaagcctacttacttccgggaggaggaggaagagatccatagcccaactctgttgcctgaagctcagaac

SEQ ID NO: 15590 - DNA, 627 bp, Artificial Sequence
  Description of Artificial Sequence: Synthetic coding sequence
atggggtctgtgtcgaaccagcagttcgcaggcgggtgcgccaaggccgccgaggaagcgcccgaagaagctcctgaggatgccgcccgcgcagccgatgaacctcaattgcttcacggggccggtatatgtaagtggttcaatgtgagaatgggcttcggattcctttccatgaccgccagagccggggtcgctttggacccacccgtcgatgtcttcgtccaccagagcaaactgcatatggagggatttcgcagtctgaaggaaggcgaagcagtagaattcacttttaaaaagtcagctaaagggttggaatctattagagtgaccgggcctggcggcgtgttttgcataggttcggagcgacggcctaagggcaaaagtatgcaaaagcgtcggagcaagggcgacaggtgctacaactgtggtgggctagaccatcacgctaaggaatgtaagttaccaccacagcctaagaagtgtcacttttgccaaagcatttctcatatggtggcatcatgccccctgaaggctcagcaagggccatccgcccaagggaagccgacttattttcgtgaggaggaagaggagatacatagcccaacgctacttcctgaggcacagaat

SEQ ID NO: 15591 - DNA, 627 bp, Artificial Sequence
  Description of Artificial Sequence: Synthetic coding sequence
atgggatctgtaagtaaccagcagttcgctggggggtgcgccaaagctgctgaggaagccccagaagaggctcctgaagatgccgctcgggctgcagatgaacctcagcttcttcatggggcggggatttgtaagtggtttaatgtgcggatgggatttgggtttctgagtatgacagctcgagccggggtggcactagatcctcccgtcgatgtttttgtgcaccagtcaaaattacatatggaaggattccgctcccttaaagaaggagaggctgttgaatttacttttaaaaaatctgccaaaggactcgaatctattagagtgacagggcccggaggggttttttgcatcggatccgaaagacgccccaaagggaaatccatgcagaaaaggcgctcgaagggagatagatgttataattgtggagggctcgatcatcatgcaaaagaatgtaagcttcctcctcagcccaagaaatgccatttttgccagtccatatcacacatggttgcatcctgcccacttaaagcccaacagggaccctcagctcaggggaagcccacgtacttccgggaagaagaagaagaaatccattctccaacactactcccagaagcacagaac

SEQ ID NO: 15592 - DNA, 627 bp, Artificial Sequence
  Description of Artificial Sequence: Synthetic coding sequence
atgggatccgtcagcaaccaacagttcgcgggcgggtgcgcaaaggctgccgaagaagcaccagaagaagcccccgaggacgcagccagggcagctgatgaaccccagctgctacacggtgccgggatttgtaaatggtttaatgttaggatggggttcggatttctgtctatgaccgccagagctggggtggcgctcgatccgcctgtggacgttttcgtgcaccaaagcaaactgcatatggaggggtttcgctctctgaaagagggcgaggccgtggagtttacctttaagaagtccgccaagggactcgagtcaataagggtgaccggaccgggtggagtattctgcatagggtccgaaagaagacctaaaggcaagtctatgcaaaagaggaggtcaaagggagacagatgttataactgcgggggactggatcatcatgcaaaggaatgcaaactaccacctcaacctaagaaatgccatttctgccaatctatctcccatatggttgcaagctgtccgctcaaagcccagcaggggccctcagctcaaggaaaacctacttacttccgagaagaggaagaagaaatccacagtccgactctgcttccggaagcacaaaat

SEQ ID NO: 15593 - DNA, 627 bp, Artificial Sequence
  Description of Artificial Sequence: Synthetic coding sequence
atgggatcggtgagcaatcaacagttcgcgggcggctgcgcaaaagcagcagaagaagcacccgaagaagcaccggaggacgccgcccgggcagcagatgaacctcagctgttgcacggagcaggaatctgcaagtggttcaacgtccgcatgggatttggatttctgtccatgactgccagagcaggagtcgcactcgatccacccgtggacgttttcgtgcatcaaagcaaactccatatggaagggtttcggtccttgaaagaaggagaggcagtggaatttacctttaagaagagcgcaaaaggacttgagtcgatccgtgtcactggacctggtggagtgttctgtatcggctcggagcgcagaccgaaggggaagtctatgcaaaagaggcgatccaagggggatcgatgttacaactgcggtggtcttgaccatcatgctaaggaatgcaagctccctccacaacctaagaaatgtcatttttgtcagtccatctcacacatggtggctagctgccctttgaaagcccaacaaggaccatcagcacagggcaaacccacctactttagagaagaagaggaggaaatccattcgcccacgcttcttcctgaagcgcagaac

SEQ ID NO: 15594 - DNA, 627 bp, Artificial Sequence
  Description of Artificial Sequence: Synthetic coding sequence
atggggtctgtgtctaatcaacaattcgcaggtggatgcgcaaaggctgcagaagaagccccagaggaagccccagaagatgccgctcgggctgctgacgagccgcaactgctccacggagcaggaatatgcaagtggtttaatgtgcgtatgggatttggatttttgtcgatgactgcacgagccggagtcgcactggatccaccagtggatgtatttgtacaccaatccaaactgcatatggaaggatttcgtagcctaaaagaaggggaggctgtggaatttactttcaagaaatcagctaagggcctggaaagtatacgggttacaggtccaggtggagtattctgtattgggtctgagcgaaggcctaaagggaagtcgatgcaaaaaaggcgaagtaaaggagatcgatgctacaattgcgggggtttggatcatcatgccaaagagtgtaagctgccgcctcaaccgaaaaagtgccatttttgtcaatctatatcccacatggttgccagctgcccactgaaagctcaacaggggcctagtgcccaaggtaaaccgacttatttcagggaggaagaggaagaaattcactccccaactctgcttccagaggctcaaaac

SEQ ID NO: 15595 - DNA, 627 bp, Artificial Sequence
  Description of Artificial Sequence: Synthetic coding sequence
atggggtcagtgagcaatcagcagttcgcaggtggctgcgccaaagctgctgaagaagctcccgaggaggcgcccgaagacgcagctagggctgccgacgagccgcagctgcttcacggagccgggatatgtaagtggtttaatgtcaggatggggtttggttttctgtccatgactgctagggctggagtggccctcgacccgcccgtggatgtttttgtgcaccagagcaagctgcatatggaaggattccgctctctcaaggagggagaggccgtggaatttacatttaaaaaatctgccaagggcctggagagtattagggttacaggcccaggcggggttttctgcatcggctctgagcgcagaccgaagggaaagtccatgcaaaaaaggcgctctaaaggcgatcgatgctataactgcggcggcctcgaccatcatgcaaaagagtgcaaactgccaccacaaccaaagaagtgtcacttctgtcagtccatctcccacatggtggcttcctgcccacttaaagcgcagcaaggcccttcagcacagggcaaacccacctattttagggaagaggaggaggaaatccactcccccactctcttgccagaggctcagaat

SEQ ID NO: 15596 - DNA, 627 bp, Artificial Sequence
  Description of Artificial Sequence: Synthetic coding sequence
atgggaagcgtcagcaatcagcagttcgctggtggatgcgcgaaagccgccgaagaagcgcctgaggaggcgccagaggacgcagcccgggccgcagacgagcctcagctgctccacggtgccggaatctgcaaatggtttaacgttagaatgggattcggattcctgtcgatgactgcacgtgcgggcgttgcactggaccctccagtggatgtgtttgtgcatcaatcgaaattgcacatggaagggtttcggtcgctcaaggaaggcgaagcagtggagttcactttcaagaaatccgcgaaaggactggaatcgatccgggtgactggaccggggggtgtgttttgcattggatcagagaggcgcccgaaagggaagtctatgcagaagcgccggtcaaagggagatcggtgttacaactgcggaggactcgaccaccatgcaaaggaatgcaagctgccacctcagcctaaaaagtgtcatttctgccaatcaatatcacatatggtggcctcctgtccgctgaaggcccagcagggacccagcgcgcaagggaagccgacttacttccgcgaggaggaagaggaaatccattcgccgacgcttctcccggaagcccaaaat

SEQ ID NO: 15597 - DNA, 627 bp, Artificial Sequence
  Description of Artificial Sequence: Synthetic coding sequence
atggggagcgtgtctaaccagcagtttgccgggggctgcgctaaggcagccgaggaagcccccgaagaggcccctgaggatgccgcgcgggcggctgacgaacctcagctgctgcatggcgcaggaatatgcaaatggtttaatgtgcgaatgggtttcggcttcctgagcatgaccgcacgcgccggagtggccctcgaccccccagtggatgtatttgtccaccagagtaagttgcatatggaggggtttcggtctctgaaagaaggggaggcagtggaattcacttttaagaaaagcgctaagggcctggaaagcatacgagttacggggcctgggggagtgttttgcatcgggagcgaacgtaggcccaaggggaagagtatgcaaaagcgcaggtccaagggagaccgttgctacaactgcggcggcttggatcaccacgcgaaggagtgcaagctccctcctcagccaaaaaaatgtcatttctgccaaagtatatcccacatggtggctagctgtcccctgaaggcccaacaaggtccatcagcacaaggcaaacctacttatttcagggaggaagaggaggagatccattcccccacactgctgccggaggcacagaac

SEQ ID NO: 15598 - DNA, 627 bp, Artificial Sequence
  Description of Artificial Sequence: Synthetic coding sequence
atgggatctgtctcaaaccaacagtttgcaggaggatgtgcgaaggcggctgaagaagcgcctgaggaggctccagaggatgcagcaagagcagcagatgaacctcaactgctccacggggcagggatttgtaagtggttcaacgtgaggatggggttcgggtttctctccatgactgctcgggccggtgttgcactcgaccctcctgtggatgtctttgtgcaccaatcgaagctgcacatggaaggatttcgctccctcaaagaaggcgaagccgtggagtttaccttcaagaaaagcgcaaagggccttgaatcaataagagtgaccggtcctggaggagtcttttgcattggttcagaacgtagaccgaaggggaaatcgatgcagaagaggcgctcgaagggcgatcggtgctataactgcggaggcctggatcatcatgcgaaggagtgcaaactgcccccacaaccgaagaagtgtcacttttgtcaatcgatttcacacatggtggcaagctgtccacttaaggcacagcaagggccatcagcacagggaaagccaacctacttcagagaagaggaagaagagattcactcgcctacgcttcttcctgaggcccagaac

SEQ ID NO: 15599 - DNA, 627 bp, Artificial Sequence
  Description of Artificial Sequence: Synthetic coding sequence
atgggctccgtgtccaaccagcagttcgctggagggtgtgcgaaagcagctgaagaggcccccgaagaagcaccggaagatgccgcacgcgccgcagacgaaccccaacttctccacggagcgggtatctgtaagtggttcaacgttcggatgggttttggattcctttcaatgactgctagggcaggggtcgcactggatcctccggtcgacgtctttgtgcaccaatcaaaactgcacatggagggctttaggtcgcttaaggaaggagaggccgtggaatttaccttcaagaaatccgccaagggtctggagtccatccgggtgaccggaccagggggtgtcttttgtatcggtagcgaacgacgtcccaagggaaagtcgatgcaaaagcggagatccaagggagatagatgttacaattgtggcggactcgatcatcatgcaaaagaatgtaagttgcctcctcagccaaagaagtgccacttttgtcaatccatttcgcatatggtcgcgtcctgtccacttaaggcgcaacagggtccatcggcgcagggcaaaccaacttactttagagaagaggaggaagagatccatagcccgacccttttgccagaggcacaaaac

SEQ ID NO: 15600 - DNA, 627 bp, Artificial Sequence
  Description of Artificial Sequence: Synthetic coding sequence
atggggtcagtgagtaaccaacagtttgccggcgggtgcgcgaaggccgcagaggaggctcctgaagaggcaccggaagatgcagcaagagcagcagatgagccacagctcctccatggagctggaatatgtaaatggtttaatgtgcgcatgggttttggatttctgtcgatgactgctagagcaggagtcgcgctcgatcctccagtggacgtgttcgtgcatcaatcaaaacttcatatggaaggctttaggagcttgaaagaaggcgaagccgtggagttcacttttaagaagtccgcaaaaggattggaatctatacgcgtgacgggaccagggggcgtattctgcattgggtcagagcgtcgcccaaagggtaagagcatgcagaagaggcggtccaagggtgaccgatgttacaactgtggtggactcgatcaccacgctaaagaatgtaagttgccaccgcaacctaagaaatgtcacttctgtcagtcgatttcgcatatggtggcatcgtgcccactgaaggcgcaacaaggaccaagcgcacaaggaaagcccacctactttcgtgaggaagaagaggagatccattcgcccaccctgctgccggaagcacagaat

SEQ ID NO: 15601 - DNA, 627 bp, Artificial Sequence
  Description of Artificial Sequence: Synthetic coding sequence
atgggatctgtatcaaatcagcaatttgcggggggatgtgccaaagctgctgaagaagcgccggaggaggccccggaagacgcggcgcgggcagctgatgaaccgcaactgttgcatggtgcgggaatttgtaaatggtttaatgttcgtatgggctttggcttcctctccatgaccgcccgggcgggggtggcgcttgacccgccagtagacgtgtttgtacatcagagtaagcttcatatggagggattccgcagcttaaaagagggagaagcagtggagtttacttttaagaagtccgctaaaggacttgagagcatccgggtaacgggacctggcggggtcttttgtattggaagtgaacgtagaccaaaaggcaagtcaatgcaaaagcgccgatccaaaggagatcggtgctataattgtgggggtttagatcatcacgcgaaagaatgtaagcttccgccacaacccaaaaaatgtcacttttgtcagagtatttcgcacatggtcgctagctgtccgcttaaagcccagcaaggcccaagtgcacagggcaaaccgacgtactttagagaggaggaagaagagattcattcccctacccttctcccggaagcacagaac

SEQ ID NO: 15602 - DNA, 627 bp, Artificial Sequence
  Description of Artificial Sequence: Synthetic coding sequence
atgggctcagtgagcaatcaacagtttgcaggcggttgcgcaaaagctgctgaagaggcacctgaagaggcgcccgaggatgcagctagggctgctgacgagccccaactgctgcatggcgccggaatctgcaaatggtttaacgtgcggatgggattcggttttctgtcgatgacagccagagctggtgtggccctggacccacccgtggacgttttcgtgcatcaaagcaagttacatatggaaggctttcggtctcttaaagagggggaggccgtcgaatttacctttaaaaagtctgctaagggtcttgagtcaatccgagtgaccggccccgggggggttttctgtatagggagcgaacggcgccctaaaggtaagagtatgcaaaagcggcggtcaaaaggcgatcgctgttacaactgcgggggcctggatcaccacgccaaagaatgtaagctgcctccccaaccgaagaaatgccacttctgtcaatctatctcgcatatggtggcatcttgccccctgaaggcccagcagggtccctccgcacaggggaagcctacatatttcagggaggaggaggaggaaatccactcccccaccctccttcctgaagcccagaac

SEQ ID NO: 15603 - DNA, 627 bp, Artificial Sequence
  Description of Artificial Sequence: Synthetic coding sequence
atgggtagcgtgagcaaccagcagttcgcaggaggctgtgctaaggcagccgaagaggctcctgaggaagcacctgaggatgccgctagagcggctgatgagcctcagctcctccatggagctggcatctgtaagtggttcaatgtgagaatgggcttcggattcctgtctatgaccgctcgcgccggcgttgcccttgatcctccggtagatgttttcgtgcaccaatccaagctgcatatggagggatttcgatcccttaaggagggcgaggccgtcgagtttacatttaagaagagcgccaaagggctggaaagcatccgagtgacagggccgggcggtgtgttttgcatcggatctgagcggaggcctaagggtaagtccatgcagaagcgacggagtaaaggtgatagatgctataactgtggggggctggaccatcatgctaaggaatgcaagctgcctcctcagcctaagaagtgccatttttgccagagcatctcccatatggtcgccagttgtccactgaaagctcagcagggacccagtgcgcaaggtaagccaacctatttccgagaagaggaagaagagattcactctccaactctactccctgaggcccagaat

SEQ ID NO: 15604 - DNA, 627 bp, Artificial Sequence
  Description of Artificial Sequence: Synthetic coding sequence
atgggcagtgtgtccaatcagcaattcgctggcggatgtgccaaggcagccgaagaggcaccagaagaagcccctgaagacgctgcaagagctgctgacgagccacaactgttgcacggcgccggtatatgcaagtggtttaatgtgagaatgggatttggctttctaagcatgaccgcccgcgccggggtagcccttgatccgcctgttgacgtgtttgtccatcagtctaaactgcatatggaaggtttccgaagcctgaaagaaggggaggccgtagaattcaccttcaagaagagcgccaaaggcctggagagcatcagggtgacaggtccaggcggagtgttttgcatcggtagtgagcggcgacctaaggggaaaagcatgcaaaaaaggcgaagtaaaggagaccgctgttataactgtggcggattggatcaccatgcaaaggaatgcaaactccctccacaacctaagaagtgccacttttgccagagcatttcacatatggtcgctagctgtcctcttaaagcccagcaggggccatccgcccagggcaagcctacctactttagagaggaggaagaagagatccactcccccactctcctgcccgaggcccagaac

SEQ ID NO: 15605 - DNA, 627 bp, Artificial Sequence; identical to SEQ ID NO: 15604
  Description of Artificial Sequence: Synthetic coding sequence

SEQ ID NO: 15606 - DNA, 627 bp, Artificial Sequence
  Description of Artificial Sequence: Synthetic coding sequence
atgggttcggtttcgaatcaacaatttgcgggtggttgtgcgaaagcggcggaagaagcgccggaagaagcgccggaagatgcggcgcgagcggcggatgaaccgcaactattacatggtgcgggtatatgtaaatggtttaatgtacgtatgggttttggttttttatcgatgacggcgcgtgcgggtgtagcgctagatccgccggttgatgtatttgttcatcaatcgaaattacatatggaaggttttcgatcgttaaaagaaggtgaagcggtagaatttacgtttaaaaaatcggcgaaaggtttagaatcgatacgagtaacgggtccgggtggtgttttttgtataggttcggaacgtcgaccgaaaggtaaatcgatgcaaaaacgacgttcgaaaggtgatcgttgttataattgtggtggtttagatcatcatgcgaaagaatgtaaattaccgccgcaaccgaaaaaatgtcatttttgtcaatcgatatcgcatatggtagcgtcgtgtccgttaaaagcgcaacaaggtccgtcggcgcaaggtaaaccgacgtattttcgtgaagaagaagaagaaatacattcgccgacgctattaccggaagcgcaaaat

SEQ ID NO: 15607 - DNA, 627 bp, Artificial Sequence
  Description of Artificial Sequence: Synthetic coding sequence
atgggatccgtgagcaaccaacaattcgccggcgggtgcgctaaggccgctgaggaagccccggaagaagctccagaggatgcggcgcgcgcggctgacgagcctcagctgctccacggggcaggaatctgcaagtggtttaacgtccgaatggggttcggcttcctgtccatgacggccagagccggcgttgccctcgatccaccggtcgacgtgttcgtgcaccagagcaagctgcacatggaaggatttcgctcgctgaaggaaggagaagccgtcgaatttacttttaagaagtccgcgaaaggattggagagcatcagagtgaccggcccgggaggtgtgttctgcatcggaagcgaaagacggccgaagggaaagtctatgcagaagcgaagatcaaaaggagataggtgctacaattgcggtggactggatcaccatgccaaggagtgtaaacttccgccgcagccaaagaagtgccatttctgccagtcgatctcgcacatggtcgcctcatgccccctcaaggcgcaacaaggcccatcagcgcagggaaaacctacctactttcgcgaggaggaagaagagatccacagcccgaccctgctgccggaagcgcaaaat

SEQ ID NO: 15608 - DNA, 627 bp, Artificial Sequence
  Description of Artificial Sequence: Synthetic coding sequence
atggggtctgtgagtaatcagcagtttgcggggggttgcgcaaaggctgctgaagaagcaccagaggaagctcctgaagatgccgcccgcgcagccgatgagccccaactgttgcacggagccggcatttgtaagtggttcaacgtgcgcatgggatttggcttcctgtcaatgaccgccagagcgggggtggcactcgacccacctgtcgacgtgttcgtgcaccagtcaaaactccatatggagggatttcggtccttgaaggagggagaagccgtcgagtttacattcaaaaagtccgcgaagggccttgaatcaatccgcgttacaggaccagggggcgtcttttgtatcggcagcgaacggcgaccaaagggtaagtcgatgcagaaacgaaggagtaagggtgaccgatgttacaattgcggtggcctggaccaccacgcaaaggagtgcaagttacctccccagcccaaaaagtgtcatttttgccagtctataagccatatggtggcttcttgtcctctcaaggcgcaacaggggccctccgcacagggtaaacccacttatttcagggaggaagaggaagagattcattctccaactctcctcccagaggcgcagaat

SEQ ID NO: 15609 - DNA, 1197 bp, Artificial Sequence
  Description of Artificial Sequence: Synthetic coding sequence
atgaaaatgcgcttcttagggttagtggtctgcctggtgctgtggacccttcactcagagggttcccgtgggaaactgaccgccgtggacccagaaacaaacatgaatgtgtctgaaatcatttcttattggggttttcccagtgaggagtacctcgtagagacagaggacgggtacatactttgtctgaatagaattcctcacggtagaaagaatcattcagataagggcccaaagccagtggtgttcttgcagcacggcttactggctgattcaagtaactgggtcaccaacttggcaaatagttctctgggatttattctcgctgacgcggggttcgatgtctggatgggcaattcccgaggcaacacttggagcagaaagcacaagacgctgtcggtgagtcaagatgagttttgggctttcagctatgatgaaatggccaagtacgatctgccggctagcatcaactttattctgaacaagaccggacaagagcaggtttattatgtcggacactctcagggaactacaattggtttcatcgccttttcccagatccccgagttagccaaacgcataaaaatgtttttcgcactgggtccagtggcgagcgtcgcattctgcacgagccccatggccaagttgggccgcctccctgaccacctcattaaagatctgttcggggacaaggagttcctaccccagagtgcgtttcttaagtggttagggacccatgtgtgcacgcatgtaatcctcaaggaactctgcggcaatctgtgttttctgctctgcgggtttaatgagaggaacctcaacatgagccgggtggacgtctacaccacccattcacccgctggaacatccgtgcagaatatgcttcattggtcgcaggctgtcaaattccagaagttccaagctttcgattggggaagttctgcgaagaattatttccactataatcagtcatatccacccacatacaatgtgaaggacatgctcgttcccaccgcagtttggtccgggggacatgattggttagccgatgtgtatgacgtgaacatacttttgacacagataactaaccttgtgttccatgaatccattcctgagtgggagcacctagattttatatgggggctggatgcgccttggagactctacaacaagatcatcaacctgatgcggaaataccaa

SEQ ID NO: 15610 - DNA, 1197 bp, Artificial Sequence
  Description of Artificial Sequence: Synthetic coding sequence
atgaaaatgcgatttcttggattagtggtttgtttagttctttggacattacatagtgaaggatctagaggaaaacttactgctgttgatccagaaacaaatatgaatgtgagcgaaattatttcttattggggatttccatctgaagagtaccttgtcgaaacagaagatggatacattttatgtcttaatagaattccacatggtagaaagaatcattcagataagggtccaaaacctgttgtttttttacaacatggtcttttggcagattcatcaaattgggtaacaaatttagcaaattcatctcttggatttatacttgcagatgctggttttgatgtctggatgggaaattcaagaggaaatacatggtcaagaaagcataaaacacttagtgtttctcaagatgagttttgggctttttcatatgatgaaatggcaaaatatgatttacctgcatcaatcaatttcattttaaataaaactggtcaagaacaagtttattacgttggacattctcaaggtacaacaattggttttattgcattctcacaaattccagagcttgcaaaaagaattaaaatgttttttgctttaggtcctgttgcttcagttgctttttgtacatctcctatggcaaaattaggtcgtttaccagaccatttaattaaagatttattcggagataaagaatttttacctcaatctgcatttttaaaatggcttggaacacatgtatgtactcatgttatacttaaggagttatgtggtaatttatgttttttactttgtggattcaatgaaagaaatcttaatatgagtcgtgttgatgtttatactactcattcaccagctgggacatcagttcaaaatatgcttcattggagtcaagcagttaaatttcaaaagtttcaagcatttgattggggaagttcagctaagaattattttcattataatcaatcatatccaccaacttataatgtaaaggatatgcttgtaccaacagcagtttggagtggaggacatgattggcttgcagatgtttacgatgttaatatacttcttactcaaataacaaatcttgttttccatgaatcaattccagaatgggaacatcttgattttatttgggggttagatgctccttggagactttataataaaattattaatttaatgagaaaatatcaa

SEQ ID NO: 15611 - DNA, 1197 bp, Artificial Sequence
  Description of Artificial Sequence: Synthetic coding sequence
atgaaaatgcggtttctgggcctggtggtgtgtctggttctgtggaccctccacagcgaaggttcccgaggcaaactgactgccgtcgacccggaaaccaacatgaacgtttcggagatcatttcgtactggggattcccgtccgaagaatacctcgtggaaaccgaggacggatacattctgtgcttgaatcgtatcccgcatggtcggaagaaccacagcgacaaaggccctaagccggtggtgtttctccagcacggcctgctggccgactcctcaaattgggtcaccaatctcgctaatagcagccttggattcatactggccgatgcaggatttgacgtctggatgggcaattcacgtggaaacacctggtcacggaaacacaagaccttgtcagtctcgcaagatgagttttgggcattctcatacgacgagatggctaaatacgacctgccggccagcattaacttcatcttgaataagactggccaagaacaggtgtattacgtgggccattcccaagggaccaccatcggtttcatcgcgttctcgcagatcccggaacttgcaaagaggatcaagatgtttttcgcactgggaccagtcgcttctgtcgccttctgtacgtcgcctatggccaagttggggagactcccagaccatttgatcaaggatctcttcggtgataaggagtttctgccgcagtcagctttcctgaagtggctgggaactcatgtgtgcacccatgtcatccttaaagagctgtgcggcaacctgtgcttcctgctctgtggattcaacgaacgcaacctgaacatgagcagggtggatgtgtatactacccattcccccgctggcactagcgtgcagaatatgttgcattggtcacaggccgtgaaatttcagaagttccaggccttcgactggggatcgtccgccaagaactacttccactacaaccaaagctacccacctacttacaacgttaaagatatgctggtgcctaccgcggtgtggtcggggggacacgactggctcgctgatgtctacgatgtgaacatcctgctcactcagatcactaatttggtctttcacgaatcgatccctgagtgggaacacctggactttatctggggactcgacgcgccttggagactttacaacaaaatcatcaacctgatgcgcaagtaccaa

SEQ ID NO: 15612 - DNA, 1197 bp, Artificial Sequence
  Description of Artificial Sequence: Synthetic coding sequence
atgaaaatgaggttccttggactcgttgtctgtttagtattgtggaccttgcattctgaagggtcccgaggaaagctgaccgcggtcgaccctgagaccaatatgaacgtgtcggaaatcatctcatattggggctttccatccgaagagtatttagtggagaccgaagatggctacatactctgtctgaaccgcattcctcacgggcgtaagaatcacagtgacaagggaccaaagcccgttgtctttcttcagcatggactgttggcagattcaagtaactgggtcacgaatctcgccaactcatctctgggtttcatcctggcagatgcgggctttgatgtgtggatggggaatagtcgtgggaacacttggtcccggaaacataaaacactgagtgtttcccaggacgagttttgggctttttcatacgacgaaatggcaaagtacgacctcccagcatccatcaatttcatacttaacaaaactgggcaggaacaggtctactatgtcggacactctcagggtacaacaatcgggttcatcgcattcagtcaaataccggagctggccaagcggatcaagatgttcttcgcactcggacccgttgcctccgtagcgttttgtacaagccccatggctaagctagggcggttacccgaccacctgattaaagatttgtttggggataaagagtttttaccccagtccgcatttctcaagtggctcggtacccatgtctgtacccacgttatcctgaaggagctgtgtggtaatctttgcttccttctgtgtggtttcaacgagcgtaatctgaatatgtcaagggtagacgtgtacactactcactcccccgccggaactagcgtgcagaacatgctacattggtctcaggcagtgaagttccagaaattccaggccttcgactggggatcttccgccaagaactacttccattataatcagtcgtacccacctacgtataatgttaaggatatgctcgtccccacagctgtgtggagcggcggccacgactggctagctgacgtgtacgacgtcaacattctgcttactcagatcactaacctcgtttttcacgagtcaattccagagtgggagcatttggattttatctggggccttgatgccccctggcggctgtacaataaaataatcaatctaatgcgaaaataccag

SEQ ID NO: 15613 - DNA, 1197 bp, Artificial Sequence
  Description of Artificial Sequence: Synthetic coding sequence
atgaaaatgagattcctggggcttgtggtctgtctggtcctgtggactctccattccgaggggtcgcgtggtaagctcactgcagtggatccagaaactaacatgaacgtttcggaaatcatctcgtactggggcttcccatccgaggagtacctggttgaaaccgaagatggctacatcctgtgtctcaaccgaattccccacggacggaagaaccattcagataagggccctaaacctgtggtgtttctccagcatgggttgcttgcagattcctccaactgggtgactaatctggccaattcatctctggggttcattctggccgacgcaggattcgacgtgtggatggggaatagccggggtaacacctggagtcgcaagcataagactctcagcgtgtcccaggatgaattttgggcattctcctacgatgaaatggccaagtacgatcttcccgccagcattaactttattcttaacaagactgggcaagaacaagtgtactacgtcggacattcccaggggacgaccattggctttatcgcattcagccaaattcctgagctcgcaaagagaattaagatgtttttcgcgctcgggcctgtggcctcagtcgcgttttgtacttcacctatggctaagttgggacggcttcctgatcacctgattaaggacctttttggagacaaagaattcctccctcaatcagcatttctgaagtggctcggaacccatgtgtgcacccacgtgatccttaaggaactttgtgggaatctctgtttcctcctttgtggctttaacgaaagaaatctgaatatgtcaagggtcgatgtgtacactacccattcgcccgcaggtacctccgtccagaatatgttgcattggagccaggcagtcaagtttcaaaagtttcaggctttcgattggggttcctccgcaaagaattactttcattacaatcagtcctaccctcctacctataatgtgaaggacatgctggtgccgactgcagtgtggagcggaggtcacgactggttggccgatgtctacgatgtgaatatcctgttgacccaaattaccaatctcgtgtttcacgaatccattccagaatgggagcatctcgatttcatatgggggcttgatgcaccatggaggctttacaacaagatcattaatctcatgcgcaaatatcaa

SEQ ID NO: 15614 - DNA, 1197 bp, Artificial Sequence
  Description of Artificial Sequence: Synthetic coding sequence
atgaagatgcgtttccttgggctcgtggtgtgccttgttctgtggacccttcattctgagggctctaggggaaagttaacagctgtcgaccccgaaaccaacatgaatgtgtcagagataatcagttattggggctttccttctgaggagtatctcgtcgagaccgaggacggttacatcctttgtctaaataggatcccccacgggcgtaagaaccactccgacaagggacccaagccagtggtctttctgcagcacggactgctggctgactcttcaaactgggtgactaacctggctaattcatctctcgggtttattctggctgacgcagggtttgatgtctggatgggaaactctagaggcaacacatggtcccgcaagcacaaaactctctctgtgagccaagatgagttctgggccttcagctatgacgagatggccaaatatgatttgccagcctcaattaactttatattaaataagacaggccaggagcaggtctactatgtgggccacagccaggggacaaccattgggtttattgccttctctcagatccccgaattagctaaacgtatcaagatgtttttcgccctcggccctgtagcatcagtggcattttgtacatcacccatggccaagctgggaagactgcctgatcacctgattaaagacttgttcggcgataaagagttccttccacagagtgcctttctgaagtggctcggcacacatgtgtgcactcacgtaatcctaaaagaactctgcggcaacctgtgcttcctcctatgtggtttcaacgagagaaatcttaacatgagtagggttgatgtttacacgactcactctcccgccggaacctcggttcagaacatgctgcattggtcccaggccgtcaagttccagaaattccaggctttcgattggggaagcagcgctaaaaattatttccattacaaccagtcctaccccccaacttacaacgttaaagatatgctggtacctacagccgtgtggtccggagggcatgattggcttgcggacgtctatgacgttaatatcttactaacccaaattaccaatctggtattccacgagagcatccccgagtgggaacacctggactttatatggggcctagatgcgccctggcgtctgtataataagatcatcaatctcatgaggaaatatcag

SEQ ID NO: 15615 - DNA, 1197 bp, Artificial Sequence
  Description of Artificial Sequence: Synthetic coding sequence
atgaaaatgaggtttctgggtctggtggtttgtctggttctgtggacgttacattcagaaggttctaggggaaaacttactgctgttgatccagagacaaacatgaacgtgtcggaaattatcagctattggggcttcccgtccgaggagtatctcgttgagacagaggatgggtatatactatgtctgaatcgcatcccccacggccgaaaaaaccattctgacaagggtcctaaacccgtcgtctttctccaacatggcctgctcgcagactctagtaactgggtgaccaatctggcaaactccagcttaggttttatcctcgccgatgctggcttcgatgtttggatggggaatagtcgggggaacacatggagtaggaaacataaaactttgagtgtgagtcaggacgaattctgggccttctcttacgacgaaatggccaagtacgatctgccggcctctattaattttatcctgaataagactgggcaagagcaggtgtattatgtcggccactcccaggggaccaccatcggcttcatcgctttcagtcagatccctgagctagccaagcgaatcaaaatgttcttcgccttgggtccagtagcgagcgtggccttctgcacatctcctatggcaaagctgggacgactgccagaccacctgattaaggacctgtttggtgacaaagaatttcttcctcagtctgcttttctcaaatggctgggcacacacgtctgtacccatgtcattctaaaagaactgtgcggtaacttgtgtttcctgctgtgtggatttaatgagagaaacttgaatatgagccgggttgacgtctacacaactcacagtcccgccggaactagcgtgcagaatatgctccactggtcacaggccgtgaagttccaaaagtttcaggcctttgactggggatcgagtgcaaagaattactttcattacaatcagagttatccaccaacttacaacgttaaagatatgttggtcccgaccgcagtctggtctggaggccacgattggctggctgacgtctacgatgtcaacatacttctgacacagattaccaacctggtgttccatgagtccatccctgaatgggaacaccttgactttatctggggcttagatgccccctggcggctgtataataagataataaacctcatgcgcaaatatcag

SEQ ID NO: 15616 - DNA, 1197 bp, Artificial Sequence
  Description of Artificial Sequence: Synthetic coding sequence
atgaagatgcgatttctggggcttgtggtgtgccttgtgctgtggactcttcactcagaaggcagcaggggtaaactgaccgctgtcgaccccgaaactaacatgaatgtgtcagagattatcagctactggggctttccttcagaggagtacctcgtcgaaaccgaggacggttacattctttgtctcaaccgcatcccacacggacgaaaaaaccatagtgacaaagggccgaagcctgtggtatttctgcagcatggtctgcttgcagattcgtcgaattgggtaactaacctcgcgaactcgtccttgggattcatactcgcagatgcgggatttgatgtttggatgggaaactcgcggggcaatacttggtcgcggaagcataagaccctttctgtgagccaggatgaattttgggccttctcatatgatgagatggcaaagtacgaccttcctgcctctatcaactttattctgaacaagaccggtcaagaacaagtctactacgtgggtcattcgcaggggacgaccataggattcattgcatttagccaaatccctgaactcgccaagcgtattaagatgttcttcgcactgggacctgtggcttccgtcgcattttgtacctcgcctatggcgaagctgggtcgcctccctgaccacttgattaaagatctttttggcgataaggaatttctgccgcaatcagcattccttaagtggctcggcacgcacgtgtgtactcatgtgatcctgaaggaactgtgtggtaatctttgctttctgctctgcggcttcaacgaacgtaatctcaacatgtcgcgggtcgatgtctacaccactcattcccccgcgggaacctcagtgcagaatatgctccactggtcccaggctgtgaagtttcagaaattccaagcatttgactgggggtccagtgcaaagaattactttcattacaaccagtcctacccacctacttacaatgtgaaggacatgctggtgccgactgcagtgtggtcgggcggacatgattggttggctgatgtctatgacgtgaacattttgctgactcagataaccaacctggtctttcacgaaagcatacctgagtgggaacatctggatttcatttggggtttggatgcaccatggagactttacaataagattatcaacctgatgcgcaaataccaa

SEQ ID NO: 15617 - DNA, 1197 bp, Artificial Sequence
  Description of Artificial Sequence: Synthetic coding sequence
atgaagatgcgcttcctcggcctggtcgtttgtttggtgctgtggacccttcactcggagggatcccgcggcaagctcaccgcggtggacccagaaaccaacatgaatgtctcggaaatcatctcctactggggcttcccgagcgaggagtacctcgtcgaaactgaagatggatacatcctgtgcctgaatcgcattccgcatggaaggaagaatcactcggacaaaggcccaaagccggtcgtgttcctgcagcacggtttgctggctgactccagcaactgggtcactaacctcgccaactcaagcctgggatttatcctggcggacgcaggcttcgacgtgtggatgggcaactcccgcggtaacacttggtcccgcaaacacaagactctgtccgtctcacaggacgagttctgggcattttcgtatgacgagatggccaagtacgatcttccagcgtcaatcaactttatcctgaataagacgggacaggagcaggtgtactacgttggacactctcagggcaccacgatcgggttcatcgccttctcccagattccggaactcgccaagagaatcaagatgttctttgcgctgggcccggtcgctagtgtggccttctgcacctcgccgatggcgaaacttggacggttgccggaccatctgatcaaggacctctttggcgataaagaatttctcccccagagcgccttccttaaatggctgggaactcacgtgtgcacccatgttatcctgaaggaactttgcggtaacctctgctttctcctctgcggattcaatgaacggaacttgaacatgagcagggtggacgtgtacaccacccactccccggccggaaccagcgtgcaaaacatgctgcactggtcacaagcggtcaagtttcagaaattccaggcattcgattggggtagctcggcaaagaactacttccactacaaccagtcctaccctccgacttacaacgtgaaagatatgctggtgccgaccgctgtgtggtcaggaggacacgattggttggcagacgtgtacgacgtgaacatcctcctgacccagattactaacctcgtctttcacgagagcatcccagaatgggaacatctggacttcatctgggggcttgatgccccttggcgcctttacaataagatcatcaatctcatgcgcaaataccag

SEQ ID NO: 15618 - DNA, 1197 bp, Artificial Sequence
  Description of Artificial Sequence: Synthetic coding sequence
atgaagatgcgatttctggggctggtcgtctgtttggtgctttggacgctgcattcagaaggttcacgaggcaaacttactgccgtggaccctgagactaacatgaacgtgtcggagataatcagctattggggttttccgtcggaagaatatctcgtcgaaaccgaagatggctacatcctttgtctcaataggatccctcacggacgcaagaaccattcagataaaggccctaaacccgtcgtctttctgcagcacggcctgttggctgactcgtcgaattgggttactaaccttgccaattcgtccttgggatttatcctggcagacgctggttttgatgtgtggatgggaaatagccggggcaacacttggtcaagaaagcacaagaccttgtccgtgagccaggatgagttctgggcattttcgtacgacgaaatggcaaagtacgacctccctgcatcgataaacttcatcctcaataagacggggcaagaacaagtgtactacgtgggacattcccaaggaaccactataggttttatcgcgttttcacaaattcctgagctcgcaaagagaattaagatgttttttgcgctcgggcccgtggcctccgtggcattttgcacttcccctatggcaaagctgggcagactgcctgatcaccttatcaaggatctcttcggtgataaagagtttttgccacaatcggcgttccttaagtggctgggtacccatgtgtgcacccatgtgatacttaaagaactttgtggaaacctgtgctttctgctttgtgggttcaatgagcgtaacttgaatatgtcgcgcgtggatgtgtacaccactcattctccagcgggaacctcggtccagaatatgttgcattggtcacaagcagttaagttccaaaagttccaggccttcgattggggatccagcgcgaagaactacttccattacaaccaaagctacccaccaacctacaatgtgaaggacatgctggtgcccaccgccgtgtggtccggaggccatgactggctcgccgacgtttacgatgtgaacattctgttgacgcagattactaacctcgtttttcacgagtcgatccccgaatgggaacatctggatttcatatggggactggatgcaccgtggcgcctctacaacaagatcattaatcttatgcgaaaataccag

SEQ ID NO: 15619 - DNA, 1197 bp, Artificial Sequence
  Description of Artificial Sequence: Synthetic coding sequence
atgaaaatgcgttttcttggcttagtcgtgtgcctggttctatggacgcttcattccgaaggctctcggggaaagttaacagcggtcgatccagaaacaaatatgaacgtgagtgaaatcatatcctattggggctttccgtccgaggaatatttagtggaaacagaagacggatatattctttgtttaaataggattccgcatggaagaaaaaaccattcagataaaggcccgaagcctgtagtctttctgcagcatggccttcttgcggatagctccaattgggttacaaacctggctaattcttccctcggcttcattcttgcagatgctggctttgatgtatggatgggaaactcccgcggaaacacatggagtcgtaaacataaaacgctttctgtttctcaagacgagttctgggcttttagctacgatgaaatggccaaatatgacctgccggcatcaataaatttcatcctgaacaaaacgggtcaggaacaagtctattacgtgggtcacagccaaggtacgactattgggtttatcgcattttcgcaaattccggaattagcgaagcgcattaaaatgttttttgcgttaggccccgtagcctctgtggcattctgtacgtccccgatggctaagttaggcagattacccgaccatttaataaaggatttatttggggataaagaatttctcccacaaagcgcctttcttaaatggctaggcacacatgtttgcactcatgtaattctgaaagaactttgcggtaatttgtgctttttgttgtgtggatttaacgaacgtaacttaaatatgtcgagagttgatgtgtacacaactcacagcccggccggtacaagtgtgcagaacatgctacattggagccaagctgtgaagttccagaaatttcaggcctttgattggggatcgtctgcaaagaattatttccactacaatcaatcctacccgcctacctacaatgtcaaagacatgttagtaccgacagcagtttggagcgggggacatgattggttagcggatgtatatgacgtaaatatattacttacacaaattacgaaccttgtttttcatgaaagcatcccagaatgggaacatttggatttcatttgggggctagatgccccctggagattatataataagatcattaaccttatgcgaaaataccag

SEQ ID NO: 15620 - DNA, 1197 bp, Artificial Sequence
  Description of Artificial Sequence: Synthetic coding sequence
atgaaaatgcggttccttggtctggtggtgtgtctggttctgtggacactccacagtgaggggtccagaggaaagctgactgcagtggaccccgagacgaacatgaatgtcagcgagataatcagttattggggattccccagtgaagaatacctggttgagaccgaagacggctatatcctctgccttaaccggattccccatgggagaaagaaccactctgacaaaggccctaaacctgtagtgttcctgcagcacggtctcttggcggacagtagtaattgggtgaccaatctggccaactcttccctgggattcattctcgccgacgcaggctttgatgtctggatgggtaatagcaggggaaacacttggagtagaaaacacaaaacattgtccgttagccaggacgaattttgggccttcagttatgacgaaatggctaagtatgatctccccgcttcaatcaattttatcctgaataagacaggccaggagcaagtgtactacgtgggacactctcagggcaccacgatcggtttcattgccttctcacagattcctgagttggccaaaagaatcaaaatgtttttcgccctcgggcctgtggcaagcgtagcattttgcacttccccaatggccaaactcggccggctcccagaccatctcattaaggatttgtttggggataaagagttcctgccgcagtccgcttttctgaaatggctcggcacccatgtatgcacccatgtcatccttaaggaactgtgtggcaacttgtgtttcctgctgtgtggcttcaatgagcggaacctcaacatgtcaagggtggacgtctataccacccactcccccgcaggcacgtcagtccagaacatgctccattggagccaggctgtgaaattccagaagttccaagccttcgactggggtagctccgcaaagaactacttccattataatcagagctacccacctacttacaatgtgaaagacatgctggtgccgacggccgtgtggtcaggtggccatgactggctggcagatgtctatgatgttaatattctgctcacacaaataacaaacctggtgttccatgagtctatcccagagtgggaacacctcgattttatctggggcctcgatgctccctggagactgtacaacaaaattatcaatctgatgcggaagtaccag

SEQ ID NO: 15621 - DNA, 1197 bp, Artificial Sequence
  Description of Artificial Sequence: Synthetic coding sequence
atgaaaatgcgatttctcggcttggttgtgtgcctggtcctgtggaccctgcactcagagggcagtaggggcaaactgactgccgtcgatcctgagaccaacatgaacgttagcgagattataagttactggggcttcccatccgaagaatacttagttgagaccgaagacggctacatcctgtgcctgaatcggatacctcacggacgcaaaaatcatagtgacaaaggcccaaaaccagttgtgtttctgcagcatggtctgctggccgactccagcaactgggttacaaaccttgcaaattcttccctgggctttatactggccgatgctggctttgacgtgtggatgggcaacagccgcggtaatacttggtcaaggaagcacaaaacactgtctgtatctcaggatgaattttgggcattttcctatgacgagatggcaaagtatgatttgcccgccagcattaacttcatcttaaataaaactggccaggagcaagtgtactatgtgggccacagccaaggaaccaccattggatttatcgccttcagccaaatcccagagctcgcaaaaagaattaaaatgttcttcgccctggggcccgtcgcctccgttgccttctgcacatcaccaatggcaaagctcggccgcctgccagatcatctgataaaggacctatttggcgataaagaatttctgccgcaaagcgccttcctgaaatggctgggcacccacgtttgtacacatgttattctgaaagaactgtgtggcaacctgtgttttctgctctgcggctttaatgagcggaaccttaatatgagtcgcgtagacgtgtatacaacacacagccctgctggcacaagcgttcagaacatgctacactggagtcaggctgtgaagtttcagaaattccaggccttcgattggggaagttccgcaaaaaattactttcactacaatcagtcctatcctcctacatataacgtgaaggatatgcttgtccctaccgccgtatggtctggcggacatgattggctagccgacgtctacgatgtcaacatattgctgacacagataacaaatctcgtgttccacgagtccatcccagaatgggagcacctggacttcatttggggcctggacgctccttggcgactgtacaataaaataattaatctgatgaggaaataccaa

SEQ ID NO: 15622 - DNA, 1197 bp, Artificial Sequence
  Description of Artificial Sequence: Synthetic coding sequence
atgaagatgaggttcttgggactggtcgtctgcctggtgttgtggaccctgcatagtgaggggagtaggggaaaactcaccgcagttgaccccgaaacaaatatgaacgtatctgagatcatcagctactggggcttcccttcagaagagtacttagtcgaaacagaggatggctacatcttatgtctaaatcgcatcccccacgggcgcaaaaaccatagcgataaaggaccaaaacccgtcgtatttctccaacacggcttgctcgctgatagctccaactgggtgactaatctggcaaattcctctctagggttcatacttgcggacgccggtttcgacgtgtggatgggcaactccaggggtaacacttggagccggaagcacaagacactgagtgtgagtcaggatgagttctgggccttctcatacgatgaaatggccaagtacgaccttcccgcatctatcaactttatcttgaataagacaggtcaggagcaggtctattacgtgggacactcacagggcaccaccatcggattcattgcatttagccagatccctgagctggccaagaggatcaaaatgttttttgcgctcgggcctgttgctagcgtggctttttgtacttcacctatggcaaaactgggccgcttgcccgatcatctgatcaaagatctcttcggcgacaaagagtttctgccacagtcggcgtttctgaagtggctgggcacccacgtatgcacccacgtgatcttaaaagagctctgcggcaacttatgcttcttgctgtgcggattcaacgagcgtaacctcaacatgtccagagtggacgtgtatacaacacacagcccggcaggtactagtgtccagaatatgctgcactggagccaggcagtaaaattccaaaaatttcaggcctttgattgggggtcctctgctaagaactatttccactataaccagtcttacccgcctacttataacgttaaggatatgcttgtacccacggccgtatggagtggggggcatgattggcttgcagacgtttacgatgtcaatattctgctaacccagatcacaaacctggtgtttcatgagtcgattcccgaatgggagcatctcgactttatttggggtttggatgccccttggcgtttgtataataaaatcattaaccttatgaggaagtatcag

SEQ ID NO: 15623 - DNA, 1197 bp, Artificial Sequence
  Description of Artificial Sequence: Synthetic coding sequence
atgaagatgcggtttctcgggttggtcgtctgcctcgtcctgtggaccctccactccgaagggagccggggaaagttaacagcagtcgaccctgagacaaatatgaacgtgtccgaaatcatctcctactggggtttccctagcgaggaatacctggtcgaaaccgaggacggctacatactgtgtctgaatcgcatacctcatggaaggaaaaaccacagtgacaaggggccaaagcctgtggtttttctccagcacgggcttctggccgacagttcgaattgggtgacaaatctggcgaactcctcgctgggattcatcctagccgacgctggcttcgatgtgtggatgggcaactctaggggtaacacgtggagcaggaaacacaagacactctcagtcagccaagacgagttctgggcctttagctacgatgaaatggctaaatacgacctccccgcgtccatcaatttcatcttaaacaagacggggcaggaacaggtgtactatgtcggacattcacaaggtactacgatcggattcatcgcgttctcccagattcccgaactagccaaacggattaaaatgtttttcgcactgggtcctgtggcctcggttgcgttctgcaccagccctatggccaaactggggcggctgcccgaccacctgattaaggatctgttcggagacaaggaattcctcccacaaagcgcattcctgaagtggttgggtacacacgtttgtacccacgtcatcctgaaggaactatgtgggaatctctgttttctcctctgtggcttcaacgagaggaatctcaacatgtcccgagtcgatgtgtatactacgcacagcccagctggaacgtcagtgcagaatatgctgcactggtcacaggccgtgaagtttcagaagttccaagcattcgactggggctccagcgctaagaattacttccattacaatcagagctatccgccaacatataatgtgaaagatatgctggtgcctactgccgtgtggtccggtgggcacgactggttggcagacgtgtacgacgtgaacattttgctcacccagattacaaacttggtgtttcacgaatcgattccggagtgggagcatctggactttatatggggtctggacgcgccctggcgcttgtacaacaagatcattaatctgatgcgtaaatatcaa

SEQ ID NO: 15624 - DNA, 1197 bp, Artificial Sequence
  Description of Artificial Sequence: Synthetic coding sequence
atgaagatgcgcttccttggtttggtcgtgtgcctggtcctgtggactctgcactccgaagggtcgagaggaaaactgactgcggtggacccggaaaccaatatgaacgtgtccgaaatcatctcgtactggggctttcctagcgaggagtacctcgtcgaaaccgaagatggctacattctctgcctcaacaggattcctcatggacgcaagaatcactcggacaagggaccgaaaccggtcgtctttcttcagcacggtctgctcgcagatagcagcaactgggtcacgaacctcgctaactcatcactgggcttcatcctggctgacgcagggttcgacgtgtggatgggtaactcacggggaaatacttggtcacggaagcataagaccctgagcgtcagccaagacgagttctgggcgttctcgtacgatgaaatggccaaatacgatctgcctgccagcatcaatttcatcttgaacaaaacgggacaggaacaggtgtactacgtggggcacagccaaggaaccaccatcgggtttatcgcgttctcgcagatccctgaattggccaagagaatcaagatgttctttgctctgggaccagtagcaagtgtggccttctgcacgtcgccaatggcgaaactgggccggctcccggaccacctgatcaaggacctgttcggtgataaggagttcctcccgcagtcagcgttcctcaagtggttgggaacccacgtctgcactcatgtcatcctgaaagaactgtgtggtaatctgtgtttcctcctctgcggattcaacgagcgcaatttgaatatgtcccgagtcgacgtgtacactacccactccccagcaggcacctcggttcagaacatgctgcattggagtcaggcagtgaagttccaaaagttccaagccttcgactggggatcgtccgcaaagaactacttccactataaccaatcctacccgccgacctacaatgtcaaggacatgctcgtgccaaccgcagtgtggagtggaggacatgactggctcgcggacgtgtacgacgttaacatccttttgacgcagatcaccaacctggtgttccacgaaagcattccggagtgggagcacctggactttatctggggactcgacgcgccgtggcggctgtacaacaagatcatcaaccttatgcggaagtaccag

SEQ ID NO: 15625 - DNA, 1197 bp, Artificial Sequence
  Description of Artificial Sequence: Synthetic coding sequence
atgaagatgagatttctgggtttggtggtgtgtcttgtactttggactctccattcggaaggttcgcgtgggaaacttacggcggttgacccagagactaatatgaatgtgtcggagattatctcctactggggtttcccatccgaagagtacctcgtggaaactgaagatggctacatcctgtgcctcaacaggatcccacacggaaggaagaaccattccgacaagggacccaagccggtcgttttcttgcagcatggactgttggcagattcgtcaaattgggtgaccaatcttgccaattcgtccctgggtttcatactcgcagatgcaggttttgatgtgtggatgggaaatagcagagggaacacttggtcacggaagcacaaaaccctgtcggtgtcacaagacgaattttgggcattttcgtacgatgaaatggccaagtacgatctccctgcaagcataaacttcatcttgaacaagaccggtcaggagcaggtgtactacgtggggcattcccaaggtactactatcggctttatcgcatttagccaaatcccggaactggccaagcgaatcaagatgtttttcgcactggggcctgtggcgtctgtggcattctgcacttcccctatggccaagctgggcagacttcctgatcatctgattaaggatctgtttggagacaaggaattcctgccccagagcgcctttcttaagtggctggggacgcatgtgtgcacccatgtgatactgaaggagctctgtggcaacctgtgttttctgctttgtggatttaacgagcgaaatctgaacatgtccagggtggatgtgtacaccacccattccccagcaggtactagcgtgcaaaacatgctgcattggtcgcaggcagtgaagttccaaaagtttcaggccttcgattggggctcctcagcaaagaactattttcactacaatcagtcataccctcccacttacaacgtcaaggacatgctcgtgcctaccgctgtgtggagcggggggcatgactggctggcggatgtctacgatgtcaacatccttcttactcaaatcactaacctcgtctttcatgaatcaattccggaatgggagcatcttgactttatctggggtcttgacgcaccatggagactgtacaacaaaatcattaatctgatgcggaagtatcaa

SEQ ID NO: 15626 - DNA, 1197 bp, Artificial Sequence
  Description of Artificial Sequence: Synthetic coding sequence
atgaagatgcgttttctggggttagtagtctgtttggtgctgtggactctgcacagcgaagggtccagggggaagctgaccgccgttgaccccgagacgaatatgaatgtgagcgagattatctcatattgggggttcccctctgaggagtatctcgttgagacagaggacggctacatcctgtgcttgaaccggataccccacggacgcaagaatcattctgacaaggggccaaagcccgtcgtgttcttacagcatggactgctcgcggactcctccaactgggtcacgaacctggcgaactccagtttggggtttatcctagccgatgctggatttgacgtctggatgggaaacagtaggggaaacacatggagtaggaaacataagacactatccgtgagccaggatgagttctgggcttttagttacgatgaaatggccaagtacgatttacccgctagcatcaactttattctaaataagacaggccaggagcaggtttattacgtaggccactcacagggaaccacaatcggatttatcgccttttcacagatccccgagctagccaaacgtattaaaatgttctttgcacttggcccggtggcaagcgtggcgttttgcacaagcccaatggctaagcttgggagactccctgaccacttgatcaaggacctgttcggcgacaaagagtttctccctcagtctgccttcctgaagtggctcggcactcacgtctgtacccacgtgatcctgaaagagctctgtgggaatctttgctttctgctttgtggcttcaatgaacgcaacctgaacatgtctcgcgtggacgtctacactactcactcgccggccggcaccagcgtgcaaaacatgctgcactggagtcaggcagtgaagttccagaaattccaagcgttcgattggggctcaagtgccaagaactacttccattacaatcagtcgtatcctcctacttacaacgtcaaggatatgcttgtgcctacagccgtgtggagtggtgggcacgactggctggccgacgtgtatgacgtcaacatcctcctcacgcagatcacgaatctggtgttccacgagtccatacccgagtgggagcatctggatttcatttggggcctggatgcaccttggaggctgtacaacaagattattaatctcatgcgtaagtatcaa

SEQ ID NO: 15627 - DNA, 1197 bp, Artificial Sequence
  Description of Artificial Sequence: Synthetic coding sequence
atgaagatgcggttccttgggctcgtcgtgtgtttggttctgtggactctccatagcgagggttcacgcggcaagctgactgcggtcgacccagaaactaacatgaatgtgtccgagatcatctcgtattggggtttcccttccgaggaatacctggtcgagactgaagatggctacattctgtgcctcaacaggatcccgcatggaagaaagaatcactcggacaaggggcctaagccggtggtgtttctccagcatgggcttctcgcggattcatccaactgggtgactaacctggccaattcatccctgggattcatcttggctgatgccggattcgatgtgtggatgggaaactcgagaggcaacacttggtcgcgcaagcataagacgctctcagtctcacaagatgaattctgggcattctcgtacgatgaaatggcgaaatacgacctgccggcatcaatcaatttcatattgaacaaaactggacaggagcaggtgtactacgttggacactctcaaggaaccactatcggtttcatcgcattttcacagatcccggaacttgccaaacgcattaagatgttttttgccctgggaccagtcgcttcggtcgccttttgcaccagcccaatggcgaaactcgggcgcctgccggatcacttgattaaggacctgttcggcgacaaggaattcctgcctcaatccgccttcctgaagtggctcggaactcatgtctgcactcatgtgatcttgaaagaactgtgcggcaatctttgtttcctgctctgtggttttaacgagcgcaatctgaacatgtcaagagtcgacgtgtacaccactcattccccggcgggaacctccgtgcagaacatgcttcactggtcccaagcggtgaaattccagaagtttcaggcattcgactggggatcctccgctaaaaactacttccactacaatcagtcgtacccaccgacctataacgtcaaggatatgctggtgccgactgcggtgtggtccggaggacatgactggttggccgacgtgtatgacgtcaacatcctgctgacgcaaatcaccaatctcgtgttccacgagagcatccctgaatgggagcacctggactttatctggggactggacgccccttggcgcctgtataacaagattatcaatctcatgcggaagtaccag

SEQ ID NO: 15628 - DNA, 1197 bp, Artificial Sequence
  Description of Artificial Sequence: Synthetic coding sequence
atgaagatgcgttttcttgggttggttgtctgtctggtcctatggactttacattccgaggggtcgcgagggaaacttacagcagttgatccagaaactaatatgaatgtatccgagattatctcgtattggggtttcccgtctgaggaatacctcgttgagacagaagatggttacatcctctgtctgaaccgaatcccacacggccgtaagaatcattccgataaaggacctaaacctgttgtttttcttcagcatggtcttctagcagatagctcgaattgggttacgaatttggctaattccagtctggggtttatcctcgccgatgccggatttgatgtttggatgggtaacagccgtggtaatacatggagcagaaagcacaagactctatcagtttcacaagacgagttctgggcttttagctatgacgaaatggccaaatacgaccttcccgctagcattaacttcatcctcaacaagaccggtcaggagcaagtatactacgtagggcactctcaagggacgaccatcggcttcatcgctttctcacaaatcccggagttggctaagcgtatcaagatgttcttcgctttgggaccggttgcttccgtagctttctgcacgtcgcccatggcgaagctcggacggttacctgatcacctcattaaagatctgttcggtgataaggagtttctgccgcaatccgcgttcttgaagtggctcgggacccatgtttgtacgcacgtcatcctgaaggagttgtgcggaaatctttgctttctattatgcggattcaatgaaaggaatctcaacatgtcccgtgtcgatgtatatacaacccatagccctgctggtacttctgtccagaacatgctacattggagccaagccgtcaaattccagaaatttcaggctttcgattggggcagctcggctaagaattattttcattataatcagagctacccacctacctacaatgttaaggatatgcttgttcccaccgcagtctggtccggggggcatgattggttagcggacgtatacgacgttaacattcttcttactcaaatcacaaacctagtgttccacgagtctatccctgaatgggagcacctagattttatctggggtcttgacgcgccttggaggctctacaataagattattaaccttatgcgcaagtatcag

SEQ ID NO: 15629 - DNA, 1197 bp, Artificial Sequence
  Description of Artificial Sequence: Synthetic coding sequence
atgaaaatgcgtttcctggggctggtggtttgtctggtgctctggactctgcatagcgagggctcccgtgggaagctgaccgccgtggacccagagacgaatatgaatgtaagcgagattatctcctattggggattcccttcggaagagtatcttgttgagacagaggacggatacatcttgtgcctgaaccggattccccatggtcgcaagaatcattctgataaagggccaaaaccagtcgtgttcctacaacacggcttactggccgatagctctaactgggtgacgaacctcgctaatagcagccttggtttcatcctggccgatgccggattcgatgtgtggatggggaattctagggggaacacctggtctaggaaacacaagacattgagcgtctctcaggatgaattttgggctttctcctacgacgagatggccaagtatgacttaccagctagcatcaactttattttgaacaaaactggccaagagcaagtgtactacgtcggacatagccagggcactactatagggtttatcgccttttctcagatcccagagttggccaaacggatcaagatgttcttcgctctggggccggtcgccagcgtggctttttgcacctcaccaatggccaagctgggccgtctccccgaccacctgattaaagatttgtttggggacaaggaatttctaccacagtccgccttcctgaaatggttgggaacccacgtgtgtacccatgtgattctgaaagaactgtgtggcaatctttgcttccttctgtgtgggtttaacgagcggaatctcaatatgtcgcgtgtcgacgtctacacaactcacagcccagcaggaacaagtgtccagaatatgcttcactggagccaagctgtaaaatttcagaaattccaagctttcgattggggtagcagtgcgaaaaactatttccactacaaccagagttacccacccacatataacgtaaaggacatgctcgtccctaccgcggtctggtccggcggacacgactggttagctgacgtgtacgacgtgaatattctgcttactcaaattacgaatctggtgtttcatgagagcattcccgaatgggagcacctagactttatctgggggctcgatgccccatggagactttacaacaagataataaacctgatgcgtaagtaccag

SEQ ID NO: 15630 - DNA, 1197 bp, Artificial Sequence
  Description of Artificial Sequence: Synthetic coding sequence
atgaagatgcggtttttaggcctagtggtctgtctggtactctggacactacacagcgaagggagcagagggaagttaacagccgtggaccctgagaccaacatgaatgtctcagaaataatctcttactgggggtttccaagcgaagaatatctcgtggagacggaggacggctatatcttatgtcttaacaggattccgcacgggcgcaaaaaccacagcgataaggggcccaaacctgtggtgttcttacagcacggcttgctcgctgattcatctaattgggtcaccaatctcgccaactccagtctcggattcatcctagcagacgcaggtttcgacgtgtggatgggcaactcccggggaaacacgtggtcaaggaaacataaaaccctctctgtttcgcaggacgagttctgggccttttcatatgatgaaatggccaagtacgaccttcctgcctccatcaatttcatcctgaataaaaccgggcaggagcaggtctattatgtggggcactcacagggcaccaccattggattcatcgcattcagccaaattccagaactcgcaaaacgcatcaaaatgttttttgcacttggtccagtggcctcagtggccttctgcacatcaccgatggctaaactgggccgactgcccgaccacctgatcaaagacctgttcggagacaaggagttcttgccgcagtctgccttcttaaagtggttgggtacgcatgtgtgtactcacgtgattctcaaagaactgtgcggaaatctgtgttttcttctctgcgggttcaatgaacgaaacctgaacatgagtagagtcgatgtatacacgacgcactctcccgctggaacaagtgtccagaatatgctccactggagccaggcggtgaaatttcagaagttccaggcctttgattggggctcttccgcaaagaattattttcattacaatcaatcatatccaccaacctacaatgtgaaggatatgttggttccaacggcagtgtggtctggcgggcacgactggttagccgatgtatatgacgtaaacattctgctcactcagataacaaatcttgtctttcacgagagcatccccgagtgggaacacctcgattttatctggggtctggacgcgccatggagattatataacaagattatcaacctgatgcggaaataccag

SEQ ID NO: 15631 - DNA, 1197 bp, Artificial Sequence
  Description of Artificial Sequence: Synthetic coding sequence
atgaagatgcgctttcttggcttggtagtgtgtctggtgctgtggaccctacacagcgagggctccagggggaagctgacggccgtggaccccgaaaccaacatgaatgtgtcagaaatcatcagttattggggtttcccttccgaggaatacctcgtggagaccgaagacgggtacattctgtgcctgaatcgcatcccacacggcaggaagaatcattccgataaaggcccaaagccagttgtcttcttacagcacggactcctggccgattcgtctaattgggttacaaatctcgcgaatagttcattaggctttatccttgccgatgccggatttgatgtttggatgggtaactctcggggcaacacatggagccgcaaacacaaaacactgagtgtaagccaggacgagttctgggctttctcatacgacgagatggctaaatatgatctccccgcctccatcaattttatcctgaataagactggccaagagcaagtttattatgtggggcactcccagggtaccactataggatttatagctttcagccagatcccagagctggcgaaaagaatcaaaatgtttttcgccctgggtcccgtcgctagtgttgctttttgcacatccccaatggccaagcttggaaggctgccagaccacctgatcaaggacctgtttggcgataaagaatttctgccccaatctgcctttctcaagtggctcggaactcacgtgtgcacacacgtgatcttaaaggagttgtgtggcaatctgtgctttctactctgtgggttcaatgaaaggaacctgaacatgtcgcgggtcgatgtgtacactacacattcaccagcagggacctccgtacaaaatatgttgcactggagtcaggcggtgaagttccagaagtttcaagctttcgactggggatcgagcgcaaagaattatttccactacaaccagtcctatccacccacatataacgtgaaggatatgctggttccaacggcagtctggagtggcggccacgactggctggccgacgtctatgacgtgaacatcctgttgacccagatcacgaatctcgtttttcacgagtcgataccggagtgggagcatttggattttatttggggacttgatgccccatggaggctatacaacaagattatcaacctgatgaggaaataccag

SEQ ID NO: 15632 - DNA, 1197 bp, Artificial Sequence
  Description of Artificial Sequence: Synthetic coding sequence
atgaaaatgaggttcctgggacttgttgtgtgtctggtgctgtggactttgcattcagaaggaagccgaggaaagctcaccgcagtggaccccgaaactaacatgaatgtcagcgagataatcagctactgggggtttccatccgaagagtaccttgtcgaaactgaggatggttacattctttgtctgaatcgtattccgcacggacggaaaaaccatagcgataagggacccaagccagtggtgttcttgcaacatggcctccttgcggactcaagcaattgggttactaacctggcaaactcctcactgggctttatacttgccgatgcggggtttgacgtgtggatggggaactcgcgaggcaatacctggtcccggaaacacaaaaccctgtcggtgtcgcaagatgaattctgggcattctcgtacgacgagatggccaaatacgatttgccggcatccataaacttcatcctcaataagactggccaggaacaggtctactacgtcggtcatagccaaggaaccacgattggatttatcgcattttcccaaattcctgaattggctaaacggattaagatgtttttcgcattgggaccagttgcctccgtggcattttgtacctcgccaatggcaaagctgggacgccttcctgatcatctgattaaggatctgtttggggataaggagttcctccctcaatcagcattcctgaagtggttggggactcatgtgtgtacccacgtgatccttaaggaactttgcgggaacctttgctttctcctttgcggttttaacgaacgcaatctgaatatgtcgcgcgtggacgtgtacaccacccactcgccggcgggtacttcggtgcagaacatgctgcattggtcgcaggcagttaagtttcaaaagttccaggcattcgattggggatcgtcggccaagaactactttcactacaaccagtcgtaccctcccacctataatgtcaaggacatgcttgtcccaactgctgtctggtctggcggtcacgactggctggcagatgtgtacgatgtgaacattcttttgacgcagattaccaaccttgtctttcatgaatcgataccagagtgggaacaccttgactttatctggggcctggatgcgccttggcgactgtataacaaaatcatcaacctcatgcggaagtaccaa

SEQ ID NO: 15633 - DNA, 1197 bp, Artificial Sequence
  Description of Artificial Sequence: Synthetic coding sequence
atgaaaatgcggttccttggtcttgtggtgtgccttgtgctgtggactctccattcagaaggatctcgaggtaagctgacggcggtggacccggaaactaatatgaacgtgtcagaaatcatttcctactggggatttccctctgaagagtacctcgtggaaactgaagatggctatattctgtgtctcaaccgcatcccccatggacgcaagaatcactcggacaaaggcccgaagccagtggtgttccttcagcatgggttgctggcagattcgtcgaactgggtgaccaaccttgcaaactcctcattgggctttattctcgccgatgcggggtttgacgtctggatggggaactcgcgtggaaacacctggtcgcgaaagcataagacccttagcgtgtcgcaagatgaattctgggcattttcctacgacgaaatggccaagtacgatcttcctgcttcaataaactttatcctgaataagaccggacaagaacaagtctattatgtgggtcattcgcaaggaaccaccatagggtttatcgccttctcccagattcctgaactcgcaaagcgcattaagatgttttttgctctggggccagtggcatccgtggccttttgtacctccccgatggccaagctgggcagacttcccgaccatttgattaaggatctgttcggcgacaaggagtttcttccacaaagcgcgttccttaaatggcttggaacgcatgtctgtactcatgtgatactcaaagaactctgcggtaatctttgttttctgttgtgtggattcaacgaacgtaatctgaatatgtcaagagtggatgtctacacgacccattcccccgcaggtaccagcgtacagaatatgttgcactggtcgcaggcggtcaaattccaaaagtttcaagcatttgactggggttcgtccgcaaagaactactttcattacaatcaaagctaccctcctacttataacgtgaaggatatgctggtgcccaccgcagtgtggagtgggggccatgattggctcgctgatgtctacgatgtgaatattctgctgactcaaatcaccaacctggttttccatgaatcgatacctgaatgggaacaccttgacttcatttggggtctggatgcaccttggcgtttgtacaacaagatcattaacctgatgcgaaagtaccag

SEQ ID NO: 15634 - DNA, 1197 bp, Artificial Sequence
  Description of Artificial Sequence: Synthetic coding sequence
atgaagatgaggttcttgggactggtagtttgtctggtgctctggacactgcacagcgaaggctcacgcggcaagcttacagctgtcgatcccgagaccaacatgaacgttagcgagataatatcttactggggcttcccatcagaagaatacctggtggaaacagaggatggttacatactgtgcctcaataggatacctcacggaagaaaaaatcactctgacaagggacccaagcctgtcgtgttcctccaacacggccttctggccgattcatctaactgggtgaccaatcttgccaacagcagcttgggttttattctcgctgacgctggttttgacgtttggatgggaaattctaggggaaacacttggtcccgcaagcataagaccctgagtgtgagccaagacgaattttgggccttctcctacgatgagatggctaaatatgacctgcccgctagtattaacttcattctgaacaagaccggccaggagcaggtttactacgtgggacactcccaaggcactacaatcggtttcatcgccttttcacagattccagagctggccaaaaggatcaagatgttcttcgcgctcggtcctgtggcatccgtggccttttgcacgtccccaatggctaagctgggccgcctgcccgaccatctgattaaagacttgtttggagacaaggagttcctccctcagagtgccttcttgaagtggctcggtacccacgtgtgcacgcacgtcatcttgaaggaattgtgcggaaatctctgcttcctgctctgtggatttaacgagcgcaacctgaacatgtccagagtagacgtatataccacccactctccggccggtacctccgtgcagaacatgctccattggtcccaggccgtcaagttccagaagttccaagcattcgactggggctctagtgcgaagaattattttcattacaatcaatcttaccccccaacatacaacgttaaggacatgttggtcccgactgcggtgtggtccggtggccacgattggctcgcggatgtttacgacgtgaatatattgttgactcaaattactaacctggttttccatgagagtatacctgagtgggaacatctggatttcatttggggcttggacgctccttggaggctctacaacaagattatcaacttgatgagaaagtaccaa

SEQ ID NO: 15635 - DNA, 1197 bp, Artificial Sequence
  Description of Artificial Sequence: Synthetic coding sequence
atgaaaatgagattccttggactcgtggtgtgtctggtgctttggacgcttcattcggaggggtctcgcgggaagctgactgcagtcgaccctgagactaacatgaatgtcagcgagatcattagctactggggctttccctccgaggaatacctggtggagacagaagacggctatatcctttgtctcaaccggattcctcacgggcggaagaatcattcagataagggcccaaaacctgtagtgtttctgcagcatggcctgcttgccgacagttcgaactgggtgacaaatctggccaactcttctctggggttcatccttgcagacgcgggatttgatgtgtggatgggaaattctagaggcaatacatggagccgtaaacacaaaacactctccgtttcccaagacgaattttgggccttctcttacgacgagatggcaaaatatgacctccccgcaagcatcaacttcatattgaataaaaccggtcaagaacaggtgtattacgttggtcactcacagggcacaacaatcggctttatcgccttctctcagattccagaattggcaaaacggataaagatgtttttcgccctggggcccgtggcttctgtcgcattttgtacctcccctatggccaaacttggacgtctgcccgaccacctgatcaaagacttgttcggcgataaggagttcctgccccagtcagcgttcctgaagtggctgggaacacacgtctgtacccatgttattctcaaagaactctgcgggaacctatgttttctgctttgcgggtttaacgagcgcaatctgaatatgagtagagtggatgtctataccacacactccccggccggtacctccgtacagaacatgctccattggagccaggcggtaaagttccagaagttccaagcgtttgactgggggtcctcagctaagaactatttccactataatcagagttatccccctacatacaacgttaaagacatgctggtgcccacagccgtgtggagtggcgggcacgattggttagctgatgtctacgatgtaaatatccttttgacacagatcacgaacctggtgttccacgagagcatccccgagtgggagcacttggacttcatatggggtttggatgctccgtggcgattatataacaagatcataaaccttatgagaaaatatcag

SEQ ID NO: 15636 - DNA, 1197 bp, Artificial Sequence
  Description of Artificial Sequence: Synthetic coding sequence
atgaaaatgaggttcctgggccttgtggtgtgtctggtcctgtggaccctgcactccgaaggcagcagaggcaaactcactgctgtcgacccagaaacaaacatgaacgttagtgagattattagctattgggggttcccttccgaggagtatctggtcgaaacagaagacgggtacattctgtgcctgaaccgaatcccccacggcaggaagaaccattctgataaaggaccaaagcccgtcgtgtttttgcagcatggactccttgccgacagttccaattgggttactaatctggccaatagcagtctgggctttatcttagcagatgcgggattcgacgtttggatggggaattcacgcgggaatacctggtcccgtaaacataaaactctgtccgtttctcaggatgagttctgggcattttcttatgacgagatggccaaatatgacttacctgccagtattaacttcatactcaacaaaaccgggcaggagcaagtttactacgtgggccacagccagggtaccacaatcggttttatagcttttagccagatccccgaattggccaaaaggattaagatgttcttcgccctgggcccagtggccagcgtggcgttttgcacatccccaatggctaaactgggcagactgcctgaccacctcatcaaagacctgttcggggataaagaattcctgccccaatcggccttccttaaatggctgggcacccacgtgtgcacccacgtgattctgaaagaactgtgtggaaatctgtgctttctgctttgcgggtttaacgagcgaaacctgaacatgagcagggttgacgtttacacgacacattcccctgccggcaccagcgtgcagaatatgctacactggtcccaagccgtgaagtttcagaaatttcaagcattcgactggggttcgagcgcgaagaattacttccactataaccagtcatatccacctacatacaacgtgaaggatatgctggttccaacagcggtctggtcaggaggtcatgactggcttgcggatgtgtacgatgttaatattctgctcacacagataactaacctcgtttttcacgagagcatcccggagtgggaacatttggatttcatctggggtttggatgctccttggagactgtataataagattattaatcttatgagaaagtatcag

SEQ ID NO: 15637 - DNA, 1197 bp, Artificial Sequence
  Description of Artificial Sequence: Synthetic coding sequence
atgaagatgcgcttcttggggcttgtggtctgccttgttctctggactctgcactcggagggttcgagaggtaagctcaccgccgtcgaccccgagactaacatgaacgtttccgagatcatctcctactggggtttcccctcggaggagtacctggtagagaccgaagacggctacatcctgtgcctcaacaggataccgcacggacgcaagaaccactctgacaagggccccaaacctgtggtcttcctgcagcacggactgctcgctgactcttccaattgggtcactaacctcgcaaattccagcctcggtttcatcctagctgatgccggtttcgatgtgtggatgggtaactccagaggcaacacatggagccgcaagcacaagacgctctcggtcagccaggacgaattctgggcattctcctatgacgagatggctaagtatgacctgcctgcaagcatcaacttcattttgaacaagaccggccaggagcaagtgtactatgtcggccactcccagggtactacaattggctttatcgccttcagccaaatccccgagttggcaaaaaggatcaaaatgtttttcgctctgggtcctgtcgcctcggtggccttttgcaccagcccgatggcgaagctcggacgtctgcccgatcacctcattaaggatctctttggcgacaaagaattccttccccagtccgcgttcctgaagtggctcgggacgcacgtctgtacacacgttatcttaaaggagctgtgcggtaacctgtgtttccttctgtgcgggtttaacgagcgcaatcttaacatgagcagagtcgacgtctacaccacacactcacccgccggcacttctgtgcaaaatatgctgcattggtcccaggcggtgaaattccagaagttccaggccttcgattggggtagtagtgccaagaactacttccactacaaccagtcctaccccccgacatacaatgtcaaggatatgctcgtccctaccgcagtctggtccggtggccacgactggctggccgatgtctacgacgtaaacattctcttgacccaaataacgaacctcgttttccacgaatctattcctgagtgggagcatctcgatttcatctggggcttggacgcgccctggcgattgtataacaagatcattaatcttatgcgcaagtaccag

SEQ ID NO: 15638 - DNA, 1197 bp, Artificial Sequence
  Description of Artificial Sequence: Synthetic coding sequence
atgaaaatgcgctttctgggactcgtcgtctgccttgtgctgtggacccttcactccgagggcagccgcggaaaactgactgccgtcgatcctgaaactaacatgaacgtcagcgaaatcatctcctactgggggttcccatctgaagagtaccttgttgaaactgaggatgggtacattctttgcttgaatcgcatcccacatggaagaaagaatcactccgacaaaggacccaagccggtggtctttcttcagcatggactcctcgcagactcctcgaattgggtgacgaatctggccaactcgagcctcggcttcatcctcgctgatgccggctttgatgtgtggatgggaaactcacggggaaacacttggtcgcgtaaacacaaaacgctgtcagtttcacaagacgaattctgggcgttcagctacgatgaaatggcgaaatacgacctgcccgcttcaatcaatttcatcctcaacaagaccgggcaggaacaagtgtactatgtgggtcacagccagggcactaccattggattcattgccttctctcagattccggaacttgccaagagaatcaaaatgttcttcgcactgggtccggtcgcgtcggtcgcattctgtacctcaccgatggcaaaactcggccgcttgccggaccacctgatcaaggatttgttcggagataaggagttcctcccgcaatcagcattcctcaagtggttggggacgcatgtctgcacccatgtcatcctgaaggagctgtgtggaaatctgtgtttcttgctctgcggcttcaacgagaggaacttgaacatgtcgcgcgttgacgtgtacaccacccatagcccggccgggacctctgtgcagaatatgctgcactggtcgcaggctgtgaagtttcaaaagttccaggcctttgactggggaagctccgccaaaaactacttccactacaatcagtcatacccgccaacctacaatgtcaaggacatgctggtgccgactgcggtctggagcggcggtcacgactggctggccgacgtgtacgacgtgaatattctgctgactcagatcacgaatctggtgttccacgagtccatccctgaatgggaacatctcgactttatctggggactggacgcgccgtggcgcctgtacaacaaaatcattaacctgatgagaaaataccaa

SEQ ID NO: 15639 - DNA, 1197 bp, Artificial Sequence
  Description of Artificial Sequence: Synthetic coding sequence
atgaagatgcggttccttgggctggtggtgtgtctggtgctgtggaccctgcattccgaaggtagccgaggtaagttgacggcagtcgaccctgaaaccaacatgaatgtcagcgagatcattagctactggggcttccctagcgaagaatacctcgtggaaactgaggatggctacattttgtgtctcaaccgcattccacatgggagaaagaatcattcagataaaggaccgaagcccgtggtttttcttcaacatggactccttgccgattcatccaattgggtcactaacctggcaaactcgtcattgggattcattttggcagacgctgggtttgatgtctggatgggaaacagccgtgggaatacctggtcgcgaaagcacaagaccttgtcggtgtcccaagatgagttctgggcattttcgtacgatgagatggcgaaatatgatctgcctgcatcaattaactttatccttaacaagactggacaggaacaagtctattacgtgggccatagtcaaggaactactatcgggtttattgcatttagccagattcccgaacttgccaagcgaattaagatgtttttcgcactcggaccagtggcatccgtggcattctgtacgtcgccaatggcaaagttgggtagacttccggatcatctgattaaggacctgttcggagataaggaatttctgccccagtcggcgtttttgaaatggcttggtactcatgtgtgcacccacgtgattcttaaggaactgtgcggcaacctgtgttttcttctttgtggtttcaatgagcggaacctcaatatgagcagggtggatgtgtacacgacccactccccggctgggacttcggtccaaaacatgctccattggtcccaggccgtgaaatttcaaaagtttcaggcatttgactgggggtcaagcgccaagaactacttccactacaaccaatcgtaccctccaacctacaatgtcaaggacatgctggtgcctacggccgtgtggagcggcgggcacgattggcttgccgatgtgtacgatgtcaacattctcctgacccagatcactaaccttgtgtttcatgaatcgattccagaatgggaacacttggactttatctggggactggacgccccttggagactgtacaataagatcatcaacctcatgcgcaagtaccaa

SEQ ID NO: 15640 - DNA, 1197 bp, Artificial Sequence
  Description of Artificial Sequence: Synthetic coding sequence
atgaagatgaggtttctcggcctcgtcgtatgtctcgtcctgtggaccctccattccgaggggtcgaggggcaagttaaccgcagtggaccctgagaccaacatgaatgtgtccgagattatctcctattggggcttccctagcgaagagtatctggtggaaacagaagacggttacattttgtgcctgaatagaattccccatggccggaaaaatcactcggacaaggggccaaagcctgtggtgtttctgcagcatggacttctcgccgattcctctaactgggttacaaatttggccaatagttctttgggttttattttggccgatgctggatttgatgtgtggatgggaaactcccgcggtaatacctggagccgtaagcataagaccctctccgtgtcccaggatgaattttgggcgttttcttacgatgagatggccaagtatgacctgcccgcgagcatcaattttatccttaacaagacgggccaggagcaggtctactacgtgggccactcccaaggcaccactattgggtttatcgccttctctcaaatcccagaactggcaaaacggataaagatgtttttcgctctaggacccgtcgcaagcgtcgccttctgtacaagccccatggccaaactggggcgcctcccagatcatctcatcaaagacttatttggtgataaggagttcctgccgcagagcgctttcttaaagtggctcggtacgcatgtgtgtacacacgtcatactcaaggagttatgtggaaacttgtgctttttactgtgcggctttaatgaacgaaacctaaatatgtccagggtcgatgtttacacaacacatagtcccgcgggcacatccgtgcagaacatgctgcactggagccaagctgtgaagtttcagaagtttcaggcgttcgactggggatccagcgcgaagaactacttccactacaaccagtcttacccccccacctataatgtgaaagacatgcttgtaccaacagccgtgtggagtggaggacatgattggcttgcagatgtgtacgacgttaatatcctgctcactcagataactaacctcgtattccatgaaagtatacctgagtgggaacaccttgacttcatatgggggctcgacgccccttggaggctgtacaacaagatcataaaccttatgaggaaataccag

SEQ ID NO: 15641 - DNA, 1197 bp, Artificial Sequence
  Description of Artificial Sequence: Synthetic coding sequence
atgaagatgagattcctgggcctggttgtgtgcctcgtcctgtggactcttcatagcgaaggtagcagaggaaaacttactgcggtcgacccagagactaatatgaacgtgtcggagattatctcgtactggggttttccgtcagaagaatatctggtcgaaactgaggacggatacattctctgtctcaatcgcatccctcatggtcgcaagaaccactcagacaagggcccaaagccggtcgtgttcctgcagcatgggctgctcgccgatagctcaaactgggtgactaacctggccaactcgtcactcggattcatcctggctgatgcaggattcgatgtctggatgggcaacagccggggaaatacttggtcacgcaagcacaaaaccctgtcagtgtcgcaggacgagttctgggctttcagctacgatgaaatggccaagtacgatttgccagcctcaatcaatttcattctcaacaagactggccaggaacaagtgtattacgtcggacactcacagggaactaccatcggatttatcgcgttttcacagatcccggaacttgccaagcggatcaaaatgttcttcgctcttgggcccgttgcatcggtggcgttttgtacgtcacccatggcgaagctgggccggctgcccgatcatctgatcaaggacttgtttggcgacaaggagttcctgcctcaatccgctttcctcaagtggctcggtactcacgtgtgcacccacgtaatcctgaaggagctgtgcggaaatctctgttttctgctgtgtggattcaatgaaagaaacctcaatatgtccagggtggacgtgtacactacccactcgccagccggcacttcagtccagaacatgcttcactggtcccaggccgtgaagttccagaagttccaggcgttcgattggggttcttcggccaagaattacttccattacaaccagtcgtacccgccgacgtacaatgtgaaggacatgctggtccctaccgccgtgtggtcgggaggacacgattggctggctgacgtgtacgacgtgaatatcctgctcactcaaatcaccaacctggtgttccacgagtcaatcccagaatgggagcacctggatttcatctgggggctcgacgcgccttggaggctctacaacaagattatcaacctcatgagaaagtaccag

SEQ ID NO: 15642 - DNA, 1197 bp, Artificial Sequence
  Description of Artificial Sequence: Synthetic coding sequence
atgaagatgcggttcctgggactcgtggtgtgcctggtgctttggaccctgcactcggaaggttcgagaggaaagctgaccgcggtggacccagagactaatatgaacgtgtcagagatcatcagctactgggggtttccgtccgaggagtacctggtggaaaccgaagatggatacatcctgtgcttgaatcggattccgcacgggcgcaagaatcacagcgataaggggccgaagccagtggttttcctgcagcatggactgctggcagactccagcaattgggtgacgaacctggcgaattcctccctgggattcattctcgcagacgcgggattcgacgtgtggatgggcaactcaagggggaatacctggtcgcgtaagcacaagacgctgtcagtgtctcaggatgaattctgggccttctcctacgacgagatggccaaatacgatctgccggcctcaatcaacttcattctcaacaagactggacaggagcaagtgtactacgtgggacatagccaagggaccaccatcgggttcatcgccttctcacagatccctgagctggccaagaggatcaagatgttctttgcactcggaccagtcgcatccgtggccttttgcacctcaccgatggccaagctgggacgcctgcctgaccatctcattaaggacctgttcggagacaaagagttcctcccacaaagcgcgtttcttaagtggctgggcacccatgtctgcacgcatgtgatcctgaaagagctgtgcggaaacctctgcttcctcctgtgcggcttcaacgagcggaacctcaatatgtccagagtggacgtttacactactcacagcccagcaggcaccagcgtgcagaatatgctccactggagccaagcggtgaaattccaaaagttccaagccttcgattggggctcgtccgccaagaattactttcattacaaccaaagctaccctccgacttacaacgtcaaggacatgctggtgccaaccgcggtctggtccggaggacacgactggctcgctgacgtctacgacgtcaacattctgctcacccagatcactaatctggtctttcacgaatcgatcccggaatgggaacacctggacttcatttggggcttggacgcgccatggaggctttacaacaagataatcaacctcatgcgcaagtaccag

SEQ ID NO: 15643 - DNA, 1197 bp, Artificial Sequence
  Description of Artificial Sequence: Synthetic coding sequence
atgaagatgcggttcttgggcttagtggtgtgtctggttctgtggaccctgcactctgagggatcccggggcaagctcacggctgtcgatccagagaccaatatgaatgtttctgagatcatcagttattggggtttccctagcgaagaatatctggtggagacagaggacggttatatactctgcttgaacagaataccccacggacgcaagaaccactcagataagggtcctaaacctgtggtcttcctgcagcatggcttacttgccgactcctcaaattgggtaactaacttggccaattcttcccttggattcattctggccgatgccggattcgacgtctggatggggaattcacggggaaatacctggagcaggaagcacaagacgctgagtgtctcgcaggacgagttttgggcattttcatatgatgaaatggctaagtatgatctgcctgcttcaattaacttcattcttaacaaaaccggccaagaacaggtttactatgttggccactcacaggggacaaccattgggtttattgccttctctcaaatccccgaactggccaagcgcataaaaatgttttttgccttgggcccggtggccagcgttgctttctgcacttccccgatggccaaattaggacgtctgcctgaccatcttatcaaagaccttttcggcgacaaggagttcttgcctcaaagtgcttttctgaaatggctaggtacacacgtgtgtacccatgtgattctgaaagagctgtgtgggaacctatgtttcctactgtgtgggtttaacgaacgcaatctcaatatgtccagggtggacgtttataccactcatagccctgctggaacgtcggtgcagaatatgctgcactggtcacaggctgtcaagtttcaaaagttccaggccttcgattggggctcctcagctaaaaactatttccattataaccagagctaccctccaacatataacgtgaaagatatgctcgttcctaccgctgtatggtcaggcggccatgattggctagctgatgtttatgatgtcaacatactgctgacgcagattacgaacctggttttccatgaaagtattcccgagtgggaacacctcgatttcatatggggcttggacgccccatggcggctctataacaaaattatcaatttaatgcgaaaatatcag

SEQ ID NO: 15644 - DNA, 1197 bp, Artificial Sequence
  Description of Artificial Sequence: Synthetic coding sequence
atgaagatgagattcctgggtctggtggtctgtctggtgctctggactctgcactcagaaggttcccgaggaaagctgactgcagtcgatcccgagactaacatgaacgtgtccgagatcatttcgtactggggtttcccttccgaagagtaccttgtggaaaccgaagatggatacatactttgtcttaacaggatccctcacggaaggaagaatcattcggataaaggccctaagccagtcgtctttctgcagcatggactgctggcagactcatcgaattgggtcaccaaccttgcaaattcctcccttggattcatactcgcagatgcagggtttgatgtgtggatgggcaactctaggggtaacacctggtcacggaagcataagaccctctcagtcagccaggatgagttctgggcattttcatacgatgagatggccaaatacgatcttcctgcctccataaactttatcctgaacaagactggacaggaacaggtttactatgtgggacattcacagggaacgactatcggcttcatcgcattctcacaaattccagaattggcaaagcgcattaagatgttctttgcactgggacccgtggcttccgtggccttttgtaccagcccgatggcaaagctcggtaggctgcctgatcacttgattaaggatctttttggtgataaagaatttcttccacaaagcgcattccttaagtggctcggtacccatgtctgcacccatgtgattcttaaggaactttgcggaaacctgtgttttctgctgtgcggtttcaatgaaagaaacctgaatatgagcagagtggatgtgtacaccacccacagcccagccggaactagcgtccagaatatgctgcattggtcccaagccgtcaagtttcagaagtttcaggccttcgactgggggtcgtcagcaaagaactatttccactacaatcagtcataccctccaacttacaacgtcaaggatatgctcgtgccaaccgcagtgtggtcgggaggacatgattggctggccgacgtctacgatgtcaacattcttctgacgcaaattactaaccttgtgtttcatgagtccatcccggagtgggaacatttggacttcatttggggactggatgcaccatggagactctacaacaagatcatcaacctcatgcgtaagtaccag

SEQ ID NO: 15645 - DNA, 1197 bp, Artificial Sequence
  Description of Artificial Sequence: Synthetic coding sequence
atgaagatgcggtttctgggactggtggtgtgcctggtcctctggaccctccatagcgaaggctcccggggcaagctgactgccgtcgacccagagactaacatgaacgtgtcagaaatcatctcgtactggggattcccatccgaagagtacctcgtcgaaactgaggatggctacatcctgtgcctgaaccgaattccccatggccggaagaaccactccgacaaaggccccaagccggtcgtctttctccagcacggactcctggccgactctagcaactgggtcaccaaccttgcgaactcgtctcttggatttatcctcgcggatgcaggtttcgacgtgtggatgggaaacagccgggggaatacctggagcaggaagcataagactctgtcggtgtcacaagatgagttctgggccttcagctacgacgaaatggcaaaatacgatctgccagcttcaatcaatttcatcttgaataagaccgggcaggaacaggtctactacgtgggtcactcccagggcactaccattggattcattgccttcagccagatcccggagttggcgaagcggatcaagatgttcttcgccctgggtcctgtcgcttcggtcgcattttgtacctcgccgatggctaaactcggacggttgcctgaccacctgatcaaagacctctttggagacaaagagtttctgcctcaatccgctttcctgaagtggctggggacccatgtttgtacccacgtcattctgaaagaactgtgcggcaacctgtgcttcctcctgtgcggattcaacgagcgcaatctgaacatgtcacgcgtggacgtttacactacccattcaccagccggtacctctgtgcaaaacatgctgcattggtcccaggccgtgaaatttcagaagtttcaggccttcgactggggcagctcggcgaaaaactacttccactacaatcagtcgtacccgcctacctacaacgtgaaagatatgctggtgccaactgcagtctggtcgggcgggcatgactggctggctgacgtgtacgacgtgaatattctgcttacccagatcaccaacctcgtgttccacgagtcaatccccgagtgggaacatctcgatttcatctggggacttgacgccccgtggcgcctttacaataagattatcaacctgatgcgcaagtaccaa

SEQ ID NO: 15646 - DNA, 1197 bp, Artificial Sequence
  Description of Artificial Sequence: Synthetic coding sequence
atgaagatgcgatttttggggctagtggtgtgtctggtattgtggacactccactctgaaggctccagaggaaaactgacagccgtggaccccgaaaccaatatgaacgtgagtgaaataattagttactggggtttcccatctgaggagtacctcgtggagacggaagatgggtatatcctgtgtctcaatcggattccccatggccgaaagaaccactccgataaaggacctaagccagtggtgtttctgcagcacggtctgctggctgattcttctaattgggtgaccaacttagccaactcatccctcggatttatccttgctgacgccggattcgacgtgtggatgggtaactccagagggaatacttggagtcgcaagcacaaaacactttctgtgtcccaggatgagttctgggcgttctcctatgatgagatggccaagtatgacctgcctgcctccatcaactttatactgaataagactggccaggagcaggtatattatgtcggacacagtcagggtactacaatagggttcatcgcctttagccaaataccagagctggctaagaggatcaaaatgtttttcgcccttggccctgtggcttccgtggcgttttgtacatctcctatggccaagttgggtcgactgccagaccacctgatcaaggacctgttcggggacaaagagtttcttccacaatcggctttcctaaaatggttggggacccacgtgtgtactcacgtgatcctgaaggaattgtgcggaaacctgtgcttcctgctgtgcggcttcaacgaaaggaacctcaatatgagcagagtcgacgtgtataccactcattctcccgccggtacctccgtacagaatatgctccactggagccaagccgtgaagttccagaagttccaggctttcgactggggctcctcagctaaaaattacttccactacaatcagagctatccccccacatataacgtgaaagacatgttggttcccacagctgtgtggtctggtggacacgattggctggctgacgtttacgacgtgaatatcctcctaacccagataaccaatctcgtattccacgaaagcatccctgagtgggaacacctcgacttcatctggggattagatgcaccttggcggctctataacaaaatcattaacctgatgagaaagtatcag

SEQ ID NO: 15647 - DNA, 1197 bp, Artificial Sequence
  Description of Artificial Sequence: Synthetic coding sequence
atgaaaatgcggttccttggtctggtggtgtgtctcgtcctgtggactctccatagcgaaggatcgagaggtaagctgaccgccgtggatccagagactaatatgaacgtctcggagatcatatcatactggggctttccatcagaagaatacctggtggaaactgaagatggatacatcctgtgtcttaacaggatcccacatggtaggaaaaaccattcggacaagggtcccaagcctgtggtgtttcttcaacacggccttcttgcagactcctcaaattgggtgaccaacctggctaactcatcccttggattcatactcgcggatgcgggctttgacgtgtggatgggaaactcgcgcggaaatacctggtcgcgcaagcataaaactctgtcggtgtcgcaggacgagttctgggcttttagctacgatgagatggctaagtacgaccttcccgcctcaatcaactttatcctcaataagactggacaagagcaagtgtactacgtgggtcattcccagggtactaccatcgggtttatcgccttctcacagatccctgaactggcaaaaagaattaagatgttcttcgcgctcgggcctgtggcatccgtggcattttgtacctcccctatggcaaagctcggccggctcccggatcatctgattaaggatttgtttggagataaagaattcctccctcaatcagcctttctcaagtggcttggaacccatgtctgcacgcacgtgattctgaaagaactttgtgggaacctgtgttttttgctttgtggattcaacgagcggaaccttaacatgtcccgggtggatgtgtacaccactcactcccctgcagggacgtccgtgcagaacatgttgcactggtcacaagcagtgaagtttcaaaagtttcaagccttcgactggggttcaagcgcaaaaaactactttcactacaatcaatcctacccaccaacgtacaacgttaaggatatgcttgtgccaacggcggtgtggtcgggaggccatgattggcttgccgatgtgtacgatgtgaacattttgctgacccaaattactaacctggtttttcatgaatcgattcctgagtgggaacatcttgacttcatatggggtttggatgcaccctggcggttgtacaataagatcatcaacctgatgcgcaagtatcag

SEQ ID NO: 15648 - DNA, 1197 bp, Artificial Sequence
  Description of Artificial Sequence: Synthetic coding sequence
atgaaaatgcggttcttgggtctagttgtatgtctcgtcttgtggacactgcactcggaagggtcaagaggaaaactgaccgctgtggaccctgaaacaaatatgaatgtttcggagattatctcctattggggctttccttccgaggagtacctagtggaaactgaggatggctacatcttatgtctgaatcgcattcctcacggaagaaaaaaccactcagacaagggccccaagccagtggtcttccttcagcacggactactggccgacagcagtaactgggtgactaacttggctaactcttcgctcggattcatcctcgcagatgcaggttttgatgtctggatgggcaactctagaggcaacacgtggtcacgcaaacacaaaacgctctctgttagccaggatgaattctgggcattttcttatgatgagatggcaaaatatgacctgcccgcgtcaataaactttattctgaacaaaacgggccaggagcaggtgtactatgtaggacactcccagggtacgacaataggcttcattgccttctctcagatccccgagcttgcaaaaagaattaagatgttttttgcactgggtccagtggcttctgtcgcattttgtacctcgcctatggccaaactcgggcgcttgcccgaccacttgattaaagatctcttcggtgacaaggaatttcttccgcagtccgctttcctaaaatggctcgggactcacgtgtgcactcatgtcatcctgaaagagctatgcgggaacctgtgtttcctgctctgtggttttaatgagcgaaatctcaatatgagcagagtcgatgtgtacaccactcattcccctgcggggacaagtgtacagaacatgttgcattggtcccaggccgtgaagtttcaaaagttccaggcgtttgattggggaagtagcgcaaagaactactttcactataatcagagctaccctcctacgtacaacgtcaaagacatgctagtgcccacagcagtttggtctggtggtcatgactggctagcagacgtgtatgatgtgaacatacttttgactcaaatcacgaacctggtctttcatgagagcatccccgaatgggaacatcttgatttcatttggggtctggatgcaccctggaggctctataacaagataataaatctgatgcgcaagtaccag

SEQ ID NO: 15649 - DNA, 1197 bp, Artificial Sequence
  Description of Artificial Sequence: Synthetic coding sequence
atgaaaatgcgcttcctcggactcgtggtgtgcctggtgctttggactcttcactcggagggatcccgagggaagctcactgcggtggacccggagactaatatgaatgtctcggagatcatcagctattggggcttcccaagcgaagagtacctggtggaaaccgaggatgggtacatactctgcctgaaccgcatcccacatggaagaaagaaccactccgacaagggcccaaagcccgtagtgttcttgcagcacggactgctggctgacagctccaactgggttacgaatttggcgaactcgtccctgggattcattttggccgacgcgggcttcgacgtgtggatgggcaactcacgcgggaatacgtggtcacgcaaacacaagactctgtccgtctcccaggatgaattttgggcattctcctacgatgagatggcaaaatacgatctcccagcatcgataaacttcatcctgaataagactggtcaggagcaggtctactatgttggccactcccaaggtaccactataggctttattgcgttttcacagatcccggaactggccaagcggatcaagatgtttttcgctcttggaccggtggcctcggtggccttctgcacctcgccgatggccaagctggggagactgccggaccatctgatcaaagacctgttcggagacaaggaatttctgccgcagtccgctttcttgaaatggctgggcacgcatgtgtgcactcacgtgattctcaaggaactctgtggtaacctctgcttcttgctgtgcggcttcaatgaaaggaacctgaacatgtctcgcgtagatgtgtacaccacgcattcgcctgccggaacttcggtgcagaatatgcttcactggtcacaagcggtcaagttccaaaagttccaggcgttcgactggggatcgtcggcgaagaactatttccactacaaccaaagctacccgcccacctacaacgtcaaggatatgctcgtccctaccgctgtgtggagcggcggacacgattggctcgccgatgtgtacgacgtcaacatcctgctgacccaaatcactaaccttgtttttcatgaatcaatcccggaatgggagcatctcgactttatctggggactggacgccccttggcgcctgtacaacaaaatcatcaacctgatgcggaaataccaa

SEQ ID NO: 15650 - DNA, 1197 bp, Artificial Sequence
  Description of Artificial Sequence: Synthetic coding sequence
atgaagatgaggtttttgggcctcgtcgtctgtctcgtgctgtggacccttcattctgaaggtagccgcggaaaactgaccgcagtcgatccggaaaccaacatgaacgtttcagaaatcatatcgtactggggattcccttccgaagaatacctggttgagactgaagatggctatattctttgccttaacagaatccctcacggtaggaaaaaccactccgataaaggccccaagcccgtggtgtttcttcaacacggacttcttgcagattcctcaaactgggtgactaatttggctaattcgtccctcgggtttattcttgcagatgcaggttttgacgtttggatgggaaactcgcgggggaacacctggtcgcgcaaacacaagactcttagcgtgtcgcaggatgaattctgggcattctcgtacgatgaaatggcaaaatacgatctgcctgcatccattaactttattctcaacaagaccggccaggagcaggtctactacgtgggccactcccaaggtaccactatcggatttatcgcattctcacaaattcccgaattggccaagcgcatcaagatgttttttgcacttggcccagtggcctcagtcgctttttgcacttcaccaatggcaaaactgggtcgcctgcctgatcatctgataaaggatctgtttggagataaagaattcctgcctcaatccgcctttcttaaatggctgggaacgcacgtctgcactcacgtgatacttaaggagctctgtggaaatctgtgctttctcctgtgcggattcaatgagcgcaatctcaatatgagccgagtcgacgtgtacaccacccactctccggcagggacctcggtccagaatatgctgcattggtcgcaggcagtgaaatttcagaagtttcaagccttcgattggggcagctcagcaaagaattacttccattacaaccagtcgtacccgcccacctacaatgtgaaggacatgcttgtgcctactgcagtgtggtccggaggacacgactggttggctgatgtgtacgatgtgaacattctcctgacccagattactaatctcgtctttcatgaatcgatcccagaatgggaacatctggacttcatatgggggctggacgcaccatggagactgtacaacaagatcatcaatctgatgcgtaagtaccaa

SEQ ID NO: 15651 - DNA, 1197 bp, Artificial Sequence
  Description of Artificial Sequence: Synthetic coding sequence
atgaagatgcggtttctgggacttgtggtttgtctggtcctgtggacgttgcattcggaaggttcgagagggaaacttaccgccgtggatccagagacgaatatgaacgtctcagaaatcatttcgtactggggtttcccttccgaggaatacctggtggagactgaagatgggtacatcctgtgtctcaaccgcattccacatggacgtaagaaccattcggacaagggtcctaaaccagtggtgtttctgcaacacggcctccttgcagattcgtccaactgggtgactaacctggcaaactcctccctggggtttattcttgcagatgccggttttgacgtgtggatggggaactcacgtggaaatacctggtcccggaagcacaagaccctttcagtttcccaagatgagttttgggccttcagctacgatgaaatggcaaagtacgacctgcctgcctccattaacttcattcttaacaagaccggtcaagagcaggtgtactacgtcggccattcccaggggactaccatcggattcattgctttttctcaaatcccagagttggcaaaaaggattaagatgttttttgcacttggtcccgtggcaagcgtggctttttgtactagcccgatggcaaaacttggtcgcttgccagatcatctgattaaggacctctttggtgataaggaatttctgccacaatccgcatttctcaagtggttgggaactcatgtctgtacgcacgtcatcctgaaggaactttgtgggaacctgtgttttcttctctgtggctttaatgaaagaaaccttaacatgtccagggtggatgtgtatacgacgcatagccctgctggcacctcggtgcagaacatgcttcactggagccaggcagtgaagttccaaaagttccaggcatttgattggggatcaagcgcaaagaattacttccattacaatcaatcctacccgccaacctacaacgtgaaagatatgctggtccctaccgcggtgtggtcgggaggacacgattggttggcagatgtgtacgatgtgaacatcctgctgacccaaattaccaatctcgtctttcatgagagcatccccgaatgggagcatcttgacttcatttggggactggatgccccttggaggctttacaataagatcatcaacctgatgcgcaaataccaa

SEQ ID NO: 15652 - DNA, 1197 bp, Artificial Sequence
  Description of Artificial Sequence: Synthetic coding sequence
atgaagatgcgcttccttgggttggtggtatgtctagtgctgtggaccttgcattccgagggctcgcgaggcaagctcacggccgtggaccccgagaccaatatgaacgtgagcgagatcatttcgtattggggatttcctagcgaagagtatcttgtggaaaccgaagacggctacatcctctgtctgaacaggatcccccatggaagaaagaaccacagtgacaagggacccaagcccgttgtgttcctgcaacatggtctgcttgccgacagcagcaactgggtcaccaatctggccaactcttctctcggttttattctggccgatgcaggctttgatgtttggatgggaaactcgaggggcaatacctggtcacgaaagcataagactctgtccgtctcgcaggacgagttctgggctttctcatatgacgagatggccaaatatgacttgcccgcgtctattaatttcatcctcaataaaaccggccaagagcaagtctattacgtgggccatagccagggcacgaccatagggttcatcgccttctcccagatccccgaactggcaaagcggattaagatgtttttcgcccttggccctgtcgccagcgtcgctttctgtacgagtccaatggcgaaactgggacggctacccgaccacctgatcaaagatttgttcggcgataaagagtttctaccccagtcagccttccttaaatggctcggtacgcacgtgtgcacgcacgtgatccttaaggaactgtgcggcaatttatgtttcctgctttgtgggttcaacgagagaaatctcaatatgagccgggtcgatgtgtacactacccacagccctgcaggaacaagcgtccagaacatgctgcattggagccaagcggtgaaattccagaaattccaggccttcgactggggcagcagtgctaagaactacttccactataatcagtcatacccacccacgtacaatgttaaggatatgctcgttcccaccgccgtgtggtctggcgggcatgactggctcgcagacgtgtacgacgtgaatattctgctgacccagattacaaacctggtttttcatgagagtattcccgagtgggagcatctggactttatttggggactcgatgccccttggagactatacaacaagattattaatctcatgaggaagtatcag

SEQ ID NO: 15653 - DNA, 1197 bp, Artificial Sequence
  Description of Artificial Sequence: Synthetic coding sequence
atgaagatgcgttttctggggctggtggtctgtctcgtactttggacgttgcattcagaaggaagccgcggaaaactgactgcagtggatccagagactaacatgaatgtgagcgagatcatcagttattggggttttccatcggaagagtacttggtggagactgaagacggttacattctgtgcctgaatagaatccctcacggcaggaagaatcattcagacaaaggccctaaacctgtggtatttcttcaacacggattacttgcggactcctcaaattgggtgacaaatctggccaattcgtccttagggtttattctggcagatgcgggattcgacgtatggatgggaaactcacggggcaatacatggagtcggaaacacaaaaccctatccgtctcacaagacgagttttgggcattctcgtacgacgaaatggccaagtacgatctgcctgcatctattaactttatcctgaataagaccggacaggagcaggtgtattatgttgggcattcccaaggcaccactatagggtttatagcgttttcgcagatcccagaactggctaaacgcatcaagatgttttttgccctcggtcccgttgccagtgtggccttctgcacatctccaatggccaaactggggcgcctgcccgaccacctgattaaggacctctttggggataaagagttcctgccgcagagcgcctttttgaaatggctggggacacatgtatgtactcatgtgatacttaaagaactctgtggaaatctttgttttcttctctgtggcttcaacgagagaaacttgaacatgtcaagggttgatgtctatacaacccactcgccggctggcacttctgtgcagaatatgctgcattggtcccaggccgtgaaattccaaaagttccaggcatttgactggggttctagcgccaagaattactttcactataatcagtcatacccgcctacatataacgtgaaggacatgttagtcccgacagctgtgtggtccggcgggcacgattggttggccgatgtgtatgacgtcaacatcctcctcacccaaatcacgaatcttgtgttccacgagtccatccccgagtgggagcacctcgatttcatctgggggttggatgctccttggcggttgtacaacaaaatcattaatctgatgagaaagtaccag

SEQ ID NO: 15654 - DNA, 1197 bp, Artificial Sequence
  Description of Artificial Sequence: Synthetic coding sequence
atgaaaatgcgctttctgggactggtcgtctgtctggtcctgtggacgctgcactctgagggcagccgcggaaaacttaccgccgtggacccagagacgaatatgaacgtcagcgaaattatcagttactggggttttccctccgaggaatacctcgttgagactgaagacggatatattttgtgcctcaatcgtatccctcacggacgaaaaaaccatagcgataaggggcctaaacctgtcgttttcctgcagcatggtctgcttgccgattcgagtaactgggttactaacctggcaaattccagcttaggatttatcctggcagacgccggttttgacgtctggatgggaaatagcagggggaatacctggagccgtaaacataaaacactgagcgtgtcgcaagatgagttttgggccttttcctatgatgaaatggcaaaatacgacctcccggcttccattaattttatcctgaataaaacgggacaggagcaagtttattatgtcggtcattcccaaggcactaccatcggctttatcgcttttagccagattccggaattggcaaaacgtatcaagatgttctttgcgctgggcccagtagcaagcgtcgcattctgtacctccccgatggccaagctgggccgcctgccggaccacctgatcaaggacctgtttggtgataaagagttcctgccacaatcagcttttctgaaatggctcggtacacacgtgtgtacccatgtgattctcaaagagctgtgcggtaacttgtgctttctgctgtgcggattcaatgagaggaacctgaacatgagccgggtggacgtttacacgacccatagcccagccggcacctctgttcaaaatatgctgcattggagccaggctgtgaagttccagaagttccaggcatttgactggggtagctctgccaagaattattttcactataatcagtcatatcctccaacctataatgtcaaagacatgctagttccgaccgcagtgtggagcggtggacacgattggctggcagacgtgtacgatgtcaacattctgttgacccagatcaccaacctggtgttccacgaaagtatcccggagtgggagcacttggatttcatctggggtctggacgccccgtggcggctgtacaataagattatcaacctaatgcggaagtatcag

SEQ ID NO: 15655 - DNA, 1197 bp, Artificial Sequence
  Description of Artificial Sequence: Synthetic coding sequence
atgaaaatgcggttcttgggtctggtggtctgtctcgtactttggaccctccactccgagggttctagagggaagctgaccgcagttgatcctgaaacaaacatgaatgtgagcgagataataagttactggggctttcccagcgaagagtatctcgtggagactgaggacggctacatcctctgccttaaccgcatacctcacggccgaaagaatcacagcgataagggccctaaacctgtcgtctttttacaacatggattactggctgactcgagtaactgggtgactaatctcgctaatagctcactgggattcattctcgcagatgctggctttgatgtttggatgggcaacagtagaggcaatacatggtctcgcaaacacaagaccctctctgttagtcaagacgagttttgggcattctcatatgacgaaatggctaagtacgatttgccagcgagcattaactttattctgaataagacagggcaggagcaagtatactatgtcggtcacagccaaggcaccaccatcgggtttattgcgttttcacagatccctgagcttgccaagagaatcaagatgttctttgccctcggtccagtggcatccgtagctttctgcacgagtccaatggcaaagcttggcagactgccggaccacctcatcaaagatctgtttggcgataaagagttcctgccgcaatccgcttttctgaagtggttaggaactcatgtatgcacacatgtcattctcaaggaactatgcggtaatttatgctttctgttatgcgggtttaatgagagaaatttaaacatgtctcgcgtggatgtgtacacaacacacagtccagccggtactagcgtccaaaatatgctgcactggtctcaagccgtcaagtttcagaaatttcaggccttcgactgggggtcatctgctaagaattactttcactataaccagtcctatccacctacctacaacgttaaagatatgttggttccaaccgcggtgtggtcgggtgggcacgattggctggccgatgtgtacgacgtgaatatcctgctcacccaaatcaccaatctcgttttccacgagagcatcccagagtgggaacacttggatttcatttggggtctggatgcaccttggcggctgtataataagatcatcaatctcatgaggaaataccag

SEQ ID NO: 15656 - DNA, 1197 bp, Artificial Sequence
  Description of Artificial Sequence: Synthetic coding sequence
atgaagatgcgcttcctgggattggtcgtctgcctcgtgctgtggaccctgcactccgaggggtcccgcggcaaactcactgcagtcgaccctgagacgaacatgaatgtgtccgagatcatctcgtactggggcttcccttcagaagaatacctggtggaaaccgaagatggctacatcctgtgcctcaaccggattccgcatggacgaaagaaccactcagataaaggaccgaagccagtggtgttcctgcagcacggacttctggctgacagctccaactgggtcaccaacctcgctaattcttcactgggattcatcttggcggacgcgggtttcgacgtctggatgggcaactcccgcggtaatacttggagcagaaagcataagacgctgtcagtgtcgcaagatgagttttgggctttctcgtacgatgaaatggcaaagtacgacctgccagcctcgatcaacttcatccttaacaagaccggacaagagcaggtttactacgtgggccactcgcaaggaaccaccattggattcattgcattctcgcagatcccagaacttgccaagagaattaaaatgtttttcgccctgggccccgtcgcctccgtggccttttgtactagccctatggcgaaactggggagactcccagaccacctgatcaaggacctgttcggagacaaggagttcctcccgcagtccgcgttcctgaaatggctcggaactcacgtgtgcactcatgtgatcctgaaggaactgtgcggaaacctctgttttctgctctgcgggttcaacgagaggaatctcaatatgagccgcgtcgatgtttacactacccacagcccagcaggtacttcagtgcagaacatgttgcattggtcgcaggccgtaaagttccaaaagtttcaagccttcgactggggcagctcagctaaaaattattttcattacaatcagagctacccgccgacctacaacgtgaaggacatgctggtgccgactgcggtgtggtccggaggacatgactggcttgccgatgtgtacgacgtcaacatcctgctgacccagatcaccaatctcgtgttccacgagtcgatcccggaatgggaacacttggattttatctgggggttggatgccccctggcggctctataacaaaatcatcaatctgatgcggaagtaccag

SEQ ID NO: 15657 - DNA, 1197 bp, Artificial Sequence
  Description of Artificial Sequence: Synthetic coding sequence
atgaaaatgagatttctcggcctagtggtgtgcctcgtgttatggactcttcactcagaaggatcacgtgggaaattgaccgccgtggatccagagaccaatatgaatgtgtcagaaatcatcagctattggggatttcccagtgaagagtatttggtggaaaccgaggatggctacatcctctgcctcaaccgtatcccacatggacgcaaaaatcactccgataagggccctaaacctgtggtgttcctgcagcacggactgttagcagatagcagcaactgggtgaccaatctcgctaacagctctttgggttttatactcgcggacgctggcttcgacgtgtggatgggtaatagtaggggcaatacctggagtaggaagcacaagacactgtcggtgtcccaggacgagttctgggctttcagttacgatgaaatggctaagtacgatctgccagccagtattaactttatcttgaacaaaacaggccaagaacaggtgtactacgtgggccacagccaaggcacaaccatcggattcatcgctttctcccagatccctgagttggccaaaagaatcaagatgttcttcgctcttgggcccgtagcgagcgtggctttttgtacttctcctatggccaagctgggaaggttgcctgatcacctcatcaaggacttgtttggcgacaaggagttcctcccccaaagcgcctttctaaagtggctggggactcatgtatgcacacacgtcattctgaaagaactgtgcggcaacctctgcttcctgctatgcggcttcaacgagcggaacctgaatatgagtagagtcgatgtgtacaccactcactcgcccgcaggcacctcggtgcagaatatgttgcactggagccaggcagtcaaatttcaaaaattccaagccttcgactggggttccagcgctaaaaattactttcattacaaccagagctacccgcctacatacaatgtgaaggacatgttggttccaacggcggtctggtcagggggacatgattggttagctgatgtttacgatgtcaacatccttcttactcaaatcacgaacctggtgtttcatgagagtattcccgagtgggaacatttagactttatttggggacttgatgccccatggagactgtacaataagatcataaaccttatgcgtaaatatcag

SEQ ID NO: 15658 - DNA, 1197 bp, Artificial Sequence
  Description of Artificial Sequence: Synthetic coding sequence
atgaagatgcgctttttggggctggtcgtttgtctggtcctgtggacgttgcatagcgaggggtctaggggaaagctgactgctgtcgaccccgaaacgaacatgaacgtgagcgagattatcagctactggggctttccatcagaggagtatctggttgagacagaggatggatacatcctgtgcctgaaccgaattccccacggccgcaagaatcactccgataaaggcccaaagcccgtagtgtttctgcagcacggtctgttggctgactcatctaactgggtcaccaacttggccaattcatccctgggcttcattctggccgacgctgggttcgacgtgtggatgggtaacagcaggggcaacacatggagccgcaagcataagaccctttctgtgagtcaggatgaattctgggcttttagctatgatgagatggcgaagtatgacctgcccgccagcatcaattttatcctgaataagactggacaggagcaggtttactatgtggggcattcccagggtaccacgatcggcttcattgcattttcccagatccccgaattggccaaacggattaagatgttctttgctcttgggccagttgcaagcgtggctttctgtacctcaccgatggccaaactcggccgcttgccagatcaccttattaaagacctgtttggcgataaggagttcttgcctcaatccgcctttctgaagtggctgggcacccatgtatgcacacacgtgattcttaaggagctttgtggcaatctctgtttcctgctgtgtggcttcaacgaaaggaatctgaatatgtcaagagtcgatgtgtacacaacgcatagccctgcgggtacctcagttcagaatatgctccactggtcccaggctgtaaaattccaaaaattccaggcgtttgactgggggagcagcgctaagaattacttccactacaatcagtcctacccacctacatataacgtcaaggatatgctcgtccctaccgccgtatggagtgggggacacgactggctggcagacgtatatgatgtgaatattcttctgactcaaataacaaacctggttttccacgaaagtattcccgaatgggagcacctggacttcatttggggcttggacgcaccctggagattgtataacaaaattataaacctcatgcgaaaataccag

SEQ ID NO: 15659 - DNA, 1197 bp, Artificial Sequence
  Description of Artificial Sequence: Synthetic coding sequence
atgaagatgcggtttctgggtcttgtggtgtgtctggtactctggaccctgcattcagaggggagccgcgggaaattgaccgcagtagatccagaaacaaacatgaacgtgtccgaaattatatcatactggggcttcccttccgaggagtacctcgtcgaaacagaggacggctatatcctttgccttaataggattccgcatggacgcaagaatcacagtgataaagggccaaagccagttgtgtttttgcagcatggactactcgcagacagctctaactgggtgactaacctcgccaacagctctctgggctttatactcgctgacgccggtttcgacgtatggatgggcaattctagagggaatacatggtctcggaaacataaaactctatccgtaagtcaggatgagttctgggccttttcatacgacgagatggccaaatacgatctgcccgcaagtataaattttatactaaacaagacaggccaggagcaggtatactatgtgggtcacagtcagggtactacgatcgggttcatcgccttttcacaaattcctgaactcgccaagagaatcaagatgttttttgcacttggtccggtggccagcgtggccttctgcacaagtcccatggccaagttgggaagactgcccgatcatctcattaaagacctgttcggcgataaagagttcttgccccagtctgcctttctgaaatggctgggaacacatgtatgcacacatgtaatcctgaaggagttatgcggcaatctctgttttcttctttgtggctttaacgagagaaacctgaatatgtctagggtcgacgtgtatacaacccactcccctgcaggtacttctgtgcagaacatgctccattggtcacaagcggttaagttccagaagttccaggcttttgactgggggtcaagcgcaaaaaactactttcactataaccaaagttaccctccgacctacaacgtgaaagacatgttggtgcctaccgctgtatggtccggcggccatgactggctggccgacgtttatgatgttaatatcctactcactcagatcacaaatcttgtgttccacgagtccatcccggagtgggagcatctcgacttcatctggggattggatgccccctggagactgtataacaaaatcattaatctaatgcgtaagtaccaa

SEQ ID NO: 15660 - DNA, 1197 bp, Artificial Sequence
  Description of Artificial Sequence: Synthetic coding sequence
atgaaaatgagatttcttgggcttgttgtgtgtctagtgctgtggactctgcactctgagggcagccgcggcaaattgaccgcagtggaccctgagacgaacatgaacgtgagcgagatcattagctactggggcttcccaagcgaggagtacctggttgaaactgaggatggatacatcttgtgccttaacagaattccccatggccggaagaaccatagtgataagggacccaaacctgtggttttcctgcagcacggcctattagccgattctagcaactgggtgactaatttagccaatagttctctgggcttcatcctcgccgatgccggcttcgatgtttggatggggaacagcaggggaaacacatggtctcgtaagcacaaaactttgtccgtgagtcaggacgaattttgggccttttcctatgatgagatggctaaatatgacctgccagccagcataaactttatcctaaacaagaccggccaggagcaggtctactatgttggacacagtcaaggcacgacgattggatttatcgctttcagccagatcccggagctagcaaagcggatcaagatgttttttgccctggggcccgtagcctcagtagcattctgtacctcaccaatggccaaactgggacggctcccagaccatttaatcaaggacctgttcggggacaaggaatttcttcctcagtcggcatttttgaaatggcttggaactcacgtgtgcacacacgtgattcttaaggagctctgtggcaatttgtgcttcctgctgtgcggatttaacgagagaaacctgaatatgtcgagagtggatgtgtatacaactcattcccccgccggaacaagtgtgcaaaatatgctgcactggtcacaggcagtcaagtttcagaaattccaggcttttgattggggatcttccgcaaagaattacttccattacaatcagagttacccaccgacttataacgtaaaagacatgctggtcccgacagccgtctggtccggcggtcacgattggctggccgatgtgtacgacgtgaacatacttctcacacaaattacaaatttggtgtttcacgagtcaatcccggaatgggagcacttagatttcatctggggattagacgcaccgtggcgactctacaataaaattatcaacctgatgagaaagtatcaa

SEQ ID NO: 15661 - DNA, 1197 bp, Artificial Sequence
  Description of Artificial Sequence: Synthetic coding sequence
atgaaaatgaggttcctcggtctcgtcgtatgcctagttttgtggacccttcactccgaaggaagtagaggtaaactgactgcggtggatccagagaccaacatgaatgtctcagagattatctcctactgggggtttccctctgaggagtacctcgttgagaccgaagatggttatatcctatgtctcaaccgtatccctcatggaagaaagaatcatagtgataaagggcctaagccagtggtgttcttacaacatggattgcttgccgactcttccaactgggttaccaatttagcaaactcatcccttggatttatactggcagatgccggctttgatgtgtggatgggtaactctagaggcaacacgtggtctagaaagcataagacactgtctgtgtcacaagatgaattttgggcattttcatacgacgaaatggcaaagtatgatttgccagctagcatcaatttcatattaaacaaaaccgggcaagagcaagtctattacgtcggacattcccaagggacaacaatcggattcattgctttttcacaaattcccgaattggcaaagcggatcaagatgtttttcgcattaggtccagttgcttcggtcgctttctgcacaagcccgatggcgaaattggggaggctgcctgaccacttgatcaaagatctcttcggtgataaagagttcttgcctcagtctgccttcttaaaatggttgggaacacacgtttgcactcacgtcattcttaaagagttgtgtgggaatttgtgctttctgttatgtggctttaacgagcgtaacttaaatatgtctagagtggacgtttatacaacacattctccagctggtacgtctgttcagaatatgttgcactggtcacaagctgttaaattccaaaaatttcaagcattcgattggggaagttctgcaaagaactattttcattataatcagtcatatcccccaacctataacgtaaaagatatgcttgtccctaccgcggtttggagtggggggcatgattggttggctgatgtgtatgatgttaacatacttttgactcaaataacaaatctggtgtttcacgagtcgattcctgagtgggaacatttggattttatttggggactggatgcaccatggcgattatacaacaaaatcatcaaccttatgaggaagtatcaa

SEQ ID NO: 15662 - DNA, 1197 bp, Artificial Sequence
  Description of Artificial Sequence: Synthetic coding sequence
atgaaaatgcggttcctcgggctggtcgtgtgcctggtcctgtggaccctgcactcggagggatcgcggggaaagctgaccgctgtggatccggagactaatatgaacgtgtcggaaatcatttcatactggggattcccctcggaggaatatctggtggagactgaagatggctacatcctgtgtctcaatcggattccacatggacggaaaaaccactcggataagggacctaaaccggtggtgtttctgcagcatgggctcctggcagacagctccaactgggtcactaacctcgcaaattcaagcctcggattcatcctcgccgacgccggcttcgacgtctggatgggtaattcaagaggcaatacttggtcccggaaacacaaaacgctgtcggtttcgcaggacgaattctgggccttcagttacgatgaaatggcaaaatacgatctgccagcgtctatcaacttcattctgaacaagaccggacaggagcaagtgtactatgtggggcattcgcagggaactaccatcggatttatcgcattcagccagatccccgaacttgcgaaacgcatcaagatgttctttgccctgggtccggtggccagcgtggcgttctgtacctccccgatggccaagctgggacgacttccggatcatctgattaaagacctgttcggcgacaaggagttcctgccgcagagcgccttcttgaagtggctgggaactcatgtgtgcactcatgtgatcctcaaagaactctgcggaaatctttgcttccttctgtgcggctttaatgagcggaacctgaatatgtcgcgcgtggatgtgtacaccactcattcccctgccggcacttcggtccagaacatgttgcactggtcgcaggcagtgaagtttcaaaagtttcaagccttcgattggggatcgtctgctaagaattactttcactacaaccaatcttacccgcctacctacaatgtgaaggacatgctcgtccctacggcggtgtggagcggaggtcatgactggctggccgacgtgtatgacgtcaatattctgctgacccaaatcaccaatctcgtctttcacgaatcaatcccggagtgggaacatctggacttcatctggggccttgacgcaccttggcgcctctacaacaagatcatcaatttgatgcggaaataccag

SEQ ID NO: 15663 - DNA, 1197 bp, Artificial Sequence
  Description of Artificial Sequence: Synthetic coding sequence
atgaaaatgcgcttcttgggactggtcgtgtgcctggtgctgtggactctgcacagcgagggttcgcgggggaaattgaccgcagtcgaccctgagacgaatatgaatgtgtccgagatcattagctactgggggttcccgtcggaagaataccttgtcgaaaccgaggacggatatatcctgtgcctgaatcggatccctcacggaagaaagaaccattcagataagggtccgaaacccgtggtgttcctccagcacggcttgcttgcagacagctcgaactgggtaactaatttggccaactcctccctcggcttcatcttggcggacgcaggcttcgacgtttggatggggaattcgaggggaaacacctggtcacgcaagcataagaccctgtctgtcagccaagacgagttttgggccttctcttacgatgaaatggcaaaatacgatctgccggcctcgatcaatttcatacttaacaagaccggccaggaacaggtctattacgttggacactcgcaaggaacgaccatcggattcattgcgttctcacagatccctgaactcgcaaagaggatcaaaatgttctttgccttgggaccggtggcatcggtggccttctgcacgtcaccgatggctaagctgggaaggcttccagaccacctcattaaggatctttttggagataaggagttcctgccacagtcagcatttttgaagtggttggggactcacgtttgcacccacgtcattctgaaagagctgtgtggaaatctgtgttttctcctctgcggcttcaacgagcgcaacctcaatatgtcaagagtggacgtgtacacgacccattctcccgccggaactagtgtccaaaacatgctgcattggtcgcaagcagtgaagttccaaaagttccaggccttcgattggggatcgtctgccaagaattactttcactacaaccagtcctatcccccaacttacaacgtgaaggacatgctcgtccctaccgctgtgtggagcggcggtcatgattggttggcggacgtatacgacgtgaacatcctgctcactcaaatcaccaatctggtgtttcacgaatccatcccagaatgggaacatctcgacttcatctgggggctcgacgcgccgtggcggctgtacaacaagatcattaacctgatgcgaaaataccag

SEQ ID NO: 15664 - DNA, 1197 bp, Artificial Sequence
  Description of Artificial Sequence: Synthetic coding sequence
atgaagatgagatttttgggactggtggtttgcctggtcctctggaccttacactccgagggaagcagaggaaaattgacggctgtcgaccccgagacaaacatgaatgtcagcgagataatttcctattgggggtttccttcggaggagtacttggtcgagacagaagatggatacatcttgtgcctgaaccggatcccacacggacgtaaaaaccactctgataaaggccctaagccagtggtcttcctgcagcatggcctgttggctgactcttctaactgggtgactaatctggccaatagctcattggggtttattctggccgacgccggcttcgacgtgtggatgggcaactctagggggaacacatggagcaggaaacacaagacactcagtgtaagccaggacgaattctgggccttttcctatgacgaaatggcaaagtatgacctgccggcttccatcaatttcatcttgaacaagacaggacaggagcaggtctactacgtgggccacagccaggggactaccatcggcttcatagcattcagccagattcctgaactggcaaagcgaataaagatgttttttgcactgggcccggttgcctctgttgcgttctgtacatctccgatggcaaaactgggaaggctcccggaccacctcatcaaggatctgttcggagacaaggagtttctgccccaaagcgccttccttaagtggttgggcacccatgtctgcacacatgtgatcttaaaggaactgtgtggtaatctctgctttctcctgtgtggctttaatgagaggaatctgaacatgtccagagtggatgtatacacaacccattctcccgccggaaccagcgttcagaacatgctacactggagccaggccgttaagtttcagaaattccaggcttttgactggggttcgtctgccaaaaattattttcactacaatcagtcctatccccccacctacaacgtgaaggatatgctcgttccaaccgctgtgtggtccggaggacatgattggcttgcggacgtatacgatgttaatatactgttgacgcaaataacaaatcttgtgttccatgagagcatccccgagtgggaacacctcgactttatctgggggctggatgcaccctggcgattgtacaacaaaattatcaatctcatgagaaaataccag

SEQ ID NO: 15665 - DNA, 1197 bp, Artificial Sequence
  Description of Artificial Sequence: Synthetic coding sequence
atgaaaatgagattcctgggcctggtcgtatgtctcgtcctgtggacgctgcactcagaaggcagtcgcggaaagcttacagcagtagatcccgaaacgaatatgaacgtttccgagataattagttactggggcttcccatcagaagagtatcttgtagagacagaggacggttatattttgtgcctcaaccgcattccccatgggcggaaaaatcactctgataagggccccaagccagtggtgtttctgcagcatggtctgctggcagacagttcaaattgggtgaccaatcttgccaacagcagcctggggtttattctggctgacgcggggtttgacgtgtggatggggaacagtcgggggaacacctggtcaagaaagcataagactctctcagtcagtcaggacgaattctgggcttttagttatgacgaaatggctaaatacgatctgcccgcctctattaacttcattctgaataagacaggccaggagcaggtttactatgtcgggcattcccaggggacaacaatcggatttatcgcctttagtcagatcccagaactcgcaaagcgcattaagatgttttttgccttaggacctgtcgcttccgttgccttttgcacgagccctatggcgaaactgggtcgcctccccgatcacctgatcaaggatctgttcggagataaagaatttcttccacagagcgctttcctaaaatggctgggcacacacgtgtgtacccatgtgatactcaaagagctctgtgggaatttgtgttttcttctgtgcggcttcaacgagcgaaacctcaatatgtctcgagtggacgtctatacaactcattcacccgccggcacctccgtgcagaatatgctgcactggtctcaggccgtgaagttccagaagtttcaggctttcgactgggggagtagtgctaaaaattattttcactataaccaaagctatcctcctacatataatgtgaaagacatgctggttccaactgctgtctggtctggtggccatgactggctggctgacgtgtatgatgtgaatattcttctcactcagataacgaatctcgtgttccacgagagtatccctgaatgggaacatctagattttatttggggactcgacgccccatggcggctctacaacaagattattaatctgatgcggaagtatcag

SEQ ID NO: 15666 - DNA, 1197 bp, Artificial Sequence
  Description of Artificial Sequence: Synthetic coding sequence
atgaaaatgcgctttcttggattggttgtgtgcctggtcctctggactctgcactcggaagggtccaggggtaagctgactgcggttgatcctgagacgaacatgaacgtgagcgaaatcatctcctactggggcttcccctcggaagagtatctggtcgaaaccgaagatggatacattctctgtctgaaccggatacctcatggacgcaaaaaccattctgacaaaggcccgaagccggttgttttcttgcagcatggcctcctggctgattcatccaactgggtgaccaacctcgctaattcgagtctgggatttatcctggccgacgcggggttcgatgtctggatggggaattcgcgcggcaacacgtggtcacggaagcacaaaaccttgtcagtgagccaggacgagttctgggccttctcttatgacgaaatggctaaatacgatcttcctgcttcaatcaatttcatccttaacaagaccggacaggagcaggtgtactacgtcggacatagccaaggtaccaccatcggttttatcgccttcagccagatccctgaactggcgaagagaatcaagatgttcttcgcactgggaccggtggccagcgtggccttctgcacttccccgatggcgaaactcggccgcctgccggaccacctcatcaaggacctgttcggagacaaggagtttcttccacagtccgcttttctgaagtggcttggcactcacgtgtgcacccatgtgattctcaaggagctctgcggaaacctctgcttcttgctctgtgggtttaacgaaagaaatctgaatatgtcccgagtcgacgtgtacactacccactcgccagcaggaacctctgtgcaaaacatgttgcattggtcgcaagcagtgaagttccaaaagtttcaagcattcgactggggctcatccgcaaagaactacttccactacaaccagtcgtacccaccgacttacaacgttaaagacatgctggtgccaaccgcggtatggtcgggtgggcacgattggctcgccgatgtctacgatgtgaacattctgcttactcagataaccaatctcgtgtttcacgaatctatcccagagtgggagcacttggacttcatttggggcctcgacgccccatggagactttacaacaagatcatcaatcttatgcggaagtaccag

SEQ ID NO: 15667 - DNA, 1197 bp, Artificial Sequence
  Description of Artificial Sequence: Synthetic coding sequence
atgaagatgcgtttcctgggcctggttgtgtgtctggtcctctggaccctccattcagaaggctcccgtggcaaattgactgccgtggaccctgaaaccaatatgaacgtgtctgagatcatctcctactggggattccccagcgaggaatacctcgtggaaacagaggatggttacatcctgtgtctcaaccgcattccccacggacgtaagaaccacagtgataagggaccaaaaccagtagtgtttctgcagcacggactgctggcagactccagcaactgggttaccaacctcgcaaattcatctctgggattcatcctggctgacgcaggcttcgatgtctggatgggcaactccaggggcaacacttggagtcgtaagcataaaactctgtctgtgtcacaggacgagttctgggctttttcttacgacgagatggctaagtatgacctccctgcatccattaacttcatcctgaataagactggccaggaacaagtctattatgtaggacatagtcagggcactaccatcggtttcatcgccttctctcagatcccagagcttgctaagagaatcaagatgttcttcgctctcggtcctgtcgccagcgtggctttctgcacaagccccatggcaaagctgggacgcctgcctgaccacttgatcaaggatctctttggagataaggagtttcttccacagtccgcctttcttaagtggctgggtactcacgtatgcacacatgtcattctcaaggagctctgcggaaatctctgtttcctgctgtgtggattcaacgagaggaacctgaatatgagcagggttgatgtgtacaccactcatagtccagccggcacctctgtgcaaaatatgttgcattggtcacaggctgtcaagttccagaaattccaggcctttgattggggctccagtgccaagaattacttccactacaaccaatcttatccaccaacttacaatgtcaaggatatgttggtacctacagcagtgtggtcaggtggtcatgattggctcgccgatgtctacgatgtgaacatcctcctgactcagataaccaacctggtcttccacgaatccataccagagtgggagcacctggattttatttggggcctggatgccccttggagactttataataagatcattaatcttatgcgcaagtaccaa

SEQ ID NO: 15668 - DNA, 1197 bp, Artificial Sequence
  Description of Artificial Sequence: Synthetic coding sequence
atgaaaatgagatttctgggactcgtggtttgcctagttctctggacactgcatagtgaggggtcaagaggaaagctgacggccgtggaccccgaaactaacatgaacgtgtccgaaatcatctcttactggggcttcccaagcgaggagtatctagtggagacagaagacgggtacatcttgtgtctaaatcgtatcccgcatggacgaaaaaaccactccgataagggccccaaacctgtggtgtttctacagcacggtctgttagccgattcctccaactgggtgaccaacctcgcaaactcttccctcggcttcattctggccgatgccggctttgacgtgtggatggggaattcccggggaaacacttggagtagaaagcacaagactctgtccgtatcccaagatgaattttgggccttttcttacgatgaaatggcaaagtatgatcttcccgcctcaatcaatttcatactgaacaagaccggccaggagcaggtgtattatgtaggccacagtcaaggcacaacgatagggttcattgccttttctcagatccccgaactggccaaaagaatcaagatgttctttgccttgggacccgtggccagcgtagctttctgcacttctccgatggcaaagttagggcgcctccccgaccacctgatcaaagatctgttcggcgacaaagagttccttccacagtccgcttttctgaagtggttgggcacacacgtgtgtacacacgtcatcctgaaagagctgtgcgggaacctgtgtttcctcctgtgtggtttcaatgagaggaatctgaatatgtctcgagtggacgtgtacaccacccactcacctgctgggacatccgtgcaaaacatgcttcactggagtcaggcggtgaagtttcagaaattccaagcgttcgattgggggtctagtgccaaaaattactttcactacaatcagtcatatcctcctacatataatgttaaagatatgctagtaccaaccgccgtgtggtcagggggccacgattggcttgccgatgtgtatgacgtgaacattttgttgactcaaattacaaacttggtgttccatgagtctatacccgaatgggagcacctggatttcatctggggtttagatgccccgtggagactgtataacaagatcattaatctgatgagaaaataccag

SEQ ID NO: 15669 - DNA, 1197 bp, Artificial Sequence
  Description of Artificial Sequence: Synthetic coding sequence
atgaagatgagatttctgggactggtggtttgcctcgtgttgtggaccctgcattccgagggatcgagggggaagctcaccgcggtggatccggaaaccaacatgaatgtgtcagagatcatctcatactgggggttcccttcggaagagtatctggtggaaactgaggacggctacatcctctgcctgaaccggatccctcatggacggaagaatcattccgataagggaccaaaaccggtggtgttcctgcagcacggcctcctggcggattcctccaattgggtgaccaacctcgccaacagcagcctcggattcatcctggcagacgcgggattcgacgtctggatgggtaacagccggggaaacacctggtcccgcaaacacaaaactttgtcggtgtcgcaggacgaattctgggctttctcatatgatgagatggccaaatacgacctgccggcctccatcaatttcattctgaacaaaaccggacaggaacaggtgtactacgtggggcactcacagggaactactatcggattcattgccttctcccagatccccgagctggcgaagcggatcaaaatgttcttcgcccttggaccagtggcctcagtcgccttctgtaccagccccatggcaaagttggggagactgccagatcatctgatcaaagaccttttcggcgacaaggagtttctgccccaatcggccttcctcaagtggctggggacccatgtgtgcacccacgtgatcctgaaggagctgtgcgggaacctgtgtttcctgctgtgcggctttaatgaaaggaacctgaatatgagccgcgtcgatgtctacactactcactccccggcggggacctctgtgcagaatatgctgcactggtcacaagccgtcaagtttcaaaagttccaggcttttgactggggatcctcggcgaagaactacttccattacaatcagtcctacccacctacttataacgtgaaagacatgctcgtcccgactgccgtgtggtccggagggcatgactggctggcagacgtctacgatgtgaacatcttgctgacccaaatcactaacctggtgttccatgaatcaatcccggaatgggaacacctggacttcatctggggactcgacgccccttggcgcctctacaacaagatcattaatctgatgaggaaataccag

SEQ ID NO: 15670 - DNA, 1197 bp, Artificial Sequence
  Description of Artificial Sequence: Synthetic coding sequence
atgaaaatgcgtttccttggattggtggtctgcctggtgctgtggacgctgcactcggagggtagcaggggaaagctcaccgccgtggatccagaaactaatatgaacgtcagcgagattatctcatactgggggtttccgtcagaggaatatctcgtggagactgaagatggatacattctttgcctgaatcgtatcccgcatggtcgcaaaaatcactcggacaagggacccaagccagtggtgtttcttcagcatggactccttgcagattcgtcgaattgggtcacgaacctcgcaaattcctcgctgggtttcattctggcagatgcaggattcgatgtgtggatgggcaacagccgagggaacacttggtccagaaaacataagactctctccgtgagccaggatgaattttgggcatttagctacgatgaaatggcgaagtacgatctcccagcctcgatcaactttattctgaataagactggacaagaacaggtgtactacgtgggtcattcacaagggaccacgatcggtttcatcgccttttcgcagatcccagagctggcaaagagaataaagatgtttttcgcgcttggacctgtcgcgtccgtggctttctgcacgtcgcctatggctaagctgggtcggctgccagatcatcttatcaaagatttgtttggagataaggaatttcttccgcaatccgccttcctgaagtggcttggcacgcatgtttgtactcatgtgattctgaaagagctgtgtgggaatctctgttttctgctgtgtggatttaacgagagaaatctcaacatgtcaagggttgatgtctacaccactcactcaccagcaggaacctccgtccaaaacatgctgcactggagccaggccgtcaagtttcaaaagtttcaggcatttgattggggttcgagcgcaaagaactactttcactacaaccagtcgtaccctccaacttataacgtgaaggacatgctcgttcctactgcagtctggtcgggtggtcatgactggctcgcggacgtgtacgatgtgaacatcctccttacgcaaatcaccaacctggtgtttcacgaaagcattccagagtgggaacacctggatttcatatgggggctggatgcgccctggaggctgtacaacaagattatcaaccttatgcgaaagtaccaa

SEQ ID NO: 15671 - DNA, 1197 bp, Artificial Sequence
  Description of Artificial Sequence: Synthetic coding sequence
atgaagatgcgcttcttgggcctggtggtgtgtctggtgctgtggactctccactccgagggatcgcggggcaagctgactgcggtggatcccgagactaacatgaacgtcagtgagatcatcagctactggggtttcccgtcagaagagtacctggtggaaactgaagacggatacatcctctgcttgaacaggatcccgcacggcagaaagaaccacagcgataagggcccgaagcctgtggtgttcctgcaacacggactcctggcggattcttccaactgggtgaccaatctggccaattcctcgctgggttttattctggccgacgccggctttgatgtgtggatgggcaattcacgcggaaacacttggtcacgcaaacacaagaccctgtccgtgagccaggatgaattctgggctttctcgtatgacgaaatggcaaaatacgacctgccggctagcatcaatttcatcctgaacaaaaccggacaggaacaagtgtactatgtcggacattctcaggggaccactatcggatttatcgcgtttagccagatacccgagcttgctaagcgcatcaagatgttcttcgccctgggccctgtggcctccgttgcattctgcacctcgccaatggccaagctcggaaggttgcccgatcatctcatcaaggatctgtttggcgataaggaattcctcccacaatcggcattcctgaaatggctggggacccacgtgtgtacccacgtgattctgaaggaactttgcggaaacctctgtttcttgctttgcggctttaacgaaagaaatctgaacatgtcccgggtggacgtgtacactacgcactcccctgcaggaacctctgtgcagaatatgctgcattggtcgcaggccgtgaagtttcaaaagttccaagcgttcgattggggctcatcggccaagaattacttccattacaatcaatcctaccccccgacctacaatgtgaaggatatgcttgtgcctacggcggtgtggtccggaggacatgattggctggcagatgtctacgatgtcaacattctcctcacccagatcaccaacctcgtgttccacgaatcgatccctgaatgggagcatctggatttcatctggggactcgatgccccgtggcgcctgtacaataagatcatcaatctcatgcgcaagtaccaa

SEQ ID NO: 15672 - DNA, 1197 bp, Artificial Sequence
  Description of Artificial Sequence: Synthetic coding sequence
atgaaaatgcgctttctcggcctggtggtctgtctcgtgctgtggactttgcactcagagggctcgagggggaagctcactgcagtcgatccagaaaccaacatgaacgtgtcagaaatcatcagctactggggcttcccgtcggaggagtatctggtggaaacggaggacggatacatcctctgcctcaaccgtatcccacacggacggaagaatcactcggacaaaggaccgaaaccggtggtgttcctgcaacatggcctcctggccgactcttcaaactgggtgaccaatctggcaaatagcagcctgggtttcatcctggcggatgcggggttcgatgtttggatgggtaacagccggggtaatacctggtcacggaagcataagactttgtccgtgtcgcaggatgagttctgggctttcagctacgacgaaatggccaagtacgatctgccggccagcatcaactttattcttaacaagactggacaggagcaggtctactacgtgggacactcccagggaaccactatcggatttatcgccttttcgcaaatcccggaattggcaaagcgcatcaagatgttttttgcccttggccctgtggcgtccgtggcgttttgcacttctccgatggccaagctcgggagactgccggatcatttgatcaaagacctgttcggggataaagaattcctcccacagtcggccttcctgaagtggctcggtactcacgtgtgcactcacgtgatcttgaaggaactctgcggaaacctgtgcttcctcctctgcgggttcaacgaaaggaacctcaatatgagcagagtggatgtctacactacccattccccggcgggaacttccgttcagaacatgctgcactggtcacaggcggtgaagttccagaagttccaggcctttgattggggctcctccgccaagaactacttccactacaatcaatcgtacccaccaacttacaacgtaaaggacatgctggtcccgacggctgtgtggtcaggaggacatgattggctggcagatgtctacgatgtcaacattctccttacgcaaatcactaacctcgtctttcacgaatccatccctgaatgggagcacctggatttcatctggggtcttgacgccccatggcggctctataacaaaatcatcaacctcatgaggaagtatcag

SEQ ID NO: 15673 - DNA, 1197 bp, Artificial Sequence
  Description of Artificial Sequence: Synthetic coding sequence
atgaagatgcgcttcctgggactggtcgtctgccttgtgctctggactctgcacagcgagggaagcaggggtaagctgaccgccgtggacccagagactaatatgaatgtgtcggagatcatctcctattggggcttcccaagcgaggaatacctggtggaaaccgaggacggctatatcctctgcctgaaccgtatcccacacgggcgcaaaaaccactcggacaagggcccgaagccggttgtgtttctccagcacggactcctcgccgacagctcgaactgggtgaccaacctggccaactcctcccttgggttcatcctggccgacgcgggattcgatgtgtggatgggaaactcccggggaaacacctggtcgcgcaagcataaaaccctgtcggtgtcgcaggatgaattctgggcgttcagttacgacgagatggcaaagtacgatttgccggcgtcgatcaacttcatcctgaacaaaacgggtcaagagcaggtgtactatgtgggacattcacaggggaccactattggattcatcgcattctcacagatcccggagctggcgaaacggatcaagatgtttttcgcactcggaccagtggcctcagtcgcattctgcacttcccctatggcgaagctgggcagattgccagaccacctgatcaaagacctgttcggggacaaggagttcctgccccaatcggcgtttttgaaatggttgggaacccacgtgtgtacccacgtgatcctgaaagaactgtgtggaaatttgtgcttccttctgtgcgggttcaatgaaagaaatttgaacatgtcgcgagtggatgtctacaccacccatagcccagcaggcacctccgtgcaaaacatgcttcattggtcccaagcagtcaagttccagaagtttcaagcgttcgattggggatcctctgccaagaactactttcattacaaccagtcgtaccccccgacttacaatgtgaaggacatgctggtccctaccgccgtctggtccgggggccatgattggttggcggatgtgtacgatgtcaacatcctgctcactcaaattactaacctggtgttccacgaatccatccccgaatgggaacatctggatttcatctggggcctcgacgccccgtggagactttacaacaagatcatcaacctgatgagaaagtatcaa

SEQ ID NO: 15674 - DNA, 1197 bp, Artificial Sequence
  Description of Artificial Sequence: Synthetic coding sequence
atgaaaatgaggtttcttgggctggtagtttgtttagtactatggacactgcactctgagggaagtcgcggaaagctaacagctgtagacccagaaactaacatgaatgtgtcagaaatcatatcttattggggatttccctctgaagaatatctcgtcgaaacagaagatggatatatcctctgtttgaatcggattccccatgggcggaaaaatcattctgataaaggacctaaacccgtggtgttccttcagcacggactcctcgctgattcttctaattgggttacaaaccttgccaattcctctcttgggtttatcttggctgatgcagggttcgatgtatggatgggaaattctagggggaatacttggtctagaaagcataaaacattgtcagtgtcccaagatgaattttgggccttctcatacgacgaaatggctaagtacgatttgcctgcatcaatcaacttcattttaaacaaaacagggcaggaacaggtgtattatgtcgggcactctcaggggacaactattggattcatcgctttctctcagataccagaacttgcgaaaagaatcaagatgttcttcgcacttggacctgtagcttcagtggcgttctgcacgagtccaatggccaaactgggaagacttcccgatcacctcattaaagatttgttcggggacaaagaatttctaccccagagtgcattccttaaatggctagggacacacgtgtgtactcacgtgattctcaaagaattatgtggaaatctctgttttcttctctgtgggtttaacgaacgaaaccttaacatgtcgagggtggacgtatatacaactcattctcccgcagggacatcagtacagaatatgcttcactggagtcaggctgtaaagtttcagaaattccaggctttcgattggggatcttccgcaaaaaattacttccattataaccagtcctatcctcccacttacaacgtgaaagatatgctggtgccaactgcagtatggtcagggggacacgattggttggctgatgtctatgatgtcaatatattgctcactcagatcacaaaccttgtgtttcacgaatccatccccgaatgggagcacctcgacttcatctggggactcgatgcaccctggcggctgtataacaaaattattaacctcatgcggaaatatcag

SEQ ID NO: 15675 - DNA, 1197 bp, Artificial Sequence
  Description of Artificial Sequence: Synthetic coding sequence
atgaagatgcgcttcctaggtctagtggtgtgtctggtactgtggacactgcattccgaaggctcacgtggcaaactgaccgccgtggatcccgagacgaacatgaatgtttcagagatcatttcctattggggattcccttccgaggagtatctcgtggagaccgaagatggctacattctgtgcttaaatcgcattccccacggaaggaagaatcactcagataaaggtcctaaaccagtggtgtttctgcaacacggactactggccgactcgagtaactgggttaccaacctggccaattcaagcttgggcttcatactcgccgatgctggctttgacgtttggatgggtaattcgcgtggaaacacttggtcgcgtaagcataagacgctgtcggtgtctcaagacgagttttgggcgttttcgtacgatgaaatggccaagtacgatttgcccgcgagtatcaactttatcctgaataagacgggccaggaacaagtttactatgtgggccacagccagggtaccacaatcggtttcatcgccttctcgcagatcccagagctagctaagcggataaaaatgttcttcgccctaggccctgtggcatccgttgccttttgcacatcgcccatggcaaagctgggcagactgcccgaccatctgataaaggacttgttcggggacaaagaatttctgccacaaagtgcctttctgaagtggctcggaacgcacgtctgcacccacgtgatcttgaaagaactgtgtggcaacctgtgcttcctgctctgtggcttcaatgagcggaatctgaatatgagtcgggtcgacgtatatacgacacactcaccggccggaacttccgttcagaacatgcttcattggagccaggctgtcaaatttcagaaatttcaggctttcgactggggcagtagtgccaagaattatttccactacaaccagagctacccgccgacctacaacgtgaaggacatgcttgtgccgaccgccgtgtggtccggcggccatgattggctggccgacgtctacgatgttaacattctgctgacccaaatcaccaatctcgtgttccacgagtccattcctgagtgggagcatctcgatttcatctggggacttgatgccccgtggcggctgtacaataagatcatcaatctgatgcgaaagtatcag

SEQ ID NO: 15676 - DNA, 1197 bp, Artificial Sequence
  Description of Artificial Sequence: Synthetic coding sequence
atgaaaatgcgatttctcggtctggttgtgtgtcttgttctctggaccctgcactcggaagggagccgggggaagttgacggcagtcgatcctgagactaatatgaacgtgtcggaaatcatctcgtattggggatttccttcagaggaatacttggtggaaactgaagatggatacattctttgccttaaccgaatcccacatggtagaaagaaccattcagacaagggacccaagccggtggtgtttcttcagcatggactcctggccgattcgtcgaactgggtcactaatcttgcgaattcatctctgggctttattctcgcagacgcgggctttgatgtctggatgggcaattcgcgcggcaacacctggtcgaggaagcacaagactctttcagtgagtcaagatgagttttgggcgttcagttacgatgagatggcgaaatacgacctgcccgcatcgatcaatttcatattgaacaagactggccaggaacaagtgtactacgtgggtcactcccaggggaccacgattggcttcatcgcattctctcaaattcctgaattggccaagagaattaagatgttttttgcgctggggcccgtggcatcagtggcattctgcacctccccaatggcaaaactgggaaggctgccagatcatctcataaaggacctttttggggataaggagtttctcccacaatcagcatttctcaaatggctgggtactcatgtctgcacccatgtaatcctcaaggaactctgtggaaatctttgttttcttctttgtggtttcaatgaacggaacctgaatatgtcgagagtggatgtttacacgactcattccccagcagggacctcggtgcagaacatgcttcactggtcgcaagccgtgaagttccagaaatttcaagcctttgattggggaagctccgcaaagaattacttccattacaaccagtcataccctcctacctacaatgtcaaagatatgctggtgcctaccgccgtctggtcaggaggacatgattggctggctgacgtgtacgacgtgaacatactgctgacgcaaattactaaccttgtctttcatgaatctattccagagtgggagcacctcgactttatctggggattggatgcgccatggcggctgtacaacaagatcattaacctgatgcggaagtaccag

SEQ ID NO: 15677 - DNA, 1197 bp, Artificial Sequence
  Description of Artificial Sequence: Synthetic coding sequence
atgaagatgagatttctgggattagtggtgtgtttagtgctttggacactacattctgagggatctagaggaaagctgacagctgtcgatcccgagacaaacatgaacgtctctgaaatcatcagctattggggttttcctagcgaagagtacctcgtcgagacggaagatgggtatattctgtgtctcaataggatcccacacggccgcaaaaatcactctgacaaaggccctaagcctgtggtgttcctccaacatggactgctggcggattcctctaattgggtgactaaccttgccaactccagtctggggtttatcctggcggacgcaggctttgatgtgtggatgggaaactcaagaggcaatacatggagtaggaaacataaaaccctctctgttagtcaggatgagttctgggcatttagctacgacgaaatggctaaatacgatctgccagcttctatcaactttattctcaataagactggacaagaacaggtgtactacgttgggcacagccaaggcaccaccatcggatttatcgcgttcagtcagattccagaactggccaagagaatcaaaatgttttttgctctcgggcctgtggcctccgtggccttttgtaccagccccatggccaagcttggaagactccctgatcatctgatcaaggatctgtttggagataaagaatttttgcctcagtcagcgttccttaagtggctcgggacccatgtctgcactcatgtgattttgaaagagctctgtggaaacctatgtttcctgctgtgtggttttaatgaacgaaatcttaacatgtcacgcgtagatgtgtatacaacccactcacctgccggcacgagcgtgcagaatatgcttcactggtcccaggccgtcaaattccaaaaattccaggcctttgattggggcagcagcgccaaaaactatttccactataatcagtcatacccccccacatacaacgttaaagacatgctggtgcctacggctgtctggtctgggggtcacgactggttggctgacgtttatgatgtgaacatattgctaacacagataacaaacctcgtgtttcacgagagcatccctgaatgggaacacctggatttcatttggggcctggacgctccatggagactgtacaacaagatcattaacctgatgaggaaatatcaa

SEQ ID NO: 15678 - DNA, 1197 bp, Artificial Sequence
  Description of Artificial Sequence: Synthetic coding sequence
atgaagatgagatttcttgggctggtcgtgtgcctcgtgctttggacccttcactccgaagggtcgagaggtaagctcactgctgtcgatcctgaaactaacatgaacgtctccgagatcatttcgtactggggttttcccagcgaggagtaccttgtggaaaccgaggatggttacatcttgtgcctcaaccgcattcctcatgggagaaagaatcactccgacaagggacccaagccagtggtctttcttcaacatggccttcttgcagattcatccaactgggtcactaacctggcaaactcctcattgggctttatcctggccgacgcaggttttgacgtgtggatgggaaattcacgggggaacacctggtccaggaagcacaaaactctgtcagtgtcgcaagatgaattttgggcgttctcctacgacgaaatggcaaagtacgatcttcctgcatcaatcaactttattctgaataagaccggacaagaacaagtgtattacgtgggtcactcgcaaggtaccaccattggtttcattgcttttagtcagataccagaactggccaagcgaattaagatgtttttcgctctgggtcctgtggcatccgttgcattctgtacttcaccaatggcgaaattgggcaggctccctgaccatttgattaaggacctctttggagacaaggaatttctcccacagagcgcctttttgaagtggcttggcacccacgtgtgcacgcacgtcatcctgaaggaactctgtgggaacctgtgttttcttttgtgtggcttcaacgaaaggaatctcaacatgtcgagagtggacgtttataccactcattcaccagctggaaccagcgttcaaaacatgcttcattggtcgcaagccgtcaaattccagaaatttcaagcattcgattggggttcatcagcgaagaattacttccactacaaccaatcgtaccctcctacctacaatgtgaaggatatgcttgtgccaacggcagtttggtcgggtggtcacgattggctggccgatgtgtatgacgtgaatattctgctcactcagatcaccaatcttgtgtttcacgaaagcattcccgaatgggaacatctggatttcatttggggtctggatgcaccctggagactgtacaataagatcatcaacctcatgcgcaagtaccag

SEQ ID NO: 15679 - DNA, 1197 bp, Artificial Sequence
  Description of Artificial Sequence: Synthetic coding sequence
atgaaaatgcgatttttaggtctagtagtttgtttagttttatggacgttacattcggaaggttcgcgtggtaaactaacggcggttgatccggaaacgaatatgaatgtttcggaaataatatcgtattggggttttccgtcggaagaatatctagtagaaacggaagatggttatatattatgtctaaatcgtataccgcatggtcgtaaaaatcattcggataaaggtccgaaaccggtagtttttttacaacatggtttattagcggattcgtcgaattgggtaacgaatctagcgaattcgtcgctaggttttatactagcggatgcgggttttgatgtatggatgggtaattcgcgtggtaatacgtggtcgcgtaaacataaaacgctatcggtttcgcaagatgaattttgggcgttttcgtatgatgaaatggcgaaatatgatttaccggcgtcgataaattttatattaaataaaacgggtcaagaacaagtatattatgttggtcattcgcaaggtacgacgataggttttatagcgttttcgcaaataccggaactagcgaaacgtataaaaatgttttttgcgttaggtccggttgcgtcggtagcgttttgtacgtcgccgatggcgaaattaggtcgtctaccggatcatttaataaaagatctatttggtgataaagaatttttaccgcaatcggcgtttctaaaatggttaggtacgcatgtttgtacgcatgtaatactaaaagaactatgtggtaatttatgttttttactatgtggttttaatgaacgaaatttaaatatgtcgcgagtagatgtatatacgacgcattcgccggcgggtacgtcggttcaaaatatgctacattggtcgcaagcggtaaaatttcaaaaatttcaagcgtttgattggggttcgtcggcgaaaaattattttcattataatcaatcgtatccgccgacgtataatgtaaaagatatgctagttccgacggcggtatggtcgggtggtcatgattggttagcggatgtatatgatgtaaatatactactaacgcaaataacgaatttagtatttcatgaatcgataccggaatgggaacatctagattttatatggggtctagatgcgccgtggcgtttatataataaaataataaatctaatgcgaaaatatcaa

SEQ ID NO: 15680 - DNA, 1197 bp, Artificial Sequence
  Description of Artificial Sequence: Synthetic coding sequence
atgaagatgcgcttcctggggctggtggtgtgtcttgtactctggactctgcactctgagggctcacgtggtaagctgaccgccgtggatcccgaaacgaacatgaatgtatctgagataatttcttactgggggttccctagtgaggaatatctggttgagaccgaagacggctacatcctatgcttaaacagaattccacacggccggaaaaaccacagtgataagggaccaaaacctgttgtatttctgcagcatggactcctggcagatagtagtaattgggtgacaaacttggccaactcctccttgggcttcattctcgctgatgctggtttcgatgtgtggatgggcaactcgcgagggaacacctggtctcggaaacacaagaccctgtcggttagccaggacgaattctgggccttcagttatgacgagatggccaaatacgacctgcccgctagtatcaacttcattcttaacaaaactgggcaggagcaggtgtattatgtgggacacagtcagggaacaacaatcggatttatcgccttcagccagatccctgaactggccaagcggattaaaatgttttttgccctgggccccgttgcttctgtggcattctgcacatccccaatggccaagctcgggaggttaccagatcacctgatcaaggacctgtttggcgataaggagtttctaccgcagtcagcatttctaaagtggcttgggacacacgtgtgtacccacgtgattctaaaggagttgtgcggtaacttgtgcttcctcctgtgcgggttcaatgagcgcaatctcaacatgtcccgtgtcgacgtgtacacaacacattcgcctgctgggacatcagttcagaatatgctacactggagccaagccgttaaatttcaaaaattccaggccttcgactggggttccagtgctaagaactatttccactataaccagagctatccaccaacttacaatgttaaggacatgctagtgcctactgccgtgtggagtgggggtcatgactggctggccgatgtgtatgacgtaaacatactactgacccagatcaccaatcttgtgttccatgagtcaataccagagtgggagcacctagactttatatgggggctggacgccccatggcgactttacaacaaaatcataaatttgatgaggaaatatcag

SEQ ID NO: 15681 - DNA, 1197 bp, Artificial Sequence
  Description of Artificial Sequence: Synthetic coding sequence
atgaaaatgaggtttttaggattggtggtatgtctcgtgttgtggaccctgcactccgagggctctcgcggaaagctaactgctgttgacccggaaacgaatatgaatgtgagcgagatcatctcttactggggcttcccctccgaggagtatctagtggagacggaagatgggtatattctgtgtttgaatcggatcccacacgggcggaaaaaccattccgataaggggccgaagccggtagtattcttgcagcacggcttgttagccgactcatctaactgggtcacaaacctcgcgaacagctcgctcggattcattctggctgatgccggcttcgacgtctggatgggtaattctcgggggaacacatggagccggaaacacaaaacactatctgtgtcccaggatgagttttgggctttcagctatgatgagatggccaagtacgatttgcctgctagtatcaacttcatcctcaacaagacaggccaggaacaagtttattatgtgggccactcacagggcactaccatcgggttcatcgctttctcccagattcccgagctcgcaaagcgaatcaaaatgttttttgccctcggccctgtggcttccgttgccttctgtacctcccccatggctaaactcgggcggcttcccgaccacctgattaaggacctgtttggggacaaggagtttcttccccagtcagcattcctcaagtggctgggcacacacgtatgcacacacgtgatactcaaggagctttgtggaaatctgtgtttcctgctgtgcggcttcaacgaacgcaacctcaatatgtcccgggtcgatgtttacaccacccacagtccggccggcaccagcgtgcagaatatgttacattggtcccaagctgtcaaatttcagaagttccaggcttttgactggggctctagtgcaaagaattatttccattataatcaaagttatccccccacttacaacgtgaaggacatgctagtgccgaccgcagtgtggtctggaggtcacgactggctggccgacgtgtatgacgtgaatattctcctcactcagatcactaacctggtgtttcatgaaagcatccctgagtgggagcacctggacttcatatggggattggacgcaccctggaggctgtacaataagattataaacctcatgcgaaagtaccag

SEQ ID NO: 15682 - DNA, 1197 bp, Artificial Sequence
  Description of Artificial Sequence: Synthetic coding sequence
atgaaaatgaggtttcttggactggtcgtctgcctagtactttggacattgcactcggagggttctcggggaaagctaactgccgtggatccagagaccaacatgaatgtgagtgagattatctcctactggggatttccgtcggaggaatatttggtggaaactgaagacggttacattctctgtcttaatcgaatcccacacggacgtaagaatcactcagacaagggcccaaagcctgtggtattcttacaacacggactactagccgattccagcaactgggttacaaaccttgccaattcatcattgggatttattctggcagatgcaggcttcgatgtgtggatgggtaatagtcgaggtaatacttggtctcgtaagcacaaaactttgtcagtttctcaagatgaattctgggcattttcctatgacgaaatggcaaaatatgatctcccagcatcgatcaattttatacttaataagactggacaggaacaagtttactacgtcggacactctcaaggtactacgatcggattcattgcattttcacagatcccagagttggctaagaggattaagatgttcttcgctctcggaccggtggcttcagtggctttttgcacctctccaatggccaaacttggacgacttccagaccatttgattaaggatttgttcggagataaagaatttctcccacagtcagcctttttgaagtggttgggaactcacgtttgtactcatgttattcttaaagagctatgtggaaacctttgctttttgctttgtggattcaatgaacgaaacttaaatatgtctcgagttgatgtctataccactcattctccagcaggtacgtcagtgcagaacatgctgcactggagtcaagcagtcaagttccagaaatttcaagcgttcgattggggatcttctgctaagaactactttcactataatcaaagctaccctccaacatataatgttaaagatatgttggttccaactgctgtctggtctggaggacacgattggcttgcagatgtgtacgatgtgaatattctcttgactcaaattacaaatcttgtgttccacgaatccatcccagagtgggaacacctggattttatttggggtttggatgccccatggcggttgtataataaaattatcaacttgatgcggaagtatcaa

SEQ ID NO: 15683 - DNA, 1197 bp, Artificial Sequence
  Description of Artificial Sequence: Synthetic coding sequence
atgaagatgcgtttcctgggattagttgtgtgccttgtgttgtggactttgcacagtgaaggatcacggggaaaactgacggcggttgatccagaaactaacatgaatgtgtctgagattatctcctattggggattccccagcgaagagtacctggttgaaacggaggacggatatatcctttgcctgaatcggattccccatgggcgtaaaaaccattcagacaagggacccaagcctgtcgtgtttttgcagcatggcctcctcgcagactcatctaattgggtcaccaatctcgccaacagttcactggggttcattctggcagatgccgggttcgacgtgtggatgggcaactctagaggtaacacctggtccaggaagcacaaaaccctatctgtatctcaggatgagttctgggccttctcatacgatgagatggcaaaatacgacctccctgcgagcataaacttcatcctgaacaagacagggcaggagcaggtttattatgtggggcactctcaaggcaccaccatcggatttatcgccttctctcaaattccagagcttgccaagaggattaagatgtttttcgcacttggacccgtggcatccgtggccttttgcacctctccaatggccaagctgggccgtctgcccgatcacctgatcaaagacctcttcggggataaggaatttttaccccagtccgcattcttgaaatggctgggaactcacgtgtgcacccacgtcatcctgaaagaactttgtggcaacttatgctttctgctatgtgggtttaacgagcggaacctgaatatgagccgggttgatgtgtacactacacattcccccgctggaacatccgtccagaatatgttgcattggtcccaggccgtgaaattccagaagttccaggcctttgactggggctccagtgctaaaaactactttcactataaccagtcctatccacctacatacaatgtgaaagacatgcttgtgccaacggccgtctggagcggcgggcatgattggctcgcagatgtatacgatgtcaacattctcctgacgcagatcaccaacttagtgttccacgagtccatacctgagtgggagcatttggactttatttggggactcgacgcaccttggaggctgtacaacaagatcataaatctgatgcgcaaataccag

SEQ ID NO: 15684 - DNA, 1197 bp, Artificial Sequence
  Description of Artificial Sequence: Synthetic coding sequence
atgaagatgagattcctgggattggtggtctgtctcgtcctgtggacccttcactcagagggatcgcgaggaaaactgaccgccgtggatcccgaaacgaacatgaacgtgtcagagattatctcctattggggcttcccgtcggaagagtacctggtcgagacggaggacggatacatcctgtgcctcaacaggatcccacatgggcgcaagaaccactcagataagggtccaaaaccagtcgtctttctccagcacggtttgctcgcggactccagcaactgggtcaccaatctggccaactcgtccttggggttcatcctggctgatgcgggatttgacgtgtggatgggcaactcgcgaggcaacacctggtcgcggaagcataagactttgagtgtctcacaggacgagttctgggccttcagctatgatgaaatggcaaagtacgatctcccagcatctattaacttcatcctgaataagacgggccaggagcaggtgtactacgtgggccattcgcaaggaaccaccatcgggttcattgccttcagccaaatccctgaactggccaagcgtatcaaaatgttttttgccctgggaccggtggcaagcgttgctttctgtacttccccgatggccaagctgggacggcttccggaccacctgattaaggacctgttcggcgataaggaatttcttcctcagagcgcattcctcaagtggctcggaactcatgtctgcacccatgtgatcctgaaggaactgtgcggaaacctgtgtttccttctgtgcggattcaatgagcggaacttgaatatgtcgcgggtggacgtgtacactactcatagcccagctgggacctcagtgcagaatatgcttcattggtcccaagccgtcaaatttcagaaattccaagccttcgactgggggagctccgcgaaaaactactttcactacaatcaatcgtacccaccgacttacaacgttaaggatatgctcgtgccgaccgccgtctggtcgggcggacacgattggctcgcggacgtctacgatgtgaacatcctgcttacccagataaccaatctcgtatttcacgaatctatccctgaatgggaacacctggacttcatttggggactcgacgccccctggagactgtataacaagatcatcaaccttatgcgcaaataccag

SEQ ID NO: 15685 - DNA, 1197 bp, Artificial Sequence
  Description of Artificial Sequence: Synthetic coding sequence
atgaaaatgcgatttctggggttagttgtatgtttagttttgtggactctccactctgaagggtcaagagggaagcttacggcagttgatcccgaaacaaatatgaatgtttcagaaataatctcatattggggattcccatctgaggaatatcttgtggaaacagaagatggatatatcttatgtctgaatcgcataccccatggacgaaagaaccattcagataaaggacccaaacccgtagtgtttctccagcatgggctcctggccgatagttcaaactgggtgacaaacctagctaatagttccctggggttcatcctggctgatgccggatttgatgtgtggatggggaactccagggggaacacttggtccaggaaacacaaaacactcagtgtgtctcaggatgagttttgggcattcagttatgatgaaatggccaagtatgacctgccagcttcaatcaattttatactcaacaaaactggacaggaacaggtatactacgtcgggcacagtcagggaactactataggatttatcgcttttagtcagatacccgaactagcaaaaaggataaaaatgttttttgcgctggggcccgtggcatcagtcgcattctgtactagtcctatggctaaactgggacgcttacccgatcatctgatcaaagatctctttggagataaagaattcctgcctcagtcagcattcctgaaatggcttgggacacacgtatgtacacacgttatcttgaaagaactgtgtggaaacctgtgtttcctgttgtgtgggttcaatgagaggaatttaaacatgtctagggttgatgtctatactactcactctccagctggaacttctgtgcagaatatgctgcactggtcacaggctgtaaaattccagaaatttcaagcctttgactgggggtcatcagccaaaaactactttcactataaccagtcttatcctcccacatataacgtaaaagatatgcttgtgccgacagccgtgtggtccggggggcacgattggttggcagatgtttatgacgtgaacatcttactcactcaaataactaatctagtgttccatgagagtatacccgaatgggaacacctcgattttatttggggacttgatgccccatggcggctttataataagatcataaacctcatgagaaaatatcag

SEQ ID NO: 15686 - DNA, 1197 bp, Artificial Sequence
  Description of Artificial Sequence: Synthetic coding sequence
atgaagatgagatttctggggcttgtggtgtgtttggtgctttggacccttcatagcgaaggttcaagagggaaactgaccgccgtggacccagaaactaacatgaacgtgagcgaaatcatctcgtactggggatttccatcggaggagtatctcgtggagactgaagatggttacattctttgcctgaatcgcattccacatggtcgcaagaaccattcggataagggaccgaagccagtggtgtttttgcaacatgggctgctggcagattcctccaactgggtgaccaatcttgcaaacagctccctcggattcattctcgcggatgcaggttttgacgtgtggatgggaaattcccgcggtaatacttggtcccgaaaacacaagactctgtcagtctcccaagatgaattttgggcctttagctacgacgaaatggcaaaatacgatttgcctgcatcgatcaactttatcctgaacaaaaccggccaagaacaggtgtactatgtcggccacagccaaggaacgaccataggattcatcgctttctcacaaattccagaactggccaagagaattaagatgttctttgcccttggtcccgtggcttccgtggccttttgcacctcgccaatggcaaagttgggacgactccctgaccatctgattaaagatctttttggagataaagaatttctgcctcagtccgccttccttaagtggctgggtacgcacgtgtgtactcatgtgatcttgaaagaactctgtggcaatctttgttttctgttgtgtggcttcaatgaaaggaatctcaatatgtcaagagtcgatgtgtacaccacccattccccagcgggtacctcggtccagaacatgcttcactggtcgcaagccgtgaagtttcagaagtttcaggctttcgactggggatcctcagccaaaaactacttccattacaatcaatcttatccccccacctacaatgtgaaagatatgctggtgcctactgcggtctggagcgggggacacgattggctcgccgacgtctacgatgtcaatattctccttacccaaatcactaatctcgtgtttcacgagtcgattccagaatgggaacatctcgatttcatttggggactggatgcaccttggcgattgtacaataagattatcaacctcatgagaaagtaccag

SEQ ID NO: 15687 - DNA, 1197 bp, Artificial Sequence
  Description of Artificial Sequence: Synthetic coding sequence
atgaagatgcggtttctgggactggtggtctgcctggttctgtggaccctgcattcggagggctcacgggggaaactgactgctgtcgatccggagactaatatgaatgtgtccgaaatcatctcctactgggggttcccatcggaagaatacctggtggaaaccgaggacggatatatcctgtgtttgaaccggatcccgcatggacgaaaaaaccattccgacaaagggccaaagcccgtggtgtttctccagcacggactgctggcggattcgtcgaactgggtgacgaatctggccaacagctcactgggattcatcctcgctgacgcaggattcgatgtttggatgggaaattcccggggcaacacctggagcagaaagcataagaccttgtccgtgtcacaagatgaattctgggcattctcatacgatgaaatggccaagtacgacctgccagcaagcatcaactttatcctgaacaagactggccaggagcaagtgtactacgtgggtcacagtcaaggcactaccatcggtttcatcgctttttcgcagattccggagttggcgaagcgcatcaaaatgttcttcgctctgggacctgtggcgtccgtagcgttctgcacctcccccatggctaagctcggacggctgcctgatcatctgatcaaagacttgtttggagacaaggaatttctgccgcagtcagcattcttgaaatggctcggaacccatgtgtgcacgcatgtcattttgaaggagctctgcggtaacctgtgtttcctgctctgcgggttcaacgaacggaatctgaacatgagccgcgtggacgtgtacactacccactccccagccggaacttcagtgcaaaacatgcttcactggtcacaggcggtgaaattccaaaagttccaggcgtttgactgggggtccagcgctaagaattacttccactacaatcaatcgtaccctccgacgtacaacgttaaggacatgctggtgccgaccgcagtctggtccggaggccacgattggctcgcggatgtgtacgacgtgaatattctcttgacccaaattactaacctcgtctttcatgaatccatcccggagtgggaacatttggacttcatttgggggctcgacgctccgtggcggctgtataacaagatcatcaatctgatgcgcaagtaccag

SEQ ID NO: 15688 - DNA, 1197 bp, Artificial Sequence
  Description of Artificial Sequence: Synthetic coding sequence
atgaagatgcgatttctggggctggtagtctgtctcgtgttgtggactcttcatagcgaggggtctaggggcaaactcaccgctgtcgatccagagaccaacatgaatgtatcagagattatctcctactggggatttccatcggaggagtatttggttgagacggaagatggttacatcttgtgcttaaatcgtatcccccacggaagaaagaatcacagcgacaagggaccgaaacctgtggtgtttcttcagcacgggttgctcgcagactcttccaactgggtgacaaacctggcaaattcttctctgggtttcatactggccgatgccgggttcgacgtttggatggggaatagccgagggaacacatggagccgaaagcacaagaccctgtcagttagccaagacgagttctgggccttttcttacgacgagatggcgaagtatgaccttccagcctccatcaacttcatcctgaacaaaactggacaggagcaggtgtattatgtggggcattcccagggcactacaattggcttcattgctttttcacaaatccccgaactagctaaacggattaagatgttcttcgcacttggacctgttgcaagcgtggccttttgtactagccctatggccaaactggggagactccctgaccacctgattaaggatctcttcggtgacaaagagtttctgccccagtctgccttccttaaatggctcgggacacatgtatgcacacacgttattctgaaggagttgtgcggtaatctgtgctttctgctctgtggcttcaacgaacgtaacttgaatatgtccagggtcgacgtttacactactcacagccccgccgggacttccgttcaaaacatgctgcactggagccaagcggttaaattccagaaattccaggcctttgattggggcagttctgccaagaattatttccactataaccagtcatatcccccaacctataatgtcaaagatatgctggtgcctaccgccgtgtggtcaggtggccacgattggctggccgatgtctacgatgtcaacatcctcctcactcagattacgaatctggttttccatgagtcgatacctgagtgggaacacttagacttcatttggggactggacgcgccatggcgcctctacaacaagatcattaatctaatgagaaagtaccag

SEQ ID NO: 15689 - DNA, 1197 bp, Artificial Sequence
  Description of Artificial Sequence: Synthetic coding sequence
atgaagatgcgcttcctcggcctcgtcgtgtgccttgtgctttggactctgcactccgagggttcccgcggaaagctgactgccgtcgaccccgaaaccaacatgaacgtgtccgaaatcatctcctactggggttttccgtccgaggaatacctcgtggaaaccgaagatgggtacattctttgccttaatcgcataccgcacgggaggaaaaaccactcggacaagggacccaaaccagtggtgtttcttcagcatgggcttcttgctgatagctccaactgggtgactaacctcgcgaatagctcgctgggattcatactggcagatgcagggtttgacgtgtggatgggaaattcgagaggtaatacttggtcgcggaagcacaaaaccctgtcagtctcgcaggatgagttttgggcgttttcctacgatgaaatggccaaatacgacttgcctgctagcataaactttattctgaacaaaactggacaggagcaggtctactacgtgggccattcgcagggcaccacgattggtttcattgccttttcgcagatcccagagctggcaaagcgcattaagatgttctttgccttgggacctgtcgcgtcagtggcattttgcacctcacccatggccaaactggggagacttcccgatcacctgatcaaggatctctttggtgataaggaattcctccctcaatcagcctttttgaagtggcttgggacgcatgtttgcactcacgtgatattgaaggaactctgcggaaacctttgttttctcctttgcggattcaatgaacgaaatctcaatatgtcgcgggtggatgtctacaccactcacagccctgctggtacttccgtgcagaatatgcttcattggtcgcaagcagtcaaattccaaaagtttcaggcatttgattggggttcctcagcaaagaattactttcattacaatcagtcatacccacctacttacaacgtcaaggatatgctcgtgcctaccgccgtgtggagcggtggacatgattggcttgcagatgtctatgatgtgaacattcttcttacccaaatcacgaacctcgttttccatgaaagcatccctgaatgggaacaccttgacttcatttggggtctggacgcaccgtggcgattgtacaacaaaatcatcaatctcatgcgaaagtaccaa

SEQ ID NO: 15690 - DNA, 1197 bp, Artificial Sequence
  Description of Artificial Sequence: Synthetic coding sequence
atgaagatgagatttctgggtctggtagtgtgtctggtgctttggacgctgcattctgaaggtagcagaggcaagttaacggcagtggatcctgaaacaaatatgaacgtatccgagattatttcatactggggatttccaagcgaagaatacctcgtggaaacggaggacggatacatcctctgcctcaacaggatccctcatggacgcaaaaaccattcggacaagggtcctaagcccgtcgttttcctgcagcacggtctgctggcagattcatctaattgggttacgaatcttgcaaactcatcactgggcttcatacttgccgacgccgggtttgatgtgtggatgggcaactctcgtggaaacacatggtcccgcaagcacaaaactctctccgtgtcgcaggacgaattctgggcattttcctatgatgaaatggctaaatacgatctgcctgcatcgattaacttcatccttaacaagactggacaggagcaagtgtactatgtaggtcatagccaagggacaaccatcggtttcattgcttttagccaaatccccgaactggccaagcggatcaaaatgttttttgcattgggacccgtggcctccgtggccttctgcacgtcaccgatggcaaagctcgggagacttcccgatcaccttataaaggacctcttcggtgataaagagttcctgccccagtccgctttcctgaaatggttgggaacccatgtgtgtacacacgtcatacttaaggaactgtgtgggaacctgtgctttctcctgtgtggctttaacgaaagaaatctgaatatgagtcgagttgacgtttacaccacccatagccccgcggggaccagtgtgcagaatatgttgcactggtcacaggcagtgaaattccaaaaatttcaggcatttgattggggtagttccgccaagaactacttccattataaccaatcctaccctcctacatacaatgttaaagacatgctggtgccgaccgcagtctggtctggcggccacgactggttggccgacgtgtacgacgttaacattctgctgacccagatcaccaacctggtgttccatgaatctatcccggaatgggaacatctggactttatttgggggctggacgccccctggcggctttacaataagattattaacttgatgaggaagtatcag

SEQ ID NO: 15691 - DNA, 1197 bp, Artificial Sequence
  Description of Artificial Sequence: Synthetic coding sequence
atgaaaatgcggtttctgggcttggttgtttgcctggtgttgtggacattgcatagtgagggtagcaggggaaaactgactgcggtcgatcccgagaccaatatgaatgtcagtgagatcatttcttactggggcttcccgtccgaagagtacctcgtggaaacagaagacggatacattctctgtctgaatcggatcccacacggacgcaagaatcattcagataagggtcccaagcctgtcgtgttcctgcagcacggacttctggctgactcatcaaattgggtgactaaccttgccaactcttccctgggttttatacttgccgacgccggattcgacgtctggatgggcaattccaggggcaacacttggagccgaaagcataagacgctctctgtgtcccaggatgaattctgggccttcagttatgatgagatggccaaatatgaccttccagcaagcataaactttatcttgaataagaccggccaggagcaggtatactatgtggggcattcacaaggcaccactattggattcatcgctttttcccaaatccccgagctggccaaaaggattaagatgttttttgctctgggacccgtcgcaagcgtggcgttctgtactagccccatggccaagctgggaaggctccctgaccacttgataaaggacctgttcggcgataaggaatttttgccccagtccgcgtttctgaagtggctgggcacccacgtctgtactcatgttatcctgaaagaattgtgcggcaacctttgttttctgctgtgcggcttcaacgagagaaacctcaatatgagcagggtcgacgtgtacacaacgcactctcctgctggcacgagtgtgcaaaacatgcttcactggtcccaagctgtgaagtttcagaagttccaggcttttgattggggttctagcgccaaaaattacttccactacaaccagtcctaccctccaacttataacgtgaaggacatgttggtgccaacagcagtgtggagtggcggtcacgactggctggctgatgtttacgatgtgaatatcctgttgacccagataacaaacctcgtttttcatgagagcattccggaatgggaacacctggacttcatatggggcctcgatgctccctggaggctctacaataagatcatcaatctgatgcgaaaataccaa

SEQ ID NO: 15692 - DNA, 1197 bp, Artificial Sequence; identical to SEQ ID NO: 15683
  Description of Artificial Sequence: Synthetic coding sequence

SEQ ID NO: 15693 - DNA, 1197 bp, Artificial Sequence
  Description of Artificial Sequence: Synthetic coding sequence
atgaagatgaggttcctgggactcgtggtctgtctcgtactatggactcttcattctgagggtagcagaggaaagctgactgctgttgacccagagaccaatatgaacgtgtccgaaatcatatcttactgggggttcccttcggaagaatacttggtggagaccgaggacggctatatcctctgcctgaatcggattccacacggacgcaagaatcactccgataaggggcccaagccggtagtctttctccaacatgggctattagccgactcttctaattgggttacaaatctggccaattctagcctgggatttatcttggctgacgccggtttcgatgtgtggatgggaaacagtcgtggaaatacttggtcccgaaaacataagacactgagcgtgtcccaggacgagttttgggcattcagttacgacgaaatggcaaagtatgatttacctgcctcaatcaacttcatcctgaacaagacgggccaggaacaggtttactacgtagggcactcccaagggaccaccattggcttcatcgcattttcacaaatccccgagctggccaagagaatcaaaatgtttttcgctctgggccccgtcgccagcgtagctttctgtaccagtcctatggcaaagctcggtaggcttcccgaccacctgatcaaagatctgttcggtgacaaagaatttctgccacagagtgcattccttaaatggctgggcacccatgtgtgtacgcacgttatcttgaaggagctgtgcggaaatctatgttttctcctgtgcggttttaatgagaggaatctgaacatgtctagggttgacgtttacactacccactcacctgccggcaccagcgtccagaatatgctgcattggtcgcaagctgttaagtttcagaaatttcaggcattcgattggggttccagcgctaaaaattactttcactacaatcagtcatacccacccacttacaatgtcaaggacatgcttgtccctaccgctgtatggtctggtggccatgactggctggctgacgtttatgacgtaaatattctgcttacccagatcacaaacctggtattccatgagtcgattccagagtgggagcatttagacttcatttggggcctcgacgctccgtggcgattatacaataaaatcatcaatttgatgcgaaagtaccag

SEQ ID NO: 15694 - DNA, 1197 bp, Artificial Sequence
  Description of Artificial Sequence: Synthetic coding sequence
atgaaaatgaggttcttgggccttgtcgtttgtctggtgctgtggactttgcacagtgaagggagccgcgggaagcttaccgccgttgatcccgaaaccaacatgaacgtgtccgagataatctcttactggggctttccatcagaagaatatcttgtggagaccgaagatggctatatcctatgtctcaatcggattccgcatggccgaaagaatcattctgataagggtccaaagccagtcgtgtttctacagcacggcctgctggctgatagttcgaattgggtcaccaatcttgctaacagctccctgggttttatactggcagatgccggatttgacgtgtggatgggcaacagtcgggggaatacttggagccgaaaacacaagaccctctctgtctcccaggatgagttttgggccttttcctacgacgaaatggctaaatatgacttgccagctagcatcaactttattctcaacaaaaccggacaggaacaggtgtactacgttggacattcgcaaggcacaaccatcggctttatcgcattttcccagattcccgaactggccaaacgcataaagatgttctttgcccttggccccgtagcctcagtcgcgttttgtacctcccctatggcaaaactgggtagactccctgaccatctgatcaaggacttgttcggagacaaggagttcctcccacagtctgccttcctgaaatggctggggactcacgtgtgtacccacgtgattctaaaggaactgtgcgggaatctctgttttttactctgcgggtttaatgagcgcaacctgaacatgtcacgcgtcgatgtctacactactcactcacccgcaggaacaagcgtgcaaaatatgctgcactggtcccaggctgtgaaatttcagaagtttcaggcctttgattggggatccagcgccaaaaattatttccactataaccagagctacccccccacatataatgtgaaagacatgctggtcccaactgcggtatggtcgggggggcacgattggctggccgatgtttacgacgtgaatattcttttgacgcagatcaccaatctggtattccacgagtccatccctgaatgggagcacctcgattttatttgggggcttgacgccccatggaggttatacaacaaaattattaacctgatgaggaaatatcag

SEQ ID NO: 15695 - DNA, 1197 bp, Artificial Sequence
  Description of Artificial Sequence: Synthetic coding sequence
atgaaaatgagatttcttggactcgtcgtgtgtttggtcctgtggactctgcactcagaagggtccagagggaaacttaccgcagtagatcctgaaactaatatgaacgtgtcggaaatcatctcctactggggtttcccttctgaagaataccttgtggaaaccgaagatggatacattctctgcttgaaccgcattccccatggacgtaagaaccattccgacaagggtccaaagccagtcgtgtttcttcagcatgggttgcttgctgatagctcaaattgggtgaccaacttggcaaatagctccctcggattcattctggcagatgcagggtttgatgtctggatgggtaattcgcgaggaaatacctggagcaggaagcataaaacgctttcggtttcacaggacgagttctgggcattttcatatgatgaaatggccaagtacgatctgccagcaagtatcaactttatcctgaacaagacgggtcaagagcaggtctattacgtcggccactcacagggtaccactattgggttcatagcgttcagccagattccagagctggcaaaacggatcaaaatgttctttgcgttgggaccggtggcctccgttgcattctgtaccagccctatggcaaaactcggccgcctgcctgatcatctcattaaggacctctttggtgataaggaatttctgcctcaaagcgcattccttaagtggttgggaactcatgtgtgtactcatgtgatactgaaggaattgtgtggtaacctgtgttttttgctgtgtggattcaatgagcggaacttgaatatgtcgcgcgtggacgtctacactactcactccccagccggaaccagcgtgcaaaacatgctgcactggtcccaagccgtgaaatttcaaaagtttcaggccttcgactggggtagctcagccaagaattactttcactacaaccaatcgtatccccctacctacaacgtgaaggacatgctggtgcccaccgcagtgtggtcgggtggacatgattggcttgcagatgtatacgatgtgaatattcttcttacccaaattactaaccttgtgtttcatgaatcaatccctgaatgggagcacctggacttcatttgggggctggatgccccatggcggctttacaataagatcataaaccttatgcgaaagtaccag

SEQ ID NO: 15696 - DNA, 1197 bp, Artificial Sequence
  Description of Artificial Sequence: Synthetic coding sequence
atgaagatgcgatttctcggactggtggtttgtctggtgctgtggactctgcacagtgaaggttccagaggaaagttgaccgcggttgacccggagactaatatgaatgtgagcgagattattagctactgggggttccctagcgaagaatacttggtggagactgaagatgggtacatcctgtgtctgaaccggataccccacgggcgcaaaaaccatagtgacaagggaccaaagcctgttgtcttcctgcagcacgggctgcttgcagattccagcaactgggtaaccaatctcgcgaacagttccctgggctttatcctcgccgacgccgggttcgatgtgtggatgggtaattctagaggtaatacctggtcccggaaacataaaacgctcagcgtgtcccaggatgagttttgggcattttcttatgacgagatggcgaagtatgatttgcccgccagcatcaatttcatactgaataaaacaggacaagagcaagtgtattatgtcggccattctcaaggaacgactataggatttatcgcattctcccagattcccgagcttgcgaaaagaattaagatgtttttcgcactggggccagtcgcgtcagtggctttctgtaccagccctatggctaagttgggtcggctccctgaccatcttatcaaagacttgttcggagacaaggagtttcttccccagagtgctttcttgaagtggctcggcactcatgtgtgtactcatgtaatcctgaaggagttgtgtggtaacctctgtttcctcctgtgtggatttaacgaacggaacctgaatatgtcacgggtggatgtctacacaacacacagtccagcaggcacctctgtgcagaacatgctgcactggtcacaggccgttaaatttcagaagttccaggctttcgattggggttcttccgcgaaaaattactttcattataatcagtcttaccccccaacctataacgtaaaagacatgctggttccaaccgcggtgtggagcggcggtcacgactggctggcagatgtgtatgacgtgaatattctcctgacacagatcactaatctggttttccacgagtccatcccagagtgggagcacctggatttcatctggggcctggacgctccctggagactctacaacaaaattatcaatctcatgcggaagtaccag

SEQ ID NO: 15697 - DNA, 1197 bp, Artificial Sequence
  Description of Artificial Sequence: Synthetic coding sequence
atgaaaatgcgctttcttggcctcgtcgtgtgcctggttctctggacacttcactctgaaggctcccgcgggaagttgacggctgtggacccagagacaaacatgaacgtttccgagatcatctcttactggggcttcccgtccgaggagtacctggttgagaccgaagatggctacatcctctgtctgaaccgaattcctcacggacgcaagaatcactcagataaggggccaaagcccgtggtttttttacagcatggtcttctggcggacagctctaactgggtaactaacttggccaactcttcactgggcttcattctggcggatgccgggtttgacgtctggatgggaaactcccgtggtaatacctggtcaaggaaacataagaccctgtccgtgagccaagatgagttttgggcattctcatacgacgaaatggctaaatatgacctccctgccagtataaactttattctgaataaaacaggccaagaacaggtgtactacgtaggccattcacagggaacaaccatcgggtttatagctttctcacagatcccagaactggcgaagcggataaaaatgtttttcgccctgggaccagtggcatccgtggctttttgcacctcgcccatggctaagctggggcggctgcccgaccacctaatcaaagacctgttcggggacaaagagttcctgccgcaatctgcctttcttaaatggctcggtacgcacgtatgtacacacgtgattttgaaggagttatgtggaaatctttgcttcctgttgtgcggttttaatgagcgcaacttgaacatgtctcgtgtggacgtgtatactacccacagccccgcaggcacaagcgtgcaaaatatgttacattggagtcaggcggtgaagtttcaaaaatttcaagccttcgactggggttccagcgcgaagaactactttcactacaaccagtcctatcccccaacctataacgtgaaggatatgcttgtgccaactgcagtgtggagcggcggtcatgattggcttgcagacgtgtacgacgtgaatatcctgctgactcagattactaatctggtattccacgaatctattccagagtgggaacacttggattttatttggggcttggatgctccgtggagactctataacaaaataattaatctaatgcgaaaataccag

SEQ ID NO: 15698 - DNA, 1197 bp, Artificial Sequence
  Description of Artificial Sequence: Synthetic coding sequence
atgaagatgcgcttccttggtctggtcgtctgcctggtgctttggactttgcattcggaaggatcgcgaggaaagctgaccgccgtggatccggaaaccaatatgaatgtgtcagagatcattagttactggggatttccaagcgaagaatacctggtcgaaaccgaagatgggtacatcctttgcctgaaccgaataccccatggtcggaagaaccatagcgataaaggcccgaaacctgtggtgttccttcagcatggactccttgcggattcgtccaactgggtgacgaatctggcaaattcatcgctgggattcatcctggcggatgccggttttgacgtgtggatgggcaactccagaggcaacacttggtccagaaagcataagaccctttccgtcagccaagacgaattttgggcattttcctacgatgaaatggccaagtatgatctccccgcgtcgatcaactttattctgaacaaaaccgggcaagaacaagtgtactacgtcggccactcgcaaggaaccaccattgggtttatcgccttctcgcagattcccgaactggccaagagaattaagatgtttttcgcactgggacccgtggcatcagtggccttctgtacttcgcctatggccaaacttggacgactccctgatcacctgattaaggacctgtttggtgataaggaatttctcccgcaatcggcgtttcttaagtggctgggtacccatgtctgtactcacgtcatcctcaaggaattgtgtggaaatctttgctttctgttgtgcggattcaatgagagaaatctcaacatgagccgagtcgacgtgtacaccacccactcaccagcgggtacctcggtgcagaacatgcttcattggtcccaggcggtgaagtttcagaaatttcaagcattcgattggggcagctccgcaaagaactacttccactacaatcaatcctacccacccacttacaatgtcaaggacatgctggtgccaaccgcagtgtggagcggaggacatgattggctggcagatgtgtacgatgtgaacatacttcttacgcaaataactaacctcgtgtttcacgagagcattcccgagtgggagcatctcgatttcatttggggcctggacgcaccgtggagactgtacaacaagatcattaaccttatgcggaagtaccag

SEQ ID NO: 15699 - DNA, 1197 bp, Artificial Sequence
  Description of Artificial Sequence: Synthetic coding sequence
atgaagatgcgctttctgggactggtggtatgtctcgttctgtggacactacacagcgaaggcagtagagggaaactcactgccgtcgatcccgagactaatatgaacgtgtcagagatcatttcttattggggctttcccagtgaggagtatctcgtcgaaaccgaggatggatacattttgtgcttgaaccgaatccctcatggccgcaaaaatcattctgataaaggaccaaagcccgtcgtcttcctgcaacacggactgctcgctgacagttcaaactgggtcaccaatctggcgaattccagcctggggttcattctggctgatgccggattcgacgtatggatgggcaactctaggggcaatacctggtctcggaagcacaaaaccctgtccgtgtcacaggacgagttttgggcattttcctatgatgagatggctaaatatgacctgcccgcgagcataaatttcatcctgaataaaactggtcaggagcaggtgtattacgttgggcactctcagggcaccaccattggatttatcgcgttcagccagatacccgagctagcaaagagaataaaaatgtttttcgcgttgggacctgtggcatcagttgcattttgcactagcccaatggccaagctggggcgcctgcctgatcaccttattaaagacttattcggagataaggagttccttccccagtccgcattcctgaagtggctcggaactcacgtctgcacacacgtgatcctgaaggaactgtgcggtaacctttgctttctgttgtgtggattcaatgaacggaatcttaacatgtcccgcgtagacgtttacacaacacattccccggctgggacgagtgtgcaaaatatgctgcactggagtcaggccgtgaaatttcagaaatttcaggcatttgattggggaagctctgccaagaactattttcactataatcagtcgtacccgccaacatataatgtcaaggacatgttggtaccaactgcggtttggagcggtgggcacgactggttggccgatgtttatgacgtgaacattctcctgacacaaatcacaaacctcgtgttccacgaatctataccagaatgggaacacctagatttcatctggggccttgacgcaccgtggagactgtataataaaattataaatctgatgaggaaataccag

SEQ ID NO: 15700 - DNA, 1197 bp, Artificial Sequence; identical to SEQ ID NO: 15699
  Description of Artificial Sequence: Synthetic coding sequence

SEQ ID NO: 15701 - DNA, 1197 bp, Artificial Sequence
  Description of Artificial Sequence: Synthetic coding sequence
atgaaaatgaggttcctcggcttagtggtgtgcctggtgctttggacactacatagtgagggtagccgagggaaattgaccgctgtagatccggaaaccaacatgaacgtgagcgaaattatttcatactggggctttccctctgaggaatatctggtcgaaaccgaggacggctatatcctgtgcctgaaccgaatcccccatggtagaaagaatcacagtgataaaggaccaaaaccagtcgtgttcctgcagcacggtttgctggcagactcctcgaactgggtgactaatttggctaacagcagcttggggtttattctggcagatgccgggtttgacgtatggatgggcaattccagaggaaacacctggagccgcaagcataaaactctgtccgtatctcaagacgagttctgggctttttcttatgacgaaatggctaaatacgaccttcctgcttcaatcaatttcatcctgaataagactggtcaggagcaagtgtattacgtggggcattctcagggtaccacaattgggtttatcgcgttcagtcagattccagagcttgctaaaaggataaaaatgttttttgccctgggaccggttgcatcagtggcattttgtacaagcccaatggcaaagttagggagactgccagaccaccttatcaaggatctgtttggcgacaaagaatttttacctcaatctgcgtttctgaagtggctgggaactcatgtttgtacccacgtaatccttaaagaactctgcggaaatttgtgtttcctcctctgcggattcaatgagcgaaacctgaatatgtctcgagtggatgtgtatacgacacactcacctgccgggacttctgtgcagaacatgctgcactggtcccaggcagtgaaattccagaaattccaggcattcgattgggggtcttccgccaaaaactattttcactacaatcagtcttatccaccaacatataatgtaaaggacatgctggtgcctacggctgtatggagcggggggcacgactggttagctgacgtatacgatgtgaatattttactgacacaaatcaccaacctggtgttccacgagtctataccggaatgggagcacttagattttatttggggcttggacgcgccctggaggctatataataaaataatcaatctgatgcgaaaataccaa

SEQ ID NO: 15702 - DNA, 1197 bp, Artificial Sequence
  Description of Artificial Sequence: Synthetic coding sequence
atgaagatgagatttctgggacttgtcgtgtgtctcgtgctgtggactttgcatagcgaagggtccaggggcaaacttaccgccgtggatccggagactaatatgaacgtgtcggagatcatttcgtactggggatttccatccgaagaatacctcgtggaaaccgaagatggatacattctgtgccttaaccgaattccacatggcagaaagaatcatagcgacaaaggtcctaaacccgtcgtctttctccaacatggacttctcgccgattcctcaaactgggtgaccaaccttgcaaacagcagcctggggtttattcttgcagatgccggtttcgatgtgtggatgggcaactcaaggggtaatacttggtccaggaagcacaagacccttagcgtgagccaagacgagttttgggcattttcatatgatgagatggctaaatacgatctcccagcttctatcaacttcatccttaacaagaccggacaagagcaagtgtactacgtgggtcattcgcagggtactaccattggtttcattgcatttagccagattccagagcttgccaagagaatcaagatgtttttcgcgctgggtcccgtggcctcagtcgcattctgtacttcccctatggccaagctgggtagacttccagatcatctgatcaaggacctgtttggcgataaggaattcctgccgcagagcgccttcctgaagtggctcggtacccatgtgtgcactcacgtgatccttaaggagctctgtggaaacctgtgttttcttctctgtggattcaacgaacgaaacctgaatatgtcacgggtggatgtgtacactacccattctccagcaggaaccagcgtgcagaatatgcttcattggtcgcaggcagtcaagtttcagaagtttcaggcttttgattggggatcctccgcgaaaaactattttcattacaaccaatcgtaccctcctacttacaacgtgaaagacatgctggtccctactgccgtgtggtccggcggacatgattggttggcagatgtgtatgatgtcaacatactcctcacccaaattacgaatctggtgtttcacgagagcataccggaatgggaacatctggactttatctggggactggacgcaccctggcggctttacaacaagatcattaacctcatgaggaagtatcag

SEQ ID NO: 15703 - DNA, 1197 bp, Artificial Sequence
  Description of Artificial Sequence: Synthetic coding sequence
atgaaaatgcggtttctgggattggtcgtctgcctggtgctttggaccttgcatagcgaaggatcacgcggaaagctgactgccgtggatcctgaaaccaacatgaacgtgtcggaaatcatttcatactggggatttccatctgaagagtacctcgtggagacggaggacgggtacatcctgtgtctcaatcgaatcccacacgggaggaaaaatcattccgacaaggggcccaaaccggtggtgttcttgcagcacggccttttggccgacagcagcaactgggtaaccaatctggccaactcctcgctgggtttcatcctggccgacgccggcttcgacgtgtggatgggaaattcccggggaaatacctggtcccggaagcataaaactctgagcgtctcacaagacgaattctgggctttctcgtacgacgagatggctaagtatgatctcccggcatcgatcaacttcattctgaataagaccgggcaggaacaggtgtactacgtgggccactcccaggggactaccatcgggttcatcgcattctcccagatcccagagcttgccaagcgtatcaagatgttctttgccctcggacccgtcgcatccgtcgccttctgcacttccccaatggctaaactgggtaggctgcctgaccatctgatcaaagatctgtttggagataaggagttcctgccgcaaagcgccttcctgaaatggctcggtacccacgtgtgtactcatgtcattctgaaggaactctgcggaaacctgtgctttctcctgtgcggattcaatgagcggaatctgaacatgtccagagtggatgtgtataccactcactcccctgccgggacttccgtgcagaacatgctgcactggtcccaggcagtcaagttccaaaagtttcaagcgttcgactgggggagctccgcgaaaaactacttccattacaaccagagctaccctcctacttacaatgtgaaggacatgctcgtcccgaccgctgtgtggtctggaggccacgactggttggcggacgtttacgatgtcaacatcctgctcacgcagatcaccaacctggtgttccacgaatccatcccagagtgggaacacttggatttcatctggggcctggacgctccgtggcggctgtacaacaagatcattaacttgatgcgaaagtatcag

SEQ ID NO: 15704 - DNA, 1197 bp, Artificial Sequence
  Description of Artificial Sequence: Synthetic coding sequence
atgaagatgcgcttcttagggctggttgtgtgcctggtgctgtggaccctgcacagtgaagggtctcggggtaagctgacggcagtggatcctgagaccaacatgaacgtgtctgagatcatatcttattgggggtttccctccgaggagtacctggttgagaccgaagacgggtacattctgtgtctgaacaggatcccacacggaaggaaaaatcacagcgacaaggggccaaagcccgtggtttttctgcagcacgggctcctggcagactcctccaactgggtgacgaacctggccaattcaagcctggggttcattctggcggatgctggcttcgatgtatggatggggaacagccgaggcaacacttggagccgcaaacacaagacgttgtccgtaagccaggacgagttctgggctttttcctacgacgagatggcaaaatatgatctccccgcctccataaactttattctgaacaaaaccggacaagagcaggtgtattacgtgggacattcccagggcactacaattgggtttatcgcatttagccaaatacctgagctggcgaagaggattaagatgtttttcgccctaggccctgttgctagtgtggcattttgtactagccccatggcaaagctggggaggttgccagaccacctgattaaggacttgttcggggacaaggagttcctcccccagtcagcctttctgaaatggctcgggacacatgtgtgtacacacgtaatcctcaaggagctctgcggaaacctctgtttcttactttgtggctttaatgaaagaaatcttaacatgtccagagtggacgtgtatacgacacatagcccggccggcacgtccgtgcaaaacatgcttcactggtcgcaggctgtcaagttccagaagttccaagcatttgactggggtagctccgccaagaattactttcattacaatcagagctacccaccaacatacaacgtgaaagacatgctcgtccctaccgcagtatggtccgggggacatgactggctggcagacgtgtacgacgtgaacatcctgttgacacagattactaacttggtgttccacgagtccatccccgaatgggagcatctggatttcatttgggggttggacgccccatggcgtctctacaataaaatcattaatctcatgcggaaataccag

SEQ ID NO: 15705 - DNA, 1197 bp, Artificial Sequence
  Description of Artificial Sequence: Synthetic coding sequence
atgaagatgcgtttcctggggctcgtggtgtgcttggtgctatggaccctccatagtgaaggctcacgtggcaagctcactgccgtcgatcccgaaaccaacatgaacgtgtctgagattatttcctattggggatttccgtctgaagaatatttggtggaaaccgaagacgggtacatcctgtgtctgaacagaattccccacggaaggaagaatcacagcgacaagggacctaaacccgtggtttttctgcaacacggactcctagctgactccagcaactgggtgacgaatttggccaactcttcactggggtttatcctggccgatgctggattcgacgtttggatgggaaactcacggggaaatacctggtctcggaagcacaagactctgtcagtatcccaggacgaattctgggctttctcttatgatgagatggcaaaatatgaccttccagccagtattaatttcatactcaataaaactggacaggagcaggtttactacgttgggcatagtcagggcactacaattgggttcattgctttctcccaaatcccagaactcgccaagcggataaaaatgttttttgctcttggccctgtcgcgagcgtggctttctgcacctctcccatggcgaaactggggcgtctccccgaccacctcatcaaggatcttttcggtgataaagaatttctcccccaaagcgcctttctgaagtggctggggacccacgtttgcacccacgttatcctcaaggagctgtgcggcaatctttgtttccttctttgtggatttaatgagaggaacttaaacatgtcgagggtggatgtgtatacaacccactctccggcagggacctctgtgcagaacatgcttcattggtcacaggccgtgaaatttcagaaattccaggcgtttgactgggggtctagcgcaaagaattattttcattataaccagagttacccccccacttataacgtgaaggacatgttggtaccaactgccgtgtggtcaggaggccatgactggctggccgatgtttatgacgtgaacattcttctgacgcaaattacaaacttggtctttcacgagtcaatccccgagtgggagcaccttgacttcatctggggcctggatgccccctggcgactgtacaacaaaattattaacctgatgaggaagtatcag

SEQ ID NO: 15706 - DNA, 1197 bp, Artificial Sequence
  Description of Artificial Sequence: Synthetic coding sequence
atgaaaatgaggtttctgggcctggtggtctgtttggtcctttggacccttcactccgagggatcgagaggtaaacttaccgcggtggatcctgaaaccaatatgaatgtgtcggagattatctcgtactggggctttccatcggaagaataccttgtggaaaccgaagatgggtacattctgtgccttaatcgaatccctcacggtcgcaagaaccattcagacaaaggacccaagccagtggtgtttcttcaacatggactccttgcggacagctcaaactgggtgaccaatctcgcgaactcatcccttggctttattcttgccgatgcaggcttcgatgtctggatgggtaacagcagaggaaacacctggtcacgaaaacacaaaacgctctcggtgagccaggatgagttttgggcattttcatacgatgaaatggcaaagtacgacctccccgcatcgattaactttatcctgaacaagaccggtcaagagcaggtgtactacgtgggacattcccagggaactaccatcggctttattgcgttttcacaaatacctgaacttgctaagagaatcaagatgttttttgcattgggtccagtggcctccgtcgccttttgtacttcgccgatggcaaaacttggtcggcttcccgatcatctcattaaagacctgttcggagacaaggaatttctgccacagagcgcctttcttaagtggctgggaacgcatgtttgcactcacgtgatcctcaaagagctgtgtggcaatctttgctttcttctctgtggttttaacgagcggaaccttaacatgtcgcgggtggacgtgtacacgacccatagccccgccggaacgtcagttcaaaacatgctgcattggtcccaggcagtgaagttccagaaatttcaagcattcgattggggatcctccgccaagaactactttcactacaaccaatcgtatccccccacttacaatgtcaaagatatgcttgtgcctacggcagtgtggtccggtggccacgattggctggccgatgtctacgacgtgaatatactcctcacccagatcactaatctggtgttccatgaatccattcctgagtgggagcatctcgatttcatatggggacttgatgcaccttggcgcctttacaacaagataatcaatcttatgcgtaagtaccaa

SEQ ID NO: 15707 - DNA, 1197 bp, Artificial Sequence
  Description of Artificial Sequence: Synthetic coding sequence
atgaagatgcggttcctaggactcgtagtttgtcttgtcctgtggacgctccacagcgagggctctagggggaagctgacggcggtcgatcccgagactaatatgaatgtgagcgagattataagctactgggggttcccaagcgaagagtatctcgtggaaactgaagacggatatatcttgtgcctgaatcgaatcccacatggcaggaaaaaccactcagacaagggtcccaagccagtggtctttttgcagcatgggctactagctgactcatccaattgggtcacgaatctcgccaactcatcactgggatttattctggccgacgccggatttgacgtgtggatgggcaactccaggggaaacacctggagtagaaagcacaagactcttagcgtatcccaggacgaattttgggcgtttagctatgacgagatggccaaatacgatctgcccgcctccatcaatttcattcttaacaagacaggtcaggagcaagtgtattacgtggggcacagtcaaggcacaacaattggcttcatagcattttctcaaatacccgaacttgcgaaacgcattaaaatgttttttgctctcggcccagtggcctcagtggccttttgtaccagccctatggccaaactcggccgcctgccagaccatctcatcaaggatctgttcggcgacaaggagtttcttccacagtcagctttcctgaaatggctcgggacccacgtgtgcactcatgtaattctgaaggaactgtgtggaaacctgtgcttcctgttgtgtggcttcaacgagaggaacctgaatatgagtagggttgatgtgtacactacgcacagtcccgcgggcactagcgtgcaaaatatgctccattggtcccaggcggtaaaattccagaaattccaggccttcgactggggtagctccgctaagaactacttccactacaatcagagctatccaccaacctacaacgtgaaagatatgctggtgcctactgctgtctggagtgggggacacgactggttagccgacgtgtatgatgtaaacattctgctcacacaaatcactaatttggtcttccacgagtccatccctgaatgggagcacctcgacttcatttggggtctggatgctccctggcggctctacaataaaattatcaatctcatgcgcaaataccag

SEQ ID NO: 15708 - DNA, 1197 bp, Artificial Sequence
  Description of Artificial Sequence: Synthetic coding sequence
atgaaaatgcggttcctcggactggtcgtctgtttggtgctgtggactctgcactcagagggctctagaggaaaattaactgctgtagaccccgaaacgaacatgaacgtgtctgaaataatttcttattggggctttcctagcgaggagtacctggtagaaaccgaggatgggtatatcctttgcctaaaccgtattccacatggaaggaaaaaccatagcgacaaaggtcccaagccggtggtgtttctacagcacggcttgttggctgattcatcaaattgggtgacaaatctcgccaattcttccctgggattcatcttagccgacgcgggttttgatgtctggatgggtaattctcgtgggaacacatggtctaggaaacacaaaacactgtctgtaagccaggatgagttctgggccttcagctatgatgagatggctaaatacgacttacctgccagcattaactttatccttaacaagaccggacaagaacaggtgtactacgtaggccatagccaaggaaccaccatcggatttatcgctttcagtcaaattcccgagctcgctaagcgcatcaagatgttcttcgccctgggccccgtcgcttccgtcgcgttctgtacgtcaccgatggccaaactgggaagactgccagatcacctgataaaggatttattcggggataaagagtttctcccccaaagcgcgtttttgaagtggctgggcacacatgtatgtacccatgtgatactcaaagaactctgcggaaatctgtgttttctcctgtgcgggttcaatgagcgaaacctgaacatgtctagggtagacgtatacacgacacatagccccgctggtacaagcgtacagaacatgcttcattggtcacaagctgtgaaatttcagaagtttcaagctttcgattggggctcctctgctaagaattacttccattacaaccagtcatacccacccacctacaatgtgaaggacatgcttgtccctacggctgtgtggtctggcggccacgattggctggcagacgtgtatgatgtgaacatactgcttacgcagatcactaacctagtgtttcacgagtcgatccctgagtgggaacaccttgacttcatatggggcttggatgctccgtggcgcctgtataataaaattatcaacctgatgcgaaaataccag

SEQ ID NO: 15709 - DNA, 1197 bp, Artificial Sequence
  Description of Artificial Sequence: Synthetic coding sequence
atgaaaatgcgttttttaggtctagtagtatgtttagttttatggacgctacattcggaaggttcgcgaggtaaattaacggcggtagatccggaaacgaatatgaatgtatcggaaataatatcgtattggggttttccgtcggaagaatatttagttgaaacggaagatggttatatactatgtttaaatcgtataccgcatggtcgtaaaaatcattcggataaaggtccgaaaccggtagtatttctacaacatggtttactagcggattcgtcgaattgggttacgaatttagcgaattcgtcgttaggttttatactagcggatgcgggttttgatgtatggatgggtaattcgcgtggtaatacgtggtcgcgaaaacataaaacgttatcggtttcgcaagatgaattttgggcgttttcgtatgatgaaatggcgaaatatgatctaccggcgtcgataaattttatattaaataaaacgggtcaagaacaagtttattatgtaggtcattcgcaaggtacgacgataggttttatagcgttttcgcaaataccggaattagcgaaacgaataaaaatgttttttgcgctaggtccggttgcgtcggttgcgttttgtacgtcgccgatggcgaaactaggtcgtctaccggatcatttaataaaagatctatttggtgataaagaatttctaccgcaatcggcgtttttaaaatggttaggtacgcatgtttgtacgcatgtaatactaaaagaattatgtggtaatctatgttttttactatgtggttttaatgaacgtaatttaaatatgtcgcgtgtagatgtttatacgacgcattcgccggcgggtacgtcggtacaaaatatgctacattggtcgcaagcggtaaaatttcaaaaatttcaagcgtttgattggggttcgtcggcgaaaaattattttcattataatcaatcgtatccgccgacgtataatgtaaaagatatgttagttccgacggcggtttggtcgggtggtcatgattggttagcggatgtttatgatgtaaatatattattaacgcaaataacgaatttagtatttcatgaatcgataccggaatgggaacatttagattttatatggggtctagatgcgccgtggcgattatataataaaataataaatttaatgcgaaaatatcaa

SEQ ID NO: 15710 - DNA, 1197 bp, Artificial Sequence
  Description of Artificial Sequence: Synthetic coding sequence
atgaaaatgagattcttaggcctggtggtgtgcttggtgctttggacgctgcactccgaaggcagcagaggcaagctcaccgctgtggaccctgaaaccaatatgaatgtgagtgagatcatctcttattggggcttcccatcagaggagtatctcgtggagaccgaggacgggtacattctgtgcctgaacaggattccccacgggcggaagaaccatagcgacaaagggcccaaaccagtagtttttctgcagcatggactactagcggatagctcaaattgggttacgaatctggccaactcttcactcggtttcatcctggctgacgcgggttttgatgtgtggatgggcaactctaggggtaatacatggtcccgcaaacacaagactctgagtgtgtcccaggatgagttttgggcttttagttatgacgagatggccaagtatgacttacccgctagcataaatttcatcttgaataagaccggacaggaacaggtctactatgtgggacactctcaaggcaccacgatcggcttcatagctttcagccagataccggagttggcaaagcggatcaagatgttttttgcactggggccagtagcctctgtagcattctgtacttccccaatggcgaaactcggcaggctgcccgatcacttaattaaagacttatttggtgacaaggagtttttgccacagagtgccttcttgaaatggttagggacccacgtatgcacccacgtgatcttgaaagagctgtgtggcaatctgtgcttcctgttgtgcggctttaacgaacggaacctgaacatgagcagggtggacgtctatacgacacactcacctgcaggcactagcgttcaaaacatgctgcattggtcgcaagccgtgaagtttcagaaatttcaagcttttgattggggatccagtgcaaagaactactttcattacaatcagtcttacccccccacctacaacgtgaaggatatgctcgttcccaccgccgtgtggtccggaggccacgattggctggcagacgtgtacgacgtgaatattctgctcacacaaattactaatctggtcttccacgaatccattcctgagtgggaacacctggacttcatatggggcctggatgcaccttggagactctataataagataataaacctgatgagaaaatatcag

SEQ ID NO: 15711 - DNA, 1197 bp, Artificial Sequence
  Description of Artificial Sequence: Synthetic coding sequence
atgaagatgcggtttctgggattggtcgtgtgtcttgtgctgtggacgcttcatagcgaaggttcgcgcgggaagctgactgccgtggatccagagacgaacatgaacgtgagcgaaatcatctcttactggggtttcccgagcgaggagtacctggtggagactgaggatggctatatactctgtcttaatcgcatcccacacggcagaaagaaccattcggataagggacctaagccagtcgtgttcctgcagcatggactgctggcggactcctcaaactgggtgaccaacctcgcaaattccagcctcggatttatcctggcggacgccggcttcgatgtctggatgggaaactcgagaggaaacacctggtcccgcaaacacaagactctgagcgtctcccaggacgaattctgggcgttctcgtacgacgaaatggcgaagtacgatctcccagcatccattaactttatcctgaacaagacgggacaagagcaagtgtactacgtgggacattcccaaggaactactatcgggtttatcgctttttcacaaattccggagctcgcgaagaggattaagatgttcttcgccctgggtcctgtggcatcagtcgccttctgcactagccctatggcaaaactgggccggctgcctgaccatttgatcaaggatctttttggtgataaggagtttctcccccagtcggccttcctgaagtggctgggaacccacgtctgcactcacgtgatcctgaaagagctgtgcggaaacttgtgcttcctgctgtgcggattcaacgaacggaacctcaacatgtcccgggtggacgtgtacaccacccatagcccggccggaacttccgtgcagaacatgttgcactggagtcaggccgtgaagttccaaaagttccaggccttcgattggggatcgtcagccaaaaactacttccactacaaccagtcttacccaccaacttacaatgtcaaggacatgctggtgccaaccgccgtgtggtccggggggcacgactggctcgccgatgtgtacgatgtgaatattctcttgacccaaatcaccaatctcgtgttccacgagagcatccctgagtgggaacacctcgatttcatctggggcctcgatgcaccgtggcgcctgtacaacaagattatcaacctgatgaggaagtaccaa

SEQ ID NO: 15712 - DNA, 1197 bp, Artificial Sequence
  Description of Artificial Sequence: Synthetic coding sequence
atgaagatgcgcttcctgggactcgttgtgtgcctagtgctgtggacactccattcagaagggagtcgagggaaacttactgccgttgatccggaaacaaacatgaacgtgtctgagatcatttcttactggggtttcccttcggaggaatatctggttgagacagaggatgggtacatactgtgcctcaacagaataccacatggaaggaagaaccattcagataaaggcccgaagcctgtcgtgttcctgcaacacggcctcctggcagactcttcaaactgggttaccaatctggccaattcatcattaggcttcatattggccgacgctggctttgatgtgtggatgggaaatagccgggggaacacctggagtagaaaacataagaccttgtccgtatcccaggacgagttctgggccttctcctatgacgagatggccaaatatgacctccccgccagcatcaattttattcttaacaaaaccggacaggaacaagtatattatgtcgggcactctcaggggaccaccattggatttatcgccttctcccagatacccgagctggcgaagagaataaaaatgttcttcgcactggggcctgtcgctagcgtcgccttctgtacctctccaatggccaagctgggccgcctccctgaccatttgatcaaggacctcttcggagacaaagaatttctaccacagtcagcctttctcaagtggctggggacccatgtgtgtacacatgttatattgaaggaactgtgcggcaacctctgctttcttctgtgcggcttcaatgagcgcaacctaaatatgtccagggtggatgtgtacacaacccattctccggcaggaacaagtgtccagaacatgctacattggagtcaggctgtcaaatttcagaagtttcaggccttcgattggggcagctccgccaagaactactttcattataaccagagttacccccctacctataacgtgaaggatatgctggtgcctaccgcagtctggtccggtggccacgactggctcgcagatgtgtacgacgtgaatatcctcctcactcagatcacaaacctggtgtttcatgagagtattccggagtgggaacaccttgacttcatctgggggcttgacgccccctggcgactgtacaataagataattaacctcatgcgtaaataccag

SEQ ID NO: 15713 - DNA, 1197 bp, Artificial Sequence
  Description of Artificial Sequence: Synthetic coding sequence
atgaaaatgaggtttctgggtcttgtggtctgccttgtgttgtggaccctccactcagagggatcccgtggtaagctgactgctgtagaccccgagaccaacatgaatgtatcagagatcatcagctattggggcttcccatccgaagaatacttggtggagacagaagatggatatatcttgtgtctgaacagaatccctcatggccgcaaaaaccatagcgacaagggacccaagccagtcgtattcctgcaacacggacttctcgctgactcttccaattgggtgaccaacctggccaacagttcactcggatttatcctcgctgatgccggctttgacgtctggatgggtaatagccgcggaaacacttggagtaggaagcacaaaaccctctcagtgtcacaggacgaattctgggctttctcctacgacgaaatggctaagtatgacctgcccgctagcatcaactttattttgaacaagaccggacaggaacaagtgtattacgtcggacactcccagggtaccaccataggcttcatcgccttcagtcaaatccccgagcttgctaaacgcataaagatgttctttgcacttggacccgtggcaagtgttgctttctgcacttcccctatggcaaagctgggtagacttcctgaccatctgattaaggacctctttggtgataaggaatttctcccccaatccgccttcctcaagtggctgggaacacacgtctgtacccacgtgattctgaaagagctttgcggaaatttgtgctttcttttgtgcggtttcaacgaaagaaaccttaacatgtcccgtgtagatgtgtatactacccactcaccagctggcacatccgtccaaaacatgcttcattggtctcaggcagtcaagtttcaaaagtttcaagcttttgactggggctcatccgccaaaaactattttcattataatcaatcatatccccctacttacaatgttaaggacatgctcgtgccaactgctgtgtggagtggaggtcacgattggcttgctgacgtctatgacgtcaatattcttctcactcagatcactaatttggtgttccacgaaagcattcccgagtgggaacacctggacttcatctggggcctggatgcaccttggcgcctgtacaacaaaatcattaacctgatgaggaaatatcag

SEQ ID NO: 15714 - DNA, 1197 bp, Artificial Sequence
  Description of Artificial Sequence: Synthetic coding sequence
atgaagatgaggttcttgggactggtggtgtgtctcgtgctgtggactctgcattcagagggttcccgaggcaaactgaccgccgtcgatccagagaccaatatgaacgtctcagagatcatctcttattggggctttccatccgaggaataccttgtggaaacagaagacgggtacatcctgtgcttgaaccgcataccgcacgggcgcaagaatcactctgataaaggccctaaaccggtggtgttccttcagcatggcctgttagccgattcctcgaattgggttacaaacctggcaaatagttcgttgggtttcattttggccgatgcagggttcgacgtttggatgggcaactctaggggcaatacatggtcgcggaaacataagacgctctcagtgtcacaggacgagttttgggcattcagttatgacgaaatggccaagtatgatctgcctgccagcattaattttattctgaacaagacggggcaagagcaggtgtattacgtaggacacagccaggggaccaccatagggtttattgcattctcccagattcctgagctggctaaaagaatcaaaatgtttttcgctctgggtcccgtggcaagtgtcgctttctgtacttcccccatggctaagcttggccgtctgccggatcacctgatcaaagatctgttcggcgacaaggagttcctaccccagagtgcctttttaaagtggctaggcactcatgtgtgtacccacgtgattttaaaggaactatgtggaaacctgtgttttctgctgtgcgggtttaacgagcggaatttgaatatgtcaagggtcgacgtgtataccacccacagtccggcaggcacctctgtacaaaatatgctgcactggagccaggccgttaaattccagaagttccaggctttcgactggggatctagtgccaagaactatttccactacaaccagtcttatccccctacatacaacgttaaagatatgttggttccgaccgctgtctggtccggaggacacgactggctggccgatgtgtacgacgtgaacatcctgctcacccagatcaccaatctggtctttcacgagtctatacccgagtgggagcaccttgacttcatctggggcctcgatgctccatggcgcctctataataagattataaatcttatgcgaaagtaccag

SEQ ID NO: 15715 - DNA, 1197 bp, Artificial Sequence
  Description of Artificial Sequence: Synthetic coding sequence
atgaagatgcgttttctcggcctcgtcgtttgcctcgtgctttggaccttacactccgaaggatctcgaggaaagctgaccgccgtggatccagagactaatatgaatgtgtctgagatcatcagctattgggggtttccgagcgaggaatacctcgtggagaccgaggacggatatatattgtgcctgaatcggattcctcacggcagaaaaaatcacagcgacaaggggccaaagcccgtggtcttcctgcagcacgggctgcttgcggattcttcaaattgggttacaaatctggccaatagttctctggggttcatcctcgctgatgcaggattcgatgtttggatggggaattctagggggaacacatggagtcgaaagcataagaccctctctgtaagccaggatgaattttgggcttttagctatgatgaaatggctaaatatgatttgcccgcatccataaactttattctgaataagaccggccaggagcaggtctactacgttggacactcccagggtacgacaatagggtttattgctttttcacagatccccgaactggccaaacgcattaagatgtttttcgctctgggtcccgtcgcttcagtggcattctgtaccagcccaatggctaagctgggacgattgcctgaccatttgattaaggacctattcggagataaagagttcctgccacagagtgccttcctgaaatggctgggcacacatgtgtgcacgcatgtgatactgaaagaattgtgcggaaatctgtgcttcttgctctgcggcttcaacgaaagaaacctgaacatgtccagagtggatgtgtacactacccattctcccgctgggacttctgtccaaaacatgctgcattggtcacaagccgtgaaatttcagaagtttcaggctttcgattggggtagtagtgccaagaactatttccattataaccagtcttatcctcctacttataatgttaaggacatgctagtccccaccgcagtgtggtctggtggtcacgactggctggcggacgtttacgatgtgaacattttgctgacgcagattacgaacctggtcttccatgagtctattcctgagtgggaacacctggacttcatatggggactcgacgccccctggaggctgtacaataagattattaaccttatgcggaagtaccaa

SEQ ID NO: 15716 - DNA, 1197 bp, Artificial Sequence
  Description of Artificial Sequence: Synthetic coding sequence
atgaagatgcgcttcttgggactggtagtttgcttagtgctgtggacacttcactcggagggcagtaggggcaaattgacagctgtagacccggagaccaatatgaatgtcagcgagatcatttcttattggggtttcccatctgaagaatacctagtcgaaaccgaggatggttatatcctgtgtctaaatcgtattcctcatggaaggaagaatcattctgataagggtcctaagcccgtggttttccttcagcatggcctcctcgctgattccagtaattgggtcactaatttagctaatagtagtctgggcttcatccttgctgatgccggatttgatgtttggatgggcaattctcggggcaacacctggtcacgcaagcataaaacgcttagcgtgtcccaggacgagttctgggccttcagctacgacgagatggcgaaatacgatcttccagccagcattaactttatccttaacaagactggccaagaacaagtatattatgtcggccacagtcagggcactacgatcggctttatcgcattcagtcaaatacccgagttagccaaaaggatcaaaatgttcttcgcactggggcccgtggcttctgtggccttctgtaccagcccaatggccaaattgggaaggttgccagatcatctaattaaagatttgttcggcgacaaggagtttttgcctcaatccgcttttcttaaatggctgggcacgcatgtttgcacacacgtgatcttgaaggaactctgtggaaacctgtgcttcctcctttgtgggtttaacgagaggaatttgaatatgagtagagtggacgtgtacaccactcattcccctgccggaacttcagttcagaacatgttacattggtcccaagctgtgaaatttcagaaattccaagcttttgactggggatcttcagccaagaattacttccactataatcaaagctaccccccaacttacaacgtcaaagatatgcttgtgcctacagcagtgtggtcagggggccacgattggctggctgatgtttatgacgtgaatatattgctgacacagatcacaaatctcgtattccacgagtccatcccagagtgggaacacttggacttcatctggggactggacgctccttggaggctgtataacaagattattaatctgatgaggaagtaccaa

SEQ ID NO: 15717 - DNA, 1197 bp, Artificial Sequence
  Description of Artificial Sequence: Synthetic coding sequence
atgaaaatgagattccttggattggtggtatgtctcgttttgtggacactgcactccgagggaagcagaggtaaactgacagctgtggatccggagacaaatatgaacgttagtgagataattagctattggggatttccctcagaggagtacctggtggaaaccgaggatggttatatcctctgtttgaacaggatccctcatggaaggaaaaatcactccgataagggcccaaagccagtagtgtttttgcagcacggacttctcgctgactcaagcaactgggtcacaaacctcgccaactcaagcctgggattcatcttggccgacgccggctttgacgtgtggatgggcaactcacgcggcaatacctggtccaggaagcacaagaccttgtctgttagccaggatgaattctgggccttcagctacgacgagatggcaaagtacgacctgcctgcgtccattaacttcattcttaacaaaactggtcaggagcaggtgtactacgttggacactcccagggtacaacaattggttttatcgcgttctcccagatacccgagctcgccaaacgcatcaaaatgttctttgccctgggccctgtcgcctccgtggccttctgcacgtctcccatggctaagctcggaagactgccagatcacctgataaaggacctgtttggtgacaaggaattccttcctcaatccgcctttcttaagtggcttggaacacacgtgtgcacacatgtcatcttgaaggagctgtgcggaaacctttgcttcctgctgtgcggattcaatgagcgcaacctcaacatgtcacgcgttgatgtctacaccactcacagcccggctggcacctccgtgcagaatatgctccactggtcccaggctgtaaagttccagaaatttcaagccttcgactggggctcatcagcaaagaattactttcattataaccagtcatatcctcctacatataatgttaaggacatgttggtgccgactgcggtctggtctggcggtcacgactggctggctgacgtgtatgacgttaacattctcttgacccaaatcaccaacctggtcttccacgagagcattcctgaatgggaacacctcgacttcatctggggtctcgatgctccctggaggctgtataacaaaataattaatttgatgcgcaagtaccag

SEQ ID NO: 15718 - DNA, 1197 bp, Artificial Sequence
  Description of Artificial Sequence: Synthetic coding sequence
atgaagatgaggtttttgggcctggttgtgtgcttggtcctgtggaccttgcatagcgaaggttcccgaggaaaactgacggccgtggacccagagactaacatgaatgtgtccgaaatcattagctactggggtttcccaagtgaggagtatttggttgagaccgaggacggttatatcctgtgcctcaatcgaattccgcatggccgcaagaatcatagcgacaaggggccgaagcctgtggtctttctccaacacggtttgctggccgattctagcaattgggttaccaacttggccaactcttccttggggttcattctggctgatgctggttttgatgtgtggatggggaatagcagggggaacacttggtctagaaagcataaaacactgtccgtgagtcaggatgagttctgggccttttcctatgacgaaatggcaaagtacgatctgcccgcttccattaacttcatccttaataaaactgggcaggaacaggtctactatgttggtcattcccagggcacgactattggcttcattgccttctcccagatccccgaactcgctaagcggatcaaaatgttttttgcactgggccccgtggcctctgtggcattctgtacctccccaatggctaaactgggaaggctgcctgaccacctgataaaggacctctttggcgacaaagaatttctcccacagtccgcgttccttaagtggctgggcacccacgtgtgcacccatgtaatcctgaaagaactctgtgggaatctgtgcttcctgctgtgtggctttaacgagaggaatctgaatatgtccagggtggacgtatacaccacacacagcccggccggcacgagcgtccagaacatgcttcactggtcccaagccgtgaagtttcagaaattccaggccttcgactgggggagctcagccaaaaactactttcattacaaccagtcttatccacctacctacaacgtgaaagatatgcttgtccctaccgctgtgtggtcaggcggccatgactggctggctgacgtttatgatgtcaacattctgctgacacaaataacaaaccttgtcttccatgagtctattcctgaatgggaacatctggactttatctgggggctggatgccccttggcggttgtataacaagattataaatcttatgcggaagtaccag

SEQ ID NO: 15719 - DNA, 1197 bp, Artificial Sequence
  Description of Artificial Sequence: Synthetic coding sequence
atgaagatgcgattcttgggcctggttgtgtgtctggtcctttggaccctgcactcggagggttccagaggcaaactgaccgccgtggatcccgaaaccaacatgaacgtgtcagaaatcatctcatattggggttttccttcagaagaatacctggtggagactgaggacggctacatcctctgcctgaataggatccctcacgggcgcaaaaatcactcagataaaggtcctaagcctgtcgtgtttttgcagcacggactcctggccgactcatccaactgggtgaccaatcttgcaaacagttccctgggcttcattctagctgatgccggtttcgatgtgtggatgggcaacagccgtggaaatacctggtctcggaaacacaaaacactcagtgtctcacaagacgagttctgggcgttctcctacgatgagatggccaagtacgatcttcccgcatctatcaacttcattttgaataaaacaggccaggaacaagtctactatgtgggtcacagtcaggggacgacaatcgggtttatcgccttttcacagatcccagagctcgccaagcgtattaaaatgttctttgccctgggacctgtggccagcgtggcattctgcacttctcccatggccaagttgggacgcctgccagaccacttgattaaagacttattcggggacaaggagtttctgccccaatctgcattcctcaagtggctggggacccatgtatgtacgcacgtaatcttaaaggagctgtgcggcaacctttgctttctgctttgtggttttaatgagcgaaatctcaacatgtccagagtggatgtctataccacacacagtccggccggtacctcagttcaaaacatgttacactggtcccaggcagtgaaatttcagaaatttcaggcattcgactggggctcttctgccaaaaactattttcactataatcagagttatcctcccacttacaatgtgaaggacatgctggtccctacagctgtatggtccggagggcacgattggcttgccgatgtgtacgacgttaacatcttgcttacccagataacaaatctcgtcttccacgaatccattcccgagtgggagcacttggattttatatggggtttagacgctccctggcgcctatataataaaattataaatctcatgaggaagtatcag

SEQ ID NO: 15720 - DNA, 1197 bp, Artificial Sequence
  Description of Artificial Sequence: Synthetic coding sequence
atgaaaatgcggtttctgggccttgtggtctgtctggtgctgtggaccctgcactcagaggggtctcgtggaaagcttacagcagttgaccctgaaaccaatatgaatgttagtgagatcattagctactggggatttccatccgaggagtacctggtcgaaactgaagatggttatatcttatgcctcaatcgaataccacacggccggaaaaaccatagtgataagggtccaaagccagttgtttttttacagcacggtctgctggccgatagctcaaattgggttacaaacctggccaattcttcgctaggctttatcctggccgatgccgggttcgatgtgtggatgggtaacagcagaggaaatacttggtctcgcaagcacaagacgctgagcgtctcgcaggacgagttctgggctttctcctatgacgagatggccaaatacgacctgcccgcttcgataaactttatactgaacaagacgggtcaagaacaggtgtactacgtcggtcacagccagggtaccacaatcgggttcatcgcattctcgcagatccccgagctggccaagaggattaagatgttttttgctcttggacctgtggctagtgtggcattttgtactagtccaatggcaaagcttggtagactacccgaccatctgatcaaggatctttttggagacaaggagtttttaccacaaagtgccttcctcaaatggctcgggacccacgtgtgtacccacgtgatactgaaagaactctgcggtaacttatgtttcttgttgtgcgggttcaatgaacgcaatttaaatatgagcagagtggacgtatacactacacatagtccggcaggtacatcagtccagaatatgctccactggtcacaggccgtgaaattccagaagttccaggcattcgactgggggagtagtgctaaaaattacttccactataaccaatcatacccgccgacatacaacgtaaaagatatgcttgtgcctacggcagtgtggtctggtgggcacgactggctcgctgatgtgtatgatgttaacattctcctgacccagattacaaacttggtgttccatgagtccattccggagtgggagcatctcgatttcatttgggggctcgatgccccttggagactctacaataaaatcattaaccttatgcggaaatatcag

SEQ ID NO: 15721 - DNA, 1197 bp, Artificial Sequence
  Description of Artificial Sequence: Synthetic coding sequence
atgaagatgcgttttctgggattagttgtgtgccttgtgctctggaccttacactcagagggctcacggggcaagctaaccgccgtggatcccgaaactaacatgaatgtctccgaaatcatttcatattggggtttcccctccgaggagtacttggtggagacagaagacgggtatatactgtgccttaatcgcattcctcacggcagaaagaaccacagtgacaagggtccaaagccagtggtctttctgcagcacgggctcctagccgactcctctaactgggtgactaacctggcaaacagtagcctgggtttcatcctggctgacgcaggttttgacgtttggatgggtaactctagaggcaacacttggtccaggaagcacaaaactctcagtgtgagtcaggacgagttctgggccttttcatacgacgagatggcaaaatacgacctgccggcttcgatcaactttatcctcaataagaccggacaggagcaggtgtattatgtgggtcattcacagggcactacaatcggattcatagctttctcccaaattccagaactggctaagcgcattaaaatgtttttcgccctggggcccgtcgcgagcgtggcattttgtacatcccccatggcgaagctcggtcgcctgccagatcatctgattaaggacctctttggagataaggagttcctcccgcagagcgcttttttgaagtggttgggcactcatgtttgtacccatgttatcctcaaggagctttgcggcaatttgtgctttctgctgtgtggttttaacgaacggaatctgaacatgtctcgggttgacgtgtacacgacgcactctccagccggcacctctgtccagaacatgttgcattggtcccaggctgttaaatttcagaagtttcaggccttcgattggggctcttctgcgaagaattactttcactacaatcagtcttaccctccaacctacaacgtaaaagacatgttggttccaactgcagtgtggagtggagggcacgattggctcgctgacgtttatgatgtcaacatactgctgacacagataactaatctggtattccacgagagcatacctgaatgggaacatttagactttatctggggccttgacgccccatggcggctgtataataaaattattaacttgatgagaaagtatcag

SEQ ID NO: 15722 - DNA, 1197 bp, Artificial Sequence
  Description of Artificial Sequence: Synthetic coding sequence
atgaagatgcggttcctcggcctggtggtgtgtctcgtgctgtggacccttcattcagaaggtagccggggcaagctcacggccgtggaccctgagactaacatgaatgtctccgagattatctcctactggggtttcccgagcgaggagtacctggtggaaactgaggacggctacattctttgcttgaaccgcatcccacatggaaggaaaaatcatagcgataagggtccgaagccagtggtgtttctgcaacacgggctgttggctgatagctcaaactgggtgactaatctcgcgaacagctctctgggcttcatccttgctgacgcgggtttcgatgtgtggatgggaaatagccgcggaaatacttggtcccggaagcacaagaccctgtcggtcagccaggatgaattctgggcgttctcgtacgacgagatggcgaagtacgacctcccggcgtctatcaatttcatcttgaataagaccggacaggaacaagtgtattacgtgggtcactcgcaaggaaccacgatcggcttcatcgcattctcccaaattcccgagttggcaaagagaattaagatgtttttcgcccttggcccagtggcctccgtcgctttttgcacctccccaatggcgaagctgggacggctgccggatcacctcatcaaggatctcttcggagacaaggagttcttgccgcagtccgcctttcttaagtggctgggaactcacgtttgtactcacgtcatcttgaaggagctctgcggaaacctgtgcttcctcctctgcggattcaacgagagaaatctgaatatgagccgggtcgacgtctacactactcatagcccggccgggacctcggtgcaaaacatgctccactggtcccaggccgtgaagttccagaagtttcaggcctttgactggggatcatcggctaagaattactttcattacaaccaatcatacccgccgacctataatgtgaaggacatgctggtgccgaccgcggtctggtcgggagggcatgattggctggcggatgtgtacgacgtgaacatcctgttgacccagatcaccaacctggtgttccatgagtccatcccggagtgggaacacctggacttcatctggggcctggacgcaccttggcgtctgtacaacaaaatcatcaatcttatgagaaaataccag

SEQ ID NO: 15723 - DNA, 1197 bp, Artificial Sequence
  Description of Artificial Sequence: Synthetic coding sequence
atgaagatgcgctttctggggttggttgtgtgtctggttctttggacactccactccgaaggtagccggggcaagctgaccgccgtggatcccgagactaatatgaacgtgtccgaaatcatttcgtactgggggtttccatccgaagagtatctcgtggagactgaggacggctatatactgtgcctcaatcggattccacatgggcggaagaaccatagcgacaaagggccgaagcctgtggtctttttgcagcatggattgttagcagattcaagcaactgggtcaccaatctggcaaattcgtcattgggctttatacttgccgacgccggattcgatgtttggatgggaaatagtaggggcaacacatggagtcgcaagcacaaaactctgagcgtgtcccaagacgaattctgggccttcagttacgatgaaatggccaagtatgacttgccggcttctattaacttcattctgaataagaccgggcaagaacaagtctattatgtgggacattcacaaggtacaaccatcggattcattgccttcagccagatcccagaattggctaaaaggatcaagatgttctttgcgctgggcccagtggcgtccgttgcattttgcactagtcccatggccaagctgggtagactgcctgaccacctgatcaaggaccttttcggagataaggaattcttgccgcagagcgcatttttgaagtggctcgggacacatgtgtgtacccacgtcattctgaaggaattgtgcggcaacctctgcttcctgctatgcggctttaacgagcgcaacctaaatatgtccagggttgatgtatacactacgcactcaccagcaggcaccagcgttcagaatatgttgcattggtcacaggctgtgaagttccagaaattccaagccttcgattgggggtccagcgccaaaaactacttccattataatcaaagttatccccctacctataacgtgaaagacatgctcgttccaactgcagtctggagtggcggacacgactggttggctgatgtttacgacgttaacattctcctgacacagatcaccaaccttgtttttcatgagtccatccccgagtgggagcaccttgatttcatttggggtctggacgccccttggagactatataataaaattattaatctcatgcgtaagtaccag

SEQ ID NO: 15724 - DNA, 1197 bp, Artificial Sequence
  Description of Artificial Sequence: Synthetic coding sequence
atgaagatgagattcctgggacttgtggtgtgtcttgtcctgtggacattacattctgaaggatccagagggaagctaaccgccgtggacccggagaccaatatgaatgttagcgagataatttcttattggggctttcctagtgaagagtacctagtagagacggaggacgggtatatcctgtgccttaatcggatcccacacggacggaagaatcacagtgataagggcccaaagccagtggtgtttctccaacacgggctgctcgcagactcgtcaaactgggtgaccaatctggccaactcctcgctgggtttcatccttgccgacgctgggttcgatgtgtggatgggaaatagtcgggggaacacctggtcacgaaagcataagacactgtccgttagccaggacgagttctgggctttttcatatgatgagatggccaagtacgacctacctgcatccatcaatttcatcctcaataaaactggccaggaacaggtatattatgtgggccatagtcagggcactacaatcgggttcattgcatttagccagattccagagctcgccaaacggataaagatgttcttcgcattggggccagtcgcttctgtggccttctgcacctcccctatggccaaactcggccgcctgcctgatcatctgatcaaagacttgttcggcgacaaagaattcctgccccaaagcgcctttctgaaatggctgggcacacatgtgtgcacacatgtcattctgaaagagctgtgcggaaatctatgcttcctactctgtggcttcaacgagagaaacctgaacatgagcagggtggatgtgtacaccacacatagcccggctggaacaagcgtacagaatatgctgcattggagccaggctgtaaagttccagaaattccaggctttcgactggggatcctctgctaaaaactatttccattataaccaatcttacccccctacctacaatgtcaaggacatgctggtgcccactgcagtgtggagtggcggacatgattggctcgccgatgtgtatgatgtaaatattctcttaacccaaatcaccaatctggtctttcacgaaagcattccagagtgggaacacttggactttatctggggactagacgccccttggcgcctctataacaaaatcatcaatttaatgcgcaaataccag

SEQ ID NO: 15725 - DNA, 1197 bp, Artificial Sequence
  Description of Artificial Sequence: Synthetic coding sequence
atgaagatgcggtttcttggactggtcgtttgtctcgtcctttggactctgcacagcgagggcagcaggggaaagttgacagcggtggaccctgagaccaacatgaacgttagcgagattattagttattggggctttccgtcagaggaataccttgtggaaaccgaagatggatacattctgtgcctcaacaggattccacacggccgaaagaatcattctgacaaggggcctaaacccgtagtattcttgcagcatggcttactcgccgactcatctaactgggttactaatctggcgaattcatctctggggtttattctggccgacgctgggtttgatgtgtggatgggcaacagcagaggcaacacttggtcacgcaagcataagacgctttctgtatcccaggatgagttctgggctttttcctatgacgagatggccaaatatgatttaccagcgtcgattaatttcattctgaacaagacagggcaagaacaggtgtactatgtgggtcacagccaaggtacgaccattggttttatcgccttttcgcagattcctgagttagctaaacggatcaaaatgtttttcgcgctggggcctgtagcctccgtagccttctgcacatctcccatggctaagctgggtagactgcctgaccacctgataaaagatctgtttggcgacaaggaatttctaccacaatctgcatttcttaagtggcttggtactcacgtatgtacccacgtcatcctgaaggagctgtgcggtaacctctgcttccttctgtgtgggtttaacgaaaggaacctaaacatgtccagggtggatgtatataccacccactcaccagccggaacttcagttcagaatatgttgcattggtcgcaggccgttaagttccaaaagttccaggctttcgattggggaagttccgctaaaaattatttccactacaaccagtcctatcctccgacatacaacgtgaaagacatgctggtgcccaccgcagtatggagtgggggacacgactggctggcggatgtttacgatgtgaacatcctgttaactcagataaccaatcttgtctttcacgagagcatccctgaatgggagcaccttgattttatctggggcctggatgcgccatggcgtctttataacaaaataatcaatcttatgcggaagtatcag

SEQ ID NO: 15726 - DNA, 1197 bp, Artificial Sequence
  Description of Artificial Sequence: Synthetic coding sequence
atgaaaatgcgctttctgggactggtggtgtgcctggtgctgtggaccctccactcggagggatcgcggggaaagctgacggccgtggaccccgaaactaacatgaatgtgtcagagatcatttcctactggggtttcccaagcgaagagtacctggtggaaacggaggacggctacattctgtgcctgaacaggatcccccacggaaggaagaaccatagcgacaaggggccgaagcctgtggtgtttctccagcatggactgctggcggattcatccaattgggtcaccaatctggcaaactcctcgctcggcttcattctggcggatgcaggtttcgatgtgtggatgggcaacagccgggggaatacttggtcaaggaaacataaaacgctcagtgtgtcacaggacgaattctgggcgttctcctacgatgaaatggccaagtacgatctgcctgcttccatcaacttcatactgaacaagaccgggcaagaacaagtctactacgtcgggcacagccaaggaaccactatcggattcatcgcttttagccaaatccccgagctggccaaacggatcaagatgtttttcgcgctcggcccagtcgcatccgttgccttctgcacttcgccgatggccaaactggggcgcctgccggaccacctcatcaaggatctgttcggagacaaggaattcttgccgcaatccgcattcctgaagtggctgggaacccatgtgtgtactcacgttatcctgaaggagttgtgcggcaacctctgttttctgctctgcggattcaacgaaagaaacctgaacatgtcgcgcgtcgacgtgtacacgacgcactcaccggccggtaccagtgttcagaatatgctgcactggtcgcaggccgtgaagttccagaagttccaggccttcgactgggggagcagcgcgaagaactacttccattacaaccagtcctaccctccgacctacaacgtgaaagatatgttggtgccgaccgccgtgtggtccggaggccacgactggttggccgacgtgtacgacgtgaacatcctcctgacccaaatcactaacctcgttttccacgagtccattccagagtgggaacatctggattttatctggggcctggacgccccttggcggctgtacaataagattatcaatctcatgcggaagtaccag

SEQ ID NO: 15727 - DNA, 1197 bp, Artificial Sequence
  Description of Artificial Sequence: Synthetic coding sequence
atgaagatgcggttcctgggccttgtagtgtgccttgtgctttggaccctgcacagcgagggatcgcgcggaaaactgactgccgtggacccagaaactaacatgaatgtctcagaaatcatctcgtactggggctttccgtcggaagagtacttggtggagactgaggacggatacatcttgtgtttgaaccgaatcccgcacggacgcaagaatcattccgacaaggggccaaagccggtggttttcctccagcacggtttgctcgcggatagctcgaactgggtgactaacctcgccaacagctcccttggattcatcctggccgacgctggcttcgatgtctggatgggaaattcgaggggaaacacctggtcccggaagcacaaaactctgtctgtgtcgcaggacgaattctgggcgttcagctacgacgaaatggcgaaatacgacctcccggcgtccattaactttatcctcaacaagactggacaggagcaggtgtactacgtggggcacagccaggggactacgattgggttcatcgccttctcccagattccagaactggccaagcgcatcaaaatgttctttgctttgggccctgtggcgtccgtggccttctgcactagcccaatggccaaacttggacgcctgcctgaccacctgatcaaagatctcttcggggataaggaattcctcccgcagtccgcgttcctgaagtggctgggcactcatgtgtgcacccacgtgatcctgaaggagctctgcggaaacctgtgcttcctcctgtgtggcttcaacgagcggaatctcaacatgtcccgggtggacgtctacactacccactccccggccggaactagcgtccaaaacatgttgcactggtcccaggcagtgaagttccagaagttccaggctttcgactggggatcctctgcgaagaattactttcactacaatcaaagctaccctccgacgtacaacgtgaaggacatgctggtgccaactgcagtgtggtcggggggccatgactggctggctgatgtgtacgatgtcaatattctgctcacccagatcaccaacttggtctttcatgaatcaatccctgaatgggaacatctcgatttcatctggggccttgacgccccgtggcggttgtacaacaagatcatcaatctgatgcgcaaataccaa

SEQ ID NO: 15728 - DNA, 1197 bp, Artificial Sequence
  Description of Artificial Sequence: Synthetic coding sequence
atgaagatgcggttcctgggcctggtggtgtgtttggtcctttggactttacattctgagggttccagaggcaaattgaccgccgtggatcctgaaaccaatatgaacgtgtccgaaattattagctattggggtttcccatcagaggagtatcttgtggaaactgaggatggctacatcctttgtctgaaccggatcccgcacggaagaaagaatcactccgataaaggccctaaaccagtggtctttttgcagcatggtctgctggcggactcctcaaactgggtcactaacctcgctaatagctccctaggttttatacttgccgatgccggatttgacgtgtggatgggcaatagccgcggtaacacctggtctcgcaagcataaaacactgagcgtcagccaagatgaattctgggcgttttcctatgatgagatggcgaaatatgacctccccgctagtatcaactttatccttaataagaccggccaggaacaagtctactacgtcggccacagccaaggaacgaccattggattcattgccttctcccaaatccccgaactggcaaagcggataaaaatgttctttgcactgggtcccgttgccagtgtggctttttgtaccagccccatggccaaactcgggaggctccctgaccacttaataaaggatctgttcggagataaggagttcttaccgcaatccgcattcttaaaatggctgggcactcatgtgtgcacccatgtgatcctgaaggagctgtgcggtaatctgtgttttctcctttgcggctttaacgaaaggaaccttaacatgtccagggtggatgtgtacacgacgcattcaccagccggtacctcagtgcagaatatgctgcactggtctcaggcagtgaaatttcagaaattccaggcttttgattggggcagctctgcgaaaaactactttcattacaatcaaagctatcctccaacctataacgttaaagatatgcttgtgcccacagcagtctggagtggcgggcatgactggctagcagatgtgtatgatgtgaatatcttgttgacacagataaccaacctggtttttcatgagtcaatcccggagtgggaacacctcgacttcatttggggattagacgctccgtggcggctttacaataaaattatcaacttaatgaggaagtaccag

SEQ ID NO: 15729 - DNA, 1197 bp, Artificial Sequence
  Description of Artificial Sequence: Synthetic coding sequence
atgaaaatgcggttcttgggactggttgtgtgcctggtgctgtggactctgcactccgagggatcgcgggggaagctgaccgccgtggacccggaaactaatatgaatgtgtcggaaatcatctcatattggggcttcccttcagaggagtacctggtggaaaccgaggatggatatatcctgtgcctgaaccgcatcccacacgggcgcaaaaatcatagcgacaagggaccgaagcctgtcgtgttccttcagcacggactgctcgcggactcgagcaactgggtgactaatctggctaattcctcccttggtttcatcctcgcagatgcgggatttgacgtgtggatggggaactcaagaggaaacacttggtcccggaaacataagactctgagcgtgtcgcaggacgaattttgggccttttcctacgacgaaatggctaagtacgatctgccagcctccatcaacttcatcttgaataagactggacaggagcaagtgtactacgtcggccactcgcaaggaactacgatcggattcatcgccttcagccagatccctgagctggcgaaacgcatcaaaatgttcttcgcactcggtccggtggcgtccgtggccttctgtacttcgcccatggcgaaactgggccggctgccggatcacttgatcaaggacctcttcggcgacaaggaattcttgccacagtcggcattcctgaagtggctcggcactcacgtctgcactcatgtgatactgaaggagttgtgcgggaatctgtgcttcttgctttgtggattcaatgagcgcaatttgaacatgtctagggtcgacgtgtacactacccattcgcctgcaggaacttcagtccaaaacatgctccattggtcccaggcggtgaagttccagaaattccaggcgttcgattggggctcctcggccaagaattacttccattacaatcagtcgtacccaccgacttacaatgtgaaggatatgctggtcccaaccgccgtgtggtctggcggtcacgactggctcgccgacgtgtacgatgtgaatatcctcctcacgcagatcacgaacctggtattccacgagagcatccccgaatgggagcacttggatttcatctgggggttggacgccccatggcgcctgtacaacaagattatcaacctcatgcggaagtaccag

SEQ ID NO: 15730 - DNA, 1197 bp, Artificial Sequence
  Description of Artificial Sequence: Synthetic coding sequence
atgaagatgagattcctcggtttggtggtgtgtttggtgctttggactctgcattcggagggaagcagaggaaaactgaccgcagtggacccagaaaccaatatgaacgtgagcgaaatcatctcctactggggattcccatccgaggagtatctggtggaaactgaagatggctacatcctgtgccttaatagaatccctcacggccggaagaatcattcggataaaggacctaagccggtggtctttctgcagcacggcctcctcgcagactcgtcaaactgggtgactaacctcgctaactcaagcctgggcttcatcctggctgacgccggattcgatgtctggatgggaaactcgcggggcaacacttggtcgaggaaacataagactctctcggtgtcgcaggacgaattctgggcgttttcctacgacgagatggcgaagtacgacctcccggcgtctatcaatttcatcttgaacaaaaccggccaggaacaagtctactacgtgggccattcccaaggcaccactatcggatttatcgcgttctcgcaaatcccggagctcgccaaacgcattaagatgttctttgccctcggaccagtggcttctgtcgcgttctgcacttcgccgatggctaagctggggcgccttccggatcacttgatcaaagacctgtttggagataaggaattcctgccacaatcggcgtttctgaagtggttgggaacccacgtgtgcacccacgtgatactgaaggaactgtgtgggaatctctgttttctcctctgcggatttaacgaacgcaatttgaacatgtccagggtcgatgtgtacaccactcactccccagcaggaactagcgtgcagaatatgctgcactggtcacaggccgttaagttccagaagttccaggcctttgactggggttcctcagctaagaactacttccactacaaccagtcgtaccccccaacctacaacgtgaaggacatgctggtcccgactgctgtgtggtccggcggccacgactggctggcggacgtgtacgacgtcaacatcctccttacgcaaatcactaatctggtgttccatgaatcaatcccggagtgggaacatctggatttcatctggggactggacgccccgtggcgactgtacaacaaaatcatcaacctgatgcgcaagtaccaa

SEQ ID NO: 15731 - DNA, 1197 bp, Artificial Sequence
  Description of Artificial Sequence: Synthetic coding sequence
atgaagatgaggttcctgggattggtggtttgtctggtgctgtggaccctgcacagcgagggcagccggggcaagctgacggctgttgatccagagaccaatatgaatgtgagtgagattatcagctactggggtttccctagcgaagaatatctggtagaaacggaggacggatatatcctctgcctgaaccgcataccccatggtcggaagaaccacagcgataagggccctaagcccgtcgttttccttcaacatggtctgctggccgactcgtctaactgggtcacgaacctcgctaacagtagtctgggattcatactggcggacgccggcttcgacgtgtggatgggcaactcccgcggtaatacttggtcacgaaaacacaagaccctctcggtcagtcaagatgagttttgggctttctcctatgacgagatggctaaatacgacttgccggcctctattaattttatcctcaacaaaacagggcaggagcaggtctactacgtcggacactctcagggcaccaccatcggtttcatcgccttctcccagattccagaactggcaaaacggattaagatgttcttcgccttgggtccggtggcctctgtagccttctgtacctcaccgatggccaaattggggcgtctccccgatcatctgattaaagatctctttggcgacaaggaattcctcccgcagtcggcgttcctgaagtggctaggcacacacgtctgcactcatgtcatcctgaaggaattgtgcggcaacctgtgctttctgctgtgcggtttcaacgagagaaatctgaatatgtctcgcgtggatgtgtacacgacacacagcccagctggcacctcggtgcagaacatgctgcactggagccaggcagtgaagtttcagaaatttcaggcttttgattggggctcctccgcgaagaattattttcactataaccagtcgtacccaccaacttataatgttaaggatatgctggttcccacagctgtttggagcggaggccacgactggctcgcggatgtctatgatgtgaacatcctcctgacgcagatcactaacctggtattccatgagagcattcccgagtgggaacacctcgacttcatctggggtcttgacgctccgtggcggctgtacaacaagattatcaacttgatgcgcaaataccag

SEQ ID NO: 15732 - DNA, 1197 bp, Artificial Sequence
  Description of Artificial Sequence: Synthetic coding sequence
atgaaaatgagattcctaggcttggttgtgtgcttggtgctgtggacgctccatagcgaggggtccagggggaagctgacggcagtagatcctgagacgaacatgaacgtctctgagataatttcctactggggctttccatcggaggaatacctggttgagaccgaagacggatatatactatgtcttaatagaattccgcacgggagaaagaaccattccgacaaaggccccaagcccgtggtgtttcttcagcatgggttgctcgcagattctagcaactgggtgacaaatctggccaactcgagtctagggtttattctagccgacgccgggttcgacgtgtggatggggaatagtcgagggaatacctggtcacggaagcacaagaccctgtccgtttcccaggatgaattctgggccttttcctatgatgagatggccaagtatgacctccccgcttctattaatttcatactcaacaaaaccggccaggagcaagtatattacgtggggcattcgcaggggactacaataggcttcatcgctttcagccagatacctgagcttgctaaacgcattaagatgttctttgctcttggccctgttgctagcgtggctttttgcacgtctcccatggccaaattaggacgactcccagaccacctcatcaaagatctattcggcgataaggagtttctgccacagagtgctttcctgaagtggcttgggactcacgtgtgcactcacgtgattctgaaggaactctgcggcaacctgtgcttcttgctctgcggattcaacgagcgtaacctaaatatgtcaagagtggatgtttatacaactcacagtcctgctggcacgtctgtgcagaacatgctgcactggtctcaggcagtgaagttccagaagtttcaggcatttgattggggatcttctgccaagaattacttccactacaaccagtcatacccacctacgtataacgttaaggatatgctcgttcccaccgcagtctggtcagggggacatgactggctggcagacgtttatgatgttaacattctcctgacccagataacaaatttggtatttcatgagtccatccccgagtgggagcatctggacttcatatgggggttggacgcaccctggcgcttatataataagatcattaaccttatgcgcaagtaccag

SEQ ID NO: 15733 - DNA, 1197 bp, Artificial Sequence
  Description of Artificial Sequence: Synthetic coding sequence
atgaagatgcgctttctcgggctggtggtgtgcctggttctgtggaccctccacagcgaaggttcccgcggaaaactgactgctgtggacccggagactaacatgaacgtcagcgagatcatttcctactggggtttcccctcggaggagtacctggtggagactgaagatggatacatcctgtgcctgaatcggatacctcatggtcgtaagaatcactcggataagggcccaaaaccagtcgtgtttctgcagcatggactcctcgcggactcctcgaactgggtcaccaacctcgccaactcgtcgctgggattcattctggctgatgccggattcgatgtctggatgggcaactcgagaggcaacacttggagccgcaagcacaaaaccctgagcgtcagccaagatgagttctgggcattctcgtacgacgaaatggcgaaatacgatctcccggcctccattaactttatcctgaacaagactggacaggagcaggtctactatgtggggcattcccaggggacgactattgggtttatcgccttcagccaaatccccgaactggcaaagagaatcaaaatgttctttgcgctggggcccgtggcctcggtggccttctgcactagcccgatggccaagctgggccggctcccagatcacctgatcaaagacctgttcggagataaggaattcctcccacagagcgcttttttgaagtggctggggactcatgtgtgcacccacgtcattctgaaggaactctgcggaaacctgtgttttctcctgtgcggatttaacgagagaaatctcaacatgtcacgggtcgatgtgtacaccacccactcgcctgcgggcacctccgtgcagaatatgttgcattggtcgcaagccgtcaagttccagaaattccaggccttcgactggggatcgtccgctaagaactatttccactacaaccagagctacccgcctacttacaacgtgaaggatatgttggtgccaaccgcggtgtggtcaggaggacatgattggctggcggatgtctacgacgtgaacatcttgctgacccagatcaccaatctggtattccacgaaagcatccccgaatgggaacaccttgactttatctggggattggatgccccttggcggctgtacaacaagatcatcaatctcatgcgcaagtaccag

SEQ ID NO: 15734 - DNA, 1197 bp, Artificial Sequence
  Description of Artificial Sequence: Synthetic coding sequence
atgaaaatgcgctttcttggcctggtggtgtgcctggtgttatggacactgcactctgagggaagccgaggcaagcttaccgctgtggacccggaaaccaacatgaatgtcagcgaaattatatcttattggggctttccgagtgaggagtacctcgtcgagaccgaggacggctacatcctttgtcttaaccgtattcctcatggacgcaaaaatcattctgacaaaggccccaagcccgtggtctttctacagcatggacttctggctgactccagtaactgggtaactaaccttgcaaactcaagcctcgggtttatactggctgacgccgggttcgacgtttggatgggcaattctcgcggcaatacatggagcaggaaacacaagactctgtccgtgtcacaagatgagttttgggccttctcatacgacgagatggcaaagtatgacctgcctgcaagtattaactttatcttgaataagaccggtcaagaacaagtgtattacgtgggacactcccaggggactacgattgggtttatagcgttttcccagattccggagctagccaagaggattaaaatgtttttcgctctcgggccagtcgcgagcgtcgctttttgtacatcccccatggcaaaactgggaaggctccctgaccatttgatcaaggatctgttcggtgataaagagtttctccctcagagcgcctttctgaagtggctgggcacacacgtctgtacgcacgtgattctaaaagaactgtgcggcaacctatgcttcctactgtgcggtttcaatgagagaaatctcaacatgagtagagtagacgtctatacaacccattcccccgccgggacaagcgtgcagaatatgcttcactggagtcaggccgtgaagtttcagaaattccaggcattcgactgggggtcttccgctaagaactattttcactacaatcagagctatccaccaacctataacgtgaaagatatgttggtaccgaccgcagtgtggagtggtgggcatgattggctggcagatgtctatgacgtgaacatcctccttacccagattacgaatctggtgttccatgagagcatccctgagtgggagcacctcgatttcatctggggattggacgctccttggcgcctgtataacaagataattaacctgatgcgcaaatatcag

SEQ ID NO: 15735 - DNA, 1197 bp, Artificial Sequence
  Description of Artificial Sequence: Synthetic coding sequence
atgaagatgagattcctggggttggtggtctgccttgtgctctggaccttgcacagcgaaggttcgagaggcaaactgaccgcagtggacccggaaaccaacatgaacgtgtcggaaatcatttcgtactggggctttccgtcggaggaatatctggtggagactgaggacggatacatcctgtgcctgaatcgcatccctcatggacggaagaatcactcggacaaggggccgaagccggtggtgtttctccagcatggactcctggctgatagcagcaactgggtgaccaatcttgcaaactcctccctgggatttatcctggcggacgccgggtttgatgtctggatgggaaactcgcgcggcaatacttggagccggaagcacaagaccttgtctgtgtcccaagatgaattttgggcgttctcgtacgacgagatggcaaaatacgatctgccggcttcaatcaacttcatcctgaacaagactggccaagaacaggtgtattacgtgggacattcacagggaaccactatcggtttcatagccttctcgcagatccctgaactcgctaagagaatcaagatgttctttgcactcgggccggtggcctccgtggcgttttgcacttcaccgatggctaagctcgggagactgccagaccatctgatcaaagacctgttcggagataaagagtttctccctcagagcgcctttctgaaatggcttggcactcacgtctgtacccatgtcatcctcaaagagctctgcgggaatctttgcttcctcctctgtggctttaacgagcgcaacctgaatatgtcacgcgtcgatgtgtacactacccactcaccggccggaaccagcgtgcagaacatgctccactggagccaggccgtcaagttccagaagttccaggcttttgactgggggtcgtccgcgaagaattacttccactacaaccaatcgtaccctccaacttataacgtgaaagacatgctcgtaccaactgctgtgtggtccggtggacacgactggctggcggacgtgtatgatgtgaacatcctgctgacccagatcaccaacctggtctttcacgaatccattccggagtgggaacacctggacttcatttgggggctggatgcaccgtggcgcctgtacaataagatcatcaacctgatgcggaaataccaa

SEQ ID NO: 15736 - DNA, 1197 bp, Artificial Sequence
  Description of Artificial Sequence: Synthetic coding sequence
atgaagatgcgattcctggggctggtcgtttgcctggtcctgtggacacttcattccgagggatcgaggggcaaactcacagctgtggatcctgagactaatatgaatgtctcagaaattataagctactgggggtttccatctgaggagtacctcgtcgagacagaagacggctacatcctgtgtctgaacagaatcccacatgggcgaaaaaaccactcagacaaaggcccaaagccggtcgtctttctgcagcacggcctgctggccgacagtagcaattgggtgactaacctggcaaattcctccctgggattcatccttgccgatgccggcttcgacgtctggatgggtaactctcgaggcaatacttggagtagaaaacataagacattgagtgtatctcaggatgaattttgggcattctcgtatgacgagatggcgaaatatgaccttcccgcttcaatcaattttatactgaataagacgggtcaggagcaggtgtactatgtgggacactcccagggcaccaccattggcttcatagccttcagccagatccctgaactggctaaacggattaaaatgttcttcgccctgggtccagtggcaagcgtggctttttgcacttcccctatggcgaaactgggccgactcccggaccatctcattaaagacctcttcggagataaggaatttctcccacaatcggcctttttgaagtggcttggtacccatgtgtgtacacacgtcatcctgaaggagttgtgcggtaatctttgctttctgctgtgcggattcaatgaaagaaatctcaacatgtcccgggttgacgtctatacaacgcattcgccagccggcacctccgtgcagaacatgctgcactggagtcaggcggtgaaatttcagaagttccaggctttcgactgggggagttcagcaaagaactactttcattacaatcagtcttacccaccaacctacaacgtgaaagatatgctggtgcctacggcagtttggtctggtggtcatgattggttggccgatgtgtacgatgtgaatattctgctgactcagatcactaacctggtattccatgagagcatccctgagtgggaacacttggacttcatttggggcctagatgctccctggcgactgtacaataagatcattaacctgatgcgcaagtaccag

SEQ ID NO: 15737 - DNA, 1197 bp, Artificial Sequence
  Description of Artificial Sequence: Synthetic coding sequence
atgaagatgcgctttcttggacttgtggtctgccttgttctgtggactttgcactccgagggatcgagaggtaagctgaccgccgtggatcccgaaaccaatatgaatgtgagcgagataatctcgtactggggattcccttccgaagagtatctcgttgaaactgaggacggctacatcctttgtctgaacagaataccgcatggtcgaaaaaaccatagcgataagggcccaaagcctgttgtgttcctccaacacggccttctcgcagacagctccaactgggtgaccaatcttgcaaattcttcactgggttttatcttggcggacgccgggtttgatgtctggatgggtaacagcagagggaatacgtggagccggaagcacaagaccctgagcgtgtcgcaggatgagttctgggcatttagctacgacgaaatggcaaaatacgatctgccggcctctattaacttcatactgaacaagactggacaagaacaggtgtactacgtgggtcattcacaaggcactaccattggattcatcgctttttcacaaattccagagttggctaagcggatcaaaatgtttttcgcgttggggcccgtggcatcggtcgctttttgtactagcccaatggcaaagttggggcgtctgcctgatcacttgatcaaggacttgttcggagataaagaatttctgccacagtccgcctttcttaagtggctgggtacgcacgtctgtacccatgttatccttaaggaactctgtggtaacctctgttttctgctgtgcggttttaacgagagaaaccttaacatgtcccgcgtggatgtgtacaccactcattcgccagcaggaacttcggtgcagaacatgctgcattggagccaagcagtgaagttccagaaattccaggcatttgactggggaagcagcgcaaagaattactttcattacaaccaatcctatcccccaacttataacgtgaaggatatgcttgtgccaaccgcagtgtggagcggtgggcacgattggctggctgatgtatacgacgtgaacatcctcctcactcagattaccaatctcgtgtttcatgagtcaattccagaatgggagcatctcgatttcatctggggcctggacgcaccttggaggctttacaacaagattatcaacctcatgagaaagtaccaa

SEQ ID NO: 15738 - DNA, 1197 bp, Artificial Sequence
  Description of Artificial Sequence: Synthetic coding sequence
atgaaaatgcggttccttggactcgtggtctgtcttgtgctgtggaccctccactccgagggctcccgagggaagctcaccgcagtcgaccctgagacgaacatgaatgtcagcgagatcatatcatactggggattcccgagcgaagagtacttggtggaaactgaggacggatacatcctctgcctgaaccggattccgcacggaaggaagaaccatagcgacaagggccccaagccagtggtctttctgcaacacgggctcctggctgattcgtcaaactgggtgactaatctggcgaactctagtctcggattcatcctggcagacgctggtttcgatgtgtggatgggaaattcccggggcaacacttggtcgcgtaaacacaaaactctttccgtgtcgcaagacgagttctgggccttctcctacgatgaaatggccaagtacgacttgcccgcgagcattaactttatcctgaataagaccggacaagagcaagtgtattatgtgggccactcgcagggtactaccatcggatttatcgccttctcgcagattccggaactcgcaaagcgcatcaagatgtttttcgcgttgggaccggtggcttccgtcgcgttttgcaccagcccgatggcgaaacttggccggctgccagaccatctcatcaaagatctgttcggggataaagaattcctcccacagtcggcctttctgaaatggttgggcactcatgtttgcactcatgtcatcctgaaggagttgtgcggaaatctgtgttttctgttgtgcggattcaatgagcgcaacttgaatatgtcgcgcgtcgacgtctacactacgcattcgccagccggaacctcagtgcagaacatgcttcattggtcgcaagcagtgaaattccagaagttccaggcctttgattggggttcgtccgccaagaattacttccactacaaccagtcatacccaccgacttacaatgtgaaggatatgctggtgccgactgcggtctggtcgggaggccatgattggctggccgacgtgtacgatgtgaacatcctgcttacccagatcactaacctggtatttcatgaatctatcccggaatgggagcacctggacttcatatggggattggacgccccgtggcgcctttacaacaagatcattaatctgatgcggaagtaccag

SEQ ID NO: 15739 - DNA, 1197 bp, Artificial Sequence
  Description of Artificial Sequence: Synthetic coding sequence
atgaagatgcgtttcttgggacttgtggtgtgcctggtcctgtggactctccatagcgaaggctcgcgcggtaaactgactgccgtggatccagagacgaacatgaatgtgtcggagattatctcgtactggggttttccatcggaggagtaccttgtcgagacggaggatgggtacatcctctgcctgaacaggattcctcacggacgtaagaatcactcggacaagggtccaaaacccgtggtgttcctgcagcatggattgctcgcagattcgtcaaactgggtgactaacctcgcgaatagctcgcttggcttcattctggcggacgccggcttcgatgtctggatggggaactcgaggggtaacacttggtcgcgcaagcataagaccctgtctgtctcgcaggacgaattttgggcattttcatatgacgaaatggcaaagtacgatcttcctgcttccatcaacttcatcctgaataagaccggacaggaacaggtctactacgttggccatagccagggaactactatagggttcattgcattttcccaaatccccgagctcgctaagagaataaagatgttttttgcattgggccctgtcgcctcagtcgcgttctgtacctccccaatggctaagctcggcagactccctgaccatctgattaaagacctttttggcgataaagagtttctgccccaatcagccttcctcaagtggttgggtacccatgtgtgcacccatgtgattcttaaagaactgtgtggaaacctctgtttccttctttgtggatttaacgaacgaaacttgaatatgtctagggtcgacgtgtacaccacccattcccccgcggggacctcagtgcagaacatgcttcactggagccaggcagtgaagttccaaaagtttcaagcgtttgattggggtagctctgcgaagaactactttcactacaaccaatcctacccacctacgtacaacgtgaaggatatgttggtgccgaccgccgtgtggtccggcggacacgattggctcgcggatgtgtacgatgtcaacatcctgcttacccaaattacgaacctcgtgttccatgaaagcatcccggagtgggaacaccttgacttcatttggggacttgacgccccctggaggctttacaacaagatcatcaacctgatgcgaaagtatcag

SEQ ID NO: 15740 - DNA, 1197 bp, Artificial Sequence
  Description of Artificial Sequence: Synthetic coding sequence
atgaagatgcgctttcttgggctcgttgtctgtctggtcctctggactctgcattcagaagggagccgcggcaaacttaccgctgtggacccagagactaatatgaatgtgtctgagatcatcagctactgggggttcccaagcgaggagtatttggtggaaactgaggacgggtatatcctgtgcctaaatcgaattccacacggccgtaagaaccatagcgataaaggacccaaaccagttgtctttctccagcacggcctgctcgctgactctagcaactgggtcaccaacctcgccaacagcagcctggggtttatccttgctgacgccggcttcgacgtttggatgggaaactctcgcgggaacacatggtctcggaagcacaagacactctcagtgagccaggatgagttctgggcgttcagctatgatgaaatggctaaatacgaccttcctgcttctatcaactttatcctgaacaagacagggcaggagcaggtctactatgtgggccattctcaaggcactacaataggcttcatcgccttctctcagatccctgagcttgccaagcgtatcaagatgttctttgcactgggacctgtggcgagcgtggctttttgtacctcgcccatggccaagctgggcagactccccgaccacttgatcaaggaccttttcggcgacaaagaatttctgccacagagcgcattcctgaagtggctgggaacccacgtgtgtacacacgtgattcttaaggagctgtgtgggaacctttgcttcctgctctgcggttttaacgaaagaaatctgaacatgagtagggtagacgtgtacaccactcacagcccagctggcaccagtgtgcagaatatgttgcactggtcgcaagcagtcaagtttcagaagttccaggccttcgattggggtagctctgccaagaattattttcattataaccaaagctatccacctacatacaacgttaaggatatgctggtccctactgctgtgtggtccggaggacacgactggctggccgatgtttacgatgtgaatatcctgttgacccagataacaaacctggtttttcacgaaagtatacctgagtgggagcatctcgacttcatttgggggttggacgctccctggcgcctgtacaacaagataatcaacctgatgagaaagtatcag

SEQ ID NO: 15741 - DNA, 1197 bp, Artificial Sequence
  Description of Artificial Sequence: Synthetic coding sequence
atgaagatgcggttccttgggttggtggtgtgcctggtgctgtggacgttgcacagtgagggtagccgaggcaagttgacggcggtcgacccggagacgaatatgaatgttagcgaaatcatttcttattggggtttcccatccgaggagtatctggtggagacggaagatggctacattctgtgcttgaaccgcatccctcatggtcgcaagaatcatagtgacaagggtcccaaacctgtcgtatttcttcagcacggtctgctggcagacagctcgaactgggtcaccaatctggcgaacagcagcctgggcttcatattggcagatgcgggcttcgatgtttggatggggaatagcagaggcaacacgtggagccgtaaacataagaccttgtccgtcagccaggacgaattttgggcgttttcttacgatgaaatggcaaagtacgatctgccagcgtctattaattttattctgaacaagactggtcaagaacaggtctattatgttggacacagtcagggcaccaccatcggcttcattgcgttcagccagattccagaactggcaaaaaggattaaaatgttttttgctctgggtccggtagcgtccgtagctttttgcaccagcccgatggctaagctgggaagactgccggatcatttgatcaaggacctgttcggagacaaagaattcctgccgcagtccgctttcctgaaatggttgggtacgcatgtttgcacccacgtcatcctgaaggagctgtgcggcaacctgtgctttctgctgtgcggtttcaacgaacggaatctaaatatgagcagagtggatgtgtataccactcatagccctgccggtacctctgttcagaacatgttgcattggtcacaggctgtgaaatttcaaaagtttcaggcctttgattggggtagctccgccaaaaattacttccattataatcagtcctatccgccgacctataatgttaaggatatgctggttcctactgccgtctggagcggcggccacgattggctcgctgacgtttacgacgttaatattctgctgacccagattaccaatctcgtgttccacgaatctatccctgagtgggaacatctggattttatctggggactggacgccccgtggcgtttgtataacaagatcatcaatctgatgcggaaataccag

SEQ ID NO: 15742 - DNA, 1197 bp, Artificial Sequence
  Description of Artificial Sequence: Synthetic coding sequence
atgaagatgagatttctgggactggtcgtctgtctggtgctgtggaccctgcactcggagggatcgcgaggcaaactcactgcggtcgatccggaaaccaacatgaacgtgtcagaaatcatctcgtattggggattcccgtcagaggaatacctggtggaaaccgaggatggatacatcctctgtcttaatcggatcccacatggaaggaagaaccactcggacaagggacctaagccggtggtctttctgcagcatggacttttggcggactcaagcaactgggtgactaatctggccaacagcagcctgggattcatcctcgcggacgcaggattcgacgtgtggatgggtaattcgcgggggaacacttggtcgcgcaagcataagaccctgtccgtttcgcaagacgaattctgggccttctcgtacgatgaaatggctaagtacgatctgccggccagtatcaactttattttgaacaaaaccggccaggagcaggtgtactacgtcggacacagccaaggaactaccattggtttcatcgcattctcacagatccctgaattggccaaacgcatcaagatgtttttcgcacttgggcctgtggcttccgtggctttctgcaccagcccaatggccaagctcggacggctgccagatcaccttatcaaggacctgttcggggataaagagtttctcccacagtccgccttcctcaagtggctcgggacccacgtgtgcacccatgtgatcctgaaagagctctgcggtaatctgtgcttcctcctctgcggcttcaacgaaagaaacttgaatatgtcgcgcgtggacgtgtatactactcactcccccgcgggcacgagcgtgcaaaacatgctccattggtcccaggccgtcaagttccagaagttccaggccttcgactggggttcctccgcaaagaattacttccactacaatcaatcatacccaccgacgtacaatgtcaaagatatgctggtgccgaccgcggtatggtctggcggccatgactggcttgccgatgtttacgacgtcaacatcctgctgactcagattactaatctcgtgtttcacgaaagcatccccgagtgggagcacctggactttatctggggactggacgctccgtggaggctgtacaacaaaattatcaacctgatgcgcaagtaccaa

SEQ ID NO: 15743 - DNA, 1197 bp, Artificial Sequence
  Description of Artificial Sequence: Synthetic coding sequence
atgaagatgcggttcctgggccttgtggtgtgtctcgtgctgtggaccctccattcagaaggatcgcggggcaaacttaccgcagtggatcctgagactaacatgaatgtgtcggagattatctcctactggggatttccttcggaagagtaccttgtggaaaccgaagatgggtacattctctgccttaacagaattccccatggtagaaagaaccactcggataaaggccctaaacctgtcgtgttcctgcaacacggactgctggcagattcttccaactgggtgaccaatttggctaattcatcccttggttttatcctggcagacgccggatttgatgtttggatgggaaattcccgcggaaacacctggtcgcgcaaacataagacccttagcgtctcgcaagatgaattttgggcattctcttacgacgagatggccaagtacgatctgcctgcttcaattaacttcatccttaacaaaaccgggcaggaacaggtctactacgtgggacattcacagggaaccactataggctttattgcattttcacaaattccggagctcgcaaagcggattaagatgttcttcgccctgggtcctgttgctagcgtcgcattctgtacctcgcccatggcaaagctgggacggctgcccgaccatcttatcaaggacctcttcggtgataaagaatttctgcctcaaagcgcatttcttaagtggctgggaacccacgtgtgtacccacgtgattctcaaggaactttgtggtaacttgtgttttcttctctgtggttttaacgagcgcaatctgaacatgtcacgtgtggatgtctacactacgcattcgcctgccggaacctccgtgcagaacatgctgcattggtcccaggcagtgaaattccaaaagttccaagcatttgactggggatcatcagcgaagaactactttcattacaaccagtcctaccctcctacctacaatgtgaaggatatgcttgtgcccactgcagtctggtcaggcggtcatgactggcttgcagatgtgtacgatgtcaatatcctccttactcagatcaccaacctggtgtttcatgagagcatacctgaatgggaacatcttgatttcatctgggggctggatgcaccgtggaggttgtacaacaagatcatcaaccttatgaggaagtaccaa

SEQ ID NO: 15744 - DNA, 1197 bp, Artificial Sequence
  Description of Artificial Sequence: Synthetic coding sequence
atgaaaatgagatttctaggcctggttgtgtgccttgtgttgtggactcttcattccgagggaagtagagggaagctcaccgcagtggatccagaaactaacatgaatgtatcagaaattatttcatattgggggtttccaagcgaagaatatcttgtagagacggaagatggatacatcttgtgtttgaatcgcatcccacacggtagaaagaaccacagtgataaaggaccgaagccggtggtctttctacagcatggtctattggcagactcctctaactgggtgacgaaccttgctaatagctctttagggtttattttggcggacgctggatttgatgtttggatgggcaattcacgtggtaatacttggagtcgtaagcataagacgcttagtgtttcgcaagatgaattctgggcattttcgtatgatgaaatggcaaagtatgatctcccagcatctattaacttcattctgaacaagacaggacaagaacaggtttactacgtcggacattcgcaaggaactacaattggatttattgctttttcgcaaatcccagaattggccaagaggatcaaaatgttttttgctttgggtccagttgcatcagtcgctttttgcacttcgcccatggccaagcttggaaggcttccagaccatttgattaaagatttgttcggagacaaggaatttctacctcaaagtgcttttctcaaatggctgggtactcacgtctgtactcacgttattttgaaagaactttgtggcaacttgtgtttcctcctttgcggctttaatgaacgcaacctaaacatgtctcgtgtggatgtgtacaccactcatagtcctgcaggcacttctgttcaaaatatgttgcattggtcccaagcggtcaaatttcagaagtttcaggcattcgattgggggtcttcggcgaagaattatttccactacaatcaaagctatccacccacctataatgtcaaagacatgttggtaccaacagcggtctggtctggaggccacgattggttggctgatgtgtacgatgtaaatattctcttgactcaaatcaccaatttggtgtttcatgaatcaatccctgagtgggaacatcttgattttatttggggacttgatgcaccctggaggctgtacaataagattataaacttgatgagaaaataccag

SEQ ID NO: 15745 - DNA, 1197 bp, Artificial Sequence
  Description of Artificial Sequence: Synthetic coding sequence
atgaaaatgcgtttcctaggtctagtggtttgcctagttctgtggacattacatagcgagggctcccggggcaagctcaccgccgtagaccccgagaccaacatgaatgtgtctgagattatctcatactgggggtttccttccgaagagtacctggtggaaacagaagacggctacatcctgtgtttaaatcgtattcctcatggtcggaagaatcactcagacaaaggacccaagccggtggtcttcctgcagcatgggcttctggcagattcctccaactgggttacaaacttggcaaatagttcactcggtttcatccttgccgatgccgggtttgacgtttggatggggaactctcggggcaacacttggagccggaagcataagacgctgagtgtgtctcaggacgagttctgggcgttttcatacgacgaaatggccaagtacgatcttccagcgtccatcaacttcatcctgaacaagaccgggcaggaacaggtgtactacgtgggtcactcgcagggtacaaccatcggattcatagcattttctcagatccccgaattggccaaaagaataaaaatgtttttcgccctcggcccagttgcctccgttgccttttgtacgtcccccatggcaaagcttggacgcctcccagatcatctgatcaaagatctcttcggagacaaagagtttctgcctcagagcgccttcctgaaatggctagggactcacgtgtgcacccacgtgatactgaaagaactgtgcgggaacctgtgttttctcctttgtggattcaacgagcgaaacctgaatatgtccagggtcgatgtgtatacgactcacagtcctgccggcaccagtgttcagaacatgctgcactggagccaagcagtgaaatttcaaaagttccaggcttttgattggggctcttccgctaagaactacttccactacaaccagtcttatccgccgacatataacgtgaaagacatgcttgtacccacggccgtgtggtcgggtggacacgactggctcgccgacgtatatgacgtgaatatcctgctgacccagataaccaacctggtttttcatgagagcatccccgaatgggagcaccttgacttcatttggggactggatgccccctggcgcctctacaacaagataatcaacctgatgagaaagtatcag

SEQ ID NO: 15746 - DNA, 1197 bp, Artificial Sequence
  Description of Artificial Sequence: Synthetic coding sequence
atgaaaatgcgcttcctcgggctggtagtgtgcctggtgctgtggactctccactcagaaggctcacggggaaaactcaccgctgtggatccggagactaatatgaatgtctctgaaatcatctcctactggggttttccatccgaagagtatttggtggaaactgaggacggttacatcctgtgtctcaatcggatccctcacggaagaaagaaccacagcgacaagggccccaaacctgtcgtctttcttcaacacggactgctcgctgactcgtccaattgggtgactaacctggccaactcctcactcggatttatcctcgccgatgcgggatttgacgtgtggatgggaaattcgcggggaaatacttggtcaagaaaacataagacgctgtcagtgtcgcaggatgaattctgggcctttagctacgatgaaatggccaagtacgatcttccggcgtcgatcaacttcatcttgaacaagacgggccaggagcaggtctactacgtcggccactcgcaagggaccacgattggatttatcgcattctctcagatcccggaactcgctaagcgcattaagatgttctttgctctgggacccgtggcaagcgtggccttctgcacttcaccgatggcaaagctcggacgactgcctgatcatctgatcaaagatctgttcggagacaaggagttcctgccacaatcagcattcctcaagtggctgggtactcacgtgtgcacccacgtcattctcaaagagctctgtggaaatctgtgctttctgctgtgcggatttaacgaacgcaacctcaatatgtcgcgggtcgacgtgtacaccactcactcgccagccggaacctcggtgcaaaacatgctgcactggagccaagctgtgaagttccaaaagttccaagcgtttgattggggctcatcggctaagaattacttccactacaatcaaagctatccgcctacgtacaacgtgaaagacatgctggtacccaccgccgtgtggtcgggcggacacgattggctcgcggacgtgtatgatgtgaacatccttctcacccagatcactaacctggtgtttcatgagtccatcccggagtgggaacacctcgacttcatctgggggctggacgctccatggaggctgtacaacaagatcattaacctcatgcgcaagtaccaa

SEQ ID NO: 15747 - DNA, 1197 bp, Artificial Sequence
  Description of Artificial Sequence: Synthetic coding sequence
atgaagatgcggtttctgggactggtggtgtgtctggtcctttggactcttcacagcgaaggttcaagaggcaagctgactgcagtggatcccgaaaccaacatgaatgtctccgaaatcatttcctactggggcttcccatcggaagagtaccttgtggaaaccgaggacggatacattctctgcctgaaccgcatacctcatgggaggaagaatcattccgataaaggacccaagccagtggtctttcttcaacacgggttgctcgccgatagctcgaactgggtaaccaatctggcgaactcctcgcttggattcattctcgcagacgccggcttcgatgtgtggatgggcaactctcgaggaaacacttggtcacggaagcataaaactctctcagtgtctcaggacgaattttgggccttttcttacgatgagatggcgaagtacgatcttcctgctagtatcaactttattctcaacaagaccgggcaggaacaagtgtactacgtgggacatagccaagggaccacgatcggtttcatcgcgtttagccaaattcctgaactggccaagaggataaagatgtttttcgctcttggtcccgtcgcttcggtggccttctgcacttcgccaatggcaaaattgggcagactgccagatcacctgattaaggatcttttcggtgataaagaatttctgcctcagagcgcgtttctcaaatggctgggaactcatgtgtgtacccatgttatcctcaaggagctctgtggaaacctctgtttcctcctgtgcggctttaatgaaagaaatcttaacatgagccgtgtggacgtgtacaccacccactcgccagcaggaacttccgtccaaaacatgcttcattggagccaagcagtgaagtttcagaaatttcaagcatttgactggggttcttccgcaaaaaactactttcactataaccaatcttaccctccgacctataatgtcaaggatatgcttgtcccgacggcagtctggtccggaggtcatgattggttggcagatgtgtacgacgtaaacattttgttgactcagataaccaaccttgtgttccatgagtcaattcctgagtgggagcaccttgatttcatctggggtctggacgcaccgtggagactgtacaataagattatcaatctgatgcgaaagtaccag

SEQ ID NO: 15748 - DNA, 1197 bp, Artificial Sequence
  Description of Artificial Sequence: Synthetic coding sequence
atgaaaatgaggtttttaggtcttgtggtttgccttgttttatggactttgcacagcgaaggatctcgaggtaaattaaccgcagtggatcccgaaactaatatgaacgtttctgaaattatttcatattggggtttcccttctgaagagtaccttgtggaaactgaagacggttacatcttgtgcctcaacagaatcccacatggaagaaagaatcacagtgataagggtccaaaacctgtagttttcctacaacatgggctcctagctgattcctctaactgggtgactaatcttgcaaattcatcactgggtttcattttggcagatgccggttttgacgtttggatgggcaacagtagggggaacacttggtctcgcaaacataaaacactctctgtttcacaggatgaattctgggctttcagctatgacgaaatggctaaatatgatttaccggcatccatcaattttattcttaataagaccggtcaggaacaagtttattacgtcggtcactctcaaggaaccacaatcggattcatcgcttttagtcagattcctgagcttgctaagcggattaagatgttctttgcccttggacctgttgcatctgtagccttctgcactagccctatggcaaaactcggtaggttacctgatcatcttattaaggacctttttggtgacaaggagtttctgccccaaagtgcttttcttaagtggctgggtacacacgtgtgcacacatgttatactaaaagaactctgtggcaatttgtgcttccttctctgcggtttcaacgagcgcaatcttaacatgtccagagttgatgtctacactacccattcacctgccggaacatccgttcagaacatgttgcactggtcacaagctgtcaaatttcagaagttccaagcttttgattggggttcttcagctaagaactatttccattataatcagagttacccccctacatataatgtgaaagatatgttagtgcctactgctgtatggagtggcggtcatgattggcttgcagacgtttatgatgttaatattctattgacccaaataactaaccttgtttttcatgagtcaattcctgagtgggaacaccttgattttatttggggattggacgccccttggaggctgtataataaaataataaaccttatgagaaaataccaa

SEQ ID NO: 15749 - DNA, 1197 bp, Artificial Sequence
  Description of Artificial Sequence: Synthetic coding sequence
atgaaaatgcgcttcctgggtctggtggtctgcctggtgctgtggaccctccatagtgagggatcacgaggaaaactgacggctgtggatccggagacgaacatgaatgtgagcgagatcatctcctactggggcttcccatcagaagaatacctcgtggaaaccgaagatgggtacatcctgtgtctcaacagaatcccgcatggacgaaagaaccacagcgataagggaccaaagccagtggtgttcttgcagcacggcttgctcgcggactcctccaattgggtgacgaatctggcgaattcgtccctcggattcatcttggcagacgcgggcttcgacgtgtggatgggaaattcacgtggaaacacttggtcgagaaaacacaagaccctgagcgtgtcccaggacgagttctgggccttttcgtacgacgaaatggccaagtacgacctgcctgctagcatcaatttcatcctgaataagactggccaagagcaagtctactatgtcgggcacagccaaggcactacgattggtttcattgcgttttcacaaatcccagaactggccaagcgcatcaagatgtttttcgcgctcggacccgtagcctcggtggccttctgtacgtccccaatggctaagctgggtcgcctgccggaccatttgattaaggatctctttggggacaaggaattcctcccgcagagcgcgtttttgaagtggctgggcactcacgtgtgcacccacgttatcttgaaggagctgtgcggaaacctgtgcttcctgttgtgcggcttcaacgaacgcaatcttaacatgtcgagagtggatgtgtacactacccattcacccgcaggaacttctgttcagaacatgctgcactggtcccaggccgtcaagttccaaaagttccaggcctttgactggggaagcagtgccaaaaactacttccattacaaccagtcctatccgccgacctacaacgtgaaggatatgctcgtcccgactgccgtctggtcgggaggacacgattggctggcggacgtgtacgatgtcaatatcctgctgacccagatcaccaatctcgtgtttcacgaatcgattccggagtgggaacatctggacttcatctgggggcttgacgcgccctggagactgtacaataagatcatcaaccttatgcggaagtatcag

SEQ ID NO: 15750 - DNA, 1197 bp, Artificial Sequence
  Description of Artificial Sequence: Synthetic coding sequence
atgaagatgaggtttctcgggcttgtcgtctgcctcgtgctgtggactcttcattccgaggggtcgagaggaaagctgactgcagtggaccctgaaaccaatatgaacgtgtccgagattatctcttactggggctttccttcggaagagtaccttgtggaaaccgaagatggctacattctttgcctgaatcgcataccacatggcagaaagaatcattccgacaaaggacccaagcctgtggtgtttctgcagcatggactccttgctgattcgtcgaattgggtgaccaaccttgcaaactcgtccctcggtttcattctggctgatgcaggtttcgatgtctggatgggaaacagcagaggtaatacctggtcccgcaaacacaagaccttgtctgtgtcccaagatgagttttgggcatttagctacgatgaaatggcaaaatacgacctgccagcctcgatcaactttattctgaataagactggtcaggaacaagtgtactacgtcggacatagccaaggcaccacgatagggtttattgcattctcccaaattcctgaactggccaaacgcatcaaaatgtttttcgcactcggtcctgtggcatccgtggccttttgcactagcccaatggcgaagctgggccgactccccgatcatttgataaaagatctgttcggagataaagaatttctccctcaaagcgcatttcttaagtggttgggaacgcatgtctgtactcatgtgatactgaaggaactgtgtggcaacctttgctttctgttgtgtggattcaatgaacgtaatcttaacatgtcccgtgtggatgtgtacactacgcattcacccgcgggaacgtcggtgcagaacatgctgcattggtcccaggcagtgaaatttcagaagtttcaagccttcgactggggttcgagcgccaagaactactttcattacaatcagtcgtatccccccacctacaacgtgaaagatatgcttgttcctacggcggtgtggtcagggggacatgactggcttgctgacgtgtacgatgtcaacatcctgcttactcaaatcacgaatctggtgtttcatgaatccatcccagagtgggagcatcttgacttcatctgggggctggatgctccatggcggctctacaacaagatcattaatctcatgcgtaaataccaa

SEQ ID NO: 15751 - DNA, 1197 bp, Artificial Sequence
  Description of Artificial Sequence: Synthetic coding sequence
atgaaaatgcgcttcctaggtctggtcgtttgcttagtattatggacactccattcggagggctcccgaggtaagttgacagccgtcgaccctgaaaccaacatgaatgtctccgagataatttcatactggggctttccgtcggaggagtatctggtggagaccgaagacggttatatcctctgtttgaatcggattccgcacggccgtaagaaccactctgataagggcccgaagcctgtcgttttcctgcagcatggtttgctagcggactcaagcaattgggtcacgaatctagcaaactcttcattgggctttatcctcgccgacgccggattcgatgtttggatgggcaactcccgcggaaatacgtggtctcgtaagcataaaactctctccgtatcgcaggatgagttctgggcattctcatacgatgagatggccaagtacgatctgccagcgtcaatcaatttcattttaaataagacgggtcaggaacaggtgtattacgttggacattctcaaggtacgacgataggattcatcgcattcagtcaaattccagagcttgcaaagagaattaagatgttttttgcccttggccccgtcgcatcggtcgccttctgtacttcacccatggccaaattgggacgcctccctgaccacttgataaaggacttgttcggagataaagagttcttgcctcagtcggctttcttgaagtggctcggtacccacgtctgcactcatgtcattctgaaagagttgtgcggaaacctgtgcttcttactctgcggattcaacgagcgtaatcttaacatgtcaagagtcgatgtatacacaacccactcgccagccggcactagcgtgcaaaacatgttgcattggtcccaggcagtcaaattccagaagttccaagctttcgattggggctcctcagccaaaaactatttccactataatcagagttaccctccgacgtataatgtcaaagatatgcttgtgccaactgcagtgtggtccggcgggcatgactggctcgcagacgtctacgacgtgaatattttgctcacgcaaatcacgaacctcgtgttccatgagagtatcccggagtgggaacacttggactttatctggggccttgacgcgccctggcgtctgtataataagattatcaaccttatgagaaagtaccag

SEQ ID NO: 15752 - DNA, 1197 bp, Artificial Sequence
  Description of Artificial Sequence: Synthetic coding sequence
atgaaaatgcgattcctcgggcttgtcgtatgtttggtcttgtggaccctgcactcagagggctctagaggtaaactgacagctgtagaccccgaaacgaatatgaatgtgagcgaaatcatttcctactggggtttcccatccgaggaatacctagtcgagacagaggacggatatattctgtgtctcaatcgaattccacatggccgcaagaaccactcagacaaggggccaaagcccgtcgtttttcttcagcacgggctgttggccgacagttctaactgggtgacgaacctcgccaatagcagtctggggttcatcttggccgacgccgggtttgatgtctggatgggaaacagtagagggaatacatggagccgaaagcacaaaaccctctcagtctctcaggatgaattctgggctttttcgtacgacgaaatggcgaaatacgatctgcccgcttctatcaattttatcctcaataaaacagggcaggaacaggtgtattacgttgggcactcccagggaactaccatagggttcattgccttctctcagatcccagagcttgcaaagcgcattaagatgtttttcgccctgggccctgtggcgtccgtcgccttctgcacctctcccatggcaaagttggggagacttcccgaccacctgataaaagacctatttggtgacaaagaattcttgccccagtcagcctttttgaagtggctcggaacacacgtttgtacacacgttatcttaaaggagctgtgcggcaacttgtgtttcttgctgtgtggatttaacgagcgcaatctgaacatgagtagggttgatgtatatacaacacacagtcccgctgggacatctgttcagaacatgctgcactggagtcaagcagtgaaatttcagaagtttcaggcgttcgactggggttcaagcgccaagaactattttcactataaccaatcctaccccccaacatacaacgttaaggacatgctggttcctactgccgtctggagtggcggtcacgattggttagcggacgtgtacgatgtgaacatcctgctcacgcagataactaacctcgttttccatgaaagcatccccgaatgggagcatctcgatttcatttgggggctagatgcgccctggcgtttgtacaataaaatcatcaatctgatgcgaaaataccag

SEQ ID NO: 15753 - DNA, 1197 bp, Artificial Sequence
  Description of Artificial Sequence: Synthetic coding sequence
atgaaaatgcggttcttgggccttgtcgtgtgtttggtgctgtggaccctccactccgagggtagccggggaaaactgactgcggtcgatcctgaaactaatatgaacgtgtcggagatcatatcatactggggttttcctagcgaagaatatctggtcgaaaccgaggacggatacatcctgtgcctgaacagaattccgcatgggaggaagaatcactctgacaagggccccaaacctgtggtctttctgcagcatggtcttttggccgattcgtcaaactgggtcactaatctggcgaactcatctttggggttcatccttgctgatgctggcttcgatgtgtggatgggcaatagccgcggtaatacctggtcacgcaagcataagaccttgtctgtgtcccaggatgagttctgggccttctcatacgacgagatggcgaaatacgacctgccggcgtctattaacttcatcctgaacaaaaccggccaagaacaagtgtactacgtcggccactcccaagggaccaccatcggatttatcgcctttagccagattcccgaactggctaagcggatcaagatgtttttcgcactgggacctgtggcctccgtggcgttctgcacgtccccgatggccaaactggggcgcctcccggatcatctcatcaaggacttgtttggtgacaaggaatttctcccacagtcagcattcctgaagtggcttggcacccacgtgtgcactcatgtgattctgaaggagctgtgcgggaacctgtgtttcctgctgtgcggattcaacgagcgcaacttgaacatgtcaagggtggatgtctacactacccactccccggcaggaacctcggttcagaacatgctccactggtcgcaagccgtgaagttccagaaattccaggcctttgactggggatcgagcgccaagaattacttccactacaaccaatcctacccgccgacttataacgttaaggacatgctggtgccgacggcggtctggtccggaggtcatgactggcttgcggacgtgtacgacgtgaacatcctcctcactcagatcaccaatctggtgttccacgaatcgatccccgaatgggagcatctggatttcatctggggattggacgccccctggcggctttacaacaaaatcatcaacctcatgagaaagtaccag

SEQ ID NO: 15754 - DNA, 1197 bp, Artificial Sequence
  Description of Artificial Sequence: Synthetic coding sequence
atgaaaatgaggtttttaggcctcgtcgtatgtctggtgctctggacactgcactcggagggctctagagggaagctgacagctgtggaccctgaaactaatatgaatgtttccgaaattatttcctactgggggttcccatctgaagagtatctggtggaaacagaggatggctatattttgtgcctgaatcgcattccgcatggtcgtaaaaatcactccgataaaggccctaaacccgtggtctttctgcagcacggtctcttggccgacagttcaaactgggtcactaacctggccaattcatccttgggttttattctggccgacgcggggtttgacgtgtggatgggaaacagtcgagggaatacgtggagccgaaagcataaaactctctcggtgagccaggacgaattctgggctttctcttacgatgagatggctaagtacgatctgcccgcttccattaatttcatattaaataagacgggtcaagagcaggtgtattacgtgggacactcacaggggactaccataggatttatcgcgttttcacagatccctgagcttgccaagcggattaagatgttttttgcactaggtcctgtagcttcagttgcgttttgtacatcccccatggcgaagctcgggagacttccagatcaccttataaaggatctctttggggacaaagaattcctgcctcagagtgcctttctcaagtggctcggaacccatgtgtgcacacacgtgatcctaaaggaactgtgtgggaatctgtgctttctcctttgcggattcaacgagagaaatctcaatatgagcagagtagacgtgtacaccacacactcacctgccgggacttccgtgcagaatatgttgcattggagtcaagcagttaaattccagaaattccaagcttttgactggggcagttcagccaaaaattacttccattacaaccaaagctacccacccacttacaacgtgaaggatatgctggtgccgactgcagtgtggtctgggggtcacgattggctggccgatgtgtatgacgtcaacattctcttgacccagatcacgaacctcgtgttccacgaaagcatccccgaatgggaacacttggactttatctggggtcttgacgccccatggcggctgtataataagattatcaacttgatgcgaaaataccaa

SEQ ID NO: 15755 - DNA, 1197 bp, Artificial Sequence
  Description of Artificial Sequence: Synthetic coding sequence
atgaaaatgcggttcctcgggctcgtggtgtgtctggtgctgtggactctccattcggagggcagccgcggaaagctcaccgcagtcgacccagaaactaacatgaacgtgtccgagataatctcatactggggatttccctccgaagaataccttgtggaaaccgaagatggatatatcctttgtctgaataggattccccacggaaggaagaatcactccgacaaaggaccgaagccagtggtctttcttcaacatggacttctggccgatagctccaactgggtgactaacctggcaaactcctcgctgggtttcatactcgcagacgcaggttttgatgtgtggatggggaactcacgaggcaacacctggtcccgaaagcacaaaactcttagcgtgagccaagatgagttttgggcattttcatacgatgaaatggccaagtacgatctgcctgcaagcatcaactttattctgaataagaccggacaggaacaagtctactacgtgggacattcacagggaaccacgattggttttatcgcattttctcaaatacctgagcttgcaaagcgcatcaaaatgttttttgcactcggtcctgtggcatcggtggcattttgcacttctcccatggctaaacttggaaggctgccagaccatcttatcaaggatctttttggcgataaagagtttcttcctcaatcagcgtttcttaagtggctgggtacccacgtttgtacccacgtgattcttaaagagctttgtggaaacctgtgctttcttctttgtggattcaatgaaagaaatctgaatatgtcgagggtggatgtctacactacgcattcgccagcggggacctccgtgcagaacatgcttcattggtcacaagcagtgaagtttcagaaatttcaagcgtttgattgggggtcctccgcgaaaaactactttcattacaaccagtcgtaccctccaacttacaacgtcaaggatatgcttgtgccaacggcggtgtggtccggcggacacgattggttggcggacgtgtacgatgtgaacatcctgctgactcagataactaacttggtgttccacgaatcgatccctgaatgggaacatctcgatttcatttggggcctggatgccccttggagactgtacaacaagataatcaatcttatgagaaagtaccaa

SEQ ID NO: 15756 - DNA, 1197 bp, Artificial Sequence
  Description of Artificial Sequence: Synthetic coding sequence
atgaaaatgaggttcctgggactggtagtgtgcctcgtcttgtggactctgcattcggaaggaagcaggggaaagctgaccgcggtcgatccagaaaccaatatgaatgtgtccgagataatctcatactggggattcccatcggaagaatacctggtcgagactgaagatggatacatcctgtgtcttaaccggatcccgcatggcagaaagaaccactccgataagggtcccaaacctgttgtgtttcttcaacacggtctgctcgcggattcctcgaactgggtaaccaatcttgcgaattcgtcgcttggattcattctggccgacgcgggatttgacgtctggatgggcaactcacgtggtaatacgtggagcaggaagcataagaccctttcggtcagccaggatgaattctgggcattctcatacgatgaaatggcaaagtatgacctgccagcttccatcaacttcatactgaataagactggacaagagcaggtgtactacgtgggacattcgcagggaaccactatcggattcattgctttctctcaaatacctgaacttgcaaaacggatcaaaatgtttttcgcacttggccccgtggcgtccgtggctttttgcaccagccctatggcgaagctcggacgcttgcctgaccacctgatcaaggacctcttcggagataaggagttccttcctcagtcggcttttcttaagtggttgggaacccacgtgtgtactcacgtgatcttgaaggagctttgtggcaacctgtgttttctgctctgtggatttaacgagagaaacctcaatatgtcgagagtggatgtgtacacgactcattcgcccgccggtacttccgtccaaaacatgctccactggtcgcaagcagtgaagtttcaaaagttccaggcatttgattggggatcatcagcaaagaattactttcattacaaccaatcataccctccgacttacaacgtgaaggacatgctggtcccaaccgccgtgtggtcgggtgggcatgactggctggcggatgtctatgatgtgaatattcttctcacccagattaccaacctcgtctttcacgaatcgatcccagaatgggaacatcttgatttcatttgggggctggatgccccatggagattgtacaacaagattatcaatctgatgcgcaagtatcaa

SEQ ID NO: 15757 - DNA, 1197 bp, Artificial Sequence
  Description of Artificial Sequence: Synthetic coding sequence
atgaagatgcgctttctgggcctcgtggtctgcctggtattatggacactccacagcgaaggctctcggggcaagctgacggcagtcgatccagaaaccaacatgaacgtcagcgagatcatctcctattggggctttccttcagaagagtacctggtcgagacagaggacggctacatcttgtgtcttaacaggattcctcacgggcgtaagaaccactctgataagggaccgaagcccgttgtgtttctgcagcatggactgcttgccgactctagcaattgggtgaccaatctggctaactccagcctcggattcatcctggccgatgcaggatttgacgtctggatggggaacagtaggggcaacacttggagccggaagcacaagaccctgagtgtgtcacaagacgaattttgggccttcagctacgacgagatggccaaatatgacctcccagccagtatcaactttattctgaataagaccggccaggaacaggtctattacgttgggcattcacaggggacgactattggtttcatcgccttctctcaaatccccgaactggcgaagcggattaaaatgttcttcgccttgggacctgtagcctcagtggctttttgtacgtcaccaatggccaaactgggacgccttccggaccacttaataaaagatctgttcggcgacaaggagttccttccgcaatccgctttcctgaagtggctgggcacacatgtgtgtactcacgtaatactgaaagaattgtgtggcaatttgtgtttcctgctatgcggctttaacgagcgcaaccttaacatgtcccgggttgacgtatatactacacatagcccagccggcacctccgtacaaaatatgctccactggtcccaggccgttaaattccagaagttccaagcgttcgactggggtagcagcgccaaaaactatttccattataatcaatcttaccctccaacctacaatgtgaaggatatgctggtccctacagcagtgtggagtggcggccatgattggctggccgatgtctacgatgttaatatactcctcacacagataaccaacctggtgttccatgagagtattccagagtgggaacaccttgactttatttggggattggacgctccatggagactctacaacaaaatcataaacctgatgcggaaataccaa

SEQ ID NO: 15758 - DNA, 1197 bp, Artificial Sequence
  Description of Artificial Sequence: Synthetic coding sequence
atgaagatgaggtttctcgggctggtcgtgtgcctcgtgctgtggactcttcactctgagggatcccgcggaaaacttactgccgtggaccccgaaaccaatatgaacgtgtcggaaatcatttcctactggggattcccgtcggaagaatacctcgttgagactgaagatggctacattctctgcttgaaccgtataccacatggaagaaagaatcattcagataagggccctaagcctgtggtgtttctccagcatggtctgcttgccgattcctcgaactgggtcaccaacctggcaaactcatcgcttggttttatcctcgcagatgcaggatttgacgtctggatggggaattcgagaggtaatacttggtccagaaagcacaagaccctctcggtttcacaagacgagttttgggctttcagctatgacgagatggccaaatatgatcttccagcatccattaactttatactgaacaagacgggtcaggagcaggtctactacgtggggcattcacaaggcacgactattggatttatcgcattttcccagatcccagaacttgccaaacgcattaagatgttcttcgcactgggaccagtggcaagcgtggctttttgtacctccccgatggcaaaacttgggcgtctccctgatcacctgattaaagatttgtttggtgacaaagaattcctgccgcaatccgcatttcttaaatggcttggaacccatgtgtgtacccatgtgatccttaaggagctgtgtggtaacctgtgtttccttttgtgcgggtttaacgagaggaatcttaacatgtcgcgcgtcgatgtgtacacgactcacagccctgctggaacgtcggtgcagaatatgttgcactggtcgcaagcagtgaagtttcaaaagttccaggcatttgactgggggtcgtcggcgaagaactactttcactacaatcaatcatacccccctacttacaacgtgaaggatatgcttgttccaaccgctgtgtggtctggtggacacgattggctggcagacgtctacgacgtgaacatcctcctcacgcaaataactaatttggtgttccacgaatccattcctgaatgggaacaccttgactttatctggggtctggacgcgccttggcggctctacaacaagatcattaatctgatgcggaagtaccag

SEQ ID NO: 15759 - DNA, 1197 bp, Artificial Sequence
  Description of Artificial Sequence: Synthetic coding sequence
atgaagatgaggttccttggcctcgtggtttgtctggtgctgtggactctgcactctgaaggttcccgcgggaaactcaccgccgtagatcctgagactaatatgaacgtttccgaaattatctcctactggggctttccttcagaagaatacttggtggaaacggaggatgggtatattctgtgcctgaatcgaatcccacacgggaggaagaaccactctgataaaggcccaaaacctgttgtgtttctccagcacggattgctggccgatagttctaactgggttacgaatctggctaactccagcctgggctttattctcgcagacgccgggttcgacgtctggatggggaattcccgggggaacacatggtccagaaagcataaaacactgtccgtgtcccaggacgagttctgggcgtttagttacgatgagatggccaagtacgaccttccagccagtatcaactttattctcaataaaaccggccaagaacaggtgtactacgtggggcactctcaggggaccaccattggcttcatcgctttcagccagatacctgagctggccaagcggatcaaaatgttttttgcactggggcccgtggccagcgttgcgttctgcacgtcccccatggctaaactgggaaggctgccagatcacctcattaaagatttgtttggagacaaagagttccttccccagagtgctttccttaagtggctgggcacccacgtctgtacgcacgttattctgaaagaactctgtggcaacctctgcttcctgctgtgtggattcaatgaacgcaatctgaatatgagcagggtcgatgtgtacactactcattctcccgccggaacatcagtgcagaatatgctgcactggtcccaggccgttaaatttcagaaatttcaagccttcgactggggaagctccgccaagaattattttcactataaccagtcataccctccaacatacaatgtaaaggacatgttggtgccgacagcagtgtggagtggcggccacgattggttggcagatgtctatgatgtgaatatcctgttgacacagattaccaatttggtttttcacgaatctatacctgagtgggagcacctggatttcatctgggggctggatgccccctggcggctgtataacaagattatcaatctcatgcggaaatatcag

SEQ ID NO: 15760 - DNA, 1197 bp, Artificial Sequence
  Description of Artificial Sequence: Synthetic coding sequence
atgaagatgcgctttctgggcctcgtcgtgtgtctcgtgctgtggaccttgcatagcgaagggtcgcgcggaaagctgacggcagttgacccggaaaccaacatgaacgtgtcagagatcatctcatactggggtttcccgagcgaagaatacctcgtggagacggaggacgggtacatcctctgcctcaaccgcatcccacatggcaggaaaaatcatagcgataagggaccgaaacccgtggtgttcctccagcatggcttgttggccgattcatcgaattgggtgactaacctcgcaaactcctcgctgggattcatccttgcggatgcgggcttcgatgtgtggatgggcaattcgcgcggaaacacgtggagccggaaacataagaccctgtctgtgtcgcaagatgaattttgggccttctcgtacgacgaaatggcaaagtacgacttgcctgcaagcatcaacttcatcttgaataagactggacaggaacaggtgtactatgtaggacactcgcaggggaccactatcggtttcattgcctttagccagatcccagagctggccaagcgcatcaagatgttcttcgcgctgggacctgtggcctctgtggccttctgcacttcgcccatggctaaactgggccgattgccggaccatttgatcaaggatctcttcggggacaaagaattcctgcctcaatcagcgtttctgaaatggctcgggacgcatgtctgcacccacgtcatcctcaaggaactgtgcgggaacctgtgtttccttctgtgcggattcaatgaaaggaatctcaacatgtccagagtggatgtgtacaccactcattcgccggcgggcacctcggttcagaatatgctgcattggtcgcaagcagtgaagttccagaaattccaagccttcgattggggttcctccgccaagaactacttccactacaaccaatcctacccacctacttacaacgtcaaagatatgcttgttcctaccgccgtgtggtcgggcggccatgattggctggcggacgtgtacgacgtgaacattctgcttacccagatcactaatctggtgttccacgaaagcatcccagagtgggagcacctcgacttcatttggggactggacgcgccgtggcgcctctacaacaagattatcaatcttatgaggaagtaccaa

SEQ ID NO: 15761 - DNA, 1197 bp, Artificial Sequence
  Description of Artificial Sequence: Synthetic coding sequence
atgaaaatgcgctttctgggtctggtggtgtgcctggtgctctggactctgcattcagagggctcgcgcggtaagctgaccgcggtggacccagaaactaatatgaacgtatccgagatcatctcctactggggatttccgtccgaagaatatcttgtggaaaccgaggacggatacatcctctgcctgaaccggatcccgcacgggcgcaagaaccatagcgataagggcccaaagccggtggttttccttcagcacggcctgctcgcggactcgtccaattgggtcaccaatctcgcgaattctagcttggggtttatcctggcagacgccggattcgacgtgtggatgggaaacagccggggaaacacctggtcccggaagcacaagaccctctccgtgtcgcaagacgaattctgggcttttagctacgacgaaatggctaagtacgacctgcctgcgtcaatcaacttcatcctcaacaaaacgggacaggagcaggtttactacgtgggtcactcgcagggaacgacgatcggctttatcgctttctcacagatcccggaacttgctaaacgcatcaaaatgtttttcgccctgggaccggtggcgagcgtggccttctgcacctccccgatggctaaacttggacggctgcccgatcatctgatcaaagatctgtttggagacaaggaattcctgccacagtcggctttcctgaagtggctgggaacccatgtgtgtacccatgtgatcttgaaggagctctgcggcaacctgtgcttcttgctttgcgggttcaatgaaagaaatctcaacatgagccgcgtggatgtctataccactcattccccagccggaacctcagtccaaaacatgctgcattggtcgcaggcggtgaagttccagaagttccaagccttcgattggggatccagcgccaagaattactttcactacaaccaatcgtaccccccaacttacaacgtgaaggacatgctggtgcctaccgcagtgtggagcggtggacacgattggctcgctgacgtctacgacgtcaatatcctcctgactcagattactaacctggtgtttcacgaatccattcctgagtgggagcacttggacttcatctggggactcgatgcgccgtggcgcctgtacaataagatcatcaacttgatgcggaagtaccag

SEQ ID NO: 15762 - DNA, 1197 bp, Artificial Sequence
  Description of Artificial Sequence: Synthetic coding sequence
atgaagatgcgcttccttggcctggtggtctgtctggtgctttggaccctccactcagaaggctcaagggggaagctgactgcggtcgatcccgaaaccaacatgaacgtctcggagatcatctcatactggggttttccttcagaagaatacctggtcgaaaccgaagatggatacattctttgtctgaacagaatccctcatggacggaagaatcactccgacaagggacctaagcctgtcgtgtttctccaacacgggctgctcgctgattcgtctaattgggtcaccaaccttgcaaactcatccctcggctttatcctcgcagacgcgggtttcgacgtgtggatgggtaactcgcgcgggaatacttggtcgcggaagcacaagactctgtcggtgtcgcaagatgaattttgggcattttcatacgacgaaatggcaaaatacgacctccctgcatcaataaactttatactcaacaagactggacaagaacaagtgtactacgtcggtcactcgcaggggactaccattggttttatcgcattttcccaaattccagaactggccaagagaatcaagatgttttttgcactgggacctgtggcgtcggtggcattttgtacttcgcctatggccaaattgggccggcttccggaccatttgataaaggatctcttcggagataaggagtttctgccccaatcggcattccttaaatggctcggaacgcatgtgtgtactcatgtcattcttaaagaactctgtggaaatctttgctttcttctttgcggatttaacgaacgtaacctcaatatgtctcgtgtagatgtctacaccacccattcccctgcaggtacctccgtgcagaacatgctgcactggagccaagccgtcaaatttcagaagttccaggcattcgattggggttcatcggcaaagaattacttccactacaatcaatcctaccccccgacttacaacgtgaaagatatgcttgtgccgaccgctgtgtggtccggaggacatgattggctggcagatgtgtacgatgtgaacatcttgcttactcaaattacgaatctggtgttccatgaatccatcccagaatgggaacatctcgacttcatctggggtttggatgccccttggaggctgtacaacaagataatcaaccttatgcgcaaataccag

SEQ ID NO: 15763 - DNA, 1197 bp, Artificial Sequence
  Description of Artificial Sequence: Synthetic coding sequence
atgaaaatgcgattcctcgggcttgttgtctgcctcgtcctctggacactgcattctgagggatctagggggaaactcacagctgttgatcccgaaactaacatgaatgtatcagaaatcatctcttattggggattcccttcggaagaatatctggtggagactgaagacgggtatattttatgtctaaataggatccctcatggacgcaaaaaccatagtgataaagggccaaaaccagtagtgttcttgcagcatgggttattggccgattcctctaactgggttacaaacttagctaattcctccctggggttcatactggcagatgctggattcgatgtctggatgggaaattcaaggggaaatacttggtcaaggaaacacaagactctgagtgtctcccaggatgaattctgggcattctcctacgacgagatggccaaatatgatctccctgcctctatcaactttatccttaataaaacagggcaggaacaggtctactacgtcggacatagtcagggaacaactatagggtttattgccttctcccagataccggagcttgctaaaagaatcaaaatgtttttcgctttggggccagttgctagtgtagcattttgtacttctcctatggcaaagctggggcgccttccagatcatctgataaaagatctttttggggataaagaatttctgccccaatcggcttttctcaagtggttgggaacacatgtatgtacacatgtgattctgaaagaactctgtggaaacctctgttttctactctgtgggttcaatgagcggaacttaaatatgtccagggtggatgtctacacaacacactctcctgcagggacatcagtgcagaatatgctccactggagtcaggcggtgaaattccaaaaattccaggctttcgattggggatcttcagcaaagaactatttccactacaaccagtcttatccgcccacttataatgtcaaagatatgctagtacctacagccgtttggtcagggggacatgattggctcgctgacgtgtatgatgtgaatattctgcttacacagatcacaaaccttgtgttccatgaatctattcctgaatgggaacacttagactttatctggggactggatgccccatggagactatacaataaaatcataaaccttatgaggaaataccag

SEQ ID NO: 15764 - DNA, 1197 bp, Artificial Sequence
  Description of Artificial Sequence: Synthetic coding sequence
atgaagatgagattcctagggctggtggtttgcctggtgttatggactctgcactcagaaggcagtcgcggcaagctgaccgctgtcgatccggagacaaacatgaacgtgagcgaaatcatctcatactggggcttccctagtgaggaatacttggtagagacagaagacgggtacatactctgcctgaataggattcctcatggccgcaagaatcactctgacaagggtcctaaacctgtggtgtttcttcagcatggactcctcgctgatagttccaattgggtgaccaatctggccaactctagtttgggatttatcttggccgatgctggctttgacgtttggatgggcaacagtcgtgggaacacatggtcccgaaaacacaagaccctcagtgtgagtcaagatgagttctgggcattcagctatgatgaaatggcaaaatacgatctgcccgcctccataaattttatcctgaacaagaccggtcaggagcaggtatattatgtggggcactcccaagggacaacaatcggcttcattgcattctctcagatccctgagttggcaaagcgaatcaagatgtttttcgcgcttggacccgtagcctctgtggccttttgtacatcccccatggccaagctcggacggttacctgaccatcttatcaaggatctttttggggacaaagaatttcttccccagtctgcattcctgaagtggttagggacccacgtatgcacacacgtgatcctgaaggaactctgtggcaatctctgctttctcctgtgcggattcaatgaacgaaatctgaatatgagccgagtggacgtatacactacacactctcccgccgggacttccgttcagaacatgctccattggtcccaggctgttaaattccaaaaattccaagcatttgattggggaagctcggccaaaaattatttccattacaatcaaagctatccaccgacatacaacgtcaaggacatgttagtgcctaccgctgtgtggtctggcgggcatgattggctagcggacgtgtacgacgtgaatattctgctaacccaaatcaccaaccttgtctttcacgaatccatcccagagtgggaacatttggatttcatctggggccttgacgccccatggcgtttgtacaataaaattatcaacctcatgaggaagtatcag

SEQ ID NO: 15765 - DNA, 1197 bp, Artificial Sequence
  Description of Artificial Sequence: Synthetic coding sequence
atgaagatgcgcttcttaggcttagttgtttgtctggttctttggacactccactcagagggctccagaggcaagttaacggccgtggatccagagacgaacatgaacgtttcagaaatcatttcctattgggggttcccaagcgaagaataccttgttgaaacagaagatgggtatattctttgcctgaatcgtattccgcatggtagaaagaatcactctgataaaggcccgaaacctgtggtattccttcagcatgggttactggcggatagcagcaactgggtaacgaaccttgcaaactcttcgctcgggttcatccttgcagatgcaggctttgatgtgtggatgggtaatagccgaggcaacacgtggtcaagaaaacacaagacattgagcgtaagccaggacgagttttgggcattcagttatgatgagatggccaaatacgatcttccggcctcaatcaattttattctgaacaaaactggccaagagcaagtctactacgttggacactctcaaggcacgacgattggatttattgcgttcagccagataccggaactggctaaacgcattaaaatgttttttgcactgggaccagtagctagcgttgcattttgtacgtcacctatggccaaattaggaagattacctgaccatttgatcaaggatctgtttggtgataaggaatttttaccgcaatcggcctttcttaaatggcttggtactcatgtgtgcacacacgttatcttgaaggaactttgtggaaatctgtgttttctactttgtggttttaacgagcgaaatctcaatatgtccagagtagacgtatatacaactcactccccagccggaacgtctgtgcagaatatgcttcattggagccaagcggtaaaattccagaaatttcaagctttcgattgggggtcttccgccaaaaattattttcattacaatcaatcttatccgccgacctacaatgttaaagacatgcttgttccgaccgccgtgtggagtggaggccatgattggttggcagacgtctatgacgttaacatactgcttacgcagatcacgaacctggtgtttcatgaatctattccggaatgggagcatctagattttatttggggcttagacgcaccttggcgtctttataataaaataattaacctgatgcgtaaatatcag

SEQ ID NO: 15766 - DNA, 1197 bp, Artificial Sequence
  Description of Artificial Sequence: Synthetic coding sequence
atgaagatgcggttcctcggcctcgtcgtctgcctggtgctatggaccctgcactctgagggctctcgtggcaagctcaccgccgtggacccagagactaatatgaatgtgtccgaaataatctcctactggggctttccctctgaggagtacttggttgagactgaagacggatatatcctttgcctcaaccgtattccgcacgggagaaagaaccatagcgataagggcccaaagcccgtagtctttttgcagcacggactcctggcggattcctccaactgggtgaccaacctggccaatagtagtctgggctttatcttggccgatgctggtttcgacgtttggatgggtaacagtcgcggcaacacgtggtctcggaaacacaagacactgagcgtctctcaggatgagttctgggctttctcctacgatgagatggccaagtacgacctccctgcttctatcaatttcatccttaataagacagggcaggagcaggtatactacgtagggcattctcagggaacgaccattggattcatagccttctctcagatccccgagctggctaagcgcattaaaatgttcttcgcattggggcctgtggcctctgtcgccttctgcacctcgcccatggccaaactcggccgtctccccgatcatctgatcaaggatctgtttggggacaaggagtttttgcctcaaagtgccttcttgaagtggttgggcactcatgtctgtacccacgtcattctgaaagagctgtgtggcaacctatgttttctcctgtgcggctttaatgagcgcaacctgaacatgagccgcgttgatgtctataccacccacagtccagcgggcacgagtgtccagaacatgctccattggagtcaagcagtcaagttccagaagttccaagctttcgactggggatccagcgctaagaattatttccactacaaccagtcgtacccacccacttataacgtcaaggatatgctagtccccaccgctgtctggtctggtggacacgactggttggcggatgtctatgatgtgaacattttattgacccagataactaacttggtcttccacgagtccatccccgaatgggagcacttggattttatctggggtctggacgcgccctggcgtctgtacaataagattataaatttgatgcgcaagtaccag

SEQ ID NO: 15767 - DNA, 1197 bp, Artificial Sequence
  Description of Artificial Sequence: Synthetic coding sequence
atgaagatgagattccttggtttggtggtgtgtctggtgctgtggactctgcactccgagggttcacgcggtaagctgactgcagtggaccccgaaactaacatgaacgtctccgaaatcattagctattgggggtttccaagcgaggaatacctggtcgaaactgaagatggttacattctctgtctgaaccgcatccctcatggacgcaagaaccattcggataaggggcccaagcctgtcgtgtttctgcagcacggccttctggccgatagctcaaattgggtgaccaatctggcaaactcaagcctcggcttcattcttgccgatgcaggatttgatgtgtggatgggaaattccaggggcaacacttggagccgtaaacataagaccctgagcgtgtcacaagacgaattttgggccttttcctacgatgagatggcaaagtacgaccttccggcctcaatcaactttatactcaacaagaccggacaggaacaagtttactacgtcggacattcgcaagggaccaccatcggattcatcgcattttcccagattcccgaacttgcaaaacgtattaagatgttttttgccctgggcccagtcgcatccgtggcattttgtacctcgccaatggcaaagctcggccgtctccctgaccatctgattaaggacctctttggcgacaaagagtttctcccccaatcggccttcctcaaatggctcggtacccatgtgtgtactcatgtgattctgaaggagctgtgcgggaatctgtgttttcttctttgcggttttaacgaaagaaaccttaacatgtcgcgagtggacgtgtacaccactcactctccggcagggactagcgtgcaaaacatgctccattggtcccaagcagtgaaatttcagaaatttcaagcctttgactggggcagctcggctaagaactattttcattacaaccagtcgtacccaccgacgtacaatgtgaaggatatgcttgtccctaccgctgtgtggtcgggcgggcacgattggcttgcagatgtgtacgatgtgaacattttgctcacgcaaataaccaacttggtctttcacgaatccattcctgaatgggaacatcttgacttcatatgggggctcgacgccccctggcgtctttacaacaagatcatcaacctgatgagaaagtaccaa

SEQ ID NO: 15768 - DNA, 1197 bp, Artificial Sequence
  Description of Artificial Sequence: Synthetic coding sequence
atgaagatgcgcttcctgggactggtcgtctgccttgtcctttggaccctgcattcggagggatctcgcgggaagctcactgccgtggatcccgaaaccaacatgaacgtgtcagagatcatcagttactggggcttcccttcggaggaatacctggttgagactgaagatggttacattctgtgtttgaataggatcccgcacggccgcaaaaaccactctgacaaggggcccaagccggtcgtttttctgcagcatggacttctcgcggacagctccaattgggtaacgaatcttgcaaattcctccctgggatttatcctggcggatgcagggtttgacgtctggatgggcaattcacgaggaaatacctggtcgcggaagcacaagactttgtcggtgtcacaagacgagttttgggcgttctcctacgacgagatggcaaaatacgacctgccggcctccatcaacttcatcctgaataagaccggacaggaacaggtctactacgtgggacactcgcagggcaccaccattgggttcatcgccttctcgcaaatcccggaattggccaagagaattaagatgttcttcgccttgggaccggtggcctcggtcgctttttgcaccagtccaatggctaagctgggaaggctgccggaccacttgataaaagatttgttcggtgacaaagaattcctgccacagagcgcgtttctcaagtggctcggcactcacgtgtgcactcatgtgatcctgaaagaactctgcggtaacctctgttttctgttgtgcggattcaacgaacgaaacctcaacatgtccagagtggacgtgtacaccactcattcacctgcgggaacgtcagtgcagaatatgctccattggagccaggccgtgaagttccagaaattccaggccttcgactggggaagcagcgctaaaaactattttcactataatcaaagctaccctccaacctacaacgtgaaggacatgctcgtacccactgctgtgtggtccggtggccatgattggctggctgatgtgtacgatgtgaacatcctgctcacgcaaatcactaacctggtattccacgagtcgatcccagaatgggagcaccttgatttcatctggggcctggacgccccgtggcggctgtacaacaaaatcattaatctgatgcgcaagtaccaa

SEQ ID NO: 15769 - DNA, 1197 bp, Artificial Sequence
  Description of Artificial Sequence: Synthetic coding sequence
atgaaaatgcgtttcttaggtttagttgtatgtttagttttgtggactttgcatagtgaaggatcaagaggaaaattgactgcagttgatccagaaacaaatatgaatgtttcagaaattattagttattggggttttccatctgaagaatatcttgtagaaacagaagatggatatattctttgtctaaatagaattccacatggaagaaaaaatcattcagataaaggacctaaaccagttgtttttctacaacatggattgttagctgattcatcaaactgggtaactaatttagctaactcttcattaggatttattcttgctgatgctgggtttgatgtttggatgggtaattcaagaggaaatacatggtctcgtaaacataagactctttctgtttcacaagatgaattctgggcattcagttatgatgaaatggctaaatatgatcttccagcttctattaattttattcttaacaaaacaggacaagaacaagtttattatgttggacatagtcaaggaactacaattggatttatcgcttttagtcaaatacctgaacttgcaaaacgaataaaaatgtttttcgctcttggaccagttgcatccgttgcattttgtacttcaccaatggcaaaattaggaagacttccagatcatttaataaaggatctttttggagacaaagaattcttacctcaatctgcttttttaaaatggttgggtactcatgtttgtactcatgttattttaaaagaattatgtggaaatttatgttttttgttatgcggatttaatgaaagaaatttaaacatgagtagagttgatgtttatactacacattcaccagctggaacttcagttcaaaatatgcttcattggtcacaagctgttaaatttcaaaagtttcaagcttttgattggggaagttcagctaagaattatttccattataaccaaagttatcctccaacatataatgttaaagacatgttagttccaactgctgtttggagcgggggacatgactggctagctgatgtttatgatgttaacattttacttactcaaataacaaatttagtttttcatgaatctataccagaatgggaacatttagattttatctggggtttagatgcaccttggagattatataataaaattattaatttaatgcgtaaatatcag

SEQ ID NO: 15770 - DNA, 1197 bp, Artificial Sequence
  Description of Artificial Sequence: Synthetic coding sequence
atgaaaatgcgatttcttgggctcgttgtttgcctggttctgtggacacttcactctgaaggaagtagggggaaactcactgcagtcgatcccgaaacaaacatgaacgtctcagaaatcatttcttattggggattcccctctgaggaatacctggtagaaactgaagatgggtacatactctgtctcaaccgaatcccccatggacgaaaaaaccactccgataaggggcctaagccagttgtattcttgcagcacggacttcttgcggactcatctaattgggtaactaatcttgcaaatagtagtctcggattcattctggctgatgccgggttcgacgtctggatgggaaattccagaggaaacacttggtcccgtaagcataaaacactaagtgtgagtcaagatgaattctgggccttttcatatgatgaaatggcgaaatatgatctgcctgcctcgataaattttatactcaacaaaacagggcaggaacaggtttattatgttggacacagtcagggaactacaattggattcattgctttttcccagattcccgagctggcaaaaagaatcaaaatgttctttgcactggggcccgtggcgtctgtggctttttgtacatctccaatggccaaactgggacggctgccagaccacttaataaaagatctctttggagacaaagagttcctaccccagtcagcatttctgaagtggctagggacacatgtatgtacacatgttattctcaaagaactgtgtggaaatctgtgctttctcctgtgtggatttaatgaaaggaacttaaacatgagtagagtagatgtttacactacacactcaccagctgggacatccgtccagaacatgcttcactggtcccaggcagtaaagttccagaaatttcaggcgttcgactgggggtcttctgccaaaaattatttccattacaaccagtcttacccaccaacttacaatgtcaaagacatgcttgtacccactgctgtttggtcagggggacacgattggttagcagatgtctacgatgtaaatatcctcctgacacagatcacaaacctagtgtttcacgaatctataccagaatgggaacatcttgattttatttggggacttgatgcaccatggaggctgtataataagattataaacttgatgcgcaagtaccag

SEQ ID NO: 15771 - DNA, 1197 bp, Artificial Sequence
  Description of Artificial Sequence: Synthetic coding sequence
atgaagatgcgatttctgggacttgtggtgtgcctcgtgttgtggaccctgcactcagagggcagcaggggaaaactcaccgctgtcgatccagaaaccaacatgaacgtgagcgagattatctcatactgggggtttccctccgaagagtacctcgtggaaacggaagatgggtacatcctttgtctgaatagaatcccgcatggccggaagaatcattccgacaagggtccaaagcctgtggtgttcctgcagcatggccttttggcagattccagcaattgggtgactaaccttgcaaatagctcgctcggattcatcctggcagatgcaggctttgacgtgtggatgggaaactcccggggaaacacgtggagccggaagcacaagactctgtccgtgtcgcaagatgaattttgggcctttagctacgacgagatggcaaagtacgatcttcctgcatcaattaacttcattcttaacaagactggccaggagcaggtgtactacgtgggccactcgcaaggaaccacgattgggtttattgcattttcacaaatccccgagcttgcaaaacgtattaagatgtttttcgcactgggacctgtggcatccgtggcattttgtacgtcaccaatggcaaagctcggtagacttcctgatcacctgatcaaggacctttttggagataaggagtttcttccgcaatcagcctttcttaaatggcttggtactcacgtctgtacccacgttatactcaaagaactctgtggtaatctttgctttttgctgtgtggtttcaacgaacggaatcttaacatgagccgtgtcgacgtctataccacccactcgccagccgggacttccgtccagaacatgttgcattggtcacaggccgtgaagttccaaaagttccaggcattcgactggggatcatccgccaagaactactttcattacaatcaaagctatcctcccacgtacaacgtgaaagatatgttggttccaaccgcagtgtggtcgggaggacacgactggctcgcggacgtgtacgacgtgaacatccttctgacccagatcactaatctcgtttttcatgaatctataccagaatgggaacatctggatttcatttggggactggatgcaccctggcggctgtacaacaagatcataaacctgatgagaaagtatcaa

SEQ ID NO: 15772 - DNA, 1197 bp, Artificial Sequence
  Description of Artificial Sequence: Synthetic coding sequence
atgaagatgcgtttcttaggcctggtcgtgtgtttagtgttatggacattgcactcagaaggatcaaggggcaaacttaccgctgtcgaccccgagaccaatatgaacgttagcgaaattatcagctactggggctttccaagcgaggagtacctggttgaaaccgaggatggctacattctgtgcctcaaccgaatcccccatggtagaaagaatcattccgataaaggaccgaagcctgtagtttttctgcagcatgggctgttagctgacagcagcaactgggtcactaaccttgccaactctagtctcggtttcatcctcgctgacgcaggctttgatgtttggatggggaacagcagaggcaatacctggagcaggaagcataaaactctgtccgtttctcaggatgagttctgggcatttagctatgacgagatggccaaatatgatcttcctgcctctatcaatttcatcctcaataaaaccggacaggaacaggtgtactatgttggccactcacaaggaactactatcggttttattgcattttctcagatccctgaactggccaagagaatcaagatgttctttgctcttgggcctgtggctagcgtggcattctgcaccagtccaatggcaaagctgggtcgcctgcctgatcacctgatcaaagatctgttcggggataaagagtttctgccgcagagtgcttttctgaagtggcttgggactcatgtctgcactcacgtgatcttaaaggagctgtgcggaaacttgtgctttctactgtgcggcttcaacgaaaggaacctcaacatgagtcgggtggacgtgtacaccacacattcccctgcaggcacctccgtgcagaacatgctgcactggtcacaggccgtgaaatttcagaaattccaagctttcgattggggatcttccgccaaaaattacttccattacaaccaatcttatcctcctacctataatgtgaaagacatgctggtgcccactgctgtctggagcggcggtcatgattggttagcggatgtgtacgacgtgaatatcctgctcacacagatcactaacttggtgtttcacgaaagcattcccgagtgggaacacctcgactttatctgggggcttgacgccccatggagactctacaacaagattatcaatctgatgcgcaagtaccag

SEQ ID NO: 15773 - DNA, 1197 bp, Artificial Sequence
  Description of Artificial Sequence: Synthetic coding sequence
atgaaaatgcgatttcttgggctcgtggtgtgtctggtgctgtggactctccactcggaagggtcccgcggcaaactgaccgccgtggaccctgagactaatatgaacgtgtcagaaatcatctcctattggggattcccaagcgaagagtacctggtcgaaaccgaggacggctacatcctctgcctgaaccggatcccgcacggacgcaaaaaccactctgacaagggcccaaagccggtggtgttcctccaacatggactgctcgccgactcgtcaaactgggtcaccaatttggccaattccagtctggggttcattctggccgatgctggttttgatgtgtggatgggaaactcaaggggaaacacctggtcccgcaagcacaaaaccctgtccgtgtcccaagatgaattctgggcattttcgtacgacgaaatggcgaagtatgatctgccagcttctatcaacttcatcctgaacaagactggccaggagcaagtctactacgtcggtcattcgcaggggaccaccatcggatttatcgcgttcagccaaatcccggagctcgcaaagcgcatcaagatgttcttcgcgctgggtccggtcgcctccgtcgccttttgtacttcgccgatggccaaactggggcgcctgccggaccatctcatcaaggatctgttcggggacaaggaattcctgccgcagtctgctttcttgaagtggttgggaacccacgtgtgcactcacgtcattctgaaggagttgtgtggcaacctctgcttcctgctgtgcggtttcaacgagcgcaacctgaatatgtcccgagtggatgtctacactacccactcaccggcaggaacttccgtccagaacatgttgcactggtcacaggccgtgaagttccagaagtttcaagcctttgactggggatcgtccgccaagaactacttccattacaatcagtcgtacccgcccacgtacaatgtgaaggacatgctcgtgcctacggctgtgtggagcggcggtcatgactggctcgcagacgtctacgacgtgaacatcttgctgacccaaatcaccaatctcgtctttcacgagtcgatcccggaatgggaacacttggacttcatctggggactggatgcgccctggagactttacaacaagataatcaatcttatgcggaagtaccag

SEQ ID NO: 15774 - DNA, 1197 bp, Artificial Sequence
  Description of Artificial Sequence: Synthetic coding sequence
atgaaaatgcgctttctgggtctcgtcgtgtgtctagtgttgtggactctccactcagagggatccagaggcaaactaactgcggtggatcctgagactaatatgaacgtctctgagataattagttattggggattcccaagcgaagagtatttggtggagaccgaagacggctatatactgtgtctcaatcgaatacctcacgggcgaaagaaccactcggataagggcccgaaacccgtcgtgtttctgcagcacggactgcttgcagatagttctaactgggtaactaaccttgctaactcttctctgggctttattctagctgatgctggcttcgacgtttggatggggaacagtcgtgggaacacttggtcaagaaagcacaagacgctatccgtgagccaggatgaattttgggcattctcatacgacgaaatggctaaatacgacctccctgcttccatcaactttatccttaataagaccggacaagaacaggtttactacgtgggacattctcaggggacaaccatcggctttattgccttttctcagatcccagagctggccaaaaggatcaaaatgttcttcgccctggggcccgtggcttccgtggccttctgcacgagcccaatggctaaactgggacgactgcctgaccacctaatcaaggacctctttggcgataaggaattccttccacaaagcgcttttttgaagtggctggggacgcacgtgtgtactcatgtgattcttaaagaactttgcggaaatttatgtttcctgctgtgcggatttaatgaacgtaatctgaatatgagtcgggtcgatgtgtataccacacactccccggctggtaccagcgtccagaacatgcttcactggagtcaggccgtaaagtttcagaaattccaagcatttgactgggggtccagcgccaaaaactactttcattataaccagtcttaccctcccacatacaatgtcaaggacatgttggtccctacagccgtgtggtccggtggacatgactggctcgccgatgtgtacgacgttaacatcctgctgacacagatcacgaacctcgtttttcatgagtcaataccagagtgggagcatcttgacttcatttgggggcttgatgctccttggcgactatataacaaaataatcaatcttatgagaaaataccaa

SEQ ID NO: 15775 - DNA, 1197 bp, Artificial Sequence
  Description of Artificial Sequence: Synthetic coding sequence
atgaagatgcggttcctgggactggtggtctgccttgtgctgtggaccctgcattcagaaggttcccgaggcaagctgacggccgtcgaccccgaaactaacatgaatgtgtccgaaatcatatcgtactggggattcccttcggaagagtaccttgtggaaaccgaagatggatacatcctgtgtcttaacagaatacctcatggacgaaagaaccattccgataagggcccaaaacctgtggtgttcctgcaacacggactgctggcagatagcagcaactgggtgacgaacctggcaaattcatcgctgggctttattcttgcagacgctggttttgatgtctggatgggtaatagccgaggaaacacctggagcagaaagcataagaccttgtccgtgtcgcaagacgaattctgggcattttcgtacgacgaaatggcaaagtacgatcttcctgcatcaattaacttcattctgaacaagaccggacaggaacaggtctactacgtcggccattcccaaggaaccactatcgggttcatcgcattttcccaaattcccgaacttgccaagaggattaagatgtttttcgcccttgggccggtggcatcggtcgccttttgtacttcgcctatggccaagctgggaaggctgcccgatcatctgattaaagatctttttggggacaaagaattcctcccacaatcagcatttctgaaatggctgggaacccatgtctgcacccatgtgatcctgaaagagctgtgtgggaacctgtgttttcttctctgtggatttaacgagagaaaccttaacatgtcccgcgtcgatgtctacactacccactcacccgcaggtaccagcgtccagaatatgctccattggtcacaagcagtcaagttccagaaatttcaggcctttgattggggatcatccgcaaagaattactttcactacaatcagtcttacccacctacttacaacgtgaaggatatgcttgtgcctaccgcggtgtggagcggaggacacgattggctggcagatgtttacgatgtgaatattctgctgactcaaattacgaatcttgtctttcacgaatcgattcctgaatgggaacaccttgatttcatatggggtcttgatgccccctggagactgtacaataagatcattaatctgatgcggaaataccag

SEQ ID NO: 15776 - DNA, 1197 bp, Artificial Sequence
  Description of Artificial Sequence: Synthetic coding sequence
atgaagatgcggtttctgggcctcgtggtgtgtctggtcctctggaccctccactctgaaggttcaagaggaaagctgactgcggtggatccagagacgaacatgaatgtctccgaaatcatttcgtactggggattcccgtcagaagagtacctggtggaaacggaggatggctacattctctgccttaatcgtattccccacggcagaaagaaccactcggacaaaggacctaagccagtggtctttctccagcacgggctcctcgcggactcctcaaattgggtcactaacttggcgaacagcagcctgggatttatcttggcagatgcaggttttgatgtctggatgggaaactcaagaggtaacacctggtcacgaaaacataagactctttcggtgtcacaggatgagttttgggcattttcgtacgatgaaatggccaaatatgatctgccagcctccatcaactttatccttaacaagacgggtcaagaacaggtctactatgtgggtcactcgcaaggcactaccatagggttcatcgcgttttcccaaattccggaactcgcaaagcgcattaagatgttttttgcccttgggcccgtggcaagcgtggcattttgcacttcaccaatggcaaagttgggtcgattgcctgatcatctcattaaagatctttttggtgacaaagaattcctgccccaatcagcatttcttaaatggcttgggacccatgtgtgtacccatgttattctgaaggaactgtgtggaaatctttgcttcctgctgtgcggatttaacgagcgcaacctgaatatgagcagagtcgatgtgtacaccacccactccccagctggcacctctgtgcaaaacatgctgcattggtcgcaggccgttaagttccaaaagttccaggcatttgattggggctcatccgctaagaactacttccactacaaccagagctaccctcccacctacaacgtgaaagacatgctggtgccgaccgcagtgtggagcggcggacatgattggttggcggatgtgtacgatgtgaacattcttctgacccaaattacgaaccttgtgttccatgagtcgattccagaatgggagcatctggactttatctggggtcttgacgcgccgtggcggctttacaacaaaatcattaacctgatgaggaagtaccag

SEQ ID NO: 15777 - DNA, 1197 bp, Artificial Sequence
  Description of Artificial Sequence: Synthetic coding sequence
atgaaaatgcggtttctgggactggtagtctgcttagtgctgtggaccctgcatagcgaggggtcacgtggcaaattaacagccgtggatcccgaaactaacatgaacgtttcggagatcatctcctactgggggtttccttcggaggagtacttagttgagactgaggatggctatattttgtgtttgaatagaattccccacggccggaaaaaccactctgacaagggacccaaacctgtcgtgtttctgcaacacggcttactggcggatagctctaactgggtgacaaacctggccaactcctcactcgggttcatactcgctgacgctgggttcgatgtgtggatggggaatagtagaggaaacacctggtctcgtaagcacaaaaccctgtccgtctcccaggacgagttttgggcgttctcatacgacgaaatggcgaagtacgatctgcccgctagtatcaacttcatcctgaataagaccggacaggagcaggtatactatgtgggtcattctcagggaacaaccattggatttatagctttttctcaaatacccgagctggccaaaagaattaagatgttcttcgccctcggcccagttgcctccgttgcgttctgtacttcacctatggccaagctaggtcgtctgcctgatcacctgatcaaggacctgttcggcgacaaagaattcctgcctcagagtgccttcctgaaatggctgggtacacatgtctgtacccacgtcatcctcaaggagctctgcggaaatctttgcttcctgttgtgtggctttaacgagcgcaatcttaacatgtcccgggtggacgtgtatacaactcactcgcccgccgggacttccgtccagaacatgctccactggagccaggcagtcaagttccaaaagttccaggcttttgactgggggagcagtgctaagaactacttccactataaccagagttatcctccgacctataatgtgaaagacatgcttgtacctaccgcggtgtggagcggggggcacgattggctggctgatgtgtatgacgtgaacattcttctgactcaaatcaccaatctcgtgtttcacgaatctatacccgagtgggaacacctcgatttcatttggggtttggatgcgccctggagactctacaacaagatcattaatctgatgagaaagtatcaa

SEQ ID NO: 15778 - DNA, 1197 bp, Artificial Sequence
  Description of Artificial Sequence: Synthetic coding sequence
atgaagatgaggtttctgggacttgtcgtgtgtctggtgctttggaccctgcattcggaaggctcgcgaggtaaacttaccgcggtggacccagaaaccaatatgaatgtgtcggagatcatttcctactggggcttcccttcggaggaatacctcgttgaaaccgaggacggttacattctgtgtctcaaccgtatccctcacggacgtaagaatcactccgataagggacctaagccagtggttttcctccaacacgggctcctggcagattcgtcgaactgggtgaccaacctggcaaactctagtcttggattcattctggcagatgcaggttttgatgtctggatggggaattcgagggggaacacttggtctaggaagcataaaaccctcagcgtctcacaggatgagttttgggctttcagctacgatgaaatggcaaaatacgacctcccagcgtcgattaactttattctgaacaaaaccggacaagagcaggtctactacgtgggacattcccagggaactaccattggcttcatagcattttcacagatacctgaacttgcaaaaagaatcaagatgttttttgcgcttggtcctgtggcttccgtggcgttttgtacgtcccccatggcaaagctggggagactgcctgatcacctcattaaagatctgtttggggataaggagttcctgccacaaagcgcatttctgaaatggctgggaacccatgtgtgtactcacgtgattcttaaggaactctgcggcaacctttgctttctgctgtgtggtttcaatgaaagaaacttgaatatgtcgcgggtggacgtctacactacgcatagtcccgcaggcacttcagtgcaaaacatgcttcactggtcccaagccgtgaaatttcagaagtttcaggcctttgactggggatctagcgcgaagaactactttcactacaaccaaagctacccaccaacttacaacgtcaaggacatgcttgtgccaactgcagtgtggtccggcgggcatgactggctggcagacgtgtacgacgtcaatattcttctcactcagattacgaacctggtctttcatgaatcgattcctgagtgggaacacctggacttcatctggggccttgatgctccttggagactctacaacaaaatcattaatctgatgcggaagtatcaa

SEQ ID NO: 15779 - DNA, 1197 bp, Artificial Sequence
  Description of Artificial Sequence: Synthetic coding sequence
atgaagatgaggttcttgggcttagtggtgtgcctggtactgtggaccctccattcggagggcagtcggggaaagcttactgccgtggatccagaaactaatatgaatgtctctgagattatatcctactggggatttccctccgaagagtatctggtagagactgaggatggctatatcttatgtctgaaccggattcctcacggccggaagaaccactccgataagggacccaagcccgtcgttttcttgcagcatggcttacttgcggatagctccaactgggtaaccaatctcgccaacagctcactgggctttatcctggccgacgccggatttgatgtgtggatgggcaattcacgggggaacacctggtcaaggaaacataagaccttgagcgtcagccaggacgaattctgggctttttcgtacgatgagatggctaaatacgatctacccgccagtatcaactttatcttaaataagaccgggcaggaacaggtgtattacgtgggccactctcagggaacaaccatcggttttattgccttttctcagatccccgagctggccaaaaggataaagatgttcttcgcactcgggccggtggcttctgtggccttctgcacatctccaatggcaaagctcggacggctgcccgaccacctgattaaggatctttttggagataaagagtttctgccacagtcagccttcctcaagtggctgggaactcatgtgtgtactcatgtcattcttaaagaactctgtggtaacctgtgctttcttctgtgcggctttaacgagagaaacctcaatatgtctagagtagatgtttatacaacacatagccctgctggtaccagtgtgcagaacatgctccactggtctcaggccgtcaaattccagaagttccaggcctttgattgggggtcctccgccaagaactattttcattacaatcagtcctacccacctacctataacgttaaagacatgctagtgcctaccgctgtgtggagtggcggccatgattggctggccgatgtgtacgatgtgaacatcctccttacccagatcacaaatctggtgttccatgagtcaatacccgagtgggaacacctggacttcatctggggtttagatgccccctggagactctacaacaaaattattaacctgatgaggaagtatcaa

SEQ ID NO: 15780 - DNA, 1197 bp, Artificial Sequence
  Description of Artificial Sequence: Synthetic coding sequence
atgaaaatgcgattcctgggactggttgtgtgcctggtgctgtggacccttcacagcgagggctccaggggcaagctgaccgccgtggatccagagactaacatgaatgttagcgagatcataagttattggggcttcccgtccgaagaatatctggtggagactgaagatggctatatattatgcctgaatcgcatacctcacggccgcaaaaaccatagcgataagggcccaaagcccgttgtcttcctccaacacggcttactggccgacagcagtaactgggtgaccaacctggccaactcctctctgggcttcatcctggccgacgccggtttcgatgtgtggatgggtaattctaggggaaacacctggagcagaaagcacaaaacactatctgtgagtcaggacgaattctgggcttttagttacgacgagatggctaagtatgacctaccagctagcatcaacttcatcctgaacaagaccggtcaggaacaggtctattatgttggtcactcacaggggaccaccattggcttcatcgcttttagtcaaatcccagaattggctaaaaggatcaaaatgttttttgccttaggcccagtggctagcgtggcattctgcacatccccaatggccaagctgggaaggctacccgaccacctaatcaaggacctgtttggagacaaggaatttctccctcagtccgccttcctgaaatggctgggaacacacgtgtgtacacatgtgattctgaaagagctgtgtggaaacctgtgcttcttgctttgtgggtttaatgagagaaacttaaatatgagccgggttgatgtgtacacaacacattctcctgccggcacttccgtccaaaacatgctgcactggtcacaggccgttaagttccagaaatttcaggcattcgactggggctccagtgcaaagaattattttcattataaccagtcctacccacctacttacaacgttaaagatatgttggttccaacagccgtgtggtcaggaggtcacgactggctcgcagatgtttacgatgtgaacattctgttaacacagataactaacctggtatttcatgaatctattcccgaatgggaacacctggatttcatctggggattagatgctccctggaggctgtacaacaaaattataaacctgatgcgaaaataccag

SEQ ID NO: 15781 - DNA, 1197 bp, Artificial Sequence
  Description of Artificial Sequence: Synthetic coding sequence
atgaagatgagattcttgggcctggtcgtgtgcctcgtgttgtggaccctgcatagtgagggatccagggggaaactaacggctgtcgatcctgagaccaacatgaatgtcagcgagatcatttcctactgggggtttccttcagaggagtacctggtagagactgaagatgggtacattctgtgtctgaatcgaatccctcatggcaggaagaaccattcggataaaggccccaaacccgtggtcttccttcagcatggactgttggcggattcttcaaattgggtcacaaacctcgccaactcaagtctcggcttcatactggccgatgcagggttcgatgtttggatgggaaattcccgcgggaatacctggagtcgcaagcacaagacactttccgtctctcaagatgaattctgggctttctcttacgatgagatggcaaagtatgacctgcccgcatcaatcaattttatcctaaacaagacaggtcaggagcaggtgtattatgtggggcactcccaagggacaactattggctttattgctttctctcagatcccagagctggccaagcgcatcaaaatgttcttcgccctaggaccggtggcttcagtggcattctgtacttccccaatggccaaactgggccgacttccggaccatttgattaaggatttattcggcgacaaggaattcctgccccaatctgcttttcttaagtggttggggactcacgtgtgcacccacgtgatcttgaaagaactgtgcggtaacctttgctttcttttatgtggcttcaacgagcgcaacctgaacatgagccgtgtggacgtttatacaacacatagtcccgccgggacgtccgtgcaaaacatgctccactggtcccaggccgttaagtttcagaaatttcaagcgttcgattgggggagctccgcaaagaattacttccactataaccagagctaccccccgacatataatgtgaaagatatgctggtgcctactgcggtgtggagcggaggacatgactggttagctgacgtgtacgacgtgaatattctgctgacgcagatcaccaacctggtttttcatgaaagtatccctgagtgggaacaccttgattttatttggggcctggacgcgccttggcggctgtataacaagattatcaatctgatgcgcaagtaccag

SEQ ID NO: 15782 - DNA, 1197 bp, Artificial Sequence
  Description of Artificial Sequence: Synthetic coding sequence
atgaaaatgcgcttcctgggacttgtcgtgtgcctggtgctctggaccctgcatagcgagggatcgcggggaaaactgactgccgtcgacccggaaaccaatatgaacgtgtcggagatcatctcctattgggggttccctagcgaggagtatctggtggaaactgaggacgggtacatcctgtgcttgaaccgcatcccgcacgggagaaagaaccacagcgacaagggaccgaagcctgtggtctttctgcaacacggcctgctggccgatagcagcaattgggtcactaacctcgctaattcgtcgctcggctttatcctggctgacgcggggtttgatgtctggatgggaaacagcaggggaaatacgtggtcgcgtaagcataagactttgtcggtttcccaggacgaattctgggctttctcgtacgatgaaatggcgaaatacgatctgccagcatccataaacttcattctgaacaagaccggacaggaacaagtgtactacgttgggcattcccaaggtaccaccatcgggtttattgcgttctcccaaatcccagagctggccaaacggatcaagatgtttttcgccttggggccggtagcttcagtggcattttgcaccagcccgatggccaaactgggccgactgccggatcacttgattaaggacctgttcggagacaaggagttccttccacaatccgctttcctgaagtggctgggaactcacgtgtgcacccatgtcattctcaaggaactgtgtggcaatctttgtttcctgttgtgcggcttcaacgaacgtaacctgaatatgagccgggtggacgtctacacgacccattcaccggccggcacttcggttcagaatatgctccactggtcccaggccgtgaagttccagaagtttcaggcgttcgattggggctcttccgccaaaaactacttccattacaaccagtcctacccacccacctacaacgtgaaggacatgctggtgccaactgcggtctggtccggtggacacgattggctggccgacgtgtacgacgtgaacatcttgttgacgcagatcaccaatctcgtgttccacgagtcgattcctgagtgggagcacctggacttcatctggggactcgatgccccatggcggctgtacaataagatcatcaacttgatgagaaagtaccaa

SEQ ID NO: 15783 - DNA, 1425 bp, Artificial Sequence
  Description of Artificial Sequence: Synthetic coding sequence
atggagtcgaaggcgttgcttgtcctgacccttgcggtctggctccagtccctgaccgcgtcgagaggtggagtggctgcagctgatcagcgaagagatttcattgacatcgaatcgaagtttgccctgagaactcccgaagatacggcagaggatacgtgtcatctgatcccaggcgttgcagaatcggtcgcaacttgtcatttcaatcactcgagcaagaccttcatggtaatccacgggtggaccgtgactggaatgtatgaaagctgggtcccaaagctggtcgcggccctgtacaagcgagagccagattcgaacgttatcgtggtggattggctttccagagcacaagaacactatcctgtctcggcaggttacactaagctcgtgggacaagacgtggcccgcttcatcaactggatggaagaagaattcaattacccgctggacaacgtccaccttttgggttactcactgggtgcacacgcggcaggcattgctgggtcgttgaccaacaagaaagtgaatcgtattaccggccttgatccagcaggtccaaactttgaatacgcggaagccccttcgagactgagtcctgacgatgcagattttgtggacgtgctgcacacctttactaggggttcaccaggccggtccataggcattcagaagcctgtgggacatgtggacatctacccaaacggaggcacctttcaacccggatgcaatatcggtgaagcaattagggtcatagcagaaagggggttgggtgacgtggatcagcttgtgaaatgttcccatgagcgctctatacacctgttcatcgactcacttctgaatgaagaaaatccgtcgaaggcctacagatgctcctcgaaggaagcattcgaaaaggggctgtgtctgtcctgccgcaagaacagatgcaataaccttggttacgagatcaacaaagtgcgcgccaagcggtcctcaaaaatgtaccttaaaacgcgatcacagatgccctacaaggtttttcattaccaagtcaaaattcacttttcgggcactgagtcggagactcataccaaccaagcatttgaaattagcctgtacggaactgtggcggagagcgaaaacattccctttaccctccccgaagtctctaccaacaaaacctactcgttcttgatctacaccgaagtggacattggagagcttttgatgctcaaactcaagtggaagtccgattcttacttctcctggagcgattggtggagctctccaggtttcgcaattcaaaagattcgcgtcaaggcgggcgagactcagaaaaaagtcatcttttgttccagagagaaagtgtcgcatttgcaaaagggaaaagcgcctgcggtgttcgtgaaatgtcatgataagagccttaacaagaagtcagga

SEQ ID NO: 15784 - DNA, 1425 bp, Artificial Sequence
  Description of Artificial Sequence: Synthetic coding sequence
atggagtcgaaggccctgctggtgctgaccttggcggtgtggctgcagtcgctcaccgcttcacgcggaggggtggcagctgccgatcagcgcagagactttatcgacattgagtccaagttcgccctccggaccccggaggacacggccgaggacacttgccatctgattccaggagtggccgaatcagtggccacttgccatttcaaccattcctccaaaacgttcatggtcattcacggatggaccgtgacggggatgtacgagtcgtgggtgccaaaactcgtcgccgccctttacaagcgcgaaccggattcgaatgtgatcgtggtcgactggttgtccagagcacaggaacattacccggtgagcgcgggatacaccaagctggtcggacaagatgtcgctcggttcatcaactggatggaagaagaattcaactaccctcttgacaacgtgcacctgctcgggtacagcttgggagcccatgctgctggaattgccggaagcctgactaacaaaaaggtgaaccggattaccggcttggatccggctgggcccaacttcgagtatgcggaggccccatcacgccttagcccggatgacgccgattttgtggacgtcctccataccttcacgcggggatctccgggacgctctatcggcattcaaaagccggtgggacacgtcgatatctaccctaatggtggcacgtttcagccggggtgcaacattggcgaggcgatccgcgtcatcgcagaacgcgggctcggagatgtggatcaactcgtgaagtgctcgcacgagcggtcaattcacctgttcatcgatagcctgctgaacgaagaaaacccaagcaaagcataccgctgttcctccaaggaggcgttcgaaaaggggctctgcctctcctgccggaagaaccggtgtaacaacctgggatacgagatcaacaaggttcgcgctaaacgatcgtcgaagatgtacctcaagactcgctcccagatgccgtacaaggtttttcactatcaggtgaaaatccacttctcaggcactgaatcggaaactcacaccaaccaggccttcgaaatctccctctacggcaccgtggcagagtccgagaacatccctttcactttgccggaagtgtcaaccaacaagacctattcgtttttgatctacactgaagtggacatcggcgaactgctgatgctgaaacttaagtggaagtcggattcctacttctcttggtccgactggtggagctcaccagggttcgcaatccagaaaatacgtgtcaaagccggcgagacgcagaagaaggtgatcttttgttcaagggaaaaagtctcgcacctccagaaaggcaaggctccagccgtgttcgtcaaatgtcacgacaaaagcctgaacaagaagtcggga

SEQ ID NO: 15785 - DNA, 1425 bp, Artificial Sequence
  Description of Artificial Sequence: Synthetic coding sequence
atggaaagtaaggcccttctcgtgctgacgttggcggtgtggttgcaatctctaacagcttctagaggcggcgtcgccgcagccgaccagagaagggatttcattgacattgaatccaagtttgcacttcggacccctgaagataccgccgaagatacctgccacctcatccccggcgtggccgaaagcgtggcgacctgccactttaaccactctagcaagacctttatggtaattcacggctggaccgtcaccggtatgtacgagtcttgggtacccaagttagtggcagctctgtacaagagggagccggattccaacgttattgtagtcgactggctctctcgggcccaagagcattatccagtgtccgcaggttacactaaactcgtggggcaagatgtggctcgatttatcaattggatggaggaggaattcaattaccctctggataacgtacacttactcgggtattcactaggagctcacgctgcgggaattgcagggtctctgactaacaagaaggttaaccgcatcaccgggttagaccctgctggcccaaacttcgaatacgccgaggcacccagcaggttgagcccagacgacgctgatttcgtggacgtgctgcacacctttaccaggggatccccaggccgctccatcggaatacagaaacccgtgggccatgttgacatctatcccaatggcggcacctttcaaccaggctgtaacatcggagaagctatccgggtaattgcggaacgagggctgggcgacgtggatcagcttgtaaaatgtagccacgaaaggtctattcatctgttcatcgattcactcttaaacgaagaaaatccctcaaaggcttataggtgttcgtccaaggaagctttcgaaaagggcctctgtctttcatgtcgcaaaaatcggtgcaataacctgggatatgagattaataaggtaagagctaagcggtcctctaaaatgtatctgaaaacccggtctcagatgccttacaaggtgtttcactaccaagtaaaaattcatttctctggaactgagtctgaaacacacaccaaccaggcatttgaaatttcgctatatggaactgtcgcagagtctgagaacatccctttcacgctccctgaggtgagcacaaataaaacctattcctttcttatttatacagaggtggatataggcgagttgttgatgctgaagttaaaatggaaatcagattcctacttctcttggagcgactggtggtcctctcccgggtttgccattcaaaagattcgcgttaaagcgggcgagacacagaaaaaggtaatattctgtagccgagagaaagtaagtcacctgcagaagggaaaggctccagccgtcttcgtgaagtgccacgacaaaagcctgaataagaagtccgga

SEQ ID NO: 15786 - DNA, 1425 bp, Artificial Sequence
  Description of Artificial Sequence: Synthetic coding sequence
atggagtcaaaggccttgctggtcctgactctggccgtatggcttcagtcgctgactgcctccagaggcggtgtggcagcagctgaccagagacgcgatttcatcgatatcgagtccaaatttgcgctcagaaccccggaagacaccgccgaggatacctgccacctgatcccaggcgtggcggaatcagtggccacttgccattttaaccacagctcgaagaccttcatggttattcacggttggacggtgaccgggatgtacgaatcttgggtaccgaaactggtcgcggctctgtacaaacgggagcctgactcgaacgtcatcgtggtcgactggctctcgcgggcccaggaacactacccagtctcagcgggatacaccaagctcgtgggtcaggatgtggcacggttcataaattggatggaggaagagttcaattacccacttgacaatgtgcacctgctcggctactcgctgggagcccatgcggccgggatcgctggatcactgaccaacaaaaaggtgaacaggattactggactggaccctgccggaccgaacttcgaatacgccgaggcgccgagccgtctgagccccgacgacgccgatttcgtggatgtgcttcatactttcacgcggggatctccgggcaggtccatcgggatacagaagccagtgggtcacgtcgacatctacccgaatggaggaaccttccaaccagggtgcaacatcggagaagccattcgggtcatcgcagagcggggactgggagacgtggaccagctggtgaagtgctcacacgagcgctcgattcatctgtttattgactccctccttaacgaagaaaacccgagcaaggcgtatcgatgttcttccaaagaagcgttcgaaaagggattgtgtctttcatgccgcaaaaaccgttgtaacaatctgggatacgagatcaacaaggtccgggcaaagagatcgtcgaagatgtacctcaagactagatcccaaatgccctacaaggtgtttcattaccaggtgaagatccatttctcggggactgagtccgaaactcacacgaaccaggcgttcgagatcagcctctacggaaccgtagccgaaagcgagaatatccctttcaccctgccggaggttagcactaacaagacctactcgttcctcatctatactgaagtcgatatcggcgaacttctcatgctgaagctcaagtggaaatcggactcctacttttcttggtcagactggtggtcctcgcctggattcgctatccaaaagatcagggtgaaggccggcgaaacccaaaagaaagtgatcttctgcagccgcgaaaaggtgtcacacctgcaaaaagggaaggcaccggcagtgtttgtgaaatgccacgataaaagccttaataagaagtccggt

SEQ ID NO: 15787 - DNA, 1425 bp, Artificial Sequence
  Description of Artificial Sequence: Synthetic coding sequence
atggagtcaaaagcactcctggtgttgaccctagccgtatggttgcagagcctgactgcgtcccgcgggggcgtggctgcagccgatcaacgccgagattttattgatatcgagtcaaagttcgccttacgcacccccgaggatactgctgaagatacgtgccacctcatacccggcgttgccgaatccgtggccacatgccatttcaatcacagctctaagactttcatggttattcatggctggaccgtcaccgggatgtatgagtcttgggtgccaaaacttgttgccgctttgtataagagggaacccgacagtaatgttatcgtagtggattggttatcgagggctcaggagcattaccccgtatcagccggatatacgaagctggttggccaggacgttgctaggttcatcaactggatggaggaggagtttaactatcctctggataacgtgcatcttttgggctactcgctgggggcccacgcagctggaatagctggcagcctcacgaacaaaaaagtaaatcgtattacgggccttgatcctgctggcccaaattttgagtatgctgaagcgccttcccgcctcagcccagatgacgctgattttgttgacgtgcttcatacattcacccgcgggtcccctggtagaagtatcggtattcagaagccagttgggcacgtggacatctacccgaacggaggcacctttcagccaggctgcaatatcggagaggcaatccgggtgatcgcagagagagggctgggagacgtggaccagcttgtcaaatgctcccatgagcgatcaatccatctgtttattgattctctgctcaatgaggagaacccatcaaaagcctatcgctgctcgtccaaagaagccttcgagaaaggtctttgcctgagttgtagaaaaaacaggtgtaataacctggggtacgaaattaataaggttagggcaaaaaggtccagtaaaatgtatctgaaaacccggtcccagatgccttataaagtgtttcattatcaggtcaagatccacttttctggaaccgagtccgagacccacaccaaccaagctttcgaaattagcctgtatggaactgtggccgagagcgagaacattcccttcacattacctgaagtttctaccaataagacctactcgtttctgatttatactgaggtggacatcggcgagctcctgatgctcaagttgaagtggaaatctgacagctactttagttggtcagattggtggtcaagccctggctttgcaatccagaaaatcagagtgaaggcaggagaaactcagaaaaaggttattttctgttcacgcgaaaaagtatcacatctgcaaaaaggaaaggcccccgccgtttttgtcaaatgccatgataaatctcttaacaagaagtctggg

SEQ ID NO: 15788 - DNA, 1425 bp, Artificial Sequence
  Description of Artificial Sequence: Synthetic coding sequence
atggaatcaaaggcacttctggttctgacacttgcagtctggttgcagtctctgacagcgtcacgagggggtgtggcggcggcggaccagaggcgagattttatcgatatcgagtcaaagttcgcactgaggactcccgaggacactgcagaggacacatgtcacctgattcccggcgtggctgaaagcgtcgccacctgccactttaaccatagctcaaaaacattcatggtcatccacggatggactgtcactggtatgtacgaaagctgggtgccaaagcttgtggctgctctgtataaaagagagccggattccaatgtgattgtcgtggactggttgagtagggcacaagaacattatcccgtgtccgctggctacaccaagcttgttggacaggacgtggcgagattcatcaattggatggaggaagagtttaattaccctttagataatgtgcatctgctcggatactccctaggggcacacgcagcgggcattgccggttctctgaccaataagaaggtaaataggataacgggactggaccccgctgggccgaacttcgaatacgctgaagccccaagccggctgtcaccagacgatgcagactttgtggatgtcctgcacacctttacccggggtagtcctggtcggagcatcgggattcagaaacccgtggggcacgttgacatctacccaaatgggggcacttttcagcccggatgcaacattggtgaagccatccgcgtaatcgctgagcgtggactcggagatgttgatcagttggtaaagtgcagtcacgagaggagcatacacttatttatcgactccctactcaatgaggaaaatccctcaaaagcctaccgctgctcatctaaggaggcctttgagaagggcctgtgtctgtcctgcagaaaaaatagatgtaataatctgggctatgaaattaataaagtgcgggcgaagcgatcttcaaagatgtaccttaagaccaggtctcagatgccctacaaggtctttcattaccaggtcaagatacacttctcaggcaccgaaagcgaaactcacaccaatcaggccttcgaaatttccttgtatggcaccgtagcagaatccgagaacattcctttcaccttgcctgaggtgtcaacgaacaagacttacagcttcttgatttataccgaagttgacattggtgagctcctgatgctgaaattgaaatggaagtcggattcctacttcagctggtctgattggtggagctcaccggggttcgccatccagaaaattagggttaaggcgggggagacacagaagaaggtgatattctgctctcgcgagaaggtcagtcacctgcagaaagggaaggcaccagcagttttcgtgaaatgccatgataagtctttaaataaaaagtccggg

SEQ ID NO: 15789 - DNA, 1425 bp, Artificial Sequence
  Description of Artificial Sequence: Synthetic coding sequence
atggagtcgaaggccctgctggtgctcaccctggctgtctggttgcaatctttaactgcctccagggggggtgtggctgcagcggaccagagaagggacttcatagatatcgagtcaaagttcgcattaaggaccccggaggacactgccgaagacacctgtcacttgataccaggggtggccgagtccgtggcaacttgtcactttaatcactcttctaagacttttatggtgatccacgggtggactgtaaccggaatgtatgaatcttgggtacctaagctggttgcggcactctataaacgagagcctgacagcaacgtgatagttgttgactggctctctagagcccaggagcattaccctgtttccgctggatacactaaacttgtcgggcaggatgtcgcccgatttatcaactggatggaagaggagttcaactatcctttagataacgtgcatttgcttggctactctctgggtgcccatgctgcaggaatagcaggctctcttacaaacaaaaaagttaatcgcatcacagggttggaccccgccggaccaaattttgagtacgctgaggccccctcaaggcttagccccgatgatgcggacttcgtagatgtgctccacacgtttacgcggggttcgcctggtcgaagcatcggaattcagaaacctgttggtcacgttgatatctatcctaatggagggacattccagccgggctgtaacatcggcgaagctattcgtgttattgccgaaagggggttgggggatgtcgaccaactggttaagtgttcccatgagcgctcaatccacttatttatagatagcttgctgaacgaggaaaaccccagcaaggcctaccggtgttctagcaaggaggcatttgaaaaagggttatgtttgagctgcagaaagaatcgttgcaataacttaggatacgaaatcaataaagtgagggcgaaacgtagctcaaaaatgtacctgaaaactcgcagccagatgccctacaaagttttccactaccaggtaaagattcacttcagcgggaccgaatcagagacacacactaaccaggcattcgagatttctctgtacggcaccgtagccgagagcgagaatataccctttaccctgcccgaagtgtccacaaacaaaacatactcgttcctgatctacaccgaggtggacattggggagctgctgatgctgaagctcaaatggaaaagcgatagttacttttcatggagcgactggtggagctccccaggcttcgcaattcagaagatccgtgtgaaagcaggtgaaactcagaaaaaggtcattttttgcagtcgggagaaggtttctcatctgcagaaagggaaggctccagcagtgttcgtaaagtgtcatgacaaatccttgaataagaaatccggt

SEQ ID NO: 15790 - DNA, 1425 bp, Artificial Sequence
  Description of Artificial Sequence: Synthetic coding sequence
atggagagtaaggccttgctcgtccttaccctggccgtctggctgcagagcctcactgcctcgcgcggcggtgtcgctgctgccgatcagcgccgcgactttatcgatatagaatccaagttcgcactgcggaccccggaggacaccgctgaagatacttgtcatctgattcctggagtggcggaaagcgtggcgacttgccacttcaaccattcatcaaagactttcatggttatccacggatggactgttaccggcatgtacgaaagctgggtgcctaagctggtggctgcgctgtacaagagggaacctgattcaaacgtgatcgtggtggactggctctcaagagcgcaggaacactacccggtgagcgcgggctacaccaaactcgtgggacaggacgtggcccggttcatcaattggatggaggaagagtttaactacccgcttgacaacgtccatctgcttggatacagccttggagcccatgccgcaggaatcgccggatcacttaccaacaagaaagtcaatcggattaccggtctggacccggccggaccgaatttcgaatacgccgaggcgccatcccgactctcaccggacgatgccgatttcgtggacgtgctgcacaccttcacccggggctcccccggcagatccatcggtatccagaagcctgtggggcacgtggatatctaccctaacggaggaaccttccagcctggatgcaacatcggagaggccattagggtgatcgcagaaagaggcttgggagacgttgaccaacttgtgaagtgcagccacgagcggtcaattcacctgtttatcgacagcctcctcaacgaggaaaacccgtccaaggcttaccgatgtagcagcaaggaggcattcgaaaaaggactgtgcctgtcgtgccggaagaacaggtgcaacaatcttggatacgaaatcaacaaagtccgcgccaaacggtcctccaaaatgtacttgaaaaccagatcccagatgccgtacaaggtctttcattaccaggtaaagattcatttctcgggtacggagagcgaaacgcacactaaccaggcgttcgaaatttccctgtacgggaccgttgccgagtcggagaatattcccttcaccctgccggaagtgtcgaccaataagacctacagcttcctcatttacactgaggtggacatcggtgagctcctcatgctgaaactgaagtggaaatctgacagctacttcagctggagcgactggtggtcctccccggggttcgccatccagaagattcgggtgaaggccggcgaaacccaaaagaaggtcatcttttgctcccgcgagaaagtgtcacacctgcagaaggggaaagcaccagccgttttcgtcaagtgccacgataagtcgttgaataagaagagcggg

SEQ ID NO: 15791 - DNA, 1425 bp, Artificial Sequence
  Description of Artificial Sequence: Synthetic coding sequence
atggaatcgaaagcattattagtacttacacttgccgtttggctgcagtcactgacggcctcacgcggtggggttgctgctgccgatcaaagacgtgatttcatagacatagaaagcaagtttgcactgcggacgcctgaagatacggcggaggatacgtgtcaccttattccaggggttgccgaatccgttgcgacatgtcatttcaatcattcgtctaagacatttatggtgattcatggctggacagttactggaatgtacgaatcttgggtccctaaattagttgcagcactctataaaagagaacctgactctaatgtgattgtggtagattggttatctcgtgcgcaggaacattatccggtgtccgcaggttacacgaaattagtgggccaggatgtggcacggtttatcaattggatggaagaagaattcaattatcctctggataatgttcaccttttggggtatagtctgggtgctcacgcagcaggcattgctggatctcttaccaataaaaaagtaaatcgcattacagggcttgaccctgccgggcctaacttcgaatatgcggaagcaccttcacgtctttcaccggacgatgcagatttcgtcgatgttcttcacactttcacccgcggcagtccgggcagatctataggcatacagaaacctgtaggtcatgtggatatctatccaaatggcggaacgtttcaacctgggtgcaatattggagaagctattagagtaatcgcagagcgcggccttggcgacgttgatcagctggtcaaatgctcgcatgaacgttctatacatctttttattgactcgctgttaaacgaggaaaatccatcgaaagcgtatcgctgtagttccaaggaagcttttgagaaagggctctgtctttcttgtaggaaaaatcggtgcaacaatttaggatacgagattaacaaagtaagagcaaagagatcatctaaaatgtatttaaaaacacggtcccagatgccttataaggtatttcattaccaggtaaagattcatttttcgggtactgagtccgagacccatacaaaccaggcatttgaaattagcttgtacggaaccgtggctgagtccgaaaatatccctttcacactcccggaggtatctacgaacaaaacatatagttttctgatttatacggaggttgatattggcgaactgcttatgttaaaactgaaatggaagtcagatagctatttttcttggtccgattggtggagctctcctggtttcgccattcaaaaaattcgcgttaaagctggagaaactcagaaaaaagtcatcttttgcagccgtgagaaggtgtcgcaccttcagaagggtaaggcaccagcagtctttgtcaagtgccatgacaaatctttgaataaaaaatcaggt

SEQ ID NO: 15792 - DNA, 1425 bp, Artificial Sequence
  Description of Artificial Sequence: Synthetic coding sequence
atggagtcaaaagcactgctggtgctcaccctggcggtgtggctccaatccctgaccgcctcaagaggtggtgttgctgcagctgaccagaggagagatttcattgatattgaatcgaaatttgcactccgaacgcccgaagatacggccgaagatacttgtcacttgatccctggtgtcgccgagtcagtggcaacctgtcatttcaatcacagctcgaaaactttcatggtgattcatgggtggaccgtaactggcatgtatgaatcctgggtgcctaagctcgtggctgcactgtacaaaagggaaccagacagcaacgtgatcgtcgtggattggttgtcgcgggcccaggaacactacccggtcagcgcaggctacacgaagttggttggtcaggacgttgcgcggtttatcaactggatggaagaggagtttaactatccacttgacaacgtccatcttctgggttacagccttggggctcatgccgcagggatagcaggtagcctgactaataagaaagtgaatcggatcaccggattggatcccgcaggtcctaatttcgaatacgccgaagcgccttcccgcctgagccctgatgatgcggactttgtggatgtgcttcatacctttactagaggatccccagggcgttcgattggcatacaaaagcccgtcggacacgtggacatctaccctaatggtggaacttttcagcccggatgcaacattggcgaggcgattagggtcattgctgaaagaggactgggagatgtggaccagttggtgaagtgctcccatgaaagatcgattcatttgtttattgattccctccttaacgaagagaacccttctaaagcataccgctgtagttccaaggaggcctttgaaaaggggctgtgcctctcatgtaggaagaatagatgcaacaacctcggttacgagataaacaaggtacgtgcaaagagaagttctaagatgtatctcaaaactcgatcgcaaatgccctacaaggtgtttcactaccaagtgaaaattcatttctcgggaaccgaatcggaaacccacacgaatcaggcatttgaaatctccctttacggaaccgtggcagaatccgaaaacattcctttcactcttccagaagtgtcgaccaataagacttacagcttcttgatctacaccgaggtggatattggcgaactgcttatgctgaaactgaaatggaagtctgacagctacttttcgtggtcagattggtggtcgtccccaggatttgcaattcaaaagatacgcgtcaaggcaggggagacgcaaaagaaggtcatcttttgttccagagagaaggtcagtcatctgcagaaaggaaaggcaccggctgtgttcgttaagtgtcatgacaagtcgcttaacaagaagtcgggt

SEQ ID NO: 15793 - DNA, 1425 bp, Artificial Sequence
  Description of Artificial Sequence: Synthetic coding sequence
atggagagcaaggctctgctggtcctaacactggcggtgtggttgcaaagcttgaccgctagcagaggtggcgtggccgctgcagaccagcgacgggatttcattgatatagagtcgaaattcgccttgcgtactcctgaagacactgctgaggacacctgccacctgatccccggtgtggccgaatcggtggcgacatgtcatttcaatcactcttccaaaacatttatggtgatccacggatggaccgtgacaggcatgtatgaatcttgggtgcctaagcttgtcgccgcattatacaaaagagagcctgattcaaacgtgattgttgtcgattggctgagtagagcacaggaacactatcccgtatcggcgggatacactaaactcgtcgggcaagatgtagctcgtttcatcaattggatggaagaagagttcaattacccactcgacaatgtgcatctgctggggtattcgcttggggcccatgcggctggaatagcgggcagcctgacaaacaaaaaggtgaacagaatcactggcctggatcctgctggccccaatttcgagtatgctgaggcacccagcaggctgtcccccgatgacgctgacttcgtagacgtcctccatactttcacacggggctcaccgggaaggtccatcggcattcagaagcctgttgggcatgtggatatttatccgaatggcgggacattccagcccggctgtaatatcggagaggccatcagagttatcgccgaacgtgggctgggtgatgttgaccagttggtgaagtgttctcatgaacgctctatccatctatttattgacagccttctaaacgaagagaatccatccaaagcctaccggtgtagcagcaaagaagccttcgaaaaggggctgtgtttgagctgccgaaagaaccggtgcaataatcttggatacgagattaacaaagtgagagccaagcgatcctctaaaatgtacctcaagacccgcagtcaaatgccctataaagtgtttcactaccaggtgaagattcatttctccggcacggaatcagaaacccacacaaaccaggcattcgaaatcagcctctacgggacagtcgctgagagtgagaatattcctttcactttgccagaagtgagcacaaataagacatacagcttcttaatctatacagaagtagatattggagagctcttgatgctgaagctgaaatggaagagcgatagctatttcagctggagcgactggtggtcctctccgggtttcgctatacagaagattcgcgtaaaagccggggagacacagaagaaggtaattttctgcagcagggaaaaggtttctcacctgcagaaagggaaggccccagccgtatttgttaaatgtcatgataaatcattgaataagaaatcagga

SEQ ID NO: 15794 - DNA, 1425 bp, Artificial Sequence
  Description of Artificial Sequence: Synthetic coding sequence
atggagagtaaagctctcttggtcctgactctcgcagtatggctgcaaagccttacagcctccagggggggggtggctgctgccgatcaacgcagagactttattgacatagaatccaaatttgcgcttagaacacccgaggacaccgccgaggacacctgccatttgattccaggcgtggcagaaagtgtagctacctgccatttcaaccatagctcaaaaacttttatggttattcacgggtggactgttactggcatgtacgaatcttgggtccctaaacttgtggccgcactgtacaagcgtgagcccgacagtaacgtgattgtggtggattggctgtcccgagcccaggagcactatcctgtgtctgccgggtatactaagctcgttgggcaagacgtcgcacgcttcatcaattggatggaggaggaatttaactatcccctggataacgtgcacttgctgggctatagcttgggcgcacatgcggcaggcatcgccggatctctgacaaacaagaaagtaaacagaattacgggactcgacccggctggccccaacttcgagtacgccgaggcgccttcccggttaagccccgacgacgctgactttgtcgacgtgttgcatacattcactagggggtctcctggacgaagtattggaatccagaagcctgtgggacacgtcgacatctatccaaatgggggtacgttccagccaggatgtaacattggtgaggcaatccgtgtcatcgccgaaagggggctgggagatgtcgaccagttggtgaaatgctctcacgaacgcagcattcacctcttcattgacagcctgcttaatgaagagaacccatctaaagcgtatcggtgtagttcaaaggaagcgtttgaaaaaggactctgcttatcttgccgcaaaaacagatgcaataacctgggctacgagattaataaggttcgggcaaaacggtctagcaagatgtaccttaaaactagatcccagatgccctataaggtctttcactaccaggtcaaaatccacttttctgggacagaaagtgagacgcatactaatcaggcattcgagatctctctgtacggtaccgttgccgaatccgaaaacattccattcacactaccagaggtcagcacaaacaagacctactccttcctgatttacactgaagttgatattggcgagctactcatgctaaagctaaaatggaaaagtgactcatactttagttggtccgactggtggtctagccctggcttcgccatccagaagattcgcgtgaaagctggtgagacgcagaagaaggtaatcttttgctcaagggagaaagtgtctcacctacaaaaaggcaaggcccctgccgtcttcgttaaatgtcacgacaagagcttgaacaaaaaatccggc

SEQ ID NO: 15795 - DNA, 1425 bp, Artificial Sequence
  Description of Artificial Sequence: Synthetic coding sequence
atggagtctaaagcattgttggtgttgactctggccgtgtggttgcagagtctgacagcatcccgcggtggagtcgctgctgctgaccaaagacgtgacttcatcgatatagagagtaaatttgctctgcgtacccccgaggacactgccgaagacacatgccatttgattcctggtgttgctgaatctgtcgctacatgccacttcaatcattcctccaagacctttatggtcattcacggatggaccgtgaccggcatgtacgagtcttgggttcctaaactggtcgctgccctttacaagcgtgaacctgactctaatgtgatcgtggttgactggctgagtagagcacaagaacactaccccgtatccgccggatataccaagctggtcggacaagacgtagcccgcttcatcaattggatggaggaggagttcaactaccctctggacaatgttcaccttctgggctattcacttggagctcacgcagctggaattgccggatctctgaccaacaagaaggtgaataggattacaggcctggatcccgccggtcccaactttgagtatgctgaggctccctctcgcctgagtcctgacgatgctgattttgtagacgtcctgcacacctttactcgtggatctcccggcagaagtattggaatccagaaaccagtaggccacgtggacatctaccctaatggcggtacttttcaacccggttgtaacatcggagaggccattcgtgtcatcgctgagcgcggacttggagatgtcgaccagcttgtaaagtgtagtcacgagaggtctatccatctgttcattgatagtctgctgaatgaagagaacccttctaaggcttataggtgctccagcaaagaagctttcgagaaaggtctgtgtctgtcatgtagaaaaaacagatgtaacaacctcggatatgagattaacaaggtgcgcgctaagcgttcctccaagatgtatctgaaaacaaggtcacagatgccttacaaggtcttccactaccaggtaaaaatccacttctctggaactgaatcagaaacccacaccaaccaggcattcgagatttccctctatggcactgtggccgagtccgaaaacatcccatttacattgcccgaggtctccactaacaagacctattcattcctgatttatactgaagtcgatatcggagagctgttgatgctcaaactcaagtggaagtccgacagctacttcagctggagtgattggtggtcatcccccggatttgctattcagaagattcgcgtaaaagccggagagactcagaagaaagtgatcttctgcagcagggagaaggtctcacaccttcagaagggaaaggccccagccgtctttgtcaagtgtcatgacaagagtctgaataagaagagtggt

SEQ ID NO: 15796 - DNA, 1425 bp, Artificial Sequence
  Description of Artificial Sequence: Synthetic coding sequence
atggagtcaaaggccttgttggtgttgactctggcagtgtggttgcaatccctgacggcaagcagaggcggagtcgccgcagcagatcaaagacgtgatttcatcgacattgagtccaagtttgcactcagaacccccgaggataccgcagaagatacctgtcacctgatccccggagtggctgaaagcgtcgcaacttgccatttcaatcattcgtccaaaacttttatggtgatccatgggtggaccgtgacggggatgtacgaatcctgggtgccgaagctggtggcagctttgtacaaacgggagcctgattcgaacgtcatcgtggtggattggctcagccgcgcgcaagaacattacccagtgtcagccggttacactaagctcgtcggacaggacgtagccagatttatcaactggatggaagaagagttcaactaccccctggataatgttcatctcctgggatactccctgggagcccatgcagcaggaattgcaggttccctgactaacaagaaggtgaacaggattaccggtctggatcctgcaggtcctaactttgaatacgccgaggcaccttcgcggctcagcccagacgacgccgattttgttgatgtccttcacacgttcaccagaggatcgccaggaagaagcatcggcattcaaaagcctgtcgggcatgtggacatctatcctaacggcgggacttttcaaccaggatgtaacattggggaagccattcgagtgattgcggaaagaggcctgggggatgtcgatcagctggtgaaatgctcacacgaacggtccatccacctcttcatcgattcgctgctgaacgaagaaaatccctctaaggcataccgatgttcaagcaaggaagcattcgaaaagggtctttgtctgtcatgtcggaaaaaccggtgtaacaatctgggctacgagattaacaaggtcagagccaagagatccagcaagatgtacctcaaaactcgttcgcagatgccttacaaagtgtttcactaccaggtcaagatacacttttccggcaccgaatcggagactcacacgaatcaagcatttgaaatctctctgtatggaaccgtggcagaatccgagaatatcccgtttaccttgcctgaagtgtcaaccaacaagacgtacagcttcctgatttacaccgaagtggatattggagaacttcttatgctcaaactcaaatggaaatcagattcctacttctcgtggtcagactggtggagctcacctgggttcgcaatccaaaagattagggtgaaggctggagagactcagaagaaggtgatcttttgtagcagagaaaaggtgtctcatctgcagaagggaaaggcacctgcagtgtttgtgaaatgtcatgacaagtccctgaacaaaaagagcgga

SEQ ID NO: 15797 - DNA, 1425 bp, Artificial Sequence
  Description of Artificial Sequence: Synthetic coding sequence
atggaatctaaggctctgttggtcctaacactcgccgtatggctgcagtctcttactgcgtccagggggggtgtggccgccgccgaccagaggcgcgatttcattgacatagagtctaagttcgctctgcgaactcctgaagacacggctgaagatacatgtcatctgatccccggagtggctgagtcagtggccacctgtcacttcaatcactcctcaaaaacttttatggtaatccatgggtggacagtgaccggtatgtatgagagctgggtccctaagctggtcgccgccctgtataagcgcgaacccgatagcaatgtcatcgtcgttgactggttgagcagggcgcaggaacactatcctgtgtccgcaggctataccaagctggtaggtcaggacgtcgcaagatttatcaattggatggaagaggagttcaattaccctttggacaacgtgcacctattaggctactcactcggcgcccacgctgccggaatcgcaggtagtctgaccaataaaaaagtaaataggattactggcctcgatcccgctggcccgaacttcgagtacgccgaagccccttcccgcctctcaccagacgacgcagattttgtcgacgtgctacatacttttacaagaggatccccagggagaagcattggaatccagaagccagttggtcacgttgatatttacccaaacggcggcaccttccagcctggctgcaatattggtgaggctatcagggtgatcgcagaaagaggcctgggagatgtcgaccagttggtgaagtgtagtcacgagcgctcgatccacctgttcatcgacagtctactgaatgaggagaacccatccaaagcttaccgatgctcgtcaaaagaggcttttgaaaaaggtctctgccttagctgcagaaagaaccgctgcaataacctcggatacgagattaataaggtgcgcgccaaacgctctagtaagatgtatctgaagaccaggtcccagatgccttacaaggtgttccattaccaggtcaagatccatttctctggtaccgagtccgagacccataccaatcaggcattcgaaataagcctctacggcacagtggccgagtctgaaaacattcccttcaccctcccagaggtgtcaacaaacaaaacatactctttcctcatatacaccgaagtagacatcggcgaacttttaatgttaaaactaaaatggaagagtgattcctacttttcctggtctgattggtggagttcaccaggcttcgccatccagaaaattcgcgtaaaagcaggcgagacccaaaaaaaggtcattttttgcagtcgcgagaaagtcagccaccttcaaaagggaaaggcccccgccgtgtttgtgaaatgtcacgacaagtcactcaacaagaaaagcggc

SEQ ID NO: 15798 - DNA, 1425 bp, Artificial Sequence
  Description of Artificial Sequence: Synthetic coding sequence
atggagagtaaggcccttcttgttttgacactggccgtttggctacaatcgctgacggcgtcccgcggtggagtggcggcggcggatcagcgcagggatttcatcgatattgaaagcaaattcgctctccgcacccctgaagacactgcggaggatacgtgtcatctcatccctggagtcgccgagtccgtggcgacctgtcactttaaccatagcagtaaaacgttcatggttatccatgggtggaccgttacgggtatgtacgagagctgggtgcccaagttggtagcagcgctgtataaacgggagcctgactccaatgttatcgttgttgattggttgagcagggcgcaggaacattatcccgttagcgccggttacacgaagttggtgggacaagacgtcgctagattcataaattggatggaggaggagttcaactatcctcttgataatgtgcacctcctgggttactccctgggtgcacacgcagctggaattgccggcagtctgacaaacaagaaggtcaatcgaattaccgggctcgatccagcaggtcccaactttgagtatgctgaggcaccgtcccggctttctcccgacgacgcagatttcgtggacgtacttcacactttcactcgaggaagccccggaaggtccatagggatacagaagccggtcggacacgtagacatctatccaaacggtggcactttccaacccgggtgcaatatcggcgaggccattcgtgtcattgctgaacgcgggctcggcgatgtagatcagcttgtaaagtgctctcatgagcgaagcattcatttgttcattgactcgttactgaacgaagagaatccgtctaaggcgtatcggtgctcctctaaagaggctttcgagaaaggtttgtgtctttcctgccgaaagaatcgctgcaataacctagggtacgagatcaacaaagtacgagccaaacgctcgtctaagatgtacctgaagactcgttcccagatgccttacaaagttttccactatcaggtcaaaatccatttttcaggcacggagtctgagacccatacaaatcaggctttcgaaatttccctctacgggacggtcgctgaatctgaaaacattcccttcactctaccagaggtctcgacgaataagacgtatagcttcttgatttataccgaagtagatatcggtgagctcttgatgcttaagttgaagtggaagagtgattcctacttctcatggtcggattggtggagttcgccgggattcgctattcaaaagatccgggtgaaggcgggcgagacccagaagaaggtgatattttgctcccgagagaaggtctcgcacctccagaaggggaaagccccagccgtgttcgtgaaatgccacgataaaagccttaataagaaatccggc

SEQ ID NO: 15799 - DNA, 1425 bp, Artificial Sequence
  Description of Artificial Sequence: Synthetic coding sequence
atggaatcgaaagcccttctcgtgcttactctcgcagtctggctgcaatcgcttaccgcttccagagggggtgtggcagcagccgatcagcgaagagatttcatagatattgagtcaaagtttgccctgaggaccccagaggatacggctgaagatacttgtcaccttatcccgggagtggctgaatccgtggcaacttgtcactttaatcatagctccaagacctttatggtgatccacggctggaccgtgaccggtatgtatgagagctgggtgccaaaacttgtcgccgcattgtacaagagggagcctgactcgaatgtcattgtcgtggattggctttcacgggcacaagaacactaccctgtgagtgcaggttacactaagttggtcggccaggatgtcgcacgattcattaactggatggaggaagagtttaactaccctctcgataacgttcatctgctggggtactctcttggtgcgcacgcggcaggaatcgccggaagccttactaacaaaaaggtcaatcgcattaccggactggatccagcgggacctaatttcgagtacgcagaggccccatcccgcctttcccccgacgacgcagattttgtcgatgtcctgcacacttttactcgagggtcgccagggcgttccatcggaatacaaaagcccgtcggacatgtggacatatacccaaacggtggaaccttccaacccggttgcaacattggagaagctatccgcgtgattgctgagcggggtctgggtgatgtcgaccagcttgtgaagtgctcgcatgaaaggagcattcatctgtttattgactccctccttaacgaagaaaatccctcaaaggcttatagatgtagctcgaaggaggcattcgaaaagggtttgtgcctctcgtgccggaaaaaccggtgcaataatctgggatacgaaatcaacaaagtgagagcaaagaggtcctccaagatgtatcttaagactcgctcccaaatgccatacaaagtgtttcactaccaagttaagatccatttttccggtactgaatctgagactcacaccaaccaagcatttgagatttcgctctacgggactgtcgcagagagcgaaaacattccatttaccctccccgaagtctctaccaacaagacgtactcattcttgatatacacggaagtggatattggggagttgcttatgctcaagttgaagtggaagtcggactcttacttcagctggtcagactggtggtcatcgccgggttttgcaattcaaaagatccgggtgaaggcaggggaaacccaaaagaaggtcatattctgtagccgggaaaaggtgagccatctccaaaagggaaaggcgcccgccgtgtttgtcaagtgtcatgacaaatccctcaacaaaaagtccggg

SEQ ID NO: 15800 - DNA, 1425 bp, Artificial Sequence
  Description of Artificial Sequence: Synthetic coding sequence
atggagagcaaggccctgctggtcctcacgctggcagtatggctccagtcacttaccgcctcacggggtggagtggctgccgcagatcagcgccgagacttcatagatatagagtcaaagttcgcacttcggaccccggaggatactgctgaggatacctgccacttgatcccaggggtggcggagtccgtcgccacatgccattttaaccattctagcaagacgtttatggtgatccacggttggacagttacagggatgtacgagagctgggtgcccaagctggtggcagcactgtacaagcgcgagccagacagtaatgtaatcgtggtggactggctcagtcgtgcccaggaacattaccctgtgtcggcgggttacactaaattggtggggcaggacgtcgcgagattcatcaactggatggaagaggagttcaactacccccttgataatgtacatttactgggctattccctgggcgctcatgccgccgggatcgccggtagcctcaccaacaagaaggtgaatcggataaccggcctcgaccccgctggtcccaacttcgagtacgctgaggccccttcacgactgtcccccgacgacgccgactttgtcgacgtactccacacgttcactaggggctcccccggaagaagcatagggattcagaaacccgtggggcacgttgacatctatcccaacggaggaacctttcagccgggatgtaacatcggggaagccatacgggtgattgcagaacggggcttgggggacgtcgaccaactggtgaagtgcagccatgagcgcagtatccatctctttattgactcactcttgaacgaggaaaacccgtcgaaggcttatcgttgttcctccaaagaagcttttgagaagggactgtgtctctcctgccggaagaatcggtgtaataacctgggctatgaaattaataaggtgcgggcaaagaggagctccaagatgtaccttaagacacgatctcagatgccttacaaggtcttccactaccaggtgaagattcacttcagtggtactgagtcggagacccacacgaatcaggccttcgagattagtttatatgggacagtcgccgagtctgagaatattccgtttaccctgcctgaagtgtccactaacaagacatactccttcctgatatacacagaggtcgacataggggagttattgatgctgaagctaaagtggaaatccgacagctatttttcttggagcgattggtggtccagtcctggcttcgcaatccagaaaatccgcgtgaaggctggggagacccaaaagaaggtcattttttgcagcagagagaaagtgagccacttacagaaaggcaaggcgcccgccgttttcgtgaaatgtcacgataagagtctcaataagaagagcggc

SEQ ID NO: 15801 - DNA, 1425 bp, Artificial Sequence
  Description of Artificial Sequence: Synthetic coding sequence
atggagtccaaggcgctgctggtgctgacgctcgcagtctggttgcaatcgctgaccgcttcccgcgggggcgtggctgcagctgaccaacgcagagatttcatcgatattgaatcaaagttcgccctcagaaccccggaggataccgccgaggacacttgtcaccttatccctggagtggcagagagcgtggcaacgtgtcacttcaaccactcgtcaaagaccttcatggttatccacggatggactgtgactggaatgtacgaatcctgggtgccaaaacttgtggccgctctctacaagagagagcctgactccaacgtgatcgttgtggactggctgtcaagggctcaagaacattacccggtcagcgctgggtacactaagctggtcggccaagacgtggccagattcatcaattggatggaagaggaattcaactacccgctggataacgtgcatctcctcggatactcgctgggtgctcatgctgccggaatcgcgggatcgctgactaacaagaaagtgaaccggataaccggccttgacccggcgggaccgaattttgaatatgctgaagctccaagcaggctgtcaccggacgatgcggactttgttgacgtgctgcacacttttaccagaggatcgccaggccggtcaattggcatccagaagccggtgggacacgtcgacatctacccgaatggaggaactttccagcccggatgtaatatcggagaagccatccgcgtcatcgcggagcgcggcctcggcgatgttgaccagctcgtgaagtgctcgcatgaaaggtctatccacctgttcatcgatagcctgctgaatgaggagaatccttcaaaggcatacagatgctcgtcaaaagaggctttcgagaaagggttgtgcttgtcctgccggaagaaccggtgcaacaacctgggttacgaaatcaataaggtccgggccaaacggagctccaagatgtatctgaaaaccagatcacagatgccgtacaaggtgtttcactaccaagtgaagatccatttctccggaactgaaagcgaaacccacactaatcaggcattcgagatctcactctacgggactgtcgccgaatccgagaacatcccattcactctccctgaagtgtcgactaacaagacttactcattcctgatctacactgaagtggatatcggcgagctgctgatgctgaaattgaagtggaagtcggactcgtacttcagctggtccgactggtggtcctctccgggctttgccattcaaaagatcagagtcaaagcaggtgaaacgcagaaaaaagtcattttctgctcccgggaaaaggtttcccatctgcagaaggggaaggcgcccgcagtgttcgtgaagtgccacgacaagtcgcttaacaagaagtcagga

SEQ ID NO: 15802 - DNA, 1425 bp, Artificial Sequence
  Description of Artificial Sequence: Synthetic coding sequence
atggaatcgaaagcgttactagtattaacgttagcggtatggctacaatcgctaacggcgtcgcgtggtggtgtagcggcggcggatcaacgtcgtgattttatagatatagaatcgaaatttgcgctacgaacgccggaagatacggcggaagatacgtgtcatttaataccgggtgttgcggaatcggttgcgacgtgtcattttaatcattcgtcgaaaacgtttatggtaatacatggttggacggttacgggtatgtatgaatcgtgggttccgaaattagttgcggcgttatataaacgtgaaccggattcgaatgttatagtagtagattggttatcgcgtgcgcaagaacattatccggtttcggcgggttatacgaaattagtaggtcaagatgttgcgcgatttataaattggatggaagaagaatttaattatccgctagataatgtacatctattaggttattcgctaggtgcgcatgcggcgggtatagcgggttcgttaacgaataaaaaagttaatcgtataacgggtttagatccggcgggtccgaattttgaatatgcggaagcgccgtcgcgtttatcgccggatgatgcggattttgttgatgttctacatacgtttacgcgtggttcgccgggtcgatcgataggtatacaaaaaccggtaggtcatgtagatatatatccgaatggtggtacgtttcaaccgggttgtaatataggtgaagcgatacgtgtaatagcggaacgtggtttaggtgatgttgatcaactagttaaatgttcgcatgaacgttcgatacatctatttatagattcgttactaaatgaagaaaatccgtcgaaagcgtatcgatgttcgtcgaaagaagcgtttgaaaaaggtttatgtctatcgtgtcgtaaaaatcgatgtaataatctaggttatgaaataaataaagtacgtgcgaaacgatcgtcgaaaatgtatttaaaaacgcgttcgcaaatgccgtataaagtttttcattatcaagtaaaaatacatttttcgggtacggaatcggaaacgcatacgaatcaagcgtttgaaatatcgctatatggtacggtagcggaatcggaaaatataccgtttacgttaccggaagtatcgacgaataaaacgtattcgtttttaatatatacggaagttgatataggtgaattattaatgttaaaactaaaatggaaatcggattcgtatttttcgtggtcggattggtggtcgtcgccgggttttgcgatacaaaaaatacgtgtaaaagcgggtgaaacgcaaaaaaaagttatattttgttcgcgtgaaaaagtttcgcatttacaaaaaggtaaagcgccggcggtttttgtaaaatgtcatgataaatcgctaaataaaaaatcgggt

SEQ ID NO: 15803 - DNA, 1425 bp, Artificial Sequence
  Description of Artificial Sequence: Synthetic coding sequence
atggaatccaaagccctgctggtgctgactcttgcagtgtggcttcaaagcctgaccgcatcccgaggtggtgtggcagccgccgaccaaaggagagactttatagatattgaaagtaagtttgcgctccggaccccagaggacactgccgaagatacttgccatcttatacctggggtcgcggaatcagtggcaacctgtcacttcaatcactcatcgaaaacctttatggtgatccatggttggaccgtgaccggcatgtacgagtcctgggtgcctaagctggtggctgcattgtacaaaagagagccagactcgaatgtcattgtggtggattggctttcgagagcacaggaacattaccctgtctccgccggatacaccaagctggtggggcaagatgtggcacgcttcataaactggatggaagaagaattcaattaccctctggataatgtccacttgcttggttactccctcggggcacatgccgcaggaatcgcaggatcccttacgaacaagaaggtgaataggattaccgggcttgacccagcgggaccgaacttcgagtacgccgaagctcctagtaggttgagcccagacgatgcggatttcgtggacgtccttcataccttcacccgtgggtcccctggccgttcaatcggtatccaaaaacccgtggggcatgtggacatctaccccaacggtggcaccttccaacccggatgtaatatcggagaagctatccgcgtgattgcagaaagaggtcttggggatgtcgaccaacttgtgaagtgttcgcatgaaaggagcattcatcttttcattgatagcctgctcaacgaagaaaacccttcaaaggcataccggtgctcctcaaaggaagcatttgaaaagggactgtgtctctcgtgcagaaagaaccgttgtaacaacctgggatacgaaatcaataaagtccgtgcaaagcgcagcagcaaaatgtacttgaaaacgagatcccagatgccctacaaggtgttccattaccaagtgaaaatccacttctcgggaaccgagtcggagactcatactaatcaggcattcgagatttccctctatggtactgtcgcagaatcggaaaacatccctttcacgcttccggaagtttcgacgaacaaaacctactcgttcctgatttacacggaagtcgacattggtgagctcctcatgctcaaacttaagtggaagtcagatagctacttctcgtggagcgactggtggtcgtctccaggctttgccatccagaaaatacgtgtcaaagcaggcgaaactcagaagaaagtgattttctgtagcagggaaaaagtctcccatttgcagaagggaaaggctccagcagtctttgtcaagtgtcatgataagagcctcaacaagaagtccggc

SEQ ID NO: 15804 - DNA, 1425 bp, Artificial Sequence
  Description of Artificial Sequence: Synthetic coding sequence
atggaatccaaagccctactcgtcctgactctcgccgtttggttacaatccctcactgcctcacgggggggggtggctgccgcagatcagagacgtgactttatagatatcgaatctaaattcgccttgcgaactcctgaggatactgccgaagatacatgtcacttaatacccggagtggccgaatcagtcgccacttgccactttaatcatagtagtaaaacttttatggtcatacatgggtggacagtgacagggatgtatgagagttgggtccccaaacttgtcgcggctctatataaacgcgaacccgatagtaacgtgatcgtcgttgattggctttctcgggctcaggaacactaccctgtctcagcaggatatactaagctcgtgggacaggatgtggcacgctttattaactggatggaagaggagttcaactatccattagacaatgtacaccttcttggatacagtcttggggcacatgcagcaggaatagccgggtctcttactaataaaaaagtcaataggattacagggttagatcccgccggacccaacttcgaatatgctgaagccccctctcggttatctcccgatgatgccgattttgtggatgtgttacatactttcacacggggaagtcctgggagaagtataggaatacagaaaccagtcgggcacgtagatatctatcctaacggaggaactttccagcctgggtgcaatataggagaagctataagggtgatagccgaaagagggttaggggatgtggatcagctggtgaaatgctcacatgaacggtccatccacctttttatcgactccctgctcaatgaggaaaacccctccaaggcatatcgatgttcctccaaagaagcatttgaaaaaggactgtgtctctcttgtcggaaaaataggtgcaataacctgggatacgaaataaacaaagtgcgcgctaaaagatcctccaaaatgtatctgaaaactcgctcacagatgccctataaagtgtttcactaccaggtgaagattcatttctctggaactgaatccgaaacacatacaaatcaagccttcgaaatctccctttatggaactgtggcggagtctgaaaacatccctttcactctccccgaagtttccacaaacaaaacttatagtttcctcatatatacagaggttgatatcggggaactactgatgctaaagctcaagtggaaatctgattcatatttttcatggtcagattggtggtcttctcccgggtttgccatacagaaaatccgggttaaggctggggaaacacagaaaaaagtcatcttttgttctcgggaaaaggtctcacatctccaaaaggggaaagctcctgcagtgtttgtgaagtgccatgacaaaagtctcaacaagaaatcggga

SEQ ID NO: 15805 - DNA, 1425 bp, Artificial Sequence
  Description of Artificial Sequence: Synthetic coding sequence
atggaaagcaaggctctccttgtgctcaccctggccgtttggctccagagccttaccgccagccgcggcggcgtggccgccgcggatcagaggagggatttcatagatatcgaatctaagttcgcgctgagaacccccgaggataccgctgaagacacatgtcacctcatccctggggtcgctgagagcgtggcaacctgccatttcaaccacagcagcaagacatttatggtgatacacggatggacagttaccggtatgtatgagagttgggtccccaagttggtggccgctctttacaaacgcgagcctgactctaacgtgatcgtagtcgattggctgtcaagagcacaggaacattacccagtaagcgctgggtatactaagctcgtgggtcaggatgtggctcgatttataaactggatggaagaagagttcaactaccccttagataatgtgcatcttctggggtactcacttggcgcacacgcggctggtatcgccggatccctcacaaataaaaaagtgaaccgcatcacagggctggaccctgccggaccaaactttgaatacgccgaggccccttctcgcctgtctccagatgatgcagatttcgtggatgtcctgcacacttttacgagaggatccccgggaagaagtatcggcatacagaaaccagttgggcacgtggatatttaccctaacggtggtacctttcagcctgggtgcaacatcggtgaagccattagggttattgctgagagagggctcggtgatgtggaccagttggtgaaatgttcccacgagaggagcatccacctgtttattgacagcctgttgaacgaggaaaaccccagcaaggcctacaggtgttccagtaaagaggcattcgagaagggactttgcctcagctgcagaaaaaaccggtgcaataacctgggttacgaaatcaacaaggtccgagccaagagatctagcaagatgtatctcaaaactcggtcgcagatgccttacaaggtgttccactaccaggtcaagatccactttagcggaacagaaagcgagacccataccaaccaagcttttgaaatctccctctatgggaccgtcgccgaatctgagaatattcctttcaccctgcctgaagtcagtaccaacaagacctattcttttctcatatacacagaggtggacattggcgaactgttgatgctcaaactgaaatggaaatcagacagctattttagctggagtgattggtggtccagcccagggtttgcaatccagaaaattcgtgtgaaggctggagagacccagaaaaaagtcatcttctgttcacgtgaaaaagtaagccatctgcagaaaggaaaagctcccgccgtgttcgtaaagtgtcacgacaaaagcttgaacaaaaaatccggt

SEQ ID NO: 15806 - DNA, 1425 bp, Artificial Sequence
  Description of Artificial Sequence: Synthetic coding sequence
atggagtcgaaggccctgctcgtgctgactctcgcggtttggctccagagcctgaccgcctctagaggtggggtggctgcagccgaccagcgaagggatttcatcgacattgaatctaaatttgcgctgagaacaccggaggataccgctgaggatacttgccacttgataccaggagtggccgagtctgtagcaacatgtcatttcaaccacagtagcaaaaccttcatggtgattcacggctggaccgttactggcatgtacgaatcgtgggtacccaagctggtggcggctttatacaaacgagagccggactcgaacgtgatcgtggtcgattggttgtctagggcgcaggaacattatcctgtgtcggctggctacactaaactcgtaggccaggacgttgcgcggtttatcaattggatggaagaagagtttaactatcccctggataacgtgcacctgcttgggtatagcttgggtgctcatgcagccgggatcgcgggaagtctgacgaacaagaaggtcaaccggattactggacttgaccccgctggaccaaactttgagtacgcagaagcgcccagcaggctgtcccccgatgacgctgactttgtggacgtcctgcacacatttacaaggggcagcccaggacggtcgatcggcatccagaagcccgtaggacatgtcgatatataccctaacggaggaacattccagccgggctgcaatataggcgaagccattcgagtcattgctgagcgcgggctgggcgatgtggatcagctggttaaatgttcacatgagaggtcgatccatctgttcatcgattctctccttaacgaagagaacccatctaaagcataccggtgtagctctaaagaagcttttgaaaagggcctgtgtctgtcctgtcgtaaaaatcgctgcaacaatctcggctacgaaatcaacaaagtgcgtgcaaagcgatcatctaagatgtatctgaagaccagatcacaaatgccctacaaggtgtttcactaccaagttaagatccatttttccggcacagagtccgaaacgcacacaaatcaagcctttgaaatcagtttgtacgggaccgtggcagaatctgagaatattccattcacgctgcctgaagtgtcaaccaataagacttatagtttcctgatctacactgaggtagacataggcgagctattaatgctaaagttgaagtggaagtctgactcttatttttcctggagtgactggtggagctcacccggcttcgccatccaaaaaattcgggtgaaagcgggtgagactcagaagaaagtcattttctgttccagggaaaaggtatcccatcttcagaagggcaaggccccagcggtttttgtgaaatgccacgataagtccttaaataagaagagtgga

SEQ ID NO: 15807 - DNA, 1425 bp, Artificial Sequence
  Description of Artificial Sequence: Synthetic coding sequence
atggaaagtaaggccctactggttttaacactggccgtgtggttacagagtctcactgcttcaagggggggtgtcgccgcagccgaccagcgaagggatttcatcgacattgagagcaaattcgccctgagaacacctgaggacacagcagaagatacatgccacctgatccctggcgtggctgaatcagttgctacatgccattttaaccactcatcaaagacattcatggtcatccacgggtggactgtgacagggatgtatgaaagctgggtccccaagttggttgctgcgctgtacaagcgcgagccagatagcaatgtgatcgtagtagactggctgtcacgagcacaggagcactatcctgtctcagccggttacactaagttggtggggcaagacgtcgcgcgattcattaattggatggaagaagaatttaactatccgcttgacaacgtgcatctgctaggttattctcttggggcacacgctgctgggatcgctggctcactaaccaataagaaagtaaaccgcataactggcctggatccagccgggccaaatttcgagtatgcagaagcgcctagccgtttatccccagatgacgctgacttcgttgatgttttacacaccttcaccagggggagtccagggagaagtatcggtattcagaagcctgtggggcatgtggacatttacccgaacggcgggacctttcagccgggttgtaatattggggaagccataagagtgatcgccgaacgagggctgggcgacgtggatcagctggtaaagtgctcgcacgagcgatcaatccatctgttcatcgatagcctgctgaacgaggagaacccatctaaggcctatcgatgttcatcaaaggaagcttttgagaagggtttatgcctgtcctgtaggaagaatcggtgtaacaacttgggctacgagatcaacaaggtgcgagcgaaaagaagctctaagatgtatctgaagacaagatcccaaatgccttataaggtctttcactaccaagtgaaaatccatttctccgggacagagtctgaaacacacaccaaccaggctttcgagattagcctgtacggcaccgttgccgagagtgaaaacattccctttacattaccagaggtgagtaccaacaagacctacagcttcctgatttatactgaggttgatatcggtgagctcctgatgcttaaactgaagtggaagagcgactcttacttctcttggagtgattggtggtcaagccccggattcgccatccagaagatcagggtaaaggccggtgagacccagaagaaagtgattttctgctctagagaaaaggtgagccacctgcaaaagggtaaagctcctgcagtattcgttaagtgtcacgacaagtctctcaataagaagagcggc

SEQ ID NO: 15808 - DNA, 1425 bp, Artificial Sequence
  Description of Artificial Sequence: Synthetic coding sequence
atggaaagcaaggctctcctggtgctgacccttgcagtctggctccaatcccttaccgcaagcaggggaggtgtggcagcagcggatcaaaggagagatttcatcgacattgagtccaagttcgcacttagaaccccagaagataccgccgaggacacctgccacctgatacctggtgtcgccgagtccgtggccacttgtcatttcaaccattcctcgaaaacttttatggtgatccacggctggaccgtgaccggtatgtacgaaagctgggtcccaaaactggtggcggccctgtacaaaagagaacctgactcgaatgttattgtggtggattggttgtccagagcacaggagcactatcctgtgtcggcaggatacactaagctcgtcggacaagatgtcgcacgattcatcaactggatggaggaagagtttaactacccccttgataacgtgcatctgctgggctactccttgggtgctcatgcagcaggaattgcgggatcgctgacgaacaagaaggtcaacaggattactggtcttgacccagcaggcccaaatttcgaatacgcagaagcaccatcaagactgtcgcctgacgatgcggattttgtcgacgtgcttcacactttcactcgaggctcacctggacggtccattggaatccagaagcctgttggacacgtggacatttacccgaacggtggcacctttcagcctggttgtaacattggggaggcgatcagagtgattgctgaacggggtctgggtgatgtcgaccagctggtgaaatgcagccacgagcgttcgattcacctgttcatcgattcacttcttaacgaagaaaacccgagcaaggcataccggtgttcctccaaggaagcattcgaaaaaggactgtgtctgtcctgtcgaaagaacagatgcaacaacctcgggtacgaaatcaacaaggtgcgggccaagagatcgtcgaagatgtatctcaagaccaggagccaaatgccatacaaggtttttcactaccaagtgaagatacatttttcgggaactgagagcgaaacccacactaaccaggcattcgaaatttcactgtacggcacggtggccgagagcgagaacatccccttcaccctgcctgaagtctccactaataagacgtactcgtttttgatatacaccgaagtggatatcggagaactgcttatgttgaagttgaagtggaagagcgattcgtacttttcttggtcggattggtggagctcccccggatttgcgatccagaaaatacgagtgaaggcaggagaaactcaaaagaaagtcattttctgttcgcgggaaaaggtcagccacctccagaagggtaaggcccccgcagtgtttgtgaagtgtcatgataagagcctgaataagaaatcaggg

SEQ ID NO: 15809 - DNA, 1425 bp, Artificial Sequence
  Description of Artificial Sequence: Synthetic coding sequence
atggagtctaaggcactgctggtcttgacattggcggtctggttacagagtttgactgcttccaggggaggtgtcgccgctgccgaccaacggcgggatttcattgatatagaatctaagtttgcattgagaacaccggaggataccgcagaggacacatgccacctcattccgggcgtagcagagtccgtagccacttgtcacttcaatcactcttctaagacctttatggtaatccacggatggaccgtcactggtatgtacgaatcttgggtgcccaagcttgtcgcagccctgtacaagagagagcccgattctaatgtcatagtggttgactggctgtcaagggctcaggagcactaccccgtgagcgccggatatactaagttagtcgggcaggacgtggcccgcttcatcaattggatggaggaagagtttaattatccgctcgataatgtgcatcttctggggtacagcctaggcgctcatgctgccgggatagccggatcgctcactaacaagaaggtgaataggatcaccggcctggatcctgctggaccaaacttcgagtacgccgaagccccctctagactgtcacccgacgacgctgactttgtggatgttctgcacacattcacacgagggagtcctggtcggagcatcggcatccaaaaacctgtcggccatgtcgatatttaccctaacggcggcaccttccagcctggatgtaacataggagaagctattcgtgtgatcgccgagcgggggctaggagacgtggatcagcttgtgaagtgttcccacgagcgttcaatccatcttttcattgatagcctactcaacgaggagaatccatctaaggcataccgctgttcttccaaggaggcattcgagaagggcctgtgtctcagttgcaggaagaatcggtgcaacaatctgggatatgagatcaataaggtgagggcgaaaaggtcaagtaagatgtacctcaagactaggagtcaaatgccctataaggtgtttcactaccaggtgaaaattcacttctctggaacagaaagcgaaactcataccaaccaagccttcgagatttcactgtatggcaccgtagcagagagtgagaacatcccattcaccctgcccgaagtgagcactaataagacgtactcattccttatctacaccgaggttgatataggagagttgcttatgctcaagctgaaatggaaatctgatagctattttagttggtccgattggtggtcaagtccgggcttcgctattcagaagattcgcgtcaaagcaggtgagacacagaaaaaggtgatcttctgctcacgcgaaaaagtttcccatctgcaaaaaggcaaagctccagcggtgtttgtcaagtgccacgacaagtcacttaataagaagagcgga

SEQ ID NO: 15810 - DNA, 1425 bp, Artificial Sequence
  Description of Artificial Sequence: Synthetic coding sequence
atggaatcaaaggcactactggtcttgactcttgcagtgtggctgcagagtctgacggcctctcgcggaggagtggcagccgccgaccaaaggcgcgatttcatcgatatcgagtcaaaatttgctttgagaacccccgaggataccgctgaagacacatgtcacttaatcccaggtgttgctgaaagcgttgctacatgtcattttaatcactccagtaagacattcatggtcatacatggatggaccgtcacggggatgtacgaatcttgggttcccaaactcgttgcagctctgtataagcgcgagccagactccaacgtgattgtggttgactggttatcaagggcgcaagagcactaccccgtgagcgcagggtacacaaagcttgtggggcaggatgttgcacggtttatcaactggatggaggaggagtttaactatccccttgataatgtgcacttgctgggttactcactgggagcacatgccgcaggcattgccggctccttgactaataaaaaagttaatcgcattaccggcttggacccagccggtcccaactttgaatacgccgaggccccatcacggttgtctcctgatgatgcggacttcgtggatgttctccacacattcacccgcggtagtcccggccggtctataggcatccagaaaccagtcggccatgtcgatatataccccaatggggggactttccagcccggctgtaatattggagaagcaattcgcgtcattgccgagagaggattaggcgatgtggaccaattggtgaaatgctcccacgaacggagcatccacttgttcatagattcactgctcaatgaggagaatccatctaaagcctacagatgtagcagtaaggaagccttcgagaaggggttatgtctgagttgccgtaagaacaggtgtaataaccttgggtacgagatcaataaggttagagccaagaggtcctcaaagatgtacttgaagaccaggtctcagatgccctacaaggtttttcactatcaggtgaagatccatttcagcggaaccgagagcgagacccatacgaatcaggccttcgagatctccctgtacggaactgtcgcggagtccgaaaacatcccctttacactgcctgaagtctccactaataagacctatagctttctgatttatacggaagtggacatcggtgagctcttaatgttgaagctgaagtggaaatccgattcttacttcagttggtccgactggtggagctctcctggatttgctattcaaaagatacgggtgaaggccggcgaaacccaaaaaaaggttattttttgtagcagagaaaaagtaagtcatctgcagaagggcaaggcacctgcagttttcgtaaagtgccacgacaaatccttgaataagaaatcaggc

SEQ ID NO: 15811 - DNA, 1425 bp, Artificial Sequence
  Description of Artificial Sequence: Synthetic coding sequence
atggaatcgaaagcattgctcgttcttaccttggcagtgtggctccaatcccttactgcgagcagagggggcgtggccgccgccgaccagcggagagatttcattgacatagaatccaagtttgctttgaggaccccagaagataccgccgaggacacctgccatctgatacccggagtggcagaatcagtcgcaacctgccactttaatcattcttcaaagactttcatggttatccatggatggactgtcaccggtatgtacgaatcctgggtgcccaaactcgtggcagcactttacaaacgcgaacctgactccaatgtcattgtggtggactggctgtcacgggcgcaggaacattaccctgtgtccgcaggttataccaagttggtaggccaagacgtcgcccggtttatcaactggatggaagaagagttcaattatccacttgataacgtgcacctgctgggatactcccttggcgcccacgctgcaggaatcgcaggcagcctgaccaacaagaaggtcaaccgaataactggactggaccctgcaggaccaaactttgaatacgccgaagcacccagccgactttctccagatgatgcggattttgtggatgtgcttcatactttcacccgagggagccctggccgctcgattgggatccaaaagccagtcggtcatgtggacatttacccgaatggagggacttttcagcccggatgcaacatcggggaagcaatccgggtgattgccgaacggggtcttggagatgtggatcaacttgtgaaatgctcgcatgagagatccattcatttgtttatcgactcactgcttaacgaagaaaatccgtccaaggcgtatagatgtagctccaaggaggccttcgagaaaggtctttgtctgtcctgccggaagaataggtgtaacaacctgggctacgagattaacaaagtgcgggctaagcggtcctcgaagatgtaccttaaaacccgctctcagatgccctacaaggtgtttcattaccaggtgaagattcatttttctggcacggaaagcgagactcacaccaaccaagccttcgaaatttcactttacgggactgttgcagagtcagaaaacatcccgtttactcttcctgaagtctcaaccaacaaaacttactcctttttgatttacaccgaagtcgacatcggtgagctcctgatgcttaagctgaaatggaagtcagattcatacttcagctggtcggattggtggtcctccccaggttttgcaatacagaagatcagggtgaaggcaggggaaacgcagaaaaaggtgatcttctgttcgcgagaaaaggtgtcgcatctgcaaaaaggcaaggcccctgcagttttcgtgaaatgtcacgataagtcgcttaacaaaaagagcggt

SEQ ID NO: 15812 - DNA, 1425 bp, Artificial Sequence
  Description of Artificial Sequence: Synthetic coding sequence
atggagagcaaagcccttcttgttctgaccctcgccgtgtggctccagtctctgaccgccagtcggggaggagtggcagctgccgaccagcgcagggattttatagatattgagtccaaattcgcattgcgaactcccgaggataccgcggaagacacttgtcacctcatccccggcgttgccgaaagcgtagccacctgtcactttaaccactcctcaaagaccttcatggtaattcatggctggacggtcaccggcatgtacgagtcttgggtgccgaagctggttgctgctctgtacaagagagaacccgatagtaacgtcatcgtggtggattggctgtccagagcccaggaacattatccggtcagcgcaggatataccaagttggttggtcaagacgtggccagatttataaactggatggaagaagagtttaattatcctctcgacaacgtacaccttttgggatactctctgggagcccatgccgccggtatcgccggctccctcacaaacaaaaaagttaacaggattactggcttggaccctgcgggacccaacttcgaatatgccgaggcgcccagcaggcttagtcccgacgacgctgacttcgttgatgtcctccatacctttacaaggggaagtcctgggcggtccatcggtatacagaaacctgtggggcatgttgacatctatcctaatggcggcacctttcagccaggatgcaacattggtgaggccatacgggtaatcgccgaaaggggcttgggagacgtggatcagctcgtaaagtgctcacacgagcgcagcatccacctattcatagactccctgttaaatgaagagaatccgtcaaaggcatataggtgctcgagtaaggaggctttcgagaaaggactttgcttgagttgtcggaagaatcggtgtaacaacctaggatatgaaattaataaagtgagggccaaacgcagcagtaaaatgtatctgaagacacggagccaaatgccatataaggtgtttcattatcaggtcaaaattcacttttccggcaccgaatcggagacgcatactaatcaggcctttgaaatctccctgtacgggaccgtggcagaaagcgaaaatataccatttactttacctgaggtcagcactaacaagacctactcctttttgatctataccgaagtggatattggcgaactccttatgcttaagctcaagtggaagtccgactcctatttctcctggtctgactggtggagctcccccggattcgccatccagaaaatcagggtgaaagctggagagacgcagaagaaagttatattctgctcccgggagaaagtctctcacctgcagaagggtaaggctcctgctgtgttcgtgaaatgtcacgacaagtctctaaataagaaaagcggg

SEQ ID NO: 15813 - DNA, 1425 bp, Artificial Sequence
  Description of Artificial Sequence: Synthetic coding sequence
atggaatccaaagcactcctggtgctcactctcgcggtctggctgcaatcgcttaccgcttcgagaggaggggtggctgccgcagatcagagacgggatttcatagacatagaatcgaagttcgcacttagaacgccagaagataccgcagaagatacctgccacctgattccaggcgtcgcggagagcgtggcaacttgtcatttcaaccattcgagcaagacctttatggtgatccatggttggaccgtcaccggaatgtatgagagctgggtgcccaaacttgtggccgcactgtacaagcgcgaacctgacagcaatgtgatagtggtggactggctttcaagagcacaggaacattacccagtatcagctggatacactaagttggttggacaagatgtggcccgctttatcaactggatggaagaggagtttaactaccctcttgataatgtgcatctgctcggatactctcttggtgcacacgctgcgggcatcgcaggctccctgacgaacaagaaggtgaacagaatcactgggcttgaccccgcagggccaaatttcgagtacgcagaagctccatcaaggctcagcccggacgatgctgacttcgtggacgtgctccatacgtttactaggggttcgccaggaaggagcatcggcattcaaaaaccagtcggacacgtcgacatttaccccaacggaggcacttttcaacctggatgtaacattggggaagccattagagtcatcgctgaaagaggactcggcgatgtggatcagcttgtgaagtgtagccatgaaaggtcaattcacctcttcattgactcccttctcaacgaggaaaatccctccaaggcctacagatgctcatccaaggaggcctttgagaagggcctttgcctgtcatgtcgcaagaaccgttgcaacaaccttgggtacgagatcaacaaggtgcgggccaagcggtcctccaagatgtacctcaaaacccgatctcaaatgccttacaaggtctttcattaccaggttaagattcactttagcggaaccgagagtgaaacgcataccaatcaggcttttgaaataagcctttacggaactgtggcagagtcggagaacattcctttcactctgcctgaagtgtccaccaacaaaacctattccttcctcatctataccgaagtggatattggagaacttctgatgttgaagctcaagtggaagtcggactcatactttagctggagcgattggtggtcatccccggggttcgcaattcagaagattagggtgaaagccggcgaaacccaaaagaaggtcattttctgctcacgggaaaaggtgtcccacctccaaaaagggaaagctccagccgtgtttgtgaagtgtcatgataagtcgctgaataagaagtcaggg

SEQ ID NO: 15814 - DNA, 1425 bp, Artificial Sequence
  Description of Artificial Sequence: Synthetic coding sequence
atggaatcgaaggcacttctggtactgacccttgctgtgtggcttcagtccctgactgcctcccgtgggggagtcgcagcagcagatcaaagacgcgactttatcgatattgaatcgaagtttgcactccggacccctgaggacactgccgaggatacgtgccatctgattccaggagtcgccgaatcggttgccacctgtcatttcaaccattcctccaaaacctttatggtgatccacgggtggacggtgactggtatgtacgagtcctgggtgccgaagctcgtcgcagcactttacaagcgggaaccagactccaatgtgattgtggttgattggctgtcgagagcacaagaacattacccagtgagcgccggatataccaagttggtgggccaggatgtggcgcgtttcattaactggatggaggaagagtttaactacccactcgataatgttcacttgctcgggtactcgctgggcgcacacgcggcaggtatcgcgggttcactgactaacaagaaggtgaacagaattaccggccttgatccagccggtcctaacttcgagtacgccgaggcgccttcacgactttcgccagacgatgcagactttgtcgatgtccttcatacttttacgagaggaagccctgggcgatcaatcggtatccagaagcctgtaggacatgtcgacatataccctaatggaggtacgttccaaccaggatgtaatatcggtgaagcaatccgggtgatcgcagaacgtggtcttggagatgtggaccaactcgtgaagtgttcccacgagcgctcgatacatttgtttatagactccttgcttaatgaagagaatccttccaaggcatatcgttgctcctccaaggaagcatttgaaaaaggactctgtctttcgtgtagaaaaaacagatgtaataacctcggctacgagattaacaaagtcagggccaagagatcgagcaagatgtacctcaagacccgctcgcagatgccttacaaggtttttcattaccaggtcaagattcacttcagtggtactgaatcagaaacccacaccaaccaagcgttcgaaatttccctgtacggcactgtcgcagaaagcgaaaacattccatttacgctgcctgaggtgagcactaacaaaacttactccttcctgatttacaccgaggtcgatattggcgaactcctgatgttgaagctcaagtggaagagcgatagctacttttcctggagcgactggtggtcgtcacctgggtttgcaatccagaagatacgtgtgaaggccggggaaacccagaagaaagttatcttctgttcgagggaaaaagtgtcgcacctgcagaaaggcaaagcaccggcggtctttgtgaaatgccatgataagtcgctgaacaagaagagcggc

SEQ ID NO: 15815 - DNA, 1425 bp, Artificial Sequence
  Description of Artificial Sequence: Synthetic coding sequence
atggagagcaaagcccttctcgtgttgaccttggcggtgtggttgcagtccctcactgcctcccggggaggagtcgcggcagcagatcaacgtcgcgactttatagatatagaatcaaagttcgcactgcgtactcccgaggacaccgctgaggacacttgtcatcttattccaggagtggcggagtccgtggcaacttgtcatttcaatcattcgagcaagacttttatggttatccatggttggaccgtaaccggtatgtacgaatcatgggtccctaagctggtggcagctctgtacaagagagaacccgacagcaatgtaattgtagtggattggttgtcccgagcacaagaacactaccctgtttcggccggatacaccaaactggtgggtcaagatgtggcacggtttatcaattggatggaagaggagttcaactacccactcgacaacgttcatcttctgggatattctctgggagcacatgcagccggaatagcggggtcgctgaccaacaaaaaggtgaaccggattactggcctcgacccagccggtccaaatttcgaatatgcagaagctcccagccgcttgtcgccggatgatgccgattttgtggacgttctccacacttttaccaggggctcaccaggcagatccattggaattcaaaagccagtggggcatgtggatatctaccctaacgggggcactttccaacctggttgcaatatcggtgaggccatccgggtgatagcagagaggggcctgggggacgtggatcaacttgtcaaatgctcccacgaaagatcgattcacctctttattgatagcctgctgaacgaagaaaacccgtctaaggcatacagatgttcatccaaggaggcatttgagaaggggctttgcctctcctgtaggaagaatcgctgtaacaacctcgggtatgaaatcaataaggtgagagccaagagatcctcgaaaatgtaccttaagacgcgctcgcagatgccttacaaggtgttccactaccaagtcaaaattcatttttccggtaccgaatcggaaacccacaccaaccaggcttttgaaatttccctctacggcactgtcgccgaaagcgaaaacattccttttaccttgccagaagtctcgactaacaagacgtacagctttctgatctataccgaggtcgatatcggagagcttctgatgctgaaacttaaatggaagtcggattcgtactttagctggagcgattggtggtcatcgcctggtttcgcaatccagaaaatacgcgtgaaggcgggagaaacgcagaagaaagtgattttctgttctagggagaaagttagtcacctccagaagggaaaggcaccggccgtgtttgtgaagtgccatgacaagagcctgaacaagaagtcggga

SEQ ID NO: 15816 - DNA, 1425 bp, Artificial Sequence
  Description of Artificial Sequence: Synthetic coding sequence
atggaatcaaaggccctgctcgtgctgacactcgctgtctggctccagtcactgaccgccagcagagggggggttgccgctgccgaccagcgccgcgactttatcgatatcgagtccaaatttgctctcagaacccccgaggacacagctgaagatacctgtcacttaatccctggcgttgctgaaagcgttgctacctgtcacttcaaccacagtagtaagacctttatggtgatacatgggtggaccgttactgggatgtacgagagctgggtgcctaaactagtcgctgctctgtataagcgcgaacctgattcaaacgtgatcgtggtggattggttgtcacgtgcacaggaacactaccctgtgagcgccggctacaccaagctggtcggccaggacgtggcacgattcattaattggatggaggaggagttcaactatcccttagacaatgttcatctactgggatactccttgggtgcacacgctgccggcatagctgggagcctgactaacaagaaggtgaaccggatcaccgggttagaccctgcaggcccaaactttgagtacgctgaggccccatcccgcctgagccctgacgacgccgacttcgtggacgtgttgcatacctttacccgaggatctcccggccgttccattggcatacaaaaaccagtggggcacgtggacatttacccaaacggcggcacctttcagcccggctgcaatattggtgaggccattcgtgttatcgctgagcgtggcttaggcgacgtcgaccagctcgtgaaatgtagccacgaacgaagcatacatctgtttatcgatagtctgctcaatgaagagaatccctccaaagcatatcgttgtagtagcaaagaagcttttgagaagggactgtgtctgagttgccggaagaatcggtgcaacaatctgggttacgagatcaacaaggtgcgagcaaaacgcagttctaagatgtacctgaagacccgttcacagatgccatacaaggtattccactatcaggtgaaaatccactttagcggcaccgagagcgagacacacaccaatcaggctttcgagattagcctgtacggcaccgtagctgaatccgagaacatcccattcacactgccagaggtttcaaccaacaagacctactcatttttgatctacacagaggtagacataggggaactgttgatgctgaagttaaaatggaaatccgatagctacttcagttggtcagactggtggagttccccaggatttgcaatccaaaaaataagagtcaaagcaggcgaaacccagaagaaggtcatcttctgctctcgggagaaagtgagtcaccttcagaaaggcaaagcaccagctgtgttcgtgaaatgccacgacaaatccctaaacaaaaagagtggc

SEQ ID NO: 15817 - DNA, 1425 bp, Artificial Sequence
  Description of Artificial Sequence: Synthetic coding sequence
atggagagtaaggctctgcttgtgcttacattggcggtgtggctccaatcactcactgctagcagaggcggagtggcagccgctgatcagcgccgggactttatcgacatagagtctaaatttgctctccgaacaccagaggacactgccgaggacacttgtcacctgattcccggagtagctgagtctgtggctacttgccacttcaaccatagtagtaagaccttcatggtcatacacggctggaccgttactggaatgtatgagtcttgggtcccaaagctggtcgctgctctatacaaacgcgaacccgatagtaacgtaatcgtcgtcgattggctgagcagggcccaagagcactaccctgtgagtgcaggctataccaagctcgtggggcaggacgtggcccggttcatcaactggatggaagaggaatttaattatccgttagacaatgtgcatttgctaggctattctttgggtgctcatgccgctggcatcgcagggagtttaactaataaaaaggtcaacagaattactgggttggaccccgcaggcccaaattttgagtatgccgaagccccttcccggctaagtcccgatgacgcagatttcgtcgatgtcctgcacacattcacacgcggcagcccaggccggagtatcggaattcaaaagccagtgggacatgttgacatttacccaaacggaggtacttttcaaccagggtgtaacatcggtgaggccattcgggtcattgcagagcggggacttggcgatgtcgatcaactggtgaaatgttcccacgaaaggtctatacacctgttcattgattccttgctgaacgaagagaatcccagcaaggcttatcggtgcagctccaaggaggccttcgagaagggactttgcttgtcttgccggaaaaatcgctgtaataatctcgggtatgaaataaataaagtgagagcaaagaggagctccaagatgtacctgaaaacccgaagccaaatgccttataaggtctttcactaccaggtgaaaattcatttttcgggtacagagagtgagactcacaccaatcaggctttcgagatctctttgtatggaaccgtggccgagtctgagaatatcccttttactctgccagaggtctcaaccaataaaacgtattccttcctgatctatacagaggttgatataggggagctgcttatgttaaaactgaagtggaagtctgattcctacttttcctggtcagattggtggagcagtcccgggtttgccattcagaaaatccgcgttaaagcaggggagacacagaagaaagtgatcttctgttcaagagagaaggtttcccatctccaaaagggcaaggcgcctgccgtgttcgtaaaatgccacgacaagagcctcaataaaaaaagcgga

SEQ ID NO: 15818 - DNA, 1425 bp, Artificial Sequence
  Description of Artificial Sequence: Synthetic coding sequence
atggaatctaaggctctgctagtgcttactctggcagtgtggctacagtctttgacagccagcagaggaggtgtagccgccgcagaccagcggagagactttatcgatatcgaaagcaagtttgcactgcgcacccctgaggacacggcggaagacacctgccaccttattccaggagtagcagaatccgttgcaacttgccattttaaccatagcagcaaaactttcatggtgatacatggctggaccgttacaggcatgtacgaatcctgggtcccaaaattggttgcagcgctgtacaagagagagccagatagcaatgttatcgtagtggactggctctccagggcgcaggaacattaccctgtgtcagcagggtataccaaactagtcgggcaggatgtggccagattcatcaactggatggaagaagagtttaactatcccttggacaatgtccatctgctgggctatagcctgggcgcccacgctgctggcattgccggatccctcacgaataagaaagtcaatagaattaccggtttggatcctgcaggccctaactttgagtacgctgaagccccatcaaggctgtctcccgacgatgctgactttgttgatgtcctgcacacctttactagagggagtccaggccgcagcatcggaatacagaaacctgtggggcacgtggacatttaccctaacggtggtacattccagccaggttgcaatatcggcgaggcaattcgagtaatagctgagcggggcctgggggacgtggatcaactagtcaagtgttcccacgagcgtagcattcacctatttatcgattctcttctgaatgaggaaaacccttcaaaggcatataggtgcagttcaaaggaagccttcgaaaaagggttgtgcctgtcctgccgaaagaaccggtgcaacaacctgggctatgagataaataaggtgagagctaagcggagcagcaagatgtatctgaaaaccaggtcacaaatgccatacaaagtttttcattatcaggtcaaaatacatttcagtgggactgaaagcgagacacacaccaatcaggcctttgagatatctctgtacggcaccgtagccgagtcggaaaacatcccctttactctgcccgaagtcagcaccaataagacctactcttttctcatatacactgaagtggacatcggagagctgctgatgctgaaactgaagtggaaaagcgattcttacttttcctggtctgattggtggtcaagtcctgggttcgccatccagaagatccgcgtgaaggccggggagactcagaagaaagtcattttttgtagcagagagaaggtctctcacctgcagaaagggaaagcccccgcagtcttcgtcaaatgccatgataagagtttgaacaaaaaatccggg

SEQ ID NO: 15819 - DNA, 1425 bp, Artificial Sequence
  Description of Artificial Sequence: Synthetic coding sequence
atggagtccaaggcactgttggtgctgaccctcgccgtgtggctgcagtctctcaccgcaagccggggtggggtggctgccgctgaccaaagaagggacttcattgacatcgaaagcaaatttgccctgcggacgccggaggacaccgccgaagatacttgccacctcatcccgggagtagccgagtccgtcgcgacctgccactttaaccacagctcgaaaactttcatggtgatacatggttggaccgtgaccggcatgtacgaatcatgggtcccgaagctggtcgctgcactgtataagcgcgaaccagactcaaacgtcatcgtggtggattggctgtcgcgggcacaggaacattaccccgtgtcggcgggatacacgaaacttgtcggccaagatgtggcaagattcatcaactggatggaagaagagtttaactacccactcgacaacgtccatctgttgggatacagcctgggcgcgcatgccgcgggaatcgctgggtcactcaccaacaagaaggtcaacagaatcactggcctcgaccccgcgggaccaaacttcgagtatgcggaagctccttcaagactgagcccggatgacgcggattttgtggatgtactgcacactttcactcgaggttcgccgggacggtccatcggaatccagaagcccgtggggcacgtggacatttacccaaatggtggaaccttccagcccgggtgcaatataggcgaggccatcagggtgatcgctgagagagggctgggtgatgtggatcagctggtcaagtgctcgcacgagcggtcgattcacctgttcatcgactcgctgttgaatgaagaaaacccgagcaaggcgtaccgctgttcgtccaaagaggcgtttgaaaagggactctgcctctcgtgtaggaaaaacagatgcaataatctcggatacgagatcaacaaagtgcgggcgaagcgctcatctaagatgtaccttaagacccggtcccagatgccgtacaaagtgttccactaccaagtgaagatccatttttcaggaaccgagagcgaaacccatactaaccaggcttttgagatttccctgtacggaactgtggccgagtcggaaaacatcccattcactttgccggaggttagcactaacaagacctactcgttcttgatctatacggaagtggatatcggggagctgcttatgctcaagctgaaatggaagtccgacagctacttctcctggtcagactggtggagcagcccgggcttcgcgatccaaaagatcagagtcaaagcaggagagactcagaagaaggtgatcttctgtagccgcgagaaggtttcgcatctccagaaaggaaaggctccggcggtgttcgtgaagtgccatgacaagagcctgaacaaaaagtccggt

SEQ ID NO: 15820 - DNA, 1425 bp, Artificial Sequence
  Description of Artificial Sequence: Synthetic coding sequence
atggagagtaaggcactgttggtactgacacttgccgtgtggcttcagtccctgactgccagcaggggaggcgtggctgccgcagatcagaggcgcgacttcattgacatcgaaagcaagttcgccctgcgcacacctgaagacacagccgaggacacatgtcacctgattccgggagtggctgagtctgtggcaacatgtcacttcaatcattcttccaaaacattcatggtgattcacggctggaccgttactggaatgtacgaaagctgggtgcctaagctcgtggccgctctctacaaacgggagccagactccaatgtgatcgtggttgattggctcagccgagcacaggaacactaccctgtcagcgcaggctatacaaagctcgtggggcaagatgtcgctagatttatcaattggatggaggaggaattcaactatcccctcgataacgtccatctcctcggttatagcctgggagcccatgcagccgggattgccgggtcactgaccaacaaaaaggttaaccgcatcactggtctggacccagcaggccccaactttgagtatgccgaggctccatctagactttcaccggacgacgccgacttcgtcgatgtactgcacacctttaccaggggctcccccggaagatccattgggattcagaagcccgtgggacatgtggatatatatccgaatggcggcacattccagccggggtgcaacattggggaagcaattcgggtgatagcagagcgcgggctgggagatgtggatcagctggttaagtgttcccacgaacggtccattcacctgtttattgatagtttgttgaacgaggaaaatccgtcaaaggcatatcgctgttcctcaaaggaagccttcgagaagggtctctgcctgtcatgtaggaaaaacaggtgtaataatctcggctacgagatcaacaaagtgagagctaagaggagtagcaagatgtacctgaaaacccggtcccagatgccctacaaagtgttccactatcaggtgaaaatccattttagcggaaccgagagcgagactcatacaaaccaagccttcgagattagtctctacgggaccgttgctgaaagtgagaacatcccctttactctgcccgaggtgagcacaaacaagacttacagtttccttatctacactgaggtggacatcggcgagctgcttatgctgaagctgaagtggaagagcgacagctatttcagttggagtgattggtggagttcacctggcttcgcgatccagaaaatcagggtcaaggcaggtgagacgcaaaaaaaagttatattctgctctcgagagaaagtgtcacatctccaaaaggggaaggcgcctgccgtttttgtgaagtgtcatgacaaatcactcaataagaagtctggg

SEQ ID NO: 15821 - DNA, 1425 bp, Artificial Sequence
  Description of Artificial Sequence: Synthetic coding sequence
atggagagcaaggcgttgctggtgctcactctcgctgtgtggctccagagtttgacagctagccggggtggggtcgcagcagctgaccagcggcgggatttcatagacatcgaatcaaaattcgccctgaggaccccggaggatacagctgaggatacttgccatctaatcccaggggtggccgagtctgtagcaacctgccacttcaaccactcttctaagacattcatggtgatccacggctggacagtgactggtatgtatgagtcctgggtgcccaagcttgtggcggcactttataaaagagaacccgattccaatgtgatagtggtcgactggctctcgcgtgctcaggagcattatcctgtgtccgccgggtacacaaagctcgtggggcaggacgtggctcggtttatcaattggatggaggaggagttcaattaccctctcgacaacgtccacctgctgggatattccctgggcgcacacgccgctgggatcgcaggctctctcacaaacaagaaagtcaacaggattactggtttggaccccgcgggtcctaactttgagtacgccgaggcaccgtctaggctgtcacccgacgacgcagactttgttgacgtgttgcacacatttacgagaggcagccccgggagaagcatcggaatccagaaacccgtcggacatgtggacatctaccccaatggcggcacgttccagcctgggtgcaacatcggggaagccatacgggtcattgccgaaaggggattgggcgacgtcgatcagttggttaaatgctcccacgaaagatctatacatctttttatcgatagcctgctgaacgaggaaaatccatctaaagcctaccgctgctcctcaaaggaggcgttcgagaaaggtctttgtctgtcgtgcagaaaaaaccgctgcaacaatctggggtatgaaataaacaaagtccgcgcaaagcgatccagtaagatgtacctcaaaacccggagccaaatgccctacaaagtcttccattatcaagttaaaattcacttttccggaactgagtctgaaactcacaccaatcaagcctttgaaatcagtctctatgggactgtcgccgaatctgagaacatccctttcaccctgccagaggtaagtactaataaaacctattccttcctgatttacaccgaggtcgatatcggcgaactgctaatgctgaaactgaagtggaagagtgacagctacttttcatggtccgactggtggtcaagcccagggtttgcaatacagaagataagagttaaggctggggagacccagaaaaaggttattttctgcagccgagaaaaggtgagccatctgcagaagggtaaggcaccagccgtgtttgtgaaatgccacgataaatcccttaacaagaagtccggc

SEQ ID NO: 15822 - DNA, 1425 bp, Artificial Sequence
  Description of Artificial Sequence: Synthetic coding sequence
atggaaagcaaagcactcctcgttcttaccctggcagtgtggttgcaaagtcttaccgcgagccgagggggcgttgcagccgcagaccaaaggagggattttatcgatattgagagcaagttcgccttgaggactccggaagacacagcagaagatacatgccatctgattccgggagtggctgaaagcgttgccacctgccacttcaatcatagctctaaaacctttatggtgattcatggatggacagttaccggcatgtacgaaagttgggtgcctaagctggtggctgcactgtacaagagagagccagactctaatgtaatcgtggtcgattggctgtcgagggcacaggagcactaccctgtgagcgctggctacaccaaactcgttgggcaggacgtggcacgctttattaactggatggaagaggagttcaactatcccctggataacgttcacctgctggggtactctctaggagcccacgccgcaggcatcgctggtagtctgaccaacaaaaaagttaacagaatcaccggcctcgacccggccgggccgaattttgagtatgcagaagcaccttcgcggctcagcccagatgacgcagattttgtcgatgtgctgcacacgttcacacgcgggagccctgggcgcagcatcggtatacagaaacctgtaggccacgtggacatataccccaatggaggaaccttccaaccaggatgtaacatcggcgaggccatcagagttatcgctgaacggggactgggtgatgtggaccagttggttaaatgttcccacgaaagatcgatacatctgtttatcgacagccttctgaacgaggagaatccgagtaaggcatataggtgttccagtaaggaagcttttgaaaaaggtttatgcctaagctgcagaaagaaccgctgcaataatttgggctatgagattaataaggtccgggctaaaagaagctctaaaatgtacttgaaaaccagatcacagatgccctacaaggttttccattatcaagttaaaattcacttcagcgggacagagtccgagacccacacgaaccaagcattcgaaatctcactctacgggacagtcgcagagagcgaaaacatccccttcacacttcctgaggtgtcaactaacaaaacctatagttttctgatttacaccgaggtggacattggggagttgctgatgctaaaattgaaatggaaaagcgattcttacttctcttggtctgactggtggagtagcccgggatttgctatacagaaaattagggtgaaagctggagaaactcagaagaaggtgatcttttgttcaagagaaaaagtgtcacatcttcagaaaggcaaagcacctgcggtttttgtgaaatgtcatgataaatccctgaacaaaaagagcgga

SEQ ID NO: 15823 - DNA, 1425 bp, Artificial Sequence
  Description of Artificial Sequence: Synthetic coding sequence
atggagtccaaggcgctgttggtcctgactctggccgtgtggctgcagtcgctgactgcatctcgcggaggagtcgcggccgcggatcagcggcgcgatttcattgacatcgaatcaaagtttgctttgagaacccctgaggataccgcagaggacacttgtcacctgatcccaggagttgccgaaagcgtggctacctgccacttcaaccattcaagcaagacttttatggtcatccacggatggaccgtgactggaatgtacgaaagctgggtgccgaagctggtagcggcgctctataagagggaaccggactcaaacgtcatcgtggtggactggctgtcgcgggcccaggaacactaccccgtgtccgcggggtacactaaacttgtcggacaagacgtcgccaggttcattaactggatggaagaagaattcaactacccactggacaatgtgcacctgctcggttactcactgggtgcacacgccgcgggcatcgcgggctcgcttactaacaagaaggtgaatcgcatcaccggccttgatccggcaggaccaaatttcgagtacgccgaagccccatcgcggctttcccctgacgacgccgacttcgtggatgtgcttcacaccttcactcggggatctccaggacgctcgatcgggatccagaagccagtcggccacgtggacatataccctaacggaggaacctttcaaccgggatgcaatatcggagaagcaatccgcgtcatcgccgagcggggactcggcgacgtggaccagctggtgaagtgtagccacgagcgctccatccatttgttcattgactcactgctcaacgaagaaaacccgagcaaagcctacaggtgttcgtcaaaggaagccttcgagaaagggctctgcctctcgtgtcggaagaatcgctgcaacaatcttggatacgagattaacaaggtgcgcgctaagcggtccagcaaaatgtacctgaaaacccggtcccagatgccgtacaaggtgttccattaccaagtgaagatccatttttcgggaaccgagtccgaaactcacacgaaccaagcctttgaaatctcgctgtacggaactgtggcggagtccgagaatattcctttcaccttgcctgaagtctcaactaataagacttactcattccttatctacactgaagtggacatcggtgaactgcttatgttgaagctgaaatggaagtcagactcctacttctcgtggtcggactggtggtcctccccggggtttgccatccaaaagatcagagtgaaggcgggggagactcagaagaaggtcattttctgctccagggagaaggtgtcgcatctgcaaaaaggcaaggcaccggccgtgttcgtcaagtgccatgacaagtcccttaacaagaagtccgga

SEQ ID NO: 15824 - DNA, 1425 bp, Artificial Sequence
  Description of Artificial Sequence: Synthetic coding sequence
atggagtcaaaggccctcctcgtgctcaccctggccgtttggctgcagtctcttactgccagtagaggtggtgtagccgctgccgaccagaggcgcgattttatagacatcgagtcaaaattcgccctgcgcacacctgaggatacggccgaggacacctgccatctcatcccaggcgtggctgagagtgttgcaacttgtcattttaaccatagctccaagacatttatggtcatacacgggtggaccgtgacaggtatgtatgaatcatgggtgcccaaactcgttgctgccctgtacaagagggagcccgacagtaacgtgattgtggtggactggctgtccagggcccaggagcattaccctgtctccgccgggtatacaaagctcgtggggcaggacgttgctcgatttattaactggatggaggaggagtttaactacccactggacaacgttcatctcctgggttactctctgggcgcacacgctgcggggatcgccggatctcttactaataagaaagttaatcgaatcaccggtctggatcctgctgggcccaacttcgaatacgccgaggcaccatctcgactttctcccgacgacgctgattttgtggacgtcctgcacacattcaccaggggctcccctggacgatccataggaatccagaaacccgtaggtcatgtggatatctacccgaatgggggtaccttccagcccggatgtaacatcggagaggcaatacgcgtgattgctgagcggggcctcggcgatgtcgaccaactggtgaaatgctctcacgagcgctccattcatctttttatagatagcttgctgaacgaggagaacccctcaaaagcctaccgctgtagcagcaaagaggcctttgagaaggggctgtgcctctcctgtcggaagaacaggtgtaacaacctggggtatgagattaacaaggtgcgggcaaaaaggtcctctaagatgtacctgaagacgcgcagccagatgccgtacaaggtgttccactaccaggtgaagatccatttctctggaactgaaagcgagacccatactaaccaagcttttgagatcagcctctacggcacggttgccgagtccgaaaacataccattcactctcccggaagtgagtacgaacaagacctactctttcctgatttacaccgaagttgatatcggagagcttctgatgctgaaactgaaatggaagtccgattcttacttcagctggtctgattggtggtccagccccggttttgcgatacaaaagataagagtgaaggcaggagagactcagaagaaggttatcttttgttcaagagagaaggttagtcatctccagaagggcaaggcacctgcggtgttcgtgaagtgccatgacaagtcattgaacaaaaaaagtggg

SEQ ID NO: 15825 - DNA, 1425 bp, Artificial Sequence
  Description of Artificial Sequence: Synthetic coding sequence
atggagtcaaaggcgctgctggtgctgaccctcgcagtctggcttcaatcactgaccgcatcaagaggtggagtggccgctgcagaccagaggcgggactttatagatatcgaatcgaagtttgcccttagaaccccagaagatactgccgaggatacctgtcacctgatcccaggagtggccgagtcggtggcgacctgccactttaatcactcatccaagaccttcatggtgattcatggctggaccgttactggaatgtacgaatcgtgggttcctaaactcgtcgcggccctctacaagcgagaacctgatagcaacgtcattgttgtggattggctttcccgggcgcaagaacattaccctgtgtcagcaggatacaccaagctcgtcgggcaggatgtcgcacgattcatcaattggatggaggaggagttcaattatccgctcgataacgttcacctgctgggatattccctgggtgcgcatgccgcagggatagcaggatccctgactaacaagaaggtcaatagaatcaccggcctggaccctgccggcccaaactttgagtacgcagaagccccctcacgactctcgccagatgacgccgatttcgtcgatgtgcttcatacttttactagaggttcccctggccggagcattggcatccagaaaccagtgggtcacgtggacatctaccctaatggcggaaccttccaacccggctgtaacattggtgaagcgatacgcgtcattgcggagagagggctcggagacgtggatcagcttgtcaagtgctcacatgaacgttccattcatctctttatagactcactgctcaacgaagagaacccctcgaaagcgtaccggtgttccagcaaagaggcatttgaaaagggactttgcctgtcgtgtcggaagaaccgttgtaataaccttggatacgagatcaataaggtccgtgcaaaaagaagctcgaaaatgtacctcaaaactcgctcccagatgccctacaaggtgttccattaccaagtgaagatccatttctcgggcacggaatcggaaactcataccaaccaggcgttcgaaatttccttgtacggcaccgtggcagaatcggagaacattccattcactcttccggaagtgagcactaacaagacctactcctttctcatttacaccgaggtggatattggcgaactgctgatgctgaaacttaaatggaagagcgatagctacttttcctggagcgactggtggtcctcccctggatttgcaatccagaagatccgggtgaaagctggagaaacccagaagaaggtgattttctgtagcagggagaaggtgtcgcatctccaaaagggtaaggctcctgcagtgtttgtcaagtgccacgacaaatcacttaacaagaagtcagga

SEQ ID NO: 15826 - DNA, 1425 bp, Artificial Sequence
  Description of Artificial Sequence: Synthetic coding sequence
atggagtcgaaagcactgctcgtgcttactctcgccgtgtggctgcaatcactgactgccagccgtggtggagtcgccgctgcagaccaaaggcgcgatttcatcgatattgaatcgaaattcgccttgagaacccctgaggatactgcagaggatacttgccatcttatcccgggagtggccgaatctgtggcgacctgccacttcaaccactcgtcaaaaactttcatggtcattcatggctggactgtcactggaatgtacgaatcttgggtcccaaagctcgtggctgccctgtataagagagagccggactcgaacgtgatcgtcgtcgattggctctctcgcgcccaggagcactacccggtgtcagcgggctacacgaagctcgtgggccaggacgtggcaagattcatcaactggatggaggaggagttcaactacccgctcgacaatgtgcacctgctggggtactcgctcggagcccacgcggcaggaatcgcaggaagtctgaccaacaagaaggtgaatagaatcaccggactggatccagccgggccaaactttgagtacgcagaagccccgtcgcgcttgtcgcctgatgacgctgacttcgtggacgtgctgcacactttcaccagaggttcccctggacggagcatcggaattcaaaagccggtgggccacgttgacatttaccctaacggaggtaccttccagcctggatgtaacatcggagaggctatccgggttatcgccgagcgggggttgggagatgtggatcaactggttaaatgcagccacgaaagatcgatccatctgttcatcgactccctcctgaacgaagaaaatccgtccaaagcctatcggtgctcgtccaaagaagccttcgagaagggactctgtttgtcctgccgcaagaaccggtgcaataacctgggatacgagattaacaaagtgcgggcgaagcggagctccaagatgtacttgaaaactaggagccagatgccatataaggtgttccactaccaagtgaagatccacttcagcggtactgaaagcgaaacccacactaaccaggcctttgagatctcactgtacggaacggtggctgagtccgaaaacataccattcactctccccgaagtctcgactaataagacttactcattccttatctacactgaagtggacatcggagaactgctgatgctcaaacttaagtggaagtcggattcgtacttctcgtggtcggactggtggtcgtcgccaggattcgcaatccagaagatccgcgtgaaggccggtgaaactcagaaaaaggtgatcttctgctcgcgggaaaaagtgtcccacctccaaaagggtaaggcgccagccgtgttcgtgaagtgccatgataagagcctgaataagaaaagcggc

SEQ ID NO: 15827 - DNA, 1425 bp, Artificial Sequence
  Description of Artificial Sequence: Synthetic coding sequence
atggaaagtaaagcactgctggtcctaactctggccgtgtggctccagagtctcactgcatccagaggaggggtcgccgccgcagatcagcgacgagattttattgatatcgaatcaaaattcgcactacgcacaccagaagatacagcagaagatacatgccatcttatacccggggttgctgaatcggtcgctacttgccatttcaaccactcatctaaaacattcatggtgatccatggatggactgtgacaggaatgtatgaatcctgggtgcctaaactcgtcgcagctctctataagagggaaccagattccaatgtgattgtggtggattggctgtcaagagcccaggaacactatccagtgtcggctgggtatacaaaacttgtagggcaggatgtcgccagattcatcaactggatggaggaagaattcaattatccactagacaatgtccacctgcttggatattcattaggggcacacgctgccggaatcgcgggatcactcactaacaaaaaagtgaatcggattactgggctggatcctgccggaccaaatttcgaatatgcggaggcaccctcccgactctctcccgatgatgctgatttcgtggatgtactacacacatttacaagagggtctcctgggcgcagtattggaatccagaaaccagttggacacgtcgatatctatcctaacggaggaacgtttcagcctgggtgcaacataggagaggctattcgagtgattgccgagcgcgggcttggagatgttgatcagcttgttaagtgctcccacgaaagatctatacaccttttcatcgattctctactcaacgaagaaaacccatctaaagcttatcgctgttcatcaaaagaagcatttgaaaaagggttgtgcctgtcttgtagaaaaaataggtgcaataacctcgggtacgaaataaataaagttcgagctaaaaggtctagtaaaatgtacctgaaaactcgctctcagatgccatacaaagtcttccattatcaggtaaaaatacatttctctgggactgagtcagaaactcatacaaatcaagcatttgaaatatctctttatgggactgtagccgaatctgaaaacataccctttacactgcctgaagtgtccactaataagacatacagtttccttatctatacagaagtagatatcggagagcttctcatgctcaaactaaaatggaagtctgatagttatttcagttggtcagattggtggtcttctcctgggtttgccatacagaaaatccgagtgaaagcgggagagactcagaaaaaggttatcttttgttcccgagaaaaagtgtctcatctgcagaaaggaaaggcaccagctgtttttgtcaagtgtcacgataaatctctcaacaaaaaatcagga

SEQ ID NO: 15828 - DNA, 1425 bp, Artificial Sequence
  Description of Artificial Sequence: Synthetic coding sequence
atggagagcaaagcacttcttgtgctgaccctcgccgtgtggcttcaatccctcacggcctccagaggtggagtcgccgcagcagaccagcgccgggactttatcgatatcgaatcgaaatttgcccttcgcacccccgaggataccgcagaagatacttgccatctgatccctggcgtcgcggagtcggtcgccacttgtcactttaaccactcctctaaaacttttatggtgatccatggatggactgtgaccggaatgtatgagtcgtgggtgcctaagttggtggcagcactgtacaaacgggaaccagactcgaacgtgattgtggtggactggctcagcagggcccaggaacattaccccgtctcggcaggttacactaagctggtgggacaggacgtggcccgtttcattaactggatggaggaggagtttaactatccgctggacaacgtgcatcttttgggatattccctgggagcacatgcagcaggcattgccgggagcctgactaacaagaaagtgaataggattaccgggctggatcccgcaggtcctaactttgaatacgcggaagcgccgagccgcctttcacctgacgatgccgattttgtggatgtgctgcataccttcactcgaggatcgcctgggagaagcattggaattcaaaagcctgtgggtcatgtggacatctacccaaacggtggcacctttcaacctggatgtaacatcggagaagcaatcagagtgattgcagagcggggccttggggatgtcgaccaactcgtcaaatgttctcacgagagatcgattcatttgtttattgatagcctgctgaacgaggaaaatccttcaaaggcatacagatgcagctccaaagaagcattcgagaagggactctgtcttagctgtcgaaagaaccgctgtaataacctgggatacgagatcaacaaggttagagcaaaaagatcgtccaaaatgtatcttaagacccgttcccagatgccttacaaggtctttcactaccaggtgaagatacacttctcaggtactgaatcggaaactcacaccaatcaggcctttgaaatctctctgtacggaactgtggccgaaagcgaaaacattccgtttacccttccagaagtgtcgactaacaagacgtactcctttctcatctacaccgaggtggatatcggcgaactcctcatgcttaagctgaaatggaagtccgattcctacttttcctggtcagattggtggtcctcaccagggttcgccatacaaaagatcagagtgaaggcaggggaaactcagaaaaaagtcatattctgtagccgggagaaggtgtcccatctgcaaaaggggaaggcacctgccgtgttcgtgaagtgtcatgacaagtcgctgaataagaagtcagga

SEQ ID NO: 15829 - DNA, 1425 bp, Artificial Sequence
  Description of Artificial Sequence: Synthetic coding sequence
atggaatccaaagcgctgctggtcttgacgctggccgtgtggctgcagtcactgactgcctcccggggaggtgtcgcggccgctgaccagagacgggatttcattgacatcgagagcaagttcgccctccgaacgcccgaggacaccgcagaggacacctgccatctgatccctggtgtggcagagtcggttgccacctgtcatttcaaccacagctccaaaaccttcatggtgatccacggctggaccgtcaccggaatgtacgaatcatgggtgccgaaactcgtggcggctctctacaagcgcgaaccggatagcaacgtgattgtggtggactggctgagccgggcgcaggaacattaccccgtctcggctggatacactaagttggtcggacaggacgtcgcgagatttatcaattggatggaagaagagttcaactaccctctggataatgtgcacctgctgggatactcccttggagcccatgctgccggaatcgccggatcactgaccaacaagaaggtcaaccgcatcaccggcctcgatcctgcaggcccgaacttcgaatatgcggaagccccaagccgcctctcgccggatgatgccgacttcgtggacgtcttgcacacctttacccgcggatctccgggtcgctcgatcggtatccaaaagcccgtgggacacgtggatatctacccgaacggagggactttccagcctgggtgtaatatcggcgaggcaattcgtgtcatagcagaaaggggactgggggacgtggaccaactcgtcaagtgctcgcacgaaagatcgatccacctctttatcgactccctgctcaacgaagagaatccatcgaaggcctaccgctgctcatccaaggaggcattcgaaaagggcctctgcctgtcatgccggaagaatcggtgtaacaacctcggctatgaaatcaacaaagtcagagctaagcggtcctcgaaaatgtaccttaagactaggtcgcaaatgccgtacaaggtgttccactaccaggtgaaaatccacttcagtggcactgaaagcgagactcatactaatcaggcctttgagatctctctttacggaaccgtggctgaatcggaaaacatcccatttaccctgccagaagtgtccactaacaagacttacagctttctgatttacacggaggtggacatcggggagctgttgatgctgaaacttaagtggaagtcagatagctacttctcctggtccgattggtggtcatccccgggcttcgcgattcaaaagatcagggttaaggcaggggagactcagaaaaaagtgatcttctgcagccgcgagaaagtgtcgcatctccaaaagggaaaagcgccagccgtgttcgtgaagtgccacgacaagtcactgaataagaagtcggga

SEQ ID NO: 15830 - DNA, 1425 bp, Artificial Sequence
  Description of Artificial Sequence: Synthetic coding sequence
atggaatcaaaggcactcctcgtgctcaccctcgcggtgtggctccagtccctcactgcctcaagagggggcgtggcggcagcggatcagcgccgcgacttcatcgacatcgagtcgaagtttgcactcagaaccccggaggacaccgccgaagatacttgccacctgattccgggcgtggctgagtcagtggccacttgtcatttcaaccattcgtcaaagaccttcatggtgatccatggctggaccgtgactggaatgtacgaatcctgggtgccaaagttggtggccgccctgtacaagcgcgaacccgattccaatgtgatcgtcgtggactggctgtccagagcacaagaacactaccctgtgtcagccggatacaccaagttggtcggccaagacgtggcgcgattcattaactggatggaggaagagttcaattaccctctggacaacgtgcatctcctgggatactccctcggagcacacgctgcgggaattgctggttcactgacgaataagaaggtgaaccggatcactggactggatccggctggacccaacttcgagtacgctgaggccccttctcggctgtctccagatgacgccgacttcgtggatgtcctgcacacctttactagaggatcaccggggcgaagcatcggaatccaaaagccggtgggacacgtcgacatctacccgaatggcggaactttccagcctggatgcaacatcggagaagccatcagagtcatcgcggagcgggggctcggagacgtcgatcagctggtgaagtgctcgcacgaaaggtccattcatctgtttatcgattcgctgctgaacgaagaaaatccatcgaaggcatacaggtgtagctccaaggaggcattcgaaaagggactctgcctgtcatgtcgcaagaacagatgtaacaatcttggttacgaaatcaataaggtccgcgcaaaaagaagctcgaagatgtaccttaagactagatcccagatgccgtataaagtgttccactaccaagtgaaaatccacttttcaggaacggagtccgagacgcacaccaaccaggccttcgagatttcgctgtacggaaccgtggccgagtctgagaatatcccgtttaccctgccggaagtgtccactaacaaaacctactcgttcctcatctacacggaagtggacatcggagagctgctcatgctgaaactgaaatggaaatccgatagctactttagttggagcgattggtggtcatccccgggcttcgcaatccagaagatccgggtcaaggccggcgaaactcaaaagaaggtgatcttctgctcccgggagaaggtgagccatctgcagaaggggaaggctccggcggtattcgtgaagtgtcacgataaatcgctcaacaagaaatcagga

SEQ ID NO: 15831 - DNA, 1425 bp, Artificial Sequence
  Description of Artificial Sequence: Synthetic coding sequence
atggaatcgaaggcgcttctcgtgcttacccttgctgtgtggctgcaatcactcacggcatcccgtggtggtgtggccgcagcagatcagcgacgggatttcattgatatcgagtcgaaatttgcactgcgaaccccggaggacactgccgaggacacttgccacctgatacctggagtggccgagagcgtggccacttgccactttaaccattcctcgaaaaccttcatggttattcatggatggacggtgactggaatgtacgaatcctgggtgcctaaacttgtggcggcactttacaagcgtgaacccgactcaaacgtgattgtggtcgattggttgtcccgtgcgcaagaacattacccagtctccgccggctacaccaagctggttggccaagatgtcgctagattcataaactggatggaggaagagtttaactacccgctcgacaatgtgcatctgcttggctactcactcggcgcacacgcagctgggatcgcaggctcgctgactaacaagaaagttaaccgaataaccggtctggacccagcaggcccaaactttgaatacgcagaagcgccgtcacgactgtccccagatgatgctgatttcgtggatgtgctgcatacttttactcgcggtagccctggacgatcgatcgggatccaaaagcctgtgggacatgtggatatctacccaaatggtggaactttccaaccaggatgtaacattggggaggcaatccgtgtgatagcggaaagaggcctcggagatgtggatcaactggtgaagtgcagccacgagcgctcaattcacctgttcatcgactcccttcttaacgaagaaaatccgtcaaaggcatacagatgttcatccaaggaggcatttgaaaagggcctttgcctcagctgtcgaaaaaacagatgtaacaatctgggttacgagattaacaaagtccgggcaaaaagaagttcaaagatgtacctcaagacccgctcacaaatgccttacaaggtgttccattatcaggtgaaaatccatttctcgggcactgagtcagaaacccataccaaccaggcgtttgaaatctctctctatgggaccgtggccgaatcggagaatatcccttttactcttccagaagtctcgaccaataagacctacagcttcctgatctacaccgaagtagacatcggggaactgctgatgctgaagttgaagtggaagtcggatagctacttttcgtggtcagactggtggtcctcgccaggatttgccattcagaaaatacgggtgaaagccggcgaaacccagaagaaggtgatcttttgctcgagagaaaaagtctcgcatctgcagaaaggtaaggccccagcagtgtttgtcaagtgtcacgataaaagcctcaataagaaatctggt

SEQ ID NO: 15832 - DNA, 1425 bp, Artificial Sequence
  Description of Artificial Sequence: Synthetic coding sequence
atggagtcaaaggcactcctggtcctgaccctggcggtgtggctccagtccctgaccgcgagccgcggcggagtggcagcggccgatcaacgccgggatttcattgacatcgaatcgaagtttgctctgcgaactccagaggacactgctgaagatacttgtcacctcatcccaggcgtggcagagtccgtggccacttgtcatttcaaccactcgagcaagactttcatggtgattcacgggtggaccgtgactggcatgtacgaatcctgggtgcctaagctggtggcagcgttgtacaagagagaaccggacagcaacgtcattgtggtggactggctgtcacgcgcgcaggagcactacccagtctctgcgggttacacgaagctggtggggcaggacgtggcaagatttatcaattggatggaagaagagttcaattacccgctggataatgtgcacctgctgggctactcgctgggagctcacgccgcggggattgccggatcactcactaataagaaggtcaatcggatcactggactcgacccggcaggcccaaacttcgagtacgcggaagcgccaagccggctgtccccggatgatgccgacttcgtggacgtcctgcacacgttcaccaggggatctccaggcaggtcgatcggtatccagaagccagtgggacatgtggatatctacccaaatgggggaacctttcaaccaggctgcaacatcggcgaagctataagagtaatcgccgaacggggcctgggagacgtggatcagctggtgaagtgttcccatgagcgcagcatccatctgtttatcgacagcctcctcaacgaagagaacccatccaaggcgtaccggtgctcaagcaaagaggccttcgagaagggactctgcttgtcctgccgcaagaaccgctgcaacaatttgggttacgagattaacaaggtgcgcgctaagcggagctcaaagatgtacctcaagaccaggtcgcagatgccatacaaagtgttccactaccaggttaagattcacttttccgggaccgagtcggagactcataccaaccaggcattcgagatctccctgtacggaactgtggcggagagcgaaaacattccattcaccctgccggaagtgtcgaccaacaaaacgtacagctttttgatctacaccgaagtggacatcggtgagctgctgatgcttaaactgaagtggaagtccgactcgtacttctcatggtcggattggtggtccagccctggatttgccatccagaagatccgcgtcaaggccggggaaacccagaagaaggtgattttctgcagccgggagaaagtgtcgcacctgcaaaaaggaaaagccccggccgtctttgtcaagtgtcacgacaagtccctgaacaagaaatccggc

SEQ ID NO: 15833 - DNA, 1425 bp, Artificial Sequence
  Description of Artificial Sequence: Synthetic coding sequence
atggagtcaaaggcgctcttagtgttgacgctggcggtgtggctgcagtccctgacggcttcccggggcggcgtggctgcggctgaccagcgccgggattttattgacattgagagtaaatttgctctgcggaccccggaggacacggcggaagacacctgccacttgattccaggagtggctgagtcagtggccacttgccattttaaccactctagcaagacatttatggtgattcacggctggactgtgaccggaatgtacgagtcctgggtgcccaagttagttgctgccctatataaaagggagcctgacagtaatgttatagtggttgattggctgtctcgggcccaggagcattaccccgtctccgcgggttataccaaacttgtagggcaggacgtagccagatttatcaactggatggaggaggagttcaactacccgttggataatgttcatctactgggctattccctgggcgcccacgcagcgggtatcgcgggcagtttaaccaacaaaaaagtgaaccgcattacgggtcttgaccccgccggcccgaacttcgagtacgcagaagccccctctcgattgagtcccgacgacgccgatttcgtggatgtcctgcacacctttacaagaggaagtcctggcaggagcataggtatacagaagcccgtgggccacgtggacatctatcccaatggcggtaccttccagccaggatgcaacataggagaggcgatacgcgtgattgcagagaggggactaggcgatgtggatcagttagtgaagtgctctcacgagcgttctattcatctgtttatcgattccctcctcaacgaggaaaatccgagcaaagcctatagatgcagctcaaaagaagcgttcgaaaaggggctctgtctaagttgcagaaagaatcgctgtaataacctagggtacgagatcaacaaagtcagagctaagagatcgagtaagatgtacctgaagactaggtctcagatgccatacaaagtatttcattatcaggtgaagattcacttctccggaaccgagtccgaaactcacactaatcaggcattcgaaatttcactttacgggaccgttgctgagagtgagaacatcccgtttacattaccagaagtgtccacaaacaagacatactcattccttatctatacagaagttgacataggagagctcctgatgttaaaactgaagtggaagagcgacagctacttttcttggtccgattggtggtcttctcctggcttcgccattcagaaaatcagagtgaaggctggggagacgcagaagaaagtcatcttctgttcgcgggaaaaggtgtcacacctccagaagggaaaagcaccagccgtatttgttaaatgccacgacaagtccctgaacaagaagagcggc

SEQ ID NO: 15834 - DNA, 1425 bp, Artificial Sequence; identical to SEQ ID NO: 15788
  Description of Artificial Sequence: Synthetic coding sequence

SEQ ID NO: 15835 - DNA, 1425 bp, Artificial Sequence
  Description of Artificial Sequence: Synthetic coding sequence
atggagtcaaaagccctgctggtgctgactctggcggtgtggctgcaatcgctgaccgcctcgaggggcggagtggccgcggcggaccagaggagggatttcatcgacatcgaaagcaagttcgctctccgcacgccggaggacactgcggaagatacctgtcatctcatcccaggcgtggcggagtcggtcgctacctgccacttcaaccatagctccaaaactttcatggtgatccacggatggacggtgaccggaatgtacgagtcgtgggtaccaaaactcgtcgcggccctgtacaaacgcgagccggattctaatgtgattgttgtggattggctgagccgcgcccaggaacattacccggtgtcagctggttacaccaaactggtgggtcaagatgtggcgcggttcattaactggatggaagaggaattcaattacccgctggacaacgtgcacctcctgggttattcgctcggagcccacgccgccggaatcgcgggtagcctgaccaataagaaggtcaatcgcatcaccggactcgatcctgcaggacccaactttgaatacgccgaggcaccgtcacgcctctcaccggatgacgctgactttgtggatgtacttcacaccttcactaggggctcccctggtagatcaatcggaattcagaagccagtcgggcacgtcgatatctatcctaatggtgggactttccagccggggtgtaacatcggggaagcaatcagagtgatagcggagaggggactcggagacgtggatcaactggtgaaatgctcccacgaacgaagcatccatctgtttatcgactcgttgcttaacgaagaaaacccatcgaaggcataccgctgctcctcaaaggaggcattcgaaaagggcctttgtctgtcatgccgcaaaaaccggtgcaataacctgggatatgagatcaataaagtccgcgccaagcgctcctctaagatgtacctcaagacgagatcacagatgccgtacaaagtgtttcattaccaagtgaaaatccatttcagcggtactgagtccgaaactcacaccaaccaggctttcgaaattagcctttatggaaccgtggccgaatcggagaatatccctttcactctgcccgaagtcagcactaacaagacctactccttcctcatatacactgaagtggacatcggagagctgctgatgctcaaactgaaatggaagtccgacagctacttctcgtggtcggattggtggagcagcccgggctttgcgatccagaagattcgagttaaagctggcgaaactcaaaagaaggtgatcttctgctcgcgcgagaaggtgagccacctgcagaaaggaaaggccccagcagtgttcgtgaaatgccacgacaagagcttgaacaaaaagtcggga

SEQ ID NO: 15836 - DNA, 1425 bp, Artificial Sequence
  Description of Artificial Sequence: Synthetic coding sequence
atggagtctaaagcactcttggtgcttaccctggctgtatggctccagagtctgaccgcatccaggggtggggtggccgctgccgatcagcgccgcgacttcattgacattgagagcaaattcgccctgaggacgcccgaagacactgctgaggacacgtgtcacctcattccaggggtggctgaatccgtcgccacttgtcatttcaaccattcatcaaagacttttatggtgattcacgggtggaccgttactggaatgtacgaatcttgggtgcctaaactggtggccgctttgtataagagagaacccgatagtaatgtcatcgtcgtagattggctcagtagggctcaagaacactatcccgtgagcgccggatacacgaagctggttgggcaggacgtggcacgatttattaattggatggaggaagaattcaattatcccctggacaacgtgcacttgcttggatatagtcttggcgctcatgctgccgggatcgccgggtcactgactaacaaaaaagtaaatcggatcaccgggcttgatcccgcaggacccaacttcgaatatgcggaggcaccctcaagactgagcccggatgatgctgattttgtggacgtgctgcatactttcacccggggttcaccgggacggtctatcggcatccagaaaccagttggacatgtggacatctaccctaacggcgggacctttcagccgggctgcaacataggcgaggctatcagagtgatcgccgagcgaggactgggagatgtggatcaactcgtgaagtgtagccatgagcggagcattcacttgttcatcgactccctcctgaacgaagagaatccaagcaaagcctatcggtgctccagtaaagaagcttttgagaagggcctctgcctctcttgtagaaagaacagatgtaataaccttgggtacgagattaataaggtgagagccaagaggagcagtaagatgtacctcaagacacggagccagatgccctacaaagtgtttcattaccaggtcaaaatacactttagcggcacggagagcgaaactcatacgaaccaggcattcgagatatctctctatgggactgtggctgaaagtgagaatatcccgttcaccttgccagaggtgtcaactaataagacctattcctttctgatctacaccgaggttgatataggcgaattgctcatgttgaaactgaaatggaagtctgattcatacttttcttggagtgactggtggtctagcccggggttcgccatccagaagatccgcgtcaaagctggggaaacccagaagaaagttattttctgttcccgggaaaaggtgtcacacctgcagaaaggaaaagcacccgcagtgtttgtgaagtgtcacgataaaagcctgaacaagaagtccggt

SEQ ID NO: 15837 - DNA, 1425 bp, Artificial Sequence
  Description of Artificial Sequence: Synthetic coding sequence
atggagtcgaaggcccttctggtgctcacgctggccgtctggctccagtctctgaccgcatcccgcggcggggtggccgcagccgaccagcggcgagattttatcgacatcgagtctaagtttgccctccggactccagaagataccgcagaggacacctgccaccttatccccggagtggccgaaagcgtggccacctgccactttaatcactcatctaaaacttttatggttattcacggctggacagtgacagggatgtacgaatcctgggtccctaaactggtggccgccctctacaagcgcgagcctgacagcaatgttatcgtggtcgattggttgtcgcgggcccaggaacactaccctgtgtctgcagggtatacgaaactggtgggacaggacgtagcccgcttcattaactggatggaggaggagtttaattaccccttagacaacgtacacctccttggttattcattgggcgcacacgccgccgggattgccggaagcctgacaaacaagaaggtgaatcggattacggggctggaccccgctgggcctaattttgagtacgcagaggccccctctcgcctctctcctgatgacgcagattttgttgatgttttacacactttcactagagggtccccagggaggtctatcgggatccaaaaacccgttggtcacgtagacatttatcccaacggggggactttccagcccggatgcaacattggtgaggccatccgggtgatcgcggagaggggtctcggagatgttgaccagctcgtgaagtgctcccacgagaggtctatccacctgtttatcgacagtctgctaaatgaggaaaacccaagcaaagcttaccggtgtagttccaaggaagcctttgagaaaggattgtgtctgagctgtcgtaagaatagatgcaataatttaggctatgagattaataaagtgagagcgaagcggagcagcaaaatgtacctgaagacccggtctcaaatgccctacaaggtctttcattatcaggtgaaaatccacttctccggcaccgaatcggagacgcatacgaatcaagcctttgagatttccctatatgggacagtagccgaatccgaaaatataccattcacactgccggaggtgtcaactaataaaacctattcatttttgatctacaccgaggttgatattggcgagcttctgatgcttaaactaaaatggaaaagtgactcctacttttcttggtcagactggtggagttctccgggcttcgccatccagaagatccgggtaaaggctggcgagactcagaaaaaggtgatcttttgctcccgcgagaaagtgagtcatctgcaaaaggggaaggcccccgcggtgttcgtgaaatgccacgataagagcttgaataagaagtctggc

SEQ ID NO: 15838 - DNA, 1425 bp, Artificial Sequence
  Description of Artificial Sequence: Synthetic coding sequence
atggaatcgaaggcactgttggtgctgaccctggcagtgtggcttcagtcactcacggcctccagaggtggtgtggcagcagccgatcaacggagggatttcatagacatcgaatcgaaattcgccctgagaacccccgaggacaccgcagaagatacgtgtcatcttatacctggtgtggcagaaagcgtcgccacctgtcactttaaccattcgtcgaaaacttttatggtgattcatggctggaccgtgaccgggatgtacgaatcatgggtgcccaaacttgtggctgctctttacaagcgggaacctgattccaacgttatcgtggtcgactggctctcacgcgctcaggaacattaccctgtgtcagcagggtacaccaaacttgtcgggcaggatgtggcacgctttatcaactggatggaagaggagttcaactacccattggataacgttcatctgcttggatacagcttgggtgcacacgcagcgggaattgctgggagtcttactaacaagaaggtcaacagaattaccgggctcgatcccgcaggccctaatttcgaatacgcagaggcaccttcacgactgagtccagatgatgcagactttgtggacgtcctgcacacttttactcgggggtcacctggtagatccatcggcatccaaaagccagtggggcacgtagacatataccccaatggcggaaccttccagcccggctgtaatatcggtgaggcaataagagtgatcgcagagcgtggactgggtgacgtcgaccagctcgtgaaatgcagccatgaaagatccattcatctctttattgattcccttctgaatgaagaaaacccgtccaaagcatatcgatgttcaagcaaagaggcgtttgaaaagggcctctgtctgtcctgccggaagaatagatgtaacaatcttgggtacgagattaacaaggtgagagcaaagagaagctcgaagatgtacctcaagactcgctcccagatgccttacaaggtttttcactaccaagtgaaaatccacttctcaggaaccgagtccgagactcataccaaccaagcctttgagattagcctgtacggaacggtggccgaatccgaaaacattcctttcaccctccccgaggtgtcaactaacaagacgtactccttccttatctacacggaagtggatattggcgaactcctgatgctgaaacttaaatggaagtccgactcgtactttagctggtcggattggtggagctcaccagggtttgccattcaaaagatccgggttaaggcgggagagactcaaaagaaggtcatcttttgctcacgcgaaaaagtgagccatcttcaaaagggaaaagcaccagcagtgttcgtgaagtgtcatgacaagtcacttaacaaaaagtccggg

SEQ ID NO: 15839 - DNA, 1425 bp, Artificial Sequence
  Description of Artificial Sequence: Synthetic coding sequence
atggaaagcaaggcgttgctggtccttacccttgcagtgtggctccaaagtctgaccgcatcgcgtggaggagtggccgctgccgatcaacgccgtgatttcatagacattgaaagcaaattcgcgcttcgcacgcctgaagataccgccgaggatacttgtcatcttattccaggagtcgcagaaagtgtggccacctgtcactttaaccactcatcgaaaactttcatggtgatacacggatggactgtgaccggtatgtacgaatcatgggtccctaaacttgttgccgctctctataagcgggagcctgactcgaacgtgattgtcgtcgactggctgagtcgcgcacaggaacattaccccgtgtctgcggggtatactaagttggtgggacaagatgtggcacggtttatcaattggatggaggaagagttcaattacccactggataacgtgcatctcctgggatattcgttgggggcacatgccgcaggcattgctggatccttgactaacaagaaggtgaatagaattaccggtcttgacccagcaggtcccaactttgaatacgctgaggcaccgtccaggttgtcaccggacgatgctgatttcgttgatgtcttgcacaccttcacccgtggctcgcccggacggagcatcggtatacagaagccagtggggcatgtggatatctaccctaatggtggcacttttcaacctggatgcaatatcggggaagctattcgtgtgatcgcagagcgaggacttggggatgttgatcaacttgtgaagtgtagccatgagcgctcgatacacttgtttatcgattcacttctgaacgaagagaacccttccaaggcctacaggtgctcctcaaaggaagcatttgagaagggcctctgtctgtcctgtcgtaagaataggtgtaacaacctgggttacgagatcaataaagttagagcaaaacggtcctcgaagatgtacctgaaaactagatctcagatgccttacaaggtctttcattaccaagttaagattcattttagcggaaccgaatccgaaactcataccaaccaggcatttgaaatttccctttacggtaccgtggcggagagcgaaaacataccatttactcttcccgaagtgtccaccaataagacttacagctttctgatttacactgaagtcgacatcggagaacttctgatgctcaaactcaagtggaagtccgactcgtacttttcgtggtctgattggtggtcgtcgccaggattcgcgatacagaagattagagtgaaagcaggggaaacgcaaaagaaggtaatcttttgctcgagagagaaggtgtcacatctgcagaagggaaaggcgccagccgtgttcgtgaaatgccacgacaagtcgctgaacaaaaagtcaggc

SEQ ID NO: 15840 - DNA, 1425 bp, Artificial Sequence
  Description of Artificial Sequence: Synthetic coding sequence
atggaaagtaaagctcttcttgtgctgactctggcagtctggttgcaatctctaacagcttcccgaggaggagttgcggctgctgatcaacggcgggatttcattgacatcgagtcgaaattcgctttacggacgccagaagacaccgctgaagatacttgccaccttataccaggtgttgcagaatcggttgccacctgtcacttcaatcattcctctaagacttttatggtaatacatggatggacagttactgggatgtatgagagctgggtgccgaaattagtcgctgccctatacaaacgtgaaccggactcgaacgttattgttgtggactggctgtcacgagctcaggaacactacccggtttctgcgggatatacaaagttggttggacaggacgtggcacgattcattaattggatggaagaagaattcaattatccgttggataatgtccacctcttgggatattctttgggagcccatgccgctggtatcgcgggatctctcacaaacaaaaaggttaaccgaataactggtctggacccagcaggtccgaactttgaatatgcggaggctccgagtcggttatctccagatgatgccgatttcgtcgatgtgcttcatacttttacccgaggatcaccaggccgaagtatcggaattcagaaacccgtcggacacgtagatatctatccaaacggagggacttttcaaccgggatgtaatattggggaagcgatccgagttattgccgaaaggggactcggcgatgtcgatcaattagtcaagtgttctcatgagcggagcatccatcttttcatcgattctttattgaacgaagagaacccgtcgaaagcttaccgttgttcatccaaagaagctttcgaaaaaggactttgcctttcatgccgcaagaaccgctgcaataatttgggttacgaaatcaacaaagttcgagcaaaacgatcctctaagatgtatcttaagacaagatctcaaatgccatacaaagtgtttcactatcaagtgaaaattcactttagtggtactgaatctgagacccatacaaaccaagcctttgagatttctctgtatggtacagttgcagaatctgagaatattccattcacattgcctgaggtatcgactaataaaacatactcattcctgatatataccgaggtggatataggagaactgctaatgttgaaattgaagtggaagtcagactcgtatttttcatggtcagattggtggtctagtccaggcttcgccatccaaaaaattagagttaaagcgggcgagacacagaaaaaagtcattttctgttctagggaaaaagtctcacacctccaaaaagggaaggctccagctgtgtttgtgaaatgccatgacaaatcactgaataagaaatcgggt

SEQ ID NO: 15841 - DNA, 1425 bp, Artificial Sequence
  Description of Artificial Sequence: Synthetic coding sequence
atggagagcaaggctctgctcgtgctcactctggccgtgtggctgcagtcactgaccgcctcgcgtggaggagtggcagctgcggaccaacggcgggacttcattgatatcgagtctaagttcgctctgcgcaccccggaggacactgccgaggacacctgtcacctcatcccgggagtcgcagagtccgtggctacctgccatttcaaccactcatccaagacttttatggtcatccacggctggaccgtgactggaatgtacgaatcctgggtaccaaaactggtggcagccttgtataaacgcgaacctgactccaacgtcatcgtcgtcgactggctttcaagagcacaggagcactacccggtcagtgcgggatacactaaactcgttggacaggacgtcgcccggtttatcaattggatggaggaggagttcaattacccactggataacgtccatctgctcgggtatagcctgggggcccatgcggccggcatcgcgggaagcctgaccaacaagaaggtgaaccgcatcactggactggacccagcaggtccgaactttgagtacgccgaggcgccctctcggctttcgcccgacgacgcagattttgtcgatgtgctgcataccttcaccagaggttcacctggaagatcgatcggaatccaaaaacccgtgggacacgtggacatctacccaaacggtggaactttccagccgggatgcaacattggcgaggcaatccgggtgatcgcggaaagagggctgggagacgtggaccaactggtgaaatgttcacacgaaaggtcaatccatctgttcattgatagcctcctcaatgaagaaaatccgtccaaagcctacagatgctcgtcgaaggaggcctttgagaagggactgtgcctgtcttgccggaaaaaccgatgcaacaatctcgggtacgagattaacaaggtgcgggccaagcggtcgtcaaagatgtacctcaagacgagatcccaaatgccgtacaaggtctttcactaccaggtcaagattcatttcagtggcaccgaaagcgaaacgcacaccaaccaggcgtttgagatctcactgtacgggactgtggccgagtcagaaaacatcccgtttactttgccggaagtctccaccaacaaaacctactccttcctcatttacactgaggtcgacatcggggaactcctcatgctcaagctcaagtggaagtcggattcctacttcagctggagcgactggtggtcctcacctggattcgctatccagaagatccgagtgaaagccggtgaaacccagaagaaggtgatcttctgcagccgcgaaaaggtgtcccatctccaaaagggaaaggccccagctgtgtttgtgaagtgtcacgacaagtcgctgaacaagaaaagtggc

SEQ ID NO: 15842 - DNA, 1425 bp, Artificial Sequence
  Description of Artificial Sequence: Synthetic coding sequence
atggaatctaaagcacttttggttcttactcttgctgtttggttacaaagtttaacagcatctagaggaggtgtagcagcagctgatcaaagaagagatttcattgatattgaatctaaatttgctttaagaacaccagaagatactgctgaggatacttgccatttgattccaggagttgctgaaagtgtagcaacttgtcattttaatcattcatctaaaacttttatggttattcatggttggactgtaactggaatgtatgaatcatgggtacctaaattagtagcagctttatataaacgagaacctgattctaacgttattgttgtagattggttatcaagagctcaagaacattatccagtttctgcaggatatacaaaattagttggacaagatgtagcaagatttattaattggatggaagaagaatttaattatccacttgataatgttcatttattaggatattcattgggagctcacgctgctgggattgctggatctcttacgaataaaaaagttaatcgtattactggattagatccagcaggacctaattttgaatatgcagaagctccatcaagactttctccagatgatgctgatttcgttgatgttcttcatactttcactagaggatctccaggacgatctattggaatccaaaagccagttggacatgtagatatttatccaaatggaggaacatttcagccaggttgtaatattggagaagcaattagagtcatagcagaaagaggtttaggtgatgtcgatcaacttgttaaatgttcccatgaaagaagtattcatttattcattgattcacttttaaatgaagaaaatccatcaaaagcatatagatgttcttcaaaagaagctttcgaaaaagggctttgtttatcatgtagaaaaaatagatgtaataatttaggttatgagataaataaagttagagctaaaaggagttcaaaaatgtatttaaagacaagatcacaaatgccatataaagtttttcattatcaagtaaaaattcacttttcaggaacagaatcagaaactcatactaatcaagctttcgaaatttcattgtacggaacagttgcagaatcagaaaatattccttttaccttaccagaagttagtactaacaagacatattcatttttaatttatactgaagttgacattggagaattattgatgttaaaattaaaatggaaatctgattcttacttttcatggtcagattggtggtctagtccaggatttgcaattcaaaaaattagagtgaaggcaggtgagactcaaaaaaaggttattttttgttctagagaaaaggtttcacatcttcaaaaaggaaaagcaccagctgtttttgtaaagtgtcatgataaaagtcttaataaaaaatcagga

SEQ ID NO: 15843 - DNA, 1425 bp, Artificial Sequence
  Description of Artificial Sequence: Synthetic coding sequence
atggagagcaaagctctcctcgtcttgacacttgctgtgtggttacagtccctcactgcaagcagaggaggcgtggcagcagctgatcagagacgggatttcattgacattgaaagcaagttcgcactaaggacgcccgaagacactgcagaggatacctgccacctgatcccaggcgtggcagagtccgtggcaacctgccacttcaaccacagtagcaaaaccttcatggtgatccacggttggacagtaacagggatgtatgaatcctgggttcccaagctcgtcgctgccctttataaaagagagccagactctaatgttatcgttgttgactggctttcgcgcgcgcaggagcattaccccgtttcagccgggtatactaagctcgtgggccaagatgtggctcgatttataaactggatggaggaagagttcaattatcccctggacaacgtgcatctactgggctactcactcggggcgcatgctgcagggatcgccggcagtctgacgaataagaaggtcaaccgcattaccggcctcgatccagcaggtcctaattttgaatatgcagaggccccctctcgattgtccccagatgacgctgacttcgtagatgtcctgcatacattcaccagaggttcacctggaagatctattggcattcagaagcctgtaggccacgtggatatataccctaatggcggaacattccagcccgggtgtaacatcggcgaggccatccgcgtgatcgccgaaagggggttaggggacgttgaccaactggttaagtgttcccacgaacggtcaatccacctgtttatcgattcgctgttgaacgaagaaaatccttctaaggcatacagatgctcaagcaaggaagcattcgaaaagggtctatgcctgtcttgccgcaagaatcggtgtaataatctaggatacgagatcaacaaggttcgtgcaaagagaagctcaaagatgtacctgaagacaaggagtcagatgccatacaaggtctttcactatcaggtgaagattcacttctcgggcaccgagtccgagactcataccaaccaagccttcgagataagcttatatgggacagtagctgaaagcgaaaacatcccattcactttgcctgaagtgtctaccaacaagacttattcttttctgatctataccgaggtcgatattggggagctgttgatgctgaagttgaagtggaaatcagactcctacttcagctggtccgactggtggagctcgccagggtttgcaattcaaaagatccgcgttaaggcaggagaaacccaaaagaaggtaatcttttgttctagggaaaaagtttctcatctgcagaaggggaaggcccccgccgtgtttgtgaagtgccatgacaaatcactgaacaagaaaagtggc

SEQ ID NO: 15844 - DNA, 1425 bp, Artificial Sequence
  Description of Artificial Sequence: Synthetic coding sequence
atggagagcaaggctttactggttttgacgctggccgtctggttgcagtccctcacagctagccgcggtggcgtcgctgccgccgatcagaggcgcgatttcatagatatcgaatcgaagtttgcattacgaacgccagaagataccgcggaggatacatgtcatctgatcccaggggtggcggagtccgtggccacatgccactttaaccattctagcaaaaccttcatggttatccacggctggacggttaccggaatgtacgagtcatgggtgccgaaattggtggccgctttatacaagcgcgaaccggactcgaatgtgattgtggtggactggttgtcgagagctcaggaacactacccagtttcagcaggctacaccaagttggtgggacaggatgtggcccgctttatcaactggatggaggaagagttcaactatccactggataacgtacacctgctgggttacagcttgggcgcccacgccgccggaattgcgggtagcctgaccaacaagaaagtaaataggattacaggcttggaccccgctggaccgaacttcgagtacgccgaagccccaagcagactttcgcccgacgacgctgattttgtggacgttttgcacactttcactcgcggatcaccgggaaggagcatcggaatacagaagcctgttggccatgtggatatttaccccaacggaggcacctttcaaccaggctgcaatatcggtgaggcaattcgcgtaatagcggaacgaggactgggcgatgtggatcagttggtgaagtgttctcatgagcgtagcatacacctgttcatcgacagccttttgaatgaagagaacccgtcgaaggcctatcgatgctcctcgaaggaggcatttgagaagggactctgcctgagttgccgcaagaacagatgcaataacttaggctacgaaattaacaaggtacgggcgaaacgtagcagcaagatgtaccttaagacgcgcagccagatgccctataaggtgttccattaccaggtgaagatacactttagcggaaccgagtctgagactcatacgaaccaagcctttgagatttccctgtacggaacagtagctgagtccgaaaacatccccttcaccctgccagaggtctcaacgaataaaacatacagttttctgatttatacggaggtggatatcggagagctcttgatgctgaagttgaagtggaagtcagactcctatttctcgtggtccgactggtggagttcaccgggctttgccatccagaagatccgtgtgaaggccggcgagacgcagaagaaggttattttctgcagtcgcgagaaggtatctcacctacagaaaggaaaagccccagcagttttcgttaaatgccatgataagtcccttaacaagaaatccggc

SEQ ID NO: 15845 - DNA, 1425 bp, Artificial Sequence
  Description of Artificial Sequence: Synthetic coding sequence
atggaatctaaagccttgctcgtccttaccctagcagtgtggctccagtccctcacggcctctcgcggaggggtggctgcagccgaccagaggcgcgacttcattgacattgaatccaagtttgcgctgaggacaccggaggacacggccgaggacacctgtcacctcattcccggcgtcgctgagagcgtcgccacttgccatttcaaccactcctctaagacattcatggtgattcacgggtggaccgtgaccggcatgtacgagtcttgggtgcccaaactggtggctgccctatacaaacgcgagcccgattccaacgttatcgttgttgactggttatctagagcacaagagcactacccagtatcggcaggttacactaaactggtcggacaggatgtagctagattcatcaattggatggaggaggaattcaattatcccctggataacgtacacctgctgggttatagccttggagctcacgccgctgggatagcaggctctctgacgaataaaaaagtgaatcggattactggtctagatccggcaggacccaatttcgagtacgcagaggctccctctcgcctttctccagacgacgccgactttgtcgacgttctccatacatttacaagggggtcccccgggagaagcataggcatacagaaacccgttgggcatgtcgacatttatcccaacggtggcactttccagcctggctgcaacattggcgaagcaatcagggtcattgccgaaagggggttgggggacgtcgaccagctagtgaaatgcagccatgagaggagcatccacctcttcattgattcactgctgaacgaagagaatccgtcaaaggcttatcgttgttcatcaaaagaagcatttgagaagggcttgtgcttgagctgtcggaagaacagatgcaataacctgggatatgaaattaacaaggtcagggctaaaagaagctccaaaatgtacctcaagaccaggagccagatgccttataaagtatttcactaccaggttaaaattcacttctcaggcactgagagtgagacccacactaatcaggcctttgaaatatccctgtatggaaccgttgctgaatctgagaacatccccttcacactgccagaggtatccacaaataaaacgtatagctttctcatttataccgaagtcgacattggcgaactcctgatgttgaagctgaaatggaaaagcgattcgtacttcagctggtccgactggtggagctcaccaggatttgccattcagaaaatccgtgtgaaggcaggggagacacagaagaaggtaattttctgctcacgggaaaaagtctctcacctccagaaaggtaaggctcctgccgtgttcgtgaaatgccatgataaatcactcaataagaagagcggg

SEQ ID NO: 15846 - DNA, 1425 bp, Artificial Sequence
  Description of Artificial Sequence: Synthetic coding sequence
atggaatccaaggccctcctagtgctgacactggcagtgtggctacagtcactgacggcgagcagagggggtgtggccgccgcagatcagcggagagactttatcgacatcgaatctaaattcgctctgcggacacctgaagataccgccgaagacacatgccacttgatacctggggtagctgaatctgtggcaacctgccattttaatcactcctcaaagacgttcatggtcatccacggatggacagtaactggtatgtacgagagctgggtgcctaaactcgtggcagccctgtacaaaagagagccggactccaacgtcatcgtagtagattggctctctagagcccaggagcactacccagtaagcgccggatataccaagctggttgggcaggatgtcgcaagattcattaactggatggaggaggaatttaattacccactcgataatgtgcatctgctagggtatagtctgggggcccatgccgccggtatcgctggctccttgactaacaagaaggtgaataggatcactggcttggatcctgccggacccaatttcgaatacgcggaggcaccaagtcggctatcccccgacgatgcggactttgtggacgtgctccacacctttaccagaggatcccctggcagatccataggcattcaaaaacccgtgggacacgtagatatatatccaaacgggggcactttccagcctggttgcaatattggggaagccatccgcgtcatcgccgagcgcggtttaggagacgtggatcagctggtgaagtgcagccacgaacgctcgatccatctattcatcgatagtctgctgaatgaggagaacccctctaaggcctataggtgctcttccaaggaagcctttgagaaaggcctgtgtctttcctgtagaaagaaccggtgcaataatctgggttatgaaataaacaaggtgagagccaagagatccagcaaaatgtatctcaagactcggagccagatgccatacaaggttttccattatcaggtcaagattcacttttcagggaccgagtccgagacgcatacgaatcaagcttttgagataagtctgtatgggaccgttgccgagtccgaaaacattccttttaccctacccgaagtgtccacgaacaaaacgtactccttcctcatctatacagaagtagacataggggagctgctaatgctgaagctgaagtggaaatccgacagttacttctcatggtccgattggtggtcctctcctgggtttgcgatacaaaaaataagggttaaggccggcgaaactcagaagaaagttatattttgttcgcgcgagaaagtgtcacacttgcagaaagggaaggcaccagcggtttttgttaaatgccatgataaaagcctcaacaaaaagtccggc

SEQ ID NO: 15847 - DNA, 1425 bp, Artificial Sequence
  Description of Artificial Sequence: Synthetic coding sequence
atggagagcaaggcgctcctcgtcctgactcttgcggtgtggctgcagagcctgaccgctagcaggggcggtgtggccgcagcggatcaaagaagagactttatcgacattgagtcgaagttcgcgctgcgtaccccggaggacacggccgaggacacttgccatctgatcccaggagttgccgaatcagtcgccacttgccacttcaaccattcgagcaagaccttcatggtcattcacggatggactgtcaccggaatgtacgagtcgtgggtgccaaaacttgtggcagcactgtacaaacgggagccagattcaaacgtgatcgtggtggactggctgtcgagggcccaagaacactacccagtgtccgcgggatacacgaagctggtggggcaagatgtggccaggttcatcaattggatggaggaggaattcaactacccgctcgacaacgtgcatcttttgggatactcgctgggagctcatgcagctggaattgcgggttcgctgaccaacaagaaagtcaacaggatcaccgggctggatccggccggacccaatttcgaatatgcagaagcaccatctcggctctccccagacgatgccgactttgtggacgtgctgcacacgtttactcggggaagtccgggtcggagcatcggaatccagaagccggtgggacatgttgacatctaccctaacggcggaactttccagccgggttgcaatattggagaggcgatcagagtgatcgccgaaagaggactcggagacgtggaccagcttgtgaaatgtagccacgaaaggtccatccacctgttcatcgactcactgctgaatgaggaaaaccctagcaaggcataccgctgctccagcaaggaggccttcgagaagggcctgtgcctgagctgccggaaaaatcgttgtaacaatctgggatacgaaatcaacaaggtccgagctaagagatcgtcaaaaatgtacctcaaaacccggtcgcagatgccttacaaggtctttcactaccaggtcaaaatacatttctcaggtaccgagtcagaaacccacactaaccaggcttttgaaatctccctgtacggtacggtggcggagtcggagaacatccctttcaccctgcccgaagttagcactaacaaaacttattctttcctgatctacactgaggtggacatcggagagctcttgatgctgaaattgaaatggaagagcgactcgtacttttcctggagtgattggtggagctcaccgggattcgcaatccaaaagatcagggtcaaggcaggcgaaacccagaaaaaggtgatcttttgctcccgggaaaaggtgtcgcacctccaaaaggggaaggctcctgcggtgtttgtgaagtgtcatgacaaatccctcaacaagaagagcgga

SEQ ID NO: 15848 - DNA, 1425 bp, Artificial Sequence
  Description of Artificial Sequence: Synthetic coding sequence
atggagtcgaaggcgcttctggtgctgactctggcagtgtggctgcagtcactgaccgcatcacgcggcggagtcgccgcagcggaccagcggcgcgacttcattgacatcgagtcgaagtttgccttgaggactccagaggacactgcagaggatacttgtcacctgatcccgggagtggcggagtccgtggccacgtgccactttaaccattcgtccaagacctttatggtgatccacggatggactgtgaccggaatgtacgagagctgggtgccgaagttggtcgcggcgctgtacaagagggaaccagatagcaacgtgatcgtggtggattggctgtcgcgggcccaagagcactacccggtgtcggcggggtacactaaactggtgggacaggacgtcgcaaggttcatcaattggatggaggaagaattcaattaccctctggacaatgttcacctcctgggctactcgcttggagcgcacgcagcgggtatcgccggatcactcactaacaagaaggtcaaccgcatcactggactggatcctgccgggccgaatttcgagtacgccgaagcaccaagcaggctgtcgccagatgacgctgacttcgtggacgtgctgcataccttcacccgcggatcaccggggcggtcgatcgggatccaaaaacctgtcggccacgtggatatctatcctaacggagggacctttcagccaggctgtaatatcggggaggccatccgggtgatcgcggaacgcggactcggagatgtcgaccaactggtgaagtgctcacacgagaggagcatccacctgttcattgacagccttctgaacgaggaaaatccgtcgaaggcgtatcgctgttcttcaaaggaggcgttcgagaaaggactctgcctgtcctgccgcaagaacaggtgcaataacctgggttacgagatcaataaagtcagagccaaacggtcaagcaagatgtacctcaagacccgctcccagatgccttataaggtgttccactatcaggtgaagatccatttctcgggaaccgagtcagaaacgcataccaatcaggcgtttgaaatctcgctgtacggcacggtggctgaatcggagaatatcccattcactctgccggaagtgtcgactaacaaaacctactccttcctgatctacaccgaagtcgatataggagaactgctcatgcttaaactcaaatggaagtccgacagctatttctcctggtcggactggtggtcctccccgggcttcgcaatccaaaagatccgagtgaaggccggagaaacccaaaagaaagtgatcttttgctcccgtgaaaaggtcagccatctccagaaaggcaaagcccccgccgtgtttgtgaagtgccatgataagtccttgaataagaaaagcggt

SEQ ID NO: 15849 - DNA, 1425 bp, Artificial Sequence
  Description of Artificial Sequence: Synthetic coding sequence
atggaatctaaggcactgctcgtgctgacgcttgcagtgtggctccagtcactcacggcctcgaggggcggcgttgccgctgcagaccagcggcgcgattttattgatatcgaaagtaaatttgccctgcgaacacccgaggacaccgcagaagacacgtgtcacctgattccgggtgtcgctgaaagtgtagccacctgccacttcaaccattccagcaaaaccttcatggttatccacggttggaccgtgacaggtatgtacgaatcttgggtgcccaaactggtggcggccttgtataagagggagcctgattctaatgtgatcgtggtggattggctttcacgggcacaggagcactaccccgtgagtgccggctacaccaaactggtgggtcaagatgtggcccggttcatcaactggatggaggaggaattcaattaccccctggataatgttcatctgctgggttattccctcggcgcccacgccgccggcatcgccggctccctgaccaacaagaaagttaacaggatcaccggtctggaccctgcaggacctaactttgagtacgctgaagcaccgtcccgattgagtcctgacgacgccgatttcgttgatgtgctgcatacctttacaaggggatccccaggaagaagtattggcatccagaagccagtggggcatgtcgacatttacccaaacggaggcacttttcagcccgggtgcaacataggagaggctatcagagtgattgcagagagaggactcggtgacgttgaccaactcgtcaagtgctctcacgagcgcagcatccacctgttcatcgacagcttgctgaacgaggaaaacccttccaaagcctatcgctgcagcagcaaggaggcgttcgaaaagggattgtgcctctcatgtcggaagaaccgctgtaacaaccttggctacgagatcaacaaggtgcgggcaaaaagatcttccaaaatgtaccttaagacccggagccaaatgccttacaaggtttttcattaccaggtgaaaattcatttcagcggcaccgagtccgagacacacaccaatcaggcgtttgagatcagcctgtatggaaccgtggcagagtctgaaaatatcccctttaccctgcccgaagtgtcaaccaataagacctacagttttctgatttacacggaagtggacatcggggagctgttaatgcttaagctgaagtggaaatccgactcttacttcagttggtccgactggtggagctcacccggcttcgcaatacagaaaattcgggttaaggccggggagacacagaaaaaggtgatcttctgtagccgggaaaaggtgtctcacctccagaagggcaaggctcccgccgtgtttgtgaaatgtcacgataagagcctgaacaagaaatctgga

SEQ ID NO: 15850 - DNA, 1425 bp, Artificial Sequence
  Description of Artificial Sequence: Synthetic coding sequence
atggagtctaaggcactgcttgtgcttactctggcagtgtggcttcagtcccttactgcgtccagaggaggggtggcagcagccgaccaaaggagggacttcatcgatatagaaagcaagtttgcccttcggacccccgaagatactgcggaggatacttgccaccttattccaggagtcgcagaatcagtcgcaacttgtcacttcaaccattccagtaagacgtttatggtgatccacgggtggaccgtgaccggaatgtacgaaagctgggtgcctaagctcgtcgcagcactgtacaagcgcgaaccagactcgaacgtcatcgtcgtcgactggctttccagagcacaagagcattaccctgtgtcagcaggttacaccaagctggtcggacaagacgtggcacgtttcattaactggatggaggaagaattcaactacccactggacaacgtccatcttctggggtactcgttgggtgcgcatgcagcaggcattgccgggtcactgaccaacaaaaaggtcaatagaattaccgggttggatccagccggaccgaactttgagtacgcagaggcaccttcaagactctcaccggacgacgctgactttgtggacgtccttcacacctttactaggggctcgcctggtcgctcgatcgggattcaaaagccggtgggacatgtggatatctatcctaatggcggcaccttccaaccaggctgtaatatcggggaagcaattcgagtgatagccgaacggggcctgggggacgtggatcaacttgtgaagtgtagccacgagcgcagcatacatctcttcattgattccctgctcaacgaagagaatccttcaaaggcctaccggtgctcgagcaaggaagcattcgaaaagggactgtgtctctcatgccgcaaaaacaggtgtaataacctgggatacgagatcaataaggtccgtgcgaagagatcgagtaagatgtatcttaaaactagaagccaaatgccatacaaagtgttccattaccaagtgaaaattcatttctcagggaccgagtcagaaacccacacgaatcaagcatttgaaatatcactgtacggcacggtggccgagtcggaaaacattccctttaccctccctgaagtgagcacgaacaagacttattcgtttctcatttacactgaagtggatatcggagagctgctgatgttgaaactcaaatggaagagcgattcgtacttctcatggtcagattggtggtctagccccggcttcgcaatacagaagattcgggtgaaggcaggtgaaacccaaaagaaggtgatcttttgcagccgcgagaaggtgagccatctccaaaagggaaaggctcccgcagtgttcgtgaagtgtcatgataagtccctgaacaagaagtcggga

SEQ ID NO: 15851 - DNA, 1425 bp, Artificial Sequence
  Description of Artificial Sequence: Synthetic coding sequence
atggaatccaaggccctgttggttctcacacttgcagtgtggctccagagcctaactgcatccaggggaggcgtggctgcagccgatcagcgacgcgattttatagatatcgagtcaaaattcgccctgcgcactcctgaagacactgctgaggatacatgccacctcatacctggcgtcgccgaatccgtggccacatgccatttcaaccacagttccaaaacctttatggtcatccatggttggaccgtgaccggcatgtacgagtcttgggtgccgaaactggttgccgccttgtataagagagagcccgactccaacgtgatcgtagttgattggcttagtagagcccaggaacactatcctgttagcgccggctacaccaagttggtcggccaggatgttgccagatttatcaactggatggaggaagagttcaactaccctttggacaacgtgcacctcctgggctacagtcttggagcgcacgcggctggaattgccggaagcttgacaaataagaaagttaaccggatcaccgggcttgaccctgccgggcctaacttcgagtacgctgaagctccttccaggctcagtccggacgacgcagacttcgtcgatgtgctccatacttttacgaggggcagcccagggaggtccatcggtatccagaagcctgtgggtcacgtcgacatctaccctaatggagggacatttcaacctggctgcaacatcggcgaagcgatccgggtaatcgctgagcgtggattaggcgacgtagatcagctagttaagtgtagccatgaaaggtcaatccacctatttatagatagtctcctgaacgaggagaacccatcgaaagcctatcggtgtagcagcaaagaggcatttgagaaaggactctgcctttcctgcaggaagaatcgatgtaacaacctcggatatgaaatcaacaaggtgcgcgctaagagaagttcgaaaatgtaccttaagacccgctcacagatgccttacaaggtgtttcactaccaggtgaagattcatttttctgggaccgagagcgaaacacacacgaatcaggcatttgagattagcctgtatgggaccgtggctgagtccgagaacatcccattcacgttgcccgaggtgagtactaacaagacatattcgtttctcatctacaccgaggtcgatatcggagaactgctcatgctaaagctcaagtggaaatctgatagctacttcagctggagtgactggtggagttctccggggtttgccattcaaaaaattcgcgtgaaggcgggtgagacgcagaagaaggtaatcttttgttctcgtgagaaggtgagtcacctccagaagggcaaagcccctgcagtgttcgtgaagtgccatgataaaagtttgaataaaaaatccggc

SEQ ID NO: 15852 - DNA, 1425 bp, Artificial Sequence
  Description of Artificial Sequence: Synthetic coding sequence
atggaatctaaggctctgttagtgctgaccttggctgtctggcttcagagcctcacggcgtcccgaggtggcgttgcagctgcagaccaaagacgagatttcattgacattgagtcaaagttcgcactacgtacccctgaggatactgccgaggatacctgtcacctgatccccggggtggccgagtccgtggctacgtgtcactttaatcactctagtaaaacgttcatggtgattcatggctggaccgtcactgggatgtacgaatcatgggtgccaaagttagttgccgcattgtacaagagggagcctgactccaacgttatcgttgtcgattggctcagccgagctcaggaacactatcctgtgagtgctggatacactaaactggttgggcaagatgtggcccgctttatcaactggatggaggaggagttcaattaccctctcgataacgtacacttgcttggatactccctgggcgcccacgctgctggaattgcaggatccttgacaaacaaaaaagtgaataggataactggactggatcccgccgggcccaacttcgaatacgctgaggcaccttctaggctgtctcccgacgatgcagatttcgtggacgttctacacacctttacgcgcgggtccccgggcaggagcattggcatccagaagccggtcgggcatgtcgacatttatcctaatgggggcacattccagcccggctgcaatattggtgaggcgataagggtgatcgctgagcggggcctgggtgatgtggatcagctagtgaaatgctcccatgagagatccattcacctctttatcgattccttgctcaacgaggagaatccttcaaaagcttatcgatgcagctctaaggaagctttcgagaaaggcctctgtctgtcctgtaggaagaacaggtgtaataatctgggttacgaaatcaataaggtacgggcgaagcggagctccaagatgtaccttaagacgcgttcacagatgccttacaaggtgttccactaccaagtcaagatccacttttctggcaccgaaagcgaaactcacaccaaccaagcgtttgaaatttccctctacggcacagttgccgagtctgaaaatattccctttacgctgcccgaagtctccaccaataaaacatacagcttcctgatctataccgaggtggacattggcgaactcctgatgctgaaactgaaatggaagtctgactcctattttagctggtccgattggtggtcctcacccggctttgcgattcaaaaaatcagagtaaaagccggggagacccaaaaaaaagtcatattctgcagtagagagaaggtgagtcatttgcaaaagggcaaggccccggccgtgtttgtcaaatgtcacgacaaaagcctgaataagaagtcgggt

SEQ ID NO: 15853 - DNA, 1425 bp, Artificial Sequence
  Description of Artificial Sequence: Synthetic coding sequence
atggaaagtaaagcccttttagtgcttaccttggcggtatggctgcagagccttacagcgtctaggggtggggtcgctgcagctgatcagagaagggactttattgacatagagtccaagtttgcgctgcggacgcctgaggacaccgccgaggatacttgtcacctcatccctggcgtagccgagagcgtcgccacctgccactttaaccactcgtccaagactttcatggtgatccatggctggaccgtcacaggcatgtatgaaagctgggtccctaaactggtcgcggctttgtacaaacgggaaccagactccaacgtaattgtggtagattggctctcccgggcccaagaacattacccagtctcggccggttacaccaagctggtcggccaggatgttgctcgtttcataaattggatggaagaagagtttaactacccgctggataacgtgcacctgttaggttatagcctcggggctcatgccgcgggaatcgccggctctctaaccaataaaaaggtgaaccgcatcactggcctggatccagccgggcccaacttcgagtatgctgaggcacccagtaggctgtctccagatgatgccgactttgtggatgtgctccacacttttactcgtgggagtccagggcggtcaattgggatccagaagccagtggggcacgtagacatttatccaaatggcgggacatttcagcctggatgtaatattggcgaagctatcagagttattgccgagcgggggttgggggacgtggaccaacttgtgaagtgtagtcacgaaagatccatacacctgttcatcgactccttgctaaacgaggaaaacccgtccaaggcctacagatgcagttctaaggaggctttcgagaagggcctgtgtttatcatgcagaaagaaccggtgtaataacctgggatatgaaattaataaagtgcgagccaagagatcaagtaagatgtacttgaaaactcgctctcaaatgccttataaagtcttccactaccaggtcaagatacatttcagtggaactgaaagtgagactcataccaatcaggccttcgagatttctctgtacggaacagtggcagagtctgaaaatattcctttcacccttcccgaagtgagcacaaataagacctatagtttcctgatctacactgaggtcgacatcggcgagctactgatgctaaagctgaagtggaaatcagatagctacttctcttggtctgactggtggtcgagcccggggtttgcgatccaaaagatccgagtgaaggctggagaaactcagaaaaaggttatcttttgttccagggagaaggtgagtcatctgcagaaaggcaaagcccctgccgtgttcgtgaagtgtcatgataaaagcctcaacaaaaagagcggg

SEQ ID NO: 15854 - DNA, 1425 bp, Artificial Sequence
  Description of Artificial Sequence: Synthetic coding sequence
atggaatccaaggcgctcctggtgctcactctggctgtttggttgcaaagcctgaccgcaagccgcggcggggtggcggccgccgaccagcgccgcgactttatcgatatcgaatcgaagttcgcactccggaccccggaggacaccgcggaggacacttgccatctgatcccgggagttgcagagtcggtggccacctgccacttcaaccattcctcaaaaactttcatggtcattcatggctggaccgtcaccggaatgtacgaatcatgggtcccgaagctcgtggccgcgctttacaagagagaacctgacagcaacgtgatcgtcgtggactggctgagccgagcccaagaacattacccggtgtcggccggatacaccaagctggtgggccaagacgtggcgcgattcattaactggatggaggaagagttcaactacccccttgacaacgtccacttgctgggatactcgctcggagctcacgcagctggtattgccggatcactgactaacaaaaaggtgaaccggatcactggattggatccggccggcccaaacttcgaatacgccgaagccccgagcagattgtccccagatgacgccgatttcgtggacgtgctgcacacctttaccaggggatccccgggccgctcgatcggaatccagaagcccgtcggacacgtggacatctatcctaatggaggtactttccagccgggatgcaacatcggtgaagcgattagggtgatcgccgagagaggcctcggcgacgtggatcaattggtgaaatgttcccacgaaagaagcatccatctcttcattgactcactgctgaacgaggagaaccccagcaaggcctaccggtgctcatcaaaagaagcattcgaaaagggactctgtctgtcctgccggaaaaatcgctgcaacaacctcggctacgaaatcaacaaggtgcgcgctaagagaagctcaaagatgtaccttaagacccgcagccagatgccgtacaaggtctttcactaccaggtgaagatccacttctcggggaccgagtcagaaacgcatacgaaccaggccttcgagatttcgctgtacggaaccgtcgcagaatccgaaaacatcccgtttactctgcctgaagtttccaccaataagacctactcttttttgatctacactgaggtcgacatcggagagttgcttatgctcaagctcaaatggaagtcggactcatacttctcgtggtccgactggtggtcctcgccagggttcgctatccagaagatccgcgtgaaggcaggggagactcaaaagaaggtcattttctgctcccgcgagaaggtgtcacatctgcagaagggaaaggcgccggcggtgtttgtgaaatgccatgacaagtccttgaacaagaagagcgga

SEQ ID NO: 15855 - DNA, 1425 bp, Artificial Sequence
  Description of Artificial Sequence: Synthetic coding sequence
atggagagtaaggcgctgctggtgttgacactggctgtttggcttcagtccctcaccgccagtaggggcggagttgcagccgccgaccagcgcagggacttcatcgatatcgaaagcaagttcgcgctccgcaccccagaggatacggcagaagacacctgtcatctcatccccggtgttgccgagagtgtggccacttgtcatttcaaccactcatctaaaaccttcatggtgatccacggttggacagtcaccggcatgtacgaaagctgggtgcctaagttggtcgcagccctgtataagcgcgaaccagattctaacgtgatcgtcgtggattggctgtctagagcgcaggaacactacccagtgtcagccggctataccaagctcgttggccaggatgttgccaggttcattaattggatggaggaggaatttaactatccacttgataatgtccatctcctcggatactccctgggagctcacgccgccggcatcgccggatctcttactaataaaaaggtgaatagaatcactggacttgaccccgccggccccaacttcgagtatgctgaagcgccatcccgcctctcacctgatgacgctgactttgtggatgtgctgcacaccttcacgagaggcagcccaggtcgctccatcggtatccagaagcccgtaggacacgtcgacatttaccccaacggtggcaccttccaaccaggctgtaacatcggcgaggccatacgcgttatcgccgagaggggtttgggtgatgttgatcaactggttaagtgttctcatgaacgcagtattcatcttttcatcgattccctgctcaacgaagagaacccctcaaaagcgtaccgctgcagcagtaaagaggcgtttgagaagggcctgtgtctctcatgtaggaagaatcgctgcaataacttgggatacgagattaacaaggttagggctaagaggagctctaagatgtatcttaaaacgaggtctcaaatgccgtacaaggttttccactatcaggtcaaaatccatttttctggcacagagagcgagacgcacacaaaccaggcatttgagatcagtctgtacggcactgtcgcagaatccgaaaacatcccgtttacacttccagaggtgtcaaccaataagacatactcatttctgatctatactgaggtggatatcggtgaattgctgatgctcaaattgaagtggaaatccgattcatatttctcctggagcgactggtggtcttcccctggatttgcaatccaaaagatcagggtgaaggccggagagacacagaagaaagttatcttctgtagtagagagaaggtatctcacctgcagaaaggaaaggcccctgcggtgttcgtaaagtgtcacgataagagcctcaacaagaaaagcggt

SEQ ID NO: 15856 - DNA, 1425 bp, Artificial Sequence
  Description of Artificial Sequence: Synthetic coding sequence
atggagagtaaggctctactggtgcttacactagctgtctggctccagagcctgaccgcgtccagggggggagtggccgcagctgaccagagaagggattttatcgacatcgaaagcaagtttgcactgcggacccccgaagatactgccgaggatacctgtcacctgattcccggggtggcagaatctgtggcgacctgtcacttcaaccacagctctaaaacctttatggtcatccacggctggacagtgactgggatgtatgagtcctgggtgcccaaactcgtggcggcactttacaagagggaacccgacagcaatgtgatagtggtggattggctgagcagggcacaggaacactatcctgtgagtgctgggtataccaagctcgtgggccaagatgtggccaggttcatcaactggatggaggaggaatttaactatccactggataacgtgcaccttttgggatacagccttggggcgcacgcggccggcattgcgggatctcttacaaataagaaagtgaaccgaattacggggctggacccagctgggcctaacttcgagtatgccgaggcaccctctcggctgtcacctgacgatgcggacttcgttgacgtgctgcacaccttcacccggggctccccaggtcgttccatcggaattcagaaacccgtggggcacgtggatatctaccccaacggaggaaccttccaacccggctgcaacattggggaagcaattcgggtcattgctgagagaggactgggagacgtggatcaattggttaagtgctcccacgaaagatcgatacatctgttcatcgactctttattaaacgaggagaacccctctaaagcgtatcgatgctcttccaaagaggcctttgaaaaggggctatgcctgagctgccgaaagaaccgctgcaacaaccttggatacgaaattaataaagtgagggcaaagcgctccagcaagatgtacctgaagactcgctctcagatgccgtacaaggtgtttcactaccaggtgaagatccacttttccggtaccgagtccgaaacacacaccaaccaagcttttgagatctctctttacgggactgtggccgagtccgagaatattccgttcacgctgcctgaggtttcgacaaataaaacctactcatttctgatttacacggaggtcgatataggtgagctgctgatgctgaagttgaagtggaagagcgactcctacttttcatggtcagattggtggagctcccccggctttgcaatacagaaaatcagagttaaagctggagagactcagaagaaagtgattttctgcagccgagagaaagtgagccacctccagaagggcaaagctcctgctgtgttcgtaaagtgccatgataagagcttaaataagaaatctggc

SEQ ID NO: 15857 - DNA, 1425 bp, Artificial Sequence
  Description of Artificial Sequence: Synthetic coding sequence
atggagtcaaaggctctgctagtgctcaccctcgctgtgtggctgcagtcgctaacggcctcacggggcggggtggccgctgcggatcagcggcgggatttcatcgacattgagagtaaatttgccctgagaactcccgaggatactgcagaagacacctgccacctgatccccggagtggccgagagcgttgcgacctgtcattttaatcacagctcaaaaaccttcatggttattcacgggtggaccgttaccgggatgtacgagtcctgggtgcccaaattggttgcagccctgtacaaacgagaacccgacagtaacgttattgtggttgactggctctcacgggctcaggaacactatcccgtgagcgctggctataccaaactcgtgggacaggacgtcgctaggttcattaactggatggaagaagaattcaattaccccctggataacgtacatctgcttggatattcactaggcgcgcatgccgcagggatcgctgggtctctgacaaataaaaaagtcaataggattaccggcctggacccagccggacctaatttcgaatacgccgaagcaccatctcgcctgtcccctgacgacgctgattttgtggatgtcctgcatacattcactcgggggtcaccaggaagaagcataggaatccagaagccagtgggacacgtcgacatctacccgaacggtggcacatttcagcccgggtgcaacataggggaagccatcagggtgatcgcagaacgtggactgggcgatgtggatcagctggttaagtgttctcacgaaagaagcatccatctcttcattgactctctgctcaacgaggagaatcccagtaaagcatacaggtgctcgagcaaggaggcattcgaaaagggcctctgcctcagttgccgaaaaaaccgctgtaacaacctgggctacgaaattaacaaggttcgcgccaaacgatcatctaagatgtacttaaaaacacggagtcagatgccatacaaagtgtttcactaccaggttaaaatccatttctccggcacggagtcagaaacccacactaatcaggcttttgaaattagcctctatggcacagttgccgaaagcgaaaatatcccttttacgttgcccgaggtgagcacgaataaaacctatagtttcttgatttatactgaagttgacataggggagctgcttatgcttaaactgaaatggaagtccgactcctacttcagctggagcgactggtggtccagtccaggatttgctatacagaagattcgggtgaaggctggggaaacccagaagaaggtgattttctgctccagagagaaggtgtcccacctacagaaaggcaaggcccctgccgtgttcgtgaagtgccatgataagtctctgaacaaaaaatccggc

SEQ ID NO: 15858 - DNA, 1425 bp, Artificial Sequence
  Description of Artificial Sequence: Synthetic coding sequence
atggaatccaaggctctcttggtgctcaccctggctgtgtggctgcagagcctgaccgcgtcgcgcggtggtgtggccgcggctgaccagcggagagacttcatcgatattgaaagcaagtttgcgctgcggacccccgaggacactgccgaggatacctgtcatttgatccctggagtggctgaaagcgttgccacgtgccacttcaaccattcctctaagactttcatggtgattcacgggtggaccgtgactggtatgtacgaatcgtgggttcctaagctggtcgcggcactctacaagcgcgaaccggattcgaacgtgatcgtcgtggactggctttcgagagcacaggagcattacccagtgtccgcgggatacactaaactggtcggccaggacgtcgcgcgctttatcaattggatggaagaggaattcaactatccgctggataacgtccatctgcttggatactcgctcggagcccacgcggcaggcatcgcaggaagcctgaccaacaagaaagtgaaccgcatcactggcctggacccggcgggacctaatttcgagtacgccgaagcgccgtcacgactgtccccagatgatgcggacttcgtggacgttctgcacactttcactcggggttcaccgggaagatcgatcgggatccagaagccagtcgggcacgtcgacatctacccaaatggaggcaccttccaaccgggttgcaacatcggtgaagctatccgagtcatcgctgagcgtggtcttggcgacgtggaccagctggtgaagtgcagccacgagcggtcgatccacctctttatcgactccctgctcaacgaagaaaatccgtcgaaggcctaccggtgctcatccaaggaggcgtttgagaaagggctctgcctgtcatgtcgcaagaatcggtgtaacaacctgggctacgagatcaacaaagtgcgcgcaaagcggtcgtccaagatgtatctgaaaaccagatcacaaatgccgtacaaagtgttccattaccaggtgaagatccacttctccggaacggagtcggaaacccataccaaccaagcatttgaaatctcgctgtatggaactgttgccgagagcgagaacatccctttcactctccccgaagtctcaaccaataagacctactcgttcctcatctataccgaggtcgatattggggaactgcttatgctcaaactgaaatggaaatcggacagctacttctcatggtcagactggtggtctagccctggcttcgccatccagaaaattcgggtgaaggccggtgaaacgcagaagaaagttatcttctgttcgcgcgaaaaggtcagccatctgcaaaaggggaaggccccagccgtgttcgtgaagtgtcacgacaagtcactgaataagaagtcagga

SEQ ID NO: 15859 - DNA, 1425 bp, Artificial Sequence
  Description of Artificial Sequence: Synthetic coding sequence
atggaaagtaaggctctgctcgtgctcactctggctgtttggctgcagtccctgaccgcttcacggggcggggtggccgccgccgaccaaagacgggacttcatcgatatcgagtccaaattcgcgctgcgaactcccgaagataccgcggaggatacctgtcacttgatcccgggcgtcgccgaaagcgtcgcaacgtgtcactttaaccatagctcaaaaactttcatggtcatccacggttggaccgtgactggaatgtacgaatcatgggtcccgaagttggtcgctgcattgtacaagagggaaccggattctaacgtgatcgtggtggactggctgtcgcgcgcccaagagcactatccggtcagcgccggatacaccaagctcgtcggacaggatgtggcccgcttcattaactggatggaggaagagtttaactaccccctggacaatgtccacctgctcggatattcgctgggagcccacgcagctggaatagcaggatccctgactaacaagaaagtgaatcgcattactgggctcgaccctgcaggccctaacttcgagtacgctgaggcaccgtcgcgcctgagcccggacgacgcggacttcgttgatgtcctgcatactttcacgcggggatcccctggccggtcaatcggtatacaaaagcctgtgggccacgtcgacatctacccgaacgggggaactttccagccagggtgtaatatcggagaggcaatccgcgtgatagcggagcggggactgggagatgtggaccagttggtgaagtgctcacatgaacggtcaatccaccttttcatcgattcactgctcaatgaggaaaatccttcaaaggcatacaggtgctcgtcaaaggaggctttcgagaagggtctgtgcctgtcgtgtcgaaaaaaccgctgcaacaacctgggctacgaaatcaataaagtgagagccaagagatcttcaaagatgtacctcaaaaccagatcccagatgccgtacaaggtctttcattaccaggtgaaaatccacttctcgggcacggagagcgagactcataccaaccaggcattcgaaatttcgttgtacgggacggtggcggaatcggagaacatcccttttacgcttccggaggtgtcgaccaataagacttatagctttctgatctacaccgaagtggacatcggagagcttctcatgctgaagctgaagtggaagtcagattcgtacttctcctggagcgactggtggtcctcgccaggctttgccatccaaaagatccgagtgaaggccggagaaactcagaagaaggtgatcttctgctcccgcgagaaagtctcacatctgcaaaaaggaaaagccccggccgtgttcgtgaagtgccacgataagagcttgaacaagaagagcggg

SEQ ID NO: 15860 - DNA, 1425 bp, Artificial Sequence
  Description of Artificial Sequence: Synthetic coding sequence
atggaatccaaagctcttctcgtactgactctcgcagtgtggctgcagtccctcaccgcctccaggggtggggtcgctgccgccgaccagaggcgggacttcattgacattgagtcaaaatttgctctgcgtacaccagaagacacagccgaagacacatgtcacctcatacctggagtcgccgagtctgtggctacatgccatttcaaccacagctccaaaacctttatggttatccatggttggacagtgacaggcatgtacgaatcatgggtgcccaaattggttgctgccttatataaacgggagcccgattccaatgtgatcgtcgtcgactggctgtcccgggcccaggagcactatccggttagtgcagggtatactaaactggtgggccaggatgttgccagattcataaactggatggaggaggagttcaattatccactggataacgttcacctgttgggctactcgctgggcgctcatgctgcggggatagccgggagcctcaccaacaagaaggtaaaccgaattaccggactggatcctgcaggacctaactttgaatacgctgaggccccgtcccgcctgtctccggatgacgccgatttcgttgatgtcctgcacacttttacccgcgggagtccgggccgctcgattggtattcagaaacccgtgggccatgtggacatttaccccaacggagggacattccagcccggctgcaacattggagaagccataagagtaatcgccgagagaggcctgggcgatgtcgaccagcttgtgaaatgctctcatgagagatccatccatctattcatcgacagtctgctgaacgaagaaaatccctcaaaggcctatagatgttcgtctaaggaggctttcgagaagggattgtgcctgtcttgcagaaagaacaggtgcaacaatctcggttatgaaattaacaaagtgcgagccaagagatctagcaagatgtatcttaagaccaggtcacagatgccttacaaggtatttcattatcaagtcaaaatccacttctctggcactgaatccgaaacacacaccaatcaggcattcgagatttcactgtatggtaccgttgctgagtctgaaaacatcccatttaccttgccagaggtctcgaccaataaaacatattcattcctcatttacactgaggtagacatcggagaacttctgatgctgaagttgaaatggaagtcagattcgtactttagttggagcgactggtggagcagccccggatttgcgatacaaaagattcgcgttaaagccggagagacgcagaagaaggtgattttctgttctagagaaaaagtgtctcatttacagaaggggaaagcccctgcggtgtttgttaagtgccacgataaatcgctgaataaaaagtccggg

SEQ ID NO: 15861 - DNA, 1425 bp, Artificial Sequence
  Description of Artificial Sequence: Synthetic coding sequence
atggagagcaaggcactcctggtgcttaccctggccgtgtggctccaatcccttactgcatcgagagggggcgttgcagcagccgatcagagaagagactttattgacatagagtcaaagtttgcactgcgaaccccagaagataccgcggaagatacttgccatttgatcccgggcgtcgcggagtccgtggccacctgtcacttcaaccattccagtaagacctttatggtgattcatggatggaccgtcaccggtatgtacgaatcatgggtgcccaaactggtggcggccctgtacaaacgagaacctgattctaacgttattgttgtcgattggctctcaagggcacaggaacattaccctgtatccgccggctacaccaaacttgtgggacaggacgtggccagattcataaactggatggaggaggagtttaactaccccctggataatgtgcacctgctgggttactcacttggcgcacatgccgcgggaatcgctggttcgctgactaataagaaagtgaatcgcattacgggattggatcctgcaggtccaaatttcgagtacgccgaggcgccttcacgcctgtcccctgacgatgccgactttgtggacgtgcttcacacctttacgagaggatcacctggacgcagtattgggatacaaaagccagtgggccacgtcgacatttatccaaatggagggacgtttcagccagggtgcaacattggtgaagcaattcgcgtgatcgccgaacgcggtttgggcgatgtggaccagcttgtcaaatgttcgcatgaacggtcgatccacttgttcattgattccctgctgaacgaagaaaatccgtcgaaagcataccggtgctcgagcaaggaagcattcgagaaaggactctgccttagttgtaggaagaacagatgtaataacttgggttacgagatcaacaaagtgcgtgctaagcggtcatcaaagatgtaccttaagacccggtcgcagatgccctacaaggtgtttcactaccaagtgaaaatccattttagcggaactgaatctgaaactcatactaaccaagcatttgagatcagtctttatggaacggtcgcagaaagcgaaaacattcctttcactcttcccgaagtgtccaccaacaagacctactcgtttcttatctacactgaagtcgatattggagaacttttgatgctgaagctgaaatggaagtcggattcatactttagctggtcggattggtggagttccccaggatttgcaatccaaaagataagggtcaaggcgggggaaactcagaagaaggtcattttctgtagcagagaaaaggtgtcgcatctgcaaaaagggaaggccccagcagttttcgtcaagtgtcatgacaaatcccttaacaagaagtccgga

SEQ ID NO: 15862 - DNA, 1425 bp, Artificial Sequence
  Description of Artificial Sequence: Synthetic coding sequence
atggaatcaaaggctttgctcgtgctcaccctcgctgtgtggctccagtcgttgactgcctcccgcggaggagtggctgctgcagaccagcgccgcgactttattgatatcgaaagcaagttcgcactgcggacgccggaggacactgccgaggacacctgtcacctgattccaggcgttgcggaatcggttgccacctgccatttcaaccactcgagcaaaactttcatggtgattcatggttggaccgtgactgggatgtacgaatcatgggtgccaaagctggtggcggccctgtacaagcgggagcccgatagcaacgtgatcgtggtggactggcttagccgggcccaggagcattacccggtgtctgcgggatacaccaagctcgtcggacaagatgtggcgcggttcatcaactggatggaggaagaattcaattacccactggataatgtgcatctgcttggatattcactgggagcccacgcagcgggcatcgcaggatccctgaccaataagaaggtgaacaggatcaccggcctggatccagcgggtcctaacttcgaatacgcagaagctccttcgcggctctccccggacgacgctgacttcgtcgatgtgcttcacacgttcactaggggatcgcctggacgctcgatcggcattcagaagccggtgggccatgtggatatctacccaaatggaggaacttttcagccgggatgtaacatcggggaagcaatccgcgtcatcgccgagagaggccttggggacgtggatcagttggtgaagtgctcacatgagcgttcgatccaccttttcatcgatagcctgctgaatgaggaaaacccttcaaaggcctaccgctgctccagcaaggaagccttcgagaaggggctgtgcctctcgtgccgcaagaaccgctgtaacaaccttggatacgagatcaacaaggtgcgcgcaaagcgttcctctaaaatgtacttgaaaacgcggagccaaatgccatacaaggtgttccactaccaggtgaaaatccatttctctggaaccgaatcggaaacccacactaatcaggcattcgaaatctccctctacggaaccgtggctgaatctgagaatatcccctttactttgccggaagtgtccaccaacaaaacttattccttccttatctacaccgaggtggacatcggtgagctgcttatgctcaaactgaagtggaagtcggactcctacttcagttggagcgactggtggagctctcccggctttgctatccagaagatcagagtaaaagctggagaaactcagaaaaaggtgatcttttgcagccgggaaaaggtcagtcacctgcaaaaaggtaaggcgccggctgtgttcgtcaagtgccacgataagtcactgaacaaaaagtccggc

SEQ ID NO: 15863 - DNA, 1425 bp, Artificial Sequence
  Description of Artificial Sequence: Synthetic coding sequence
atggagtctaaagcgctgctggtgctcacgcttgcggtctggctccagtcactgaccgcaagccggggaggggtggccgcagccgatcagcgccgggatttcatcgatatcgagagcaaattcgccctccgcaccccggaggacaccgctgaggacacttgccacctgatcccaggagtggcagagtcggtggctacttgtcatttcaatcactcctcgaaaaccttcatggtgatccacggatggaccgtgaccggcatgtacgagtcgtgggtccctaagctggtcgcagcattgtacaagcgagaaccggattcaaatgtgatcgtggtggactggctctcccgcgcacaggaacattacccggtgagcgcaggatacactaagctggtgggacaggatgtcgctcgcttcatcaactggatggaagaggaattcaattaccccctcgacaacgtccatctgctgggatactccctcggcgcacacgccgctgggatcgctggctcactgaccaacaaaaaggtgaacagaattactgggctggacccggctggaccgaacttcgagtacgcggaggccccgtcacggttgtcgcctgatgacgcggatttcgtcgatgtgctgcacaccttcaccagaggatcacccggtcgctcgatcggcatccagaagcccgtcggccatgtcgacatctatccgaacggaggaactttccaaccgggctgcaatattggagaagccattcgggtgattgcagaacgtggcttgggcgacgtagatcagctggtgaagtgctcgcatgagcgatccatccatctgttcatcgacagcctgctcaacgaagagaatccgtccaaggcctaccggtgttcctctaaggaggccttcgaaaaaggactgtgcctgagctgcagaaagaatagatgcaacaatcttggttacgagataaacaaggtccgggccaaaagatcatctaagatgtacctcaagactagatcacagatgccttacaaagtctttcattaccaggtgaagatccacttttctggaactgagtcggaaacccatacgaatcaagcgttcgaaatctctctgtacggcactgtggcggagagcgagaacatcccttttactctgccagaagtctcgacgaacaagacctactccttcttgatctacaccgaagtcgatatcggtgagctcctgatgctgaaacttaagtggaagtcggactcctacttcagctggtcagattggtggagctccccggggtttgccatccagaaaatccgcgtgaaggctggggaaactcagaagaaggtgatcttctgctcacgcgaaaaggtgtcccacttgcagaaaggaaaggctccggcggttttcgtgaagtgtcacgataaatccctgaacaaaaagagcgga

SEQ ID NO: 15864 - DNA, 1425 bp, Artificial Sequence
  Description of Artificial Sequence: Synthetic coding sequence
atggagtccaaggccctcctcgtgctcaccctggccgtgtggctgcagagtctgacagcctcacgcggcggggttgcagcagctgatcagcgtcgcgacttcatcgatattgagtctaagttcgccctccgcacaccggaggacaccgccgaagatacgtgtcatctgatccctggagttgccgagtccgtcgcgacatgccactttaaccactcctcgaagaccttcatggtcatccacgggtggaccgtcactggaatgtacgagtcttgggtgccaaagctggtagcggccctgtacaagagggaaccggattcgaatgtcatcgtggtggattggttgtcccgcgctcaggagcactaccccgtttctgcgggctatactaagctggtgggtcaagacgtcgcccgtttcatcaactggatggaagaagagttcaattaccccctcgacaacgtccacctgctaggctactcactcggggcccatgctgcgggcattgctggaagcctgacgaacaaaaaggtcaatcgaatcaccggcttggacccagctgggcccaacttcgagtacgctgaagcccctagcaggctcagtccggatgacgctgattttgtcgatgttctccacaccttcactagaggctccccgggccgctccatcggcattcaaaaaccggtgggacacgtcgatatctaccccaacggaggcacttttcagcccgggtgcaacatcggggaggcaatccgggtgatcgctgagcgcggccttggtgacgtcgatcagctagttaagtgctcccacgaacgcagtatccacctgttcattgactccctgcttaacgaagagaaccccagcaaagcgtatcggtgttcctcgaaggaggctttcgagaagggcctctgcctgtcttgcaggaagaaccgctgtaataacctgggatacgagatcaacaaagttcgtgccaaacgatccagtaagatgtacctgaaaactcgcagccaaatgccttataaggttttccactatcaggttaagatccacttctcgggaaccgagtctgagactcacacaaatcaggccttcgagatctccttgtatggaaccgtggcagagtctgagaacatcccatttactctgcctgaggtatcgaccaataagacatattccttcctgatctacacagaggtagatatcggtgagctgctaatgctgaagctgaagtggaagtcggattcctacttctcctggagtgactggtggtcttctccgggtttcgcgatccaaaagatccgcgttaaagccggcgagacccagaagaaggtcattttttgctctcgcgagaaagtgtcccacttgcagaaagggaaagcccccgcggtgtttgtcaagtgccacgacaagtcgttgaacaagaagtccggc

SEQ ID NO: 15865 - DNA, 1425 bp, Artificial Sequence
  Description of Artificial Sequence: Synthetic coding sequence
atggagtcgaaagctctcctggtcttgaccctcgctgtttggctgcagagtctcacagccagtcgaggcggagtggcagccgccgaccaaagacgggattttattgacatcgaatccaagttcgccttacgcactcccgaggacactgccgaggacacttgccacctgatcccgggcgtcgctgagtcagtggctacatgtcattttaatcattccagtaagacattcatggtgatccacggatggacagtgacaggtatgtatgagagctgggtccctaaactagtagccgccctttacaagcgcgaacctgacagtaacgtgattgtcgttgactggctctcaagggcacaggagcactacccagtgtcggcaggctacaccaaactcgtgggccaggacgtcgctcggttcatcaattggatggaggaggagttcaattacccactggataatgtgcacctcctgggatacagcctgggcgcccacgctgctggaattgctgggagcctgacaaataagaaggtgaatcgtataaccgggttggatcccgccggccccaatttcgaatacgcagaagcaccctcacgtttgagtccagatgacgcagactttgtggatgttcttcacacatttactagaggtagccccggcagaagcataggcattcaaaaaccagtcgggcatgtggacatttaccctaacggcggaaccttccagcccggatgcaacataggtgaggcaatcagagtgatcgcagagcgcgggctgggagatgtcgaccagctggtaaagtgttcgcacgaacgctccatccacctctttatagacagcctgctaaatgaggagaatccgtctaaagcgtatagatgctcttcgaaggaagcgttcgagaagggtctttgcctgagctgccgcaagaatagatgcaataatctcggatatgaaatcaataaagtcagggcaaaacggagctctaaaatgtatcttaaaacacgtagccagatgccttacaaggttttccattatcaggtgaagattcacttttcaggcaccgagtccgaaacccacacaaaccaagcctttgaaatctcactctacgggaccgtcgcagaatccgagaatataccgtttactcttccagaagttagcaccaacaagacctatagtttcctgatttacacagaagtagacatcggggagctgctaatgctgaagctgaaatggaaatcagatagttatttttcatggagcgactggtggagtagccccgggtttgctatccagaagattagggtaaaagctggggagacgcagaagaaagtgattttttgctctcgcgaaaaagtgtcacacctgcagaaaggcaaggcaccagccgtgtttgtcaaatgccatgataaatccctgaacaaaaagtctggg

SEQ ID NO: 15866 - DNA, 1425 bp, Artificial Sequence
  Description of Artificial Sequence: Synthetic coding sequence
atggagagtaaggctcttctagtgctcactctagctgtctggctccaaagtttgacagcatcaagagggggagtagcggctgctgaccaaagaagagattttatagatatagaatcaaagtttgcattgagaactccagaggataccgcagaggacacatgtcatttgattccaggagttgcagagtctgtcgctacttgccattttaatcactcttctaaaacttttatggttattcatggctggaccgtgaccggaatgtatgaaagttgggtcccaaaactagtggcagcactgtataagcgcgagccagactctaatgttattgtggtcgattggctatccagggcacaggagcactatcctgtgagcgccggatacaccaagttagtgggacaagatgttgctagatttattaattggatggaagaagaattcaactatcccctggataatgtgcaccttttggggtacagcttgggggcccatgctgccggaatcgccggtagtttgaccaataaaaaggttaatcgtatcaccggtttggatcccgcaggaccaaacttcgaatatgcagaggccccttcgcgtttgtcgcctgacgatgctgattttgtcgatgtcttgcacacctttactagagggagccctggcaggtctatcggaattcagaagccagttggccatgtggacatatacccaaatggaggaacttttcaacctggttgtaatattggtgaggctatcagagtcattgccgaaaggggcctaggagacgtggatcaactggtaaaatgctctcatgaaagatctattcacctatttattgactctttattaaacgaggagaacccaagcaaggcctatcgttgttcctccaaggaagcttttgaaaaaggtctctgccttagctgtagaaaaaatcgttgcaacaatcttgggtatgaaattaacaaagttagagcgaagagatctagcaaaatgtacttgaaaactaggagccaaatgccctataaggtcttccattatcaagtgaaaatccatttcagtggcacagagagtgagactcatactaaccaggcttttgaaatttcgttatatggaacagtggcagagagcgaaaatattccgtttacccttccagaagtgtcaactaacaagacatatagctttttaatttatacagaggttgatatcggtgaacttttaatgctgaagttgaagtggaaatcagatagttacttctcctggtccgactggtggtcgtcaccaggatttgctatacaaaaaattcgagtcaaggcaggagaaactcagaaaaaggttatattttgttcaagagagaaggtttcccacttgcagaaggggaaggcgcccgccgtgtttgtgaagtgtcacgataaatcacttaacaagaaaagcggt

SEQ ID NO: 15867 - DNA, 1425 bp, Artificial Sequence
  Description of Artificial Sequence: Synthetic coding sequence
atggaatccaaggctctgctggtgctgactctcgcagtgtggctgcaaagcttgacggccagccgtggcggtgtggctgctgctgatcagcgtcgcgactttattgatatcgagagcaaattcgcactgcgcactccagaggataccgctgaggatacgtgccatctgattccgggggtcgcagagtcagtcgcgacctgccactttaatcactcgtccaagaccttcatggtgatccacggttggacggtgacgggcatgtacgagtcttgggtgccaaagcttgttgccgctctgtataagcgtgaacctgactccaatgtaattgtggtggattggctgagccgtgcgcaggagcactacccagtgtctgcgggctatactaaattggttggtcaggacgtagcacgctttatcaactggatggaggaggagtttaactaccctctcgataacgtccatctgctgggctacagtttgggtgcccatgccgcggggattgcgggatcactaaccaacaagaaggtgaaccgcataactggtctcgatccggcgggtcctaacttcgagtacgcagaagccccatctaggctctctcctgacgacgccgactttgtggacgtgctgcacacctttacgaggggtagccctggtcgcagcattggtatccagaaacccgtcgggcacgttgacatctatcccaatggaggcacattccaaccgggctgtaatatcggtgaggcgattcgagtcatcgcggagcgcggtctgggcgatgtagatcagcttgtgaagtgcagccacgagcgcagcattcatttattcattgatagcctgttgaatgaggaaaatcctagtaaggcctaccgctgctcttccaaggaagctttcgaaaagggtctgtgcttgagctgccgcaaaaatcgctgcaacaatctggggtatgaaattaataaagtgagggctaaacgttccagcaagatgtatctcaagacgcgcagccagatgccttacaaagttttccactatcaggttaagatccatttctccggtacagagtctgagacccacaccaaccaggcgttcgagattagcctttatggtaccgttgccgagagcgagaacattccgttcaccctgcctgaggtctcgactaataagacctatagcttcttgatctacacggaggttgatatcggggaactgctgatgttgaagctgaagtggaaatctgactcctatttcagctggagcgactggtggagcagccctggtttcgccatccagaagatacgcgttaaggctggcgaaacccagaaaaaagttatcttctgtagccgtgagaaggtttcacatctgcagaagggcaaagcgccggccgttttcgtgaagtgccacgacaagtctttgaataagaagtccgga

SEQ ID NO: 15868 - DNA, 1425 bp, Artificial Sequence
  Description of Artificial Sequence: Synthetic coding sequence
atggagtctaaggcccttctggtgctgaccctagccgtgtggctgcagtctctaacagcgagtagagggggtgtggctgccgctgaccagcgcagggattttattgatatcgaaagtaagtttgcccttcgaacacccgaagataccgctgaagatacctgccacctgatccccggcgtagctgaaagtgtggcaacctgccactttaaccacagttccaagacattcatggtcatccacggatggactgtcacagggatgtacgagagttgggtgcccaagctggtggcagctctatataagcgcgagccagacagcaacgtgatcgttgtggactggctcagccgagcgcaggaacactaccccgtgtccgctggttatactaagttagtcggccaagatgttgctagattcatcaactggatggaggaggagttcaactacccccttgataatgtgcatctccttgggtactccctaggagctcatgctgccggtattgccggcagtctgaccaataaaaaagttaatcgcatcacggggctagacccggccggaccgaattttgagtacgccgaagcaccttcgcggcttagccccgacgacgctgactttgtggatgtgctccacactttcacccgaggttctccaggtaggtcaatcgggatccagaagcccgtaggtcacgtcgacatttatcctaacggtggtacctttcagcctggctgtaacatcggagaggcaatcagagtcatagctgagcggggactgggtgatgtggaccagctcgtgaagtgctcacacgagaggtccattcacctgtttatcgacagtttgctgaacgaggaaaaccctagtaaggcctatcgatgtagcagcaaagaagccttcgagaaaggcctctgcctgagctgtcgaaagaataggtgtaataatcttgggtacgagatcaataaagtgagagccaaaagatcctctaaaatgtacctgaagacaagatctcaaatgccatataaggtcttccactaccaagttaagatccacttttcaggaacagaatccgagacgcacacaaaccaagctttcgaaatctccctgtacggaaccgtcgctgagagtgagaatatccccttcaccctgccagaggttagtaccaataagacttattctttcctgatttacacagaggtcgacatcggcgagctgttgatgcttaaattgaagtggaagtcggactcctatttctcatggtcagattggtggtccagccccggcttcgcgatccagaaaattcgagtcaaagcaggagaaacccagaaaaaggtgatattctgtagccgcgaaaaagtcagccaccttcaaaaggggaaggcaccagcggtctttgtcaagtgtcacgataaaagcttaaataaaaaatctggc

SEQ ID NO: 15869 - DNA, 1425 bp, Artificial Sequence
  Description of Artificial Sequence: Synthetic coding sequence
atggagtctaaggcacttctcgtgctgaccctcgctgtctggctgcagagtctgaccgcgtcacgcggcggggtggcggcagcagatcaacgacgagactttattgacattgagtcaaaatttgccctgagaactccagaggacaccgccgaagacacgtgtcatctaatccccggcgtggccgagtcagttgccacctgtcacttcaaccactccagcaaaacattcatggtaattcatggatggaccgtgacaggaatgtacgaaagttgggttcctaagttagtcgctgccctatataagcgggagcccgacagtaacgttatcgtggtcgattggctgagcagggcgcaggagcattatcctgtgagtgctggatataccaagttagttgggcaagacgtggcccgcttcataaattggatggaggaggaatttaattaccctctggacaacgtgcaccttttgggttactccttgggtgcacacgctgctggtatagcagggtccctcaccaataagaaggttaatcgaatcaccggactagaccctgctggaccaaacttcgaatatgctgaggcaccgtcccgcctgtcccccgatgatgccgatttcgttgacgtgctgcacacctttaccaggggaagtccgggaagaagcattggcatccaaaaaccggtcggtcacgtggacatctatcccaatggaggcaccttccagcccggatgtaacatcggggaggcaattcgcgttatcgccgagagaggcctcggcgacgtcgaccagctggtcaagtgtagtcatgagcgctccattcacctgttcattgactccctcctcaatgaggagaatccgagtaaagcttacagatgttcatcgaaggaggcattcgagaagggcctttgcctgtcctgtcggaagaataggtgtaataatcttggttacgagataaataaggtccgggccaagcgctcttccaagatgtacctcaaaactcggtcccagatgccatataaagtgtttcactatcaagtgaaaattcatttctccggtactgaatctgagactcacaccaaccaggccttcgagatcagcctgtatggcactgttgcagaaagtgaaaacattcccttcacactccccgaggtgtctaccaacaagacctacagttttctaatctacacggaggtggatattggcgaactgttgatgcttaagctgaagtggaaaagcgacagctattttagttggagcgactggtggagttccccggggtttgccattcagaaaattagagtcaaggcgggggaaactcagaagaaggtgatcttctgcagtagggaaaaggtgagccatctgcagaaggggaaggcccctgcagtattcgtaaagtgccacgacaaaagtttgaacaaaaagtcaggt

SEQ ID NO: 15870 - DNA, 2580 bp, Artificial Sequence
  Description of Artificial Sequence: Synthetic coding sequence
atgggaccatggggctggaagctgcgatggacggtcgccctgctcctcgctgctgccggaactgcggtgggcgacaggtgcgagagaaacgagtttcaatgccaggatggcaagtgcatatcttacaaatgggtgtgcgacggttctgctgagtgtcaggacggtagtgatgagtctcaggagacatgtctaagcgtcacctgtaagtctggggatttttcgtgtgggggaagggttaatcgatgtattcctcagttctggaggtgcgacggtcaggtggactgtgataacggatctgacgagcaggggtgtcctcctaagacttgcagccaggacgagttccgctgtcacgacgggaagtgcattagcaggcagtttgtgtgtgatagtgatcgtgattgcctggacgggtccgacgaggcgagttgcccggtgttgacatgcggacccgctagttttcagtgtaactcgtctacgtgcataccacagctctgggcatgtgataatgacccagattgcgaagacgggagtgacgaatggcctcaaagatgtcggggattgtatgtttttcaaggggatagctcaccgtgctctgcattcgaatttcattgcctgtcaggcgagtgtatccattcctcctggcgttgtgacggtgggcctgactgcaaggataagtctgacgaggagaattgtgctgttgccacctgccgacccgatgaatttcaatgctctgatggcaattgtatccatggcagcaggcagtgcgatcgggagtacgactgtaaggatatgagtgatgaggtggggtgtgttaatgtgactctttgcgaaggccccaataagttcaagtgtcattccggcgagtgtataactcttgataaagtttgtaacatggctagggattgtcgtgactggtctgacgaaccaatcaaagaatgtggaacgaatgagtgcctggacaacaatggcggctgctctcacgtctgcaacgatctcaaaatcgggtatgagtgtttgtgtccagatggctttcagctggtcgctcagaggcggtgtgaagatatagacgagtgtcaagaccctgatacctgcagtcagctctgtgtgaatctggaggggggttacaagtgtcaatgtgaagagggattccaactggatcctcacaccaaagcctgcaaagccgtgggatcaatagcctacttgttcttcactaaccgtcacgaagtgcgcaagatgaccctcgacaggtcagaatatacatccctgataccgaacctgaggaatgttgtcgccttagataccgaggtcgcatccaatcggatttattggagcgacctgagtcagaggatgatctgcagcacccagcttgatagagcccacggcgtcagctcatatgataccgtgatcagtagagatattcaagccccggatggactcgcagtggattggattcattcaaacatctattggacagactcagtactggggacggtgtccgtcgccgacacaaaaggcgtgaagcggaagacactgttcagggagaacggatctaagccccgcgccatcgttgttgatcctgtacatgggtttatgtactggacggattggggaacgcccgccaagattaagaaaggaggacttaacggggtggatatatattcccttgtaactgagaatatacagtggccgaatggcatcaccctggatctgttgagtggccgactgtactgggttgattccaagctgcactcaatcagtagcatcgacgttaacgggggaaataggaagaccatcttggaagacgaaaagcgactggcccatcccttcagcctcgctgtgtttgaggataaagtgttttggacagacatcatcaacgaagcaattttttcagcaaacaggctcacaggttcagatgttaatctactggccgaaaatctcttgagtcctgaggacatggttcttttccacaatcttacacagccacgtggcgtgaactggtgtgaaaggacaactctgagcaatggtggatgtcagtatctgtgtttaccagccccacagattaatccccactcccctaagtttacttgcgcgtgtcccgacgggatgctccttgcccgcgatatgcgctcctgcctcacggaagcagaagccgcagtggctacccaagagactagcactgtcaggctcaaggtgagttcaacagcggtgcgaacgcaacacacgactaccaggcctgttccggacacatcgcggttgcctggagcaacaccgggtctgactacagtggaaattgtaaccatgtcccaccaggcactaggtgacgtggcaggtaggggcaatgagaaaaaaccctcctctgttcgcgccctatctatcgttttaccaattgtgttactcgtgttcctgtgtctcggagtgtttctgctatggaagaattggagactcaagaacattaatagtattaattttgacaaccccgtttatcagaaaacaacagaggatgaggtgcacatatgccacaatcaggatgggtattcatacccttctcgacagatggtgtccttagaagacgacgtggca

SEQ ID NO: 15871 - DNA, 2580 bp, Artificial Sequence
  Description of Artificial Sequence: Synthetic coding sequence
atgggaccgtggggatggaagctgaggtggactgtggccctgctgctcgcagcagccgggaccgcggtgggcgatcggtgcgaacggaacgaattccagtgtcaagacggaaaatgcatcagctacaagtgggtttgcgatggatcggccgaatgccaggacggatctgatgagtcccaagagacgtgtttgtcggtgacctgcaagagcggggatttctcatgcggaggacgcgtcaataggtgcatcccgcagttttggcggtgtgatggacaggtggattgcgataatgggtcagatgagcagggatgcccgccgaaaacctgctcccaggacgaattcagatgccatgacggtaagtgcatttcgcgccaattcgtctgcgactcggaccgcgactgcctggatggctcagacgaagcctcgtgcccggtgctgacttgcgggcctgcgagcttccaatgtaactccagcacgtgtatcccgcagctgtgggcttgtgacaatgacccagactgcgaggatggatcggacgaatggccgcagcgctgccggggcctttacgtgttccaaggagactctagcccatgctccgcgttcgaattccactgcctgtccggagaatgtatccactcatcttggcggtgcgacggtggaccagattgcaaggacaaatcggacgaggaaaattgcgcggttgccacttgtagaccagatgaatttcaatgctccgacggaaactgcattcatgggagcaggcaatgcgacagggagtacgactgtaaagatatgtcggatgaagtgggctgtgtgaacgtcaccctgtgcgaaggcccgaacaagttcaagtgccactcgggggaatgcatcactctggacaaggtgtgtaacatggcgcgcgactgtcgggattggtcggatgaaccgatcaaggaatgcggtactaacgaatgcctggacaataacggcggatgttcgcacgtgtgtaatgacctgaagatcgggtacgaatgcctgtgcccggacggattccagctggtggcgcagcggcgctgtgaggacatcgatgaatgtcaggacccggacacctgctcgcagctgtgcgtgaatctggagggtggatacaaatgtcagtgcgaggaaggattccaattggatccccatactaaggcctgtaaggccgtggggtctatcgcgtacctctttttcactaatagacatgaagtgcgcaaaatgaccctcgaccgttccgagtatacctcgctcatccctaacctccggaatgtagtggcgctcgacactgaggtggcgtctaaccgaatctattggtccgacctttcccagagaatgatctgttcgacgcaactggacagggcccatggtgtgtcgtcttacgatacggtcatcagccgggacatccaagcgcctgatggattggcagtggattggatccactcgaatatctactggactgattcagtgttgggaaccgtttccgtcgctgacactaaaggcgtgaagagaaagaccctgttccgggagaatggatccaagccacgcgccatcgtcgtggatccggtccatgggttcatgtactggaccgattggggaaccccggccaagatcaaaaagggaggtctgaacggagtggacatctactcgctcgtcaccgagaatattcagtggcctaatgggatcacccttgatctgctctcgggccggctgtactgggtggacagcaagctgcattccatctcgagtatcgatgtgaatggaggcaaccggaaaacgatactggaagatgagaaaagactcgcccacccattctcgctggcggtgttcgaggacaaggtgttttggaccgacatcattaacgaagccattttctccgcaaaccgcctcaccggctccgacgtgaacttgctggcggagaatctgctgtccccggaggatatggtgctgttccacaacctgactcagcctagaggggtgaactggtgcgaacgcaccaccttgtcgaatggcggatgtcaatacctgtgcctcccggccccccaaatcaatcctcattcccctaaattcacgtgcgcgtgcccagatggcatgctgctggcacgcgatatgcgcagctgcctcacggaagcggaggctgctgtggcaactcaagaaacctcaaccgtccggctgaaggtgtctagcacggcagtgcgcactcagcacactactacccgcccggtgccggacacgagccgccttccgggagctaccccgggacttactactgtggaaatcgtgactatgtcgcaccaggcgctgggagacgtggcgggacgcggcaacgagaaaaagccatcctcggtcagagctctctcaatcgtgctgccgatcgtgctgcttgtctttctctgcctcggagtgttcctcctctggaagaattggcgcctgaagaatatcaatagcatcaattttgataatccagtgtaccaaaagactaccgaggacgaagtccatatatgtcacaatcaagacggatactcgtacccgtccagacagatggtgtcactcgaggacgacgtggcc

SEQ ID NO: 15872 - DNA, 2580 bp, Artificial Sequence
  Description of Artificial Sequence: Synthetic coding sequence
atgggcccctggggctggaaactgagatggacagtggctctgctgctcgctgccgctgggacagctgtgggagaccgatgtgaaaggaacgagttccagtgtcaggacggtaaatgcattagctataaatgggtgtgtgacggcagtgcagaatgccaagatggtagtgacgagagccaagaaacatgcctctctgtgacttgtaagagtggcgatttttcttgtggagggcgggttaacaggtgcatcccccaattttggaggtgtgatgggcaggtcgactgcgataatggaagcgacgagcaggggtgcccacccaaaacctgctcacaggatgagttccggtgccatgacggcaagtgcatttcccgacagttcgtctgcgacagtgatagagactgtctagatggtagtgatgaagcctcctgtccggtgctcacctgcgggccagctagttttcagtgcaattctagcacatgcatcccacagctatgggcctgcgataatgatcccgattgcgaagatggctcagatgagtggccacaacgctgcagagggctgtatgtattccagggagatagttctccatgttccgcctttgaattccactgcctgtcgggcgagtgtatacactccagctggcggtgtgatggaggccctgactgtaaggataagtctgatgaggagaactgtgctgtcgctacatgcaggcccgatgaatttcagtgctccgacggcaattgtattcacgggtccaggcaatgtgatcgcgaatatgattgcaaagacatgagcgacgaagttggctgtgtaaacgtgacattgtgtgaggggcccaacaaattcaagtgccatagcggcgaatgcattacactggataaggtgtgcaatatggcgcgcgattgccgggattggagcgacgaacctatcaaggagtgtggcacaaatgagtgcctggacaacaacggtgggtgctcccacgtgtgtaacgacttaaagattggttacgagtgtctttgcccggacggattccagttagtggcacagcgacggtgtgaggacatcgacgagtgccaagaccccgacacctgtagtcagctgtgcgtaaatctggaaggtgggtataaatgccaatgtgaagagggctttcagctcgacccacacaccaaagcttgcaaggccgttgggagtatcgcatatctcttttttacaaatagacatgaagtccggaagatgacccttgaccgttccgagtacaccagtctgattcccaacttgcgcaacgtggttgcactggacaccgaggtggctagcaacagaatttactggtctgaccttagtcaaaggatgatctgctccacgcagctggacagggcacacggtgtgagttcatatgacacagtcatctccagggacatccaggcaccagatggactcgccgtcgattggatccatagcaacatctactggactgacagtgttctggggacggtgtccgttgccgatactaagggggtgaaacggaaaactctatttagagagaatggtagtaagccgagagccatcgtcgttgatccagttcatgggtttatgtattggacagattggggaacacctgcaaaaataaagaaaggggggctgaatggggtggacatatactcactggttaccgagaacatccagtggcctaatggcatcaccctggatctactcagtgggcggctctattgggtggattctaagttgcattctataagctcaattgatgtaaacgggggcaaccgcaaaactattctggaagacgagaagcggttggctcatcctttttccctggcagtcttcgaggataaggttttttggacggatatcatcaacgaagcgattttcagcgccaaccgattgactggatctgacgttaacctgctggcggagaaccttctttcccctgaagacatggtgctgtttcataatcttacacaaccccggggggtgaactggtgcgagcgtaccaccctgtctaacggcggctgtcagtacctgtgcttgcccgctccccagataaacccccactccccgaagttcacatgcgcgtgtcctgacgggatgctgctagcccgagacatgcggagctgcctcacagaagcagaggcagcggttgccactcaagagacatctaccgtgagattgaaggtctccagcacggctgtaagaactcagcataccacgactcggcctgtgcccgacacgtctaggctcccaggggcaaccccaggcctgacaaccgtagaaattgtcactatgtcccatcaggccctgggcgacgtggccgggcgcggaaacgaaaagaagccaagctctgtccgggctttgtctatcgtgctccctatcgtgctgctggtcttcctttgtttgggagtattcttgttgtggaaaaattggcggctcaaaaatatcaactctatcaatttcgacaaccctgtgtaccagaaaacaactgaggatgaggtccacatttgtcacaatcaggacggctattcttaccctagtcgacagatggtttccctggaggatgacgtcgcc

SEQ ID NO: 15873 - DNA, 2580 bp, Artificial Sequence
  Description of Artificial Sequence: Synthetic coding sequence
atgggaccgtggggttggaagctgagatggaccgtggcgctcttgctggccgccgctggaaccgccgtcggggaccgttgtgaacggaatgaattccaatgtcaagatggtaagtgcatctcatacaagtgggtgtgcgatggttcggccgaatgccaagacggcagcgatgagtcccaggagacttgcctgtcagttacctgtaagtcaggcgacttctcgtgtggaggcagggtgaaccgctgcattccacagttctggcggtgtgacggacaagtggattgcgacaatggatcagacgagcaaggatgcccgccaaagacttgcagccaggacgaatttagatgtcacgacggaaagtgcattagccggcaatttgtctgcgattccgacagagattgcttggatggctccgacgaagcctcatgtcccgtgctcacgtgtgggccagctagcttccagtgcaattcctctacctgtatcccacagctctgggcttgtgataacgacccggattgcgaggatggatccgacgagtggccccaacgctgcagggggctttacgtgttccaaggagactcaagcccatgcagcgctttcgagttccattgcctgtcgggagaatgcatccatagctcatggaggtgcgacggagggccggactgcaaggacaaatctgacgaggaaaactgtgctgtcgccacctgcagacccgacgagttccagtgttccgatggcaactgcatccacggctcgcgccaatgtgatagggaatacgattgtaaggacatgagcgatgaggtcggctgtgtgaacgttaccctgtgcgaaggccctaacaagttcaagtgccactcgggagagtgcatcactctcgacaaggtgtgcaatatggctagagattgtagagactggtctgacgagccgatcaaggaatgcggaaccaacgaatgcctcgataacaatggaggttgttctcacgtctgcaatgacctgaaaatcggttacgaatgcctctgcccagacggattccagctcgtggcccaacgccgttgcgaggatatcgacgaatgtcaagaccctgacacttgctcccagctctgcgtgaaccttgaagggggatacaagtgccagtgcgaagaaggcttccagcttgatcctcataccaaggcttgtaaggccgtaggaagcatcgcgtatctgttcttcactaataggcacgaggtgaggaaaatgactttggaccgatccgagtacacctcgctgattccgaatctccgcaacgtggtcgcgctcgatactgaggtcgcgtcgaaccgcatttactggtcggacctgtcccagcgcatgatctgttcgacccagctggaccgggcccatggtgtgtctagctacgacactgtcattagccgcgacatacaggcgccggacggcctggccgtggactggatccattcaaacatctattggacggatagcgtcctgggtacggtgtcggtcgcagacaccaagggcgtgaaacggaaaacgctgttccgcgagaatggatcaaagccaagagccatcgttgtggacccggttcatgggtttatgtactggaccgactggggaaccccagcgaagatcaagaaaggtggactgaatggagtcgacatctactcgctggtcactgaaaacatccagtggcccaatggcatcaccctggatctcctgtccggacggctgtactgggtcgatagcaaactccactcgatctcatccatagacgtcaatggaggtaatagaaaaaccattcttgaggacgaaaagcggttggctcacccttttagtctggccgtgtttgaagataaagtgttttggactgatatcatcaacgaagcgatcttttcggcaaacaggctgactggttcagacgtaaacctcctcgcggagaacctcctgtcgccggaggacatggtgctgttccacaacctgactcagccgaggggagttaattggtgtgagcgcactaccctgtcgaacggagggtgtcagtacctttgcctcccagcaccacaaatcaacccccactcaccaaagttcacgtgcgcgtgtccggacgggatgttgttggcacgggatatgcgctcgtgtctgactgaagcagaagccgctgtggcaacccaagaaacttcgactgtgcgcttgaaggtcagctccacggcagttcgtacccagcacacgaccacccgcccggtccctgatacttcgaggctgccgggagcaaccccgggactgaccactgtggaaatcgtgaccatgagtcatcaggcgctgggcgatgtggcgggccggggaaacgaaaagaagccgtcgtccgtgagggccctgtccatcgtcttgcccatcgtgctgctcgtgtttttgtgtctcggtgtctttcttctgtggaaaaactggcgcctcaaaaacataaactccattaacttcgacaaccctgtgtatcagaaaactacggaggacgaggtgcacatctgccacaaccaagatggctacagctacccgtcccgccagatggtgtccctggaggacgatgtggcc

SEQ ID NO: 15874 - DNA, 2580 bp, Artificial Sequence
  Description of Artificial Sequence: Synthetic coding sequence
atgggaccttgggggtggaaacttcgttggaccgtggccctcctgctcgcggccgccggtaccgccgtcggggatagatgtgaacgcaatgaattccagtgccaggacggtaaatgtatttcgtacaagtgggtctgtgatgggtccgcagaatgtcaggatggttcagacgaaagccaagagacttgcctttcggtcacctgtaaatccggtgatttctcatgtggaggacgtgtgaacagatgcattcctcaattctggcgctgtgatggacaagtggattgtgataacggttccgacgaacaaggttgtcctcctaagacgtgttcgcaggatgagtttaggtgccatgatggaaagtgcatttcgaggcagttcgtgtgtgactcggatagagattgcttggacggatcagatgaggcgtcctgtccagtcctgacttgtggtcccgcatcatttcagtgtaactcctcgacttgtatcccccagctttgggcctgtgacaacgacccagactgcgaagatggttcagatgaatggccacaaaggtgtagaggattgtacgtgttccaaggcgattcctccccgtgctccgcttttgaatttcattgcctttcaggggaatgtattcactcatcatggagatgtgatggagggccggattgtaaggacaagtcagatgaagaaaattgcgctgtcgcgacttgtcgtccagatgaatttcagtgctcggatggaaactgtatacacggatcccgtcaatgtgatagagaatacgattgtaaggatatgtcagatgaagtcggttgtgtcaacgtgaccctttgtgaaggtcctaacaagttcaagtgccacagcggagaatgtattacgctggacaaggtgtgtaacatggcaagagattgtcgcgactggagcgacgaacctattaaggaatgcggtactaatgagtgtcttgacaacaacggaggttgctcgcacgtgtgtaacgatctcaaaatcggttacgaatgtctgtgcccggacggatttcagctcgtggcccaacgccggtgtgaagatattgatgagtgccaggatcctgatacgtgctcccagctttgcgtgaatctggagggcggatacaagtgccaatgtgaggaagggttccaacttgacccccacacgaaggcatgtaaggccgtgggatccatagcatacctgttctttactaatcggcacgaagtgcgtaagatgactttggatcgatcagaatacaccagccttataccaaacctgcgcaacgtggtggcactggacaccgaagttgcctccaaccgtatttactggtccgacctcagccaacgaatgatttgttcaacccaacttgacagggcacatggtgtgtcgtcctatgacacggtgatttcacgcgatattcaggcacccgatgggctcgcagtcgactggatccattcgaatatctattggaccgatagcgtccttgggaccgtgtcggtggctgatactaaaggggtgaagagaaagactctgtttcgagaaaatggatctaagccacgggcaattgtggtcgatccagtgcatgggtttatgtactggaccgactgggggacgccagcgaagatcaaaaaaggcgggctgaacggcgtggatatctactccctggttacggaaaacatccagtggcctaacggtatcaccctggatctgctgagtggacggctttactgggtcgactccaagttgcattcaatttcaagcattgacgtgaacggtgggaatcggaaaaccattcttgaagatgaaaagagacttgcacatccgtttagcttggcagtgtttgaggataaggtgttttggaccgacatcataaacgaagccattttcagtgccaatagattgaccggtagcgacgtcaatctgctggcggaaaatctgctgtccccagaggacatggtgctgtttcataatctcacgcaaccccgaggcgtgaattggtgtgaacgcactacgcttagcaatggaggatgccagtacctgtgtttgcccgctcctcaaatcaaccctcattcgccgaaattcacctgtgcctgtccagacggaatgctccttgccagagatatgcgcagctgcctcaccgaggctgaggctgcagtggcaactcaagaaacttcgaccgttcgactgaaagtttcctccacggctgtgcggactcagcataccactaccaggccagtcccagatacctcaagacttccaggagcaaccccaggactgactactgtggagattgtcacgatgtcacaccaggcacttggtgatgtggctggtagaggcaatgagaagaagccatcttcagtgcgagcactttccattgtcctcccaattgtgttgcttgtttttctttgtctcggagtgtttctgctctggaaaaactggcggctgaagaacatcaatagcataaactttgacaacccagtctaccagaaaactaccgaggatgaggtgcatatttgccacaatcaagatggctattcctacccgtcccgccagatggtcagtctggaagatgacgtcgca

SEQ ID NO: 15875 - DNA, 2580 bp, Artificial Sequence
  Description of Artificial Sequence: Synthetic coding sequence
atgggtccctggggctggaaactgcggtggaccgttgccctgctgctagctgcggcaggtacagcagtgggcgaccggtgcgagcgaaatgagtttcaatgtcaagatgggaagtgcatcagctataagtgggtgtgcgatggctccgccgagtgccaggatggcagtgatgagtcacaagaaacatgcctctccgtgacatgtaagtcgggcgattttagctgtggcggtagagtgaacaggtgcatcccccagttttggaggtgcgatggccaggtcgactgcgacaatggcagcgacgaacagggatgtcccccgaagacatgttcccaagacgagtttcggtgccatgacggaaagtgtatctcccggcagttcgtttgtgactccgaccgagattgcctggacggcagtgatgaagcatcttgtcctgtcctgacttgcggcccagccagctttcaatgcaactcatctacatgtatccctcagctctgggcatgcgataatgatccagattgcgaggatgggtccgacgagtggccgcagcgctgccgggggctttacgtgttccagggcgattccagcccgtgctccgcatttgaattccactgtctgtctggggaatgtatacactcatcctggcgctgtgacggcggccctgattgcaaggataagagtgacgaggaaaactgcgcagttgccacttgccgtcctgatgagtttcagtgttctgatggaaactgtattcacggatctaggcagtgcgacagagaatatgattgcaaggatatgagtgacgaagttggctgcgtcaacgtaacactgtgcgaaggtccgaataaattcaagtgccactcaggggaatgcatcaccctggataaggtctgcaacatggcacgcgactgcagggattggagcgatgagcccatcaaggagtgtggcacaaatgaatgtcttgataataatggtggctgcagccacgtctgtaacgatctgaagatcggttacgagtgtctgtgcccagatgggtttcagctggtcgcacagcgaaggtgtgaggacatagatgagtgtcaggatccggacacctgttctcaactctgcgtaaatctggagggtggatacaagtgccagtgcgaggaaggctttcagttggatccacatactaaggcgtgcaaggccgtcggatcgattgcttacctctttttcactaacaggcatgaggttaggaaaatgacgctcgatcgcagtgaatacactagcctgatcccaaacctgaggaacgtcgtagctttggatactgaggttgctagcaatcggatatattggagcgatctctctcagagaatgatttgctctacccagctggacagggcacacggggtctctagctatgacaccgtcataagcagggacatccaagcacctgacgggctcgcagtcgattggatccactctaatatatactggaccgatagcgtgcttgggactgtgagcgtggctgataccaaaggcgtcaagcggaaaactctcttccgagagaatgggtctaagccaagagctattgttgtggatcctgtccacggcttcatgtattggaccgattgggggacgcctgctaagatcaagaagggcgggttaaatggggtggatatctacagtctggtaaccgagaatatccaatggccaaacggcatcaccctggacctgctgtccggaaggttgtactgggttgattcgaaactgcatagtattagtagtatcgacgtaaatggcggtaatcggaagaccatacttgaggacgagaagaggctggcccaccctttctctttggctgtgttcgaggataaggttttttggaccgatattattaacgaagcaattttttccgcaaatcgtttgacaggatccgatgtgaacctgctggcagagaacctgttaagccccgaagatatggtgctattccacaatctgacgcagcccagaggagtgaactggtgcgaaaggacaaccctctccaacgggggatgtcagtatctgtgtctcccagccccgcaaatcaaccctcactccccaaagtttacatgtgcctgccctgacggaatgctcctcgcacgagacatgcgatcttgtctaacagaggcagaagccgctgtggccacacaagaaacatctacagttcgcctgaaggtgagttcaactgctgtccgaactcagcacaccactacaagacctgttccagacacgtctagactcccaggagctactcccgggctaaccactgtcgaaatcgtgaccatgtcccaccaagccctcggggatgtggccgggcgtggaaacgaaaaaaagccttcctccgtgcgggcgctgtctatagtgctgcccattgtgcttctcgttttcctttgcctaggggtgttcttactgtggaagaactggaggcttaaaaatattaacagcatcaacttcgacaatcccgtgtaccagaagactaccgaggatgaggtgcacatctgtcataatcaggatggttacagctaccctagccggcagatggtgtcactggaggacgacgtggcg

SEQ ID NO: 15876 - DNA, 2580 bp, Artificial Sequence
  Description of Artificial Sequence: Synthetic coding sequence
atgggaccatggggatggaaactgcgatggactgtcgccctcttgctcgccgcggccggaactgctgtcggggaccggtgtgagcggaacgagtttcagtgtcaggacggcaagtgtataagttataaatgggtatgcgatgggtccgcagaatgccaggacggaagcgacgaatctcaagaaacgtgtctgtccgtaacctgcaagtccggtgacttctcatgcggggggcgcgtgaaccgctgtattccccaattctggagatgcgacggccaggtcgactgcgacaacggctcagatgaacagggatgcccgccgaagacttgctcccaggacgagtttcggtgccacgatggtaaatgcataagccgacagtttgtgtgcgactccgacagagactgcctcgacggatcagatgaggcatcttgtcctgtccttacctgcggtcccgcatcttttcagtgcaactcaagtacatgtatcccccaactgtgggcatgcgacaatgatcctgattgcgaggacggctccgatgagtggccacagcgatgcaggggtctgtacgtttttcaaggcgattcctcaccttgtagcgcatttgagtttcactgcttgagtggagagtgcatacacagctcttggaggtgtgatggcggccctgattgtaaggacaaatctgacgaggaaaattgcgctgttgcaacttgcaggccagacgagttccaatgtagcgacgggaactgtatccacggctctaggcagtgtgaccgagaatacgactgcaaggacatgagtgacgaagttggttgcgtgaacgtaacactctgcgagggccctaacaagttcaagtgccactcaggagaatgcatcacactggacaaagtctgcaatatggcacgggattgtcgggactggagcgatgagcctattaaggagtgtggtacaaatgagtgcctggataacaacggcggttgttctcatgtttgcaatgatctgaaaatcggatatgaatgcctgtgcccagacggctttcagctggtcgcacagcgccggtgtgaggacattgacgaatgtcaggatcccgatacatgctctcagttgtgtgttaatttggaaggcggctacaaatgtcagtgcgaggaaggattccagctcgaccctcatacaaaggcatgcaaagctgtcggatccatcgcatatctgtttttcactaataggcatgaggtccggaagatgactttggaccggagtgagtacacttccctgatccccaatcttcggaatgtggtggctttggacacagaagtcgcctccaatcgcatctattggagcgatcttagtcaacgaatgatatgttctacgcagctcgaccgagcccacggcgtgtcttcctatgataccgtaattagcagagacatccaggcgccagatggcctggcagtggactggattcacagcaatatttattggaccgattctgtactgggaacggtgtctgtggctgacactaagggcgtgaagaggaagaccctgtttcgcgagaatggctctaaacctcgcgccatcgtcgtggacccagtgcacggctttatgtattggacagattgggggaccccagcaaagattaagaagggcgggctgaatggagtggacatctacagcttggtcaccgagaacatacagtggcccaatggaataacattggatttgctgtccggaagactctattgggtggattctaagctccatagcatttctagcattgatgtaaatggcggaaatcgaaagaccatactggaagatgaaaaaaggctggcacacccgttttccctggctgtgttcgaggataaagtgttctggacagacattattaacgaggccatcttcagcgctaacagactgactgggtcagacgttaatctgctcgcagagaatttgctgagcccggaagatatggtcctttttcataatttgacgcagcctagaggtgttaattggtgtgaaagaacaaccctcagtaacggaggctgccaatacttgtgtctgcccgccccccagataaatccccactcaccgaagtttacctgcgcctgcccagacggtatgctcctggcacgcgatatgcgatcctgtcttactgaggccgaagcagccgtagctacccaagaaacatccacagttcggttgaaggtgtccagtacggctgtcagaacccagcataccacaacgaggcctgttcctgacacttcccgcctgccaggagctacgcctggtttgactaccgtcgaaattgtgaccatgagtcaccaagcactgggcgatgttgccggaaggggaaatgaaaagaaaccatcctctgttagggccctgagcatagtgctgccgattgtgctcctcgttttcctgtgcctgggtgtgtttcttctctggaaaaactggcgcctgaaaaatatcaactctatcaacttcgacaaccccgtatatcagaagactacagaagacgaggtgcatatctgtcataaccaagacgggtatagttacccatctagacaaatggtgtctctggaagatgacgtagcc

SEQ ID NO: 15877 - DNA, 2580 bp, Artificial Sequence
  Description of Artificial Sequence: Synthetic coding sequence
atgggtccatggggctggaaacttcggtggactgtggccttgctgcttgcagccgcaggaaccgccgtgggagacagatgcgaacgtaatgagtttcagtgccaagatggcaaatgcatctcctataagtgggtgtgtgacggctcggcagagtgtcaggatggcagcgatgagtcacaagaaacgtgtctgtccgtgacctgcaagagcggtgatttttcatgtggaggacgagtcaacagatgtatcccgcaattttggagatgcgatggccaggtagattgtgacaacggctctgatgagcagggttgtccacccaagacctgctcccaggatgagtttagatgtcatgacgggaagtgcatctccaggcaattcgtgtgtgacagcgatcgtgactgcttggacgggtccgacgaggcatcgtgtcctgtgcttacctgtggcccagcttcctttcaatgcaacagcagcacctgcataccgcagctctgggcctgcgataatgatccagattgcgaggacgggtcagatgaatggcctcaacggtgtcgagggctctacgtctttcagggagattcctcgccatgttcggcatttgaatttcattgcctgagcggtgagtgcatacactcgtcatggcgttgcgatggcggaccagattgtaaggataagtcggacgaggaaaactgcgcagtggccacctgccggcccgatgaatttcagtgttcggatggaaactgcatacatggatcgcgccaatgcgatcgtgagtacgactgtaaggacatgtcggacgaggtcggttgtgtgaacgtgaccctttgtgaagggccaaacaagttcaagtgtcactccggagaatgtattactctggataaggtctgcaacatggctagagattgccgcgattggtcagacgaacccattaaagagtgtggcaccaatgagtgcttggacaacaatggcggatgctcccacgtgtgtaatgacctcaagattggctacgagtgcctgtgtccagacggatttcagctcgtggcacagcggagatgtgaggacattgatgaatgtcaagatccagatacttgttctcaattgtgtgtcaatcttgaaggtgggtacaagtgtcaatgtgaagaaggatttcaacttgatcctcacaccaaagcatgcaaggcagtgggttcgatagcctacctgttctttactaacagacacgaggtgcgaaagatgactctggaccgaagcgaatacacctccctcatccctaacctccggaacgtggtcgcgctcgatactgaagtggcatcaaacagaatatactggtctgatcttagccaaaggatgatctgctccacccaactggatcgagctcacggagtgtcatcgtacgatactgtgatttcgcgcgatattcaagcacccgatgggctggcggtggactggatccattcgaatatctactggaccgattccgttctgggaacggtgtcagtggcagacactaagggtgtcaagagaaaaaccctgtttagagagaacggctcgaaacctcgggcaattgtggtggatccagttcatggatttatgtactggactgactggggaactcctgcaaagataaagaagggaggtctgaatggagtggatatctactcactcgtgactgaaaacatccaatggccaaatgggattaccctggatttgctctcaggacgactgtactgggtggactccaagctgcattccatttccagcatcgacgtcaacggaggtaataggaaaaccatactcgaggatgaaaagcggctcgctcatcctttttcgctggctgtctttgaagataaggtgttctggaccgatatcattaatgaagcgatctttagcgccaaccggctgactggatcggacgtgaaccttctggcagaaaacctgctttcgccggaggacatggtgctgttccataatctgacccagccccggggagtgaattggtgcgagcgcactaccctgtcgaatggtggttgtcaatacctgtgcctccctgcacctcaaatcaatccccactcgcctaagtttacctgtgcatgtccagatggaatgctgctggcacgagacatgcgatcgtgtttgacggaagcagaagcagccgtcgcaacgcaggaaaccagcacggtccgactgaaagtctcctctaccgcagtcaggactcaacatactaccactagaccggtgccggacacttcgagacttcccggagcgactcctggtcttaccacggtggaaatcgtgaccatgagccatcaggcactcggagatgttgcaggaaggggtaacgaaaagaagcctagctccgtcagagcgctttcgatcgtgctccctattgtgctgctcgtgttcctttgtcttggggtgtttctgctttggaagaattggcgcctgaaaaacattaacagcataaactttgacaaccctgtgtaccagaaaactactgaggatgaagtccacatatgtcacaatcaggatggttactcctacccttcgcggcagatggtttcactcgaagatgatgtggcg

SEQ ID NO: 15878 - DNA, 2580 bp, Artificial Sequence
  Description of Artificial Sequence: Synthetic coding sequence
atgggaccgtggggatggaagctgagatggaccgtcgccctcctgcttgcagcagctggaactgcggtgggtgacagatgtgaacggaatgaattccagtgccaagatggtaagtgcatttcctacaaatgggtgtgcgatggatcggccgagtgtcaagacggatccgatgaatcgcaggaaacttgtcttagcgtcacctgtaagtccggtgacttttcgtgtgggggtcgcgtgaaccggtgtattccacagttctggcggtgtgatggacaagtcgattgcgataacggttcagatgaacagggatgtcctccaaagacctgttcgcaagacgaattccgatgtcacgacggaaaatgcatttcccgccaattcgtgtgtgacagcgatcgggactgtctggacggaagcgatgaggcttcctgtcctgtgctcacctgtggaccagcttccttccagtgtaactcgtcgacctgtatccctcaactgtgggcctgcgataacgatccagactgtgaggatggtagcgatgaatggccacaaaggtgcagaggattgtacgtgtttcaaggcgattcaagtccatgtagcgcgtttgaattccactgcctgtcgggtgaatgtatccattcatcctggcgttgtgatggaggtccagattgtaaggataaatccgatgaggaaaactgcgcggtcgcaacttgcaggccagacgagtttcagtgctcggatggtaactgtatacatggatcaaggcaatgtgatagggaatacgactgtaaggatatgagcgatgaagtgggttgcgtcaatgtaactctgtgtgaagggccaaacaagtttaagtgccactcaggcgaatgcattactctggataaggtctgcaacatggcaagagactgccgggattggtccgacgaacctataaaggaatgtggaactaacgaatgtctggacaataacggaggatgttcccatgtgtgtaacgatctgaagatcggctacgaatgtttgtgtccagacggattccagcttgtggcacaacgccgctgtgaagatatagatgagtgccaggaccccgatacttgttcccaactgtgcgtgaaccttgaaggaggttacaagtgccaatgtgaagaaggtttccaattggaccctcataccaaagcatgcaaggcagttggatcgatcgcatacctcttctttaccaaccgtcatgaagtcaggaaaatgaccttggatcggtccgagtacacctccctgattccgaacctgagaaacgtcgtggcattggataccgaggtggcctcgaaccgcatatactggtcagacctgtcccaacggatgatttgcagcactcaactggaccgggcgcatggggtttcatcctacgatactgtcatttcaagggatatccaagcccccgatggacttgctgtcgattggattcattcgaacatctactggactgactcggtgcttggaaccgtgtcggtcgcagacaccaagggtgtcaaaagaaagaccctttttagggaaaacggatcaaagccacgtgcaatcgtggtggacccggtccatggttttatgtactggaccgactggggaactcctgcaaagattaagaaggggggcctgaacggtgtcgacatttactcgctggtgaccgaaaacatacagtggcctaatggaattacccttgatttgctgtccggtcgcctgtactgggtggatagcaagctccattcgatatcatccatcgacgttaacggtggaaaccgcaagactattctggaggatgaaaaacggcttgctcatccttttagcctggccgtgtttgaagataaagtcttttggactgatatcatcaacgaagcaatcttttcggccaatagacttacggggtcggacgtcaatcttcttgcagaaaacctgctgagcccggaggatatggtgctgtttcataatctcactcaacctagaggggtcaactggtgcgaacgcaccactcttagtaatggtggatgtcagtacctctgcttgccggcaccacaaatcaacccacattcacctaagttcacttgtgcatgtcctgatgggatgctgctggcacgagatatgcgttcctgtctcactgaggcagaggcagctgtggcaacccaggaaacctcgactgtgagacttaaggtttcatccacggcggttcggacccaacataccactactcggccagtgcccgacacttcgcgcctccccggggcaacccctgggctgaccactgtcgaaattgtgactatgtcccatcaggcacttggtgacgtggccggcaggggaaatgaaaagaaaccttcgagcgtgcgtgccctgtccatcgtgctcccaatagtgcttctcgtgtttctttgtctgggagtctttcttctctggaaaaactggagactcaaaaacatcaattcaattaactttgacaaccctgtgtaccaaaagacgactgaagatgaagtgcacatttgtcataaccaagacggatacagctacccatcacgccagatggtcagccttgaagatgatgtggca

SEQ ID NO: 15879 - DNA, 2580 bp, Artificial Sequence
  Description of Artificial Sequence: Synthetic coding sequence
atgggaccctgggggtggaagctgcgctggacggtcgcacttctgcttgccgcagcaggcaccgcagtcggcgaccggtgtgaacgtaacgaattccaatgtcaagacgggaagtgcatctcatacaagtgggtgtgtgacggctcggcagagtgccaggacggatcagacgagtcccaggagacttgtctgagcgtgacctgcaaatccggagatttttcatgtggagggcgtgtcaaccgttgtattcctcaattttggagatgcgatggacaagtggattgtgacaatggctcagatgagcaggggtgcccacctaagacgtgcagccaggacgaattcagatgccatgacggaaagtgtatctcgaggcaattcgtctgcgactcggacagagattgtttggatggatcggatgaggccagctgccctgtcttgacttgtggtcccgctagcttccaatgtaactcgtcgacttgcatcccgcagctctgggcgtgtgataacgatcccgattgtgaagatgggagcgacgaatggccacaacgctgtcgtggcctgtacgtctttcagggagacagctcgccatgttccgcctttgaattccattgtctttcgggtgagtgtattcatagctcctggcgatgcgacggagggcctgattgcaaagataaaagcgacgaagagaactgcgccgtggcgacctgtcggccagatgagtttcagtgttcggatggtaattgcatccatggatcacgtcaatgtgaccgggaatacgattgcaaggatatgtccgatgaagtgggatgcgtgaatgtgactctgtgtgaaggccctaacaaattcaaatgtcattcaggagagtgtatcaccttggacaaggtgtgtaatatggctagagattgtcgagattggagcgatgagcccatcaaggaatgtgggactaatgagtgcctcgataacaacggcggctgttcccacgtgtgtaacgatctgaagattggatatgaatgtctttgtcctgacggatttcaactggtggcccaaagacgctgtgaagatattgatgaatgccaagatcccgacacttgttcgcagctgtgtgtgaacctcgaaggtggatacaaatgtcagtgtgaggagggattccaactcgaccctcatactaaggcttgtaaggcagtgggttcaatagcgtatctgtttttcaccaaccggcacgaagtgcggaaaatgactttggatcggagcgaatacactagcctcatcccaaacttgaggaacgtcgtggcattggatacggaggtcgcatccaacagaatttactggagcgatctgtcccagcggatgatctgttcgacccaactggatcgggcacatggagtgtcgtcctacgataccgtgattagcagagatatacaggcaccagacggtctggcagtcgactggattcattccaacatttactggaccgattcggttctgggtactgtgtcggtggcggataccaagggggttaaacgcaagaccctttttagagaaaacggtagcaaacctcgcgcaattgtcgtggaccctgtgcatgggttcatgtattggactgattggggcactccggctaagatcaaaaagggcggtcttaatggagtggacatctactccttggtgactgagaatatacagtggcctaacggtataaccctggatcttctctccggtagactgtactgggtcgactccaagctgcactctatctccagcattgatgttaatggtgggaacaggaaaaccattcttgaagatgaaaagagacttgcccatccattttcactcgcagtatttgaagataaagtcttttggaccgacatcattaacgaagctatcttctccgcaaacaggctgaccgggtccgatgtcaaccttcttgcggaaaacctgctgtccccagaagatatggtgcttttccataaccttacgcaaccaagaggcgtgaactggtgcgaacgaaccaccttgtcaaacggtgggtgccaatacctgtgcctgcctgcgccccaaatcaatccccattcgcctaaattcacttgtgcctgtccagatggaatgcttctggcccgcgatatgagatcatgtctcacggaagctgaagcagctgtcgcaactcaagaaacgtcgactgtgaggctgaaggtcagctcgaccgctgtgaggacgcaacataccaccacccgtccagtgccagatacctcccgactgccaggagcaacgccaggcctcactaccgtcgagattgtgaccatgtctcatcaggcattgggcgacgtggccgggcggggaaatgagaaaaagccctcgtcagtgcgcgctctgtccatcgtgctgcccatagtgcttctggtgtttctttgcctgggagtctttctgctgtggaagaactggagacttaagaacattaactctatcaattttgataaccccgtttatcaaaagacgactgaggacgaagtccacatctgtcataaccaagatggttactcctatccatcacggcaaatggtgtccctggaagatgacgtggca

SEQ ID NO: 15880 - DNA, 2580 bp, Artificial Sequence
  Description of Artificial Sequence: Synthetic coding sequence
atgggtccttggggctggaagctgaggtggaccgtggcgctgcttcttgccgctgcaggcaccgcagtgggtgataggtgtgagcggaacgagtttcagtgtcaggatggtaaatgcatttcatacaagtgggtgtgtgacggctcggcagagtgtcaagatggttctgatgaatcgcaggaaacctgtctgtcagtcacctgtaaaagcggagatttttcctgcggaggcagagtcaacagatgtattccgcagttttggcggtgtgacggtcaggtcgattgcgataacggatcggatgagcaaggatgcccacccaaaacgtgtagtcaagatgagttccgttgtcatgatggaaaatgtattagccggcaatttgtctgcgacagtgaccgggattgtctcgatggatccgatgaggcctcgtgccctgtccttacctgcgggccagccagcttccaatgtaactcctcaacttgcattccacaactctgggcttgtgataatgatcccgattgtgaggatggaagtgacgaatggccccaacgctgtagagggctctacgtgttccaaggggatagctccccttgctcggcgtttgaatttcattgtcttagcggagaatgtattcattcgtcctggcgatgtgatgggggtcccgactgtaaggacaaatcggacgaagaaaattgtgcggtggcgacttgtcgcccagatgaattccagtgttcggacggcaactgtatccacggaagccggcagtgtgacagagagtacgactgtaaagatatgtcggacgaagtgggatgcgtcaatgtgaccctttgcgaagggccaaacaaattcaagtgtcattcgggtgaatgtatcactcttgacaaggtgtgtaatatggctcgtgactgcagagactggtccgatgaacctattaaggagtgtggtacgaacgagtgcctcgacaacaatggtggatgctcgcatgtctgtaacgatctcaagataggttacgaatgtctctgtccggacggctttcagttggtcgcacaacgcaggtgtgaggacatcgatgaatgccaagacccagatacctgtagtcagctttgcgtgaatctggaaggtggttacaaatgccagtgcgaggagggatttcaactggacccgcataccaaggcttgtaaggcagtgggatcgattgcatacctgtttttcaccaatcgccatgaagtcaggaaaatgaccctggatcgcagtgaatacacctcccttatccctaacctgcgcaacgtggtggcattggataccgaagtggcaagcaaccgaatctattggtccgacctttcgcaaagaatgatttgctctacccagcttgaccgggcacacggggtgtcaagctacgataccgtgatctcccgtgacatccaggcaccagatggcttggcagtcgactggatacacagcaatatctattggacggattccgtgctcggtaccgtgtcggtggctgatactaagggcgtaaagcgcaagaccctgtttagagaaaacggctccaagcctagagccattgtggtggatcctgtgcacggatttatgtactggaccgattggggtactccggcaaagattaagaaggggggcctgaacggagtggacatttactcccttgtaactgagaacattcagtggcccaatgggataaccctggatctgctgagcggaaggctgtactgggtcgattcgaagctccactcaatttcgagcattgatgtgaacggaggtaataggaaaactatattggaagatgagaagagattggcccatccattttccctggcagtctttgaagataaggttttctggacggacattatcaacgaagcaatcttctcagccaaccggttgactggaagcgatgttaatcttctcgccgaaaaccttttgtcacctgaagatatggtgctgttccataatcttactcaaccaagaggagttaactggtgtgaacgtaccacgttgtccaacggtggctgccaatacctctgccttcctgcgccccagatcaacccacactctccaaagtttacttgcgcttgtcctgatggcatgctgctggccagagatatgcggtcctgtctcactgaagcagaagccgcagtggcaacccaggaaacttctactgttagattgaaggtgtcatcaactgcagtgaggacccagcatactaccacccgccccgtgcctgacacttcacgactgcccggggcgactccaggactgacgaccgtggagatagttaccatgagccaccaagcccttggtgatgtggcaggtagaggaaacgagaagaaaccttcgtcagtacgagcacttagcattgtcctgccaatcgtgcttctcgtgttcctttgcctgggcgtctttctgctctggaagaattggcgtctcaagaacatcaattccattaactttgacaaccctgtctaccaaaaaactactgaggatgaagtgcatatttgccataatcaagatggctactcgtacccttcacgacaaatggttagtcttgaagatgacgtcgca

SEQ ID NO: 15881 - DNA, 2580 bp, Artificial Sequence
  Description of Artificial Sequence: Synthetic coding sequence
atgggaccttggggctggaaacttcggtggactgttgccctgctgctggcagccgccggaactgcggtgggggatcgttgtgaacgaaatgagtttcagtgccaggatggcaaatgtatctcatacaagtgggtctgcgacggaagcgcagaatgccaagacggatcagatgaatcccaggaaacgtgcctgtccgtaacctgcaagagcggggacttctcgtgcggaggacgggtaaatcggtgtatcccgcaattctggcgttgtgatggacaggtcgactgcgataacggctccgacgagcagggatgtccgccaaagacttgctcccaggatgagttcagatgccatgacggaaaatgcatctcacgacaatttgtgtgtgactcagacagagattgcctcgacggttccgatgaagcgagctgcccagtcctcacctgtggaccagcatcttttcaatgcaactcgtccacctgcattccacagctttgggcatgcgataatgacccggattgtgaggacggatcggacgaatggccccaacggtgccggggtctgtacgtctttcagggcgattcatcgccctgctccgcgttcgagttccactgcctgtcgggtgagtgcatccactcatcgtggcgctgcgacggaggtccagattgcaaagataagagcgatgaggaaaattgcgcggtcgctacgtgccgccctgacgaattccaatgttccgatggaaactgcattcacggctcccgccagtgcgacagagagtacgattgcaaggatatgtccgatgaggtgggttgcgtgaacgtgactctgtgtgaaggacccaacaaattcaaatgccattccggggaatgcatcaccctggacaaagtttgcaacatggcacgcgattgtagagactggagtgacgaacccattaaagagtgcggtaccaatgaatgcttggataacaacggaggctgctcgcacgtgtgtaatgacctgaaaataggttacgaatgcttgtgccccgacggcttccaactcgtggcccagagacgctgcgaagatatcgacgagtgccaggatccagacacctgttcccagctctgcgtgaacctggaaggaggatacaagtgtcagtgtgaggagggattccagctggatccacacactaaggcgtgcaaggccgtcgggtccatcgcttacctgttcttcaccaacaggcacgaagtgcggaagatgactctcgaccggtccgagtatacgtcgctgatccccaacttgcggaacgtggtggcattggataccgaagtggcaagcaatcggatctactggtcagacctttcccaacgcatgatctgcagcacccagcttgatagggctcacggagtctcatcatacgatactgtgatctccagagacattcaagcaccggacgggctggccgtggactggattcactctaacatctactggactgatagcgtgctggggacggtgtcagtcgcagacaccaaaggggtgaagagaaaaaccctgttccgcgagaatggaagcaagccgcgggcgatcgtggtcgacccggtgcatggcttcatgtactggaccgactggggaactcccgcgaagatcaagaagggaggactgaatggagtcgacatttactcactcgtgaccgagaatattcagtggccaaacggcattaccctggacctgctgtctggccggctttattgggtggatagtaaacttcatagcatcagctccatcgacgtgaatggaggaaataggaaaaccatccttgaggacgagaaacgcctcgcgcatcccttcagccttgcagtgttcgaggataaggtgttttggactgatatcatcaacgaagcgatcttctcggcaaatagattgaccggttccgatgtcaacttgcttgccgagaacctgctgtccccggaagatatggtgctgttccataacctgacccaaccgcggggagtgaattggtgcgagagaaccactctctcgaatgggggctgccagtacttgtgcctcccggccccgcagatcaacccgcactctccaaagttcacttgcgcatgcccagatgggatgctgctcgccagagacatgaggtcgtgccttactgaagccgaagctgcggtggccacccaggaaaccagcactgtgagactcaaggtgtcctcaactgcagtgcgcacccagcatacgaccactcgcccagtcccggacacttcgcggctcccaggcgctaccccgggccttactaccgtggaaatcgtcaccatgtcgcatcaggcgttgggggacgtggcggggcgggggaacgaaaagaagccgtcatcggtgcgcgccctgtccatcgttctgccaatcgtgctgctcgtgtttctgtgtctgggagtgttcctgctctggaagaattggcggctgaagaacatcaattccatcaatttcgataaccccgtgtaccaaaagaccactgaggatgaggtgcacatttgtcacaaccaggacggctactcgtacccttccagacagatggtgtcgctggaggatgacgtggcc

SEQ ID NO: 15882 - DNA, 2580 bp, Artificial Sequence
  Description of Artificial Sequence: Synthetic coding sequence
atgggaccttggggatggaagctcaggtggactgtggccctgcttctggcagctgcgggtactgccgtgggcgaccggtgtgaacgcaacgagtttcaatgtcaggatggaaagtgcatctcgtacaagtgggtgtgcgatggatccgcggagtgccaggacgggtcggatgaatcgcaagaaacttgcttgtccgtcacttgtaagtcgggagacttctcctgcggagggagggtcaataggtgcatcccacagttctggcggtgtgacggacaggtggactgcgacaacggatcggatgagcagggctgtcctccaaaaacgtgcagccaagatgagttcagatgtcacgatggaaaatgtatctcccgccagttcgtctgcgactccgaccgggactgtctggatggatctgatgaggcatcttgcccagtgctgacttgcggacctgcctcgtttcagtgcaactcctcgacttgcatcccgcaattgtgggcctgcgataatgatccagactgcgaagatgggagcgacgagtggccgcaaagatgccgggggctctatgttttccaaggagactcatccccgtgcagcgccttcgagttccactgcctgtctggcgaatgcatccattcctcctggcggtgcgatggaggcccggactgcaaagataaatcagacgaagaaaactgcgccgtggccacctgcagaccggacgagttccagtgctcggacggcaactgcatccacggctcgcgccagtgtgaccgtgaatacgactgcaaggacatgagcgacgaggtcggatgcgtgaacgtgactctgtgcgaaggtcccaacaagttcaaatgccattcgggtgagtgtattactctggacaaagtgtgcaatatggcacgcgactgccgagactggagcgacgagccgatcaaggaatgcggcactaacgagtgtctggacaacaacggaggctgctcgcatgtgtgtaacgacttgaaaattggctacgaatgcctgtgtccggatggcttccagctggtggcccaaaggcggtgcgaagatatcgatgaatgtcaggatccggacacgtgtagccagctgtgcgtgaatctggaaggcggatacaaatgccagtgcgaagagggattccaactcgacccacataccaaggcatgcaaagcagtcggatcgatcgcttacctcttcttcactaatcgccatgaggttcggaagatgactctggaccgctcggaatacacttccctgatcccgaacctcaggaacgttgtcgcactggacaccgaagtcgcgtccaaccggatttactggtcagatctgtcacaacggatgatctgcagcactcaactggatagagcacacggagtctcctcgtatgataccgttatcagccgagacatccaagcccctgacggactggccgtggactggatccacagcaacatatactggaccgactcggtgctgggaactgtctcagtcgccgacactaagggagtgaaacgcaagaccttgtttcgcgaaaacggaagcaagccacgcgccatcgtggtggaccctgtccatggtttcatgtactggactgattgggggactccggctaaaatcaaaaaggggggactgaacggagttgatatctattccctcgtgactgaaaacatccagtggccaaacggcattaccctcgatttgctcagcggaaggctgtactgggtcgactcgaaacttcactctatttcctccatcgatgtgaacggaggcaatcgaaagacgatcctggaggacgaaaaacgcctggcccacccattttcacttgctgttttcgaagataaggtgttttggaccgatatcattaacgaggcaatcttttccgctaacagactgactgggtccgatgtgaatctgctcgcggagaacctgctgtcgcctgaggacatggtgctgttccacaacctgacccaacctcgcggcgtgaactggtgcgagagaactactctgtccaacgggggttgtcaatacctgtgtttgccagctcctcagatcaacccacactcacctaagttcacttgtgcatgcccggacgggatgctgctcgcgcgcgatatgagaagctgcctcaccgaggccgaggccgcagtggccactcaggagacttcaaccgtccggctgaaggtgtcaagcactgccgtcaggactcagcacactactacgaggcctgtccctgacacttcccgccttccaggtgctactccgggactcaccaccgtggaaatcgtgacgatgtcgcaccaggctctcggagatgtggctggacgcgggaacgagaagaagccctcgtcagtgcgcgccctgagcatcgtcctgccaatcgtgctgctggtgttcctctgcctgggagtctttctgctctggaagaactggcggctcaaaaacatcaatagcatcaatttcgataatccagtgtaccaaaagaccaccgaggatgaggtgcacatttgccacaaccaggatggatactcctacccgtcccggcagatggtatctctcgaggatgatgtggcc

SEQ ID NO: 15883 - DNA, 2580 bp, Artificial Sequence
  Description of Artificial Sequence: Synthetic coding sequence
atggggccgtggggctggaagctgagatggacagttgcccttctgctggccgcagccgggacagcagtcggtgatcgatgtgaacgaaacgagttccagtgtcaagatggtaaatgcatttcctataagtgggtatgcgatggaagtgcggaatgtcaggatgggtctgacgagtcacaggagacctgcctgtcagtaacctgcaagtcaggggactttagttgtggaggaagagtgaaccggtgcatccctcagttttggcgttgtgatggccaggtggattgcgacaacgggtcagacgaacaggggtgcccaccaaagacatgttctcaggatgaattccgttgccacgacggaaaatgtatttcgagacagttcgtttgtgattctgatcgcgattgtttagacggcagtgatgaagcctcatgcccggttcttacttgcgggcctgctagcttccagtgcaacagctcgacatgcatcccccagctctgggcctgtgataatgacccggactgcgaggatggatccgacgaatggccacaaagatgccgtgggctctatgtctttcagggtgattccagcccttgcagtgccttcgagtttcattgtttgtcgggcgagtgcattcacagctcatggcggtgtgacggaggcccagattgtaaggacaaatccgatgaggaaaactgcgctgtcgctacctgcaggcccgacgagtttcaatgctccgatggcaattgcattcatggttcaagacagtgcgacagggaatacgattgtaaggacatgagcgatgaagtgggatgtgttaacgtgaccctgtgtgagggaccaaacaagttcaaatgccattctggagagtgtattacactggataaggtctgtaatatggctagagactgtcgcgactggtctgatgagccaatcaaagagtgtggtacaaatgaatgcctggacaataatggcgggtgcagtcacgtctgcaatgatctcaagattggctatgaatgcctttgtcccgacggatttcaactggtagcacagcgtcggtgtgaagacatcgatgaatgccaggatcctgatacttgtagccagctttgcgtcaaccttgagggaggctataagtgccagtgtgaagaagggttccagttggatccacacaccaaggcatgcaaggcagtggggtcaattgcttacctgttctttactaacaggcatgaagtgcgtaagatgaccctcgatagatctgagtatactagtcttatccctaatttgagaaatgtcgtagccttggacactgaggtcgcgagcaatagaatctattggtccgacttatctcagcggatgatctgctccacacagctggatcgagcccacggcgtgagcagctacgacacagttatcagtcgggacatccaggcccccgatggtttggctgtggactggatccactctaatatctattggacagactccgtactcgggactgtgagtgtggccgacacaaagggagtgaagaggaagaccctgttcagggagaatggctcaaagccaagagccattgtggtggatccagtgcacgggttcatgtactggacagactggggtacgcctgcaaagatcaaaaagggtgggttaaatggggtggatatctactccttagtgacagagaacattcaatggccgaacggcatcactcttgatctcctgagcggccggctctattgggttgattctaagttgcatagtatcagctcgattgatgttaacggtggaaaccggaaaaccatcctggaggacgagaagagactggcgcatccattctccctagcagtattcgaggataaggtgttttggaccgacattataaatgaagctatcttcagtgccaacagactcaccggcagcgatgtgaacctactggcagagaatctcctctctcctgaggacatggtcttatttcataatctcactcagccgagaggcgtgaactggtgcgagaggacaactcttagcaatggcggctgccagtatctatgtttgccagcacctcagattaaccctcattctcctaaattcacgtgcgcttgcccagacggaatgcttctggcccgggatatgcgctcttgtctcacggaggccgaggccgccgtggctacccaggagacgagcactgtaaggctgaaagtgagtagcacggccgttcgaacccagcacacaaccacaagacctgtgcccgataccagccgtttgccgggagcaacacccggactgactaccgtggagatcgtgaccatgagtcaccaggctctgggcgacgtggcaggaaggggaaatgagaagaagccatcttctgtgagagccctctccatagttttacccatcgttctgctggtgtttctgtgtctgggagtgttcttactgtggaagaattggcgacttaaaaatatcaatagcatcaactttgataaccctgtctatcaaaagacgaccgaggacgaggtgcacatctgtcacaatcaggatggatatagctaccctagtagacagatggtgtcactggaggacgacgtcgca

SEQ ID NO: 15884 - DNA, 2580 bp, Artificial Sequence
  Description of Artificial Sequence: Synthetic coding sequence
atgggaccatggggatggaaactgcgatggaccgtggcactcctgctggctgcagctggcaccgctgtaggagatcggtgcgaacgcaacgagttccagtgccaggacggaaaatgcatctcgtacaagtgggtgtgcgatggatcagccgaatgtcaagatggttccgatgaatcccaggaaacctgcctgtccgtcacttgcaagtcgggagacttctcctgcggaggcagagtcaaccgctgcatcccgcagttctggaggtgcgacggacaggtcgattgcgacaacgggtccgacgaacagggctgcccacctaagacgtgcagccaagatgagttcagatgccatgatgggaagtgcatctcgcgccagttcgtgtgcgactcggaccgggactgcctggatggctcagatgaggcctcgtgcccagtcctcacctgtggcccagccagctttcagtgcaactcatcgacttgcatcccgcaactgtgggcctgcgataacgacccagactgcgaagatgggtcggacgaatggccccaacgttgcaggggactttacgttttccagggagactcaagcccatgcagcgcgtttgaattccactgtcttagcggtgaatgcatccactcatcgtggagatgcgacggaggtcctgactgcaaagacaagtccgatgaggaaaactgcgccgtggccacgtgtcgcccggacgaattccagtgctcggacggtaattgcattcacggaagccggcaatgcgatcgcgagtacgactgtaaggacatgtcggacgaagttggatgcgtgaacgtcactctgtgtgagggaccaaacaagtttaagtgtcattccggggaatgcatcactctggataaggtgtgcaacatggcacgcgactgcagggactggtccgacgagccgatcaaggaatgcggtactaatgaatgtctcgataacaatggaggttgcagccatgtgtgtaacgacctgaaaatcgggtatgagtgtctgtgccccgacggcttccaactggtggcacagaggcgctgcgaggacatcgatgaatgccaagacccggacacttgctcccaactgtgtgtcaaccttgaaggagggtacaagtgtcagtgcgaagagggatttcagcttgatccgcacactaaggcctgtaaagctgtgggatcaattgcctacctgttctttaccaaccggcacgaggtccgcaaaatgaccttggatcgctcggaatacacctcactgatccctaatctccggaacgtggtcgccctggacactgaggtggcgtcaaaccgcatctactggtctgatttgtcacagaggatgatttgttccacccaactcgatagagcccacggagtctcctcgtacgataccgtgatcagcagagatattcaggccccagatggattggccgtcgactggattcattcgaatatctactggacggactcggtgctgggcactgtgtcagtggcggacaccaagggggtgaagcgcaaaactctcttccgcgagaatggcagcaagccccgggcaattgtcgtggacccggtgcacggcttcatgtactggaccgactggggaactccggcgaaaatcaaaaaggggggcctcaacggagtggacatctactcacttgtgaccgagaacatccaatggcctaatggaattaccctggatctgctttcggggcgcctttactgggtggattcaaagctgcactccatcagctccatcgatgtgaacggcggaaacagaaagaccatcctggaagatgaaaagcggctggcccacccattttcactggctgtctttgaagataaagttttctggaccgacatcatcaacgaggcgatcttctcggcgaacagactgactgggtccgatgtcaatctccttgcagaaaatctgctgtcaccggaggacatggtgctgttccacaatctcacccagccaaggggggtcaattggtgcgagagaactaccctctcaaacggaggatgccagtatttgtgcctgccagccccacagatcaatcctcactcgcccaagttcacctgcgcctgtccagacggcatgctgctcgcccgcgatatgcgcagctgcctcactgaggctgaagccgcggtggcgacgcaagaaacctcgaccgtccggcttaaggtgagctcgaccgccgtgagaactcagcacaccactacccgcccagtgccggacaccagccgcctgccaggcgcgactccgggattgactaccgtggagatcgtgacgatgagccaccaggccctgggagacgtggctgggcgcggaaacgagaagaagccatcgagcgtcagggcgctgtcgatcgtcctgccgatagttctgctggtgttcctttgccttggagtgttcctgctgtggaagaattggagattgaagaatatcaactcaatcaacttcgataacccggtgtatcagaaaactaccgaggacgaagtgcacatttgccacaatcaagacggatactcatacccgtccagacagatggtgtccttggaagatgacgttgcc

SEQ ID NO: 15885 - DNA, 2580 bp, Artificial Sequence
  Description of Artificial Sequence: Synthetic coding sequence
atgggcccctggggatggaagttacgatggacggtcgctttacttttggcggctgcaggcacagcagttggcgatcgctgtgaacgtaacgagtttcagtgtcaggatggaaagtgtataagttataaatgggtctgcgatggatccgcggagtgccaggatggatcagacgaatcgcaagagacctgcctgtccgtaacatgtaagagcggcgacttcagttgtgggggacgcgtgaatagatgcatccctcaattctggcggtgtgacggccaggtcgattgcgataatggatccgatgaacaaggatgcccacctaagacatgctcgcaggatgagttccggtgccacgacggcaagtgcataagtcggcagtttgtgtgtgatagtgatagagactgtctggacggcagtgacgaggcatcttgtcctgtacttacttgtgggcccgcgagtttccagtgcaatagcagcacttgcataccccagctctgggcttgcgacaacgatcccgactgcgaggacggcagtgatgagtggccgcagcgatgtcgaggtctttacgtgtttcaaggcgatagtagcccctgttctgcattcgaatttcactgtctgtctggggaatgtatccacagttcctggcggtgcgatggaggacctgactgcaaagacaagtctgacgaggagaactgtgcagtggcgacctgtaggcccgatgagtttcagtgtagcgatggcaactgtattcatggtagcaggcaatgcgatcgggagtacgattgtaaggatatgtctgacgaagtaggctgcgtcaatgtcacgctctgcgagggcccgaataagtttaaatgtcactcaggagaatgcatcactctagacaaagtgtgcaatatggccagggattgccgtgactggtccgatgagcccattaaggagtgcggaacgaatgagtgcctcgacaacaatggcggctgttcacacgtctgcaatgatcttaaaatcggttatgaatgtctctgtccagacggctttcagctagtggcccaaaggcgatgcgaggacatcgatgaatgtcaggatccagatacatgctcccagttatgcgtgaatcttgagggcggctacaaatgtcagtgcgaggaaggcttccagttggatccgcacacaaaggcgtgtaaggccgtgggcagtatcgcttatctctttttcacaaacagacacgaggtgagaaaaatgactctcgatcggagcgaatacactagcctgatcccaaacttgcggaatgtggtggccctggacactgaagtcgcttccaacaggatatactggagcgatctttcacagagaatgatctgttcgacacaactggaccgggctcatggcgtgtcatcatacgacaccgtaatttcccgtgacatccaggccccagacggcttggctgtggactggatccattccaatatttactggacagattctgttctgggcaccgtatcagttgccgacaccaagggcgtgaagcgtaagactctctttcgcgagaacggttctaagccgagggcgatagtagtggacccagtacatggatttatgtactggaccgattggggtactcctgcgaagatcaagaagggcgggctcaacggtgtggacatctactcgctagtgaccgagaacatacagtggcctaatggaatcactctggatttacttagcgggagactctactgggtggactccaagctgcactcaatctcgtctatcgacgtcaatggcgggaatcgcaaaactatcctggaagacgagaaaagactcgcacacccctttagtctggcggtattcgaggacaaggtgttctggaccgacatcatcaacgaggctatcttctcagccaatagactgactggttcagatgttaatctgttggccgagaacctgctgagtcccgaagatatggtgctgttccataatcttactcagcccaggggggtgaactggtgcgaacgcacaaccctttcaaacggcggctgccagtatctgtgcctccctgcacctcagatcaatccccactcccccaaatttacctgcgcctgccctgatgggatgctcctggcacgcgacatgcggtcttgcttgacagaggcagaagctgctgtggccacccaagaaaccagtaccgtacggctcaaggtgagctctacagccgtccgaacccagcacacaactacccgacctgtgccagacacgtccagattgcctggggctaccccaggcttaacaacagtggagattgtgacaatgagccatcaagcactgggcgacgtcgcaggacgtggcaacgaaaagaagcctagtagcgtccgcgctctgtctatagtcttgcctattgtgcttttggtgttcctttgtcttggagtgttcttattgtggaagaactggaggctgaagaatataaattctattaacttcgataacccagtctaccagaagactacagaggatgaggtgcacatctgccataaccaagacgggtacagttatcccagccgtcagatggtgtccctagaggacgacgttgct

SEQ ID NO: 15886 - DNA, 2580 bp, Artificial Sequence
  Description of Artificial Sequence: Synthetic coding sequence
atgggaccttggggttggaaactgaggtggactgtggcactgctgctggcagcggctggaacggccgtgggggaccgatgtgagaggaacgaatttcaatgtcaggacggcaaatgcatttcgtacaaatgggtctgtgatggctctgccgagtgtcaagatgggtcagatgagtcgcaggaaacttgtctttcggtcacttgcaagagcggggatttctcatgtggagggcgcgtgaacaggtgtataccacagttctggcgctgtgatggtcaagtggattgtgacaatggttccgatgaacaaggatgccctcctaagacttgcagccaggacgaattccgctgtcatgacggtaagtgtatttcccgacaattcgtgtgcgattccgatcgagactgccttgatggctcagatgaggcctcgtgtcccgtgcttacttgcggacctgcatcatttcagtgcaattcctcaacttgtattccccaactttgggcatgtgataatgaccccgattgtgaggatggatcggacgaatggcctcaacgttgtagaggtttgtacgtgtttcagggagattcatcgccatgctcggcctttgaattccattgtctcagcggagaatgtattcattcttcatggcgatgcgatggggggcctgattgcaaagataagagcgatgaagagaactgtgcagtcgcgacctgtagaccagatgagtttcagtgttccgatggaaattgtatccatgggtcgaggcaatgtgacagagaatacgactgtaaggacatgagcgatgaagtgggttgcgtgaatgtcactctgtgcgaaggtcctaacaagttcaagtgtcattcgggagagtgtattacccttgataaggtctgtaacatggcaagagactgccgagactggtccgatgagcctattaaggaatgcggcacgaatgagtgtcttgataacaatggtggctgttctcacgtctgtaatgacctcaagatcggatacgaatgtctgtgcccagacggatttcagctggtggcacaacgacgctgcgaagatatagatgaatgtcaggatccagatacctgttcgcaactttgcgtgaatcttgaaggaggctacaaatgtcaatgtgaggaaggcttccagctggacccacacactaaggcatgtaaagcagtgggttcaatcgcctacctgttctttaccaaccggcatgaagtgaggaaaatgactcttgacagatctgagtacactagcctgattcctaatctgcgaaacgtggtggcattggataccgaagtggcatcgaatcggatctattggtcggatctcagccaaagaatgatctgtagcacccagcttgacagagcgcatggggtttcgtcgtacgacaccgtcattagccgggacattcaggcacctgatgggctcgcagtggattggatccactccaacatttactggaccgacagcgtcctgggaaccgtctcggtcgccgatactaaaggggtgaagcgtaagactctgtttcgcgagaacggcagcaagccacgcgcaatcgtggtcgacccagtgcatggatttatgtactggactgactggggaacgcctgcaaagattaagaagggcggactcaacggcgtggatatctactccctggtcaccgaaaacatccaatggcctaacggtataactctggaccttctctcaggacggctttactgggtggactccaaactgcattccataagctcaattgatgttaatgggggaaataggaaaaccattctggaggatgaaaaaaggctggcccacccattcagtctcgcagttttcgaagataaggtgttttggactgacataatcaatgaggctatcttttcagctaacaggctgaccgggtctgatgtgaacctgctggcagaaaaccttctgtcaccagaggatatggttctttttcacaacctgactcaaccccgtggcgtcaactggtgtgaaaggactaccctctcaaatggaggttgtcagtacctctgtttgcctgcacctcagattaaccctcatagccctaaattcacctgcgcatgtccagatggaatgctgctcgcgagagatatgagatcatgtctgacggaggccgaggcagccgtcgccacccaggaaacctcaaccgtgcgactgaaagtgtccagcacggccgtgagaacgcagcacactaccactcggcccgtgccagatacctcgagacttcccggcgcaaccccgggtctgaccaccgtggaaatagtcactatgtcgcatcaggctctcggtgacgtcgcgggaagagggaacgaaaagaagccaagctccgtgagagctctttccatcgtgcttcctattgttcttcttgtgtttctgtgtcttggagtgtttttgctttggaagaattggcgcctgaagaacataaacagcattaactttgataatcccgtctaccaaaagaccactgaggacgaggtccacatctgtcacaaccaggatggatacagctatccttcgaggcaaatggtgtcgctggaggacgatgtggca

SEQ ID NO: 15887 - DNA, 2580 bp, Artificial Sequence
  Description of Artificial Sequence: Synthetic coding sequence
atgggaccatgggggtggaagcttcgctggaccgtagctctgctcttggccgccgccggcactgctgtgggggatcggtgtgagcgcaacgaattccagtgccaggatgggaaatgtattagctacaaatgggtatgcgatggttcagctgagtgccaagatggctcagacgagtctcaagaaacatgtctgagcgtgacttgtaagtctggtgattttagttgcggggggcgggtaaacagatgtataccacagttctggcggtgtgatggacaggtggactgcgacaacgggagtgacgagcagggctgtcccccgaaaacatgcagtcaggacgagtttcgctgtcacgacgggaagtgtatctcaagacagttcgtatgtgattctgatcgcgattgccttgatggaagtgatgaggcaagctgtcctgtcctgacgtgcgggcctgcaagtttccagtgcaacagttccacatgtattcctcagctctgggcttgtgacaatgaccctgactgtgaagatgggtcagacgagtggcctcagcggtgtcgcggcctgtatgttttccagggcgattcttcaccatgctcagccttcgaattccactgtctgagtggggaatgcatccatagctcttggcggtgtgacggcggcccagactgcaaggataagagcgatgaggagaattgtgcagtcgccacctgcaggcctgacgaatttcagtgtagtgatgggaattgcatccatgggagccgccaatgtgaccgcgaatatgactgcaaagacatgagtgatgaagtaggttgtgtgaatgtgaccctttgtgaggggccgaacaagttcaagtgccattccggggaatgtattacactcgacaaggtctgtaacatggcccgggattgtagagattggtctgatgaaccaatcaaagagtgcggaaccaacgagtgtctggataataacggagggtgtagtcatgtctgcaacgatcttaaaatcgggtacgagtgcctgtgccctgacggcttccagctcgtcgctcagcggcgctgcgaagacatcgatgagtgccaggatcccgacacatgtagccaactctgcgtcaacctggaaggaggatataagtgccagtgtgaggagggcttccagctcgacccccacactaaggcgtgcaaggcagtgggctctatagcatacctgttcttcaccaaccgccatgaggtgcgcaagatgactctggacaggtctgaatatacatctttgattcctaatttgcgaaatgttgtggcccttgacactgaagttgcttccaatcgaatctattggtccgacctgtctcagcggatgatctgctcaactcagcttgacagagctcatggcgtgagcagctacgacactgtgataagtagggatatccaggctccagatggactggccgttgattggatccactcaaatatttactggaccgatagtgtccttgggaccgtcagtgtcgccgataccaaaggcgtgaaaagaaagacactgtttagggagaacgggagtaagccaagggcgatcgttgtggaccccgtgcacgggttcatgtactggacagattggggcactccagctaagatcaaaaagggagggctgaacggagtggacatctacagtctggtgaccgagaatattcagtggcctaatggcattacactggatttgttgtctggacgcttgtattgggtggattcaaaactgcattccatctctagcattgacgtcaacggtgggaataggaagacgattctggaggatgagaaacggctcgcccatcctttctcattggcagtatttgaggataaagtcttctggacagatatcataaatgaggcaatattctccgctaaccgactgactggctctgatgtgaatttgctggccgaaaatttgctgtcaccggaagacatggtcctgttccacaacttgactcaacctcgcggagtgaactggtgtgaacgcactacactcagtaatggcggttgccagtatctttgtctgcccgctccccaaataaatccacatagcccgaagttcacctgcgcatgcccagatgggatgctgctggcacgcgacatgaggtcctgccttacggaggctgaggcagctgtggcaactcaggaaacttctaccgtccgcctgaaggtgtcctccactgctgtacgcacccaacacacaacaacacgcccggtgccggatactagccgcctgccaggcgccactcctggtctcactaccgtcgaaatcgtgactatgtctcaccaggctcttggggacgtggccgggagaggcaacgaaaaaaagccttcaagcgttcgggccttgtccatagtcttgcctatcgtgctcttggtcttcctttgcctgggggtgttcctgctttggaaaaattggcgcctgaagaacattaacagcatcaattttgacaaccccgtataccagaaaaccaccgaagatgaggtgcacatctgccacaatcaggacggctattcatatccgtcccgacagatggtgagtctcgaggatgatgtggcc

SEQ ID NO: 15888 - DNA, 2580 bp, Artificial Sequence
  Description of Artificial Sequence: Synthetic coding sequence
atgggaccttggggatggaagctgagatggactgtggcgttgctgctggctgcggcgggcaccgccgtcggggaccgctgcgaacggaacgaattccaatgccaggatgggaagtgcatctcatacaagtgggtctgcgacggctcggcggagtgccaggatggttcggatgaaagccaagagacttgcctctcggtcacttgcaaatccggcgatttctcctgtggcggtcgagtgaaccggtgcatcccccagttctggaggtgtgatggccaagtggattgcgataatgggtcagacgaacaagggtgcccaccgaaaacctgttcgcaggacgaattccggtgccatgacggaaagtgcatctcccggcagttcgtgtgcgatagtgaccgcgattgtctcgacggcagcgatgaagcatcgtgccccgtgctcacttgcgggccagccagcttccagtgcaactcctccacctgcataccgcaactctgggcttgtgacaacgacccggactgcgaagatggatccgacgagtggccgcaaagatgtagaggcctgtacgtgttccaaggagattcatccccgtgctcggcattcgagttccactgtctgtccggagagtgcatccacagcagctggcgctgtgatggaggccctgattgtaaggacaagtctgatgaggagaactgtgcggtcgcgacctgtcgcccggatgaatttcagtgctctgacggcaactgcatccatggatcgcgccaatgcgaccgcgagtacgattgcaaagacatgagcgacgaagtcggatgcgtgaacgtcaccctctgcgaaggtcctaacaaattcaagtgccactcgggagagtgcattactcttgacaaagtctgcaacatggcacgcgactgccgcgactggtccgacgaacccatcaaggagtgcggcacgaatgaatgccttgacaacaacggaggctgttcacatgtgtgcaatgatctcaaaatcgggtatgagtgcttgtgcccggatggattccaactcgtggcccaaaggcggtgtgaggacatcgacgaatgccaggatcccgacacctgtagccagctgtgcgtgaatctcgaaggaggctacaaatgccagtgcgaagagggcttccaacttgatccgcatactaaggcctgcaaagccgtgggctcgatagcctacctgttctttaccaatcggcacgaagtgagaaagatgaccctggacagatccgaatacacttcgctgatcccgaacttgagaaatgtggtggccctggataccgaggtggcctcgaacagaatctactggtcggacctctcccagcggatgatctgctccactcaactggatcgcgcccacggagtcagctcctacgacactgtcatctcccgcgacatccaggcgccagacggactcgccgtcgactggatccattcgaacatctactggaccgattcggtgctgggcactgtgtcggtggcagacaccaagggagtgaaaaggaaaacgctgttcagagaaaatggctcgaagcctcgggccatcgtggtggatccggtgcacggcttcatgtactggactgattggggcactccggcaaaaatcaagaagggcggcctgaacggggtcgatatctacagcctcgtgactgaaaacattcagtggccgaatggaattactctcgatctcctgtcggggcgcctttactgggtggactctaaactgcatagcatctcttctatcgacgtgaacggaggaaatcgcaagactatcctggaagatgagaagaggctcgcccacccgtttagcctcgccgtgtttgaggacaaagtcttttggactgacattatcaacgaggctatcttctcggcaaacaggctgactggtagcgacgtgaatttgctggcagagaatttgctctcgccagaagatatggtgctgttccacaatctcacccagcccagaggagtaaactggtgtgagcggactactctgagcaatggtggatgccaatacctctgcctgccggctcctcagattaatccgcacagcccgaagtttacgtgtgcttgcccagatggaatgctcctggctagagacatgcgctcctgcctcacggaggcagaggccgccgtggcgacccaggaaacctccaccgtgcggctgaaagtgtcctcgaccgcggtgcgcacccagcacactactactcgcccagtgccggatacctcccggctccccggagcgacgccgggcttgaccaccgtcgagattgtgaccatgtcgcaccaagccctcggcgacgtcgcgggtcgcggaaatgaaaagaagccttcatcggtccgggccttgtcaatcgtcctgcctatcgtgcttctcgtgttcttgtgccttggcgtgttcctgctgtggaagaattggcgcctcaaaaacatcaactccatcaacttcgacaacccggtgtaccaaaaaaccactgaggacgaagtccacatctgccataaccaggatggatactcataccccagccgtcaaatggtgtccctggaggacgacgtggca

SEQ ID NO: 15889 - DNA, 2580 bp, Artificial Sequence
  Description of Artificial Sequence: Synthetic coding sequence
atgggtccatgggggtggaagctcaggtggacggttgcacttcttctcgcggccgcaggtaccgccgtgggggatagatgtgagcgcaacgaattccagtgccaagacggtaagtgtatctcatacaaatgggtgtgcgacgggagcgcagaatgccaggatggttccgatgaatcccaagaaacttgcctttcggtgacctgcaagagcggagatttttcatgcggaggcagggtgaaccgatgtatcccacaattctggagatgcgatggacaggtggattgtgataacggaagcgacgagcagggttgcccgcccaagacctgctctcaggacgagtttagatgtcatgacggaaagtgcatctcccgacaatttgtgtgcgattcggatagagactgcttggacggctcggatgaagcgtcatgcccagtgctcacctgtggccctgcatccttccagtgtaatagctccacctgcatccctcagctttgggcatgtgacaatgaccccgactgtgaagatggatcggacgaatggccacagagatgtaggggtctttacgtgtttcagggcgatagctccccgtgcagcgccttcgaattccattgcctgtcaggggaatgcatccactcctcctggaggtgtgatggggggcctgattgcaaagacaagtcagatgaggagaactgtgcagtggcaacttgtcggcctgatgagttccagtgcagcgatggcaactgtatccatggctcgagacagtgtgatcgcgaatacgactgcaaagacatgtccgatgaagtgggatgcgtgaatgtgaccctgtgtgaaggaccaaacaagttcaaatgccacagcggtgagtgcataactctggacaaggtctgtaacatggcacgagattgtcgcgattggtcggacgagcccattaaagaatgtggcactaacgagtgtctcgataacaatggaggatgctctcacgtctgtaacgatctgaaaattgggtacgaatgcctctgccccgatggctttcaacttgtggcacagcgccgctgtgaagatatcgatgaatgtcaagatcctgatacctgctcgcaactgtgtgtgaatcttgaagggggttacaagtgtcagtgtgaagagggtttccaacttgatccccatactaaggcctgcaaagcagtgggttccattgcgtatctctttttcactaatcgacatgaagtgcgaaagatgaccttggacagatcagaatacacttccctcatccctaatctgcgtaatgtggtggcactcgatactgaagttgcttcgaacaggatatactggtcggatcttagccaacgaatgatctgctccacccagctcgatcgtgcacacggagtgtcatcctacgacactgtcatttcgagagacattcaggctcccgatggtttggcagtagattggatccatagcaacatttactggactgacagcgtccttggtactgtgtctgttgcagataccaagggagtgaagcggaaaactctgtttagagaaaacggatcaaaacctcgagcaattgtggtggacccagtgcacgggtttatgtactggaccgactggggaactccggccaagattaagaaaggaggcctgaacggcgtcgacatttactcgctcgttacggagaacatccaatggcctaatggaattaccctggatttgttgtcgggacggctgtactgggtggatagtaagctgcactcgatttcgtcaattgatgttaatggcggcaatcgcaagaccattctggaagatgagaagagactggcccatcctttttcactggcagtttttgaggacaaggtcttttggactgatatcataaatgaggcaattttcagcgcaaatcgccttaccggctccgatgttaaccttcttgcagaaaaccttctgtcccctgaggatatggtgctttttcataacttgacccaacctcgcggcgtgaactggtgtgagcgcaccactctgtccaatggcggctgccaatacctttgtctgcccgcgccccagattaaccctcactctcctaagtttacttgcgcatgcccagatgggatgctgcttgcacgcgatatgcgtagctgtcttacggaagctgaggcagctgtggctacgcaagaaacgagcactgtgaggctcaaggtgtcgtcgacggcggtccgcactcagcatactacgacgcgacctgtgcccgacaccagccggcttccgggggcaactccagggctcaccactgtggaaatagtgactatgtcccaccaagccctgggggatgtggcagggcgcggaaacgagaagaagccttcgtcagtgagggcgcttagcatagtgctccccatagtcctgctggtctttctttgtctcggagtctttctcctgtggaaaaactggaggcttaagaatatcaactccataaactttgataatccagtctatcaaaagactaccgaagatgaggtgcatatatgtcataaccaggatggctactcttacccatcccgtcagatggtgtcgctggaggacgacgtggcc

SEQ ID NO: 15890 - DNA, 2580 bp, Artificial Sequence
  Description of Artificial Sequence: Synthetic coding sequence
atgggtccgtgggggtggaagctcaggtggaccgttgcattgctgctcgctgcagcagggactgcagtgggagatcgatgtgagcggaacgaattccagtgtcaagatgggaagtgcatatcctacaagtgggtctgcgatggttccgcagaatgtcaagatggttctgacgaaagccaggagacttgtctttctgtgacgtgtaaatctggtgatttctcttgcggtggtagggtcaataggtgtatcccccaattttggaggtgtgacggtcaggttgattgcgataacggcagtgatgagcaaggctgccctcctaaaacatgctcacaagatgaattcaggtgtcacgatggtaaatgtatttctagacagtttgtatgcgattcagaccgtgattgcttggatggcagtgatgaggcgtcatgcccagtgctcacatgtggtcctgcctcttttcagtgtaattcatcaacttgcatccctcaactctgggcatgtgataacgatccagattgcgaagatgggtctgatgagtggcctcagagatgtcgcggcctctacgtgttccagggtgattcctccccctgttccgcttttgaattccattgcctgtctggcgaatgtatccacagcagttggcggtgcgatgggggacccgattgtaaggataagtccgacgaggaaaactgcgcagtggctacctgtagacctgatgagttccaatgctcagatggtaactgtattcacggatcacgccagtgcgatcgagagtacgattgcaaggacatgtccgatgaagtcggttgtgtgaatgtcacactatgtgaaggtcccaacaaatttaagtgtcactcaggtgaatgtatcacattggataaggtctgtaatatggcacgggattgccgtgattggagcgacgagcccatcaaggaatgcggaacgaatgaatgcctcgataataatggtggatgttctcacgtttgtaacgacttgaagatagggtacgaatgtttatgtcccgatggtttccagctggttgctcaaagacgatgtgaagatattgatgagtgtcaagatccagacacttgttctcaattatgtgtcaacctcgagggagggtataaatgtcaatgtgaagagggctttcagctcgatccgcatactaaggcttgtaaggccgtggggagcattgcttatcttttctttaccaaccgtcacgaggttaggaagatgactcttgataggtctgagtatacatcgttaattcctaatcttcgtaatgtcgtggctttggataccgaggtggctagcaatagaatctattggtcagatctctctcagagaatgatttgttccacccaattggatagagcccatggcgtatctagctacgacacagtcatttcaagagatattcaagctccagatggcttagccgtagattggatacattcgaatatttattggactgattcagtactggggactgttagtgtggctgacacaaagggggtaaagcgtaagacattgttccgagagaatggttcaaagccacgcgccatagttgttgaccccgtgcacggttttatgtattggactgactggggtacccctgctaagataaaaaaaggtggtctgaacggagtagatatatactccttggtgactgaaaacatacagtggcctaatggaattactcttgatcttctaagtgggcgtctttattgggtggattcaaagctgcactcgatttcatctatcgatgtgaacggaggaaacaggaagaccattctggaagatgaaaaacggctggcacatcctttttctctggccgtctttgaggataaggtcttttggaccgatataatcaacgaagctatcttttcggcaaatcgacttacaggttcagacgtcaatcttctagctgaaaacctcttgagcccagaggatatggttttgtttcataacctaactcaacctcgcggagtcaattggtgtgagagaacaactctcagcaacgggggttgccaatatctttgtctgccagcacctcaaattaatccacattcaccaaagtttacctgtgcgtgcccggatgggatgcttctggcccgcgatatgaggtcttgtctgaccgaggctgaagcagctgttgctacgcaggagacatcaactgtgcgtctcaaagtgagttcaacagcggttaggactcagcatactacaaccagacccgttcctgatacaagccgactgcctggtgccactccgggactcacaacagtcgaaatagttaccatgagccatcaggccttgggtgatgttgctggtcgtggaaatgaaaaaaagccatcatccgttagagctctgtctatagttttgccgatagtgctccttgtttttttatgtcttggggtgttcctgctgtggaagaactggcgattgaagaacatcaactctataaactttgataaccctgtttatcaaaaaactactgaggatgaggtacatatttgccacaatcaggacggttactcgtatccgtcaaggcaaatggtgagcttggaagacgatgtggcc

SEQ ID NO: 15891 - DNA, 2580 bp, Artificial Sequence
  Description of Artificial Sequence: Synthetic coding sequence
atgggtccgtgggggtggaaattgcgttggaccgtcgcgttgctgctggcagcggccggaacggccgtgggagatcgctgcgaacggaacgaattccagtgtcaagacggaaagtgcatcagctacaaatgggtctgcgacgggtcagcagagtgccaggacggaagcgatgagtcccaggaaacctgcctgtcagtgacttgtaagtccggcgatttctcctgcggaggacgcgtgaatagatgcatccctcagttctggagatgcgacggtcaggttgactgcgataacggatccgacgagcagggatgcccccctaagacttgctcacaagatgagttcagatgtcatgatgggaagtgtatctcgcgccaattcgtgtgcgactccgaccgagattgtctggatggatcggacgaggccagctgccccgtgctcacttgtggcccggccagcttccagtgtaattcgagtacctgtatcccgcagctgtgggcatgtgataacgacccggattgtgaagatggaagcgacgaatggcctcaaagatgcagaggactgtacgtgttccagggcgattcctccccttgttcggctttcgagttccactgcctttcgggcgaatgtatccactcctcctggcgctgtgatggggggccggattgcaaagataagtcagacgaggagaactgtgctgtggctacttgccggccagatgaatttcagtgcagcgacggcaattgcatccacggaagccgccaatgcgatagagaatacgactgtaaggacatgagcgacgaggtcggttgcgtgaatgtgactctttgcgaaggaccgaataagtttaagtgtcattcgggtgaatgcattaccctggacaaagtgtgcaatatggctagggattgccgcgactggtccgatgagccgattaaggaatgcggaactaacgaatgcctggataacaacggaggatgctcgcacgtgtgcaacgacctgaagatcggatacgaatgtctgtgcccggatggattccagctcgtggcccagcgccgctgcgaggacatcgacgaatgccaagaccccgatacgtgttcacaactctgcgttaatctggaaggtggatacaagtgccagtgcgaagaaggtttccaactggatcctcacaccaaggcctgtaaagcagtgggatccatcgcctacttgttcttcacgaatcggcacgaagtcaggaagatgaccctggatcgcagcgagtacacttcgctgatccctaacctgcgtaacgtggtggccctcgacactgaggtggcatcgaaccgcatctactggtccgatctgtcacagcggatgatctgtagcactcagctcgaccgcgctcacggggtgtcgagctatgacactgtgatctcgcgcgacatccaggctcctgacggtctggctgtggattggatccattccaacatctactggacggattccgtgctgggcaccgtctccgtcgcagacaccaagggtgtgaaacggaaaaccttgttcagggagaatggatcaaagccgcgcgcgatcgtggttgacccagtgcatgggtttatgtactggactgattggggaactccagccaagatcaagaagggagggctgaacggagtggacatctactcgctggtgacggaaaacatccagtggccgaatgggatcactctcgacctgctgtctggccgattgtactgggtcgactccaagctgcattcgatcagcagcattgatgtaaacggcggaaatcgcaagaccatcctcgaggacgaaaagcgcctggcccatccattctctctcgcagtctttgaagataaagtattctggactgatatcattaacgaggcgatcttttcagctaaccgcctgaccggaagcgatgttaatctgctggcggaaaacctgctgtcgccggaggacatggtgctctttcataacctgactcagccacggggcgtgaattggtgcgaaagaactacgctgagcaacggagggtgccagtacctgtgcttgcccgctccccaaatcaacccacactcaccaaagttcacttgcgcctgcccggacggaatgttgctggcgcgcgatatgaggtcgtgcctgaccgaagcggaggcagccgtggcgacgcaggaaacctccactgtcagactcaaagtctcctcgactgcggtgagaactcagcacaccaccacccgcccagtgccggacacttccaggttgccgggcgccactccaggcttgaccaccgttgagatcgtgaccatgtcccatcaagccttgggagatgttgcgggcaggggaaatgaaaagaagccgtcgtcggtaagagccctctccatcgtgctgccaatcgtgctcctggtgttcctctgcctgggggtgttcctcctgtggaaaaactggcgcctgaagaacatcaacagtatcaacttcgacaacccagtctaccaaaagaccaccgaggacgaggtgcacatttgccacaaccaagacggttactcgtacccgagccggcaaatggtgtcattggaggatgatgtggcg

SEQ ID NO: 15892 - DNA, 2580 bp, Artificial Sequence
  Description of Artificial Sequence: Synthetic coding sequence
atgggtccgtggggctggaaattgcggtggacggtcgcattgctccttgctgccgccggaactgccgtgggagataggtgtgagcgcaacgagttccagtgccaggatggaaagtgcatctcgtacaagtgggtctgcgacggttccgcggagtgccaggacgggtcggacgagtctcaggaaacgtgcctctcagtgacgtgcaaatcgggggacttctcgtgcgggggtcgcgtgaaccggtgcatcccgcaattctggcgctgtgatggtcaggtcgactgcgacaatggttccgatgaacaaggctgcccgcctaagacctgctcgcaagatgagttccggtgtcacgatgggaagtgcatcagcagacagttcgtctgcgacagcgacagagactgcctcgacggtagcgatgaagccagctgtcctgtgctgacctgtggaccggcctccttccagtgcaactcgtccacctgtatccctcagctgtgggcgtgcgataatgaccctgattgcgaggacggctccgatgagtggccgcagcggtgccgcgggctgtacgtgttccaaggcgactcgtcgccatgttccgcctttgaattccattgcctgtctggcgaatgcattcatagcagctggcgctgcgacggcggaccggattgcaaggataaatccgacgaagaaaactgcgcggtggccacttgccggccggatgagtttcagtgttcggacggcaactgcatccacggatcgaggcagtgcgacagagaatacgactgcaaggatatgtcagacgaagtgggatgcgtgaacgtgactctctgtgaggggccgaataagtttaagtgccactcgggagaatgtatcaccctggataaagtgtgtaacatggctcgggactgcagagattggtccgacgagccgatcaaggagtgtgggaccaacgagtgcttggacaacaacggagggtgtagccacgtctgcaacgacctgaagattgggtacgagtgtctgtgtccggacggtttccagctggtggcacagcggcggtgcgaagatatagacgaatgtcaggacccggacacgtgctcccaactgtgtgtgaatctggagggaggatacaagtgtcagtgtgaggaaggattccagctggatccccataccaaggcctgtaaggcggtgggatccattgcgtacctgttcttcactaaccgtcatgaggtgcggaagatgaccctcgaccggtcggaatatacctccttgattccgaacttgcggaacgtggtcgccctggatactgaggtcgcctccaaccgcatctattggtcggatctctcacaaagaatgatctgttcgacccagctcgatagagcacacggagtatcgtcttacgacactgtgatcagccgcgacattcaggccccggatggactcgccgtggactggattcatagcaacatctactggaccgactccgtccttggaactgtgtccgtcgccgatactaaaggtgtgaaaagaaagacgttgttccgcgagaatgggagcaagccgcgggctattgtcgtggaccctgtgcacggattcatgtactggactgactggggcaccccagcgaagatcaagaagggaggactgaacggggtggacatatactctctggtgaccgaaaacatccagtggccgaatggaatcactctggacctgctttcgggccggctgtattgggtggatagcaaactgcactctatcagcagcatcgacgtgaacggcggaaacagaaaaacgatccttgaggacgaaaagcggctcgctcaccctttctcgctcgctgtgttcgaggacaaggtgttttggactgacattatcaatgaggcgatctttagcgcgaatcgcctgaccggttccgacgtgaatctgctcgctgaaaatctcctgtccccggaggacatggtgctgtttcataatctcacccaaccccggggagtgaactggtgtgaacgcacgactctctccaacggtggttgccagtacctgtgtctgcctgctcctcagatcaacccgcactcccctaaattcacttgtgcgtgcccagacggaatgctgctcgcgcgggacatgcgctcatgtctcactgaagcagaggcggcggttgcaactcaagaaacctcgactgtgagacttaaggtgtccagcactgcggtgagaacccaacatacgaccactcgaccagtgcctgatacctcccgcctgcccggcgcaaccccaggcctgacgactgtggaaatcgtgactatgtcgcaccaggcgctgggggatgtggcaggccgggggaacgagaagaaaccatcttcggtgcgcgcactgtcaatcgtcctcccaatcgtgcttctggtgttcctgtgcttgggagtgtttctgctgtggaagaattggaggctcaagaatatcaacagtattaacttcgacaacccagtctaccaaaaaaccactgaggacgaagtgcacatctgccacaaccaagacggatactcatacccatcccgccaaatggtttcccttgaagatgacgtggca

SEQ ID NO: 15893 - DNA, 2580 bp, Artificial Sequence
  Description of Artificial Sequence: Synthetic coding sequence
atgggaccctggggatggaagttaaggtggaccgtggctcttcttctggcagccgcaggcaccgccgtgggagatcgctgtgagcgtaacgagttccagtgtcaggacggtaaatgcatctcatacaagtgggtttgtgatgggtctgctgagtgtcaggacggatctgatgaatcccaggagacgtgtttaagcgtcacctgcaagtcaggagacttttcttgcggaggtagagtcaatcgctgcatccctcaattttggcgctgcgatggacaggtcgactgtgataacggtagcgacgagcaaggctgtcccccaaagacctgttcccaggacgaattcagatgtcatgacggtaaatgtatatcccgccagttcgtgtgcgatagcgaccgggattgcctggatggcagtgacgaggcctcttgtcctgtactgacatgcggaccagcctcctttcaatgcaactcgagcacttgtatcccacaattgtgggcttgtgacaatgatccggactgtgaagatggcagcgacgaatggccacagagatgcaggggactctacgtcttccagggtgactctagcccctgcagcgcttttgagtttcactgcttatccggcgaatgcatccactctagctggagatgcgacggcggtcccgattgcaaggacaaaagcgatgaggagaactgcgctgtcgcgacctgcaggcctgatgagtttcagtgctctgatgggaattgcattcacgggagcagacagtgcgacagagagtacgactgcaaagacatgtctgatgaagtgggatgcgtcaacgtgacattgtgtgagggaccaaataagttcaaatgccacagtggagagtgcataacacttgataaggtctgcaacatggccagagattgtagggactggtcagatgaaccaattaaagaatgcggcacaaacgagtgcttagataataacggcggatgctcccatgtgtgtaacgacctaaaaattggctacgagtgcctgtgtccggatggtttccagctggtggcgcagcgcagatgcgaagatatcgatgaatgtcaagatccagacacctgctcacagctgtgcgtgaacctggagggaggctataagtgccagtgcgaagaaggcttccaacttgatccacataccaaagcctgcaaagctgttggctcaatagcctacttattttttacaaacaggcatgaggttaggaagatgacgttagacaggagcgagtacacatctctgattccaaacctccggaacgtggtcgccttggacaccgaggtggcctcaaaccgaatctattggagcgatctctcacaacgaatgatttgtagtacccagctggatcgcgcccacggcgtgtcaagctatgatactgtgatcagtcgcgatattcaagcccctgatggtctggcggttgattggatccactctaatatatactggactgatagtgtattgggaaccgtaagcgtggcagacaccaaaggggtgaagaggaaaaccctgtttagggagaatggcagcaaaccgagggctattgtagtggatcccgtccacggcttcatgtactggacagactggggtacacctgccaagatcaaaaagggaggattgaatggggtcgatatctattccctggtcaccgagaacattcaatggcctaacggtatcacactggacctgctgtccggccgactttattgggtggactctaaacttcattccatcagttcgattgatgtgaacgggggcaacagaaaaaccattctggaagacgagaaacgactggcacaccctttttctctggccgtgtttgaagacaaagtgttctggacagatatcatcaatgaagcaattttttccgcaaacagactgacaggctccgacgtcaatctgctcgccgagaacctactcagcccagaagacatggtcctgtttcacaacctgacccagcctaggggggttaactggtgcgagcgcacgaccctctcaaacggaggctgccaatacctgtgccttcccgcaccccaaataaaccctcacagccctaaatttacctgcgcctgcccagatggcatgttgctggcgagggatatgcggtcatgcctgacagaagcagaagctgcagtggcaacacaagagacctccacggtccgcttaaaagtgagctccacggctgtccggacacagcacacaactacaaggcctgtccccgatacctcccgattgcccggagcaaccccaggactgaccacagtggaaatcgtgacaatgagtcaccaggccttgggagatgtcgcgggcagaggcaacgaaaagaaaccaagtagcgtgcgcgctctctcaattgtgctgcctatagtgctccttgtgtttctttgcctcggagtgtttctgctgtggaaaaattggaggttaaagaacattaatagtatcaattttgacaatccagtataccaaaagacgaccgaagacgaagtgcacatctgtcacaatcaagacgggtattcttacccttctaggcaaatggtcagcctggaggatgacgtggca

SEQ ID NO: 15894 - DNA, 2580 bp, Artificial Sequence
  Description of Artificial Sequence: Synthetic coding sequence
atgggcccttggggttggaagctccgatggactgttgccttgcttctggctgccgcgggtaccgccgtgggcgatcggtgcgaacgaaacgagttccagtgtcaggacggcaagtgtattagttataagtgggtttgcgatggctctgcagaatgtcaggatggttcggatgagtcgcaggagacttgcctgtccgttacctgcaaaagtggggacttcagttgtggcgggagggtcaatcgctgcattccccaattctggaggtgtgatggtcaggttgactgtgataacggaagcgatgagcagggatgcccaccgaagacctgttctcaagatgagtttcgttgtcacgatggaaagtgcatctcacgacagttcgtttgcgattcggatcgtgattgcttggacgggagcgatgaagcctcgtgccccgtactgacgtgcgggccagcttcttttcagtgcaactcctcaacatgtataccgcagttgtgggcctgcgacaacgatccagattgcgaagatggcagtgatgagtggccccagagatgtcgaggcctatacgttttccaaggtgactcaagtccgtgctctgctttcgagttccactgcttgtccggggagtgcattcatagctcgtggcgatgtgacggtggtccggactgtaaagacaagtccgatgaggagaattgcgctgttgccacatgtcgtcctgacgagttccaatgcagtgatgggaactgcatacatggttctcgacagtgtgatcgagaatatgattgcaaggatatgtccgacgaagttggctgtgtcaatgtcacgttgtgtgaaggtccgaacaagtttaagtgccactcgggcgagtgtataaccctggacaaagtctgcaacatggcccgtgactgtcgtgattggagtgacgagccaattaaggaatgcggaacaaatgagtgtctcgacaacaacggtggctgcagtcatgtgtgcaatgatcttaagataggatatgaatgcctatgcccagatggatttcagctggttgcgcagagaagatgtgaagacatagatgaatgccaagacccggatacgtgtagccagttgtgtgtgaaccttgaggggggctataagtgtcagtgtgaggagggattccagctcgatccccatacgaaggcctgcaaggcggttggatcgatagcctaccttttcttcaccaaccgccacgaggtgcgcaaaatgactttggataggtctgaatatactagcctcattccaaacttgcgcaacgtcgtagccctggacaccgaggtcgcctcgaatcggatctactggtctgacttgtcccagagaatgatctgcagcacgcagctagatcgggcccacggtgtctcgagttatgataccgtgatctcgcgcgacatacaggcacccgatggattggccgtcgattggatccactccaatatctactggacggattcggtgctgggtaccgtgagtgtggccgacaccaagggcgtgaagcggaagacactattccgagaaaatgggtccaagccacgcgccatcgtggttgaccctgttcacggttttatgtattggacggactggggtacgcctgccaaaattaaaaaaggagggttgaacggtgtggacatctattctctcgttacggagaatattcagtggccaaatggaataacactggacctcctgagtggtcgcctttactgggttgatagcaagctgcatagcataagcagtatcgatgtcaacggaggcaataggaaaactattctggaggatgaaaagcgcttggcgcatcctttctccctagcggtgtttgaagataaggttttttggactgacattatcaacgaagccattttttccgctaaccggctaactggctctgatgtaaacttgcttgcggagaacctcctgtcgcccgaagatatggttttgttccacaacctcacgcaacctaggggagtcaattggtgtgaacgaaccactctgtccaatgggggttgtcagtatctctgcctgccggctccgcagatcaacccacacagtcctaaatttacttgcgcctgtccagacggcatgctcctggcaagggatatgaggtcatgtctaaccgaagcggaagcggccgtcgctacccaggagacatcgacagtccggctaaaggtttctagcacagccgtgagaacccaacacactaccactcggccagtccctgacacttccaggctccccggtgctacccccggcctgaccactgttgagattgtcaccatgagccaccaagccctcggtgatgtggccggccgcggaaatgaaaagaagcctagctctgtccgcgcgcttagtatagtcttgcctattgtcttgttggtcttcctctgccttggcgtatttctgctttggaagaactggagactaaaaaacataaattcaattaactttgataatccagtctatcaaaaaacaactgaggacgaggtccatatctgtcacaatcaagacggctactcctacccttctcggcagatggtttcgttagaggatgacgtggct

SEQ ID NO: 15895 - DNA, 2580 bp, Artificial Sequence
  Description of Artificial Sequence: Synthetic coding sequence
atgggtccgtggggttggaaattacgatggacggtagcgctattactagcggcggcgggtacggcggtaggtgatcgatgtgaacgaaatgaatttcaatgtcaagatggtaaatgtatatcgtataaatgggtatgtgatggttcggcggaatgtcaagatggttcggatgaatcgcaagaaacgtgtttatcggtaacgtgtaaatcgggtgatttttcgtgtggtggtcgtgttaatcgttgtataccgcaattttggcgttgtgatggtcaagtagattgtgataatggttcggatgaacaaggttgtccgccgaaaacgtgttcgcaagatgaatttcgatgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgatgtcgtggtttatatgtttttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggttgcgacgtgtcgaccggatgaatttcaatgttcggatggtaattgtatacatggttcgcgacaatgtgatcgtgaatatgattgtaaagatatgtcggatgaagttggttgtgttaatgtaacgttatgtgaaggtccgaataaatttaaatgtcattcgggtgaatgtataacgttagataaagtatgtaatatggcgcgagattgtcgtgattggtcggatgaaccgataaaagaatgtggtacgaatgaatgtctagataataatggtggttgttcgcatgtatgtaatgatctaaaaataggttatgaatgtttatgtccggatggttttcaattagttgcgcaacgtcgatgtgaagatatagatgaatgtcaagatccggatacgtgttcgcaactatgtgtaaatttagaaggtggttataaatgtcaatgtgaagaaggttttcaactagatccgcatacgaaagcgtgtaaagcggttggttcgatagcgtatttattttttacgaatcgacatgaagttcgtaaaatgacgttagatcgttcggaatatacgtcgctaataccgaatttacgaaatgttgtagcgttagatacggaagtagcgtcgaatcgtatatattggtcggatctatcgcaacgaatgatatgttcgacgcaattagatcgtgcgcatggtgtatcgtcgtatgatacggttatatcgcgtgatatacaagcgccggatggtttagcggtagattggatacattcgaatatatattggacggattcggtattaggtacggtatcggttgcggatacgaaaggtgtaaaacgtaaaacgttatttcgagaaaatggttcgaaaccgcgtgcgatagtagtagatccggttcatggttttatgtattggacggattggggtacgccggcgaaaataaaaaaaggtggtctaaatggtgttgatatatattcgttagtaacggaaaatatacaatggccgaatggtataacgttagatttactatcgggtcgtctatattgggttgattcgaaactacattcgatatcgtcgatagatgttaatggtggtaatcgtaaaacgatactagaagatgaaaaacgactagcgcatccgttttcgctagcggtatttgaagataaagtattttggacggatataataaatgaagcgatattttcggcgaatcgtttaacgggttcggatgttaatttattagcggaaaatttattatcgccggaagatatggtattatttcataatctaacgcaaccgcgaggtgtaaattggtgtgaacgtacgacgttatcgaatggtggttgtcaatatctatgtttaccggcgccgcaaataaatccgcattcgccgaaatttacgtgtgcgtgtccggatggtatgttactagcgcgtgatatgcgttcgtgtttaacggaagcggaagcggcggtagcgacgcaagaaacgtcgacggtacgtttaaaagtatcgtcgacggcggttcgtacgcaacatacgacgacgcgaccggtaccggatacgtcgcgattaccgggtgcgacgccgggtttaacgacggtagaaatagtaacgatgtcgcatcaagcgctaggtgatgtagcgggtcgtggtaatgaaaaaaaaccgtcgtcggtacgtgcgttatcgatagttttaccgatagtattattagtatttttatgtttaggtgtttttttactatggaaaaattggcgtctaaaaaatataaattcgataaattttgataatccggtatatcaaaaaacgacggaagatgaagtacatatatgtcataatcaagatggttattcgtatccgtcgcgtcaaatggtatcgttagaagatgatgttgcg

SEQ ID NO: 15896 - DNA, 2580 bp, Artificial Sequence
  Description of Artificial Sequence: Synthetic coding sequence
atgggcccatgggggtggaaactgagatggactgtggccctgctgctcgcagctgctgggaccgccgtgggcgacagatgcgaaaggaacgagttccagtgccaagatggaaaatgtataagctataaatgggtgtgtgatggctctgcagagtgccaggacggctctgacgagagccaggagacctgtctatctgttacctgcaaaagtggcgacttctcttgtggaggccgggtgaatcggtgtatcccacagttctggaggtgtgatggacaagttgactgtgataacggatctgatgagcaagggtgcccacctaaaacctgttctcaggacgagtttagatgccacgacgggaagtgtatatcacggcagtttgtatgcgacagcgacagagactgcctggatgggagtgatgaagccagctgccctgttctaacctgtggcccagcatctttccaatgcaattcctcaacttgcatacctcagttgtgggcttgtgacaacgacccagattgcgaagacggctccgacgaatggccacagcggtgtcgcgggctgtatgttttccagggcgacagttccccttgtagcgctttcgagttccactgtctgtccggggaatgtatccacagttcctggcgatgcgatggggggccagattgtaaggataaaagcgatgaagagaattgtgcagtcgcaacatgccgccctgacgagtttcagtgtagcgacgggaactgcattcatggatctcgacagtgcgatcgtgaatacgattgcaaggacatgagcgatgaggttggatgcgtgaacgtcactctgtgtgaaggtccaaataagttcaagtgccattctggcgaatgtatcaccctggataaggtgtgtaacatggccagagattgccgtgattggtccgacgagccgataaaggagtgtgggaccaacgaatgtttggataacaatggaggctgttctcatgtgtgcaacgatctgaagatagggtacgagtgtctgtgtccagatgggttccagttagttgcacagaggcgctgtgaagatatagatgagtgccaggaccctgacacatgttcacagctatgcgtgaatctcgaggggggatataagtgtcagtgtgaggagggcttccagctggacccacataccaaggcctgtaaagctgtgggcagcatcgcatacctattttttaccaaccggcacgaggttcgtaaaatgacactggaccgatctgagtatacttcactcattccaaatcttaggaatgtcgtggctctggacaccgaggtggcttcaaatcgcatctactggtccgacttgtcacagcgcatgatatgcagcacacagctcgacagagctcatggggtttcctcttacgataccgtgatcagccgggatatacaggccccagatgggctagctgtggattggatccattccaacatttactggaccgacagcgtgctgggcaccgtgagtgtggccgacacaaaaggcgtgaagaggaaaactctcttcagggaaaacgggtccaagcctagagcaattgtggtggatccagtccacggattcatgtattggactgattggggtactcctgctaaaattaagaagggtggactaaacggggtggacatatattccctagttacagagaacatacagtggccaaatggcataaccctggatctgcttagcgggagactgtattgggttgatagtaaactccattccatctctagtatagatgtaaacggcgggaataggaagactatcctagaggacgagaagaggctggcacatccattctcactggcagtctttgaggataaggtcttctggactgatataatcaacgaggctatctttagtgcaaacagactaaccggcagtgatgttaacctgctcgccgaaaacctgctctcccctgaagacatggtcctattccacaacttaacccagccccgcggggtgaactggtgtgaacggacaacactcagtaacgggggctgccagtatctgtgtctcccggccccacaaattaaccctcactctcctaagttcacctgcgcatgtccagatgggatgctcctggctagggatatgcgtagctgcctgacagaggccgaagctgcagtcgccacccaggaaacctccacagtgcggctcaaagtgagtagtacagccgtgagaacacaacacactaccactcggcctgtcccagacacctcccggcttcccggcgccaccccagggctgacaacagttgagatagtgacaatgagtcaccaggcccttggagacgttgccggacgaggcaacgagaagaagcctagcagtgtccgagcactcagtatagtcctgccaatcgttctgctggtgttcctatgtctaggcgtcttcctgctatggaagaattggcgcctgaaaaatattaacagcataaattttgacaaccctgtttatcagaagactacagaagatgaagttcatatctgccacaatcaggacggctatagctacccaagtagacagatggtgtcactagaggacgacgtcgcc

SEQ ID NO: 15897 - DNA, 2580 bp, Artificial Sequence
  Description of Artificial Sequence: Synthetic coding sequence
atgggtccgtgggggtggaagctgcgctggaccgtggccctgctgctggcggccgctggaactgctgtgggtgaccggtgcgaacgcaatgaattccaatgccaggacggaaaatgcatctcatacaagtgggtctgcgatgggtcagcggaatgccaagatggatcggacgaatcccaggagacgtgcctctctgtcacgtgcaagtcaggcgacttctcgtgtggcggacgggtcaatagatgcattccgcagttctggcgctgcgacggacaggtggattgcgacaacggttccgatgaacagggatgcccacctaagacgtgctcccaagatgaattcagatgtcacgatggaaaatgcattagccggcagttcgtgtgcgacagcgatagagattgcttggatggctccgacgaagcctcctgtcctgtgctgacctgtggccctgcctccttccagtgcaacagctctacttgcatcccacagctttgggcctgcgacaacgacccggattgcgaggacgggtcggacgagtggccgcaaaggtgccgggggctttacgtttttcaaggtgattcctcgccttgctcagcctttgagttccattgcttgtcaggagagtgcattcactcctcctggaggtgtgacggagggccggactgcaaagataagtcagacgaagaaaattgcgcagtcgcgacctgcagacctgatgaattccagtgctcagacggcaattgcatccacggatcgcggcaatgcgacagagagtacgactgcaaggacatgagcgacgaagtcggctgcgtgaacgtgaccctgtgtgaaggaccgaacaagttcaagtgccacagtggtgaatgtatcactctggacaaagtctgtaacatggcacgcgactgccgcgattggtcggatgagccaatcaaagagtgcggaaccaacgaatgcctggacaacaacggaggctgctcccacgtgtgcaacgacctgaagatcggttacgaatgcttgtgccccgatggattccaactcgtggcacagcgcagatgcgaggacatcgatgaatgccaagaccccgacacctgctcgcagctgtgcgtgaacctcgaaggggggtacaagtgccagtgtgaagaaggctttcagctggaccctcacactaaagcatgcaaagccgtgggatcaatcgcctacctcttcttcaccaatcgccatgaggtgcggaaaatgactctggaccggagcgaatacacctcactcattccgaatctcagaaatgtggtggccttggacaccgaggttgcctcaaacaggatctactggtctgacctgtctcaacggatgatctgctcgactcagttggaccgcgcgcacggtgtctcaagctacgacactgtcatcagtcgggacatccaggcgccggacggactggcggtcgactggatccattccaacatctattggactgactctgttctcggcactgtctccgtggctgacactaaaggagtgaaacggaaaaccctgttcagagagaacggctcgaagcccagagccattgtcgtggatccggtgcatggattcatgtactggaccgattggggcactcctgcgaagatcaagaagggaggactgaacggggtggatatctacagcctggtcaccgaaaacatccaatggccgaatgggattaccctggacctgctgtcagggagactgtactgggtggattcgaaacttcattccatcagctctatcgacgtgaacggcggcaaccgcaagacgatcttggaagatgaaaagcgcctggcccacccgttctccctcgccgtgttcgaggacaaggttttctggacggacatcattaatgaagcaatcttctcggctaacagactcaccgggagcgatgtgaacctcctcgcggagaacctcctgtctccggaagatatggtgctcttccacaacctgactcagccgcgcggagtgaactggtgtgagcgcactaccctttcgaacgggggctgccagtatctttgtctcccagccccccaaatcaatcctcacagcccgaagttcacttgcgcctgtcccgacggaatgctgcttgctagagatatgcgaagctgcctgactgaagcagaagccgcagtggccactcaggagactagcactgtgcgcctgaaggtgtcgtccactgccgtgcgcacccagcacacgactactcggccggtgccggatacgtcgagattgcctggcgccaccccgggtctgactactgtcgagatcgtgaccatgagccatcaggcgctgggagacgtcgctggtcgcggtaatgagaaaaagccaagctcggtgcgggctctgtcgatagttctcccaattgtgcttctggttttcctctgcctcggagtgttcttgctctggaagaactggaggctcaagaatatcaattccataaacttcgacaatcctgtttaccagaaaaccactgaagatgaggtccacatctgccataatcaggacggctattcgtacccgtcaagacaaatggtgtctctggaggatgatgtcgcc

SEQ ID NO: 15898 - DNA, 2580 bp, Artificial Sequence
  Description of Artificial Sequence: Synthetic coding sequence
atgggaccctggggctggaagctcagatggaccgtggccctgctcctggcagcggccgggaccgcagtgggtgatcgctgtgagagaaatgaatttcaatgccaggacggaaagtgtatctcgtacaaatgggtgtgtgacggaagcgctgagtgtcaggatggctcagacgaaagccaagaaacctgtctcagcgtcacctgtaagtcgggtgatttttcctgtggcgggcgcgtgaaccgatgcatacctcaattttggagatgtgatggacaggtggactgtgacaatggatcggatgagcaaggatgccctccaaagacttgttcccaagacgagttccgctgtcatgatggaaagtgtatttcccgacagtttgtctgcgactcagatcgggattgcctcgatggatcagacgaagcatcatgccctgtgcttacttgtggtcctgcatccttccaatgtaactcttccacgtgcattcctcagttgtgggcctgtgacaatgaccctgactgtgaggacggctcagacgagtggccacaacgctgtagagggctttacgtgtttcaaggtgactcgtccccctgctcagcctttgaatttcactgtcttagcggggaatgtatccattcatcctggcggtgcgacggaggtcctgactgtaaggataagtccgacgaggaaaactgcgcagtggccacctgcagaccggacgaatttcagtgttcagacggaaattgtattcacggttccaggcaatgtgatagggaatatgattgtaaggatatgtccgatgaagtcggctgtgtcaatgtcaccctttgtgaaggtccaaacaagttcaaatgtcattccggcgaatgtatcacccttgataaagtctgcaatatggcacgagactgtagagattggtcggacgaacccattaaagagtgtggaactaacgaatgcctcgacaataacggcggatgttcccacgtgtgcaacgacctgaagattggctatgagtgtctgtgtccggatggttttcaactcgtcgcgcagcgcagatgtgaggatatcgacgaatgtcaagatccggatacttgcagccaactgtgtgtcaacctggagggaggatacaagtgtcagtgcgaggaaggtttccaactggatccacacactaaggcttgtaaggcagtcggatcaattgcgtaccttttcttcaccaatcgccatgaagtgaggaagatgactttggaccgatcggaatacacctccctcatccctaatctgcggaatgtggtggcacttgatactgaagtggcgagtaacaggatatactggtccgacctctcgcagcggatgatatgcagcacccaactcgaccgggcacatggtgtgtcgtcgtacgatactgtgatatccagagacatccaagcgccggacggactcgccgtcgattggatccatagcaatatctactggaccgattctgtgctgggaacggtgtccgtggcagacacgaagggcgtgaagcgcaaaactcttttccgagagaatggcagcaagcctcgggcaatcgtggtcgaccctgtgcatggattcatgtactggactgactggggcactccagcaaagatcaaaaagggtggtcttaatggggtggatatctacagcctcgtgactgaaaacattcagtggcctaatggtataaccctcgacctcctttccggccgactgtactgggtcgactcgaagctgcacagcatctcctcaatcgatgtgaatggaggtaaccgtaagaccattcttgaggatgagaagcgactggcacacccttttagcctcgcagtattcgaagataaggtcttttggaccgacattatcaatgaagcaatcttttccgccaacaggctgaccggatcagacgtcaaccttcttgccgaaaacctcctgtccccagaggatatggtgctttttcataaccttactcaaccgcggggtgtgaattggtgtgagagaacgactttgtcaaacggcggttgccagtacctctgtctgccggcccctcagattaacccgcactcgccgaagtttacctgtgcatgtcctgatggcatgctcctcgcacgggatatgcgctcctgcctgaccgaagctgaagctgctgtggccacccaagagactagcactgtgaggcttaaggtttcgagcacggccgtccgcactcaacacactactactagaccggtgcctgatacgtcgcggcttccaggggcaacccccggtctgactactgtcgagattgtgactatgtcacatcaagcactgggcgatgtggcaggtcgtggcaacgaaaagaagccaagctcggtccgggcactctccatagtgctgccaattgtcctgcttgtgttcctttgccttggggtctttctgctgtggaaaaactggagattgaaaaacattaactctattaactttgataaccccgtttatcaaaagaccaccgaggatgaggtccacatttgtcacaaccaggatggttactcatacccctcacggcaaatggtgtcattggaggacgatgtggcc

SEQ ID NO: 15899 - DNA, 2580 bp, Artificial Sequence
  Description of Artificial Sequence: Synthetic coding sequence
atgggtccttgggggtggaagctgcgctggactgtcgccttgttgctcgccgcggcgggcactgccgtgggtgaccggtgtgagaggaacgagtttcagtgtcaagatggaaagtgcattagctacaaatgggtgtgcgatggatcagccgaatgtcaagacggatccgacgaatctcaggaaacttgtctctccgtcacgtgtaagtcgggagacttttcatgcggaggcagagtgaatcgatgtatacctcaattttggcgctgcgatggtcaggtggactgcgataatgggtccgatgaacaaggatgtccgcctaagacttgctcgcaagatgagttccggtgtcatgatggcaaatgtatttcaaggcaatttgtctgtgattcggacagggattgtctcgatgggtcggatgaagcaagctgtcccgtgttgacctgtggtcctgcatcgtttcagtgtaattcgtcaacgtgcattcctcaactgtgggcatgcgataatgatcctgactgtgaggatggatccgatgaatggccacagaggtgccgtggactgtatgtgttccaaggagattcctcaccttgctccgcattcgagtttcactgtctctcgggcgagtgtatccattcctcctggcgttgtgatggtggcccagactgcaaagataagtcagacgaagagaattgtgcagtggcaacttgtcgtcccgacgaatttcagtgtagcgacggtaactgtattcacggaagcagacagtgcgatcgcgagtacgattgcaaagacatgagcgatgaagtgggctgtgtgaacgtgactttgtgtgagggccctaacaagtttaagtgccattccggagaatgtattactcttgacaaggtctgtaatatggcgagagattgtcgcgactggtcggatgagcctattaaggaatgtggtaccaacgaatgtttggataacaacggtggttgttcgcatgtgtgcaacgacttgaaaattggatatgaatgcctttgtccggatgggtttcaactcgtggcccaaaggaggtgtgaagatattgatgagtgtcaggatcccgacacttgcagccagctttgcgtgaaccttgaaggggggtacaagtgccagtgtgaggaaggatttcaacttgacccacataccaaggcatgtaaagcagtgggttcaatagcttacttgttcttcaccaatcggcatgaagtgcggaagatgacgctggatcggtcagaatacacttcgctgattccaaatttgaggaatgtggtggcgcttgacactgaggtggcatctaatcggatctactggtccgacctgtcccagcggatgatctgctccactcagctggatagagcacatggtgtctcctcgtacgatactgttatctcacgggatattcaagcacctgatggacttgccgtggattggatacatagcaacatctattggaccgactcggtgctgggcacggtttcagtggcagacactaaaggggtgaagcggaaaactctgttccgtgaaaacggaagcaagcccagggcaatagtcgtcgatccggtgcacgggtttatgtactggaccgattgggggactccagcaaagattaagaaaggaggactcaatggcgtggacatctactccctggtgaccgaaaacatacaatggccaaacggaatcactcttgatctgcttagcggccgactgtactgggtcgattccaagctccacagcatttcttcgatcgacgtcaacggaggtaaccgcaaaaccatccttgaggacgaaaagagacttgcgcatcctttctcccttgcagtgtttgaagataaggtgttttggactgatatcattaacgaggctatcttttcagctaaccgcctgactggatcagatgtcaatctgctcgcggagaatttgctttcaccagaagatatggtcctgtttcacaaccttacccagcctagaggcgtgaactggtgcgagcgcactactctgagcaacggggggtgccaatacctgtgtttgcccgcacctcagatcaatccccacagcccgaaattcacttgcgcatgccctgatggaatgcttttggccagagatatgagaagctgtctgacggaagccgaggccgcagtcgcaactcaagaaactagcaccgttcgactgaaggtttcttccactgcagtgagaacccagcataccaccacccgaccggtgccagacacttcccgactgccgggtgccactccggggctcaccactgtggaaatcgtgaccatgtcgcaccaagcgctgggagacgtcgctggtagggggaacgaaaagaagccgtcgtcggtcagagcactgtcgattgtccttccaatagtgcttcttgtgttcctctgtctgggagtgttcttgctctggaagaactggagactgaagaacattaactcaattaactttgacaatcccgtgtaccagaaaaccaccgaagatgaagttcatatttgtcataaccaggatggatactcatacccatcccgccaaatggtgtcccttgaagatgacgtcgca

SEQ ID NO: 15900 - DNA, 2580 bp, Artificial Sequence
  Description of Artificial Sequence: Synthetic coding sequence
atgggaccttggggttggaaattgcgctggacagtggcgcttctgctggctgctgccggaacagcagttggagatcgatgtgaacgcaacgagtttcagtgtcaggatggcaagtgcatcagctataaatgggtgtgtgacgggtctgcagagtgtcaggacggctcagatgaatcacaggagacttgcctgtccgtgacatgtaaaagtggagacttctcatgtgggggtagagtcaatcggtgtatcccccagttttggagatgtgatgggcaggtcgattgcgataatgggtcagatgaacaaggctgcccccccaaaacctgttctcaggacgagtttcgatgtcatgacgggaaatgtatttcaagacagtttgtgtgtgactctgaccgagactgtttggacggatccgacgaggccagctgtccagtattaacctgcggccccgcttcatttcagtgcaactcaagtacgtgcatcccccaactatgggcctgtgacaatgacccagattgtgaagatggcagtgacgaatggccacagcggtgccgaggcctgtatgtcttccaaggcgatagttccccttgctcggcctttgagtttcactgtctatccggagaatgtatccactccagttggagatgtgatggaggccccgattgtaaagataagagtgacgaagagaactgtgcggtcgcaacatgccggccagacgagttccagtgctccgacgggaattgcatacacggatcacggcaatgcgacagagaatatgactgcaaggacatgagtgatgaggtaggctgcgtaaacgttaccctgtgtgaaggacccaataaattcaagtgtcatagcggggaatgcattacgctggacaaagtttgtaacatggcccgcgactgtcgtgattggtccgacgagcctataaaagaatgcggtaccaacgagtgcctcgacaataatggagggtgtagccatgtctgcaatgatctaaagattgggtacgagtgcctgtgtccagatggattccaactggtcgcccaacggaggtgcgaggatattgatgagtgtcaggacccagatacctgctcacagctctgtgttaatttggaaggtggctataaatgtcagtgcgaagaggggttccagttggatccccatacaaaggcctgcaaagcagtcggatccattgcctatctgtttttcactaatagacatgaggttcggaaaatgactctcgaccgtagcgaatacacctctctcatcccaaatctccgaaatgttgtagccctggacaccgaggtggcaagtaatcgtatctactggtccgatctgagccagcgaatgatctgcagcacccagcttgacagggcacatggcgtgtcctcatacgacactgtgattagccgagatatacaggcacctgatggtcttgcggtagactggatccattccaacatatattggacggactccgttttgggcacagtatccgtggccgatacaaagggagtaaaacgtaagacactctttcgggaaaacggatcaaaaccccgagcgatcgtggtggaccccgtgcacggatttatgtattggacggactggggcacccctgctaagattaagaagggcgggctgaatggggttgatatctattctctggtaacggagaatatccagtggccaaacggaataaccttggacttgcttagtggacgcctttactgggtggattctaaattgcactccatctcatcaatcgacgtgaatggaggcaatcggaagactattttggaggatgagaagcggctggcccatccgttttctttggctgtgttcgaggacaaggtgttttggacagacattattaacgaggccatttttagcgccaatcgcctaacgggtagtgacgtaaacctgctggcagagaatctgttatccccagaggatatggtcctgtttcataatttgacacaaccaagaggcgtgaactggtgcgaacggaccacactaagcaacggggggtgccaatacctgtgcctccctgcccctcagattaatcctcactctccaaagttcacctgtgcctgcccagacggaatgttgctggctcgagatatgaggtcttgtctaactgaggccgaagccgctgttgcgactcaggaaaccagtactgtccgcctgaaagtgagtagtactgcggtgcgtacacagcatacaacaacacgcccggttcccgatacctccagactgcccggggccacccctggcttgactactgttgaaatcgtcaccatgtcacatcaggccctcggtgacgtggctggccgcgggaatgaaaaaaagcctagttctgtgagagctttgagcattgtccttcctattgtgctgctggtttttctttgtttaggtgtgttcctgctgtggaagaattggcggcttaagaacataaatagcataaacttcgataaccccgtctaccagaagaccacagaagacgaagtacatatttgccacaaccaagacggatattcatacccttccaggcaaatggtctccctggaagacgacgtggcc

SEQ ID NO: 15901 - DNA, 2580 bp, Artificial Sequence
  Description of Artificial Sequence: Synthetic coding sequence
atggggccttggggatggaaacttaggtggactgtcgcgctgttgctcgctgcagctggaacagcggtgggagacagatgcgaaagaaatgaattccagtgccaggatgggaagtgcatcagttacaaatgggtgtgcgatggatcggccgagtgccaagatgggtctgatgaaagtcaggagacatgtctgtccgtgacttgtaaaagtggagattttagttgcggggggcgggtaaataggtgcatcccacagttctggaggtgtgacgggcaggtcgattgcgataatggaagtgatgagcaggggtgcccgcccaaaacttgttcccaggatgaatttcgatgtcatgatggaaaatgtatatctagacagtttgtgtgcgattccgaccgggattgcctggatggatcagacgaagcgtcctgtcccgtcttgacttgtgggcccgcgtcgtttcagtgtaactctagtacatgtatcccccagctctgggcatgtgataacgatccagactgcgaagacggatccgatgaatggccacagaggtgtaggggactctatgtgtttcagggggatagttctccttgctcagccttcgaattccattgcttatcaggagaatgtatacactcttcgtggaggtgtgacggagggccagattgtaaagataaatccgacgaagagaactgcgccgtagctacttgccgccccgatgaattccaatgctccgacgggaattgcatacacgggtctcgacagtgcgatcgggaatatgattgcaaggatatgtccgatgaggtcggatgtgtgaatgttactctgtgcgaagggcccaataaatttaaatgtcactccggggaatgtattacactcgataaggtctgcaacatggctcgcgattgtagggattggagtgatgaacccatcaaggaatgtgggactaacgaatgtctagataacaatggggggtgttcacacgtttgcaatgatcttaaaatcggatatgaatgtttatgtcccgatggattccagctcgtcgctcagcgacgctgcgaagacatagatgagtgtcaggatcctgatacttgctctcagctttgcgtaaatctcgaaggggggtataaatgtcagtgcgaagaggggttccagctggatccccatacaaaagcgtgcaaagcagtggggtcgatcgcctacctgttctttactaaccggcatgaagtcagaaagatgactctggatagatctgaatacacttctcttatccctaatctgagaaacgtcgtggctcttgatactgaagttgccagtaatcgaatctactggtccgatctttcccagaggatgatatgcagtactcagctggacagggcccatggggtatcttcttacgatacagtgattagtcgagatatccaggcacccgatgggctagcggttgattggattcactctaatatttattggactgattctgtcctgggaacagtttctgtggccgacacaaaaggggtgaaacgaaaaactctatttagggaaaatggatcgaagccacgggctatcgtggtcgaccccgtgcacgggtttatgtattggacagattggggaacacccgccaaaataaagaaaggagggctgaacggggttgatatatattccctcgtgactgaaaacatccagtggcctaacggaataactctggatctgttaagtggaagactctactgggttgactccaaactgcactccatatccagtatcgatgtcaatggagggaatagaaaaactattttagaagatgagaaaagactagcacatcccttctccctagccgtgtttgaagacaaagtcttctggactgacatcatcaacgaagctatcttttctgcaaaccgactcactgggagtgatgtaaacctcctagccgagaacttgctatccccagaagacatggttttattccataacctaactcagccaagaggggtaaattggtgcgaacgcacaactctctctaatggagggtgtcagtacctttgcttacccgctccacagatcaacccccattctcctaaattcacatgtgcctgtcctgatgggatgctgctcgcgcgcgatatgaggtcttgtcttactgaagcagaagctgcggtagctactcaggaaacatcgactgttagactcaaggtctcctccacggccgtccggacacagcacactacaacacggccagtacccgatacttccagacttcccggggccacaccagggctgactactgttgaaatagttacgatgtcccatcaggcccttggggatgtcgctggaagggggaacgaaaagaaaccctcaagtgtcagggcgctatctatcgtactacctatagtgctgttagtctttttatgtctgggggtgtttctgctgtggaaaaattggcggctaaaaaatataaattccattaattttgataaccctgtgtaccagaaaacaacagaagatgaagtccatatctgtcataatcaggatgggtattcatatccctcacgccagatggtgtctctggaggatgacgtggcc

SEQ ID NO: 15902 - DNA, 2580 bp, Artificial Sequence
  Description of Artificial Sequence: Synthetic coding sequence
atgggaccatggggctggaagctcagatggaccgtcgccttactgctggccgcagccggcacagcagtgggcgaccgctgcgagaggaatgaatttcagtgtcaggacggaaagtgtatctcgtacaaatgggtatgcgacgggtctgcagagtgccaggatggttcagatgagtcccaggaaacatgtttatccgtcacatgcaaatccggagacttctcatgtggcggccgtgtgaatcgctgcatacctcagttttggcgctgcgatggccaagtggactgtgacaatgggtctgatgagcaagggtgccctccgaagacgtgctctcaagatgagttcaggtgtcacgatggcaagtgcatctccaggcagttcgtgtgcgattccgaccgggattgtctggacggatccgacgaggcgtcttgcccagtgctaacctgtgggcccgcgtcattccagtgcaactcttccacctgcatccctcagctctgggcttgtgacaacgaccccgactgcgaggacgggagcgacgagtggcctcaacggtgcagaggattgtatgttttccagggggattcatccccttgctcagcttttgaattccattgcctctccggcgagtgcatccacagctcatggcgttgtgacgggggtcccgattgcaaagataaatcagacgaggagaattgtgccgtggctacctgcagacctgatgagttccagtgtagtgatggaaactgtattcacggaagcagacaatgtgatcgtgaatatgattgcaaggacatgagcgacgaggtaggatgtgtgaacgtgacgctctgcgaggggccaaataagttcaagtgccattccggagaatgtatcacactggacaaagtctgtaacatggcccgggactgtcgggactggagcgacgagcctattaaggagtgcggcaccaatgaatgtctggacaacaacggaggatgttcccacgtgtgtaatgaccttaagatcggatatgaatgcctgtgtccggacggtttccagttggtggctcagcgcaggtgtgaggacatagatgaatgtcaggatcccgatacttgcagccagttgtgtgtgaatctcgagggcgggtataaatgccaatgcgaagaagggttccagttagacccgcacacaaaagcttgtaaggccgtgggctctattgcatacctcttttttaccaacagacacgaggtaaggaagatgactctggacagaagtgaatacacctctctgatccccaacttgagaaacgtagtggccttggatacagaagttgcctcaaatcggatctactggagtgatctaagccagcggatgatctgctcgacgcagctagatagagcccatggcgtatccagctatgatactgtcatcagtcgagacatccaggccccagacgggctagccgtcgattggatccattccaatatctattggaccgatagcgtgttgggaacagttagcgttgccgacacaaaaggggtgaagaggaagaccctctttcgcgaaaatggttccaagccccgtgctatcgtcgtcgacccagtgcacggcttcatgtactggactgattgggggactccagccaagataaaaaaagggggcctgaatggagtggacatttacagcctcgttactgaaaacatccagtggccaaacgggattacactggatcttctgtcaggaaggctttattgggttgactcaaagctgcactctatcagttcaatcgatgtgaacggaggaaaccgaaagacaatcttagaagatgagaagaggctggcgcacccgttttccctggccgtgttcgaggacaaggtcttctggacagacatcatcaatgaagctattttctccgctaaccgcctgaccggatccgacgtcaatttgctggctgagaacctgttgtctccagaggacatggtactgtttcataatctaacccaacctcggggcgtcaattggtgcgaaaggactaccctaagtaacggaggctgtcagtatctgtgcctacccgctcctcagattaaccctcattctccgaaattcacctgcgcctgccctgatgggatgctgctcgcacgcgacatgcggagttgtctcacagaggccgaagccgcggtagctacccaagaaacatcaacagtgaggctgaaggtgtcttccaccgccgtgcgaacccaacatactacgactcgacccgttcccgacacatcccggctcccgggagcaaccccgggactgacaacagtggaaatcgtcactatgagtcaccaggcactgggcgacgtggctggacgcggcaatgagaagaaaccctcttccgtgagagccctgtccatagttttacctatcgtgctgttagttttcctctgccttggtgtgtttctcctgtggaagaactggcgcctaaaaaacatcaattccataaactttgataatcccgtgtaccagaaaactactgaggatgaagtgcacatctgccacaaccaggacgggtacagctacccgagccgccagatggtcagcctagaggacgacgtagca

SEQ ID NO: 15903 - DNA, 2580 bp, Artificial Sequence
  Description of Artificial Sequence: Synthetic coding sequence
atgggcccttgggggtggaagttgagatggacagtggcactcctcttggctgctgccggcacggccgtcggcgaccgctgtgaaaggaacgagttccaatgtcaagatgggaaatgcatctcatacaaatgggtgtgcgatggatctgcggagtgtcaagatggctccgatgagagccaggagacttgcctgagtgttacatgcaagtctggcgacttcagctgcggcggtagggtgaataggtgcatcccacaattctggaggtgtgatggccaggtcgactgcgataatggtagtgatgagcaggggtgtccacccaagacctgttcccaagacgagtttaggtgccacgacggcaaatgtatctctcgacagtttgtgtgcgactccgatcgggactgtctcgacgggtctgatgaggcctcttgccctgtgctgacctgtgggccagcttcttttcagtgtaactcgtccacctgcattccgcagctgtgggcatgcgataatgaccctgactgtgaggacggctctgatgagtggccccagcggtgtcggggactatacgtcttccagggtgattcttcaccttgtagcgccttcgagttccactgtctgtccggagaatgcattcactcctcctggaggtgtgacggaggccccgattgcaaggacaagtcagatgaggagaactgtgctgtggccacttgccgccctgatgaatttcagtgctctgatggtaattgtattcatgggtccaggcagtgcgatagggagtacgactgtaaagacatgagcgacgaagtcggctgcgtgaacgtgacactgtgcgaaggaccgaataagttcaagtgccactcaggcgagtgcattacattagataaggtttgtaatatggcccgcgattgccgcgactggtccgatgagccgatcaaagagtgcgggactaatgagtgcttggacaacaatggtggctgtagccacgtatgcaatgatcttaaaattggatatgaatgtttgtgtccagatgggttccaactggtcgcgcagaggagatgcgaggatatcgatgagtgtcaggatcccgacacctgtagtcagttatgcgttaacctggaaggtggctataagtgtcagtgtgaggagggctttcagttagatccgcacacgaaagcctgcaaagccgtcggaagcattgcctatctctttttcacaaatagacacgaagtgagaaagatgacgctagacaggtctgagtacacctcattgattcccaacctacgcaatgttgtggccctggataccgaagttgcctccaatcggatttactggagtgacttgtcacaacgaatgatatgttccacccagctcgacagagcgcacggcgtgagttcttatgacacggttatctcaagagacatccaggctcccgatgggctggctgtcgactggatccattcgaacatttactggaccgattcagtactggggactgtaagtgtggctgatacaaaaggagttaaacgcaaaaccttgtttcgggagaacggctcaaagcctcgcgctatagtggtggatcctgtgcacggattcatgtattggactgactgggggactcccgctaagattaaaaagggaggactgaatggagttgacatatatagtctggtcaccgaaaatattcaatggccaaatggaattactctggacctcctgtccggtcggttgtactgggtcgactccaagctacattccatctcatccatcgacgtgaatggaggcaatcgtaaaacaattttggaagacgagaaacggttggcacatcctttctcgctcgcggtttttgaggacaaagtgttctggacagacatcatcaacgaggcaatctttagcgccaatagacttaccggcagcgacgttaatcttttggccgagaatctactgtctccagaggatatggtgctatttcataatcttacccagccacgcggggtcaattggtgtgaaaggacaaccctgtccaatgggggatgtcagtacttgtgcctgccagcacctcaaatcaatcctcacagtcccaaattcacttgtgcttgtccagacgggatgctcctcgcaagggacatgcgcagctgcctgacagaagcagaagccgcagtcgccacccaggagacctccactgtgagacttaaagtaagtagcaccgccgtgcgcacccagcatacgaccacgcggcccgtccccgacaccagtaggctccccggcgctacgcctggactgaccaccgttgagatagtgaccatgtctcatcaggccttgggggacgttgccggaaggggtaatgagaagaagccttcatcagtccgcgccctgagcattgtgttaccaattgttctgctggtcttcttatgtctcggagtgttcctcctgtggaagaactggcggctgaaaaacataaattccattaacttcgataacccggtctaccagaagacaactgaggatgaggtgcatatctgccacaaccaagacggctacagttaccccagccgccagatggtgtctttggaagacgacgttgct

SEQ ID NO: 15904 - DNA, 2580 bp, Artificial Sequence; identical to SEQ ID NO: 15902
  Description of Artificial Sequence: Synthetic coding sequence

SEQ ID NO: 15905 - DNA, 2580 bp, Artificial Sequence
  Description of Artificial Sequence: Synthetic coding sequence
atgggcccctggggatggaagctgcggtggaccgtcgcgttactgcttgctgcagccgggactgcagtgggcgaccgatgtgaaagaaatgagttccagtgtcaggatggaaaatgcatcagctataagtgggtctgtgatggatccgctgaatgccaggacgggtccgatgagtcccaagaaacttgcctctcagtcacctgcaagagtggtgacttttcatgtgggggcagggtcaacagatgtatcccacagttctggaggtgcgacggccaggtggactgcgataatggcagtgacgagcagggatgcccccccaaaacttgctctcaagacgaatttaggtgccacgacgggaaatgcataagccggcagttcgtgtgtgatagcgaccgagactgtcttgacggatccgacgaggcatcttgccccgtcttgacatgtggacccgcctctttccagtgtaactcctccacatgtataccccaactgtgggcctgtgacaatgacccagattgcgaagacggttctgatgaatggccgcagcggtgcaggggactatacgtctttcagggagacagctctccatgcagcgcttttgaattccactgccttagtggcgagtgcattcattccagttggcgatgtgatgggggccctgattgcaaagacaaatcagacgaggagaactgcgccgtagcaacatgcaggcccgatgaattccagtgctccgatgggaactgcattcatggaagccgacagtgtgatcgtgaatacgattgtaaggatatgtctgacgaggtgggttgcgtgaacgtgactctatgcgagggccctaataagtttaagtgccattccggagaatgtattactttagacaaggtttgtaatatggcgcgcgattgcagggactggtcggacgagccaatcaaagaatgtggcactaatgaatgcctcgataataatgggggatgctcccatgtgtgtaacgacctgaaaatcggatatgaatgtctgtgccccgatggattccagctggtcgcccaaaggagatgcgaggacattgacgaatgtcaagaccctgacacctgttcccagctctgtgtcaatcttgagggcggctacaagtgccagtgcgaggaaggcttccagcttgaccctcatacaaaagcatgcaaagctgttggaagtatagcatacctgttttttacaaatcgacacgaggtaaggaagatgaccctcgaccgatccgagtatacctctctgattccaaacctgaggaacgtcgtagccttggataccgaagttgcgagtaataggatctattggagcgacctctcacagaggatgatttgctcaactcagcttgacagggctcacggcgtcagcagttatgacacagtgataagcagggatatccaggcaccggacggtttggccgtggactggattcatagcaatatttattggacagactctgtgctgggaacagtttctgtggccgatacaaagggcgtgaagcgcaaaacccttttccgagagaacggctcaaagccaagagccattgtggtggaccctgttcacgggtttatgtactggacggactgggggacccccgctaagattaagaagggaggcctcaacggggtggatatctattctctggtgacagaaaacatacagtggcccaacggaatcaccctggacttgctcagtgggaggctgtattgggttgattccaaactccatagcattagttctatcgacgtcaacggagggaatcgaaaaacaatcttggaagacgaaaagagactagctcatcccttttccctggccgtcttcgaggataaggtgttctggactgacattatcaatgaggccatattttccgcgaatcgattgaccggtagtgatgtcaacctcctcgccgaaaacctcctatctccagaagacatggttctatttcataatttgacgcagccccggggggttaattggtgcgagcggactaccctgtccaacggtggatgtcagtatctgtgcttacccgctccccagatcaatccacacagcccaaagttcacctgcgcgtgtccagatggtatgctactggccagggacatgagatcttgccttactgaggccgaagctgcggtggctacgcaggaaacatccaccgtgaggctgaaggtctcgtcaacagccgtgcgaacacaacataccacgaccaggcctgtgcccgacacatcaagactgccaggtgcaacccccggactgacaaccgtggaaattgtaaccatgagtcatcaggccctcggcgacgtggccggacgaggaaacgaaaagaagccctcctctgttcgggccctttctatagtgctgcccattgtcctgctggtgtttctctgcttaggagtatttctcctctggaagaattggagacttaaaaatataaactcaatcaatttcgataaccccgtttatcagaagacgaccgaagatgaggtgcatatttgccacaatcaggacggctattcgtacccctcaaggcagatggtctccctggaggacgatgtcgcc

SEQ ID NO: 15906 - DNA, 2580 bp, Artificial Sequence
  Description of Artificial Sequence: Synthetic coding sequence
atggggccttggggttggaagctgcggtggacagttgcactgctgctggccgctgctggaacggctgtgggagacagatgtgagcgtaatgagttccagtgccaggatggaaagtgcatcagctacaagtgggtgtgcgacggctctgcagaatgccaagatggaagcgatgagtcacaggaaacttgcctctccgtaacatgcaagtcaggtgatttttcctgtggcggccgagtcaatcggtgtatcccccagttctggcgatgcgacggccaagtggattgtgacaatggctctgatgagcaaggctgccccccaaaaacctgcagtcaggatgagtttcgatgccatgacgggaagtgcattagtagacagttcgtgtgcgactccgatcgggattgtcttgatggcagcgatgaagcctcctgcccggtcttaacctgtggccctgcctcattccagtgtaactccagcacgtgcattccccagctgtgggcatgtgataacgacccagattgcgaagacggatctgatgagtggccccagcggtgtcgggggctctacgtgtttcaaggggattcatcaccatgcagcgccttcgagttccattgcctgagtggtgaatgtatccactcctcgtggcgctgtgatggtggtcctgattgtaaggacaagagcgatgaggaaaactgcgccgtggctacctgtaggcccgatgagttccagtgcagtgatggcaattgcatccacggcagcagacagtgcgaccgggagtatgactgcaaagatatgtctgatgaggtgggatgtgttaacgtcaccctctgcgagggtcccaacaaattcaaatgtcacagtggcgagtgcatcaccctggataaggtgtgcaacatggcccgtgactgccgcgattggagcgacgagccaattaaggaatgtggaacaaatgagtgtctggacaataacgggggatgctctcacgtgtgcaacgacttgaagattggttatgaatgtttgtgtccggatgggttccaacttgtagcccaaagaaggtgtgaagacatcgatgaatgccaagatccggatacgtgttcccagctgtgtgttaatcttgagggaggttataagtgccagtgcgaggaagggttccagctcgacccacacaccaaagcatgcaaagccgtcggcagtatcgcatacctgtttttcactaaccgccacgaggtgcggaaaatgacccttgacaggagcgagtacacctccctgattccaaacctcagaaatgtagtcgctctggacactgaggtcgcatccaatcgcatctactggtcagacctcagccagagaatgatatgtagcactcagctggaccgagcacacggagtctcctcttacgacaccgtgatcagtagagatattcaggcacctgacggtctggccgtggattggatccattcaaatatttactggaccgactccgtgctcggtacagtgtcggtcgcggacaccaagggagttaagcgtaaaacgctttttcgggagaacgggtccaaaccccgcgcaattgtcgtggacccggttcacggattcatgtattggaccgattggggcactcctgcaaaaattaaaaaagggggtctgaacggagtcgacatatattcacttgtgaccgagaacattcaatggccaaatggtattactctcgatctgcttagcggccgcctctattgggtggactcaaagctgcattctatcagtagcatcgatgttaatggcggaaatcgcaagacaatactggaggatgagaaaaggctggcacatccattttctctcgctgtttttgaggacaaagtgttctggaccgatatcatcaatgaggccatcttctccgccaaccgcttaaccgggtccgacgtaaacttgctggcggaaaatctgctgtcaccagaagacatggtacttttccacaatctgacgcagccccgcggtgttaattggtgtgagcgtaccaccctgagtaatggaggctgccagtatctatgcctcccagcgccccagattaatccacactctccaaaattcacatgtgcttgtcccgacgggatgctcctggccagagacatgcggagctgtctcaccgaggcagaagccgccgtcgctactcaggaaacgagcacagttaggcttaaggtctcctccacagccgtgaggacccagcacacgacaactcgccctgtgcccgatacatcgcgcttacctggcgcaacccccggcctcaccacggtggaaatcgtcacaatgagccaccaggcactgggtgacgtagcaggtcgaggaaacgagaagaagcctagcagcgtgagggcactgtcgattgtcctccctattgtcctgctcgtcttcttgtgtctgggagttttcctgctctggaagaactggaggctgaagaacattaatagtataaacttcgacaaccctgtttatcagaagaccacagaggatgaggtgcacatctgccacaaccaagacgggtattcttacccgtcacgccaaatggtctcactcgaagatgatgttgct

SEQ ID NO: 15907 - DNA, 2580 bp, Artificial Sequence
  Description of Artificial Sequence: Synthetic coding sequence
atgggtccctggggttggaagttgcggtggactgtcgcactgctcctcgccgcggcagggaccgccgtgggagatagatgtgagagaaacgaatttcagtgtcaagatgggaagtgtatctcatacaaatgggtctgcgatggatcggcagagtgccaggatggttcagatgaatcccaagaaacctgtctgagcgtcacttgtaagtcgggagacttttcgtgtgggggaagggtgaataggtgcattccccaattctggcgttgtgatgggcaggtcgactgcgacaacgggtcggatgaacaaggttgcccacctaagacgtgttcgcaagatgagttcagatgccacgacggaaaatgtattagccgtcagtttgtttgtgattcggacagagactgtctggatggatctgacgaggcctcctgtcctgtgcttacttgtggacctgctagcttccaatgtaatagcagcacttgtattccgcagctttgggcatgcgacaacgaccctgactgtgaggatggttccgacgagtggccacagcggtgtagaggactctatgtgtttcaaggcgactcgtcgccttgctcggcatttgagtttcactgtttgtccggggaatgtatccactcctcgtggagatgcgatggaggtccggattgtaaggataagagcgatgaggaaaactgtgctgtcgcaacttgtcgacctgatgagtttcaatgttccgatggaaactgtatacacggctcaagacagtgcgaccgagaatatgattgtaaggacatgtcagacgaagtcggatgcgtcaacgtgaccctttgcgaaggaccaaacaaattcaaatgccattcaggagaatgtatcaccctggacaaggtctgtaacatggcgcgggattgtagagactggtcagatgagcccattaaggagtgtggcacgaacgaatgtttggacaataatggtgggtgcagccatgtgtgtaatgatctgaaaattgggtacgaatgcctttgtccagatggattccaactggtggcgcaaagacgttgtgaagatatcgacgaatgccaagatccggacacttgttcacagctgtgtgtgaatttggaaggcggctacaagtgtcagtgcgaggagggatttcaacttgatccccatacgaaggcatgcaaggcagtgggttccatagcatacctgttctttacgaacaggcatgaagttaggaagatgaccctggacaggtcagagtacacctctctcatcccaaaccttcgaaatgtggtggcacttgacaccgaagtggcctcgaatcgaatttactggtcggacctttcgcaaagaatgatctgtagcactcagctcgatagagcacacggagtctcgtcgtacgatactgttatctcgcgtgatattcaagcaccagatggtctggcagtggactggatacatagcaacatttactggaccgattcggtgctgggaaccgtctcagtggccgatactaagggtgtcaagagaaagaccctgttccgggaaaatggttcgaaaccgcgcgcaattgtggtggatcccgtgcatggctttatgtactggactgactggggtactccagccaagatcaaaaagggtggtctgaatggcgtggacatatactccctggtgacggagaatatacaatggcctaacgggatcaccttggacttgctttcgggtcggttgtactgggtggattctaagttgcactccatttcatctatcgatgttaacggaggaaaccggaaaacgattcttgaagatgaaaagcgactcgcgcatcctttttccctcgcggtgtttgaagataaggtgttttggaccgacattatcaacgaagctatcttttcggcgaacaggcttaccggctcagacgtgaaccttctggccgagaatcttctctcccccgaggacatggtcctgtttcacaacctgacccagccgcggggagtcaattggtgtgaaaggaccaccctttccaacggtggttgccaatacctttgcctgcctgcacctcagattaacccccatagccccaagttcacgtgcgcctgccctgacggaatgctcttggcaagagacatgcggtcctgtctcactgaagcagaggctgcagttgcgactcaggaaacctcaaccgtgagactgaaagtgagctccactgccgtccggacccaacataccaccacgcgcccagtgcctgatacctctcgcctgcctggtgccactcctggccttactacggtcgaaattgttactatgtcccatcaggccctcggggatgtggcaggtcgtggcaacgaaaagaagccatcctccgtgcgagcattgtccatagtgctgcctattgtgctgcttgtttttctctgccttggagtgttcctcttgtggaaaaactggcggctgaaaaacattaactctatcaacttcgataatcccgtgtaccaaaagaccactgaagatgaagtccatatatgccataatcaagatgggtactcgtacccaagcagacaaatggtgagccttgaggatgacgtcgca

SEQ ID NO: 15908 - DNA, 2580 bp, Artificial Sequence
  Description of Artificial Sequence: Synthetic coding sequence
atgggcccctgggggtggaagctccgatggaccgtggccctactgctggcggccgcaggaacggcagtgggtgatcggtgtgagcggaacgaattccagtgtcaggacggcaaatgcatctcgtataaatgggtttgcgacggcagtgcagaatgccaggacggctcagacgagtctcaggagacctgtctttcagtgacttgcaaaagcggggactttagttgcggcggacgtgtcaacaggtgcattccacagttttggcgctgcgatggtcaggttgactgcgacaacgggtctgacgaacaggggtgcccccctaagacgtgttcgcaggacgagttccggtgtcacgacggaaagtgtatctcccggcagtttgtgtgtgactctgatcgggactgtctagacgggtccgacgaagcatcctgtccagtgcttacttgcggtccagcctcatttcaatgcaactcctctacctgtataccccagttatgggcttgcgacaacgatcctgactgcgaggacggctccgacgagtggccacagcgctgcagggggctttacgtattccagggagattcaagtccatgttccgcgttcgaatttcattgtcttagcggggaatgcattcactcctcatggagatgtgacggcggccccgattgcaaggataagtctgacgaagagaattgcgccgtggcaacatgcaggcctgatgaattccagtgctccgatggaaattgcatacatggcagccggcagtgtgatcgggagtatgactgcaaagacatgtctgacgaagttggatgcgtgaatgtgacgctatgtgagggcccgaacaagttcaaatgtcacagcggagagtgtataaccctcgacaaagtttgtaatatggccagggactgccgtgattggtctgatgagccaatcaaggagtgtgggacgaacgagtgcctggacaataacggtggttgttcacacgtgtgtaacgatctcaaaatcggttacgagtgtctgtgtccagacggcttccagctagtggctcagcggcgttgcgaagacatcgacgaatgtcaagatccggacacgtgttctcaactatgtgtgaatctcgagggagggtataagtgtcagtgcgaagagggttttcagcttgacccgcatacaaaggcctgcaaagctgtaggatctatagcttaccttttcttcactaatcgccatgaggtgcgcaaaatgacccttgacaggagtgagtacacatccctcattcccaacctgagaaacgttgtggcactggacacagaggtggcaagcaacagaatatactggtctgacctctctcagcgcatgatctgcagcacgcaacttgatagagctcacggagtgtcatcttatgacacagtgataagccgggacatccaggccccagacgggttagccgtggattggatccactctaatatctactggacggactctgttcttggcacagtcagcgtcgctgatactaaaggtgttaagagaaaaaccttgtttcgggaaaacgggtcgaaacctcgcgccatcgtggtcgatccagtgcacggttttatgtactggactgattggggaaccccagccaaaattaaaaaagggggcctcaatggggtcgacatctacagtttggtcaccgagaacatccagtggcctaacggtattacgcttgacctccttagcggcagattgtactgggtagattccaagttacatagcatcagcagtatcgacgtaaatggtggaaatcgtaaaacgattctggaggacgaaaaaagactggctcatcccttttctctagctgtctttgaggacaaggttttctggaccgatatcattaacgaggccatcttttcagccaacagactcacgggttccgacgtcaacttactagcagagaacctgttgagcccagaggacatggtgctgtttcacaatcttacacagcctagaggggttaattggtgcgagaggaccaccctgtccaatgggggctgtcagtatctctgcctgccagccccccagatcaacccccactcccctaagttcacatgcgcatgtcctgatggtatgctgctggcccgtgatatgcgctcgtgcctgacagaggccgaagctgccgttgccacgcaggagacatctaccgttaggctcaaggtctctagcaccgccgtgcgaacccagcatactactacacgacctgtgccagatacatcacgacttcctggggcgacccctggcctgaccacggtcgagattgtcaccatgagtcaccaagccctgggagatgtagctgggcgcggtaacgaaaagaagccttccagtgttcgcgccttgtcaatcgtgttgcctatagtcctcctcgttttcctgtgcttgggcgttttcctgctgtggaaaaattggcgactcaaaaatattaactctatcaatttcgacaaccctgtgtaccagaaaacaactgaagatgaagtgcacatctgccacaatcaggacgggtacagctaccctagccgacaaatggtaagcttggaggacgacgtggct

SEQ ID NO: 15909 - DNA, 2580 bp, Artificial Sequence
  Description of Artificial Sequence: Synthetic coding sequence
atgggaccgtggggatggaagctcagatggaccgtcgcgctgctccttgccgcagcgggaaccgccgtgggcgaccggtgcgagcgtaatgagttccagtgtcaagacggtaagtgtatcagttacaaatgggtgtgcgacgggtcggctgagtgccaggatgggtcagacgagtcccaggagacgtgcctgtccgtgacctgcaaaagcggagatttttcgtgcggtgggagagtgaacaggtgcataccgcaattctggcggtgcgacggacaagttgattgcgacaacggctcagatgaacagggatgtccgcctaagacgtgctcacaagacgagttccggtgtcatgacggaaagtgcatctcgaggcaattcgtgtgtgactcagatagggactgcctcgacggctcggatgaagcgtcgtgcccagtgctgacttgtggcccggcctcgtttcagtgcaactcgtctacttgcataccccagctttgggcatgcgacaacgacccggattgcgaggatggatcggatgagtggcctcagagatgccggggactttacgtgttccagggcgactcatccccatgctcggccttcgagttccattgtctgtctggagaatgcatccactcttcgtggcgatgcgatgggggaccggattgtaaggacaaaagcgacgaggagaattgcgcggtcgcgacttgccggccggacgagttccaatgctcggacggaaattgcatccatggctcccgccagtgtgaccgcgagtacgattgcaaggacatgagcgatgaagtgggatgcgtgaacgtcaccctgtgcgaaggcccgaacaaattcaaatgccactccggagaatgtatcaccctggataaagtgtgcaacatggcgcgcgactgcagagattggtctgatgaaccaatcaaggaatgcggcaccaatgagtgcctggataataacggtggatgctcccatgtgtgtaatgacctgaagatcgggtatgaatgtctctgtcctgatggctttcaactggtggcccaacggaggtgtgaagatatcgacgaatgccaggacccagatacttgcagccagttgtgtgtcaatctggaaggaggatacaagtgccagtgcgaagaaggattccaactggacccacacacgaaggcatgtaaggccgtcgggtcgatcgcctacctgttttttaccaaccgacatgaagtgcggaagatgacccttgaccggagcgaatacacctcgctgatccccaatcttcggaatgtggtggccttggatacggaagttgcctcaaaccggatctactggtcagacctctcacagcggatgatctgcagcacccagctcgaccgcgcgcacggcgtctccagctacgatactgtgatctcgcgcgacatacaggctccggacggactggccgtcgattggattcattcgaatatctactggactgactcagtgctgggaacggtttccgtggccgatacgaagggtgtcaagagaaaaaccctctttcgggagaatggctcgaaaccgcgggccattgtcgtggatccggtgcatggtttcatgtactggacggactggggcacccctgcaaagatcaaaaaaggcggactcaatggagtggatatctactcgttggtgacggaaaacatccagtggccgaacggaatcaccctggacctgctttccgggaggctgtactgggtcgatagcaaactgcattcaatctcatcgattgacgtgaacggagggaaccggaagactatcctcgaagatgaaaagcgcctggcccacccgttctcgctcgccgtgtttgaggacaaagtgttctggaccgacatcattaacgaggcaatcttctcagctaatcggctgactggatcggacgtgaatctcttggcagagaacctgttgtccccagaggacatggtgctgttccacaatctcacgcaaccgcgcggcgtgaactggtgcgaacggaccactctgtcaaatggaggctgtcaatatctttgcctgcctgccccgcagattaacccacattccccgaagttcacttgcgcatgtccggacggtatgctcctggcccgggacatgaggtcctgcctgacggaggctgaggccgccgtcgcgacccaagaaacctcaaccgtgcgcctgaaggtgagcagcaccgcggtccgcactcagcacacgactaccagacccgttcctgatacttcccgcctcccaggagctactccgggcctcaccaccgtcgaaatcgtcaccatgtcccaccaggctctgggagacgtcgcaggacgaggaaatgaaaagaagccatcgtccgtgagggcacttagcatcgtcctgcccatcgtcctgctggtgtttctgtgcctcggagtgtttctgctctggaagaactggcgcctgaagaacatcaatagtataaactttgacaacccggtctaccagaagaccactgaagacgaagtgcacatctgccacaatcaggacggatacagctacccatcgcggcagatggtgtccctcgaggacgacgtggcc

SEQ ID NO: 15910 - DNA, 2580 bp, Artificial Sequence
  Description of Artificial Sequence: Synthetic coding sequence
atgggaccttggggatggaagctgcgctggactgtggccctcctgcttgcagcggccggcaccgccgtaggggatagatgcgagcgcaacgaattccagtgtcaggacggcaagtgtatttcgtacaagtgggtgtgcgatggaagtgccgaatgtcaggatggatccgacgaatcacaagaaacttgtctgagcgtgacttgtaagagcggcgacttctcgtgtggcggacgagtgaaccgatgcatccctcaattttggagatgtgacggccaagtggactgcgataacggaagcgacgagcaaggttgtccgcctaaaacctgtagtcaagatgagtttcgttgccatgacggcaagtgcattagcaggcaatttgtgtgtgactcggatcgagactgtctcgatggttcggatgaggctagctgcccagtgcttacctgcggaccggccagctttcagtgtaactcctccacttgtattccccaactttgggcatgtgataacgatcccgattgcgaggacgggtcggacgagtggccacagcgatgcagaggactttacgtctttcagggagactcatcgccctgtagcgcatttgaatttcattgtttgagcggtgaatgtatccactcctcctggcgctgcgacggcggtccggactgtaaagataagtcggatgaagagaactgtgccgtcgcaacttgtcgccccgacgaattccaatgctccgacggtaattgtattcatggctcgcgacaatgcgatcgggagtatgattgtaaggatatgtccgacgaagttggatgtgtgaacgtgactctgtgcgagggacctaataagtttaagtgtcactcaggagaatgtataaccttggataaggtttgtaacatggcacgtgactgcagagattggtcggacgaacccataaaggaatgtgggactaacgaatgcctggacaacaacggaggctgctcccatgtgtgtaatgacctgaagatagggtacgagtgcttgtgtccggatggttttcagcttgtggcacagcgccgttgtgaagatattgatgaatgtcaagatccagacacttgttcgcaactctgtgttaaccttgaaggtggctacaagtgccagtgcgaagaaggcttccagctggatcctcataccaaggcgtgcaaggctgtgggcagcattgcatatctgttctttactaatcggcatgaagtccgcaaaatgactctggatcgatcggaatacacctccctgatacctaacttgcgcaatgtcgtggccctggataccgaggtggcgtcgaaccgcatttactggtcggacctgtcccaacgcatgatctgctcgacccagttggaccgagcgcatggtgtctcctcatacgacacggtcatctcgcgtgacatccaagcccccgatgggctcgcagtggattggattcacagcaacatatactggaccgattcagtccttggaaccgtgtccgtggccgacactaagggggtgaagcgtaaaaccttgtttagggagaacggttcgaaacccagagcaatagtcgttgacccagtccacggttttatgtactggaccgactggggtactccagcgaagatcaaaaagggaggactgaacggagtggacatttactcacttgtgaccgaaaacatccaatggccaaacggaattaccctggacctccttagcggacgtctctactgggtggattccaagctgcatagcatttcaagcatcgatgtgaacggcggtaaccgcaagactattctggaagatgaaaagcgtttggcacacccgttttcccttgccgtgtttgaagataaagtgttttggaccgatatcattaacgaagcaatcttttccgccaaccgactgactggaagcgacgtgaacctcctggcggaaaacctcctgtctccagaagatatggtcctttttcataacttgacgcaacctagaggtgtgaactggtgtgaaaggaccaccctgtctaacggtggatgtcagtacctgtgtctccccgcaccacagattaatccacattcccctaagtttacctgcgcatgtcctgatggaatgctgcttgctcgcgatatgaggagctgtcttaccgaggctgaggcagcagtggcgactcaggaaacctcaaccgtgcgactcaaggtcagcagcactgcagtccggactcaacataccaccacgcggccagtgccagacacttcgagacttccgggagcaactccaggacttaccactgtggagatcgtgaccatgtcacaccaggcactcggtgatgtggcaggacgcggaaatgagaagaagcccagctcagttagggcactttcaatcgtgctgcctattgtgctcctcgtgttcctttgtcttggagtgttccttctctggaagaattggagactcaagaacattaactccatcaactttgataaccccgtctaccaaaagaccaccgaagatgaagtgcacatctgtcataaccaagatggctactcctaccctagcagacagatggtgagcctcgaagatgacgtggcc

SEQ ID NO: 15911 - DNA, 2580 bp, Artificial Sequence
  Description of Artificial Sequence: Synthetic coding sequence
atgggaccatgggggtggaagctgaggtggaccgtggctctgctgcttgccgctgccggaacagctgtgggagatagatgcgagagaaatgagtttcagtgccaggacgggaagtgtatttcgtacaaatgggtgtgcgatggcagtgccgagtgtcaggatggttccgatgagagccaggagacctgcctttcggttacctgtaaatctggtgatttcagctgcggaggcagggtaaatcgctgcatcccccagttttggcggtgcgacggtcaggttgattgcgacaacgggagtgacgagcaggggtgtccccccaaaacttgctcgcaggacgaatttagatgccacgacggaaagtgcattagtaggcagttcgtgtgtgatagcgatagagactgtctggatggaagcgacgaggcttcatgtcccgtcctgacatgcggccccgcatctttccagtgcaatagtagcacttgtatccctcagctgtgggcctgtgacaatgacccagattgcgaggacggctctgatgagtggccacaacggtgtcgaggattgtatgttttccagggcgattccagcccctgcagtgccttcgaatttcattgtctgtccggggagtgcatccattcttcatggagatgtgacgggggtcctgactgcaaggacaaatctgatgaggaaaattgcgcagttgcaacctgccgtcctgacgaattccagtgcagtgatggtaactgcatacacggctcgcgccagtgcgatagagaatacgattgcaaggacatgtctgatgaggttggatgtgtgaacgttaccctgtgtgagggccccaacaagtttaaatgccatagtggcgaatgcatcaccctggacaaggtctgtaatatggcccgtgactgccgggactggagcgacgaacctattaaagagtgtgggactaacgaatgtcttgataataacgggggatgctcacatgtgtgcaatgatctgaagattggctatgagtgtctttgtcccgatggctttcagctagtcgcacagaggcgatgtgaggacatcgatgaatgtcaggaccccgacacgtgttcacagctgtgcgtcaatctggagggcgggtataaatgccagtgtgaggaaggatttcagctggatccccacacaaaagcatgtaaagcagtgggcagcatagcctacctgttttttacaaatagacacgaggtccggaagatgactctggataggtctgaatataccagtctaattccaaatctcagaaacgtcgtcgccttggacacggaagtggcatccaacaggatatattggagcgacttatcacagagaatgatctgctctactcagctcgatcgggcccacggagtctccagttacgacacggtcatctccagagacattcaagccccagatggccttgctgtcgactggatacactcgaacatttactggaccgactctgtgttagggaccgtcagcgtcgctgacacgaagggggtaaagcgaaagactctgttccgcgagaatggaagcaagccccgggctatcgtggtggaccctgtccatgggtttatgtattggacagattggggaaccccagctaagataaaaaagggagggctgaatggcgttgatatttatagcctggtcactgagaacatccagtggcctaacggaatcacccttgacctgctgagcggaaggctgtattgggttgacagcaagcttcactctatcagcagcattgacgtgaacggcggtaatcgaaaaacaatcctggaggacgagaagcggctggcccaccccttcagtctggcagtgttcgaggataaggtgttctggacagacatcatcaacgaagcaatattcagcgctaatcggttgaccgggagcgacgtgaatctgctggccgagaatctactgagtcccgaggatatggtgctgttccataacctcacccagcctcgaggagtaaactggtgcgaaagaacgacgttgagtaatggcggatgccagtacctttgcctccccgccccacagattaatccccacagtccaaagtttacgtgtgcttgcccagacggcatgctcctcgctcgggatatgaggagctgtctcacggaggccgaagcagctgtggccacacaagagacctccacagtgcgcctgaaggtgtcctccactgcggtcaggacacagcacactactacccgcccagtgccagatacttcgcgacttcccggtgctaccccgggactgactaccgttgaaatcgttaccatgagtcaccaggcacttggagatgtagccggccgcggaaacgagaagaagcccagtagtgtccgagctttatccattgttcttccaattgtgttactcgtatttctgtgtctgggcgtattcctgctgtggaagaactggcgcctgaaaaatattaatagcatcaattttgataatcccgtgtaccagaaaactacagaggacgaggtacacatctgccacaatcaagacggatactcctatccatctaggcaaatggtgagtcttgaggatgatgtggcc

SEQ ID NO: 15912 - DNA, 2580 bp, Artificial Sequence
  Description of Artificial Sequence: Synthetic coding sequence
atggggccttgggggtggaagttgcgttggactgtggccctactcctggcggccgcaggcactgctgtgggggataggtgcgagcgcaacgaatttcagtgccaggatggaaaatgtatttcttacaagtgggtctgtgacgggagtgccgaatgtcaggatggctccgacgagtcccaagagacgtgtctaagcgtgacctgcaagagcggcgattttagctgtgggggaagagtaaatcgctgcataccacaattctggagatgcgatggccaggtggactgtgacaacggcagcgatgaacaagggtgcccccccaagacatgcagccaggacgagttccgatgtcacgacgggaagtgcatttcccgacaattcgtatgcgatagtgaccgggactgcctggatggaagtgacgaggcttcatgccctgtccttacctgcggacctgctagcttccagtgcaatagtagtacctgcatcccacagctgtgggcgtgcgacaacgaccctgactgtgaggacggctccgacgaatggccacagcggtgtcgaggcctgtacgtctttcagggggatagttctccctgttctgcgtttgaatttcattgcctaagcggagagtgtatacacagttcttggcgctgcgatggcggccctgactgtaaggacaaaagcgacgaggagaactgtgccgtggctacctgtcgccccgatgaatttcagtgttctgatgggaactgtatccatggcagtcgccaatgtgatcgagagtatgactgtaaggacatgagcgacgaagtcgggtgcgtgaatgtgactctctgcgagggccctaataagttcaagtgccactctggcgaatgtataacactagataaggtttgtaacatggccagagactgtagagattggtcagatgagcctatcaaagagtgcggcacaaatgagtgtctggacaataatggaggttgtagtcatgtatgtaacgacttgaagatcgggtatgaatgcctgtgccctgatggcttccagctggtcgctcaaaggcggtgtgaagacattgatgagtgtcaggacccggacacttgtagtcagctctgcgtaaaccttgagggtggctacaaatgccagtgtgaggaggggttccagttagacccacacacaaaagcttgtaaggccgttggcagcatcgcttatttgtttttcacaaatcgacacgaagtccgaaagatgactcttgaccggagtgaatatacttcacttatcccgaatctcaggaacgtagtggcactggatactgaggtggccagcaatcgtatctactggagtgatctctcccaacgtatgatttgttccactcagctagatcgcgctcatggcgtgtcttcatatgacactgtgatttcaagggacatccaggctccagatggcctggcagttgattggatccactctaatatatattggacagattcagtactgggcacagtgtcagttgccgacacaaagggggtgaagcgcaagactctgtttcgtgagaatggatctaagcctagggctattgttgttgacccagttcacggcttcatgtactggaccgactggggcacacctgccaaaattaagaagggcggtttaaatggagtggacatctatagcctggtcacggagaacattcagtggcccaacggaataaccctcgatctgctgtctggacgactttattgggtggacagcaaactgcacagcatctcatccatcgatgtgaacggaggaaacaggaaaactattcttgaggatgagaaacgtctggcacacccattctcactggctgtgtttgaggataaggtgttctggactgacataataaatgaagctatattttccgcaaatagactaaccggctctgacgtcaatctactggcggaaaatctgttgagtcccgaggatatggttctgttccacaatctgacgcagccgaggggggtaaattggtgtgaacgcacaactctctccaatggaggatgtcagtacctctgtctgcccgcccctcagatcaatccccatagccctaagtttacatgcgcatgtcccgatgggatgttgctggcccgggatatgagaagctgcctgactgaggctgaggccgccgtcgccactcaggagacctccaccgtgaggctaaaagtcagtagcacggccgtgaggacacagcacaccacaacacgccctgttcctgatacctctcgcttacctggagcgacaccaggcctgactaccgtagagattgtgacgatgtctcaccaggccctaggtgacgtggcgggcagaggtaacgaaaagaagccctcctccgtcagagccctatccattgtattgcctatcgtcctgttagtgtttctgtgcctcggagtgttcctgctgtggaaaaattggagactgaagaacatcaatagcattaatttcgataatcctgtttatcagaaaaccacggaggatgaggtgcacatttgtcacaaccaggacggttattcatatccatcccggcaaatggtcagtttggaggatgacgtcgcc

SEQ ID NO: 15913 - DNA, 2580 bp, Artificial Sequence
  Description of Artificial Sequence: Synthetic coding sequence
atgggtccctggggctggaagctgcgatggaccgtagcactgttgttagccgccgctggcactgctgtcggtgaccgctgtgagagaaatgagttccaatgtcaggacggcaagtgtatctcctacaaatgggtgtgcgacgggagcgcggaatgccaggacggctccgatgagtcccaggagacctgtctttcagtcacctgcaagtccggcgacttttcatgtggtggccgggtgaaccgatgtatccctcagttctggcgatgcgacggccaggtggattgcgataatggctccgatgaacagggctgtcccccaaagacgtgctcgcaggacgaatttcgatgtcatgacggcaagtgcatcagccgccagtttgtgtgcgactccgatagagattgtctcgacggatctgacgaggcatcttgccccgttctgacctgcggtcccgcctcatttcagtgtaatagctcgacttgtattccccagctttgggcctgtgataatgacccggactgtgaagatgggagcgacgaatggccgcaacggtgccgcggcttgtatgtctttcagggcgatagctccccctgcagcgctttcgagtttcattgtctgagcggagagtgcatccattctagttggaggtgtgatgggggacctgattgcaaggataagtccgacgaagagaactgtgccgtggccacatgtagaccagacgaatttcagtgttctgacggaaattgtatacacggatcccggcaatgtgatcgcgagtatgattgcaaggatatgtcagatgaagttggatgcgtgaacgttaccctttgcgaaggaccaaacaagttcaagtgtcattctggcgagtgtattacactggataaggtatgtaacatggctagagactgtcgtgactggtccgacgagccaataaaagaatgtgggacaaatgaatgtctcgataataacggcggctgctcccacgtgtgtaacgaccttaagataggctacgagtgcctgtgccctgatggcttccagctggtcgcacagagacgctgcgaggatatagacgagtgtcaggacccagacacatgttcccaactgtgtgtgaacctggaaggaggatacaagtgccagtgcgaggaaggatttcaactggatccgcacaccaaagcctgtaaggccgttggaagcatcgcatatctgttttttactaatcggcacgaggtaagaaaaatgaccctggataggtcagaatacacgtcattgatacctaatctgaggaatgtggttgcactcgataccgaagtggcttctaaccgcatctactggagcgacctctctcagcgaatgatttgttccacccagttggatagagcccacggggtgagcagttacgataccgtgatcagtcgggacatacaagcccctgatggcctagcagtcgattggatacattccaatatatattggacagatagcgtgcttggcactgtgtctgttgctgatacaaagggcgtgaagcggaagacactattcagagagaacgggtctaaaccaagagctattgtggtggaccctgttcacggattcatgtattggaccgactggggaaccccagccaagatcaaaaaaggagggcttaatggagtagacatttatagccttgtgactgaaaacattcagtggccaaatgggatcactttagacttactctccggtcgcctgtattgggtggactctaaactacatagcatcagctcaatcgatgtgaatggcggaaacagaaagaccatcctggaagacgaaaagaggctggcacatcctttcagcctggccgtttttgaggataaagttttttggaccgacattatcaacgaagcaatctttagtgccaatcggctcactggctctgacgtaaacctcttggctgagaacctcctctcgccagaagatatggtccttttccataatctgactcagccaagaggggtgaactggtgtgaacgcactactttgtcgaacgggggctgtcagtatctgtgtttgccagctccacagattaatcctcattccccgaaatttacctgcgcatgcccggacggcatgttactggcccgagatatgaggtcatgtcttaccgaggctgaggccgccgtggctacacaggaaacctcaacagttcgactgaaagtgtccagtaccgccgtaaggacacaacacactacaacgcggccggtgccggatacctcaagactgcccggcgccacccctggcctcaccacagtcgagattgtgactatgtcccaccaagccttgggcgacgtcgcaggacgcgggaacgagaaaaagcctagctcggttagggccctcagcatcgtgcttccaatagtcttgcttgtgttcttgtgtctgggtgttttcctgctgtggaaaaattggaggcttaagaatatcaactccatcaattttgataaccccgtctaccaaaagactaccgaagatgaagtgcacatctgccacaaccaagatggctactcttatccatcgcgccagatggtgtcacttgaggatgacgttgct

SEQ ID NO: 15914 - DNA, 2580 bp, Artificial Sequence
  Description of Artificial Sequence: Synthetic coding sequence
atgggaccatggggatggaaattaagatggacagtagcattattattagctgctgcaggaactgcagtgggagacagatgtgaacgtaatgaatttcaatgtcaagatggtaaatgtattagttataaatgggtttgtgatggaagtgcagaatgtcaagatggaagtgatgaatcccaagagacttgtttatctgttacttgcaaaagtggtgattttagttgtggaggaagagttaatagatgtattccacaattctggcgttgtgatggacaagttgactgtgataatgggagcgatgaacagggatgtccaccaaagacttgttcacaagacgaattcagatgtcatgatggaaaatgtattagtagacaatttgtttgtgattcagatagagattgtcttgatggttctgatgaagcatcttgtccagtattaacctgtggaccagcctcattccaatgtaattcaagtacttgtattccacaactttgggcatgtgataatgatccagattgtgaagatggaagtgatgaatggccacaacgttgtagaggactttatgtatttcaaggtgactcttcaccatgttctgctttcgaatttcattgtttatctggagaatgtattcattctagttggagatgtgatggtggtccagattgtaaggataaaagtgatgaagaaaattgtgctgttgctacatgtagaccagatgagtttcaatgttcagatggaaattgtattcatggatcacgacaatgcgatagagaatatgattgtaaagacatgtcagatgaagttggatgtgttaatgttacattgtgtgaagggccaaataaatttaagtgtcattctggagaatgtattactttagacaaagtatgtaatatggctagagattgtagagattggtcagatgaacctataaaagaatgtggaacaaatgaatgtttagataataacggtggttgttcacatgtttgtaatgatttaaagattggatatgaatgtctttgtccagatggttttcaacttgtagctcaaagaaggtgtgaagatattgatgaatgtcaagatccagatacatgtagtcaactttgtgttaatttagaaggaggttataaatgtcaatgtgaagaaggttttcaacttgatccacatacaaaagcatgtaaggcagtaggttccattgcatatttgttctttactaatagacatgaagttagaaaaatgaccttggatagaagtgaatatacaagtcttatcccaaatttacgaaatgtggttgcattagatacagaagtagccagtaatagaatttattggtctgatttaagtcaaagaatgatatgttctactcaacttgatagagcacatggagtttcttcatatgatactgttatttctcgtgatatacaagctccagacggacttgcagttgactggattcattcaaacatttactggacagattcagttttaggaacagtttctgttgcagacactaaaggagtgaaaagaaaaactttattcagagaaaatggttctaaaccaagggcaattgttgttgatcctgttcatggattcatgtattggactgactggggaacacctgcaaaaattaaaaagggtggacttaatggtgttgatatctattcattagttacagagaatattcaatggcctaatggaattactttagatcttctttctggaagattatattgggttgattcaaaacttcattctattagttcaattgatgttaatggtggtaatagaaagacaatattagaagatgaaaaaaggcttgcacatccattttcacttgctgtgtttgaagataaagttttttggacagatattataaatgaagcaatatttagtgctaatagattaactggaagtgatgttaatttacttgccgaaaatcttttgtcaccagaagacatggtattgtttcataatttaactcaaccaagaggagtaaattggtgtgaacgtacaactctcagtaatggaggatgtcaatatctttgtcttccagcaccacaaattaatccacattctccaaagtttacttgtgcttgtccagatggaatgcttttagccagagatatgagaagttgtttaactgaagctgaagcagcagttgctacgcaagaaactagtactgttagattgaaagtaagttcaactgcagttcgaacacaacatacaactacaagaccagttccagatactagtagacttccaggtgctactccaggtcttacaacagttgaaattgtcactatgagtcatcaagcattaggagatgtagctggaagaggaaatgaaaaaaaaccatcatccgttagagctctttctattgttctcccaatagttttacttgtttttctttgtcttggagtttttttattatggaaaaattggcgtcttaagaatattaattcaattaattttgataatccagtttatcaaaagacaactgaagatgaggttcatatttgtcataatcaagatggatattcttatccaagtagacaaatggtatcacttgaagatgatgttgct

SEQ ID NO: 15915 - DNA, 2580 bp, Artificial Sequence
  Description of Artificial Sequence: Synthetic coding sequence
atggggccatggggctggaagctgcgatggactgtggctctactgttagctgctgcaggcactgctgtcggggatcggtgcgagcgcaacgagttccagtgtcaggatggcaagtgcatcagctataagtgggtgtgcgatgggagcgcggaatgtcaagacggaagtgatgaatcacaagaaacatgcctctccgtgacttgtaagtcaggtgacttctcctgtgggggaagggtcaacagatgtatccctcagttctggaggtgtgacggccaggtggactgtgacaacggaagcgacgaacagggctgcccgcctaaaacttgtagccaagatgagtttcgctgtcacgacggcaaatgcatttccagacagtttgtctgcgattcagatcgagattgtctggacggctctgacgaggcatcctgtcctgttctcacctgtggccctgcctcgttccagtgtaactcttctacctgtatccctcagctctgggcttgtgacaacgatcccgattgtgaggatggatcagacgaatggcctcaacgttgtcggggcctctacgtttttcagggggactcatcaccgtgcagtgcttttgagtttcactgcctgtccggagagtgcatccactcatcctggcggtgcgatggaggtcctgattgcaaggacaaaagcgacgaggagaattgtgccgtagcaacctgccgcccggacgagttccagtgcagtgacggaaactgcatacatggatcaaggcagtgcgatcgtgaatacgattgtaaagacatgagcgacgaggtcggatgcgtcaacgtcaccctttgtgaagggcccaacaagttcaaatgccactccggggagtgcattactcttgacaaggtctgcaacatggccagggactgtcgtgactggtcagacgaacctataaaggagtgtgggaccaacgagtgcctggataacaacggcggctgctcccacgtgtgcaacgacctaaagattggctacgagtgcctatgccccgacgggttccagttggttgctcagcggcgatgtgaagacattgatgagtgccaagacccggacacttgtagtcaactgtgtgtgaatcttgagggaggttacaagtgccaatgtgaagaggggtttcaactggatccacacacaaaggcttgcaaagccgtaggcagtatcgcctatttattttttactaaccggcatgaagtgcgcaaaatgactcttgaccgcagcgagtatactagccttatccctaatcttcgtaacgttgtcgcactggacacggaagtggcctcaaaccgaatctattggtccgacttgtctcaacggatgatttgtagtacacagctggacagagcacacggcgtgagcagttacgatactgttatttctcgcgacatacaagctcctgacggtctggccgtcgactggattcactccaatatctactggactgacagtgtactcggtaccgtgtccgtagcagacactaagggagtgaagcgtaagacactctttagggaaaatgggtcaaagccacgggccatcgttgtggatcctgtccatgggtttatgtattggaccgattggggaactcctgccaaaatcaagaaggggggcctgaacggggtggacatttattcgttggttactgagaatattcagtggcctaacgggattacccttgacctgctgagtggacggctttactgggtggactccaagctgcactctatttcatctattgacgtgaacggcgggaatcggaagaccatcctggaagacgaaaagagacttgcacaccccttctccctggcagtgttcgaggacaaggtgttctggaccgatattatcaacgaagcaattttttcagcaaacagactgacagggtctgatgtgaatctgctggccgaaaatctgctgtcaccggaggatatggtcctgttccacaatcttacacagccacggggcgtgaactggtgcgaacgcacgacattgtccaacggcgggtgtcagtatctttgtctacctgctccacagattaacccccactcgccaaaatttacttgcgcatgccctgacgggatgcttctcgcaagggatatgcggtcttgcttgactgaggcggaagcagccgtcgccacccaggagactagtactgttaggcttaaggtcagcagcactgccgtgagaactcagcacacaaccaccagaccagtccccgacacctcaagactccccggagccaccccaggactaactaccgtggagatcgtgaccatgagccaccaagcgctaggggatgtggccggtcgcgggaacgaaaagaagccttccagcgtgcgagcgctcagtattgtgttaccgattgtcttgctggtgttcctatgtcttggggtgttcctcctgtggaaaaattggagattgaagaacataaatagtattaacttcgataatcctgtgtaccaaaagaccaccgaagatgaggtccacatttgtcataatcaagatggctacagctatccttcacgccagatggtgagtctggaggatgacgtagct

SEQ ID NO: 15916 - DNA, 2580 bp, Artificial Sequence
  Description of Artificial Sequence: Synthetic coding sequence
atggggccctggggctggaagctcagatggaccgtagccctacttttagctgctgcaggcacagcagtgggtgaccgctgcgagcggaatgaattccagtgtcaagatggtaagtgcatctcttataaatgggtgtgtgatgggtctgcagagtgtcaggacggcagcgatgagtcacaggagacatgcctcagtgtgacatgcaagagcggggatttcagttgtggcggtagagttaacagatgtattccccaattttggcgctgtgacggccaggtggactgcgacaacgggtctgacgagcagggttgtccacccaagacgtgctcgcaggatgaatttcggtgccacgacggcaaatgtatttcaaggcagtttgtgtgcgatagtgaccgagattgcctcgacggcagtgacgaggcctcctgcccagttctgacatgtggccccgccagtttccagtgcaactcgtctacatgcatccctcagttatgggcctgcgataatgacccagactgcgaagatggatccgatgagtggccccagcggtgtcggggtctctatgtcttccagggcgatagcagcccttgtagcgctttcgagttccactgtctgtctggagagtgtatacactcctcctggagatgcgatggcggccccgactgtaaagacaagtcagatgaggagaactgtgcggtggccacctgcaggccagatgagttccaatgcagcgatggcaattgcatccacggaagtcgccagtgcgaccgggagtacgattgcaaggacatgtccgacgaagttgggtgcgtcaacgttacactgtgtgagggacccaacaaatttaagtgtcattctggtgagtgcatcacactggataaagtctgtaacatggcgagagactgcagggattggagtgatgagcctattaaagagtgtggaacgaatgagtgcctggacaataatgggggctgttctcacgtgtgcaacgatctcaagatagggtatgagtgcctctgtccagatgggttccaactggtcgcccagcgccgatgtgaggatatcgacgaatgtcaggatccagacacctgttcacagctatgcgttaacctggagggtggatacaagtgccagtgcgaagaaggttttcagctggatcctcataccaaagcgtgtaaggcagttggcagtattgcctatctgttcttcaccaatcggcatgaggtcaggaagatgactcttgaccgcagcgagtacacttccctgattccaaatttgagaaatgtggtagcactcgacacagaggtagcatctaacaggatctactggagcgacttatcccaacggatgatctgcagcacccagctggatcgggctcacggcgtttcatcttacgatactgtgataagccgggatattcaagccccagacggactggccgtggactggattcacagtaacatttactggacagactcggtactggggactgtctccgtggcggataccaagggtgtcaagcgaaagactctgtttcgtgaaaatggatcgaaaccacgcgccatcgtggtggacccagtgcacggattcatgtattggacagactggggcaccccagccaagataaagaaaggtggacttaatggcgtggatatttactctctggttactgagaacatccagtggcccaacgggataaccctggaccttttatccggtcggttatactgggtggacagtaagctccacagcatctcttccattgacgttaatggagggaatagaaagacaatcctggaagacgagaagaggctcgcacaccccttttctctcgcagtgttcgaggataaggtcttctggacagacattataaacgaggcgattttctcagcgaaccggctcactggctcagacgtcaacctcctggccgaaaacttgctatctcctgaggacatggtgctgtttcacaatttgacccagccacggggtgtgaactggtgcgagcgcaccacccttagcaacggggggtgccagtatctttgccttcctgcacctcagatcaatcctcactccccaaagtttacgtgtgcctgccccgatggcatgctgctggccagagatatgcgttcatgcctgacagaagcagaggccgccgtcgccacacaggagacgtcgaccgtcaggttaaaagtctccagcacagcagttaggacacagcataccactacccgacccgtgcctgacacttcccggcttccgggggctactccggggcttactaccgtggaaatcgtgacaatgtcacatcaggcgctcggcgacgttgccgggagagggaacgagaagaaacccagtagtgttcgagctctgtcgatcgtgctaccgatcgtccttctcgtcttcctctgtctgggcgttttccttctgtggaagaactggcgactgaagaatattaacagtattaacttcgataatccggtttatcagaagacaacagaggatgaggtgcatatttgtcacaatcaggacggatatagctacccttctcgccaaatggtgtctttggaagatgatgtggcg

SEQ ID NO: 15917 - DNA, 2580 bp, Artificial Sequence
  Description of Artificial Sequence: Synthetic coding sequence
atgggtccatggggctggaaacttagatggaccgtcgccctgttattggctgcagccgggacagcggtgggtgacaggtgcgagagaaatgaatttcaatgtcaggatggtaaatgtatctcttacaagtgggtttgcgatggaagcgctgagtgtcaagacggtagcgacgaatcacaagaaacatgtttgtctgtaacctgcaagtcgggcgatttctcctgtgggggtagggtaaaccgatgcattcctcagttctggcggtgcgatggccaggtggattgcgacaacgggagtgatgagcagggatgtccccctaagacctgctcacaagatgagtttcggtgccacgacgggaaatgcatctcccggcagttcgtgtgcgactcggatcgggactgcctggatggcagcgatgaagccagttgccctgtactgacttgtgggccggcctcattccagtgtaatagttccacctgcatcccccagttgtgggcgtgcgacaacgacccagactgtgaagatggctccgatgaatggcctcagcggtgtcgcgggctctacgtcttccagggagatagctcaccttgctccgcattcgaatttcactgcctttccggcgaatgcattcatagttcttggaggtgcgatggaggcccagattgcaaggataagtccgatgaagagaactgcgctgtggccacatgtaggccggacgagttccagtgtagtgacggtaactgcattcacggctcccgtcagtgtgaccgagagtatgactgcaaggatatgagcgacgaagtgggctgcgtgaacgttactttatgtgagggacccaataaattcaaatgccattctggggaatgtataaccctggacaaggtttgtaacatggctcgagactgcagagattggtcagacgaacccatcaaggagtgcgggactaatgagtgcttagataataacggaggctgcagccacgtctgcaatgacctgaaaattgggtatgaatgtttatgccccgatggattccagttggtcgcacagcgtagatgtgaagatattgatgaatgtcaggatccagatacatgtagccaactgtgtgtgaacttggaaggtggatacaagtgccagtgcgaggagggattccagttagacccccacaccaaggcctgtaaagccgtaggcagcattgcctatctgttcttcaccaaccgccacgaagtgagaaagatgaccttggatcggagcgaatacacctctctgattccaaatttgcgtaacgtggtagctctcgacactgaagtcgcctcaaataggatttactggtctgatctgtctcagaggatgatttgtagtacgcagttggaccgtgcccacggagtcagtagctacgacaccgtgatctcgcgagatatccaggctccagatgggttggcagttgactggatccattccaacatttactggaccgacagtgtgttggggaccgtttcagtggctgataccaagggggtgaagcggaagacactttttagggagaatggatccaagccccgcgctattgttgtggaccccgttcacggctttatgtattggactgattggggcaccccagccaaaatcaagaaaggaggcctgaacggcgtggacatttactccctcgtcaccgaaaatatccagtggcccaatgggatcaccctggatctgctgtctggtcggctgtactgggtcgattccaaactgcattctatatcctcaatcgatgtgaatggaggtaacaggaagacgatcctggaagacgagaaacgcttggctcaccccttcagcctggccgtttttgaagacaaggtgttctggactgacataatcaacgaagcgattttcagcgctaataggctaactggatccgatgttaacctgttagcagaaaacttgctctcccccgaagatatggttctgttccacaatctcacacagcccagaggcgtgaattggtgcgaacgtacgacgctgtccaatggggggtgccagtatttgtgcctgcctgccccacagatcaacccccattcgccaaagttcacctgtgcctgtccagacggtatgctcctggcccgggacatgcgctcctgccttaccgaggccgaggcggccgttgcaacacaggaaacatccacagtgaggcttaaggtttcttcaaccgcagtaaggacccaacacacaacaactaggccagtccctgatacaagtcgcctgccgggcgctactcccggtctgaccacggtcgaaattgtgaccatgtcacatcaggcccttggcgacgtcgctggtcgcgggaatgagaagaagccgagctcagtacgcgctttgtcaatcgtcctccctatcgtgctgctcgttttcctgtgcctaggtgtgtttctcctctggaagaattggcgactcaagaacataaacagtataaacttcgataatccagtatatcagaaaacgacggaggatgaagtgcatatctgccacaatcaagatggatactcttatcccagcagacagatggtgagtctggaggacgatgttgct

SEQ ID NO: 15918 - DNA, 2580 bp, Artificial Sequence
  Description of Artificial Sequence: Synthetic coding sequence
atgggcccttggggatggaaactcagatggaccgtggccctcttgctcgctgcagcagggaccgctgtcggagaccgatgcgagcggaacgaatttcaatgccaggatggcaaatgtatttcatacaagtgggtgtgcgacggtagcgccgagtgccaggatgggagtgatgagagccaggagacatgcctgtcagtcacctgtaagagtggcgacttttcctgcggcgggagggtgaaccgctgtattccgcagttttggcggtgtgatggacaagtggattgcgacaacggctcagacgaacagggatgtcctccaaagacatgctctcaggatgagtttcgatgtcacgacggaaaatgcatttccaggcagtttgtgtgtgactctgacagggactgcctggacgggagcgatgaggcttcctgtcccgtgctcacctgcgggccagcatctttccagtgcaacagtagcacttgtatccctcagctttgggcctgtgataatgacccagactgcgaggacggctctgacgagtggccccagagatgcaggggattgtacgtcttccagggcgacagcagcccttgcagcgcatttgaattccactgtctcagcggcgaatgtatacacagctcctggaggtgcgatgggggacctgactgtaaggacaagtccgacgaagagaattgcgcagtagccacatgtcgccctgacgagttccagtgctccgacggaaactgtatccacgggtcccggcagtgtgatagagagtatgattgcaaagatatgtctgacgaggtaggatgtgttaacgtcaccctctgcgaggggccgaataagttcaagtgccacagtggtgagtgtatcactttggataaggtctgtaacatggcccgggattgcagggactggtcagatgaacctattaaggaatgcggtactaatgagtgtctggacaataatggcggttgttctcacgtgtgtaatgacttgaagatcgggtacgaatgcctctgcccagacgggttccagctcgtcgcccagaggcgatgtgaggacattgacgaatgccaagatccagacacgtgttctcagctttgcgtaaacttggagggtgggtacaagtgtcagtgcgaagaagggtttcaactcgatccacacaccaaggcatgtaaggccgtggggtccattgcgtacctgtttttcaccaataggcatgaagtgcggaaaatgactctggaccgctctgaatacacctctttgatccccaacctcaggaacgtggtcgccctggatacagaggtagctagtaatcgcatttactggtcagatctgtctcagcgcatgatctgctctacccaactggacagggcacatggagtcagttcttatgacacggtgatctctagagatatacaggccccagacgggttggccgttgactggattcattccaatatctactggacagatagcgtgctgggtacagtttctgtggccgatacaaagggcgtcaagagaaaaaccctctttagagaaaacggcagcaagccacgggcgatagtggtcgatcccgtccacggctttatgtactggacagattgggggacccccgccaagattaagaagggggggttgaatggagtcgacatatacagcctggtcaccgaaaacattcaatggcctaacgggatcacactcgacctgctgagcgggcgcttgtattgggtggattctaagcttcacagcatctcttcaatagacgtcaacggcggtaaccgcaagaccatactggaagatgaaaaacgactggcgcatccgttctcacttgcagtgttcgaagacaaggtgttctggacagacatcattaacgaggcgattttttcagccaacagattgaccggttccgacgtgaacctgctggcagaaaatctgctcagccctgaagatatggtgcttttccacaatctcacacagcccaggggagtgaattggtgtgaacgcaccactctttctaatggtggttgtcagtatctgtgtcttccagcacctcagatcaatcctcatagccctaagtttacgtgtgcatgtccggatggcatgttgctcgcgcgagatatgcgatcctgtctgaccgaagccgaggctgctgtggctactcaggagacgtccaccgtcagactcaaggtgtcttccaccgctgtgcgcactcaacacactaccactcggcctgtacccgatacgagccgcttgcccggggctactcccggacttaccactgtggagatagtgacgatgagccaccaagctctgggcgacgtggctggcagaggtaacgagaagaaaccgtcctcagtccgggccctctccatcgtgctgcctatcgtgctgcttgtgtttctttgcctcggagtgtttctcctttggaaaaactggaggctgaaaaacattaactccatcaacttcgacaatccagtgtaccagaaaaccaccgaagatgaagttcacatctgtcacaatcaggacgggtattcataccccagccgccaaatggtttcccttgaagacgatgtggca

SEQ ID NO: 15919 - DNA, 2580 bp, Artificial Sequence
  Description of Artificial Sequence: Synthetic coding sequence
atggggccatggggatggaagctgcgctggaccgtggcgctgctcctggctgccgcaggaaccgccgtgggagacagatgcgaaagaaacgagttccaatgccaggatggtaaatgtatctcgtacaagtgggtttgcgatgggtcagccgagtgtcaggacggatcggatgagtcgcaggaaacctgcctgtcagtgacgtgtaagtccggagacttctcctgtggaggaagagtcaatagatgcatcccacagttttggcggtgcgatggtcaggtagattgcgacaatggaagcgacgagcagggatgcccgcccaagacctgtagccaggacgaattcagatgtcacgacggtaagtgtatttcccgacagtttgtctgtgattccgaccgcgactgtcttgatggatcagatgaagcgtcgtgccccgttctgacttgtggacctgcctcgttccagtgcaatagctcaacctgcatccctcaactctgggcatgcgacaatgatcctgattgcgaagatggatcagacgagtggcctcagcgctgccggggactctacgtgttccagggagattcgtcaccctgctcagctttcgagtttcactgcctgtcgggagaatgtatccatagctcttggcggtgtgacggcgggcctgattgtaaggacaagtcggacgaagaaaattgcgccgtggcgacttgcaggccggatgaattccaatgtagcgatggcaactgcattcacggatcccgccaatgcgaccgcgagtacgactgcaaagacatgtccgacgaagtcggatgcgtcaacgttactctgtgcgaagggccaaataagtttaagtgtcactctggagaatgcatcaccctggataaagtgtgcaacatggcgcgcgactgtcgcgactggtcggacgagccgatcaaggagtgcggaactaacgagtgtctggataacaatggaggttgcagccacgtgtgcaacgatttgaagatcggctatgaatgcctgtgcccggacggcttccagctcgtggcacagcgacggtgcgaggacatcgacgagtgccaggaccctgacacttgttcccagctgtgcgtgaatctcgaaggagggtacaagtgccagtgcgaggaaggattccagctggatcctcataccaaggcgtgcaaggccgtcggatcaatcgcgtacctgtttttcactaacagacacgaagtgcgcaaaatgaccctggaccgttcggagtacacctccctgatcccaaacctgagaaacgtggtggcactcgacaccgaagtcgcctcgaacaggatttactggtcggacttgagccaacgcatgatctgttcgactcagctggatcgcgcgcatggagtgagctcctacgataccgtgatctcccgcgacatccaggcgcccgacggactggcggtcgactggatccatagcaacatttactggactgattctgtgttgggtactgtgagcgttgccgatactaagggagtgaagcgcaagaccttgttccgggaaaacggatcaaagcccagggcaatcgtggtcgaccctgtgcatggattcatgtattggaccgactggggcaccccagcgaaaatcaaaaaaggagggttgaatggagtggatatctatagcctggtgactgaaaacatccaatggcccaacggaattacccttgacttgctctcaggcaggctctactgggtggattccaagctgcactcaatctcgagcatcgacgtgaacggcgggaacaggaaaacgattctggaagatgagaagagactggcccacccattctcgctggccgttttcgaggacaaggtgttctggaccgacatcatcaatgaagcaatcttctccgcaaacaggctgaccggatcagatgtgaacctcctggcagagaacctcctttcaccggaagatatggtgctcttccataacctgactcaaccgagaggagtcaattggtgcgaaagaactacgctgagcaacggcgggtgccagtacttgtgtctcccggcacctcagattaatccgcatagccctaaattcacttgcgcctgcccagatgggatgctgctggcacgggacatgcgctcctgcctgactgaggccgaagccgccgttgccacccaggaaacgagcacggtgaggcttaaggtgtcaagcactgcagtcagaacccaacacaccactactagaccagtgccggatacctcgagactgccgggcgctacccccggactcactaccgtggaaattgtgacgatgtcccaccaagccctgggggacgtggcgggaagaggcaacgagaaaaagccatcctcggtgcgggctcttagcattgttctgccgatcgtcctcctggtgtttctgtgcctgggcgtgtttctgctttggaagaactggaggctcaaaaacatcaattcgatcaatttcgataatcccgtgtatcagaaaactacggaggacgaggtgcacatctgtcacaaccaagatggatactcatacccttcccgccagatggtgtcgctggaggacgatgttgcg

SEQ ID NO: 15920 - DNA, 2580 bp, Artificial Sequence
  Description of Artificial Sequence: Synthetic coding sequence
atgggtccctggggatggaagctaagatggaccgtagcgttgctgctggctgcagcagggactgctgtgggcgatcggtgtgagcgcaatgagttccagtgccaggatggcaagtgcatttcgtataaatgggtttgtgatggttcagcagaatgtcaggacggatccgacgagtctcaagaaacttgtctgagcgtgacatgtaagagtggtgacttctcatgcggaggccgggtgaacaggtgcataccccagttttggaggtgcgacggccaagttgactgcgacaacggaagtgacgaacaggggtgtccacccaagacatgctcacaggatgagttccgatgtcacgatggcaagtgtatttcccgacagttcgtgtgcgacagtgatagggactgcctggacgggtctgatgaagccagctgtcctgtgctgacttgtgggccagcttcctttcagtgtaactcaagcacttgtatcccccaattatgggcctgcgataacgatcctgattgtgaggatggaagcgatgagtggcctcagagatgtcggggcctctacgtcttccaaggagattccagtccatgtagcgcatttgagtttcactgcttgtctggcgaatgcatccacagctcatggcggtgtgacggaggacccgattgcaaggacaaatcggatgaagagaactgcgcagtggccacttgtagacctgatgagtttcagtgtagcgacggcaattgtatacacggaagtagacagtgtgatcgggagtacgactgcaaggacatgtcagatgaagtaggatgtgtcaacgtgacactctgcgagggtcccaataaatttaagtgccattccggagagtgtattacactggacaaggtttgtaacatggcacgagattgtcgggactggtccgatgaacctatcaaggaatgcggtaccaatgaatgcctggataataacggtggctgtagccatgtgtgcaacgacctaaaaattggctacgagtgcctctgcccagacggattccagcttgttgcacagcgtcggtgtgaagacatcgacgaatgtcaggatcccgacacatgctcgcaactgtgcgtgaacctcgagggaggatataagtgccagtgtgaagagggcttccaactggatccacacaccaaggcctgcaaagctgtggggtctattgcctacctgtttttcaccaatcgccacgaagtacggaaaatgacgcttgaccgatctgagtacacctccctaattcctaacctccggaacgtggtggcgctcgataccgaggttgcttctaataggatctattggtccgacctttcacaaaggatgatctgctctacacaattggatagggcccacggcgtatcttcctatgatacagtgattagccgtgacattcaggcccctgacggcctcgccgtagattggattcattccaacatatactggaccgactctgtcctaggcaccgtgagcgtggcagacaccaagggagtgaaaagaaaaaccctgtttagggaaaatggcagcaagccaagggctatagttgtggaccctgttcacggtttcatgtactggacagattgggggacacctgcaaagatcaagaaaggtggtctgaatggggtggacatttatagcttggtaactgagaatatccagtggcctaatgggataactttagatctgctgtccggtagattgtattgggtggacagtaaattgcattctatttccagcatcgacgttaatggcggaaaccggaagaccattttagaggacgagaaacgcctcgcacatcccttcagtctggccgtattcgaggataaggtcttttggaccgacattattaatgaagccatcttctcagctaacagactgactgggagcgacgtcaatctgctagctgagaatctgctcagtccagaagatatggtgctctttcataaccttacacagcctagaggtgtgaattggtgcgagcgaacaaccctctctaatggagggtgccagtacctatgcctgccagccccccagattaatcctcactctcctaagtttacttgtgcttgtccggatggaatgttgctcgcacgtgatatgcgctcttgtctgactgaggcggaggcggctgtcgccacacaggaaacctcaaccgttcgccttaaggtgtcaagtactgctgtaagaacccagcacacaaccactaggccagtgcctgacaccagcagattgcccggggccactcccgggttgacaacagttgagatcgtaacgatgagccaccaggccctcggggatgtcgcggggaggggcaatgagaagaagccatcctcagttagggctctcagcatcgttctgcctatagtcctattggtgtttttgtgcttaggggttttcctcctgtggaaaaactggaggttgaaaaatatcaacagtataaatttcgacaatcctgtgtatcagaagactacagaagacgaagtgcatatttgccacaaccaggacgggtattcctatccatcccgccagatggtgagcctcgaggacgatgtggct

SEQ ID NO: 15921 - DNA, 2580 bp, Artificial Sequence
  Description of Artificial Sequence: Synthetic coding sequence
atgggaccatggggttggaaactaagatggacagtcgccttactgctcgcggccgcgggcaccgcggttggtgacaggtgtgaaaggaatgagtttcagtgccaggacggaaagtgcatcagctacaaatgggtctgcgatgggagtgctgagtgccaggatggcagtgacgaatctcaggagacatgcctgtctgtgacctgtaaatccggtgatttctcctgcggcggcagagtgaatcgatgtatacctcaattctggagatgcgatggtcaggttgactgcgataacggtagcgacgagcaggggtgtcctccgaagacttgttcccaggatgaattcagatgtcatgatggcaaatgtatttcacgacaattcgtgtgtgattccgatagagattgcctggacggatctgacgaggcttcttgtcccgtgttgacttgcgggcctgcaagttttcagtgtaattcttcgacttgcatccctcagctatgggcctgtgataacgatcctgactgcgaggacggtagcgatgaatggccccagcgatgccgaggcttatacgtctttcagggggattcaagcccctgttcagcattcgagtttcattgtctgagtggagagtgtatccattcgtcttggaggtgcgacggaggccccgactgtaaggacaagagcgacgaggaaaactgcgcagtcgccacttgtcgccctgatgaattccagtgctctgacggcaactgtatccatggtagcagacaatgcgaccgcgagtacgattgtaaggacatgagcgatgaggttgggtgtgtgaatgtaactctttgtgagggtccaaataaatttaagtgtcattcaggcgaatgcattacactggacaaagtgtgtaatatggcgagggattgtcgtgattggtccgatgagccgatcaaggagtgtggaacaaacgagtgcctggataataacggggggtgttcacatgtgtgtaatgatctgaaaattggatacgaatgcctctgccccgacggatttcagctcgtggcccaaagaaggtgcgaggatatcgatgagtgtcaggacccagatacgtgttctcagttatgcgtgaatctggagggcggttataaatgccagtgcgaggagggtttccagctggatccccacacaaaggcttgtaaggccgtgggcagcatagcctatctcttctttacaaatcgacatgaggtgcgaaagatgacgcttgataggtcagagtatacttcactgattcccaatctccggaacgtggttgccttagacacagaggtggcaagtaaccgtatttactggagtgatctcagccagcggatgatttgttcaacccagctcgatcgcgcccacggtgttagttcttacgacacagtgatctctcgggatatccaggcccctgatggattggccgttgactggattcactccaacatctattggaccgacagtgtactgggcacagtgtccgttgcagatactaagggagtgaaaagaaaaaccctatttagagagaacggaagtaagccccgagccattgtcgttgatccggtgcacggctttatgtattggacagactggggaacccccgcaaagatcaagaagggcggcctcaatggtgtggacatctattccctagtgactgagaatattcagtggcccaatgggatcacactggacctactgagcggccggctgtactgggtggacagtaaactccattcaatctcctcaatagatgtgaatggtggtaacaggaaaactatattagaggacgaaaagcggttggcccaccccttctccctggctgtatttgaggataaggtattctggactgacattatcaacgaagcaattttcagtgccaaccgcctcacggggagcgatgttaacctcctagctgaaaatctccttagcccagaagatatggtgcttttccacaacctcacccagccccgaggtgtaaactggtgtgagcgcaccacactgagcaatggtggctgccaatatctctgcctgcctgcaccccaaattaacccgcattctcctaagttcacctgcgcgtgtccggacggcatgctgctggcaagggacatgaggagctgtctgacggaggcggaagcagcagtggctactcaagagacaagcaccgttcgattaaaagtgtccagcacagcagtcagaactcagcatactacaacccggccagttcccgacacaagcagactgccaggcgccacaccagggctaactactgtagagattgtgacaatgagtcaccaggctctcggcgacgtcgctggcagaggtaacgaaaagaaaccatccagtgtgcgggcactgtctatcgtgctgcctattgtgctgctcgtgttcctgtgtctcggagtttttctgctatggaagaactggaggctgaaaaacatcaactccataaactttgacaatccagtgtaccaaaagaccactgaagacgaagtgcatatctgtcacaatcaagatggctatagctacccaagccggcagatggtgtccctggaagatgacgtcgcg

SEQ ID NO: 15922 - DNA, 2580 bp, Artificial Sequence
  Description of Artificial Sequence: Synthetic coding sequence
atgggtccatggggctggaagctgcggtggaccgtcgccttgctgctggccgcagccgggactgccgtgggggatcggtgtgagcgcaacgaattccaatgtcaggatggcaagtgtatttcttacaaatgggtgtgcgacgggtccgccgagtgccaagacggttccgacgagtcccaggagacctgtttaagtgtgacctgcaaatctggcgacttttcctgtgggggtcgagtaaacagatgtatccctcagttctggaggtgtgacgggcaggtcgattgtgacaacggatctgacgagcagggatgtccccccaagacctgtagtcaggacgagtttaggtgtcatgatggtaaatgcatctcaagacagtttgtttgcgacagtgacagggactgtcttgacggttcagacgaagccagttgtcccgtgttgacgtgcggtcctgccagcttccagtgcaatagcagcacctgtatccctcagctgtgggcctgtgataacgacccggactgtgaggatggctctgatgaatggccgcaacgatgccgaggactgtacgtgtttcaaggcgattctagtccctgcagtgcattcgaattccattgcctgagcggggaatgcatacattcctcttggcgttgcgacggtgggccagactgcaaagacaagagtgatgaggagaattgtgccgtggcaacctgtagacccgatgaatttcagtgctccgacggaaattgtatccacggaagccgacagtgtgatcgagagtacgactgcaaggacatgtcagacgaagtagggtgtgtaaacgtgaccctctgtgaagggcctaataagttcaaatgccacagcggtgagtgtatcacgctggataaggtgtgtaacatggcgagagactgtagggactggtcagatgagccaattaaggaatgtggtacaaatgaatgtctggacaataacgggggttgttcccacgtctgcaacgacctcaagattggttatgagtgcctgtgtcctgacggctttcaactggtggcccagcggcgatgtgaagatatagatgaatgtcaggaccctgacacatgtagccagctgtgtgttaatcttgaaggcggctataagtgtcagtgcgaagaagggtttcagcttgatcctcatacaaaggcttgtaaggccgtcggaagtatcgcctacctgttttttactaacaggcatgaagtcaggaaaatgacactcgatcgttcagagtacactagtctgatccccaatcttagaaatgtagttgccttagacactgaagtggccagtaacagaatctactggagcgatttaagccagcgtatgatttgcagtacccagttagacagggcccatggagtgagtagctatgatacagtgatatctagggacattcaggcccctgatggactggccgtggactggatccattcaaacatctactggacagactcagtcttgggtaccgtctcggtggccgatactaaaggggtgaaaaggaagacactgttccgggagaacggttctaagccacgtgccatcgtggtcgatccagtacacgggttcatgtattggacagattggggtacaccagctaaaatcaagaagggtggcttgaatggtgtggatatctacagcctggtgacagaaaatattcagtggcctaacggaattactcttgacctgttatctggtaggctttactgggtggactccaaactccattctatttcgagcatcgatgtgaacggcggcaatcgcaaaactattctggaggacgagaagcgactcgcccatccttttagtctggccgtgtttgaggataaggtgttctggactgatatcattaatgaggctatcttcagcgccaatcgtctgaccgggtcagacgtaaacctcctcgcagagaacctgttgtctcctgaggacatggtgctgttccataacctgacacagccccgaggcgttaattggtgtgagcgaacaactctgtctaatggaggctgccagtatctttgccttcctgccccgcaaatcaacccccatagccccaagtttacatgcgcttgtcctgatggcatgctgctggctagggatatgcgaagctgcttgacagaggctgaggccgcagtggctacacaggaaaccagtacagtgcgattgaaggtttcctctactgccgtacgcactcagcacaccaccacacgacccgtcccagacacatctcgacttccaggagccactccggggcttaccaccgttgagatagtgaccatgagtcatcaagccttaggagatgtagctggcagagggaacgaaaagaaacccagcagtgtacgagccctgtccatcgttctcccaattgtactacttgtgttcctttgcctgggcgtgtttcttctttggaaaaactggagactgaaaaatatcaactccattaatttcgacaaccccgtgtatcaaaagacaaccgaggatgaggtgcacatctgccacaaccaagatggctactcctatccatccagacagatggtgtctctagaagacgacgtagct

SEQ ID NO: 15923 - DNA, 2580 bp, Artificial Sequence
  Description of Artificial Sequence: Synthetic coding sequence
atgggaccgtggggatggaagctccgctggaccgtggctctgctcctcgcagcggccggaacggctgtcggagacaggtgcgagcgcaatgaattccaatgtcaggatggaaaatgcatatcctacaaatgggtgtgtgacggttctgcggaatgccaagacggatccgacgagtcccaagaaacttgcttgagcgtgacctgcaaatcaggtgatttctcgtgcgggggacgcgtcaacagatgcatccctcagttctggcgctgcgatggacaagtcgattgtgacaacggttcagacgaacaaggatgccctcctaagacgtgctcccaggacgaattccgctgccacgatggtaagtgcataagcaggcaattcgtgtgcgatagcgacagggattgcttggatggatccgatgaagcgtcctgcccggtcctgacttgcggcccggccagctttcagtgcaactcgtcgacctgtatcccacaactgtgggcctgcgacaatgaccccgactgcgaggatggctcggacgagtggcctcagagatgccggggcctgtacgtgttccaaggcgatagctcaccgtgttctgccttcgagttccactgcttgtcgggagagtgcatccactcctcgtggcgctgcgacggcggaccggattgcaaggacaagagcgacgaagaaaactgcgccgtcgcgacgtgccgtccggacgagttccagtgctcagacggcaattgcatccatgggtcccgtcagtgcgatcgggaatacgactgcaaagatatgagcgacgaggtcggatgcgtgaacgtgactctgtgtgaaggaccgaacaagttcaagtgccattctggagaatgcattaccctggataaagtgtgcaacatggcacgcgattgccgggactggtccgatgagcctatcaaagaatgcggaactaacgagtgtctggataacaacgggggatgttcacatgtgtgtaatgatctgaaaatcggatacgagtgcctctgcccggatggtttccagcttgtggctcagcgcaggtgcgaagatatcgatgaatgccaggatccggacacgtgttctcagctctgcgtgaatctggaaggcggctacaagtgccaatgcgaagagggattccagctggacccgcatactaaggcctgcaaggccgtgggttcgatcgcctacctgttcttcaccaaccggcatgaagtccggaagatgacgctggatcgaagcgaatacacctcgcttattccgaatctgagaaatgtcgtggccttggatactgaggtcgcctcaaaccggatctactggtcggacctcagccagcgcatgatctgttccactcaattggaccgggcccacggcgtcagcagctacgacactgtcatttccagggatatccaagccccggacggactcgccgtcgattggatccattcgaatatctactggacggactcagtgctgggcactgtgtccgtcgcagacaccaagggtgtgaaacgcaagaccctgttccgggaaaacgggtcaaagccgcgcgcgatcgtcgtggacccggtccatggattcatgtactggactgattggggcacccccgcaaagatcaaaaagggaggactgaacggggtggatatctattcactggtgaccgaaaacatccagtggcccaatggtatcacgctggatctgctgtcagggaggctgtactgggtggactcgaagctccactccatctcgtcgattgatgtgaatggcgggaaccgcaaaactattctcgaagatgagaagcgcctggcgcatccattctcgctggccgtgtttgaggacaaggtgttctggaccgacattatcaacgaagccattttctcggcaaaccggctgactggatccgatgttaacctcttggccgaaaatctgctgtcacccgaggacatggtcctctttcacaatttgacccaaccacggggagtcaattggtgcgaaaggaccacgctgtccaacggcgggtgccaatacctctgcctgccagcgcctcagatcaaccctcacagcccgaagtttacttgcgcctgtccagacgggatgctgctggcacgggatatgagatcgtgcctgaccgaggccgaggcggccgtggcaacccaagaaactagcaccgtgaggttgaaggtgtcatctaccgcggtgcggacgcagcacaccactactagaccggtgccagatacctccaggctccctggtgcaaccccaggactgactaccgtggaaattgttaccatgtcccaccaggcactgggcgacgtagctggaagaggaaacgaaaagaagccgtcatcggtgagggctctcagtatcgtcctgcccatagtgttgctggtgtttctgtgcttgggtgtgttcctgctttggaagaattggcgcctcaagaacatcaattcaatcaatttcgataacccagtctaccaaaagacgaccgaggacgaggtgcacatctgtcataatcaagacgggtactcatatccatcgagacagatggtgtccctggaggacgacgtggcc

SEQ ID NO: 15924 - DNA, 2580 bp, Artificial Sequence
  Description of Artificial Sequence: Synthetic coding sequence
atgggaccctgggggtggaaactgagatggacggtggcgcttctcctagctgcggctgggacagcagtcggagatcggtgtgagcgaaacgagtttcagtgtcaggatgggaaatgcattagttataaatgggtatgcgatgggtctgcagaatgccaggacgggtcagatgagtctcaggagacttgtctttcagtcacttgtaagtctggggacttttcatgcggaggaagagtcaaccgatgtataccacagttctggagatgtgatggacaagtggactgtgataacggatctgatgaacaagggtgtccacctaaaacatgcagtcaggatgaatttcggtgtcacgatgggaagtgtataagtagacagttcgtctgtgattcagatagagactgtcttgatggatcagatgaagcttcttgccccgtactcacatgcgggccagcctcctttcagtgtaattcctctacatgtattcctcagctctgggcatgcgataacgacccagattgcgaagatggatctgatgagtggcctcaacgctgccggggactctacgtatttcagggggattcaagtccttgttccgcctttgaatttcactgtctttctggagaatgcatccacagtagttggaggtgtgatggggggcccgattgtaaggataaatccgacgaagaaaattgcgctgtagctacttgtcgcccagacgaattccagtgttctgacggaaattgcatccatggaagtcggcaatgtgatagagaatacgattgcaaagacatgtccgatgaagttgggtgcgtaaatgttacactttgtgaagggcctaataaatttaagtgtcactctggggagtgtattacacttgataaagtatgcaatatggctcgggactgcagagattggtctgatgagccaattaaagaatgtgggactaacgagtgcctggataacaatggaggatgttctcatgtgtgcaatgatctgaaaattggatatgaatgcctttgtcccgacgggtttcagctcgtggcccagaggcgctgtgaggacatcgatgagtgtcaagatcccgacacatgttcacagctctgcgtcaatttagaaggggggtacaaatgccagtgtgaagaagggttccagcttgatccacatactaaagcctgtaaagctgtagggtctatagcctatcttttctttacaaacaggcatgaagttagaaaaatgactctggatagaagtgaatatacttctctaattcccaatcttaggaatgtcgtagcactagatactgaagtggcctctaacagaatctattggtctgacctaagtcaaagaatgatctgctccactcagttagaccgggcacatggggtgtcctcttatgatacagtcatctctcgggatatccaggcgccagatgggcttgccgtcgactggattcacagtaacatttattggacagattcagtactgggaactgtatctgttgcagatacaaaaggggtcaagagaaaaacactgttcagggagaatggatctaagcctcgggcaatagtggtcgatcccgtacatggatttatgtattggacagattggggaactcctgcgaaaattaaaaaaggaggattaaacggagtcgatatatattcactagtgactgaaaacatccagtggcccaatgggattacacttgatctcctttctggacggctgtattgggtagatagtaaattacattctatctcatcaatcgacgtcaatggggggaaccggaagactatactagaagatgaaaaacgcctcgcacaccccttttcattagcggtttttgaagataaagtcttttggacagatattataaacgaagctatattctccgccaatcggctcacaggaagtgacgtcaatctcctcgccgagaatcttctgtccccagaagatatggtgctattccataatttaacacagcctaggggagtgaactggtgcgaaaggactactctttcaaatggagggtgtcagtatttatgccttccagcccctcagattaatcctcactctcctaagttcacatgtgcttgccccgatggaatgctgctggcccgggatatgagatcttgcctcacagaagctgaagctgccgttgccacacaggagactagtactgtaaggctgaaagtgtcctctactgcagtgagaactcagcatacgactactcgccccgtccctgatacttctaggctgcccggagcaacacccggactcacaacagtggaaatcgtgacaatgagtcatcaggcattgggagatgtagcgggaaggggaaatgaaaagaaaccttcaagtgtgagagcgctgtccatcgtgcttcctatcgtgctgttagtatttctatgtttaggagtttttttactttggaagaactggcggctcaagaacataaattctattaactttgataacccagtgtaccagaaaacaacggaagatgaagttcatatctgccataatcaggatggatattcctacccatctagacagatggtatccctggaagatgatgtggct

SEQ ID NO: 15925 - DNA, 2580 bp, Artificial Sequence
  Description of Artificial Sequence: Synthetic coding sequence
atgggcccgtggggctggaagcttcgctggaccgtcgctctccttcttgccgcggcaggcacagctgttggtgaccgttgcgagagaaatgaattccagtgccaagatggaaagtgcatcagttataaatgggtatgcgacggcagtgccgaatgccaagatggatcagatgaatcgcaagagacgtgcctgtcagtgacatgcaagagcggggacttctcttgcggtggacgcgttaaccggtgtataccgcaattttggcgttgcgatgggcaggtcgattgtgataacgggagcgatgaacaagggtgcccaccgaaaacgtgtagtcaagacgaattccgctgccacgatggaaaatgcattagccggcaatttgtctgcgattcggatagagactgcttggatggctcagacgaggccagttgccctgtgctgacatgtggaccggcgtcttttcagtgcaattcctcaacatgcatcccccaactgtgggcgtgcgacaatgacccagactgcgaagatggctccgacgagtggccgcaacgttgtcgtggcctctacgtattccaaggcgacagctcgccgtgttctgcctttgaatttcattgcctgtcgggtgaatgtattcactccagctggagatgtgatggaggcccggattgcaaggataaatcagacgaagagaattgtgcggtcgctacgtgtcggcctgacgaatttcaatgttcagacggcaactgcatccatggaagccgacagtgcgatagggagtacgattgcaaggatatgtccgacgaagtggggtgtgtgaacgtcacactgtgcgaggggcctaataaattcaagtgccattcgggcgaatgcataacgttagataaggtgtgtaatatggccagagattgccgcgattggtctgacgagccgattaaagaatgtggaacaaatgagtgccttgacaacaacggaggttgttcacatgtctgcaatgacttgaagattggttacgaatgtttatgtcctgacggatttcaattagttgctcaaagaagatgtgaggatatcgacgaatgtcaggatcctgatacgtgcagccagttgtgtgttaatcttgaaggtggatataaatgccagtgcgaggaaggctttcagctcgaccctcacacgaaagcgtgcaaagccgttgggtcaattgcctaccttttttttacaaatcgtcatgaagttaggaaaatgaccttggatagaagcgaatatacaagcctgatcccaaacctgcggaatgttgtcgcactggacacggaagtggcctcgaatcgtatctactggtcagacctgtcacagaggatgatttgcagtacacagttggatcgcgctcatggcgtcagctcatatgatacggtgattagtcgagatatacaagcgcctgacggattagcggtcgattggattcatagcaatatttactggactgattccgtactgggaacggtgagtgtggcggatacaaagggagtgaaacgcaaaacattatttcgcgaaaatggttcaaaaccgagggcaatcgtagtcgatccggttcatggttttatgtattggacagattgggggacgccggccaagattaaaaaaggcggattaaatggtgttgatatttactccttggttacggaaaatatacaatggccgaatggtataacgttggatttgctatcaggtcggttatattgggtggattctaaactgcactctataagttcaattgatgtgaacggcggaaaccgcaaaacaattttggaagacgaaaaacgcttagcgcatccattctcactggccgtgtttgaagataaagtcttttggacggacattattaatgaagcgattttctcagcgaataggcttacaggctctgatgtaaatttgttagcggaaaatctgctgtcaccggaagatatggtcttgttccataaccttactcagccgcggggcgttaattggtgcgagcggaccacattatcaaatggcggatgtcaatatctatgcttacctgcgccgcaaattaatccgcattcaccgaaattcacgtgcgcttgcccggatggtatgttgcttgcgcgagatatgcgcagttgcctgacagaagcagaggccgcggtagcgacccaggaaacatcgacggtccgtctcaaagtcagctcgacggccgtcagaacacaacatacaacaacgagaccagtaccggatacaagcagattaccgggagctactccgggattgacgacagtggagatcgtaacaatgtcccaccaggcactgggagacgtggctgggcgcggaaatgaaaagaaacctagcagtgtgcgcgcgttaagcatcgtcttaccaattgttctgttagtattcttatgcttgggcgtctttcttctgtggaaaaattggagattgaaaaacattaatagcatcaacttcgataacccggtttaccagaaaacaactgaggacgaagttcatatatgtcataaccaggacggatattcttatccaagtagacaaatggtctctttagaggatgatgtggcg

SEQ ID NO: 15926 - DNA, 2580 bp, Artificial Sequence
  Description of Artificial Sequence: Synthetic coding sequence
atgggaccgtggggttggaagctgagatggaccgtggccttgttgctggctgcagcgggaactgccgtgggtgacagatgcgaacggaatgaatttcaatgccaagacggaaagtgcatttcctacaagtgggtttgtgacggttctgccgaatgtcaagacggatcggatgagtcccaggagacttgcttgtcggtcacttgtaaatccggcgatttctcctgtggagggagagtgaatagatgtatcccacagttctggcggtgcgacggacaggtggattgcgacaacgggtcggacgaacagggatgcccgccaaagacttgctctcaggacgaattccggtgccacgatggcaagtgtatcagccgccagtttgtttgcgactcagatcgggactgtctcgatgggtcggacgaggcttcatgcccggtgctgacctgcggacctgcgagcttccaatgcaactcctccacgtgcatcccgcagctttgggcgtgcgacaatgatccggattgtgaagatggatccgacgaatggcctcaaagatgccggggactctacgtgtttcagggggactcctctccttgctccgcctttgaattccactgcctctcaggtgaatgtatccattcttcatggagatgcgacggtgggccggactgcaaggacaaatcggacgaagaaaattgtgccgtcgcgacgtgccgccccgacgagttccaatgctctgacggcaactgcatccacggatcgaggcagtgtgatagagaatacgattgcaaagatatgagcgacgaagtgggctgcgtgaacgtgactctctgtgagggccctaacaagttcaagtgtcacagcggagagtgcatcacgctcgacaaggtgtgtaatatggcgcgggattgccgggattggtcagacgagcctatcaaggaatgcggtaccaatgaatgtcttgacaacaacggaggatgcagccatgtgtgcaacgacctgaagatcggatacgaatgtctttgcccggacggctttcagctggtggctcagcggcgctgcgaggatattgatgaatgccaggaccccgatacgtgctcgcagctgtgcgtgaaccttgaaggcggatacaaatgtcagtgcgaggaaggattccagcttgatccgcacaccaaggcttgcaaggccgtaggatccatcgcttacctcttcttcaccaatcggcacgaggtcagaaagatgaccctggatcgctccgagtacacctctcttattccgaacctgaggaatgtggtggcgctggatactgaagtggctagcaataggatctactggtcggacctctcccagaggatgatctgcagtacccagctggaccgcgcgcatggtgtgagctcctacgacaccgtgatctcgcgcgacatacaagccccagacggtctggccgtggattggatccattcgaatatctactggaccgactccgtgcttggtactgtgtctgtggcagatactaagggagtcaagagaaagactttgttccgcgaaaacggctcaaaaccgcgcgctattgtcgtggatccggtgcatggtttcatgtattggacggattggggcactccggcgaagatcaagaagggaggtctgaacggagtggacatctactccctggtgaccgaaaacatccagtggcccaacgggatcactctcgacctcctgtcaggacgcctctactgggtcgactccaaattgcatagcatctcgtccatcgatgtgaacggaggaaaccgcaaaactattctcgaggacgagaagcggttggcgcaccctttcagcctcgccgtctttgaggataaggtgttctggaccgacatcattaacgaggctatcttctcagctaatcgccttacgggatccgacgtcaacctgctcgcggaaaacctcctttccccagaggacatggtcttgttccataatctgacccaaccgcgcggggtgaactggtgtgaacgcaccactctgtctaacggagggtgccaatacctgtgcctgcccgcaccccaaatcaatcctcactcgccgaagtttacctgcgcctgtccagacggaatgcttctggcgcgcgacatgcggtcctgcctcactgaggcggaggccgctgtggcaactcaggaaacctcaactgtgcgactgaaagtgtcctccaccgcggtgcgtacccaacataccaccacccgtcctgtcccagatacttcgcggctgcctggggctactccaggtctgactactgtggaaatcgtcaccatgtcccatcaagcattgggcgatgtggcaggtcgcggaaatgaaaagaaaccctcaagcgtgagggctctgtcgatcgtcctgccaatcgtgctgctggtgtttttgtgtttgggagtgttcctgctgtggaagaattggcgcctcaagaatatcaactcaattaacttcgacaaccctgtctatcagaaaaccactgaggacgaggtgcacatctgccacaaccaggatggctactcctacccgtcaagacagatggtcagcctggaagatgacgttgcc

SEQ ID NO: 15927 - DNA, 2580 bp, Artificial Sequence
  Description of Artificial Sequence: Synthetic coding sequence
atgggcccctggggatggaagttacgctggactgttgcactgcttcttgcggccgctggaactgccgtaggggaccggtgcgaacgaaatgaattccagtgtcaggacggcaaatgcatttcttacaagtgggtgtgtgacggttccgcagaatgccaggatggctccgatgagtcacaggaaacctgcctatcggttacctgcaaaagcggggatttctcgtgcggagggcgagtgaatcggtgcattccgcagttctggagatgtgatgggcaggtcgattgtgacaatgggagtgatgagcagggctgccctcccaagacttgttcacaggacgaattcaggtgccacgacggtaaatgtatttcccgacagttcgtctgcgactcagatcgagattgtcttgatggaagcgatgaagcttcgtgccctgtcctcacttgtggtcccgcttcctttcagtgtaactcatctacctgcatcccgcagctgtgggcttgcgataatgatccggactgtgaggacggatccgacgaatggcctcaacgctgccggggcctatatgtttttcaaggggactccagtccctgctctgctttcgagttccattgtctctctggggagtgcatccactccagctggcgatgcgacggaggacccgactgtaaggataaaagcgatgaagagaactgtgccgtcgccacttgtcggcctgatgagtttcagtgttctgatggaaattgtatacatgggtctaggcagtgcgaccgcgagtatgactgcaaggacatgtcagatgaggttgggtgcgtgaacgtgactctgtgcgagggtccgaataaattcaagtgccatagtggggagtgcattactctggacaaggtctgtaacatggctagagattgtagagattggtctgatgagcccattaaagagtgcggaacgaacgaatgcctggataacaacggtgggtgcagccacgtgtgcaatgacttgaaaatcgggtatgagtgcctatgtccagacgggtttcaactggtggcccaacgtcgctgcgaggacattgacgagtgtcaggacccagacacctgcagtcagctttgtgtgaatctcgagggagggtataagtgtcaatgcgaggagggattccagcttgacccacatactaaggcctgtaaagcagtgggttcgatcgcttacttgttcttcacaaataggcacgaggtcagaaagatgacactagatcgtagcgagtacacgtccctgattcctaatctgaggaatgttgtcgccctcgataccgaggtggcctctaatagaatctattggagtgacctgagccagaggatgatttgctcaacacagctggaccgggctcacggggtgagcagctatgacaccgtcatttctcgggatattcaggcaccagacggcctcgcggtggactggatacattccaacatctattggacagacagcgtgcttggcacagtgtccgtggccgacaccaaaggcgtgaagcgaaaaaccctgttccgcgaaaacggctccaaaccccgagctatagtggtggatcccgtacatggcttcatgtactggacagactggggtacaccagctaagatcaaaaagggcggactgaacggggtggatatttactctttggtgacagaaaacattcagtggcccaacgggatcactctcgatctcctcagtggaaggctgtactgggtcgattctaaactccactccatctcatccatagatgttaacggcggcaatagaaagactatcttggaagatgagaagcggcttgcacatcctttcagcctcgccgtgtttgaggacaaggtcttctggaccgacattatcaatgaggcgatattttccgcaaatcgcttgaccgggtctgacgtgaacctactcgcggagaacctccttagccctgaggacatggtcctgttccataaccttactcagcctcgcggcgtcaattggtgtgagcgaactactctgtcgaacggaggatgccaatatctgtgtctgccagcaccacagatcaaccctcattcaccgaaatttacctgtgcatgcccagacggcatgctcctcgcgagagacatgcgatcttgccttacagaagccgaagctgcagtcgccactcaggaaactagcacggttagactgaaggtgagtagcaccgcggtaagaacgcaacacactacaaccagacccgttcccgatactagccggctgcctggggcaacaccaggattgaccaccgtcgaaatcgtgaccatgtcccatcaggccctcggcgacgtcgctggaagagggaatgaaaaaaagccctcaagtgtacgggctttaagcatagtacttcctattgtcctgttggtgtttctgtgcttaggagtgtttctcctctggaaaaactggcgtctgaagaatataaattctattaattttgacaatcctgtctaccaaaaaactacagaagacgaagtgcatatctgtcataatcaagacgggtacagctatccatctcgccaaatggtctcgttggaagacgatgtcgct

SEQ ID NO: 15928 - DNA, 2580 bp, Artificial Sequence
  Description of Artificial Sequence: Synthetic coding sequence
atgggcccatggggctggaagctccggtggactgttgctcttcttctcgcggccgctgggactgcagtcggcgataggtgtgaacgaaatgagtttcagtgccaggacggaaaatgcatcagctacaagtgggtttgcgacggctcggcagaatgtcaggatggttcggacgaatcgcaggagacttgtttgagcgtgacctgtaagtcaggagatttttcctgcggcggtcgcgtcaacaggtgcatcccgcagttctggagatgtgacggacaagtggattgcgacaatggatctgacgagcaggggtgcccgccgaaaacttgctcgcaggatgaatttcgctgccacgatggaaagtgtatttcacgccagtttgtgtgtgacagcgatcgcgactgcctggatgggagcgacgaagcctcgtgtccggtcctcacttgcggccctgcctcgttccaatgcaactcgagcacgtgcatcccccaactgtgggcatgtgacaacgaccctgattgcgaggacggttcagacgaatggccgcaaagatgccggggattgtacgtattccagggtgactcctccccttgctcagcgttcgagttccattgcctgtcaggagaatgcatccattcaagctggcggtgcgatggcggcccggactgtaaagataagtcggacgaggagaactgcgcagtggccacgtgccgccctgacgaatttcaatgttcggacggcaactgcatccacggctcaaggcaatgcgaccgggagtatgattgcaaagacatgtcggacgaggtcggatgcgtgaacgtaaccctgtgcgaagggcccaataagttcaagtgtcattccggagaatgtatcactctcgataaagtgtgtaatatggcgagagactgccgggactggtcggacgagcctatcaaagagtgcggaaccaacgaatgcctggacaacaatggagggtgctcacacgtttgtaatgacctcaagattggatacgagtgcctgtgcccagacggattccagctggtcgcgcagagacggtgcgaggacatcgatgagtgccaagacccggacacttgctcccagctgtgcgtcaatctggaaggcggctacaagtgccagtgcgaagaaggattccagctcgatccacataccaaggcatgcaaagccgtgggatcaatcgcctacctgtttttcaccaatagacacgaagtgaggaaaatgaccctggaccgcagcgaatatacctcgctgatcccgaatctccggaacgtggtcgccctcgacaccgaagtggcgtcaaataggatctactggtcggatttgtcgcagagaatgatttgctcaacccagctggaccgcgcccatggcgtgtcaagctacgatactgtgatcagcagggacatccaagcgccagacgggctcgcggtggactggattcacagtaacatatactggactgactcggtcttgggtaccgtgagcgtggccgacaccaagggtgtgaagagaaagactctgttcagggaaaacggatcaaaaccgcgggctatcgtggtggacccagtccacggattcatgtactggactgattggggcaccccggccaagatcaaaaagggcggactgaatggggttgacatttacagtcttgtgacggaaaacatccaatggccgaacggcatcaccctggacctcctgagcggacgcttgtactgggtcgactcgaagctgcattcgatcagctcgatcgatgtcaacggcggaaaccgcaagaccatcctggaggatgagaagagactcgcccacccgttctcgctcgccgtgttcgaagataaagtgttctggaccgacatcatcaatgaggcgatcttttccgcgaaccgtctcactggcagtgacgtgaacctgctggcggagaatctgctgtcgcccgaggatatggtgctgttccacaacttgacccaaccgcgcggtgtgaactggtgtgaacggactacgctgtcaaacggaggctgccagtacctgtgtctgccagcccctcaaatcaacccacattcgccaaaattcacttgtgcttgtcctgacggaatgctgctggcgcgcgacatgcggtcgtgtttgaccgaagcggaggctgccgtggctactcaagagacttccactgtgcggctgaaggtgtcctccaccgccgttcgtacgcagcacactactaccaggccggtcccagatacttctcgcctgccgggggccacccccggacttactacggtcgagatcgtgactatgtcgcaccaagcgctcggagacgttgctggcagagggaatgagaagaagccgagctcagtgagagcactgtcaatcgttctgcccatcgtgctgctcgtgttcctctgcctgggagtgttcctgctgtggaagaactggaggctcaagaacatcaacagcatcaattttgataatccagtgtaccaaaaaactactgaggatgaggtgcacatctgccataatcaggatggatactcgtacccatcacgccagatggtgagcctggaagatgatgtggcg

SEQ ID NO: 15929 - DNA, 2580 bp, Artificial Sequence
  Description of Artificial Sequence: Synthetic coding sequence
atgggaccatggggatggaagcttaggtggaccgtcgctctcctgcttgccgccgcaggaactgccgtgggcgacagatgcgagcgtaatgagtttcaatgtcaggacggaaagtgcatcagttacaagtgggtatgtgacggatccgccgagtgccaagatggttccgacgaaagtcaggagacctgcctcagcgtaacatgtaagagcggagacttcagttgcggcggaagggtcaatcgttgcatccctcagttttggcgctgcgatggacaggtcgactgtgacaacggttcagacgagcagggctgcccccccaaaacatgttcccaagacgaatttagatgccacgacggaaaatgtatctcaaggcagttcgtctgcgacagcgatagagactgtctggatggtagtgacgaagctagctgccctgtactgacctgtggccctgccagcttccagtgtaactcctccacatgcataccccagctgtgggcctgcgacaacgatcccgactgcgaggacggtagtgacgaatggccacagcgctgtaggggtctttacgttttccagggagactcctctccatgttctgctttcgagttccattgcttgtccggagaatgcatccatagctcttggaggtgcgatggaggtccagactgcaaggacaagagcgatgaagagaactgtgccgtggctacatgcaggcccgacgagttccaatgtagcgatggaaactgcatccacggttctaggcagtgcgacagagaatacgactgtaaggacatgagcgatgaagtgggttgtgtcaatgtgaccttgtgtgagggacccaacaagttcaagtgccactctggagagtgcatcacattggacaaagtatgcaatatggctcgtgattgcagggactggtctgacgagcccataaaagaatgtggtacaaacgaatgcctggataacaatggaggatgtagtcacgtctgcaacgatctcaagattggctacgagtgtctctgccccgacggattccaactggttgcacagaggaggtgcgaggacatagacgagtgccaagatcctgacacttgctcccagttgtgtgtcaacctcgagggaggctacaagtgccaatgtgaggagggtttccagttggatccacacactaaggcctgcaaggctgttggatccatcgcctatctgttctttacaaacagacacgaagtgcgcaaaatgaccctcgatcgttctgagtacacctctctcatccctaacttgaggaacgtggtggctttggacactgaggtggctagtaatagaatttactggagtgacctgagccaacgtatgatttgcagtacacagctggatcgcgcccacggagtgagcagctacgacaccgtcatcagtcgtgatatacaggcacctgacggacttgcagttgattggatccactccaacatctattggactgactcagtgcttggcactgtgtctgtggctgatacaaagggagtgaagcgcaagacattgttcagggagaatggttctaaacctcgcgctatcgttgtggaccccgtacatggcttcatgtactggactgattggggcacacccgccaagataaagaagggcggactcaacggcgtggacatctactccctggtgacagagaacatccagtggcccaacggcatcacattggatcttctctccggcagactttattgggtggactctaagctccattccatatcaagcatcgatgtcaatggtggtaatcgtaagaccatcctggaggatgagaagcgtctcgcacacccattctcactggctgtatttgaggataaggtgttctggactgacatcattaacgaagcaattttttctgccaaccgcctgaccggctctgacgttaacctgttggccgaaaatcttctcagcccagaggacatggtgcttttccataacctcacccaaccccgtggtgtaaactggtgcgaacgtactacactgtctaatggaggttgccagtacctgtgcctgcccgctcctcagatcaaccctcactcacctaagtttacctgcgcctgccccgatggaatgctgctggccagggacatgcgtagctgtcttaccgaagccgaggctgcagtggccactcaggagactagcaccgtgcgtcttaaggtctccagtacagctgtaaggacccagcacactacaacccgtcctgtaccagacacttcacgtttgccaggcgctacacctggcctcaccaccgtagaaattgtaaccatgtcacaccaagctctgggagacgtggctggaagaggtaatgagaaaaagccttccagcgtgcgcgccttgtctatcgtcttgccaatagtcctgctggtatttctctgtctgggtgttttcctgctgtggaaaaattggcgtctcaaaaacatcaactcaattaacttcgataaccctgtgtaccagaaaactactgaggacgaggtgcatatctgccacaatcaggatggctactcttacccctcacgccaaatggtgtccttggaggatgatgtagct

SEQ ID NO: 15930 - DNA, 2580 bp, Artificial Sequence
  Description of Artificial Sequence: Synthetic coding sequence
atgggcccttggggatggaagctccggtggaccgtggccctgctcctcgcggccgccggaaccgccgtcggcgataggtgcgaacggaatgagttccagtgccaggatggaaagtgtatttcatacaagtgggtctgtgacgggtccgccgaatgccaggacggatcagacgaaagccaggagacgtgcttgagcgtgacttgcaaatcgggagatttctcgtgcggaggccgcgtgaacaggtgtatcccacagttttggcgctgcgatggccaagtggattgcgacaacggttccgatgaacaaggatgtccccctaagacttgctctcaagatgagttcagatgtcacgatggtaaatgtatcagccggcagttcgtgtgcgactccgacagggactgcttggacggatctgatgaggcttcttgcccggtcctgacttgcggccccgcctcctttcaatgcaatagcagcacctgcatccctcagctgtgggcctgcgacaatgacccggattgcgaagatggcagcgatgaatggccgcaacgatgccgcgggctttacgtgttccaaggagactcgtcaccatgttccgcgttcgaattccactgcttgagcggagaatgcattcactctagctggaggtgcgacggaggacccgactgcaaagataaatccgatgaagaaaattgcgccgtggctacttgtcgcccagacgaattccagtgttccgatggaaactgtattcatggatcaagacagtgtgatcgggagtacgactgcaaggacatgtccgatgaggtgggatgtgttaacgttaccctgtgcgagggcccgaacaagtttaagtgtcactccggggagtgcatcacgctcgataaagtctgtaatatggccagagactgccgcgattggtcggacgagccgatcaaggaatgcggaaccaacgaatgcttggacaataacggaggatgctcacatgtgtgcaacgatctgaagatcgggtacgaatgtttgtgtcccgatggattccagctcgtcgcccaaagaagatgcgaggacatcgacgagtgccaggatccggacacctgctcacaactctgcgtgaacctcgaaggaggatataagtgtcaatgtgaggaaggatttcaactcgacccgcatactaaagcgtgcaaagctgtcggatcgatcgcttacctgttcttcacgaatcggcacgaagtgagaaagatgactttggaccgctcagaatacacttcactcatccccaacctgcgcaacgtcgtggcgctggatactgaagtggccagcaaccggatctattggtcggatctctcccagcggatgatctgctccacccagctggaccgcgcccacggggtttctagctacgacactgtcatctccagagacatccaggccccggacggtctggctgtggactggatacattcaaacatctactggactgactcggtcttgggcaccgtctcggtggcagacaccaagggggtgaaacggaaaactctgtttcgcgaaaacggatcgaagccgcgcgcgatcgttgtggacccagtgcatgggtttatgtactggaccgattggggaacgcccgctaagatcaagaaaggagggctcaacggagtcgacatttactcattggtgaccgagaatatccagtggccgaacggtatcactctggaccttctgtccggtcggctgtactgggtcgattccaagctgcactcaatctccagcatcgacgtgaacggcggaaaccgtaagacgattctggaggacgagaagcggctggcacaccctttcagcctcgcggtgttcgaggacaaggtgttctggactgacattatcaacgaagctatcttcagcgccaatcgcctgactggcagcgacgtgaacctgctcgcagaaaacttgctgagcccggaagatatggtgttgtttcacaacctgactcagcccaggggagtgaattggtgtgaacgcactaccctgtcgaacggaggctgccagtacctgtgcctgccggcaccgcagattaacccgcatagcccgaagttcacctgcgcatgtccagatggcatgcttctcgcccgggatatgcggtcctgtctcactgaagctgaagcggccgtggcgactcaggaaacctctactgtgcgactgaaggtgtcctccaccgctgtccgcacccagcataccacgactcggcctgtgccagacaccagccggctgcccggcgcgactcctggattgaccacggtggaaattgtgaccatgtcacaccaggcgctgggagatgtcgcaggcagaggtaacgaaaagaagccatcaagcgtgcgcgccctgagcatcgtgctgccgattgtgctgctggtgttcctttgtctgggagttttccttctgtggaaaaactggcgcttgaagaacatcaattcgatcaatttcgacaatccagtgtaccaaaaaactactgaggacgaagtgcacatctgccataaccaggatggatactcctacccatcacgccaaatggtttcgctcgaggacgatgtggca

SEQ ID NO: 15931 - DNA, 2580 bp, Artificial Sequence
  Description of Artificial Sequence: Synthetic coding sequence
atgggcccttggggctggaagctgaggtggacagttgctctattgttggctgccgctggaaccgctgtcggcgacagatgcgagagaaacgaattccaatgtcaggacgggaaatgcataagctacaaatgggtctgcgacggctcggcggagtgccaagacggctcggacgaaagccaagaaacatgtctgtccgtgacctgcaagtcgggcgactttagttgcggaggaagagtgaacaggtgtattcctcaattctggaggtgcgatggacaggtggactgtgacaacggtagtgatgagcaaggttgccctccaaaaacctgtagccaagatgagttccggtgccacgacggaaagtgcatctcacgccagtttgtgtgcgatagcgatcgagattgcctggacgggtcagatgaggcatcatgtccagtgctgacttgtggccccgcttcatttcagtgcaattctagcacttgcataccccagctctgggcatgcgataacgatcccgattgcgaggatggctctgacgagtggcctcagagatgtaggggattatatgtgtttcagggcgacagctctccctgcagtgcctttgagttccattgcctcagcggggaatgtatccattcaagctggcggtgcgatggaggccctgactgcaaggacaagtctgacgaagaaaactgcgccgttgccacctgtagacccgacgaattccaatgcagcgatgggaattgtatccacggctccaggcagtgcgaccgagagtatgactgcaaggatatgtctgatgaagtcggatgtgtgaacgtaaccttgtgcgagggaccgaacaaattcaaatgccattctggagagtgcatcacactggataaagtgtgcaacatggctcgcgactgtcgggactggagcgatgaacccattaaagaatgcggaactaacgaatgcctggacaataacggcggctgctcccatgtgtgcaacgatttgaagatcggttacgagtgcctgtgccctgacggcttccagctggtggcccagcggaggtgcgaagacatcgatgagtgccaggaccctgatacttgttcccagctctgcgtgaatctggagggcggctacaaatgccagtgtgaggaaggctttcaactggacccacatactaaagcttgtaaggctgttggatctattgcctatcttttctttaccaacaggcacgaggtcaggaagatgaccttggacagaagcgaatacacgagtctgatccctaaccttcgaaatgtggtggcactggataccgaagttgcttcaaatagaatttactggagcgatcttagccagcgcatgatctgttcaacccagctagacagggcacacggcgtgagctcatacgatacagttatcagcagggatatccaggcgcctgacgggcttgctgttgactggatccacagcaacatctattggaccgattctgtgctgggaacagttagcgttgcagataccaaaggagtgaagaggaaaactctctttcgcgagaacggttctaagccccgcgcaatcgttgtggacccagttcacggctttatgtattggactgactggggcacaccggcaaaaatcaagaaagggggcctcaacggagtcgatatctactctctggtcaccgaaaacatccagtggcctaacgggataaccctcgaccttctgagcgggagactttactgggtggacagtaaactccattcgatatctagtattgatgtaaatggtggcaacagaaagactattcttgaagacgagaaacgcctggcccaccccttctcactggcggttttcgaggacaaggtgttctggactgacattatcaacgaggcaatcttcagcgctaaccgattgacaggcagcgacgtcaacctcttggccgaaaatctgctatctccagaggatatggtgctcttccataacctgacacagccgcgtggagtcaactggtgcgaaaggaccaccttgagcaatggcggctgccaatatctgtgcctccctgctccccaaatcaatcctcatagtcctaaattcacctgtgcatgccccgacggcatgctgctcgcccgggatatgaggtcttgtctcaccgaggctgaggccgcagttgcaacccaggaaacttcaacagtgaggttaaaagtgtcatccaccgccgtgcgcacccagcacactaccacccggcccgttcctgacacaagcaggctgcccggagccaccccagggcttactactgtcgagatcgtgaccatgtcccaccaagcactgggagacgtggccggcagaggaaatgaaaagaagcctagcagcgtgagagccttgtctattgttctgcctatcgtgctgcttgtctttttgtgtcttggggttttcctcttatggaaaaattggcgcctgaaaaatatcaacagtataaacttcgataaccccgtttaccagaagacaactgaggacgaagtccacatttgccacaatcaggacggatattcatacccatcacgccaaatggtgtcacttgaggatgatgtcgct

SEQ ID NO: 15932 - DNA, 2580 bp, Artificial Sequence
  Description of Artificial Sequence: Synthetic coding sequence
atgggcccttggggttggaagctgcggtggacggtggctctcttgctagcggccgctggaacagctgtcggagacaggtgtgagagaaacgaattccagtgtcaggatggaaaatgtatatcatacaagtgggtgtgcgacggaagcgccgaatgccaggatggatcggacgagtcccaggagacatgcctgtctgtcacctgtaaaagtggtgatttctcatgtggcggacgggtgaacaggtgcattccccaattctggcgctgtgatgggcaggtggattgtgataacggctccgacgagcagggttgtcccccaaagacttgtagccaggatgagtttagatgtcacgatggaaaatgtatttcacggcaattcgtctgcgattctgacagagattgtcttgacggctctgatgaggcgagttgtccagtgctgacatgtggcccagcgtcgttccaatgtaattctagtacgtgcattcctcagctctgggcttgcgataatgatcccgactgcgaagacgggtcggacgagtggccacagaggtgcagaggcctttacgtcttccagggggactcctccccatgttctgccttcgaatttcattgtctttcaggtgaatgcatccattcatcttggaggtgcgacggaggcccggattgtaaggataagagcgacgaggaaaactgcgcagttgcaacctgccggcctgacgaatttcaatgcagcgatggaaactgcatacacggttccaggcaatgtgaccgagagtatgattgtaaagatatgagcgatgaagtcggctgcgtgaatgtgacactgtgtgaaggccctaataagttcaagtgccactccggcgagtgtattacacttgacaaggtgtgtaacatggcccgcgactgccgggactggtcagacgagcccattaaagagtgcggcaccaatgaatgtctcgataataacgggggctgttctcatgtgtgcaacgatctgaaaatcggttacgaatgcttgtgcccagatgggtttcagctcgtggctcaaagacgatgcgaagacattgatgagtgccaggatcccgatacctgttctcagttgtgcgtgaaccttgaaggcggctacaaatgccagtgcgaagagggcttccagctggacccccacaccaaggcttgtaaagccgtgggttccattgcataccttttctttacaaacaggcatgaggtgaggaagatgactttagatcgttcagagtacacctctctcatacctaacctcaggaacgtggtcgctctcgacacggaggtcgcaagtaacagaatctactggtccgacctttcccagcggatgatctgcagtacccagctagatagagcacatggggtgtctagctacgacaccgtgatttcgcgggacattcaagccccagacgggttggcggtggattggattcactcaaacatctattggactgattcagtgctcggcacagtatctgtggccgatactaagggggttaagagaaaaacccttttcagggagaacggcagtaaaccccgggcaatagtagtggacccagtgcatgggtttatgtactggacggattgggggactcccgccaagattaaaaaggggggtcttaacggtgtcgacatatattcgttagttacagagaacattcagtggccaaacggtatcaccctagacctgttaagtggcagactgtattgggtagacagcaagctccactccatctcgtccatcgacgtgaatggcgggaaccggaaaaccatcctggaggacgagaagcgactggcccaccccttctcacttgcagtgtttgaggacaaagtgttttggacagacattatcaacgaggctatattctcggctaatcgcttgactgggagcgatgtcaatcttctcgccgagaacctcctgtctccggaggacatggtgctgttccataatcttacccagcctcgcggcgttaattggtgcgaacgaactacattgtccaatgggggttgccagtatctatgtctgccagctccccaaattaatccacactccccaaaatttacctgcgcctgtcctgatggcatgctgcttgcaagggacatgagaagctgcttaacagaagccgaggctgcagtggccacacaggaaacctctactgtgcgattaaaagtgagcagcacagccgtgagaacccagcatacaaccacccgcccagtgcctgatacttcacggctgccaggcgccacaccaggactgacgactgtagaaatcgtgacaatgagccaccaggccctcggggacgttgcagggagaggtaacgagaaaaagccaagctcagtgagggcattaagtattgttttgcccatcgttctgctggtatttctgtgtctgggagtattcctcctgtggaagaactggcgcctgaagaatatcaattctatcaactttgacaaccccgtgtaccagaaaaccacagaagatgaggtgcatatttgccataaccaagacggttactcgtatccaagtaggcagatggttagcctggaagacgatgttgca

SEQ ID NO: 15933 - DNA, 2580 bp, Artificial Sequence
  Description of Artificial Sequence: Synthetic coding sequence
atgggaccgtgggggtggaagcttcgctggactgtcgctttgttattagctgcagcgggaactgccgtcggcgacagatgcgaaagaaatgaatttcaatgccaggatggcaaatgtatttcttataaatgggtctgtgatggaagcgccgaatgtcaagacggaagcgatgagtctcaagaaacgtgtttgtcagttacgtgtaaatcgggggatttcagttgcggtggtcgagttaatagatgcatcccacaattctggcgatgtgatggtcaagttgattgcgataacggaagcgatgagcaaggatgtccgccaaaaacgtgttcgcaagatgagttcagatgtcatgatggaaagtgcatttcccgacaattcgtgtgcgattcagatagagattgcttggatggttcggatgaagcatcttgccctgtgctgacttgtggacccgcaagttttcaatgcaattcttccacctgcattccacaactctgggcttgcgataatgatccagactgtgaagatgggtccgatgaatggccacaacggtgtcggggattgtatgttttccagggagatagcagtccctgtagtgcctttgagtttcattgtttgagcggagagtgtattcattcatcttggcgctgtgatggaggacctgattgtaaggataagtcagatgaagagaattgtgcagtggctacttgtcgcccagatgagtttcaatgctcggatggaaattgtattcacggttcccgtcaatgcgatcgggagtatgattgcaaagacatgtccgacgaggttggttgtgttaatgtaactttgtgtgaaggaccaaataagtttaaatgccactctggcgaatgcattacgcttgataaagtatgtaacatggcacgcgattgtcgagattggtccgatgaaccgattaaggagtgtggaacgaatgagtgcctagacaacaatggaggatgttcgcacgtgtgcaatgatctgaagattggttacgaatgcctgtgtccggatggattccagctggttgctcaaagacgctgtgaagatattgatgaatgtcaagatccagatacctgttcacagttgtgtgtaaatcttgaaggcggttacaagtgccagtgcgaagaagggtttcaactggacccacatactaaggcgtgtaaggcagtagggagtattgcatacttgtttttcaccaacagacacgaggtacgaaagatgactttggatagatctgaatatacttctctcatccccaatctaaggaacgtagttgcacttgacacggaggttgcgtctaaccggatctactggagcgatctttctcaacgtatgatttgttcaacccaattggatagagctcatggagtatcatcttacgacactgtcatttcccgagacattcaggccccagatggccttgccgtagattggattcactccaacatttactggacagatagcgtattaggaaccgtatcggttgcggatactaagggagtgaaaaggaaaactctttttcgagaaaacggatctaaaccacgagctattgttgtggatccagtacacgggtttatgtattggacagattggggaactcctgcgaaaattaaaaaaggcggactgaacggagtagacatctattctcttgttactgaaaatatccaatggccaaatggtataacgctcgatcttctttcgggacgactgtactgggtcgactctaagttgcattcaatttcgtcgatcgacgtaaatggaggaaatagaaaaactattctagaagacgaaaaacggctcgctcaccctttttcacttgcggtatttgaggataaagttttctggacagatataatcaacgaggctatcttcagcgctaatagacttacaggaagtgacgtaaatctgttggccgaaaacttgctgtctcccgaagatatggtactcttccacaatctcacacaaccacgaggagtcaattggtgtgaacggactacgctttcgaacggaggttgtcagtacctttgcctgccagctccccagatcaatccacattcacctaaatttacttgcgcgtgcccagatggtatgcttcttgctagagatatgcgttcatgtcttacagaagctgaagcagctgttgctacgcaagaaactagtacagttcgtttaaaagtgagttctaccgcggtgcgaactcagcacactaccacgcgaccggtcccagacacatccagactgccgggagctacgccaggactaaccacagttgaaattgtcaccatgtcacaccaagcactgggtgacgtggccggacgtggaaatgaaaagaagccaagttctgtgcgagctctgtctattgttctccccatagtacttctagttttcctttgtctcggcgtctttctgctgtggaaaaattggcgattgaaaaatatcaatagtattaattttgacaacccggtataccaaaagaccactgaagacgaggtccacatttgccataatcaggatggatacagttatccatccagacaaatggtctctcttgaagacgatgtggcc

SEQ ID NO: 15934 - DNA, 2580 bp, Artificial Sequence
  Description of Artificial Sequence: Synthetic coding sequence
atgggcccttggggctggaaacttcgctggacggttgcgctgctgttggccgctgccggtacggcagtgggggatcgttgcgagcgtaatgagttccagtgtcaagacggaaagtgcatatcgtataagtgggtatgcgacggatcggctgaatgtcaggatggttcggacgaatcacaggagacatgcctgagcgttacctgcaagtctggtgatttcagttgtggcggacgtgtgaatcgttgcattccccagttttggcgatgcgacggccaggtggactgtgataacggatcagatgaacaaggttgcccacccaagacctgctcccaggacgagttcagatgtcacgatggcaagtgcatttccaggcagttcgtgtgcgactcggaccgggattgcctggacggctcagatgaggcttcctgcccagtgctgacctgcggaccggctagcttccagtgcaacagttcgacatgcattcctcagctgtgggcctgcgacaatgatccagactgcgaggatggatctgacgagtggccgcagagatgccgtggtttgtatgtctttcagggtgacagttccccgtgttctgcctttgagtttcattgcttgtcgggcgaatgcatccatagtagttggagatgcgatggtggccctgattgcaaggataagagcgacgaggagaattgtgccgtagctacttgccgtccagatgagttccagtgcagcgacggaaactgcatccacggatcccgacaatgcgaccgcgagtatgactgcaaagatatgtccgatgaggtgggatgcgtgaacgtgaccctttgtgaaggaccgaataagttcaagtgccattcgggcgagtgcataactctggataaagtgtgtaatatggccagggactgtagagattggagcgatgaacccatcaaggagtgcggaaccaatgagtgcctggacaacaacggtggatgctcgcatgtgtgtaatgacctgaagatcggttacgaatgcctgtgccctgatggcttccagttggtcgctcagaggcgctgcgaggacatcgacgaatgccaagatccggacacctgtagccagctgtgcgtcaatctagaaggcggctacaaatgccagtgcgaggagggattccaattggaccctcatacgaaagcctgtaaagctgtgggcagcatcgcctacctatttttcaccaatcgacacgaggtgcgcaagatgaccctggataggagtgagtacaccagtctgattccaaatctgcgaaatgtagtggccctcgacacagaggtcgccagtaaccgcatctactggtcggatctctcccagcgcatgatttgctccactcagttagatcgagcccacggcgtgtcgagctacgatactgttatcagccgtgacattcaagccccggacggcttggccgttgactggattcattccaatatctattggaccgattccgtactgggtaccgtctcggttgccgatacaaagggcgttaaacgcaagacgctcttccgggagaatggtagcaagcccagggcgatcgtcgtggatccagtccatggttttatgtactggactgattggggcacacccgccaagattaaaaagggcggacttaatggcgttgacatctattcgttggtgacggagaatattcagtggcccaacggcataactctggacctgttgtccggccgtctctattgggtggatagtaagctccattccatctcctccattgatgtgaatggcggcaacagaaagacaatcctagaggacgagaagcggctagcgcatcccttcagcctggccgtgttcgaggataaggttttctggacggatatcataaatgaggctatcttttccgccaatcggcttacgggctcggatgtcaacctcctggcggagaatctgctgtcccccgaagacatggttctgtttcacaatctgacccaaccgcgcggagtcaactggtgtgagcgaacaacccttagtaatggcggctgccaatacctgtgtcttccggccccccagattaacccacactcgccaaagttcacgtgcgcatgccccgatggaatgctgcttgctagagacatgcggagctgtctaacggaggccgaggcggcggtggccactcaagagacatcgacggttcgactgaaggtatcctccacggctgtgcgtacccaacacacgactacacgcccggtccctgacacatcgcgactgcccggtgccacaccgggccttaccacagttgaaatcgtgacgatgtcccatcaggcactcggagacgtcgccggtcgtggaaacgagaagaagccgagctcggtgcgcgcccttagtatcgtgctcccgattgtcctcctcgtgttcctgtgtctgggcgtgttcctactttggaagaattggcgactgaagaacatcaacagcattaatttcgacaatccagtttatcagaagaccaccgaggacgaagttcacatctgccataatcaggacggctactcctaccccagccggcaaatggtgagcctggaggatgacgtcgcg

SEQ ID NO: 15935 - DNA, 2580 bp, Artificial Sequence
  Description of Artificial Sequence: Synthetic coding sequence
atgggaccctggggatggaagctccggtggactgtggcacttctgcttgccgcagcgggaactgcagtgggcgatcggtgtgaacgcaacgaatttcagtgtcaggatggaaagtgcatctcctacaaatgggtctgtgatggaagcgcagaatgtcaagatggatcagatgagtcgcaggaaacctgtctgtcggtcacttgtaagtctggcgacttctcctgcggtggacgtgtcaatcgctgcatcccacaattttggagatgtgatggccaagtggattgtgataatgggtcggacgagcagggatgcccgccaaagacctgtagccaggacgaatttagatgtcatgatgggaaatgtatatcgcgccaatttgtgtgtgactccgatcgagactgcctggatggctcggatgaagcctcgtgcccagttcttacctgcggtcctgcatcatttcaatgtaactcgagcacctgtatacctcaactttgggcatgtgataatgaccccgactgtgaagatgggagcgatgagtggccccaaagatgccgcggactctacgtgttccaaggagactcatccccttgttcagcgtttgaatttcattgtctttcaggtgaatgtattcattccagctggaggtgtgatggaggacccgattgcaaggataagtcggatgaagaaaactgcgcggtagcaacctgcagaccagatgaatttcagtgctccgacggaaattgcatacacggatcgagacaatgtgatagagaatacgattgtaaggatatgtccgacgaggtcggttgtgtgaacgtgactttgtgtgagggacctaacaagtttaagtgccactcaggggagtgtatcactctggataaagtttgtaacatggccagagattgtagagattggtcggatgagcctatcaaggaatgtgggactaacgaatgtctggataacaacggcggttgctctcacgtgtgcaacgatcttaagattggctacgaatgtctttgccctgatggattccaactcgtggcacaacgtcgctgtgaggatattgatgaatgtcaggatcccgacacctgcagtcagctgtgtgtcaacttggaaggcggctacaagtgtcaatgtgaagaaggattccaattggatcctcacactaaagcatgtaaggcagtgggttcgattgcgtacctcttcttcactaatcgccatgaggtgaggaagatgactctcgacaggtccgagtacaccagcctcatccctaacctgcggaatgtggtggcgctcgatacggaggtcgcgtccaaccgcatctactggagcgatctgagccagcgcatgatttgttctacccaattggatcgcgcacatggcgtgtcctcgtacgatactgttatttcgcgggatatccaggcacctgatggtcttgctgtggactggattcacagcaatatctactggactgacagcgtcttgggcaccgtgtcagtggcggataccaagggtgtcaagagaaagaccctgtttcgagagaacggttccaaacctcgtgcaatcgtcgtggacccagtgcacggctttatgtattggactgattggggaactcccgcaaagatcaaaaagggcgggctgaatggtgtggatatctatagcttggtgaccgagaatattcaatggccaaacggtatcactctcgacctgcttagcggacggctttactgggtggattcgaaactgcactccatttcgtccatcgacgtcaacggaggcaatcggaaaaccatcctggaagatgaaaagcgactggcacatccattctctctggcagtgtttgaagataaggtcttttggactgacataatcaatgaagcgatcttcagcgccaaccgcctcactggttccgatgtcaacttgctggcagaaaatctgctgtcccctgaggacatggttctgtttcataacttgacccaacctagaggtgtcaactggtgcgagcgtacgaccctgtcaaatggcgggtgccaatatctttgtctgccagcgcctcagatcaaccctcattcaccaaagtttacctgtgcctgtcctgacggtatgcttttggctcgcgacatgagatcatgcctgacggaagcagaggcagccgtggcaacgcaagaaacctcaactgtgagactgaaagtgtcatcgactgccgtgcggacccaacatactaccacgcgacctgtgcccgatacttcaaggcttcctggtgcaaccccaggtcttaccaccgtggaaatagtgaccatgtcgcatcaagcacttggagatgttgcaggacgaggaaatgagaagaagccttcttcggtgcgcgcactgtcgatagtgcttcctatcgtcctgcttgtgtttctctgcctcggtgtctttctgctgtggaagaactggagactcaagaacattaactccatcaacttcgacaaccctgtctaccaaaagaccactgaagatgaagtccatatttgccataaccaggatggttacagctaccccagccggcagatggtgtccctcgaagatgatgtggca

SEQ ID NO: 15936 - DNA, 2580 bp, Artificial Sequence
  Description of Artificial Sequence: Synthetic coding sequence
atgggcccttgggggtggaaacttcgatggaccgtggccctgttgttagccgcagccggaactgccgtgggagacaggtgcgagcgaaacgagttccaatgtcaggacgggaagtgtatcagctacaagtgggtgtgtgatggtagtgcagaatgtcaggacggatcagacgagtcccaggagacctgcctgtcggttacgtgcaaaagtggggacttttcctgcgggggtcgggtaaaccggtgtataccacagttctggaggtgtgacggccaggtcgattgcgacaatggttctgacgagcaagggtgtccacccaaaacttgtagtcaggatgagttcagatgtcacgacggaaaatgcatctcccgtcaatttgtgtgtgattccgatcgagattgtctggacggcagcgatgaggccagctgtcctgttctgacctgcgggcccgccagcttccagtgtaacagtagcacttgtatcccccagctgtgggcatgtgataatgatcctgactgtgaggacggatctgacgagtggcctcagagatgccgaggtctctatgtatttcaaggcgattcctcaccatgttccgcctttgaatttcattgtttgtctggtgagtgtattcacagctcatggcgatgcgacggcgggcccgattgtaaggataagagcgatgaggagaactgtgctgtcgctacttgtcgacccgacgaattccagtgctccgatggcaactgcatccacggaagccggcagtgcgaccgcgagtacgattgtaaggacatgtcagatgaggtcgggtgcgtaaatgtgacactgtgtgagggcccaaacaaatttaagtgccactcgggagagtgtattacactggataaggtttgtaatatggcacgggactgtcgtgattggtcagatgagcctataaaggagtgcggcaccaacgaatgtttggataacaatgggggctgcagtcacgtgtgcaatgacctgaaaataggctatgaatgcctttgtccggatggattccagctggtggcccagaggagatgtgaagacatagatgagtgccaggatccggacacttgctcacagctgtgcgtaaacctggagggcggctacaaatgtcagtgcgaggaaggattccagctagaccctcataccaaagcttgcaaggctgtcggatccatcgcttatttgttcttcacaaaccgtcatgaggtgcgaaagatgacgttggaccgctcagagtatacctcccttatccctaacttacggaacgtggtggcgcttgacacagaggtggcctccaacagaatttactggtctgatctgagtcagcgaatgatttgttctacccagcttgaccgagcacatggggtcagctcctatgataccgtgatctcgagagatatacaggctccagacgggctagctgtggattggatccacagcaacatctactggaccgacagtgtcctgggaaccgtatctgtggccgatacaaagggcgtcaagcggaaaacactgtttagggagaacgggtctaaacctagggctatcgtggtcgatccagttcacggattcatgtattggaccgactggggaacccccgctaaaattaagaagggggggctgaatggggtcgacatctatagcttggtcacagagaatatccaatggcccaacggcatcaccctcgacctactctccggaagactgtactgggtggacagtaaactgcattccatttctagcatcgatgttaatggaggtaaccggaagacaatcctggaagacgaaaagagacttgctcatccgttttctctggctgtattcgaggataaagtgttttggacagatatcattaatgaagcgattttcagtgctaatagattaacaggcagcgacgtcaaccttctagctgaaaatctcctctcaccagaggacatggtgctatttcacaacctcacacagcccagaggagtgaattggtgcgaacgaactaccctgagtaacggaggctgtcagtacctgtgcctgccagcgccacagattaatccgcactcccctaagttcacatgcgcttgtccagatggcatgctgcttgcccgggatatgaggtcttgcctaacagaagctgaggcggctgtggccacccaggagacgagtacggtaagactaaaagtcagctcaacggccgtgagaactcaacataccacaacccgccccgtgcccgacacatccagactcccgggcgccacccccgggttaaccacagttgaaatcgtgactatgtcccatcaggccctcggagacgtggccggcagaggcaacgagaagaagcccagttctgtaagggctctatctatcgtcttaccaatcgttcttctcgtgtttctgtgccttggcgtcttcctgctgtggaagaattggcgcctaaaaaacatcaatagtatcaattttgacaaccctgtttaccaaaagaccaccgaagacgaagtgcatatttgccacaaccaggatggctattcctatccgagtcggcagatggttagcctggaggatgatgtagca

SEQ ID NO: 15937 - DNA, 2580 bp, Artificial Sequence
  Description of Artificial Sequence: Synthetic coding sequence
atgggaccatggggttggaaacttcgttggacggtggcacttcttcttgcagcagcaggaaccgctgtcggcgatcgctgcgaacgaaatgaatttcagtgccaagatgggaagtgcatctcctacaagtgggtgtgtgatggttccgcagaatgtcaagatggaagcgatgaaagccaagaaacctgcctttcggtgacctgcaaaagtggggatttcagctgtggcggaagagtgaatagatgtatcccccagttttggcggtgtgatggtcaagtggattgtgataacggatctgacgagcaaggttgtcctcccaagacttgctcacaggatgagttccggtgtcacgacggtaagtgtatctcacggcagttcgtctgcgattccgatagagactgccttgatggatcagatgaagcctcgtgtccagtgcttacttgtggaccagcatcctttcagtgcaactcatcgacctgcatcccccagttgtgggcatgcgataatgatcccgactgtgaagatggatccgatgaatggccacaaagatgccgcggactttacgtgtttcaaggagacagctcgccatgttcagcgtttgaatttcactgtcttagcggggagtgtattcattcctcgtggaggtgtgacggtggacctgattgtaaagacaagtccgacgaggagaactgcgcggtggccacctgccgtcctgatgagtttcagtgctcggatgggaactgtattcatggatcgagacaatgcgacagagaatacgattgtaaggacatgtcagacgaagttggttgtgtgaacgtgaccctctgtgaaggtcctaacaaattcaagtgtcatagcggtgaatgtataacccttgataaggtctgtaacatggcaagagattgtcgagactggtcagatgagcctatcaaagaatgtggaactaatgaatgtctggacaacaatggcggatgcagccacgtgtgtaacgatctgaaaattggatacgagtgtctttgtcctgacggattccaattggtcgcgcaacggcgctgcgaggacatcgatgagtgtcaggacccagacacctgctcacagttgtgcgtcaatcttgagggaggttacaagtgtcaatgtgaggagggattccagcttgacccgcatactaaggcatgcaaggcggtgggttctatagcatacttgttctttactaaccggcacgaagtgcgcaagatgacccttgaccgcagcgagtacacctccctcattccaaaccttagaaacgtggtggcacttgacactgaggtggcctcgaatcgcatttactggtcggacctgtcgcaacgtatgatctgttcgacccagctggatagagcacatggagtgagctcgtacgatactgtgatttcccgggatattcaagcaccagatggacttgccgtggactggattcattccaatatctactggacggattcggtccttggtactgtgtccgtggcggacacgaagggcgtgaagcgaaagaccctgttccgcgaaaatggttccaaaccacgcgcaattgtggtggatcctgtgcacgggtttatgtactggactgactggggtacccctgcaaaaatcaaaaagggaggactgaatggtgtggacatatactccctcgtcactgagaatatccaatggccaaacggcattactctggatcttctgtcggggcggctttattgggtggacagcaaactgcactctatctcatcaattgacgtcaacggcggaaaccgcaagaccattcttgaggacgagaagcgtcttgcccatcccttttcactggccgtctttgaggataaggtgttctggaccgacatcatcaacgaagcaatcttttcggcgaatcggctgaccggttccgatgtgaatctcctggcagaaaacctgctttccccagaagatatggtcctgtttcataatctgactcagccgaggggtgtcaattggtgtgagcgcacgaccctgtccaacggtggctgtcaatacctttgcttgccagcacctcagatcaaccctcacagccctaaattcacctgtgcctgtcctgatggtatgcttttggctagagatatgcgatcctgcctgaccgaggcagaagcagcggtggcaacgcaggagacttcgaccgtgaggctgaaagtgtcctcgaccgcagtgagaacccaacatacgactaccaggccagtgcctgacacttcacggctgccaggggcaacccctgggttgactacggtggagattgtgactatgagccatcaagccctgggggatgtggcaggccggggtaacgaaaagaagccatcgtccgtgcgcgcccttagcattgttctgcctatcgtcttgttggtctttctttgcctgggtgtgtttctgctgtggaaaaactggaggctgaagaatatcaactcgattaactttgacaatcctgtgtaccagaaaaccactgaagatgaagtccatatttgtcacaaccaagacggatactcctacccatcgaggcagatggtgtccctggaggacgatgtggca

SEQ ID NO: 15938 - DNA, 2580 bp, Artificial Sequence
  Description of Artificial Sequence: Synthetic coding sequence
atggggccctggggttggaaacttcgttggaccgtcgcacttctgcttgcagccgcaggaaccgcggtcggtgacagatgtgaaaggaatgagtttcaatgtcaagacggaaagtgtatttcatacaagtgggtgtgtgatggtagcgcagaatgtcaggatgggtcagacgagtcgcaggaaacgtgtctgagcgtgacgtgtaaatccggtgatttttcgtgtggaggccgtgtgaaccggtgtattccacaattttggaggtgcgatggtcaggtggattgtgataacggatccgatgagcaaggttgtcctccgaaaacgtgctcccaagacgaattccgttgtcacgacggtaagtgcattagccgccaatttgtgtgtgattcggatcgtgattgtcttgatggtagcgacgaggcaagctgccctgtccttacttgtggtcctgcctcctttcaatgcaactcttcgacctgcatccctcagctttgggcatgcgacaatgatccagattgcgaggatggttccgacgagtggcctcaacgctgtagagggctttacgtgtttcaaggagacagctcgccttgtagcgcgtttgagtttcactgcctttccggcgaatgcattcactcatcctggagatgtgatggcggaccggattgtaaggataaaagcgatgaagagaattgtgctgttgctacttgtcggccggacgaatttcaatgtagcgatggtaattgtattcatggatctcgccagtgcgatagggaatacgactgtaaggacatgagcgacgaggtgggttgtgtgaatgtcaccctctgtgagggacctaacaagttcaaatgtcattcgggagagtgcattactctcgataaagtctgtaatatggcaagagactgtcgcgactggagcgatgagcccatcaaggagtgtgggactaatgagtgtcttgataacaatggcgggtgctcccacgtgtgtaacgatctgaagataggctacgagtgtctttgcccggacggatttcagcttgtggcccaaagacggtgtgaggacattgatgagtgccaggatccagatacctgctctcagctttgtgtgaacctcgagggcgggtacaaatgccaatgcgaggaaggttttcaattggatccacacactaaggcatgtaaggccgtcggtagcatagcttacttgttctttacgaacagacacgaggtccgtaagatgacccttgatagaagcgaatacacctccctgattcctaatctgcgtaatgtggtcgctctggacactgaagtggcgtcgaataggatttactggtccgatctctcgcagcgcatgatctgttcaacccagttggatcgagctcatggggtcagctcgtacgatactgtcatttcaagagatatacaggcacctgatggactcgcagtggattggattcattcaaacatctactggactgatagcgtcttgggtactgtgtccgtggcagataccaagggagtgaagagaaagaccctttttagagaaaacggttccaagccacgagcaattgtggtcgaccccgtccatgggtttatgtactggaccgattggggtaccccggccaagattaagaagggcggactcaatggagtggatatctactccctggtgactgaaaacattcagtggcccaatggtattacccttgacctgctgtcaggcagactctactgggtggacagcaaactgcattcaatatcgtcaatcgacgtgaacggcggaaatcggaaaaccatactggaagatgaaaaaaggcttgcgcacccattttcgcttgcggtgtttgaagataaagtgttttggactgacattatcaatgaggcaatcttttcagcgaacaggctcaccggatcggatgtcaatctgctcgcagagaatctcctctcgccggaagatatggtgcttttccataacctgacccaacccagaggggttaactggtgtgaaaggaccactctgtcaaacggcggatgtcaatacctttgcctgcctgcgccacagataaacccccactcgccaaagtttacctgtgcctgtcctgatgggatgctgctggcgcgggatatgcgatcgtgcctgactgaagcggaggcagcagtggcaactcaggaaacctcaaccgtgagactgaaagtctcctccactgcagttcgcacccagcataccaccacccgccccgtcccagataccagtagactgccaggagcaactcctggtcttactaccgtcgagatagtcaccatgtcacatcaagcactgggagatgtggcaggcagagggaacgaaaagaagccttcgtccgtgcgagcactctcgattgtgctgcctattgtgttgcttgttttcctttgccttggtgtctttcttctttggaagaactggaggttgaagaacataaacagcattaacttcgacaacccagtctaccagaaaacgacggaagatgaggtccatatctgccataaccaggatggttactcgtacccatcgcgccagatggtgtcgctggaagatgatgtcgcg

SEQ ID NO: 15939 - DNA, 2580 bp, Artificial Sequence
  Description of Artificial Sequence: Synthetic coding sequence
atgggcccttggggttggaaactccggtggactgtggctttgttgctggcggcggccgggaccgccgtgggagacaggtgcgaacgcaacgagttccagtgtcaagatggaaaatgcatctcatacaagtgggtgtgcgacggatcggctgaatgtcaggacggctcggatgaatcccaagaaacttgcctgtcggtcacgtgcaagtcaggtgacttctcctgtggcggaagggtaaaccgctgtatcccccagttctggcgctgcgatggccaggtggattgtgataacggatcggacgagcaaggatgcccgccgaaaacctgttcacaagacgaattccggtgtcacgacggaaagtgcattagtcggcagttcgtgtgcgactcggatcgcgactgtctggatggatccgatgaagcatcgtgcccggtgctcacttgcgggccggcgtcctttcaatgcaactcatctacctgcatccctcagttgtgggcctgcgacaatgacccagactgcgaggatggctccgacgagtggccccagcggtgccgcggcctgtacgtattccagggagatagctcaccatgctcagcctttgaattccactgtctgagcggtgagtgcatccacagcagctggcggtgcgacggtggaccagactgcaaggacaagtcggacgaggaaaactgcgccgtggcgacctgccgcccggatgaatttcagtgctcggacggaaactgcatacatggatcgcgccaatgcgacagggaatacgattgcaaagacatgagcgacgaagtggggtgcgtgaatgtcactctgtgcgagggcccaaataaattcaagtgtcatagcggcgaatgtatcactcttgacaaggtctgtaatatggcccgcgactgccgagactggtctgatgaaccaatcaaagaatgcggaactaatgaatgccttgacaacaatggaggctgttcccacgtgtgcaacgatctgaagatcggatacgaatgcctgtgcccggacgggttccaactcgtggcacagagaaggtgcgaagatattgacgagtgtcaggaccccgacacctgctcacaactttgcgtgaacctcgaaggaggatacaagtgccagtgtgaggaggggtttcaacttgacccacacaccaaggcctgtaaggcggtgggaagcatcgcatacctgttcttcaccaaccggcacgaggtgcggaaaatgaccctggatcgctcggaatatacctcgctgatcccgaacctgagaaacgtcgtcgccctggacaccgaagtcgcttcgaacaggatctactggtccgatctgtcgcagcggatgatctgttcaacccagctcgaccgcgcgcatggtgtgtcgtcctacgatacggtcatctcgagagacatccaagctccggatggcctcgctgtggactggattcacagcaacatctactggaccgacagcgtcctgggaaccgtcagcgttgcagacaccaagggcgtgaaacgtaagaccctcttcagagaaaatggctccaagcctcgggccatcgtggtggacccggtccacggattcatgtactggactgactgggggacccctgccaagatcaagaaaggaggactgaacggggtggacatctacagcctggtgactgagaacattcagtggcctaatggcatcacgctggatctgctgagtgggcgcctgtactgggtggactcgaagctgcactcaatttccagcatcgacgtgaacggtggcaatagaaagactatcctggaggatgaaaagagactggcgcacccgttctcgctcgccgtctttgaggataaagtgttttggactgatatcatcaatgaagcaatcttctcagctaaccgcctgactggaagcgatgtgaatctcctcgcagaaaacctgctgtccccggaggacatggtgctcttccataatctgactcagccaagaggcgtgaactggtgcgagcgaactacgctttcgaacggcggatgccagtacctttgcctcccggcacctcaaattaatccgcattccccaaagttcacttgcgcgtgcccggatggtatgctcttggccagggatatgcggtcgtgtttgacggaagcagaggccgccgtcgccacccaggagacttcaactgtccggctgaaagtgtcctcaaccgcagttcgcacccaacataccacgacccgccccgtgcctgacacctcccgcctcccaggagcgactcccggactcaccactgtcgaaatcgttactatgagccatcaggccctgggagatgttgcggggagaggaaacgagaagaagccatcaagcgtgcgggccttgtccattgtcttgccgatcgtcctgctggtgttcctttgcctgggtgtgttcctgctctggaagaattggagactcaagaacatcaactccatcaactttgacaatcctgtgtaccaaaagaccactgaggatgaagtccatatctgccacaaccaggatggatattcttacccgtcccggcagatggtgtccctcgaggatgacgtggct

SEQ ID NO: 15940 - DNA, 2580 bp, Artificial Sequence
  Description of Artificial Sequence: Synthetic coding sequence
atgggaccctggggctggaagttgagatggacagtggccctcctgctcgcagccgcgggcacagccgtgggcgacaggtgcgagagaaacgagttccagtgccaggacggtaagtgcatctcttataagtgggtctgcgatggtagcgccgagtgccaggacggttctgacgaaagtcaggaaacatgcctgagcgtcacatgcaagagcggtgacttttcctgcggaggtagagtgaataggtgcatcccccaattctggcgctgcgacggacaggtggactgtgacaacggtagcgatgagcagggttgccccccaaaaacgtgctctcaagacgagttccgctgtcatgacggtaagtgcatctctaggcaatttgtttgtgacagtgacagggactgtctggatggaagcgacgaagcttcatgtcctgtactgacgtgcggtcctgcctctttccagtgtaactcctcaacctgtatcccacagctgtgggcgtgtgataacgatccagattgcgaggacggatccgacgagtggccacaaaggtgtcgcggactgtatgtttttcagggagacagttccccctgttccgctttcgaattccactgcctgtctggtgagtgcattcattcttcttggcgctgtgacggaggtccagattgcaaggataagtcagacgaagagaactgtgcggttgcgacatgcagacctgacgagttccaatgtagcgatggaaactgcattcatggtagcagacagtgcgaccgcgagtacgattgcaaggacatgtccgacgaagtaggctgtgttaacgtgactctttgtgagggacctaataaattcaaatgccacagcggagagtgcattaccttggataaggtgtgcaatatggctagagactgccgcgattggtcagatgaacccatcaaggagtgcggcactaacgagtgcctggataataacggtggctgttcccatgtgtgcaacgaccttaagattggatatgagtgtctgtgccccgatggttttcagttggtcgctcagaggaggtgtgaagatatcgatgaatgtcaagatccagatacatgttcacaactttgcgttaacctggaaggaggttataagtgccaatgcgaggagggttttcagcttgatccccacacgaaggcctgcaaggccgtgggctccatagcgtacttgttctttacgaaccgccatgaggtgcgcaagatgactttggatcgcagtgagtacacaagcctgattcccaacttgagaaacgttgtcgccttggacacagaggttgcctcaaatcgcatctattggtctgacctgtctcagaggatgatctgctcaacccaactcgaccgcgcacacggcgtgagctcctacgatactgtgatttcaagggatatccaggcccctgacggcttggctgtagactggatccacagcaatatttattggactgattcagtgctgggcaccgtgagcgtcgccgacacgaaaggtgtgaagcgcaaaacactgtttagagaaaatggctcaaagccccgcgctatcgtcgtggaccctgtacatggttttatgtattggaccgattggggcacacctgccaaaatcaaaaagggcggactgaacggcgtggatatttactccctggtgacagagaacatccagtggcctaacggtattacattggacctgcttagtggccgcctctactgggtcgattcaaagctgcacagtatctcctccattgacgtaaacggtggcaatagaaagacgatcttggaggatgagaagaggcttgcacaccccttctcactggctgttttcgaggacaaagtcttttggaccgacattattaatgaggcaattttcagcgccaatagacttaccggtagcgacgtgaatttgctggccgagaacttgcttagccccgaggacatggttttgttccataacctcacacagcccaggggtgtaaactggtgtgagagaactaccctgagcaacggcggttgccagtacctttgccttcctgcgccacaaattaatccgcattccccaaagtttacctgcgcctgccccgacggtatgttgctcgccagagacatgcgctcatgcctcactgaagcagaggctgccgttgccacacaggaaacctctactgtaagattgaaggtctctagcactgctgtcaggacccagcacacgactacccgccctgtgcctgatacctccaggctgcctggcgccaccccaggcctgacgaccgtggaaatcgtgactatgagccatcaggccttgggcgatgttgccggtcgcggtaatgagaaaaaaccatcctccgtgcgcgccctgagcatcgtgctgcccattgtgctcttggtcttcctgtgtctcggagtgttcctgctctggaagaactggcgccttaaaaatatcaacagcattaacttcgataacccagtctaccagaaaactacagaggacgaggtgcacatctgccacaatcaggacggctactcttacccttcccgccagatggtaagtctggaagacgacgtcgct

SEQ ID NO: 15941 - DNA, 2580 bp, Artificial Sequence
  Description of Artificial Sequence: Synthetic coding sequence
atggggccgtgggggtggaaattacggtggactgtggcacttttgctcgctgctgccggcacagcagtgggcgacagatgtgagcgcaatgagtttcaatgtcaggatgggaaatgtatcagttataagtgggtctgtgatggaagtgcggaatgccaggacgggagcgacgaatcacaggaaacgtgtctgagtgtgacatgcaagtcaggtgacttcagctgtggcggaagagtgaatagatgcattcctcagttctggcgatgtgatggccaggtggattgcgacaatggatctgatgagcagggctgtccgcctaagacctgtagccaggatgagttccggtgccacgatggcaaatgtatctcacgacagtttgtttgcgactccgatagagactgcctggatggcagtgacgaagctagttgccctgtgctcacttgcggaccggccagtttccagtgcaactcctcaacatgcataccgcaactttgggcttgcgataacgatcccgattgtgaggatgggtcagatgaatggccacagcgatgccggggactctacgtatttcagggagactcatcgccctgttccgccttcgagttccattgcttgtcaggggagtgcattcattccagttggcgctgcgacggaggacccgactgcaaggacaaaagtgacgaagagaattgtgcggtggctacttgccgccctgacgaattccagtgttctgacggcaactgtatccacgggtctaggcaatgcgacagggaatatgattgtaaagacatgtctgacgaagtgggctgcgttaatgtcactctgtgtgagggacccaacaagtttaagtgccacagtggggagtgtatcacattagacaaagtatgcaacatggcccgagattgcagagattggagcgacgaacctataaaggagtgtggaacgaatgaatgcctggacaataacggcggctgcagtcacgtgtgcaacgatctcaagatcggttatgagtgtctgtgtccagatggatttcagcttgtagcacagcgtcgatgtgaagatatcgatgagtgccaggatcctgacacatgttcccaactgtgcgtgaatcttgaaggagggtacaagtgccagtgcgaagaaggctttcagttggatccccacactaaggcctgcaaggccgtgggctccatagcgtacctgtttttcacaaatcgccacgaggtgagaaagatgaccctcgacagatcagagtacactagcctaatccccaacttgaggaatgtggtggctctggacactgaagtggcctccaaccgcatttattggagtgatttatctcagcggatgatttgtagcactcagctggatcgagcacacggtgtgtcaagctatgatactgttattagcagggacattcaggcgcctgacggtctggcagtggattggatacattctaacatttactggaccgactccgttctagggactgtctccgttgcagataccaaaggtgtcaagcggaagaccctgttcagagagaatggctcgaaacctcgcgccattgtcgtcgatcccgtacacggcttcatgtattggactgattgggggactccagctaaaataaagaaaggtggactgaatggggtggacatctactctttggtaactgaaaacatacagtggcccaacgggataactctggacctgctgtcgggacggctgtattgggtcgatagtaaactccactctatcagctccatcgatgtgaatgggggtaatagaaagaccatcctggaggatgaaaagcgcttggctcacccgttttccttagcggtgttcgaagacaaggttttttggacagatattatcaatgaagccatattctctgctaataggttgaccggttccgacgtcaatttactggctgagaatctgctgagtccggaggacatggtgctgtttcacaaccttacccagcctcggggggtgaactggtgcgagaggaccacactctcaaacggtgggtgccagtacctttgcctccccgctccccagatcaacccccattcccctaagtttacctgcgcctgtcctgatggaatgctactggcccgggacatgaggagttgccttaccgaggccgaggcggccgtcgccacccaagagactagcaccgtccgtctgaaggtaagttccactgccgtgagaacccagcacactacaaccagacccgtgccagatacaagtcggctgcctggagctacgccaggactgacaaccgttgaaatcgttactatgagccaccaggccctgggggatgtagccgggagaggcaatgagaagaaaccttcttctgttagggctttgagcattgtactgcctatcgtgcttctcgtctttctgtgcctcggggtctttcttctgtggaaaaattggcgattgaaaaatatcaattccattaatttcgacaatccggtgtaccagaagaccactgaggacgaagtgcacatttgtcacaatcaagatggctactcctacccatcccgccagatggtgtctttggaggacgacgttgca

SEQ ID NO: 15942 - DNA, 2580 bp, Artificial Sequence
  Description of Artificial Sequence: Synthetic coding sequence
atgggcccttgggggtggaagctccgttggaccgtcgcattgttgctggcagccgcaggcactgcagtcggagacagatgtgagcggaacgagtttcagtgtcaagacggtaagtgcatttcatacaagtgggtgtgtgacggatcggctgaatgccaagacggaagcgatgaatcacaggaaacctgtctctcggtgacctgcaagtcgggcgactttagctgcggcgggcgagtgaatagatgtatcccacagttctggaggtgtgacggacaggttgactgtgataatggaagcgatgagcagggttgtcctcctaaaacctgttcacaggatgaattcaggtgtcatgatggcaaatgcatctcccgccaattcgtgtgtgactcggatcgcgattgcctcgatggatcagatgaagcatcatgtcctgtgcttacttgcggacctgcgtcgtttcagtgtaactcaagcacttgtatcccacaactttgggcctgtgacaatgaccccgattgcgaagatggcagcgatgaatggccccagaggtgtaggggtttgtacgtgtttcagggagattcttccccatgttcagcctttgaattccattgcctgtccggcgaatgtatacatagttcctggcggtgtgatggtggacctgactgtaaggataagtcggatgaggaaaactgtgcagtggccacttgtcgaccagatgaatttcagtgttcagatggtaactgtatccatgggtcgcgccaatgcgatcgcgagtacgattgtaaagatatgtccgatgaagttgggtgcgtgaacgtaaccctctgtgagggacctaataagtttaagtgtcatagcggcgagtgcattaccttggataaagtgtgtaacatggcaagagactgtcgtgattggtcggacgaacccattaaggaatgcggaaccaacgagtgtctggataacaacggaggatgcagccatgtgtgcaatgacctgaagatcggctacgagtgcctgtgtcctgatgggttccaactggtcgcgcaacgcagatgcgaggacatagacgagtgtcaagaccctgacacttgttcacagttgtgtgtgaacctcgaaggaggatataagtgccagtgcgaggaagggtttcaacttgatccgcatactaaagcgtgtaaggcagtgggatcaattgcatacctgttctttaccaatcgtcacgaagtgcgaaaaatgacgctcgatcggtccgaatacactagcctgattccgaacctgagaaatgtcgtcgcactcgatactgaggtcgcatcgaaccggatttactggtcggatctgtcacaaaggatgatctgttcgactcaacttgaccgagcacacggtgtctcttcgtacgacaccgtcatttcccgtgatattcaagcacctgatgggctcgcggtggattggattcatagtaacatatactggactgatagcgtccttggcactgtgagcgtggcagataccaaaggcgtgaagcggaaaactctgttccgcgaaaatggatcgaagcctcgagccatcgtcgtcgaccccgtgcatgggtttatgtactggaccgactggggaaccccagccaagattaagaaaggtggtcttaacggcgtcgacatctactctctcgtgactgagaatattcaatggccaaatggtattacgcttgatctgctgtccggacgcctctactgggtggattccaagctgcattccatttcatcaatcgacgtgaacggggggaatcgaaagaccatcctggaggacgaaaagcgactggcgcaccctttttcgctcgcagtattcgaagataaggtgttctggacggacattatcaacgaggcaatcttttcggccaatcgactcaccggaagcgatgtcaatctgctcgctgaaaaccttctttcgcctgaagatatggtgctgtttcacaacctcacgcagcctagaggagtgaactggtgcgaaagaaccaccctctccaacggcggttgtcagtatctgtgtctgcccgccccccagattaatccacacagccctaagtttacctgtgcctgtcctgatggaatgctccttgcgagagatatgagatcctgtctgaccgaagcggaagcagccgtggcaacgcaagagacgtcgactgtgaggctgaaggtgtcgagcaccgcagtccgtacccagcacactaccacccgccctgtcccagacacctcgcgcctccctggtgctacccccgggcttaccactgtcgaaatagttactatgtcccatcaggctcttggggacgtggcaggacggggaaatgagaaaaaaccttcgtccgtgagagccctttcgattgtgctgcctattgtgttgctggtctttctgtgtctcggtgtctttctgctgtggaagaattggagactgaagaatatcaactccatcaacttcgacaaccccgtgtaccagaaaaccactgaggacgaggtgcatatttgtcataaccaagatggatactcatacccgtcgcggcaaatggtatcgcttgaagatgatgtggca

SEQ ID NO: 15943 - DNA, 2580 bp, Artificial Sequence
  Description of Artificial Sequence: Synthetic coding sequence
atgggcccctggggttggaagctgcgctggaccgtggcgttgcttctcgcggcggccggaaccgctgtgggcgaccgctgcgaaagaaacgaatttcagtgccaggatgggaagtgcatcagctacaaatgggtgtgcgacggaagcgcagagtgccaggacggttctgatgagtctcaggaaacttgcctcagtgtgacatgcaagtcaggcgacttctcctgcggcgggcgggtcaatcggtgtattccccagttttggaggtgtgacgggcaggtggactgtgataacgggtccgatgagcagggatgcccccctaagacctgtagtcaagatgagttccgttgccacgatgggaaatgcataagcagacaattcgtctgtgatagtgacagggattgtctggatggaagcgatgaggcttcctgtccggtcctgacgtgtggccctgccagcttccagtgcaatagttcaacttgtataccgcagctttgggcgtgcgataatgatcccgactgtgaggacggctctgacgaatggcctcaaaggtgcagaggcttgtatgtgttccagggtgattcaagcccctgctcagcgtttgaattccactgtctctctggtgaatgcatccatagctcatggcgctgcgacggaggacctgattgtaaagataagtccgacgaagagaactgcgctgtggccacctgtaggcctgatgaatttcaatgttccgacgggaactgtatccacgggtcccggcagtgcgatcgagagtacgactgcaaggacatgagcgatgaggtggggtgtgttaatgtgacactatgcgaaggtcctaacaagttcaaatgccactcgggggaatgtatcacactagacaaagtgtgcaatatggcccgagattgcagagattggtccgatgagccgataaaggagtgcgggacaaatgagtgtctggacaataacggaggctgttcccacgtgtgtaacgacctgaaaataggctatgagtgcctatgtccagacggatttcagttggttgcgcaacggcgatgtgaagacatagatgaatgccaagatcccgatacctgctcccagctgtgtgtgaatctggaaggcgggtataaatgtcagtgcgaggagggctttcagctggatcctcacacaaaagcctgcaaggcagtcggctctatcgcttatttgttctttactaatcggcatgaagtgaggaaaatgaccttggatcgttctgagtacacatcactgatccccaatttacggaatgtggtcgccctagataccgaggtcgcgagtaacagaatctactggtccgatctaagccaaagaatgatctgtagcacacaattggaccgagcccacggtgttagttcgtacgacacggtgatctcaagagatattcaggcgccggacgggctggccgtggactggatacattccaacatatattggaccgactccgtcctggggactgtctctgtggcagacacaaagggggtgaagaggaagacactctttcgcgaaaacgggtcaaagccacgggctatcgtggtggatcctgtgcatgggttcatgtactggacagattgggggacacccgccaagatcaagaagggcggcctgaatggtgtggatatttactctttggtgaccgaaaatattcagtggcccaacgggattacactggacctgttgagcggtcgcctctattgggtggattcgaaattgcactccatctccagcatagatgtcaatggcgggaaccggaaaactattttggaggacgaaaagcggctagcccaccccttttctctggccgtctttgaggacaaagtcttctggacggacatcatcaatgaggccatctttagcgccaataggcttaccggcagcgatgtcaatctgcttgccgagaatcttctgtcccccgaggacatggtgttattccacaacctaacccagccaagaggggtgaactggtgtgagcggaccacgctgagcaatggtggttgccaatacctgtgcctgcctgcaccacaaatcaacccacacagtcccaagttcacctgcgcttgtccggacggcatgctgttggcaagagacatgcggtcttgtctgacagaggccgaggccgccgtggccacccaggagacaagtacggttcggctgaaggtgtcctcaacagctgtgcgcacgcagcatacgaccacgagacccgtgccagatacgtcccgcctgcctggtgccacccccggcctcaccaccgtggaaatcgtcactatgagccatcaagctctcggcgatgtcgccggaagggggaatgagaagaaaccttcatctgtccgggccctctcaatcgtcctgcctatcgtgctgctcgtcttcctgtgtctcggagtgtttctcctctggaagaattggcggctgaagaacatcaatagcatcaacttcgataatccagtctaccagaaaacgacagaagatgaggtacacatctgtcataatcaggacggatattcatacccctcacgacagatggtgtctttagaagatgacgtggca

SEQ ID NO: 15944 - DNA, 2580 bp, Artificial Sequence
  Description of Artificial Sequence: Synthetic coding sequence
atgggtccttgggggtggaaactgaggtggactgtcgcactgcttctggcagccgcaggcactgcagtgggggacagatgtgaaagaaacgagtttcaatgtcaagatggaaagtgtatctcgtacaagtgggtgtgtgatggatcagctgagtgccaagacggttcggacgaatcgcaggaaacttgcctctccgtgacctgtaagtcaggcgatttttcgtgtggtggtcgtgtgaatcgctgcattcctcaattttggcggtgtgacggacaagtggattgtgataatggatcggatgagcagggatgtccacctaaaacttgctcgcaagacgaatttagatgtcacgacggtaagtgcattagcagacaatttgtgtgtgactcggatagggattgcctcgatggtagcgacgaagcaagctgccctgtgctcacctgcggccctgcctcatttcagtgtaactcctccacttgtataccacaactctgggcctgcgataacgatccagactgtgaggatggatcagatgaatggccacaaaggtgccgcggcttgtacgtgtttcaaggtgattcgtcaccctgttcagcatttgaatttcattgtctgtccggagaatgtattcatagcagctggcggtgcgatggaggaccggactgcaaggataagagcgacgaagagaactgtgcagtggcaacttgcaggccggacgaatttcaatgtagcgatggcaattgtatacatggttcgagacaatgtgatcgtgaatacgattgcaaggacatgagcgatgaagtgggatgtgtgaatgtgaccctttgtgaaggtcctaataagtttaagtgccattctggagagtgcattacgcttgataaggtttgtaacatggcccgggattgcagagactggagcgacgaacctattaaggaatgcggcaccaatgaatgcctcgacaataatggaggctgttcgcacgtgtgtaacgatctgaagattggttacgagtgtctttgtccggatggatttcagcttgtcgcacaacgcaggtgtgaagatatcgacgaatgtcaagacccagacacctgctcgcagctctgtgttaacctcgaaggtggctataagtgtcaatgtgaagaaggttttcagctggatcctcatactaaagcctgcaaggcagtggggtcgattgcttacctgtttttcactaatcggcatgaggtgcgcaagatgaccttggacagatcagaatacacttccctcattccaaaccttaggaatgtcgtcgccttggacacggaggtggcctccaaccggatttactggtccgatctctcgcagagaatgatctgctccacccaacttgatcgcgcccacggagtcagctcgtacgataccgtcatttcccgtgatatccaggcaccagacggtctggccgtcgattggattcactccaacatctactggaccgattcggtgctgggaactgtttccgtcgcggacactaagggtgtgaaaagaaagaccctttttcgggaaaatgggtccaagccccgcgcgattgtggtcgatccggtgcacggttttatgtactggactgattggggcacccctgcaaagattaagaaaggcgggctcaacggagtcgacatttactcgcttgtgaccgaaaacatacaatggcctaatggcattactcttgatctgctgtctggcagactttactgggtggactcaaaacttcactccattagcagcattgatgtcaatggaggaaaccgcaagactatcctggaggatgaaaagcgccttgcacatccattctcacttgcagtgttcgaagataaagtgttttggaccgacataatcaatgaagcgatattcagcgccaacaggctgaccggctcagatgttaatctgcttgcagaaaacctgcttagccctgaggatatggtgctctttcataaccttactcaacctcgaggtgtgaattggtgtgagagaaccactctttccaacggaggctgtcagtacctctgcttgcccgcaccacagattaacccgcatagccccaaattcacctgtgcgtgtcctgacggtatgcttctggcccgcgacatgcgctcctgcctcactgaagccgaagcagcagtggctacccaagaaaccagcaccgtgaggctgaaggtgtcgtcgactgcagtccgtacccaacacacgaccacgcgacctgtgccagataccagccgtttgcctggggcaacgccggggttgaccaccgtggagatagtgactatgtcccatcaggccctcggagatgtcgcaggaagaggaaacgagaaaaaaccttcaagcgtgagggccctctcaatagtgctgcctattgtgctgctggtgttcttgtgtcttggggtattcctgctttggaagaattggcggctcaagaacatcaactccataaactttgataatcctgtgtaccaaaagaccactgaagatgaggtccacatttgtcataaccaggatggctactcgtacccttccagacaaatggtgtcgctcgaagatgatgtggcg

SEQ ID NO: 15945 - DNA, 2580 bp, Artificial Sequence
  Description of Artificial Sequence: Synthetic coding sequence
atgggcccatggggatggaaattgagatggaccgtggctctgttgctggccgcggcgggaaccgccgtgggagacaggtgcgaacggaacgaattccagtgccaggatggaaaatgtatttcgtacaaatgggtctgtgacggctcggccgaatgtcaagacggctctgacgagagccaagagacttgcctgagcgttacctgtaagagcggagacttcagctgcggcggacgggtaaatcggtgcatcccgcagttctggcgatgcgacggccaggtcgattgtgataacggatcagatgaacaagggtgtccgcccaagacttgctcgcaggatgagttcaggtgccatgacggaaagtgcatttcgcgccagttcgtctgtgactccgaccgggactgtctcgatgggtccgacgaggcgtcatgccccgtcctgacttgtgggcccgcctccttccagtgcaacagctcaacctgcatcccccagctgtgggcctgtgacaacgatccggactgcgaggacgggagcgacgaatggcctcaacggtgccgcggactttacgtgttccaaggggatagcagtccatgctcggcgttcgagtttcactgcctgtctggtgaatgtatccactcgagctggcgctgcgatggaggaccggattgtaaggacaagtccgatgaagagaattgcgccgtcgctacctgtcgccccgacgaatttcagtgctccgacggaaactgtatccatggatcgcgtcagtgcgatcgggaatacgattgcaaggacatgagtgacgaggtgggatgtgtgaatgtgactctttgcgaaggcccaaacaagtttaagtgccactccggagaatgcatcaccctggataaggtctgcaatatggcgagagactgcagagactggtcggatgaacccatcaaggagtgcggaaccaacgagtgcctcgataacaatggcggatgttcccatgtgtgcaacgacctcaagattgggtacgagtgtttgtgccctgacggtttccagctcgtcgcacagagacggtgcgaggatatcgatgaatgccaagatcctgacacttgttcccaactctgcgtcaatctcgagggtggctacaaatgccaatgtgaagagggattccaactggaccctcatacgaaagcctgcaaggctgtgggaagcatcgcgtacctgttcttcacgaaccgccacgaagtgagaaaaatgaccctggaccggtccgaatacactagtctcatccccaatctgaggaacgtggtcgcgctcgacaccgaagtggcgtccaacaggatctactggtccgatttgagccagcggatgatctgctccacgcagctggacagggcgcacggcgtctcttcttacgacaccgtgatttcgagagacattcaggcccccgatggtcttgcggtggattggatccactcgaatatctactggactgactcggtgctcggtactgtgtcggtggcggatactaaaggagtgaagcgcaagactctttttagagagaatgggtccaaaccaagggccatcgtggtggatccggtccacggcttcatgtattggaccgattggggtaccccggccaagataaagaaggggggactgaacggtgtggacatttactccctggttaccgagaatatacagtggcccaacggaatcactcttgacctcctgtccggacgcctgtactgggtcgattcaaagctgcactccatctcgtccatcgatgtgaatggagggaaccgcaaaacgattttggaggacgaaaagcgcctggcccatcctttcagcctcgcggtgttcgaggacaaagtgttttggaccgacatcatcaacgaggccatcttctccgccaaccgccttactggttcggatgtcaatctcttggccgaaaacctgctctcacctgaagatatggtgttgttccacaacctgacccagcccaggggcgtcaattggtgcgaacgcaccactttgtctaatggagggtgccaatacctgtgcctcccggcaccgcagattaatccgcattctccaaagttcacctgcgcctgcccggatggtatgctgctggcccgggatatgagatcctgcctgaccgaggccgaggccgcagtggccacccaggagacgtcaaccgtgcggctcaaagtgtcgtcgaccgccgtccggactcaacatactacgaccagacctgtgcctgacaccagccgactgccgggcgctacgccaggactgactaccgtcgagatcgtgactatgtcgcaccaggcactgggcgacgtggccggccggggaaacgagaagaagccgtcctcggtgagagctctgtcaatcgtgctgcccatcgtgctcctcgtgtttctgtgcctgggcgtgttccttctctggaagaattggagactgaagaacatcaattcaatcaacttcgataacccagtctaccagaaaactactgaagatgaagtgcatatttgccacaaccaggacggctattcttacccgagcagacagatggtttccctggaagatgacgtcgcc

SEQ ID NO: 15946 - DNA, 2580 bp, Artificial Sequence
  Description of Artificial Sequence: Synthetic coding sequence
atgggcccttgggggtggaagctgagatggaccgtggccctgcttctagctgcagccggcacggcagtgggggatagatgcgagcggaacgaattccaatgtcaagatggaaaatgcatttcatacaagtgggtgtgtgatggaagcgcagagtgccaagacggctctgatgagtcccaggagacctgtctgtccgtgacctgcaaaagtggagacttctcatgcggtgggagggtgaatcgttgcattcctcagttttggcgctgtgacggccaggttgactgcgataatggctccgatgaacaagggtgccccccaaaaacctgcagccaggacgagttcagatgccacgacgggaagtgcatctcaagacaatttgtgtgcgactcagatagggattgtctggacgggagcgacgaggccagttgtccagtactgacatgtggtcccgcctcgttccaatgcaattcaagcacatgtattccgcagctttgggcctgtgataatgaccccgattgcgaagacggttctgacgaatggccacagcgttgccggggcctttacgtctttcagggcgactcctctccctgctcggcatttgagtttcattgcctatcaggtgaatgtattcattcctcatggagatgcgatggtgggcctgattgtaaagataaaagcgatgaggaaaactgtgcggtggcaacctgccgaccggacgagttccagtgtagcgatgggaattgcatacacggctccagacagtgtgaccgcgagtacgattgtaaggatatgagtgatgaagttgggtgcgtgaatgtgacactgtgcgaggggccaaataagtttaaatgtcattccggcgaatgtattacgctggataaagtttgtaatatggcccgggactgtcgggactggtcagatgagccgatcaaggaatgtggtactaacgagtgcctagacaataacgggggctgctcccacgtgtgtaacgacctgaagatcggctatgagtgcctatgtcccgatggctttcagttagtggcccagcgccggtgtgaagatattgatgagtgtcaggatcccgacacctgttcccaattatgtgttaaccttgagggaggatacaaatgccagtgtgaggaaggctttcagctcgatccccacacaaaggcatgtaaggcagtggggagtattgcatacttgtttttcaccaacagacatgaagtgcggaagatgaccctggatcgcagtgagtacacctctttaatccctaatctcagaaatgtagtggccctcgacactgaggtagccagtaaccgaatctattggagtgatctgagtcagaggatgatttgctccactcagttggatcgggcgcatggcgtctcgtcttacgacaccgtcatctctagagatatccaggcccccgacgggctggcagtggactggattcactcaaatatctactggaccgactctgtgctgggcacggtttcagttgccgacaccaagggtgtgaaaaggaaaaccctcttccgagaaaacggaagcaagccacgcgcaatcgtggttgatccggtacacgggttcatgtactggaccgattgggggactcccgcaaagattaagaagggtggtcttaacggagtagatatctattcactggtgaccgagaacatccagtggcccaatggcatcaccctggatctgctgtcaggtcgcctctactgggtggacagcaagctccattctatctcttccattgacgtcaacggcggcaatagaaagaccattttggaagacgagaaacgcctggcacaccccttctctctggcagtgttcgaagataaagtgttctggacagatatcattaatgaggccatcttctcggccaatcgcctaacagggagcgacgtgaatttgctggctgagaacttgttatctccggaagatatggtcctgttccataacttgacacagccacgtggggtaaactggtgcgagaggacaacactttccaatggtgggtgccagtacctgtgcctacccgccccacagatcaatccacattcccccaagtttacatgtgcctgcccagatggaatgctgttggcccgggatatgcgttcttgtctcacagaagcagaggcagctgtggcaacccaggagacgagcaccgtgcgcctcaaggtgagctccactgcggtacggacacagcacaccacaactagacccgtgccagacacttctcgccttccgggcgcaacccctggcctaactaccgtggaaattgtgaccatgtctcaccaggctctgggggatgttgctggccgcggcaacgagaaaaaaccatctagtgtacgggccttgtccatagtgttaccaattgtactgctggtctttctctgcctgggggtgttcttattgtggaaaaattggaggttaaagaacattaactctattaattttgacaatcctgtatatcagaagacgacagaggacgaagtgcacatctgccataatcaggacggttatagctatccgtcacgccagatggtgtctttggaagatgacgtggca

SEQ ID NO: 15947 - DNA, 2580 bp, Artificial Sequence
  Description of Artificial Sequence: Synthetic coding sequence
atgggaccgtggggttggaagctccggtggacggtggctctgctgctcgcggcagctgggaccgccgtgggcgaccgctgtgaacggaatgaatttcaatgccaggacggcaagtgtatctcgtacaaatgggtctgcgacggatcggcggaatgtcaagacggctctgacgaatcgcaagagacttgtctcagcgtgacttgtaagtcaggcgacttctcctgcggaggacgggtgaaccgctgcatcccgcagttttggagatgcgacggacaggtggattgtgataatggcagcgacgaacaggggtgcccgcctaagacttgctcgcaagacgagttccgctgccacgacggtaagtgtatctccagacagttcgtgtgtgatagcgatagggattgcctggatggaagcgacgaagccagctgtccagtcctgacctgcggaccggccagcttccagtgcaactcaagcacctgcatacctcagctctgggcgtgcgataacgacccagattgtgaggacggatcggacgaatggccacagaggtgccgaggactgtacgtgttccagggagactcgtctccgtgttcggcatttgagtttcattgcctgagcggggagtgcatccactcatcgtggcggtgcgacggaggaccagattgcaaagacaagtcggatgaagagaactgtgcggttgcgacttgccgccctgatgagttccaatgctcggacggtaattgcatccatggttcgaggcaatgcgaccgagaatacgattgtaaggacatgtcagacgaggtgggatgcgtgaacgtcactctgtgtgagggacctaacaaattcaagtgccattcgggcgaatgtatcaccctcgataaggtgtgcaatatggccagggattgtcgagattggagcgacgagccaatcaaagagtgcgggactaatgaatgcctggacaacaacggaggctgctcccacgtgtgcaacgatttgaagatcggatacgagtgcctctgccccgacgggttccagcttgtggcacagcgccggtgcgaagatattgatgaatgtcaggacccagatacttgctcccaactttgcgtgaatctggagggcggttacaaatgtcaatgcgaggaaggattccagctggatccgcacaccaaagcatgcaaagccgtggggagcatcgcttacttgttcttcactaatagacatgaggtgcggaagatgactttggaccgcagcgaatacactagcctcatcccaaacttgagaaacgtggtggcgcttgacactgaggtcgcgagcaatagaatctactggtcagacctttcccagcggatgatttgctcgactcagctggatagagcacacggagtgtcgtcgtacgacaccgttatctccagggacatccaggcaccggatgggctggcagtggactggatccactccaacatctactggactgattcggttctcgggaccgtgtccgtggccgacaccaagggggtcaagcgcaagaccctcttccgggaaaacggatctaagccgagagcgatcgtggtggaccctgttcatggtttcatgtactggactgactggggcaccccagccaaaatcaaaaagggaggacttaatggagttgatatctactcgctcgtgaccgagaatattcagtggcccaatggaatcacgctggatctgctgagcggccgtctgtactgggtggactcaaagctccattcaatctcgtcgattgatgtgaatggcggaaatcgcaagactattctcgaggatgaaaagcggctggcgcacccattttccctggccgtgttcgaggacaaggtgttctggactgacatcatcaacgaagcgatcttttccgccaaccggcttacggggtccgatgtgaacctccttgccgaaaatctcctgtccccggaagatatggtcctgtttcacaacctgactcaacctcgcggcgtgaattggtgcgaacgcaccactttgtctaatggcgggtgccagtacctgtgtctgccggccccacagatcaacccccattccccgaaattcacttgcgcgtgccctgatggtatgctgctcgctcgtgatatgcgatcctgcctgaccgaagccgaggcagcagtggccacccaagagactagcaccgtcaggcttaaggtgagctcaactgccgtacgcacgcaacacacgactaccagacctgtgccggacacttcccggctcccaggtgcaacccctggcctgaccaccgtggaaatcgtgactatgtcccaccaagccctcggagacgtcgccgggcgaggaaacgaaaagaagccatcctcagttcgggcattgtcaatcgtgctgccgatcgtgctgttggtgttcctgtgtctcggtgtttttctgttgtggaagaactggcgacttaagaatatcaactcaatcaacttcgacaatccagtgtatcagaaaaccaccgaagatgaggtacacatttgtcacaaccaggacgggtactcatatccctcgcggcaaatggtgtctttggaagatgatgtggcg

SEQ ID NO: 15948 - DNA, 2580 bp, Artificial Sequence
  Description of Artificial Sequence: Synthetic coding sequence
atgggcccttgggggtggaagctgaggtggaccgttgcactgctactggcggctgcgggaacagccgtgggagatcgctgtgaacgtaacgagttccagtgccaggatggtaagtgcataagttacaagtgggtgtgtgatgggagcgccgagtgccaagacggatccgacgagagccaggagacttgcctttcagtaacttgcaaatctggcgactttagctgcgggggccgggtaaacagatgtataccgcaattctggcgatgtgacggccaggtcgattgtgataacggatccgatgaacaaggttgtcccccgaagacctgctctcaggacgagttcagatgccacgatggaaaatgcattagcaggcaatttgtatgcgattcggaccgcgactgtctagatggcagtgacgaggctagctgtcctgtcctgacctgcggaccggcatctttccaatgtaacagttcaacatgcataccccagctttgggcctgtgataacgaccctgactgcgaggatggctctgatgagtggccccagagatgccgaggcctgtatgtttttcagggggatagtagcccttgcagtgccttcgagttccattgcctgtccggagaatgtatccatagttcttggaggtgcgacggcggacccgattgtaaagataaatccgatgaggagaactgtgccgttgccacctgccggcctgacgaattccagtgtagtgacgggaattgtatccacggttctcgacaatgcgatagggaatacgattgcaaggacatgagcgatgaggtgggctgtgtgaatgtcaccctgtgcgaggggcctaacaagttcaaatgccactcaggcgagtgtatcaccctggataaggtctgtaacatggctcgcgattgtcgcgactggtcagatgaaccgatcaaggagtgcggcaccaatgagtgtcttgacaataacggagggtgtagtcatgtctgcaatgatttgaaaatcggttatgagtgcctctgtccagatggcttccaacttgttgcccagcgtcgctgcgaggatatcgacgagtgccaagaccccgacacttgctctcagctgtgcgtgaacctggaaggcggctacaaatgccagtgtgaagaagggtttcaacttgaccctcatacaaaagcttgtaaagctgtggggagcatcgcctacttattttttactaacagacacgaggtccggaaaatgactctcgatcgaagtgagtacaccagcctaatacccaaccttaggaacgtggtggcacttgatactgaagtggcaagcaataggatttactggagcgacttgtctcagcgcatgatatgctcgacccagttagaccgggcacacggcgtgtctagttatgacacagtgatctctcgggacatacaggcgcccgacgggctggccgtggattggattcacagtaatatatattggactgacagcgtgttaggcactgtctcagtggcagatacaaaaggcgtgaagaggaagacattattcagagaaaacgggtcaaagccgcgcgcgatcgtggtggacccagtgcacggttttatgtattggactgattggggcactcctgctaaaattaagaaagggggactgaatggggtagacatatatagcctggtgaccgaaaacatccagtggcccaacggcataaccttggatctgctgagcggcagactatattgggtggactcaaagctgcactccatctcgagtattgatgtgaacggcgggaatcgcaaaaccattctggaagacgagaaacgcttggctcatccgtttagcctcgcagtgttcgaggacaaagtcttttggaccgatatcatcaatgaggcgattttcagcgccaaccgtctgactggcagcgatgtcaacctactggcagagaacctactttccccagaggacatggtgttattccacaatctaactcagccacgaggcgtgaactggtgtgaacggaccacactgtcaaatgggggctgtcagtacttgtgccttccggcaccacagatcaatccccacagccctaaattcacatgcgcatgtccagacgggatgctcctagcacgagacatgcgatcatgcctcactgaagccgaagcagccgtagccacacaggaaaccagcaccgtgaggctgaaggtgagcagtaccgccgtgagaactcagcacaccaccactcggcctgtgccagacacctcaagactcccaggcgccacacctgggctgactaccgtggaaattgtcaccatgtctcaccaggccctcggtgatgtggctggccggggaaatgagaaaaagcccagttcagttcgggcactgagtattgtattgcctatcgtcctgttggtcttcctgtgcctgggagtgttcttgctgtggaagaactggcgactcaaaaatatcaatagcattaatttcgataatcccgtgtaccagaaaactactgaggatgaggtgcacatttgtcataaccaggacggctacagctacccttctcgtcagatggtgagcctggaggacgatgtagca

SEQ ID NO: 15949 - DNA, 2580 bp, Artificial Sequence
  Description of Artificial Sequence: Synthetic coding sequence
atgggcccttgggggtggaaactgaggtggaccgtcgcgttgctgctcgctgcagccggcacagccgtgggcgaccgatgcgagcggaatgagttccagtgtcaggacggcaagtgcatttcttacaaatgggtgtgtgacggctcagctgagtgtcaagatggttccgacgagtcccaggagacctgcttaagcgtgacttgcaaaagcggggacttctcttgcggcggacgtgtgaatcgctgcattcctcagttttggcgttgcgacggccaggtggattgcgacaacggcagcgatgagcaagggtgcccacccaaaacctgtagtcaagatgagttcaggtgccatgacggcaagtgcatttcccgtcaattcgtatgcgacagcgacagggattgcttggatggctctgacgaagcgagttgtccagtcctcacttgcggcccagcgtcattccagtgcaatagcagcacctgcattccacagctgtgggcatgtgacaatgatcctgattgcgaggacggatctgatgaatggcctcagcgatgtaggggcctctacgtgttccaaggcgactcttcaccttgtagcgcttttgagtttcattgtctcagcggagagtgtatccatagttcttggcgctgtgatgggggccctgactgcaaggacaagtctgacgaggaaaattgcgctgtagctacttgccggccagacgagtttcagtgctcagatgggaactgcatccatggatcccgccagtgtgaccgagagtatgactgtaaagacatgtctgatgaggttgggtgcgtaaacgtcacactctgtgaaggccccaataagtttaagtgccatagcggagaatgcataaccctggataaagtgtgtaacatggcgcgggactgtagggactggtctgacgagccaattaaagaatgcggcaccaacgagtgcctagacaataatgggggatgctctcatgtttgcaacgacctgaagatcggttacgagtgcctgtgcccagacggtttccagctggtggcccagcgccgatgtgaggacatcgacgaatgtcaagatccggacacctgctcccagctgtgcgtgaacctcgaaggcggctacaagtgtcagtgcgaggagggctttcaactcgatccccacactaaagcctgcaaggcagtcgggtctatcgcgtatctattttttaccaataggcacgaggtgcgaaagatgacattagataggagcgagtacacaagcctgattcctaatctgcgaaacgtagtggccctggatactgaagtcgctagtaaccggatatattggagcgatctgagccagagaatgatttgttcaacacagttagatagggcccatggcgtgtcgtcttacgatacagtaatctcacgagatattcaagcgcctgacgggttggccgtcgactggattcattcaaatatttactggactgattccgtgcttggcactgtgtcagttgctgataccaaaggcgttaagcgtaagacactctttagagagaatggaagcaaacccagagccatagtggtagatcccgtccacggtttcatgtattggaccgactggggaacccctgcgaagattaagaaggggggcctgaacggagttgatatatactccttggtcacagaaaatatacagtggcctaatggtattacgcttgaccttttgagcggccggctgtattgggtggattctaagctgcacagcatttcaagcattgacgtaaacgggggcaaccgcaaaacaatcctagaagacgagaaacgcctggcccaccctttctccctcgctgtgtttgaggacaaggtcttctggacagatatcatcaatgaagctatcttcagcgctaatcggctgaccgggtctgatgtaaacctactggcagagaacctcctatccccggaggacatggttctgttccacaaccttacccaacctagaggggtcaactggtgcgaaagaacgactctttcaaacggagggtgtcagtatctgtgccttcccgccccccagattaacccgcacagccctaagtttacatgcgcttgccctgatggaatgttgcttgccagggatatgcggagctgcctcactgaggccgaagcagctgtggctacacaggagacgtccactgtgcgcctgaaggtttcgagtactgctgtgcggacccagcacacaactacaagacctgtgccggacaccagtaggctgcccggggctacccccgggctcactacagtcgagattgtgactatgtcccaccaggcccttggtgacgtcgcaggaagagggaatgagaagaagccaagtagcgtgcgcgccctcagcatagttcttcccattgtgctgcttgtatttctgtgcctaggcgtgttcctactatggaagaactggcgcctgaagaacataaatagcatcaactttgataatcctgtgtaccagaagaccaccgaggacgaggtccatatttgtcataatcaggatggttacagctacccaagccgccaaatggtcagcctggaggatgacgtggct

SEQ ID NO: 15950 - DNA, 2580 bp, Artificial Sequence
  Description of Artificial Sequence: Synthetic coding sequence
atggggccgtggggttggaagctgcgctggaccgtcgccctgcttctggccgccgctggaaccgccgtcggcgaccggtgcgagcggaacgaatttcaatgccaggatggaaaatgcatctcgtacaagtgggtctgcgacggatccgcggaatgtcaagatggatcagatgaatcacaggaaacctgcctctccgtcacttgcaaatcaggggacttttcatgcggcggacgcgttaaccggtgtatcccacaattctggagatgcgatggacaggtggattgtgataacggctcggacgagcaaggatgcccaccaaagacctgcagccaagacgaattccgttgtcatgacggaaagtgcatctcgcgccagttcgtgtgcgattccgacagagactgcctcgacggatcggacgaagcctcctgcccggtcctgacttgcggtccagctagctttcaatgtaattcgagcacgtgtattcctcagctctgggcgtgcgataatgacccggattgcgaggacggctcagacgagtggcctcagcgttgtaggggcctgtacgtctttcaaggcgactcatcgccgtgctccgcgttcgaattccactgcctttcgggggaatgcatccactcgtcttggagatgtgacggaggccctgactgtaaggacaagtcggatgaggagaactgcgcggtggccacctgtcgcccggacgagttccaatgttcagatggcaactgcattcatggctctcggcagtgcgacagagagtacgattgtaaagacatgtcagacgaagtgggatgcgtgaacgtgactctctgcgagggccctaacaaattcaagtgccactcaggagaatgcatcacgctggacaaagtctgtaatatggcacgcgactgccgggactggtccgacgaaccgatcaaagaatgtggaaccaacgagtgtttggacaataacggcgggtgctcacatgtgtgcaatgatctgaaaatcggatacgagtgcttgtgcccggacggattccagctcgtcgcgcagcgcagatgcgaggacattgacgaatgccaagaccctgatacctgctcccagctctgcgtgaatctggaaggaggctacaagtgccagtgcgaagaaggatttcagctggatcctcacaccaaggcatgcaaggccgtcggttcgatcgcttacctgtttttcaccaatcgccacgaggtgcggaagatgaccctcgaccggtcggaatacacgagcctgatcccaaaccttagaaatgtcgtcgccctcgacaccgaagtcgcatccaaccggatctattggtcagatctgtcgcagcgcatgatctgctcgactcagctggatcgagcacacggagtctcctcgtacgacactgtgatatcacgggacatccaggccccagacggactcgccgtggactggatccacagcaatatctactggactgattcagtcctcgggaccgtgtcggtggcagacacgaaaggggtgaagaggaaaaccctcttcagagaaaacggttccaagccgcgagctatcgtcgtggacccggtgcacggttttatgtactggactgactggggcacgcctgctaaaatcaaaaagggaggactgaacggcgtggacatctactcgctggtgaccgaaaacattcagtggccgaacggtatcaccctggacctgctttcgggacggctgtactgggtggactccaagctgcactcgatcagctccatcgatgtgaacggcggaaaccgaaagaccatcttggaggacgagaagcggctcgctcacccgttctctcttgccgtctttgaggacaaggtgttctggaccgatatcatcaatgaggcgatattcagcgccaacagactgactggatctgatgtgaacctgcttgcagagaacctcctttccccagaagatatggtgctgtttcacaatcttactcagccacggggtgtgaattggtgcgagcgcaccaccctgtccaacggaggatgccaatacttgtgtctcccggcgccacagatcaatccgcactcgcccaagttcacctgcgcttgccctgatggaatgctgctggcacgggatatgcgatcctgtctgactgaggctgaagctgccgtggcaactcaagaaacctcgactgtcaggttgaaggtttcgagcactgcggtgcgcacgcagcatactactaccagacccgtcccggacacgtcgcgcctccccggagccaccccgggactgactaccgtggagattgtgactatgtcccatcaggcgcttggcgatgtcgccggaagaggaaacgagaagaagccatcaagcgtgcgagccctcagcatcgtcctcccaatcgtgctgctcgttttcctgtgtctgggtgtgtttctcttgtggaaaaactggagactgaagaacatcaactccatcaactttgacaacccggtgtatcagaaaaccaccgaggacgaagtgcacatttgccacaatcaagacggatactcgtacccctctaggcagatggtgagccttgaagatgacgtggcc

SEQ ID NO: 15951 - DNA, 2580 bp, Artificial Sequence
  Description of Artificial Sequence: Synthetic coding sequence
atgggtccatggggatggaaacttcgttggactgtcgccctgctgctggcagcagcaggaaccgcagtgggggacaggtgcgagcggaatgagttccagtgtcaagacggtaaatgcatctcgtacaagtgggtctgcgacggttcagccgaatgccaggatggatccgacgagtcacaggaaacgtgtctgtccgtgacttgtaaatcaggcgatttttcatgcggtggtcgggtgaacagatgtattccacagttctggcgatgtgatggacaggtcgactgtgacaacggatccgatgaacagggttgtccaccaaaaacctgcagccaagacgaattccgctgtcacgatggaaagtgcatctccagacaatttgtgtgtgattcggatagagactgccttgatggaagcgatgaagcatcctgtccagtgcttacgtgtggtccggcgtccttccaatgtaacagctcaacgtgtatcccgcagctttgggcgtgcgataatgaccccgattgtgaggatggatcagatgaatggcctcagagatgtaggggcctctatgtgtttcagggagattcgtccccttgctcagcttttgaatttcattgtctttctggtgaatgtatacatagctcctggcggtgtgacggtggacctgactgcaaggacaagtccgatgaggaaaactgcgcagtggccacctgtcgacctgatgaatttcaatgtagcgatgggaattgtattcatgggagccgccaatgcgatcgagaatacgattgtaaggatatgagcgatgaagtgggatgtgtcaacgtgactctttgtgagggacccaacaagttcaaatgtcactccggggaatgtatcactcttgataaagtttgcaatatggcaagagactgtcgggattggtcagatgaacctatcaaggaatgcggcaccaacgagtgtctggataacaacggcggatgttcacacgtctgcaatgatcttaagattggctacgagtgtctgtgtcctgatggatttcagctggtcgcgcagcggcgatgcgaggatatcgatgaatgtcaagatccggacacctgttcccagctctgcgtgaacctggaaggaggctataagtgccaatgtgaggaaggttttcagctggatccgcatactaaggcctgtaaggcagtgggaagcattgcatacctgttctttactaatcgtcatgaagtgcgcaagatgacccttgatcggtcagaatacacgagcctgattccgaacctgagaaatgtcgtggcgttggatactgaagttgcgtcaaaccgaatctactggtctgacctgtcgcaaagaatgatttgtagcacccagcttgatagagcgcatggggtttcttcttacgataccgtgatttcccgtgacattcaagcacctgatggtttggccgtcgactggattcactctaacatatactggacggattcggtcctgggtaccgtgtcggtcgcagacaccaagggggtcaaacgtaagactctgtttagagaaaacgggtccaagcctcgtgcaattgtcgtggatcctgtccatggttttatgtactggactgattgggggaccccagcaaagatcaaaaaaggaggccttaacggtgtcgatatctactcccttgtgactgagaacattcaatggccaaacggaattaccctcgatctgctttcaggacgactttactgggtcgactcaaaactccatagcatttcgagcatagatgtcaacggtgggaatcgcaagacgatcttggaggacgagaagcggcttgcacatccttttagcctggctgtgtttgaggataaagtgttttggacggacataatcaatgaggccattttctccgccaaccggcttactgggtctgatgtgaatcttttggcagagaatcttctttccccagaagatatggtgctgtttcacaatctgactcaaccccggggtgtgaactggtgtgagcgcactactctttccaacggtggctgtcaatacctttgccttcctgcaccacagattaatccacacagccctaagttcacctgtgcctgcccagatggaatgctgctggccagagacatgagaagctgtcttaccgaggcagaagcagcagtggcgactcaagaaaccagcactgtccgtctgaaggttagttcgacggcagtgcggactcagcataccactacccggcccgtgcctgatacttcgcgactgccgggcgccaccccaggacttacgaccgtggaaatcgtgaccatgtctcaccaggccctgggggacgtggcaggaaggggtaatgagaagaagccttcttcggtgagagccttgtccatagtcctgccaattgtgcttctggtgttcctctgtttgggagttttccttctgtggaagaattggaggctgaagaacatcaactccatcaattttgacaacccagtctaccaaaagaccactgaggacgaggttcatatttgtcacaaccaggacggatattcgtacccatcgagacagatggtgtcgctggaggacgatgtcgcc

SEQ ID NO: 15952 - DNA, 2580 bp, Artificial Sequence
  Description of Artificial Sequence: Synthetic coding sequence
atgggaccctggggttggaaacttaggtggaccgtggccttgctgttagcggccgcaggtactgctgtgggcgaccggtgcgagcgaaacgagttccaatgtcaggatgggaaatgtattagttataaatgggtctgtgacgggagcgccgaatgccaggacgggagtgacgaatcacaagagacctgtcttagtgtgacctgtaagagcggcgattttagttgcggaggtagagtcaacaggtgcattcctcagttctggaggtgcgatggccaggtagattgcgacaacggctctgatgagcagggctgccccccaaagacttgttcccaagacgagttcaggtgccacgacggcaagtgcatctctcggcagtttgtgtgcgattccgatcgcgactgtctcgacggttctgacgaagcctcgtgtccggtcctaacttgtggtccggcgtcttttcaatgcaactctagtacttgcatccctcagctgtgggcttgcgacaatgaccccgactgtgaagacggttcagatgagtggcctcagagatgccgaggcctttatgtgttccagggtgattcatctccatgctcagcctttgagttccattgtctgtcgggggagtgcattcattcaagctggcggtgcgatggaggccccgactgcaaagataagagcgacgaggagaactgcgccgtcgccacctgcagacccgatgaatttcagtgctctgacggcaactgcatccacggtagccggcaatgtgaccgcgaatacgactgtaaagacatgtcggatgaagtgggatgcgtaaatgtaaccctctgtgaaggtccaaacaaattcaagtgccactccggagaatgcattacgctcgataaggtttgtaatatggcacgagactgtcgggattggtctgacgaaccaataaaggaatgcggcactaatgagtgtttggacaataatggagggtgcagtcatgtgtgcaatgacctgaaaataggatatgaatgtttatgcccggatgggtttcagttggtcgcacagcgcagatgcgaagacattgatgaatgccaggacccagacacatgtagccagctctgtgtaaatctggaagggggttacaaatgccaatgcgaagagggcttccagctggaccctcacacaaaagcgtgcaaagcggtgggttccatcgcctacttgttctttactaatcggcacgaggtgcgcaagatgaccctggaccgcagcgagtacacatcgctcattccaaatcttaggaacgtggtcgcccttgacacagaggtggcctccaacaggatatactggtccgacttgagccagcgcatgatctgttccacacaactggaccgcgctcatggcgtctcgagctacgacacagttatcagcagggacattcaggctccggatggtctcgccgtagattggatacacagtaacatatactggacagactccgtgttgggaacggtatctgtggcagacacaaagggggttaagaggaaaacgctctttcgtgagaatggatcaaagccgcgcgctatagtagtggacccggtgcacggattcatgtattggactgactggggcacacccgcgaagatcaaaaaggggggactgaacggggtcgatatctactccctcgttaccgagaacatccagtggcctaacggcattactttagacttgctgtctggtcgcctgtactgggtcgacagtaagttacatagtataagcagtattgatgtgaacggcgggaacaggaagaccatcctcgaggatgaaaagcggctggcccatcccttcagccttgccgtcttcgaggacaaggtcttctggaccgatatcataaacgaggccatcttctccgcaaacagattgacggggtctgacgtgaaccttctcgctgaaaatctcctgtcacccgaagatatggttctctttcacaacttgacccagccacggggggtaaactggtgtgagaggacaactttgagcaatggtgggtgccagtatctctgtctcccagctccccaaatcaatccccacagccccaagttcacctgcgcatgcccggacggcatgctcttggccagggacatgcgaagctgtcttaccgaggctgaagccgccgtcgccacccaggagacctcaactgtcaggcttaaagtttcttccacggcggtgcggacccaacacaccaccacgaggcccgtgccagacacttcgcgccttccgggagccacaccagggctgacgactgtcgagattgtcacaatgtctcaccaggccctcggtgacgtggccgggagaggtaacgagaaaaaaccaagctcagtgagagccctgtccattgttttgccaatcgttctgcttgttttcctgtgtcttggtgtcttcctgctgtggaagaattggcgtcttaagaacatcaattccatcaacttcgataacccagtgtatcagaagactacagaagatgaagtccatatttgtcataatcaggatggctacagttatccaagtagacagatggtaagcctcgaagatgacgtagcc

SEQ ID NO: 15953 - DNA, 2580 bp, Artificial Sequence
  Description of Artificial Sequence: Synthetic coding sequence
atgggtccctgggggtggaaactgcgttggaccgtggctctattgctcgcagctgctggtacggccgttggcgaccgctgcgagcgcaacgagttccagtgtcaagatgggaagtgcatctcatacaagtgggtctgtgacggtagtgcagagtgtcaagatggctcggacgagtcccaggaaacatgcctctctgtcacttgtaagagtggtgatttttcctgtggcggtcgcgtgaaccgctgtatccctcagttctggcgttgcgacggccaagtcgattgcgacaacggcagcgacgagcagggttgcccccccaagacttgttcacaggatgagttcaggtgtcacgatgggaagtgtatatcccgccagttcgtgtgtgattccgatcgcgattgtctcgacggtagcgatgaggcctcctgtccggttctcacctgcggacctgcgtcctttcagtgtaactcctccacctgcattccacagctttgggcctgcgacaatgacccggattgcgaggacgggtcggatgaatggccccagcggtgccgtggtctctacgtgttccagggcgactccagcccatgttccgcgttcgagttccactgtctctcgggtgagtgtatccattcctcatggagatgtgacggtggtcctgattgcaaggataagtccgatgaagagaactgtgcggtggctacctgtcggcccgatgaattccaatgtagcgacggcaactgcattcacggttcaaggcagtgcgaccgtgagtacgactgcaaggacatgtccgatgaggtcgggtgcgttaatgtcaccctctgtgagggacccaacaagttcaagtgccattcaggagagtgcattaccctcgataaggtctgtaatatggctcgcgattgtcgtgactggagcgacgaacccatcaaggagtgcggtactaatgaatgcctggataacaacggcggatgctcgcacgtctgcaacgacttgaaaatcggttatgagtgtttgtgtcccgacggctttcaactggttgcccagcggcgctgcgaggacattgacgaatgtcaggaccccgatacctgctcccagttgtgtgtcaacctcgagggcggttacaaatgtcaatgcgaggagggcttccaacttgaccctcacactaaggcttgcaaggcagtgggttctatcgcttaccttttcttcaccaaccgtcacgaggtccggaagatgacccttgacaggtccgagtacaccagcctgatccctaacttgcgcaatgtcgtcgctctcgacaccgaggttgccagcaaccgcatttactggagcgatctcagtcagcgcatgatctgctccactcaactcgacagagcccacggcgtgtcttcctatgacaccgtcatcagcagggatatccaggcccctgatggtctcgctgtggactggatccattcgaacatatactggaccgactcagtcctgggaaccgtatccgttgctgacactaagggcgtcaagcgtaagacgcttttccgcgagaacgggtcaaagccccgggctatcgtcgtggacccagttcacggctttatgtactggacggactggggtaccccagctaagattaagaagggcggcctgaacggtgtcgacatctacagtctagtcaccgaaaacatccagtggcccaacggcattaccctcgaccttctttcgggaaggctgtattgggtcgactctaagttgcactctatatccagcatcgatgttaatggtggcaatagaaagaccatcctcgaggacgagaagcgtctcgcccaccccttcagtctcgctgtgttcgaggacaaggtgttttggacggacatcatcaacgaggctattttcagcgctaatcgtctcacgggtagcgatgtgaacctgttggccgagaaccttctaagccccgaggacatggtactcttccataatctcacacagcctagaggcgtcaactggtgcgagcgcaccacactcagcaacgggggctgtcaatacttgtgtcttcctgcaccccagattaatccacattcacctaagttcacatgtgcgtgccccgatggtatgctgctggcacgggatatgaggtcttgtctgaccgaagccgaggcggcggtggccacccaggagacttctaccgttcgcctgaaggttagcagtaccgctgtccgcactcagcatacgacgactcggccagtccctgatacctcgcggctgcctggcgctaccccgggtctcaccactgtggaaatcgtgactatgtcccaccaggcactcggagatgtcgctggccggggcaacgagaagaagcccagctccgtgcgggcactgtccattgtactccccatcgtcctccttgtcttcttgtgcctcggcgtttttctgctgtggaagaactggcgtctcaagaatatcaattctatcaacttcgataacccggtctaccaaaagacgaccgaggatgaggttcatatctgccataaccaagatggatactcctacccatcccgccagatggtctccctcgaggacgacgtggct

SEQ ID NO: 15954 - DNA, 2580 bp, Artificial Sequence
  Description of Artificial Sequence: Synthetic coding sequence
atgggcccctggggttggaagctgaggtggactgtggccttgctgctcgcagctgctggcacagcagtgggggacagatgcgaacgaaatgagttccaatgccaggacggcaagtgcatctcctataagtgggtgtgtgatggttcggctgaatgccaggacggttctgatgaaagtcaagaaacctgtctgtcagtgacctgtaaatctggcgacttctcttgtggaggtagggtgaatcgttgtattccgcagttctggagatgtgatggccaggtggactgcgataatgggtcagacgaacagggctgtcctcctaagacatgcagccaggatgagtttagatgtcacgacgggaagtgtataagtcgccaattcgtgtgcgactctgaccgagactgccttgatgggtccgatgaagcgagctgccctgtgctgacttgcgggcccgccagcttccaatgtaattcatccacttgcataccccagctttgggcctgcgataacgaccctgattgcgaagacggatcagacgaatggccccaacgttgtcgcggcctgtacgttttccagggcgattcatcgccctgcagcgcgttcgaatttcattgtctttccggtgaatgtatccacagcagctggcggtgcgacggaggaccagattgcaaggataagtccgatgaagaaaactgtgcggtggctacctgcaggcccgacgaatttcaatgttccgatgggaattgcatccacggttcacggcagtgcgaccgagaatatgattgcaaggatatgagtgacgaagtcggctgcgtgaacgtgaccctttgtgaaggaccaaacaaatttaaatgccactcaggtgagtgcataactcttgacaaggtgtgtaacatggcccgggactgccgagactggtctgatgagcccatcaaggaatgcggaacgaatgaatgtctggacaataacgggggctgttcgcacgtgtgtaatgacctgaagattggatatgaatgcctgtgtcccgatggattccagctggtagcccagaggaggtgtgaagacatcgatgaatgccaggaccctgacacttgcagtcagctgtgtgtcaacctcgagggcgggtacaagtgtcagtgtgaggagggatttcagttagatccccataccaaggcttgcaaggctgttggatccatagcatatctcttcttcactaaccggcacgaggtgcgaaagatgaccttagaccggtcagaatatacaagtctgatacccaatctgcggaatgtagtcgctcttgacaccgaggtggcatccaaccggatttactggagcgatctatctcaacgcatgatttgttccacacagctcgatagggcgcatggggtcagttcatacgacacggtgatctcgcgcgatatccaggcgccagatggcctggccgttgattggatccacagtaacatttactggactgacagtgtgctgggcacagtttccgttgccgacaccaagggggtcaaaaggaagaccctgttccgagagaatggaagcaagccccgcgccatcgtggtggatcctgtccacggattcatgtactggaccgattggggaacgcccgctaagataaaaaaggggggcttgaacggcgtggacatatattcactagtaactgaaaatatccagtggcccaacgggatcacactggatttattgagcggtaggctgtactgggtggactccaagctgcactcgatttctagtatagacgtaaatggaggaaatagaaagacgatcctggaagacgaaaagagactggcccatccttttagtctggctgtgtttgaggataaagtcttctggaccgacatcatcaatgaggccattttctctgcgaaccggctcacggggagtgatgttaacttactggctgagaatctgttatcaccagaagatatggttctattccacaacctgacacagcccaggggcgttaattggtgcgagcgaaccacactgtctaatggaggttgtcagtacttgtgcctgcccgccccgcagattaacccccacagccccaagttcacctgtgcctgtccggatggcatgctgctcgctcgcgacatgcggtcctgcctgacagaggccgaggcagccgtggctacccaagaaacttccactgtgcgactaaaggtgtcctctaccgccgtgcgcacccagcataccaccacacggcctgtccctgacaccagccgactcccgggggctacccccgggttaacaaccgtggagatcgtgacaatgtcccatcaggcattgggcgatgtggctggtcgcggcaatgagaaaaaaccaagctccgtgagagcgctgtcaatcgtgctacccatcgtcctcctggtttttctctgcctgggcgtttttctattgtggaaaaactggcgcttaaagaacatcaacagcattaacttcgataatcctgtctaccagaagactactgaggatgaggtgcatatctgccataaccaggatggctacagctacccttcacgacagatggtgtcattggaggatgacgttgca

SEQ ID NO: 15955 - DNA, 2580 bp, Artificial Sequence
  Description of Artificial Sequence: Synthetic coding sequence
atgggcccatggggatggaagctcagatggaccgtcgcgctgctgctggccgcagcgggcactgcggttggtgaccgatgcgaaagaaatgaattccagtgccaggatggcaaatgtatctcttataagtgggtgtgtgacgggagcgccgaatgtcaggatgggagcgacgagtcccaagagacgtgtctctccgttacctgcaagtccggagattttagctgtggtggcagggtcaatcggtgcataccccagttttggagatgcgatggccaagtagattgcgacaatggtagtgatgagcagggatgtccccctaagacatgctcccaagatgagttcaggtgtcacgatggcaaatgcatttcacggcagtttgtgtgtgactctgatcgcgattgcttagacgggtctgatgaagcatcttgccctgtcttaacatgcgggccggcctctttccagtgtaattcaagcacttgcatcccacaactatgggcttgtgacaatgatcccgattgtgaagacggatctgacgagtggccacaacggtgcagggggctctatgtgttccagggcgacagcagtccctgcagcgcgttcgagtttcactgcctgtcaggtgagtgtatacacagttcctggaggtgcgacggagggccagactgcaaagacaaatccgatgaagagaactgcgctgtggcaacatgcagaccagacgaattccaatgcagcgatggcaactgcatccatgggtcaaggcaatgtgacagagaatatgactgtaaggacatgtcagacgaggtcgggtgtgtgaacgtgaccctgtgcgaggggccgaacaagtttaagtgtcactctggcgaatgtatcacgcttgacaaggtgtgcaacatggctagggattgtcgggactggagcgacgagcccattaaggagtgtgggaccaatgagtgcctggacaataatggcggatgtagccacgtctgtaatgatctgaaaatcggctatgaatgcctctgccccgatggattccagctggtggcccaacgacgttgtgaagatatcgacgaatgccaggatcccgacacctgctcccagctgtgcgttaacctagaggggggatacaagtgccagtgcgaggagggattccaattggatcctcataccaaagcttgtaaggccgtagggtctattgcctatctattctttacaaaccggcacgaagtacgtaagatgactctcgaccgcagcgagtacacaagcctgataccaaatctccggaatgtggtggccttagacaccgaagttgcatctaatcggatctactggagcgatctgtcacagagaatgatttgctccacccaactagatcgggcacatggtgtttcctcgtatgacacagtgatctctagagatattcaggccccggacggcctagcggttgactggattcactcgaatatttactggacagactctgtcctggggacggtttccgtggccgacactaaaggcgtgaaacggaaaacactgttccgcgagaatggctccaaaccaagagctatcgtggtcgatcccgttcacgggtttatgtattggaccgactggggcacccctgctaagatcaagaagggcggccttaatggcgtggacatatatagccttgttaccgaaaacatccaatggccaaacggcatcaccttagacctcctgtccgggcggctctactgggtcgattccaagctccattccatctcctctattgatgtcaacggcggcaatcggaagaccatcctggaagacgaaaaaaggttggcgcatcctttttccttagcggttttcgaagataaagtcttttggacagatataattaacgaagctatcttttctgccaacaggctcactgggtcagatgtgaatttactggcagaaaatctactgtctccagaggacatggtgcttttccacaacctgactcagcctcgaggcgtgaattggtgcgagcgcaccactttgtccaatggcggttgccagtacctgtgccttcctgcccctcagataaatcctcactcccccaaatttacatgtgcctgtccagacggaatgctccttgctagagacatgcgatcctgcttaacagaggccgaagccgcagtggcaacacaagaaacatccacagtccgcttgaaagtgagctctactgctgtgcgcacccagcacacaaccactaggccagtccccgacacctctcgtcttcctggtgccacacccggtctcacaacagtggaaatagtgacaatgagtcaccaggctctgggagatgttgcagggcggggaaatgagaagaaacctagtagcgttcgggctctgtcaatagtactgcctattgtgctcctggtcttcctatgcctgggggtttttctgctgtggaagaattggcgcctgaagaacatcaattccatcaactttgacaacccggtgtatcagaaaaccactgaggatgaagtgcacatatgtcacaaccaggatggttacagttacccatctagacaaatggtctctctcgaggatgacgttgcc

SEQ ID NO: 15956 - DNA, 2580 bp, Artificial Sequence
  Description of Artificial Sequence: Synthetic coding sequence
atgggtccttggggttggaaactgaggtggactgttgcactgcttctggccgcggctggtactgctgtgggagacagatgcgagcgcaatgagtttcaatgtcaggacggtaaatgtatcagctacaaatgggtttgcgacggctctgccgaatgccaggacggcagcgacgagtcccaggagacgtgcttgagcgttacctgtaaatcaggcgacttcagctgcgggggtcgcgtgaaccggtgtattccccaattttggcgctgtgatggtcaggttgactgcgataatggtagtgatgagcagggttgtcctcccaagacttgctcccaggacgagtttcgctgccacgatggtaaatgcattagcaggcaattcgtttgtgattccgatagagactgcctggatggttccgacgaagcaagctgtcctgtgttaacgtgcggtccggccagctttcaatgtaatagctctacgtgcatccctcagctgtgggcgtgcgataacgaccctgactgcgaggacggtagtgatgaatggcctcagcgatgtcgaggcctgtatgtatttcagggtgacagcagcccatgcagcgccttcgaattccactgcctgtctggagaatgcattcatagctcatggcgctgtgacggtggccctgactgcaaggataaaagcgatgaggaaaattgcgcggtggccacgtgtcgcccagatgagttccagtgttctgatggtaactgcattcatggttcaagacaatgtgacagggagtatgattgcaaggatatgagcgacgaggttggctgtgtgaacgttaccctgtgcgagggaccgaataaattcaagtgccacagcggcgaatgtatcacgcttgataaagtgtgtaacatggctagggattgccgcgactggtctgacgaaccaattaaagagtgcggaaccaatgaatgtctggataacaacggcggatgcagccacgtgtgcaacgacctgaaaataggttacgagtgtctgtgccctgacggattccaattggtagcgcaacgacggtgtgaagatattgacgagtgccaggatcctgatacctgttctcaattatgcgtcaatcttgaaggcggctataagtgccaatgcgaagagggatttcagcttgatccacacacgaaggcctgtaaggcggtggggagcatcgcctatttgttctttacgaaccgccatgaggtgcgtaaaatgactctggacaggtcggagtatacgagcctgatccctaatctgcggaacgtggtcgcgctggacaccgaagttgcgtcaaacagaatctattggagcgacctgagccagcgtatgatttgctctacccagctcgaccgggcgcacggagtctctagctatgatacagtaattagccgcgacatccaagccccggacggactcgcagtggactggatccactcaaatatatactggaccgatagcgtccttggcacggttagcgtagcagataccaagggtgttaagcgcaaaaccctatttagagagaacggaagcaaacctcgtgctatcgtcgtggatcctgtgcatggctttatgtactggaccgactggggcacccctgcaaaaatcaagaaggggggccttaatggagtggacatctatagccttgtgaccgaaaacatccagtggccgaacggtatcacccttgacctgctgtccggccgtctgtattgggttgattctaagctgcactctattagctccattgatgtgaatggaggtaatcgcaagaccattctggaggatgaaaagcgtttggcgcaccctttcagcttggcagtgttcgaggacaaagtattctggactgacattatcaatgaagccattttcagcgctaatcgccttacaggttccgatgtgaacctcctggcagaaaacctgcttagccctgaggatatggtgctgttccacaatctcacccagccacgcggtgttaattggtgtgagcggacgaccctgtctaatggcggttgtcagtatttgtgcctgcctgccccacagattaacccacatagcccaaagttcacgtgtgcctgtccggacggcatgctgcttgctcgcgacatgcgctcctgcctgactgaggcagaagccgcagttgccacccaagagaccagcaccgtgcgcctgaaggtttcgtcaacggcggttcgcactcagcacaccactaccaggccagttccggacacgagcagattgcccggtgcgacacctggtctgactaccgtcgagatcgtgaccatgagccatcaggcgctgggtgatgttgcgggtagaggtaacgagaagaagcctagcagcgtgcgcgccctgtctatcgtcctgccgatcgtacttctggtgttcctgtgcctgggagtatttctgctgtggaagaattggcggctgaaaaatatcaactctataaacttcgataacccagtttatcagaagaccactgaggatgaggtgcatatctgccataatcaggacggttactcctaccctagcaggcaaatggtgtctttggaggatgacgtcgcg

SEQ ID NO: 15957 - DNA, 2580 bp, Artificial Sequence
  Description of Artificial Sequence: Synthetic coding sequence
atgggcccttggggatggaaactgaggtggacagtagcgctcctgctggctgcagctggcactgctgtgggcgacagatgtgaaagaaacgagttccagtgtcaagacggcaagtgcatcagttacaagtgggtatgcgacggctctgctgaatgccaggacggttccgacgaatctcaagagacttgtctgtccgtgacttgtaaaagcggagacttttcttgcggaggccgcgtgaacaggtgcatcccccagttttggcgctgtgatggacaggtcgactgtgataacggttccgacgagcagggttgtccccccaagacgtgcagccaggatgagttccgctgtcacgacggcaaatgcatctccaggcagtttgtttgcgacagtgatcgcgactgccttgatggatctgatgaggccagttgtccggtgctgacctgtggacccgcctctttccagtgtaatagttctacctgtatcccacaactctgggcgtgtgacaatgatcccgattgcgaggatggctccgacgaatggcctcaaaggtgcaggggactgtatgtgtttcaaggcgactcttcaccctgtagcgctttcgagtttcactgtttgagcggtgaatgcattcacagtagctggagatgcgatggcggccccgattgcaaggacaagtctgacgaagaaaattgtgctgtggctacctgcaggcccgacgaattccagtgtagtgacggtaactgtattcacggtagcaggcaatgcgatagggagtacgattgtaaggatatgagcgacgaggtcggatgtgttaacgtcactctctgcgagggccccaacaagttcaaatgtcacagcggtgaatgtataaccttggataaagtgtgcaacatggcccgcgactgtagagattggtccgacgaaccaatcaaagagtgcggaacaaacgaatgcctcgataataatggcggttgttctcacgtctgtaatgaacttaagatcggctacgaatgcctttgcccagatggtttccagctcgtcgctcaaagaaggtgcgaggatatcgacgagtgtcaggacccagacacatgcagccagctgtgcgtgaacctggaaggcggttacaagtgtcagtgtgaggagggattccagctggaccctcatacaaaggcttgtaaggccgtcggatccatcgcgtacctgttcttcacaaataggcacgaagtacgcaaaatgacgttggataggtctgagtatacctcactgattcctaacctgagaaacgtggtcgccttggataccgaggtagcttcaaaccgcatctactggtctgatctttcccagcgcatgatctgttccacgcagctggatagggctcatggtgttagttcatacgatacagtcatctctagagacatccaggcccccgacggccttgctgtggactggatacacagcaacatttactggacggacagcgtcctcggtacggtgtccgtggcagacaccaagggcgtgaaaagaaagacactcttcagagagaatggtagcaaaccaagggcgatcgttgtggatccggtacacggcttcatgtattggacagactggggtacacccgccaagatcaagaaaggtggattgaacggcgtggacatctactctctcgttacagagaacatccaatggccgaacggaatcacactcgacctgctttccggcaggctgtactgggtggatagcaagctgcattccatatcttccatcgatgtgaatggcggcaaccgcaagaccatcctcgaagacgagaagaggctggcccatcccttcagcctcgctgtgttcgaagacaaggtgttctggactgacatcatcaacgaggcaatctttagtgcaaacagactgactggctctgacgttaacttgcttgctgagaaccttctgagcccggaggacatggtgctctttcataatctgactcaaccgagaggagtgaattggtgcgagcgcactacgttgtccaatggaggctgtcagtatctttgcctccccgctccccagatcaacccacattccccaaagtttacttgcgcctgtcccgacggcatgctgctcgcaagagacatgaggtcttgccttaccgaggccgaagcagctgtggctacacaggagacttcaaccgtaaggcttaaggtcagcagtacggctgtgagaacgcagcatacaactaccaggccggtgcccgatacctcaagactgccaggcgccacaccaggactcacgaccgtggagattgttaccatgtcacaccaggccttgggagacgtagcaggcaggggcaacgagaagaagccctcatccgtaagggccctgtctatcgttctgcccatcgtgctgctggtgttcctctgtttgggcgtgttccttctttggaagaattggagactcaagaacatcaatagcatcaacttcgataaccctgtgtaccaaaagacaaccgaagacgaggtgcacatctgtcacaaccaggacggttacagttacccttctagacaaatggtctccctcgaggatgatgtcgca

SEQ ID NO: 15958 - DNA, 2580 bp, Artificial Sequence
  Description of Artificial Sequence: Synthetic coding sequence
atgggaccatggggttggaaactcagatggacagtagcattgttgctggcggcggcaggcactgcagtaggagacagatgcgaacggaacgaattccaatgccaagacggaaaatgcatttcgtacaaatgggtctgcgacggatctgcagaatgccaagatggaagtgatgaatcacaggaaacttgcctgtccgtaacctgtaaatccggagatttttcatgcggaggaagagttaatcgatgtattccacagttctggagatgtgatggtcaagtcgattgtgataatggtagtgacgaacaaggatgccctccaaaaacatgttctcaggacgaattcaggtgtcacgacggaaaatgtatttctagacagttcgtatgcgacagtgaccgagattgcttggatggatcagacgaagcttcatgcccagtgttgacatgtggtcctgcatcttttcaatgcaattcgtcaacatgcattccccaactatgggcctgcgataatgatccagactgtgaagacggtagtgatgaatggccacagcgatgtaggggactatatgtgtttcagggtgattcttcgccgtgttcagcttttgagtttcattgcctatccggggaatgcatacattcttcgtggcgatgtgacggcggaccagattgtaaggacaaatctgacgaagaaaactgcgcagtggcaacgtgcagaccggatgaatttcaatgctcagatggaaactgcattcatggaagccgacaatgcgatcgagaatatgactgtaaagatatgagtgacgaggtgggttgcgtgaatgttacgctctgtgaaggaccaaataaattcaaatgtcattctggagagtgcattactttggataaggtctgcaacatggcacgcgattgtcgggactggagcgatgagccgattaaggaatgtggtactaacgaatgtctcgacaacaacgggggatgttcgcatgtttgcaatgaattgaaaataggatacgagtgtttatgtccagatggctttcagctcgttgcacaacgtcgttgcgaagacatcgatgagtgccaagatccagatacctgttctcagctttgtgtaaacctggaaggtggctacaagtgtcaatgtgaagagggttttcaattagatccacacaccaaagcctgcaaagccgttggatctatcgcttatttgtttttcacaaatcgtcatgaggtccgtaaaatgactcttgatcgctctgaatatacctcactcataccaaatttaagaaatgtcgttgctttagacacagaggttgcgtctaaccggatttactggtccgatttatcacaaaggatgatctgttctacgcagttagaccgagcacatggagtttcctcatacgataccgttatttctagagacatccaagctcctgatggtctcgccgtcgattggatccattctaacatatattggacggattcagttctaggaaccgtttcagtcgccgatacaaagggggtgaaacgcaagacactttttcgtgaaaatgggagtaagccacgggccattgtagtggatccagttcatggattcatgtattggaccgactggggaaccccggctaaaattaagaaaggcggactcaatggagtcgacatctattcgttggtaacggaaaatattcagtggccaaacgggattactctggacttgttgagcggacgactgtattgggtagattcaaagttgcactctatcagtagcatcgacgtgaatggaggaaatagaaaaacgatactcgaggatgagaaaagacttgcccacccattttcactagcagtttttgaagacaaggtgttctggactgacatcataaacgaagcaattttctcagcaaatcgccttaccggatcagatgttaatctactcgctgaaaatcttctctcgccagaggatatggttcttttccataatttaacccaaccacgaggagtaaattggtgcgaacgaactacattatcaaatggaggatgtcaatatctttgcctcccagcacctcagatcaatccacactctccaaaatttacatgtgcctgcccagatggtatgttattggcgcgtgatatgcgttcgtgccttacagaagcagaagctgcggtggcaacccaggaaacgtctacagttcgactcaaagtctcttcaactgccgtcagaacccaacacacgactacaagaccggtaccggatacatctcgtcttccgggggcaaccccaggactaacaacggttgagattgtcacgatgagtcatcaagcattgggagacgttgcagggcgtgggaacgaaaaaaagcctagctcagtccgagccttatccattgttttgccaatagttcttctagtctttctttgtttgggagtttttctgctttggaaaaattggagacttaaaaatatcaactcgatcaacttcgataatccagtttaccagaaaaccacagaggatgaagtgcacatttgccataatcaggacggatactcctatccgtctagacagatggtttcgttagaggatgacgttgcc

SEQ ID NO: 15959 - DNA, 2580 bp, Artificial Sequence
  Description of Artificial Sequence: Synthetic coding sequence
atgggcccgtggggctggaaattaagatggaccgtagccctgttactggccgccgctggaacagctgtgggtgataggtgtgaacgaaacgaattccagtgccaggatggaaaatgtattagctacaagtgggtgtgtgatggctctgcagaatgccaggacggttcggacgagagccaggaaacatgcctttctgtgacatgcaaaagtggcgacttcagctgcggcgggcgagtcaaccgttgtatcccacagttctggcggtgtgatggtcaagtggattgcgacaatgggtccgatgagcagggttgccccccgaagacgtgtagtcaggacgagttccgctgtcacgacggcaagtgtatttcccgccagttcgtgtgcgattcggacagggactgtctagacgggagtgacgaggcctcttgccccgtgttaacttgtgggcccgcatctttccagtgcaattctagcacctgcattccacagctatgggcgtgcgataatgacccagactgtgaggatggaagtgacgagtggccgcagcgatgccgtggcctctacgtgttccaaggagatagttccccctgctcagcctttgaattccattgcttatcaggcgaatgcatccattcaagctggagatgcgacggaggaccggattgtaaggataagagcgacgaagaaaactgtgcagtggccacgtgcaggcccgacgagtttcagtgcagcgatggtaactgtatacatgggtcaagacagtgcgatcgcgaatacgattgtaaagatatgtccgacgaggttggctgtgtaaacgtgaccctctgtgaaggacccaacaagttcaagtgccactctggcgagtgcattacactggacaaagtgtgcaacatggctcgggactgtcgtgattggagcgacgagcccattaaagagtgtggcactaatgaatgtctagataataatggaggttgttcacacgtatgtaatgaactgaaaatcggttacgagtgtctgtgtcccgacggtttccagctggtggcgcagcgaaggtgcgaagatattgatgagtgtcaagaccctgacacatgcagccagctatgtgtgaatctggagggcggctacaagtgccagtgcgaggaagggtttcagttagacccacacaccaaggcctgtaaagcagtcggctcaattgcctacttgtttttcaccaaccgacacgaagtgaggaagatgacccttgatcgctcagaatatacatctctgatccccaatctcagaaacgtagtggccctggacaccgaagttgcgtccaatagaatttattggagcgacctaagccagcgcatgatctgctctacacaactggatcgcgcgcatggagtgagtagttacgatacagttatcagtcgagacatacaagcccccgatggcctggccgttgattggattcatagtaacatctattggaccgacagcgtgctgggcacggtatccgttgcagacaccaaaggcgtgaaacgcaaaaccttattccgcgaaaacggatcaaagcctcgggccatagtggtcgaccccgtgcatggctttatgtattggacggactgggggacccccgccaagatcaaaaaggggggactgaacggagtcgacatctactctcttgtgaccgagaatattcagtggccgaacgggattacattggacctgcttagcgggcgtctgtactgggtcgacagcaaactgcactctatttcctccattgatgtgaatggaggaaatagaaaaacgatccttgaagatgagaaaagactcgctcaccctttttcacttgccgtcttcgaagataaggttttttggactgacatcatcaacgaagcaatctttagtgccaatcggctcacaggaagcgatgtcaacctgctcgctgaaaatttgctctcaccagaagatatggttttgttccataaccttacacaacccagaggggtgaattggtgtgaacggacgacattgagcaatggcggttgccagtatctgtgcctgccagccccacaaatcaatcctcacagcccaaagttcacttgcgcctgccccgacggtatgctcctggcacgagacatgcgtagctgtctgacagaggcagaagccgccgttgccacacaggagacaagcacggtccgtcttaaggtgtcctctaccgctgtgcgcacccagcatactaccacgcggccggtacccgacacttcaaggctaccgggagccaccccaggcttaacaacagttgaaattgtgacaatgagtcatcaggccttgggagatgtggcgggacgaggcaacgaaaagaagccgtcctccgtgagagctctatctatcgtactacctattgtgcttctcgtgttcctttgcctaggagtttttctgctgtggaagaactggcgattgaagaacataaactcgataaatttcgataaccccgtctatcagaagacgactgaggacgaagtgcacatctgtcacaaccaggacgggtacagctatccaagtaggcagatggtaagcctagaggacgacgtggct

SEQ ID NO: 15960 - DNA, 2580 bp, Artificial Sequence
  Description of Artificial Sequence: Synthetic coding sequence
atgggcccctgggggtggaaactgcgatggacggttgccttgttactggccgccgctggcactgctgtcggagatagatgtgagcggaacgaatttcagtgccaggacggaaaatgtatctcgtataaatgggtatgtgacggcagcgctgagtgtcaagacggttctgatgaatcgcaggagacatgcctgtccgtcacttgtaaatcgggggacttttcttgtggaggccgtgtgaaccgctgcatcccgcagttttggaggtgcgatggccaagtcgattgcgataatggatctgatgaacagggatgcccacctaaaacgtgtagccaagacgagtttcgttgccatgatggcaaatgtatcagccggcagtttgtatgcgattcagatagggattgccttgacgggagcgatgaagcatcttgcccggtgcttacctgtggtcctgcttcattccagtgtaactctagcacgtgtattccgcaattatgggcctgcgataatgacccggattgcgaggatggctcagatgagtggccacagcgatgtcgcggattgtatgtattccaaggagactcaagcccttgttcggcgtttgaatttcactgtcttagtggtgaatgtatacatagttcttggcggtgcgatggcggaccggactgtaaagacaaatcagatgaagaaaattgtgctgttgcgacgtgcaggccggatgagtttcagtgtagcgatggaaactgtattcacggcagcagacagtgcgatcgcgaatacgattgcaaggatatgtcagacgaggtcggctgtgtcaatgtaacattatgcgagggtccaaacaagtttaagtgtcattcgggtgaatgcatcacgcttgataaagtatgcaatatggctcgagattgccgggattggagcgatgaacctataaaagaatgcgggacaaatgagtgtctagataacaatggcggctgcagccatgtgtgtaatgagttaaaaattggatatgagtgtttatgcccggatggattccaactggtcgcgcagcgccgatgtgaagatatcgacgaatgtcaagatccggacacatgcagtcagctctgcgtaaatttggaaggcggctacaaatgtcagtgtgaggagggatttcagctagatccacacacaaaagcatgtaaagccgtgggtagcattgcctatcttttttttacgaatcgtcatgaagtaagaaagatgacactggatagatcagaatatacatcgcttattcctaaccttcgcaacgtagtagctctggataccgaagtggcctccaatcgtatatattggtcagacctgtctcaacgcatgatttgtagtacacaacttgatagggcccacggcgtctcatcctatgatacggtgatcagccgggatatccaggcgcctgatggtcttgcggtagactggattcacagcaatatttactggacggatagcgtcctgggcactgtgtcagttgctgacacaaaaggcgtaaagagaaaaactctctttcgggaaaatggctcaaagcctcgcgccattgttgtagatcctgtacacgggtttatgtattggacggactggggtacaccggctaagatcaaaaaagggggccttaatggagtggatatttattccttggtgacggaaaatattcaatggccaaacgggataactctcgatctactgtcaggtcggctttattgggtggatagtaaacttcatagtattagctctattgatgtcaatggcggaaatagaaaaacgatcctggaagacgaaaagcgtctggcacaccctttctccttagcagtattcgaagataaagtgttttggacagatattatcaatgaagccatctttagcgcgaatcgacttactggcagtgacgtaaaccttcttgctgaaaacttgttatctccagaagatatggtcttatttcataacttaacacagccacgcggagtcaattggtgcgaaagaacaacgctttctaacgggggatgccaatacctttgcttacctgcacctcagattaacccgcattcccctaagtttacatgtgcgtgccctgatgggatgcttttggcgagagatatgcgctcctgtctcactgaagctgaagctgctgtagcgacacaggagacgagcacagttagattgaaggtgagctcgacggcagttagaacacagcatacgaccacaagacctgttccggataccagccgtttgccgggcgcgacccctggtctgaccacggtcgaaatcgttacaatgtcccaccaggcgttgggtgatgttgccggaaggggcaatgagaaaaaaccgtcttccgtgcgtgccttatcgatcgtcctgcctatcgtgttgttagtatttctttgccttggtgttttcttgctttggaaaaattggagactcaagaatattaactcaattaactttgacaatcctgtataccagaagacaacggaagatgaagttcatatttgccataatcaagatggctattcttacccttctagacagatggtgagccttgaagatgatgtcgct

SEQ ID NO: 15961 - DNA, 2580 bp, Artificial Sequence
  Description of Artificial Sequence: Synthetic coding sequence
atgggaccgtggggatggaagctgagatggaccgtggcgctgctcctcgctgcggctggcaccgctgtcggcgaccgctgcgaaagaaacgaatttcaatgtcaggacggaaagtgcatctcgtacaaatgggtttgcgacggtagcgctgaatgccaggatggctccgacgagtcccaggaaacttgtctgagcgtcacctgcaagagcggcgatttctcatgcggaggcagggtcaacaggtgcatcccacagttctggaggtgcgacggacaggtggactgtgacaacggctcagacgaacagggatgtcctcccaaaacctgttcccaggatgaatttcggtgccatgatgggaagtgtatttcacggcagttcgtctgcgactcagaccgggattgcctggacggatccgatgaggcgtcctgccccgtcttgacctgtggacctgcctcatttcaatgcaattcttcaacttgcattccgcagctgtgggcatgcgacaacgaccctgactgcgaggacgggagcgacgaatggccgcaacggtgtaggggtctgtatgtctttcagggagactcgtccccttgcagcgcctttgagttccattgtctgagcggggaatgtatccactcgagctggcgctgtgacggaggacctgattgtaaggacaagtcagacgaggagaactgtgcggtggctacgtgtcggccggatgaattccagtgctcggacggcaactgcatccatggatcccgccagtgcgaccgcgaatacgactgcaaggatatgtcggacgaagtggggtgcgtgaatgtgactctctgtgaaggccccaataagtttaagtgccactcgggagagtgcatcactctcgacaaggtctgcaacatggcccgggattgccgggactggtcggatgagccaatcaaggaatgcggaaccaatgagtgtcttgataacaacggaggatgctcccacgtctgcaacgaactcaaaatcggatacgagtgcctctgcccggacgggttccaactcgtggcccagagacgatgcgaagatatcgatgagtgccaggatccggacacctgctcccaactctgcgtgaacctcgagggcggatacaagtgccagtgtgaagaagggttccagctcgatcctcatacgaaggcgtgtaaggctgtcgggagcatagcctacctcttcttcacgaaccgccatgaggtgcgcaagatgaccctcgaccgcagtgagtacacctcccttatcccgaacttgcggaatgttgtggctttggacaccgaagtggcctccaatcggatctactggagtgatctctcacagagaatgatctgctcgacgcaactcgaccgcgcccacggtgtgagctcgtacgatactgtgatctctcgggatatccaagcaccggatggcctggcggtggactggatccactcgaacatctactggactgactcagtgctggggaccgtgtctgtggcggacaccaaaggagtgaagcgtaaaaccctcttccgagaaaacgggtcgaaaccacgagcgatcgtggtggatccggtccatggattcatgtactggactgattggggaacgccggctaagattaagaaaggaggactgaatggagtggacatctactcactggtgaccgaaaacattcagtggccgaatggtattactctggacctgctcagcgggcgcctgtactgggtggactcgaagctgcacagcatctcctccatcgatgtgaacggaggaaatcgcaaaactattttggaggatgaaaagagactggctcaccctttcagcctcgcagttttcgaggacaaagttttctggactgacattatcaatgaggccatcttttccgccaaccgactgactgggtctgacgtcaacctgctggccgaaaatctgctgtcgccggaagatatggtcctctttcacaatctgacccaaccccgcggcgtgaactggtgcgagaggactactcttagcaacggcggatgtcagtacctgtgcctgcctgcgccccagattaacccacatagtccgaagttcacctgcgcctgccctgacggaatgttgctggctagggacatgagatcgtgtctgactgaggccgaggcggcggtggcgactcaagagactagcaccgtccgcctgaaggtcagttccaccgccgtgagaactcagcatacgaccacccgcccagtgccggataccagccggcttccgggagcgactccaggcctgactaccgtggaaatcgtaacgatgtcacatcaggccctgggggacgtggcaggccggggaaacgaaaagaagccatcatcagtgagggcactgtcaatcgttctccctatcgtccttctggtgtttctgtgcttgggcgtgtttctgctgtggaagaattggaggttgaaaaacatcaactcgatcaatttcgacaacccggtgtaccaaaaaactactgaggacgaagtccacatctgtcacaatcaagatggatactcgtacccatcgagacagatggtcagtctggaagatgatgtggcc

SEQ ID NO: 15962 - DNA, 2580 bp, Artificial Sequence
  Description of Artificial Sequence: Synthetic coding sequence
atgggcccgtgggggtggaaacttaggtggaccgtcgcccttctgctagccgccgccgggaccgcggtaggagatcgatgtgagcgtaacgagtttcagtgccaggatggcaagtgtatttcctacaagtgggtgtgtgacggttctgcagagtgccaggacgggtctgacgagagccaagagacatgcctttcagttacctgcaagtcaggggatttttcctgtggggggagggtgaatcgctgcattccccaattttggagatgtgacggtcaggtggactgcgataacggatccgatgagcaggggtgtcctcctaagacctgttcgcaagatgagttcaggtgtcatgatggtaagtgtatatcccgccagttcgtgtgcgactccgatcgggattgtctggatgggagtgatgaggccagttgccctgtcctcacatgcggccctgcgtccttccaatgcaacagctccacgtgtatcccgcagctctgggcctgtgacaacgaccctgattgcgaagacggcagcgacgaatggcctcagcgctgtcgcggcctatacgttttccagggcgatagctctccatgttctgctttcgaatttcactgcctgagcggagagtgcatccatagcagttggagatgcgacggcgggccagattgcaaggacaaatccgacgaggaaaactgtgccgttgccacgtgtcggccggacgaattccagtgtagcgacggaaactgcatccatggaagtcgtcagtgtgaccgtgagtatgactgcaaagatatgtcagacgaggtggggtgcgtaaatgtcactctctgcgaagggcctaataagttcaagtgccacagcggggagtgcattaccctagataaggtatgcaatatggcgcgggactgcagagattggtctgatgagcctattaaagagtgtgggaccaacgagtgtctcgataataatggaggatgcagccatgtatgtaatgagctgaagataggctacgagtgcctatgtcctgacggcttccagctggtcgctcagagaaggtgcgaggacatcgatgagtgccaggaccctgacacttgtagccagctctgcgtgaatctggaaggtggatataagtgccagtgcgaggagggtttccagcttgacccccacacaaaggcgtgtaaagctgtcggatctatcgcttacctgttttttactaacagacatgaagtgcggaagatgactctggaccgctccgaatacacaagcctgatccctaacctgcgcaatgtggtggccctggacaccgaagttgctagcaacaggatttattggtctgacctctcccagcgcatgatctgttccactcagctggatcgggcccatggggttagctcctatgacacggtgatctctcgagatattcaggcgcctgacggcctggctgtggattggattcattcaaatatctactggacagactcagtccttggtaccgtcagcgtggctgacactaagggagtcaagaggaaaaccctgttcagggagaacgggtccaagcctagggccattgttgtggatcccgtccatggctttatgtactggaccgactggggcacacctgctaagattaagaaagggggcttgaatggagtggatatttacagtctggtcaccgaaaatatacagtggcctaacggcattaccttagacctgctgtccgggcgactgtattgggttgattccaagctccacagcattagctccattgacgtgaatggaggcaatcggaaaaccattctggaggacgaaaagaggctggctcacccgttctcactcgcagtgtttgaggacaaagtgttctggacagatatcataaacgaagcgatctttagcgccaaccgacttacaggttctgacgtaaacctgctggccgaaaatctcctgtctcctgaggacatggtcttgttccataatttgactcagccgaggggcgtgaactggtgcgagaggaccacattaagcaacggcggctgccagtatctttgcctgccggcaccacagatcaatccccacagccctaaatttacatgcgcctgtcctgatgggatgctgctcgcccgcgacatgagaagctgcctcacagaggcagaggcagcggtggccacccaggagacatccactgttagactgaaagtaagctcaactgctgtgagaactcagcatacgactacgagacctgtgccagatacatcccgcttacccggagcgacccctggcctgactacagtcgaaatagttacgatgtcccaccaggctcttggagacgttgcggggcggggaaatgagaagaagcctagctccgtccgggccctgtcaatcgtactgcccattgtcttgctcgtgttcctttgcctgggcgtgtttctgctgtggaaaaattggcgacttaagaacatcaactcaatcaatttcgataatcccgtgtaccaaaagacaacagaggatgaagtgcacatttgccataaccaggatggatatagttacccatctagacagatggtcagcctggaagatgacgtcgca

SEQ ID NO: 15963 - DNA, 2580 bp, Artificial Sequence
  Description of Artificial Sequence: Synthetic coding sequence
atgggcccatggggatggaagctacggtggaccgtagcgttgctcctggcggcagcagggaccgcagtgggagatcggtgcgagcgaaatgagttccagtgccaggatggcaaatgtatcagctataagtgggtgtgtgacggttcagccgaatgccaggacggcagtgacgagtcacaggaaacctgtttatccgtcacttgcaaaagtggcgactttagctgtggggggagggtgaatcggtgtatccctcagttttggcgatgtgacggtcaagtcgactgcgataacggttccgacgagcagggatgcccacccaagacatgctcccaggatgaatttagatgtcatgacggcaagtgcatatccagacagttcgtgtgtgattcagatcgggactgcctggatggtagtgatgaggcatcctgcccagtccttacatgtggtccagcctcatttcagtgtaatagcagcacttgcatcccacagctgtgggcttgcgataatgaccccgactgtgaggacggatccgatgaatggccccagcgctgtcgtggcctttatgtgttccagggcgatagcagcccatgctctgcatttgaatttcattgcctgtctggggaatgcatacatagctcctggaggtgtgacggagggccagattgtaaagacaagtcagacgaggagaattgcgccgtcgcaacatgcagacctgatgagtttcaatgcagtgatggaaactgtattcatggcagcaggcaatgcgaccgggaatatgactgcaaagacatgtccgatgaagtcggatgcgtcaacgttacgctgtgtgaaggccccaacaaatttaaatgtcacagtggggaatgcatcacactggataaagtttgtaatatggctcgagattgtcgcgactggagcgacgagccgattaaggaatgtggaacgaatgagtgcttggataataatggcggatgtagccatgtctgtaacgagctgaagattggctacgaatgcttgtgcccggacggcttccaactggtagcccagaggcgctgcgaggatatcgacgaatgtcaagaccccgacacgtgctcgcagttgtgtgtgaatctggaaggtggatacaaatgtcaatgcgaggagggctttcagctggaccctcacaccaaggcatgtaaggctgtaggcagtattgcgtacctctttttcacgaacagacacgaggtccgaaaaatgacgcttgacaggtcagaatatacttccttgattcccaatttgcgaaatgtcgtggcgcttgataccgaagtcgcatctaatcgcatttattggagtgatctcagtcagagaatgatctgctccactcagctggatagagcccatggcgtgagctcatacgacacagtgatttcccgtgacatacaggcaccagatggactggcagtagactggattcatagcaatatttactggacggactctgtcctggggactgtgagcgtagccgataccaagggcgtcaagaggaagactctgtttagggagaatggttccaagcctagggcaatagtggtggatccggtccacgggtttatgtactggactgattggggaacccctgctaaaatcaagaagggcggcttgaatggggtggacatctactcactggttacggaaaacattcaatggcctaacgggattacacttgatctgctgtctggccgattgtactgggtggattctaaacttcactccattagttctatcgacgtgaacggagggaatagaaagactatactagaggacgagaagcggctggcccaccccttcagcctggcagtgttcgaggataaggttttctggacggatatcataaacgaagcaatttttagtgctaaccggctgacaggcagcgacgtgaatctgctggctgaaaacctactgagcccagaggatatggtgttatttcacaacctgacgcagcctcgcggcgtgaattggtgcgaacgcaccactctttccaacggcggctgccagtacctctgtctgcctgccccacagatcaaccctcacagcccaaagtttacatgcgcctgcccagatggaatgttgctggcacgcgacatgcggagctgtttgaccgaggccgaggcagctgtggctacccaggagacatcaaccgttaggttaaaggtgtctagtaccgcggttcggacgcagcacaccactactcgaccagttcccgatacatcccgactgccaggggcaacgcctggattgaccacagttgaaattgtcaccatgagccatcaagccctgggcgatgtagccggccgggggaacgagaaaaagccgtccagcgtgcgtgccctgagtatagtgctgccaatagtgttacttgtgttcctctgcctcggggtctttctcttatggaaaaactggcgcctcaagaacatcaactcaatcaacttcgacaatccagtctatcagaagacaaccgaggatgaagtccatatttgtcataatcaggatggatacagctacccttcacgccaaatggtttcgctggaggacgacgtcgct

SEQ ID NO: 15964 - DNA, 2580 bp, Artificial Sequence
  Description of Artificial Sequence: Synthetic coding sequence
atgggaccgtggggatggaaattacgttggaccgtcgccctgctgctagccgccgccgggaccgccgtgggagacagatgcgagcggaatgagtttcagtgccaggacggcaagtgcatctcctacaaatgggtctgcgacgggagcgcagagtgccaagacgggtcggatgagtcacaggagacgtgtctatccgtgacgtgcaagagtggtgacttcagctgcgggggcagggtcaatagatgcatccctcaattctggcgctgtgatgggcaggttgactgcgacaacgggagtgatgagcaggggtgcccaccgaaaacctgttctcaggatgaattccgatgccacgatgggaagtgtatctctcggcaatttgtgtgcgatagcgatcgagattgtctggatggcagcgatgaagccagctgcccggtgctaacctgtggccctgcctcatttcagtgcaattcatctacgtgcatcccacagctgtgggcgtgcgataatgatccagactgtgaggacggctccgacgaatggccacagcgttgcagaggactctatgtgtttcaaggtgactcctcaccctgtagcgcgtttgaattccattgccttagtggcgagtgtatacactcctcatggcggtgtgatggcggtccagactgcaaggacaagtcagacgaggaaaattgtgccgtcgccacgtgcagaccggacgagttccagtgtagcgacggaaactgcatacacggtagcagacagtgtgacagggagtatgactgtaaagatatgagcgatgaggtaggatgtgtaaacgtcaccctctgcgaggggcccaataaatttaagtgccacagcggggaatgcattacgctggataaggtttgcaatatggcacgcgactgtcgtgattggtccgacgagcccataaaggagtgcggtacaaacgagtgcctagacaacaatggtggctgcagccacgtttgtaatgagctgaagataggttacgaatgcctctgtcctgacggttttcagctggtggcccagcgcaggtgcgaagatattgacgagtgccaagaccccgacacttgtagtcagctgtgcgtgaacctggaaggcggctataaatgtcagtgcgaggagggattccagctggacccacacacaaaagcatgcaaagcagtgggaagtattgcgtatttattcttcacaaatcgacacgaggttaggaaaatgacgttagaccgatcagagtacaccagtctaattcccaaccttcgtaatgtggtggcactggatacagaggtcgcatctaaccgcatctactggagcgatttgtctcaaaggatgatctgcagcacgcagctggaccgtgcacatggtgtgtccagctatgatacggtcatatcaagagacattcaggctccagatggcctcgcagtggattggatccacagcaacatttattggacagattccgtactcgggaccgtcagtgtggcggacacaaagggcgtgaaacggaagacccttttccgggaaaatgggtctaaaccacgagctattgtcgtagatcccgtacacggctttatgtattggaccgactgggggacacctgcgaaaatcaagaagggcggacttaacggagtcgacatatatagcctggtcaccgaaaatatccagtggcctaatgggatcacactcgatctgctgtccggtcggctatattgggtcgactccaagctgcatagcatcagttccattgatgtgaatggcggcaaccgtaagaccatcttagaagacgagaagcggctagcacacccattttcattagctgtgttcgaggataaggtgttttggacagacatcatcaacgaagccatattctcagccaatcgtctgactggatccgacgttaacctgctggctgagaaccttctatctccagaggatatggttctgttccataacctgactcagcccagaggagtcaattggtgtgagcggaccacactatcaaatggcggatgtcagtacttgtgcctgccagcgccccagataaatccgcactcacccaagtttacctgtgcctgcccggatggcatgctgctggcccgagacatgaggtcctgcctgacagaagctgaggccgccgtggccacgcaggaaacctccactgtgcgattaaaggtaagcagcaccgcagtcaggactcagcacaccacaacccgcccagtacctgatacctccaggctccctggtgccacgccgggcctgaccactgtggaaatcgttaccatgagccaccaggcattgggcgacgtagcgggacgggggaatgagaagaagccttccagtgtgcgcgcactgtccatcgtgcttccaattgtccttctggtctttctgtgtctcggggtattccttctctggaaaaactggagactgaagaatataaattctattaattttgacaacccagtatatcagaagaccaccgaggacgaggtgcacatctgccacaatcaggacggctactcatatccttcccgccagatggtgagcctggaggacgatgtggca

SEQ ID NO: 15965 - DNA, 2580 bp, Artificial Sequence
  Description of Artificial Sequence: Synthetic coding sequence
atgggaccatggggttggaaactccgatggactgtggccttgctcctggcggctgcaggaacagcggtgggcgatcgctgcgagcgaaacgagtttcagtgccaagatgggaagtgtatttcctacaagtgggtgtgcgatggaagcgctgaatgccaggacggtagcgacgagtctcaggaaacttgcctgtctgtaacctgcaaatccggcgattttagctgtggagggagggtgaatcgatgtattccgcagttttggcgctgtgacggacaggtcgactgtgacaatggcagcgatgagcaaggttgccctccaaagacctgttcccaggacgagttcaggtgccatgacggcaagtgcatcagtcggcagttcgtatgcgacagtgaccgcgattgcctggacggttctgacgaagccagctgtccagttttgacctgcgggcccgcaagtttccagtgtaattcctcaacctgcatcccccagctgtgggcgtgcgacaacgaccccgactgcgaggacggatcagacgaatggccccaaaggtgccggggcctgtacgtgtttcagggggactccagcccatgttctgccttcgagtttcactgcctgtcaggggagtgtattcacagctcttggcgctgtgatgggggtccagattgcaaggacaaatccgatgaagaaaactgcgccgttgctacctgtcgacctgacgaattccagtgttccgatggcaattgcatacatgggagtcggcaatgtgaccgcgaatacgattgcaaagacatgtcagatgaagttggttgtgtaaacgtcaccctgtgcgaagggcccaacaaattcaagtgccacagtggcgagtgtattactctggataaggtctgcaacatggccagagactgtcgagattggtccgatgagccgatcaaggaatgcggcaccaatgaatgtctggataataatggagggtgcagccacgtgtgcaatgaactgaagattgggtacgagtgcctgtgtcctgatggattccagctggtagctcagcggaggtgcgaggatattgacgaatgtcaggaccccgatacatgttcacaactgtgtgttaatctggagggcgggtacaaatgtcagtgcgaagaaggtttccagctcgatccccacaccaaggcgtgtaaggcggtggggtctattgcatacctcttctttacgaaccggcatgaagtgcggaaaatgactctcgacaggtccgaatatacatccctcataccaaacctgcgcaacgtggtcgcgttggatactgaggtggcttctaatcgcatttactggtccgatctgagtcagcgcatgatctgttcaacccaattggacagagcgcatggcgtgtcttcatacgacacagtcatttccagggacatccaggcgcccgatggtttggcagtcgactggatccattcaaatatctattggactgactccgtattgggtaccgtgagtgtcgccgatacaaagggagtcaaaaggaagaccctgtttagggaaaatggctccaagccacgcgctatagtcgtggacccagtgcacgggtttatgtactggaccgattggggaactcccgccaagatcaagaaaggaggcctgaacggtgtcgatatttattccctcgtgacagaaaatatacaatggcctaatgggatcaccttggacctgctgtccggccggctctattgggttgattccaagctgcactccatttcaagcatagatgtcaatgggggcaaccgcaagaccattcttgaggacgagaagcgcctcgcccaccctttctcactggccgtctttgaggataaggtgttttggaccgacatcattaatgaggcaattttcagcgcaaatcggctgacaggcagtgatgtgaacttgctggcagaaaatttgttgtcaccagaggacatggtgctgtttcacaaccttacgcagccccgaggggtgaactggtgcgagcgcacaaccctgtccaatggcggctgccagtacctttgccttcccgccccccagataaatcctcactctccgaagttcacatgcgcatgtcccgacgggatgctcctcgcgagggacatgcgctcctgcctcaccgaagccgaggctgcagtcgccacgcaggagactagcactgtcagactcaaagtgtcttccacagcagtgcgcactcagcacaccacaacccggccagtccccgataccagtagactgccgggtgccaccccaggccttacaaccgtcgagatcgtgaccatgtctcatcaggctctcggagacgtcgcaggaagaggaaatgagaagaaaccaagttccgtgcgagccctttccattgtcctgccgatagtgctgctggttttcctgtgtctgggggtattcctcttgtggaaaaattggagactcaagaatataaactctattaatttcgacaatcccgtctaccagaagacaaccgaagacgaagtacatatctgtcacaaccaggacgggtattcctatccatctaggcagatggtgagtctggaagatgacgttgca

SEQ ID NO: 15966 - DNA, 2580 bp, Artificial Sequence
  Description of Artificial Sequence: Synthetic coding sequence
atgggcccttggggctggaagctgaggtggacggtggcgctcctgctcgcggcggcgggaaccgccgtcggcgaccggtgcgagcgcaacgaatttcagtgtcaggacgggaaatgcatcagctacaagtgggtctgcgatggatctgcagagtgccaggatggctcagacgagagccaagaaacctgtctttccgttacttgtaaatcgggcgacttcagctgcggaggacgggtgaaccggtgcatcccacagttttggcggtgcgacggacaggtggattgtgacaatgggtccgacgaacaaggctgcccgccaaaaacttgctcccaagacgagttccgctgccatgatggaaagtgcatctcacgacaattcgtgtgcgattcggatcgggattgtctcgacggatcggatgaagcgtcgtgcccggtgctcacttgcggaccggccagctttcaatgcaattcgtcaacctgcatccctcagctgtgggcctgcgacaacgatccggactgcgaggatggatcggacgaatggccccaaagatgccgcggtctgtacgtgttccaaggtgactcctcaccgtgttcggcgttcgagttccactgtctcagcggggaatgcatccactcgtcatggaggtgcgacggtggtccagactgtaaggacaagtcggatgaagagaactgcgctgtcgccacgtgcaggcctgatgagtttcagtgctcggacggaaactgcattcacggaagccggcagtgcgaccgggagtacgattgcaaagacatgtccgatgaggttggttgtgtcaatgtcacgctctgtgagggaccgaataagttcaagtgccattccggagaatgtatcaccttggataaggtctgcaatatggcgagagactgccgcgactggagcgatgagccgatcaaagaatgcggaactaacgaatgtttggataacaatggcggctgtagccacgtgtgcaacgagctgaagattggatacgagtgcttgtgccctgatggatttcaactggtcgcacagagacggtgcgaggacatcgatgaatgccaggatcctgacacctgcagccagctctgtgtcaacttggagggaggatacaagtgccagtgtgaggagggctttcagctggacccgcacaccaaggcatgcaaggccgtggggtccatcgcctacctctttttcaccaataggcatgaagttcggaagatgacccttgaccggtcggaatatacttcgcttatcccgaatctccggaacgtggtggccctggatactgaggtggcatcgaaccgcatctactggtctgacctgagccagcggatgatctgctcgacccagctggaccgggcccacggagtgtcctcctacgacactgttatatcccgagacatccaggctccagacggactcgcggtcgattggatccattccaacatctactggaccgattccgtgctgggaactgtgtccgtggccgatactaaaggggtgaagcgcaagaccctgttccgcgagaacggatcgaagccgcgcgcgattgtggtcgaccctgtgcacggatttatgtattggaccgactggggtactccagccaagatcaagaaggggggactcaacggtgtggacatctactcacttgtgaccgaaaacatccaatggcccaacggcatcactcttgacctgctctcgggcagactgtactgggtggacagcaaactccatagcatatcctcaatcgacgtcaacggcggaaataggaaaacgatccttgaagatgagaaaagactcgcacacccattctcactcgcggtctttgaggataaagtgttctggaccgacatcattaacgaagcaatcttttcggccaaccgcctgactggatccgacgtgaacctgctggcagagaacttgttgtccccggaggacatggttctcttccataacctcacccagccccggggtgtcaactggtgcgaaagaaccactctctcgaacggtggctgtcaatacctgtgcctgcccgctccccagattaacccgcactctccgaagttcacttgtgcctgccccgatggaatgctcctggctcgcgacatgagatcatgcctcacggaggccgaggctgccgtggcaacgcaggaaacctccactgtcagactgaaggtgtcgagcaccgccgtgcggacccaacatactacgactagaccagtcccggacacctcgagactgccgggagctaccccgggcctgaccaccgtggaaatcgtgacgatgtcccaccaggcactgggagacgtggcgggacgcgggaatgagaaaaaaccttcgtcagtcagagctctcagcatcgtgcttcctatcgtgctgttggtgttcctttgtctgggagtgttcctcctttggaaaaactggagactcaagaatatcaattcgatcaattttgacaatccagtgtaccaaaaaacgactgaggatgaggtccacatctgccacaaccaggacggctactcatatcctagccgccaaatggtttcgctggaagatgacgtggcg

SEQ ID NO: 15967 - DNA, 2580 bp, Artificial Sequence
  Description of Artificial Sequence: Synthetic coding sequence
atgggcccatggggttggaagctgagatggaccgtggcgctgcttctcgcagcagcagggactgcagtgggtgacaggtgtgagcggaatgaattccaatgccaagatggaaaatgcatttcatacaaatgggtgtgcgacggaagcgcagagtgtcaagacgggtcagatgaaagccaggaaacttgcctttcggtcacttgtaagagcggagatttttcctgtggaggacgcgtgaacagatgtatccctcaattctggagatgcgacggtcaagtggactgcgataacgggtcggatgaacaaggatgtccacccaaaacttgcagccaggatgaatttaggtgtcacgatgggaagtgtattagcagacagttcgtgtgtgattccgatcgtgattgcctggatggtagcgacgaagcctcgtgcccggtgttgacttgtggacccgcctcatttcagtgtaactcgtccacttgtatacctcaactgtgggcatgcgacaacgatccagattgtgaggacggatcggacgaatggcctcaaaggtgcaggggactctacgtgtttcagggagactcaagcccatgctcagcattcgaatttcactgtctgtcgggtgaatgtatccatagctcgtggcgatgtgacggcggtcccgattgcaaggataagtccgatgaggaaaattgtgccgtcgcaacctgcaggccggatgagtttcaatgttccgatggtaactgtatccatggttcgcgccagtgtgatcgggaatacgattgtaaggacatgtccgacgaagtgggttgtgtcaatgtgaccctgtgtgaaggacctaacaaattcaagtgccattcaggagaatgtattaccttggacaaggtgtgcaacatggcacgcgactgcagagattggtcagatgaaccaataaaggagtgtggaaccaacgagtgcctggacaacaatggaggatgttcccacgtctgtaatgagcttaagatcggatacgaatgcctctgccctgatgggtttcagcttgtggcccaacgaagatgtgaagatatcgatgaatgtcaagaccctgatacttgcagccaactgtgtgtcaatctggaaggtggctacaaatgtcaatgtgaggaaggatttcaacttgatccacataccaaagcatgcaaggccgtgggctcgattgcatatctcttctttactaacagacatgaagtgaggaagatgacccttgatagatccgaatacacctccctcatacctaacctccgaaacgtcgtggccctcgacaccgaagttgcctcgaacagaatatactggtcggatcttagccagagaatgatctgttcaactcaacttgatagggcacatggcgtttccagctacgatactgtgatatcgcgggatattcaggcgcccgacggtcttgcggtggattggattcacagtaacatatactggactgattctgtgttggggactgtctcggtggctgatactaagggagtgaaacgtaaaaccctgtttcgcgaaaatgggtctaaacctcgggccatcgtggtggatcccgtgcatggttttatgtactggaccgactgggggactcctgcaaagataaagaagggcgggctgaatggcgtcgatatctacagccttgtgaccgagaatatccaatggccgaacggaatcacccttgatctgctttcggggagactctactgggtggatagcaaacttcattccatttcctctattgatgtgaatggtggcaaccgcaagaccatcctcgaagatgaaaagcgtctcgcacaccccttctcactggcagtattcgaggataaggtgttttggactgacattatcaatgaagctattttctcggccaacaggttgaccggaagcgacgtgaacttgctcgccgaaaatctcctttcccctgaggacatggtcctgtttcataacctcactcagcccaggggggtgaactggtgcgagcgcacgaccctttccaacggtggatgccagtacctttgtctgccagcaccccagataaaccctcattcgcccaagtttacctgtgcatgtcctgatgggatgcttctggctagagacatgcgtagctgtctgactgaggctgaggccgccgtggccacccaagaaaccagcactgtgaggcttaaggtgtcgtccactgcagtcaggacccagcataccactaccagacctgtgccagataccagcagactgccaggggccacccccggccttacgactgttgagatcgtgactatgtcgcaccaggcgctgggggatgtggccggaagagggaacgagaaaaagccatcctccgtcagggcactctccattgtgttgccaattgtcctgctggtgtttctctgtcttggcgtctttctcctttggaagaactggcggttgaaaaacattaactccatcaatttcgacaatccagtgtaccagaaaaccacggaggacgaagtgcacatatgtcataatcaagacgggtactcatacccttcgaggcagatggtgtcgctggaagatgatgtggca

SEQ ID NO: 15968 - DNA, 2580 bp, Artificial Sequence
  Description of Artificial Sequence: Synthetic coding sequence
atgggtccatggggatggaaactgaggtggacagtggccctcctccttgccgccgctggcacagcagtcggcgaccgatgtgagagaaacgaatttcagtgtcaggacggaaagtgtatctcttacaagtgggtctgcgatggatccgccgagtgccaggatggatcagacgaatcccaggagacctgcctgagtgtgacctgcaagtcaggagatttctcctgtggggggcgtgtcaaccgctgtatcccgcagttctggcgttgtgatggacaggtggattgtgacaacggctcggatgagcaaggatgtccacccaaaacatgctcacaggacgaatttagatgtcacgacgggaagtgcatctccaggcagttcgtatgcgatagcgatcgggattgtctggacggtagcgacgaggcgtcttgtcctgtcttgacctgtggcccagcgtcttttcagtgcaattccagcacctgtattcctcagttgtgggcttgcgataacgacccagactgtgaagacggctctgatgagtggccacagaggtgccgtgggctgtatgtgttccaaggagattcctccccgtgcagcgccttcgaattccactgcctgtccggcgagtgtattcattccagctggcgatgtgatggggggcccgactgtaaggataagagtgatgaagagaattgtgccgtggccacatgcagaccagacgaatttcagtgttctgacgggaattgcatccatggctctcgccagtgcgacagggagtatgactgcaaggatatgagcgatgaagtcggatgtgtcaacgtcaccttatgcgaaggtcccaataagttcaagtgtcattctggcgaatgcattacactggacaaggtatgtaatatggcacgtgactgtagagattggagcgacgagccaattaaggaatgcgggaccaacgagtgcctggataacaacgggggctgcagccacgtgtgtaatgagctgaaaataggatatgaatgcctgtgccctgatggtttccagctcgtggcgcagcggaggtgcgaagacatcgacgagtgtcaggatccggacacatgtagccaactctgcgtcaacttggagggcgggtataagtgccagtgcgaggagggcttccagctcgacccccacaccaaagcttgcaaagccgtaggctcaatcgcatacttattcttcacgaacaggcatgaagttcgaaaaatgaccttagaccggtccgaatacactagccttatcccaaatctgcgcaacgtggtggcgcttgacacagaagtggccagcaaccgtatatactggagtgacttgtcgcaaagaatgatttgctccacccagttggaccgggcccatggggtaagttcatacgacaccgtcatcagcagagacatacaggcacctgatgggctggcggtcgactggatacattctaacatctactggaccgattccgtcctcgggaccgtgtctgttgcagataccaaaggtgtaaagcgtaaaacactttttagagaaaatggctcaaagcccagagccatcgtcgtcgatccagtgcatggattcatgtactggaccgactggggaaccccagccaaaattaaaaagggcggcctgaacggggtggacatctactcactggtaaccgaaaacatccagtggccaaacggcattaccttagatctgctgtctggccgcctgtactgggttgattcaaagctccatagtatctctagtattgatgtcaatggggggaaccgtaagaccatcctggaagacgagaagcgcctcgcccaccctttcagtttggcagtgttcgaggataaagtcttttggacagacatcataaatgaagctatattcagcgctaatcgcttgaccggtagtgatgtgaatttgctggccgaaaacctactctcgcctgaagacatggtgctgtttcacaatctgacacagcctcgcggggttaattggtgcgagcgcacgacattgtccaatgggggctgccagtacctctgtctgcccgctccccagatcaatccacactctccaaaatttacatgcgcttgcccagacggcatgctcttagcacgggatatgaggtcttgtttgactgaagcggaagccgctgtagccacacaagagacatcaactgttcgactcaaggtcagctccactgcagtccgcacccagcataccacgactagacccgtcccagatacaagtcggttacccggcgcgacacccggtctgaccaccgtggagattgttactatgtctcaccaagcgcttggggatgtggcggggagggggaacgagaagaaaccgagttctgtgcgtgctctaagtatcgtgctccccattgtcctccttgtgttcctgtgcctcggagtctttcttttgtggaaaaactggcgccttaaaaacataaacagcatcaactttgacaatcctgtgtaccagaaaacaaccgaggacgaagtccacatatgtcataatcaggacgggtatagttacccatccaggcaaatggtgtcattggaggacgacgttgca

SEQ ID NO: 15969 - DNA, 2580 bp, Artificial Sequence
  Description of Artificial Sequence: Synthetic coding sequence
atggggccctggggctggaaactgaggtggactgttgcacttctgctcgcggcagccggtacagcagtaggagatcgatgcgaacgaaacgagtttcaatgccaggacggcaaatgtatatcatataaatgggtctgcgacggaagcgcagagtgtcaagatgggtcagatgagtctcaagaaacatgcctgagcgtgacctgtaagagcggcgatttctcctgcggcggaagggttaataggtgtatcccccagttctggagatgcgatggccaagttgattgtgataacggttccgatgaacaaggatgtccacccaaaacctgctcccaggacgaattccgttgccatgacggaaaatgtatttcacgacaatttgtttgtgatagtgaccgtgattgtttggatggctcagatgaagcttcgtgtccagttcttacttgcggaccagcgtccttccagtgtaactcgagcacctgtattccgcagctttgggcatgcgacaacgatcccgattgcgaggatggctcagacgagtggccacagaggtgcaggggactatacgtgttccagggggattccagtccatgttctgcctttgaatttcactgtctgtcaggggaatgcattcactccagttggaggtgcgatgggggaccagattgcaaagataagagcgatgaggagaattgtgccgtggccacttgccggcccgacgagtttcaatgtagtgatggaaattgtattcacggatctcgacagtgtgaccgagagtatgactgcaaggatatgtccgacgaggtgggatgtgtaaacgtcaccctgtgtgaaggtccaaacaaattcaagtgccacagcggcgaatgtatcacactggacaaggtatgtaacatggctagggattgccgagattggtctgacgagccaattaaggagtgtggcacaaacgagtgcctggataacaatggtgggtgcagtcatgtgtgcaatgaactgaaaatcgggtacgaatgcctttgcccagatggctttcagctagtggcccagaggagatgcgaagacatcgatgagtgtcaagacccagatacatgtagccagctgtgtgtaaacctcgaaggaggatacaagtgtcagtgtgaggaaggcttccagctggacccgcacaccaaggcttgtaaggccgttggatctatagcttacctcttttttaccaataggcacgaggtacggaagatgaccctggacaggagtgaatatacatccttgatacctaacctcaggaatgtggtagcgttggacacagaggtggcttccaaccgtatttactggtccgacctgtcccagcgcatgatttgtagtacccagctcgacagggcccatggagtctcaagttatgataccgtcatttctagggatatacaggctcccgatggcctggcggttgattggattcattcaaacatctactggaccgattccgtcctcggcaccgtgagtgtcgccgacacgaagggggtcaagcggaagactctgttcagggagaacggttccaaaccgcgtgccattgtagtggaccccgtgcacggttttatgtactggacggactggggcaccccagcaaaaattaagaaaggcggattgaacggtgtggatatctacagcttggttaccgaaaatatccagtggcctaatggcattacattggacctccttagcggcaggctctattgggttgatagcaaactccacagtattagctccatcgatgtgaacgggggcaatcgaaaaacaatccttgaggatgagaaaagattggcccatcctttcagtctggctgtttttgaagataaagtcttctggacagatattatcaacgaagctatattctccgcgaatagattgaccggcagcgacgttaacctattagccgagaaccttctgagccccgaagacatggtcctatttcataacctcacccaacccagaggcgtgaattggtgcgaacgtacgactctctctaacggcggctgccagtacctttgtctcccagctccacaaatcaacccccactctccaaaatttacgtgcgcatgtcctgacggcatgttgctggctcgtgacatgcgaagctgcctgacagaagccgaagctgcagtggctacacaggagacgagtacagtgcgactgaaggtgtcttcaacagccgtcagaacgcagcacaccactacccggccagtgcccgatacttccagactgcccggcgccactccaggcctgaccaccgttgaaatcgtgacgatgtcacatcaggccctgggggatgttgcagggagaggaaacgaaaagaagccctccagcgtgcgtgctctcagcattgtgttacctatagtactcctagtcttcttatgtctgggtgttttcttactatggaagaactggagacttaaaaacatcaactcgatcaacttcgacaacccggtgtaccaaaaaactacagaggatgaggttcacatctgtcacaaccaagatggctactcctacccctcacggcagatggtttcgttggaggatgatgtcgct

SEQ ID NO: 15970 - DNA, 2580 bp, Artificial Sequence
  Description of Artificial Sequence: Synthetic coding sequence
atgggtccgtggggttggaagctgcgttggactgtagctctgctcttggcagcggctggcacagcagtaggtgacagatgtgagcgtaatgaatttcaatgtcaagatggtaagtgcatatcttataagtgggtctgcgatggtagcgcagagtgccaagatggttctgatgagagccaggagacctgcttgtccgttacctgcaagtccggggattttagctgcggtggccgcgtcaatcgttgtataccgcagttttggcgatgcgacggtcaggtcgattgcgataatggctctgatgagcagggctgccctcccaagacctgtagccaagatgagtttaggtgtcatgacggcaagtgcataagccgccagttcgtgtgcgactctgatcgtgactgtctggacgggtccgacgaagccagctgtccggtccttacctgcggcccggctagcttccagtgcaacagcagcacctgtatcccccagttgtgggcgtgcgacaatgatccagactgcgaggacggtagcgatgaatggcctcagcgttgtcgcggtctgtatgttttccagggcgattcgtccccatgtagtgcattcgagtttcattgcttgtcgggtgagtgcatccacagctcgtggcgttgcgacgggggtccggattgcaaggataagagcgacgaggagaattgcgcggtggcgacctgccgcccggatgaattccagtgcagcgacggcaattgtatccatggctctcgccaatgcgaccgcgagtatgactgtaaagatatgagcgacgaggtcggctgcgtgaatgttaccctgtgtgaggggcccaataagttcaagtgtcacagcggcgaatgtatcaccctggataaggtatgtaatatggcgcgtgactgtcgcgactggagcgatgaaccgatcaaggagtgcgggactaatgagtgcctcgataataatggtggttgtagccacgtctgcaatgagttgaagattggatacgagtgtctctgccctgatggctttcagctggtggcacaacgtcgctgtgaggacatcgatgaatgtcaggacccagatacttgcagccagctgtgcgtcaatctggaaggcgggtataaatgtcagtgtgaagaaggcttccaattggaccctcacacaaaagcatgtaaggcagttggttcgatcgcgtaccttttctttacgaaccgccacgaagtaaggaaaatgacgttggatcgatcagaatatacctcactgattcctaatctgcgcaacgttgtggccctcgacaccgaggtggctagcaaccgcatttattggtctgacttgagccaacgcatgatttgcagcacccagttagaccgtgcccacggtgttagctcctatgacacggttattagccgcgacatccaagctcctgatggtctggctgtggactggatccattccaatatttactggacggactctgtcctcggcaccgtcagcgtagcagacaccaagggcgtcaaacggaaaacactgtttcgcgaaaacggcagcaagccgcgcgcgatcgtggttgaccctgtccacggcttcatgtactggacagactggggtacccctgctaaaattaagaagggtggtctgaatggtgtcgatatttacagcctggtaacagagaacattcaatggcctaacggcatcaccctggacctgctgagcggccgcttgtactgggtggattccaagctgcactccatttcttctattgatgtcaatggcggcaatcgcaaaacgattctggaggatgagaaacgcctcgcccacccatttagcctggccgttttcgaagataaagtgttctggactgatataatcaatgaagctattttcagcgcaaatcgactgactggtagtgacgtgaatttgttggcagagaatctgctgagccctgaagacatggtgctgttccataacttaacccaaccgcggggtgtgaattggtgcgaaagaactaccctgtccaacggtggctgtcagtacctgtgcctccctgccccccagattaatccacactctcccaagtttacctgtgcatgcccggatgggatgctgctggcaagggatatgcgctcctgcctgaccgaagccgaggcagccgttgctacccaagagacgagcaccgtgcgcctgaaagtcagctccactgcggttaggactcagcacacgactacgcgccctgtcccggacacgagccgcttgcctggtgcgaccccaggcctgaccactgtggagattgtgaccatgagccatcaagcgttgggggacgtggccggccgcggcaatgagaagaagccttcctcagtgcgcgctctgtctattgtgctgcctattgtgctcctggtcttcttgtgccttggcgtgttcctactgtggaaaaactggaggcttaagaacatcaacagcattaatttcgacaatccggtgtaccagaaaacgaccgaggatgaagttcacatttgccataaccaggatggctactcataccctagccggcaaatggtgagcctggaggatgatgtggct

SEQ ID NO: 15971 - DNA, 2580 bp, Artificial Sequence
  Description of Artificial Sequence: Synthetic coding sequence
atggggccttgggggtggaaactacgctggacagtcgccctgctgttagctgccgccggaactgcagtgggagacaggtgcgaacggaatgaatttcagtgccaggatgggaagtgtatatcttataaatgggtgtgcgatggatcagcagagtgtcaggatggaagtgatgagtctcaggaaacatgtttaagtgtcacgtgcaaatccggagatttctcatgcggggggcgggttaatcgatgtatcccacagttctggcgctgtgatggacaagttgattgtgacaacggatctgatgaacaggggtgcccaccaaaaacatgctctcaggatgaattccggtgtcatgacgggaagtgcatctcacggcagtttgtttgtgattctgacagagattgtcttgacgggtctgatgaggcttcgtgtccagtactgacttgtgggcctgcttctttccagtgcaattcttcaacatgcatcccacagctgtgggcttgtgataatgatccagattgtgaagatgggtcagatgaatggccccagcgatgtaggggactctatgtatttcagggggattcttcgccatgttccgcattcgagtttcactgtctgtcaggggaatgtatacactcttcctggagatgtgatgggggacctgattgcaaagataagagtgatgaggaaaattgcgccgtggccacttgcaggcctgacgaatttcagtgttcagatgggaactgtattcatgggtcaagacagtgcgatcgggaatacgattgtaaggatatgtctgatgaggtgggatgcgtaaacgtgacattatgcgagggacctaataaattcaaatgtcactcaggggaatgcataacacttgacaaagtgtgcaatatggcccgggactgtagggattggtcagatgaacctatcaaggagtgcgggactaatgaatgtctcgataacaatggagggtgctctcatgtatgcaatgaacttaaaataggatacgaatgcctatgcccagatggatttcagctggttgcccagaggcggtgtgaagatatcgacgaatgtcaggaccctgatacgtgttctcagttatgtgtgaacctcgagggaggatataaatgccagtgcgaagaaggattccagctcgacccccatacaaaagcatgtaaagctgtcgggagtatagcttatctgttttttacaaacaggcatgaagtccggaaaatgacattagatcgctccgaatatacatccctgataccaaatcttcgaaatgtggttgccctcgatactgaagtggcatcgaatcgcatctactggtccgatctgtctcaaaggatgatctgcagtacacagctagatcgggcccacggagtgtcaagttatgatactgtgatttctagggatattcaggcgccagatggactagctgtcgattggatacactcaaatatctattggactgattcagtattgggaacagtgtccgtagcagatacaaaaggggtcaaaaggaaaactcttttcagagaaaacgggtcaaaaccccgagccatagtggtggatccagttcatggattcatgtattggacagattggggaacaccggcgaaaatcaaaaaaggaggactcaacggagtggatatctattcacttgtcactgaaaatatacagtggccaaatggaataacactagatctactctctgggcggttatattgggttgattcaaaactacacagtatctcatccatcgatgtgaatggaggaaatagaaaaacaatcctcgaggatgagaagaggctggctcacccattttcattagccgtttttgaagacaaagttttctggacagacattatcaatgaggctatattctctgccaatagactgacaggatctgatgtgaacctccttgcagaaaacttattgtctcccgaggacatggtgctgttccataatttgactcagcctcggggggttaactggtgcgaacgaacaactctgtccaacggggggtgtcagtatctttgtttgcccgctccacagatcaatccccactccccaaaattcacatgcgcatgccctgatggaatgctactagcccgggatatgagaagttgcttgacagaagctgaagccgctgttgctactcaggaaactagtacagtcaggcttaaagtgtccagtactgccgtgcggactcagcacacaactactagaccagtgccagatacttctaggttacctggggctacacctgggctaactactgtagaaattgtgacaatgtcacaccaggctctaggggacgtggctgggcgcgggaacgaaaagaaaccttcatccgtgagagcactatctatagtattaccaatagtccttttagttttcctttgccttggagtgttcctcctctggaagaactggaggctgaaaaacattaactctatcaactttgacaatccggtgtatcagaagacaacagaagatgaggttcacatatgtcacaatcaggatggatattcctatccatcacgtcagatggtaagtctcgaagatgatgtagcc

SEQ ID NO: 15972 - DNA, 2580 bp, Artificial Sequence
  Description of Artificial Sequence: Synthetic coding sequence
atgggaccgtggggctggaagctgcgctggaccgtcgctctgctcctcgctgcagcaggaaccgctgtgggagatcgttgcgaaagaaatgaattccagtgccaggacggtaaatgcatctcgtacaagtgggtgtgcgacggatccgcggagtgtcaagacggctcagacgaatcacaagaaacctgtctgtcagtgacgtgtaagtcgggggatttctcctgcggcggaagagtcaacagatgcatacctcagttttggaggtgcgatggacaggtggattgcgacaatggctccgacgagcaaggctgtccgcccaagacgtgctcccaggacgagttccgctgtcacgatggaaagtgcatctcgcggcaatttgtctgtgatagcgatcgggactgcctcgacggaagcgatgaggcctcgtgcccagtgctgacttgcggtcctgctagcttccagtgcaacagctcgacttgcatcccacagttgtgggcctgcgacaacgatccggattgcgaggacggatccgacgaatggccgcaacgctgcagaggactgtacgtctttcagggagactcgtctccttgctcggcgtttgagttccattgcctttccggtgagtgtatccactcaagttggcggtgcgatggtggacccgactgcaaagacaaaagtgacgaagagaactgtgcagttgctacttgcagaccggacgagttccagtgctccgatggaaattgtatccacggctcccgacaatgtgatcgggaatacgattgtaaggacatgtcagacgaagtgggttgcgtcaacgtgactttgtgtgagggcccaaacaagttcaaatgtcattcaggagaatgtattaccctggacaaggtctgcaatatggcgcgcgattgtcgggattggtcggacgagccgatcaaagaatgtggaacgaacgagtgccttgacaataacggtggatgttctcacgtgtgcaacgagctcaagatcggatatgaatgcctctgcccagacggcttccagctcgtggcgcaaaggcggtgcgaggacatcgacgaatgccaggaccctgacacttgctcgcaactttgcgttaatctggaaggggggtacaagtgccagtgcgaggaggggttccaactggatccccacaccaaagcgtgcaaagccgtgggatcgattgcctacctgttcttcaccaatcgccacgaagttcggaagatgactctggaccggtccgaatacacctccctgatcccgaacctccgcaacgtggtggctcttgatacggaagtggcttccaaccgcatctactggtcggacctgtcgcagcgcatgatttgctccactcagttggacagggcgcatggcgtgtcgtcgtatgacaccgtgatttccagagacatccaggccccagacggactcgccgtcgattggatccactcaaatatctactggaccgactcagtcctcggaactgtctcggtcgccgacactaagggcgtcaaacgcaagacgttgttcagggaaaacggatctaagccgcgcgccattgtggtggatccggttcacggctttatgtactggaccgattggggcactccagcgaaaatcaaaaagggaggacttaatggagtggatatctatagcctggtgactgaaaacatccagtggcccaatggcataaccttggatctgttgtcgggtcgtctttactgggtggattccaaactgcattcaatctccagcatcgacgtgaacggcgggaaccgaaagaccattctcgaagatgaaaagcggcttgcccacccgttctcactggccgtgtttgaggacaaagtgttctggaccgatatcatcaacgaagcgatcttctccgcaaaccggctgaccggctctgacgtcaatctgctggccgaaaacctgctgagcccggaggacatggtactgttccataacctgacccagccgcgcggcgttaattggtgcgagcgcaccactttgtcaaacggggggtgccagtatctgtgtttgcctgctccacagattaatccacattcgcctaagttcacctgtgcatgccctgacggaatgctgctggctcgggacatgagatcatgccttactgaagccgaagccgccgtggcaacgcaggaaacttcgactgtgcgactgaaggtgtcctctactgccgtcagaacccaacacaccacgacccggccagtcccggacacttcacggctgccaggcgcgactcccggcctcaccaccgtagagatcgtgaccatgtcgcatcaagcccttggagatgtggcgggtcgcggtaatgagaagaagccatcctctgtgcgcgccctgtcaatcgtgctgccgatcgttctgctcgtctttttgtgcctgggggtgttcctgttgtggaagaattggcgactcaagaacatcaatagcatcaactttgataacccagtgtaccaaaagactaccgaagatgaagtacacatctgtcacaaccaagacggctactcctacccatccagacagatggtgagcctcgaggatgacgtggct

SEQ ID NO: 15973 - DNA, 2580 bp, Artificial Sequence
  Description of Artificial Sequence: Synthetic coding sequence
atgggtccctggggatggaagttgcgatggaccgtggcgctgctgcttgcggcagcaggcacggcggtgggagatcgttgtgaacgaaacgaattccaatgtcaggacggaaagtgcatttcttacaagtgggtctgtgatggctcggcagagtgtcaggatggatcagatgagtcgcaagaaacctgtctcagcgtgacctgcaagtccggggacttctcctgtggtggaagagtgaacaggtgtatcccacagttctggcggtgcgatggtcaggttgattgcgataatggctccgatgagcaaggctgtccgcccaagacctgttcacaggacgaattccggtgccacgacggcaagtgcatcagccgccaatttgtatgcgattcagatcgcgattgtcttgatggtagcgacgaagccagctgtccagtgctgacctgcggtcctgcatcattccaatgtaactcaagcacttgtattccccagctttgggcctgtgataacgatcctgactgtgaagatggatcggacgaatggcctcagagatgtaggggactgtacgtgtttcaaggagactcatcaccctgttcggcattcgaattccactgtctttccggagagtgtattcactcgtcctggagatgcgacgggggtcctgattgcaaagataaaagcgatgaggagaattgcgcagtcgccacttgtagaccagacgaatttcagtgtagcgatggaaattgtattcatggatcgcgacagtgtgatagggaatacgactgtaaagatatgtccgatgaagtcgggtgtgtgaacgtgaccttgtgcgaaggacccaataagtttaagtgtcattccggtgaatgtataacgctggataaggtctgtaatatggcacgtgattgccgcgactggtcagacgaacccatcaaagaatgtggaaccaacgagtgcctcgataacaacggggggtgttcgcatgtgtgtaacgagctcaagattggttacgaatgtctttgtccggatggatttcaacttgtggcacaaagacgttgtgaagatatcgatgaatgccaggatcctgacacttgctcacaactctgcgtgaacctggaaggaggatacaagtgtcaatgtgaagaaggctttcaacttgaccctcataccaaagcatgcaaggccgtcggatcaattgcataccttttcttcaccaacagacacgaggtgcgcaagatgactctggatagatcagaatacacttcgttgatacctaatcttcgaaacgtggttgcactcgataccgaagtcgcctctaatcggatctactggtcagatctgagtcaaagaatgatttgctccacccaactcgatcgggcccatggagtcagctcctatgacactgtgatcagcagagacattcaagctcccgatggactggcggttgattggattcattctaatatctactggactgactcagtgttgggtaccgtgtcggtggccgataccaaaggagttaagcgtaagacgctttttcgagaaaatggatccaagcctagggcaatcgtcgtcgatccagtgcatgggtttatgtactggaccgattggggaactccagcgaagatcaaaaaggggggacttaatggagtggatatctattcacttgtcactgagaacattcagtggccaaatggtatcacccttgatctgctgtcgggcaggctttactgggtggatagcaaacttcattcgatttcctccattgacgtgaacggaggtaatcggaaaaccatactggaggatgaaaaaagactcgcacatcctttctcgctggcagtctttgaggacaaagttttttggaccgatatcattaacgaggcaattttctccgcaaatcgacttactggctccgacgtaaatcttcttgcagagaacttgctctcacccgaggatatggtcctctttcataatctgacccagccaagaggtgtgaactggtgcgagaggaccacgctctcgaacggcggctgtcagtacctctgcctcccagcgccgcaaatcaaccctcactccccaaagtttacgtgtgcgtgtcctgatggcatgttgctggcaagagatatgagatcatgcctcactgaagccgaggccgccgtggcaactcaggagacttccactgtgcgattgaaggtgtcgtcgacggcagttcggacccaacacaccaccactagaccagtgcccgatacctcacggctgcctggagcaacccccggactgactacggtcgagattgtgactatgtcgcaccaggcactgggtgacgtcgccggtagaggaaatgaaaagaagccatcatcggttagggctctttcgattgtgcttccaatcgtgttgctggtgttcctttgcctgggagtctttcttctgtggaagaactggcggctcaaaaacattaacagcattaactttgacaatcccgtttaccagaaaacgaccgaggatgaagtccacatttgtcataatcaagatggttacagttacccatcgagacagatggtgtcgttggaggatgatgtggca

SEQ ID NO: 15974 - DNA, 2580 bp, Artificial Sequence
  Description of Artificial Sequence: Synthetic coding sequence
atgggcccctggggatggaagttgcgttggaccgtagctttgttgctggcagcagcaggaactgcagtgggtgacagatgcgagcgcaatgaatttcagtgccaggatggaaagtgcatcagctacaagtgggtgtgcgacgggagcgccgagtgccaagacggctcggacgaatcccaggaaacttgcctcagcgtgacctgcaaaagcggagactttagctgcgggggccgtgtgaacagatgtatcccgcagttctggcggtgtgatggacaggtcgactgcgacaacggttctgacgagcagggatgccctcctaaaacgtgttcccaggacgaatttaggtgccatgatggaaaatgcatctcaaggcaattcgtgtgtgactcggaccgcgactgcctcgatggatcagatgaggcgagctgccctgtgctcacctgtggacctgcctccttccagtgcaatagcagcacttgcatcccgcagctgtgggcctgtgataacgacccggactgcgaggatggatcggatgaatggccgcagaggtgccgcgggctgtacgtgttccaaggagattcgagcccatgctcggctttcgaattccactgcctttcaggagaatgcatccactccagctggcgctgtgatgggggccccgactgcaaggataagagcgatgaggagaactgcgctgtcgcgacctgcaggccagatgagttccaatgttccgatggaaactgtatccatggttcgcgccagtgcgatagagaatacgactgtaaggacatgagcgatgaggtcggttgcgtgaacgtcaccctgtgcgaaggaccaaacaaattcaagtgccattcgggagagtgtatcaccctggacaaggtctgcaatatggcaagagactgccgggattggtcagacgaaccgattaaggaatgcggaaccaatgaatgcctcgacaataacggaggttgttcccacgtgtgtaacgagctcaagatcggatacgaatgcttgtgcccagacgggttccaactcgtcgctcagagaaggtgcgaggacatcgacgaatgccaggatccagacacgtgctcacagctgtgtgtgaacctggaaggcggatacaaatgtcaatgcgaggagggtttccagctggacccgcacactaaggcatgtaaggccgttggatcgatcgcttacctgtttttcacgaatcggcacgaagttcgcaagatgactttggacagatctgaatacacctccctcattccgaatttgagaaacgtcgtggcacttgatacggaagtggcctcgaaccgcatatactggtcggacctttcgcaaagaatgatctgctcaactcaactggaccgcgcccacggggtgagttcttacgacaccgtcatctcgagggatatacaggcgccagacggcctggccgtcgattggatccactctaacatctactggaccgattcagtcctgggaactgtgtctgtcgcggacactaagggtgtgaaacgcaagactcttttccgggagaatggatccaaaccacgcgcaatcgtagtagatccagtccatggctttatgtactggacggactggggtactccggcgaagatcaagaaaggcgggctcaatggtgtggatatctattccctcgtgaccgaaaacattcaatggcccaacggcatcacccttgacctgctctccgggcgactgtactgggtggacagtaaactgcactcgatcagcagcatcgacgtgaatggcggaaatcgcaagactatcctggaggatgagaagcgcctcgcccatccgttctccctggcagtttttgaagataaggtgttctggaccgatatcattaacgaagcgatcttttcggccaatcggctgactgggtcggacgtcaacctgttggccgaaaacctgctctccccagaagatatggtactcttccacaatctgacccaaccgagaggggttaactggtgtgaacgcactaccctgtccaacggaggatgtcaatatctgtgcctgccggccccgcagataaacccgcatagccctaagttcacttgtgcctgcccagatggaatgcttctggcccgagatatgcgcagctgcctcaccgaggctgaagccgcagtggcgactcaggagacttccaccgttcggctgaaggtgtcatcgacggcggtgcggacccagcacacgaccacccggcctgtgccagacacttcacggctgccgggtgcgacccccggccttactaccgtggagattgtgactatgtcccaccaggccttgggcgacgtggctggaaggggaaatgagaagaaaccgtccagcgtgcgcgccctgtcaattgtcttgccgattgtcctcctcgttttcctgtgcctgggcgtgttcctgctgtggaaaaactggcggctgaagaacatcaacagcatcaattttgacaaccctgtgtaccaaaagaccactgaggatgaagtgcatatctgccacaaccaggacggatactcatacccctcgcggcagatggtgtcgctcgaggacgacgtcgct

SEQ ID NO: 15975 - DNA, 2580 bp, Artificial Sequence
  Description of Artificial Sequence: Synthetic coding sequence
atggggccgtggggctggaagttgcgctggaccgtggcgctcctcctcgcggccgccggaacggccgtgggggatcgctgcgaacggaatgaattccagtgccaagatggcaagtgcatctcgtacaagtgggtgtgcgacggctcagcagagtgccaggacggaagcgacgaatcccaggaaacctgcctgtcggtgacctgtaaatccggagacttcagctgcggaggtcgggtgaatcgctgcatccctcagttctggaggtgtgacggacaggtcgactgcgacaatggctcggatgagcagggatgcccgccaaagacctgctcgcaggacgaatttcgctgccacgacggaaagtgtatctcccgtcaattcgtctgtgattcggacagagactgcctggacggatccgatgaggcgtcgtgcccggtgctcacctgcggacccgcatccttccagtgcaactcctcaacgtgcatcccgcagctgtgggcttgcgacaatgacccagactgcgaagatgggagcgacgaatggccacagcgctgcaggggactgtacgtgttccaaggagactcgtccccatgctccgcattcgagttccactgtctcagcggagagtgcattcacagctcgtggagatgcgacgggggtccggactgcaaggacaagtccgacgaggaaaattgtgccgtcgcaacttgccggccggacgagttccagtgttccgacggaaattgtatccacggatcgcgacaatgtgatcgcgagtacgattgcaaagacatgagcgatgaagtgggatgcgtcaatgtgaccctgtgcgagggaccgaacaagttcaaatgccacagtggagaatgtattactctcgataaagtgtgcaatatggcgcgggactgccgcgactggtcggacgaaccaattaaggaatgcggaaccaacgaatgcttggataacaacggaggctgcagccacgtgtgcaacgagcttaagatcggctacgagtgcttgtgcccggacggatttcaactggtagcgcaaagacgatgcgaagatatcgacgagtgtcaagaccctgatacctgctcacaactgtgcgtgaatctggaaggagggtacaagtgccagtgtgaagagggatttcagctcgaccctcacactaaggcatgtaaggcagtcggctcgatcgcatacctgttctttactaatagacatgaggtgagaaagatgacccttgaccggtcggagtacacgtcgctcataccgaacctccggaacgtggtggcgttggataccgaggtggcatcgaatcgcatctactggtcggatctgtcacagcggatgatttgttcaacccaacttgacagagcgcacggagtgtcctcgtacgatactgtgatcagccgcgacattcaagccccagatggacttgccgtggactggatccactccaacatctattggaccgactccgtcctcggcactgtgtcagtggccgatactaagggagtgaagcgcaaaactctgtttcgcgagaacggctcgaagcccagagccatcgtggtcgacccagtccatggattcatgtattggaccgattggggaactcccgctaaaatcaagaagggaggactcaacggcgttgacatctactccctcgtgactgagaatatccagtggcctaatggaattaccctggatctgctctccggccgcctgtactgggtggactccaagctgcattcaatttcttccatcgacgtcaacggaggaaaccggaaaacgatccttgaggacgagaaacggctcgcgcacccgttttcgctggcggtgtttgaggacaaagtgttctggacggacatcatcaacgaagccatctttagcgcgaatcggctgaccggatccgacgtgaatctcctggccgaaaacctgttgagcccggaagatatggtgctgttccataacctgacccagccgagaggagtgaattggtgtgagcgcaccaccctgtccaacggaggatgccaatacctgtgccttccagctccccagattaacccacattccccgaagtttacctgcgcttgcccagatggcatgctgctggcccgcgacatgagatcatgtttgactgaagccgaagccgcggtggcgacgcaggaaacgtcgactgtcagactcaaggtgtcaagcactgcagtccgcactcagcataccactacccggccagtgccagacacctcaagacttccaggagcgaccccgggactcaccaccgtggagatcgtgactatgtcccatcaagcgctcggtgacgtggccggacgcggcaacgagaaaaaaccatcgtcggtgagggccttgtccatcgtcctgccgattgtcctcctcgtgttcctctgtctgggggtctttctcctctggaagaactggagactgaaaaacataaacagcatcaacttcgacaaccctgtgtaccagaaaaccactgaagatgaagtccatatttgtcataatcaggatggatactcatacccctccagacagatggtttccctggaagatgatgtggcc

SEQ ID NO: 15976 - DNA, 2580 bp, Artificial Sequence
  Description of Artificial Sequence: Synthetic coding sequence
atgggaccatggggatggaaacttagatggacagttgcattacttctcgcagcagctggaacagcagttggagatagatgcgaacgtaatgaatttcaatgtcaagatggaaagtgtatttcatataagtgggtttgtgacgggtcagctgaatgtcaagatggttctgatgaatctcaagagacatgtttatcagttacttgtaagtcaggagatttttcttgtggtggtagagttaacagatgtattcctcaattttggagatgtgatgggcaagtagattgtgataatggaagtgatgaacaaggttgtcctccaaaaacttgttcacaagacgaatttagatgccacgatggaaaatgtattagtagacagttcgtatgtgattctgatagagattgtttagatggttctgatgaagcttcatgtcctgttttgacatgtggtccagcttcatttcaatgtaatagttctacctgtattccacaattatgggcttgtgataatgatccagattgcgaagatggtagtgatgaatggcctcaaagatgtagaggattatatgtttttcaaggagatagttctccatgttcagcttttgaatttcattgtttatcaggtgaatgtattcacagtagttggagatgtgatggaggacctgattgtaaagataagtcagatgaagaaaattgtgctgttgcaacctgtcgaccagacgaatttcagtgtagtgatggtaattgtattcatggaagtagacaatgcgatagagaatatgattgcaaagatatgagtgacgaagttggatgtgttaacgttactttgtgtgaaggacctaataagttcaaatgtcattcaggtgaatgtattacattagataaggtttgtaatatggcaagagattgtagagattggagtgatgaaccaattaaagaatgtggaacaaatgaatgtcttgataataatggaggatgttcacacgtttgtaatgaattaaaaattggatatgaatgtctttgtccagatggatttcagcttgttgcacaaaggagatgtgaagatatagatgaatgtcaagatccagatacttgttctcaactttgtgtcaatttagagggaggatataaatgccaatgtgaggaaggatttcaattagatcctcatacaaaagcttgtaaagctgtaggaagtatagcatatcttttttttacgaatagacatgaagttagaaaaatgacattggatagatcagaatacactagtcttattcctaatttacgaaatgttgttgctttagatactgaagtcgcatcaaatcgtatttattggtccgatttgtctcaaagaatgatttgttcaacacaattagatagagctcatggagtttctagttatgatactgtaatatcaagagatatccaagctccagatggattagctgtcgattggattcattctaatatttattggacagatagtgtgttaggtacagtttctgttgcagatacaaaaggagttaaaagaaaaacattatttagggaaaatggaagtaaaccaagagcaattgttgttgatcctgttcatggatttatgtattggactgattggggtacaccagcaaaaatcaagaaaggaggattaaatggtgtagatatatacagtttagtaactgaaaatatacagtggccaaacggtatcactcttgatttactatcaggacgattatattgggttgattctaaacttcattcaataagttctattgatgttaatggaggtaatagaaaaactattttggaagatgaaaaacgacttgctcacccattctcattggctgtatttgaagataaagtattttggacagatattattaatgaagcaattttctcagctaatagattaacaggatctgatgttaatcttttagctgaaaatcttctttcaccagaagatatggtcctttttcataatttaactcaaccaagaggtgtcaattggtgtgaaagaacaactttatctaatggaggttgccaatatttatgtcttccagctcctcaaattaacccacatagtccaaaatttacgtgtgcatgtccagacggaatgcttttagctcgagatatgagatcatgtttaactgaagcagaagctgctgtagctacacaagaaacttcaactgttagattaaaagtttcgtctactgctgttcgtacacaacatactactacacgacctgttcctgatacttcacgattaccaggtgctacaccaggacttacaacagttgaaattgtaacaatgtcacatcaagcattaggtgatgtagctggacgtggaaatgaaaaaaaaccatcttcagttagagcattgtcgatagttttaccaattgttcttttagtttttctttgtttaggtgtatttttactttggaaaaactggagattaaaaaatattaatagtataaattttgataatcctgtttaccaaaagactacagaagatgaagtacatatttgtcataatcaagatggatacagttacccatcaagacaaatggtttcattagaagatgatgtagca

SEQ ID NO: 15977 - DNA, 2580 bp, Artificial Sequence
  Description of Artificial Sequence: Synthetic coding sequence
atggggccatggggctggaagctgagatggactgtggcccttctgttggcagcagcagggactgccgtgggggatagatgtgaacgcaatgagtttcagtgtcaggacggaaagtgtatcagctacaagtgggtgtgtgacggaagcgcggaatgtcaagatggaagtgacgaatcgcaagaaacgtgtctgagcgtgacctgtaagagcggtgatttttcgtgtgggggacgggtgaatagatgtattccacagttctggaggtgcgatggacaagtcgactgtgataatggatccgatgaacaaggctgcccccctaaaacttgttcccaggatgagtttagatgtcatgatggaaaatgtatctcgcgacagttcgtgtgcgactccgacagggattgcctggatggaagcgatgaagcatcgtgccctgtgctgacttgtggtcccgctagctttcaatgtaactcgtcgacctgtatacctcagctctgggcatgtgacaatgaccctgattgtgaggacggctccgatgagtggcctcaaagatgtagaggactgtacgtgtttcagggagatagctctccttgttccgcctttgaatttcattgtctgtccggagaatgcatccacagctcatggcgttgtgacggtggaccggactgtaaggacaaaagtgatgaagagaactgcgctgtcgccacctgccgtcctgatgaattccagtgctcggacggaaattgtatccatggaagtcgacagtgtgatagagaatacgactgtaaggatatgtcggacgaagtgggttgtgtgaacgtgaccctgtgcgagggaccgaataagtttaagtgccactccggagagtgtataaccctggataaggtgtgcaacatggcacgggattgtagagactggtccgatgaaccaattaaggaatgtgggaccaatgaatgtctcgacaataacggtggatgttcacatgtgtgtaacgagttgaaaatcgggtacgagtgtctgtgcccagatggattccaattggtcgcacagagacggtgtgaggatatagatgagtgtcaagaccccgacacgtgttcgcagctctgtgtgaatctcgagggaggatacaagtgccagtgtgaagaaggatttcagctggatccgcataccaaagcctgtaaggcagtcggttcgatagcctacctctttttcactaaccgccacgaagtcagaaagatgactcttgatcgctcagaatacacttcactgatcccaaatttgcgcaacgtggtcgcccttgacacggaagtcgccagcaacagaatttactggtccgacctcagccagcggatgatttgtagcacccagctggatcgagcacacggggtgagcagctatgatacggttatctcccgagacattcaggcaccagatggcctcgcagtcgattggattcattcgaacatctactggaccgactcggtgctgggcactgtgagcgtggcggataccaagggggtgaaacgcaaaactctttttcgggaaaatggatcgaaacctcgggcaattgtcgtggatcctgttcacggtttcatgtattggactgactggggtacccccgcaaagatcaaaaagggaggtctgaacggagtcgacatttactcgcttgtcaccgagaacattcaatggccaaatgggattactcttgacctcctctcaggtagactgtactgggtggattctaagctgcattcaatttcgagcatcgatgtgaacgggggtaacagaaagaccatacttgaagatgagaagcgcctggcacatcctttttccctggccgtgttcgaagataaggttttctggactgacataatcaatgaagcaatattctccgcaaacagactcaccggatccgacgtcaacttgctggcagaaaacttgctcagcccggaggacatggtgctctttcacaatctgactcaaccaagaggcgtgaattggtgtgaaaggactacgctgtcaaatgggggatgtcagtacctttgtttgccggccccccagattaaccctcattccccaaagtttacctgtgcatgccctgatggaatgttgctcgcccgagatatgcgctcgtgtcttaccgaggcagaggcagcagtagctactcaggaaacttcaaccgtccggcttaaggtgtcgtcaaccgctgtccggacgcagcataccactactagacctgtgccagatacctcccggctgcctggagccacccccggactgactactgtggaaattgtgactatgtcccatcaagccctgggcgacgtggcgggtaggggcaatgaaaagaagccatcgtcggtgcgcgcactgtctatagtgctgccaattgtgctccttgtgtttctttgtctgggagtctttctgctttggaagaattggaggctgaagaacattaactcaattaactttgacaatcctgtgtatcaaaagactaccgaggacgaagtgcatatttgtcataaccaagatggatacagctacccctcaagacagatggtttcactggaagatgacgttgcg

SEQ ID NO: 15978 - DNA, 2580 bp, Artificial Sequence
  Description of Artificial Sequence: Synthetic coding sequence
atgggcccctggggctggaagcttcgctggaccgtagctctgttgctggccgccgctgggaccgcagtgggagacagatgtgagcgcaatgagttccagtgtcaggacggaaagtgcatatcctacaaatgggtatgcgacggcagcgccgagtgccaggatggcagtgacgagtctcaggagacatgcctgtctgtgacctgcaaaagcggcgatttttcttgtggtggcagggttaacaggtgtattccacaattttggcgctgcgatggccaagtggattgcgataacggttccgatgaacagggctgcccccccaaaacatgcagccaggatgagttccggtgtcacgatggtaaatgcataagccgacaatttgtctgcgactccgaccgcgattgtctggacggcagcgacgaggcctcctgtcctgtgttgacatgtggacctgcctcatttcaatgtaacagctccacctgtatcccacagctttgggcttgcgataatgacccagattgcgaggacggctccgatgaatggcctcaaaggtgtaggggtctttacgtgtttcaaggggatagctcaccttgcagcgcatttgaatttcattgtctgagcggggagtgtatccatagtagttggaggtgtgatggtggacccgattgcaaagataagagcgatgaggaaaactgtgcagttgccacctgtcggccagacgaattccagtgtagcgacggtaattgtatccacggcagtcggcagtgcgaccgcgagtacgattgcaaggatatgtcagacgaagtaggctgtgtaaatgttaccttgtgcgaggggcccaacaagtttaagtgtcactcaggggaatgcattaccctcgataaggtgtgcaacatggccagagattgccgggactggagcgatgaacccattaaggagtgtgggaccaacgaatgcctggacaataacgggggatgctcccacgtatgtaacgaactgaagattggctacgagtgcctgtgtcctgacggcttccagctggtcgcccagcggagatgcgaggatatcgacgagtgtcaggatccagacacatgcagccagctgtgtgttaacctcgagggcggctataaatgccagtgtgaagaggggttccagctggatcctcacacaaaggcctgcaaagctgttggatctattgcttatctcttcttcaccaacagacatgaggtgcggaaaatgacactggataggagcgaatacacgtccctgatccccaatctgcggaacgttgtggcactggacacagaggtagcttcaaaccggatctactggtccgacttgtctcagaggatgatctgcagcacgcagctggatcgggctcatggggtcagtagctatgatacagtgatctctagggacatccaggccccagatggacttgctgtcgactggatccactccaatatatattggactgatagcgtgctgggaacagtttctgtggccgacaccaaaggagtcaaaaggaagacactgtttcgagaaaacggaagcaaaccgcgagccatcgtagtggaccccgtgcacggttttatgtactggacagactgggggacaccagcaaaaattaagaaggggggcctcaatggggtcgacatttattcactcgtgaccgagaacatacaatggccgaacgggattacactggacttgctgtcaggacgactgtattgggtggacagcaagctccatagcatatccagtattgacgtgaacggcgggaaccgcaaaaccatcctcgaggacgaaaagcgactcgctcatccattttcactggcggtgttcgaggacaaggtgttttggacggacataatcaatgaagctatcttctccgcaaataggcttacaggctctgacgtcaatctgctggccgagaatcttctctcaccagaagacatggtcctcttccataacttgacacagcctcggggcgttaattggtgcgaaagaacaacgctttctaacgggggatgtcagtacttgtgcctgcctgcacctcagatcaatccccatagtccaaagttcacatgtgcatgtcctgatggtatgctcctcgcccgggacatgaggtcatgtctcactgaggctgaagctgcagtggctacccaagaaacgagtacagtgcgactgaaggtgtcctcaacagctgtccgcacacagcatacgacaacaaggcctgtccctgacacaagcagactgccgggtgctacgccaggactgaccacggtagagattgtgacaatgtctcaccaggccctgggggacgtggctgggcgcggcaatgaaaagaagccaagcagcgtgagagccctgagcatcgtcctgcccatcgttctcctggtgttcttgtgtttgggcgtcttcctgctttggaaaaactggagacttaagaatatcaacagtattaattttgataaccctgtataccagaagactacagaggatgaggttcacatatgtcacaaccaggacggttacagttacccatcccgacagatggtcagtctcgaggatgacgtcgcc

SEQ ID NO: 15979 - DNA, 2580 bp, Artificial Sequence
  Description of Artificial Sequence: Synthetic coding sequence
atggggccttggggctggaagctgcgctggaccgtggcgctcctgctggccgcagccggcaccgcagtgggagatcgctgcgaaagaaacgaatttcaatgccaggacggtaagtgcatttcgtacaagtgggtgtgcgatgggagcgcggagtgtcaggacggttcggacgaatcacaggaaacctgcttgtcggtgacgtgcaaatccggagatttcagttgtggtggccgcgtgaatcggtgcatccctcaattctggcgctgtgatggccaagtggattgcgacaacggatcagacgaacagggttgccctcccaagacgtgctcgcaagacgagtttaggtgccacgatgggaaatgcatcagccgccaattcgtctgcgactccgatagagactgcctggacggatctgatgaggcttcatgcccagtgctgacctgcggaccggcctcgttccagtgcaactcgtccacttgtatcccccagctgtgggcctgcgataacgacccggactgcgaggacggaagtgacgaatggccgcaacgctgccgaggactgtacgtgttccagggtgatagctctccgtgtagcgccttcgaattccattgcctgtcgggcgagtgtatccactcaagctggcggtgcgatggggggccagattgtaaagacaaatcagatgaggagaattgcgccgtcgcaacctgccgccccgatgagtttcagtgtagcgacggcaattgtatccacggatcacggcagtgcgaccgggaatacgactgcaaggacatgtccgatgaggtcggctgtgttaacgtgactctgtgcgaaggtcctaacaagttcaagtgccattcgggagaatgcatcaccctcgacaaagtgtgcaatatggcaagagactgtcgcgactggtcggacgaaccgatcaaggagtgcggaaccaatgaatgcctcgacaataatggcggatgcagccacgtctgcaatgaacttaagatcggatacgaatgcttgtgccccgatgggttccaactggtggcccagaggaggtgtgaagatatcgatgaatgtcaggacccggacacttgctcgcagctctgcgtgaacctggaaggagggtacaagtgccaatgcgaggaggggtttcagcttgacccccataccaaggcgtgcaaggctgtcgggtccatcgcctacctgtttttcactaacagacatgaggtgcggaagatgactctggaccgcagcgaatacacgtccctgatcccaaatctccgtaatgtggtggcattggacacggaagtcgcgtcaaacagaatttactggtcggatctgtcgcagagaatgatctgctcaacccagctcgatcgggctcacggcgtgtctagttacgacactgtgatttccagggatattcaagcgccggatggactcgcagttgactggatccactcaaacatctactggaccgattccgtcctgggcaccgtgtccgtggcagacaccaagggtgtgaaaaggaaaactttgtttagggaaaacggatctaagcctcgggcgatcgtggtcgacccagtgcacgggttcatgtactggaccgactggggcactccggcgaaaatcaaaaagggcggactgaacggagtagatatctattcgttggtgactgagaacatccaatggccgaacggaatcactctcgacctgctgtcagggcggctctactgggtagattcaaaacttcacagcatcagttcgattgacgttaatggagggaaccgcaagacgatactggaagatgaaaagagactcgctcatccattctccctcgcggtgttcgaggataaagtgttctggaccgacatcatcaacgaagcgattttcagcgccaaccggctcacgggaagcgacgtcaacctgctggctgagaacctgctgtcgccagaggacatggtgcttttccataacttgactcagcctagaggagtgaattggtgcgagcggaccaccctgtctaacggaggctgtcaatacctctgtctcccggccccacagataaacccgcactccccgaaattcacttgtgcctgtccggacggcatgcttcttgcacgcgacatgcgctcttgcctcaccgaagccgaggcggctgttgccactcaggaaaccagcactgtccggctgaaggtgagctctactgccgttcgcacccaacacaccaccacccgccctgtcccagatactagccgtctgccgggagccaccccgggactcactactgtggaaatcgtcaccatgtcacatcaggcactgggggacgtggcgggacggggaaacgaaaagaagccgtcgtcagtgcgcgctctctccatcgtgctgccgatcgtcctgctcgtgtttttgtgcctgggtgtgttcctcttgtggaagaattggagactgaagaacatcaattcaattaacttcgataacccagtctaccaaaagaccactgaggacgaagtacacatctgccataatcaggacggatacagctatccctcgaggcagatggtttcccttgaggacgatgtcgca

SEQ ID NO: 15980 - DNA, 2580 bp, Artificial Sequence
  Description of Artificial Sequence: Synthetic coding sequence
atgggaccttggggatggaagctgagatggactgtggcactgctgctggccgcagcgggaaccgccgtgggcgatcgctgtgagagaaatgagtttcagtgtcaagatgggaaatgtatttcatataagtgggtgtgtgatggctcggctgaatgtcaggacggatccgatgaaagccaggaaacctgcctgtcggtcacttgcaaatccggcgatttcagctgcgggggacgtgtgaatagatgtatcccacaattctggagatgtgacggtcaggtcgactgcgataacggttcggacgagcagggctgcccacctaagacctgttcgcaagatgagtttaggtgccatgatggtaaatgcatttcgagacaatttgtgtgcgattcggaccgggattgtctggatggttcagatgaagcgtcgtgtcccgtgctgacttgcggtccagctagctttcagtgtaacagctccacctgtattccacaactctgggcatgtgataacgatccggactgcgaggacggatctgatgaatggccccaaaggtgtaggggactgtacgtgttccaaggagattcctcgccttgttcggcattcgagttccattgtctgtccggcgagtgtattcattcctcatggcggtgtgatggcggtccggattgcaaggataagtccgatgaagaaaactgtgccgtggcgacttgtcgtcctgacgaatttcaatgttccgatggaaattgtatccacggttcgagacaatgcgacagagagtacgactgtaaagacatgtcggacgaagtgggatgtgtgaacgtcaccctttgtgaagggccgaacaaattcaagtgtcactccggcgaatgtatcactctcgataaggtgtgtaatatggcccgagattgtagagattggtctgacgaacccatcaaggaatgcggaactaacgaatgtttggataacaacggaggatgttcgcatgtgtgcaacgaacttaagattgggtatgaatgcctctgccccgatgggttccagcttgtggcacaacgccggtgcgaagatatcgatgaatgtcaagatcctgatacctgcagccagctgtgtgtgaacctggagggaggttataagtgccagtgtgaggaagggttccaactcgatccacatactaaggcctgcaaggcggttgggtcaattgcatacctgtttttcaccaatcgccatgaggtgcggaagatgaccctcgatagatcggagtacacctctcttattccaaatcttaggaacgtggtggccctcgatactgaggtcgcatcgaaccggatttactggtccgatctcagccaaaggatgatctgctccactcaactggatcgcgcacatggggtcagctcctacgataccgtgataagccgtgacattcaagcaccagacgggctcgcagtcgactggatccattcaaacatatactggaccgactccgtgctgggaaccgtctcagtggcggataccaagggtgtgaagaggaaaacgttgtttagagaaaacggatcgaaaccccgagcaattgttgtggaccctgtgcatggtttcatgtactggacggattggggaaccccagcaaagatcaaaaagggagggctcaacggagtggatatctacagcctggtgaccgaaaacattcaatggccaaacggtataactctggatctgctgtccggtaggctgtactgggtcgactccaagctccatagcatctcgtccatagatgtgaacggcggaaatagaaagactattttggaagatgaaaagaggctggcacaccccttctcgctggccgtctttgaggacaaggtcttttggactgacatcataaacgaagcgatcttctcagctaaccgactgactgggagcgatgtgaaccttttggcagaaaacctgcttagcccagaagatatggtgctcttccacaaccttacccaaccacggggggtcaattggtgtgagagaactaccctgtcaaacggtggatgtcagtacctgtgtctgcctgcacctcagattaacccgcactctccaaaattcacgtgtgcatgccccgacggaatgcttctggcaagggacatgaggtcctgcctgaccgaagcagaagccgcagtcgcaacccaagagactagtaccgtgcgcctcaaggtttcgtcgaccgctgtgcggacccaacataccaccactcgtccagtgccagacacttcgcgccttccgggtgcaaccccaggccttactactgtggaaatcgtcactatgagccatcaagcgctgggagatgtggcagggagaggaaacgaaaagaagccctcctccgtgagagccctgtcgattgtgcttcccatcgtgctgcttgtattcctgtgcctgggagtctttcttttgtggaaaaactggcgtctcaaaaacatcaactcaataaactttgacaatccagtgtaccagaaaacgactgaagatgaagtgcacatttgtcacaatcaagatggatacagctacccatccaggcaaatggtgagcctcgaggatgacgtggca

SEQ ID NO: 15981 - DNA, 2580 bp, Artificial Sequence
  Description of Artificial Sequence: Synthetic coding sequence
atgggaccgtggggatggaaacttagatggactgtcgcactgctgctggccgcggccggaaccgcagtgggtgatagatgtgaacgcaacgaatttcagtgtcaagatggcaagtgcatatcatacaagtgggtctgtgatggatcagccgaatgtcaagatgggagcgatgaaagccaagaaacctgcctgagcgtcacttgcaagtccggtgacttttcgtgcggtggaagagtcaaccggtgcatccctcagttttggcggtgtgacggacaggttgattgtgataatggttccgacgaacagggctgtcctcctaagacgtgttcacaggatgaatttagatgccacgatggtaagtgcatttcgagacaatttgtgtgcgattccgacagagactgcttggatgggtccgacgaagcatcatgtcccgttctgacctgcgggccagccagctttcagtgcaattcctcgacctgcatcccccagctgtgggcatgtgacaacgatcctgactgcgaagatggatcagatgagtggccgcaacgttgcagagggctgtacgttttccaaggggactccagcccatgtagcgccttcgagttccattgcctgagcggcgaatgcatacattcgtcgtggcgatgtgacggaggtcccgattgcaaagacaagagcgacgaagaaaactgtgcagtggccacctgccgcccggatgaatttcaatgttccgatggtaattgtattcacggatcacgacagtgtgatcgcgagtacgattgtaaggatatgagcgacgaagtgggatgcgtgaacgtgactctctgtgaaggaccaaacaaattcaagtgccattccggggagtgtatcacccttgacaaggtgtgcaacatggcaagagactgtagagattggtccgatgagcccattaaggaatgtggaaccaacgagtgtttggataacaatggcggatgctcccatgtgtgtaacgaacttaagatcggatacgagtgtttgtgtcccgacggatttcaacttgtggcccagcgtcgctgtgaggacatcgatgaatgccaggacccagatacgtgctcacaactttgtgtcaacctcgaaggcggttacaagtgccagtgtgaagaaggttttcaactggacccgcatactaaagcctgcaaggcggtggggtccattgcttatcttttcttcaccaatagacacgaagtgagaaagatgaccctggatcgaagcgaatacaccagccttattccgaatttgcgcaatgtcgtcgcgctggatactgaagtggcctccaacagaatctattggtcagatcttagccaaagaatgatttgcagcactcagcttgatagggcacacggtgtctcctcgtacgacaccgtcataagccgtgatattcaggccccggatgggctggctgtggactggatccactcaaacatatactggacggactctgtcctgggtactgtctctgtggcagataccaagggagtcaaaaggaaaaccctttttcgcgagaacggcagcaagccccgcgcaatcgtggtggatccagtacacggtttcatgtactggaccgactggggtacccctgctaagatcaagaagggagggcttaatggagtggatatctactcgcttgtgaccgaaaacattcaatggccgaacggcattaccctggacctgttgtccggtaggctgtactgggtcgactccaagctgcactcaatcagcagcatcgatgtgaacggagggaatcggaaaaccattcttgaggatgaaaaaaggctggctcatccgttttcacttgcagtctttgaggacaaggtcttttggaccgacattatcaacgaggcaatctttagcgcgaatcggcttactggaagtgatgtgaacctgcttgccgaaaaccttttgtccccagaagatatggtcctgttccataatctgacccagcctcgcggtgtcaactggtgtgagcgcacgactctttcaaatggcggatgtcagtacctgtgcttgccagcccctcagattaatcctcattcgccaaaattcacttgtgcgtgccctgatggaatgctcctggcacgcgatatgcgctcctgtctgactgaggcagaagcagcagtggcgactcaagagacgtcgacggtcagactcaaagtgagttccacggcggtgaggacccagcatactaccacccgccctgtgcctgatacctccaggctgcctggtgccactcctggactcaccactgtggagatcgtgactatgtcgcaccaggcactcggtgacgtcgcaggccggggcaatgagaaaaagccatcttccgtgcgcgcactctccatcgttttgcctattgtgcttcttgtgtttctgtgtctgggtgtgttccttctctggaaaaactggcgcctgaagaacattaactcaattaactttgataatcctgtgtatcaaaagacgactgaagatgaagtgcacatctgtcataatcaagatggatacagctacccatcgcggcaaatggtgtcccttgaagatgacgtggca

SEQ ID NO: 15982 - DNA, 2580 bp, Artificial Sequence
  Description of Artificial Sequence: Synthetic coding sequence
atgggcccttggggatggaaactgcgttggaccgtggccctcctgttggcggccgccggaaccgcggtcggtgatcggtgcgaaaggaacgaatttcaatgccaggatggaaaatgcatatcatacaaatgggtctgtgacggttcggcagaatgccaggacggttcagacgagtcacaggaaacctgcctgagcgtcacttgcaagtccggagatttctcttgcggaggccgcgtgaatcggtgcattccgcagttttggcgctgtgacgggcaggtcgactgtgataacggatctgacgaacaaggctgtccccctaaaacttgtagccaggatgagttccgctgccacgacggaaagtgcatctcgcgacaattcgtgtgtgacagtgatagagactgccttgatggaagtgacgaggcatcctgccctgtgttgacctgcggcccggcttcgttccaatgcaactcgagcacttgcatcccacagctctgggcctgcgacaatgacccggactgtgaagatggttcggacgagtggccacagcgctgccggggactctacgtctttcagggagatagttctccttgttcagctttcgaatttcactgcctgtccggagaatgtatccactcctcgtggcgctgcgacggcggaccggactgcaaggataagtcggacgaggagaattgcgcagtagcaacgtgtagaccggatgaatttcagtgctccgatggaaattgcatccacggctcgaggcaatgtgaccgtgagtacgactgcaaggacatgtcagatgaagtgggctgtgtcaatgtgactctgtgcgaaggaccgaataagttcaaatgccactcgggagagtgcatcactctggacaaggtgtgcaacatggcccgcgattgtcgtgattggagcgatgaaccaatcaaagagtgcggaaccaatgaatgtttggacaacaacggcggttgctcacatgtgtgtaatgagctgaaaataggatacgaatgtctgtgcccagacggcttccagcttgtcgcccagagaaggtgcgaggatatcgacgaatgccaagacccagacacctgcagccaactgtgcgtgaaccttgagggcggatacaagtgccagtgtgaagaaggtttccagctggatccgcataccaaggcatgcaaggctgtgggttcgatcgcgtacctcttcttcacgaaccggcacgaagtgcgcaagatgaccctcgaccggtcagaatatacctcgcttatcccgaacctgcgcaacgtggtggctctggatacggaagtggcgagcaaccggatttactggagcgacctgtcgcagcggatgatatgttcgacccagcttgaccgcgcccatggcgtgtcatcgtacgacaccgtcatctcaagagatatccaagctccggacggcctggctgtggactggatccactccaacatttactggacggattccgtgttgggaactgtgtccgtggctgatactaaaggtgttaagaggaaaactctgttcagagaaaacgggtcaaagcctcgcgcgatcgtggtggacccggtgcatgggttcatgtactggactgactggggtacgccggcaaagatcaaaaagggcggactcaacggagtggacatttactccctcgtgactgagaacatccagtggccgaacggaatcactctggatcttctctccgggcggctgtactgggtggacagcaagctccactcgatctcctccattgatgtgaatggtggtaacagaaagactatcctggaggacgaaaaacgactggcccatccattctcactggcggtgttcgaagataaagtgttttggactgacattatcaacgaggcgatcttctccgccaatcgcctgactggtagcgacgtcaacttgcttgctgagaacctcctgtcaccggaagatatggtactgtttcataacctgacccaaccaaggggagtgaactggtgcgagagaaccactctgtccaacggaggctgccagtacctctgcctcccagcaccacagatcaacccccactccccaaagttcacctgcgcgtgccctgacggcatgctcctcgcccgggacatgagaagctgcctgactgaggcagaagccgcggtggccacgcaggagacgtccacggtgcggctcaaggtgtcatcgaccgctgtgcggacccaacataccaccacgcggcccgtgccggacacttcgcgactcccaggagccaccccgggcctgactaccgtggagatcgtgaccatgagccaccaggctcttggtgacgtggcagggcgggggaatgagaaaaagccgagcagcgtgcgcgcactgtccatcgtgctccctatcgtcctcctggtgtttctctgcttgggcgttttcctgctttggaagaattggcggctgaagaatatcaattcgatcaacttcgacaaccccgtctatcaaaagaccactgaagatgaggtgcatatctgccacaatcaagacggatactcctacccttcgagacagatggtgtctctcgaggatgatgtcgca

SEQ ID NO: 15983 - DNA, 2580 bp, Artificial Sequence
  Description of Artificial Sequence: Synthetic coding sequence
atgggcccctggggctggaaacttaggtggaccgtggcgctattactcgcggccgcgggaacagcggtgggggatcgatgcgagcgtaacgagtttcagtgccaggatggtaaatgtattagttataaatgggtgtgcgatggtagcgccgaatgtcaggatggttccgacgagagtcaagaaacatgcttgtctgtgacatgcaagtccggggacttctcttgcggcggcagagtgaacaggtgcataccacagttctggcgatgtgatggccaggttgactgcgacaatggatccgatgagcagggctgccccccgaaaacatgtagccaggatgaattccggtgccacgatgggaagtgtatttccagacagttcgtatgcgatagtgatcgggattgcctggacggatccgatgaggccagctgccctgtgctgacatgcggtcctgcatctttccagtgtaattcatcaacttgcatacctcagctgtgggcctgcgataatgatcccgactgcgaagatggttcagacgaatggcctcagagatgccgagggctgtatgtatttcagggggactcttccccttgctcagccttcgagtttcattgccttagcggagagtgtatccatagtagctggaggtgcgatggcggaccagactgtaaagacaagagtgacgaagagaactgtgccgtggccacctgccgaccagatgaattccaatgttctgacggtaattgcatccatgggagtcgccagtgcgacagagaatacgactgcaaggacatgtccgatgaagtgggttgcgtgaatgttactttgtgcgaaggcccaaataaattcaaatgtcattccggcgaatgcatcacactggacaaagtgtgcaatatggcgcgggactgtagggattggagtgacgaacctataaaggagtgtggcactaatgagtgtctggacaacaatggtggttgtagccacgtgtgtaatgaacttaagatcggatacgaatgcctttgtcctgacggatttcaattggtggcccagcggcggtgtgaggacattgatgagtgccaggatcccgacacctgcagtcagctctgtgtcaacctggagggaggctacaagtgtcaatgtgaggagggattccagctggacccccatacgaaggcctgcaaggctgttggttctattgcttacctctttttcaccaatcggcacgaagtgcggaagatgacgctggatcgctcagaatacacgagccttataccgaaccttcggaacgtagtggccctcgataccgaggtagctagcaacaggatttactggtctgatctgtctcagcggatgatttgctctacgcagctggacagggcccacggggtgtcctcctacgatactgtgatcagcagagatatccaggctccggacggactggctgtggattggatccactcaaatatatactggaccgattctgtgctggggacagtatcagtggccgacacaaaaggggtgaaaaggaaaactctcttcagagagaatggcagtaagcctcgggctattgttgttgaccctgtacatggcttcatgtactggactgattggggaacgcctgctaagatcaagaaaggggggctgaacggagttgatatttactccctcgtcacggagaatatccagtggcccaatggcatcactctggacctgctttctggccgactgtattgggtggactctaagctccattccattagtagcatcgatgtgaatggagggaatcgtaagacgatattggaagacgagaaacgcctcgcccaccccttttccctggccgtattcgaggataaagttttctggacagacatcattaacgaggcaattttttccgcgaataggctgacagggtccgacgtaaatctcctggctgaaaacttgctgagtcctgaggacatggtgctgttccacaacctcacgcagcctagaggggtgaattggtgtgaaaggacgaccttgtccaacggcggttgccagtacctctgcctccctgctccacagattaatccacactcacctaagtttacttgtgcctgccccgacggaatgctgctcgctcgcgacatgcggtcttgcctgacagaagctgaagccgcggtggccactcaagagacaagcaccgttagactcaaggtatcaagcaccgcagtgcgaacacagcatacaacgacgcggccggtccccgatacgtccagactccctggagcaactcctgggctaactactgtggaaatcgtgacaatgtcccaccaggcgctgggtgacgtagcagggcggggcaacgaaaagaagcctagctctgtcagagccctgagcatcgtactacccatcgtgcttctggtgtttctatgtttgggagttttcctgctttggaagaattggcgactgaaaaacataaattcaatcaatttcgataaccccgtgtaccagaaaacgacggaagatgaggttcacatctgccataatcaggatggctattcctaccctagtcgacagatggttagtctggaagatgacgtggcg

SEQ ID NO: 15984 - DNA, 2580 bp, Artificial Sequence
  Description of Artificial Sequence: Synthetic coding sequence
atgggcccatggggctggaaacttagatggaccgtggcactgcttcttgcagcagctggaactgcggttggagatcgctgtgagcggaacgaatttcaatgtcaagacggaaagtgcatttcatacaagtgggtgtgcgatggttcggcagaatgtcaagatggtagcgacgaatcgcaggaaacctgtctttcggtgacttgcaagagcggtgattttagctgtgggggccgcgtgaacagatgtattccacaattttggagatgcgatggacaggtggactgtgacaatggttcagatgaacagggatgtcctcccaagacctgttcacaagatgaattccgctgccacgatggaaagtgtatctcgcgccaatttgtatgcgacagcgatcgcgattgtctggatggatcggatgaagcctcctgccctgtgctcacttgcggaccggcctcgtttcagtgtaacagcagcacctgtatcccgcagctttgggcatgcgataacgaccctgattgtgaagatggttcggatgaatggccacaaagatgtcggggtctttatgtgtttcaaggagactcgtccccctgctcggccttcgagttccattgtctttcaggggaatgtatccactcgtcctggcgttgtgacggtgggcctgactgtaaggataagtccgatgaagagaactgtgctgtggcaacttgccgccctgacgagttccaatgctccgatgggaattgcattcatggaagccgccaatgcgatagagaatacgactgtaaggacatgtcggatgaggtgggctgtgtcaatgtgaccctctgtgaaggaccaaacaagtttaagtgtcactcgggagagtgtattaccctggataaggtttgtaatatggcaagagattgtcgcgattggtccgatgaacctattaaggaatgcggaactaatgaatgccttgataacaatggtgggtgctcacacgtctgtaacgaactcaagatcggatacgaatgtctttgtcctgatggctttcaattggtcgcgcaacggagatgtgaagatattgatgaatgccaggatcccgacacgtgctcgcaactctgtgtcaacctcgaaggagggtacaagtgtcagtgtgaagaaggttttcagcttgacccacataccaaggcatgcaaggcagtgggaagcattgcatacctgtttttcaccaacaggcacgaggtcaggaaaatgacccttgacaggagcgagtacaccagcctgatcccaaatctgcgcaacgtcgtggcacttgacactgaagtcgcatcgaatcgaatctactggtccgacttgagccagcgcatgatttgtagcactcagctggatagggcccatggtgtctcgagctacgacaccgtgatttctcgtgatattcaggcccctgatggtctggcggtggattggatccactccaacatctactggactgattccgtgctcggaaccgtgtcggtcgctgacaccaaaggagtcaagagaaagacgctttttagagaaaatggctcgaagcctagagctatcgtcgtggatccagtccatgggttcatgtactggaccgattggggtacgccagcaaagataaagaagggtggtcttaacggggtggatatctactccctggtgaccgaaaacattcaatggcccaacggaatcaccctcgatctgctttcgggaaggctgtactgggtggatagcaagctgcactcgatctcctcgattgatgtgaacggaggtaaccgtaagaccattctggaagatgagaaacggcttgcacatcccttcagcttggccgtttttgaggataaagtcttttggaccgacatcataaacgaagcaatattctcggcaaaccgtcttactggtagcgatgtcaacctgttggccgagaaccttctgtctcctgaagatatggtcctgtttcataaccttacccaaccaagaggcgtgaattggtgcgaacgcacgacgctttcaaacggaggatgtcagtatctttgtctgccagcacctcagattaaccctcactcccctaagtttacctgcgcctgtcccgacggtatgctcctcgcacgtgatatgcggtcgtgccttactgaagctgaggcagccgtggctacccaggagactagcaccgttagactgaaggtcagttccactgccgtgagaactcagcacactactacccgaccagtcccagatacgtcgcggctgcccggcgccacccccggacttactactgtggagattgtaaccatgtcacaccaagcattgggtgatgtggccggacgaggaaatgagaagaagccctcctcagtgagggcgcttagcatcgtcctgcctattgtgctcctcgttttcctctgcctcggtgtgttcttgttgtggaagaattggcgtctcaagaacatcaattcgattaactttgataaccctgtgtaccaaaaaactaccgaagatgaagtccatatttgccacaaccaggatggatatagttatccttcccggcaaatggtgtccttggaggacgacgtcgct

SEQ ID NO: 15985 - DNA, 2580 bp, Artificial Sequence
  Description of Artificial Sequence: Synthetic coding sequence
atgggaccatggggatggaaactgcgctggactgtggctctgctgctcgccgcggcaggcactgctgtgggtgatagatgcgaaaggaacgagttccagtgtcaggacgggaaatgcatctcgtacaagtgggtgtgtgacggatccgcggaatgtcaagacggatcggatgagtcgcaggagacttgcctgtcagtgacctgcaaatcaggagatttcagctgcggaggaagagtaaatagatgcatcccacaattctggcggtgcgatggacaggttgactgcgataacggctcagatgaacaaggatgcccaccaaaaacctgttcgcaggatgaattcagatgccatgatggtaagtgcattagtcgacaattcgtctgtgattccgatagagactgcctcgacggaagtgacgaagcgtcgtgccctgtcctcacttgtggccccgcttcctttcaatgcaatagctccacctgcatccctcagctgtgggcatgcgataacgacccggattgcgaggacgggtcggacgaatggccgcaaaggtgtagagggctctacgtgttccagggagattccagcccttgttctgcctttgaattccactgcctgtcaggagagtgtatccactcgtcgtggcgttgcgatggcggaccagattgtaaggataagagcgacgaggaaaactgtgccgtggccacctgccggccggacgagtttcaatgtagcgacggcaattgcatccacggttccagacagtgcgaccgcgagtacgactgcaaagatatgtcggatgaggtggggtgcgtcaacgtgaccctttgtgagggtcccaataagttcaagtgccatagcggggagtgcatcacgctggataaagtgtgcaacatggcccgggattgtcgtgactggtctgatgaaccgatcaaggaatgcggcaccaacgagtgtctcgacaacaatggcgggtgctcgcacgtgtgtaacgaactcaagatcggatacgagtgcctttgccccgacggattccagctggtggcccaaagacgctgcgaggacatcgacgagtgccaggacccggacacgtgctcgcagctttgtgtcaacctcgagggcggatataagtgtcagtgtgaagaaggattccagctcgacccgcacactaaggcctgcaaggcagtcgggtccatcgcgtacctcttcttcactaaccgccacgaggtgcggaagatgaccctggacagatcggaatacacctccctgatcccgaatttgcgcaacgtggtggccctggacaccgaagtggcctcgaaccggatttactggtcggacttgtcgcagcgcatgatctgctcaactcaattggacagagcccacggagtttccagctacgacactgtcatcagccgcgacatccaagcgccggacgggcttgcagttgattggatccattcaaacatttactggactgacagcgtcctgggaactgtgtcagtggcagacaccaagggagtcaagcgtaagaccctctttcgcgaaaacggctcgaagccgcgggccatcgtggtggaccctgtgcatggattcatgtattggactgactggggaaccccggccaagattaagaagggaggactgaacggcgtggacatctactcgcttgtaactgaaaacatccagtggcccaatggcatcactctcgacctcctttcgggacgcctctactgggtcgatagcaaactccacagcatctcctccatcgacgtgaacgggggcaatcgaaagacgattctggaggacgaaaaacgcctggcgcatccgttctccctcgccgtgttcgaggacaaggtgttctggacggatatcatcaatgaggcaatctttagcgcaaataggcttaccggatccgacgtgaatctcctggccgaaaatctcctcagcccggaggacatggtattgttccacaatctgacgcagccgcggggggtgaactggtgcgaaaggaccactttgtcaaatggtgggtgtcagtacctttgcttgccagccccgcagatcaacccgcactcaccaaagtttacctgtgcctgccctgacggcatgctgctggcccgcgacatgcggtcttgcctgacggaagctgaggcggctgttgctactcaggaaacctctactgtgcgccttaaggtcagctcgacggcagtgcgcacccagcacactactacgcgcccagtgccagatacctcccggctcccaggtgcgacgcccggcctgaccaccgtcgaaatcgtgaccatgtcccatcaagctcttggagatgtggcgggaagaggaaatgagaaaaaaccctcctccgtcagagctctcagcatcgtgctgccgatcgtgcttctcgtgttcctgtgcttgggggtgtttctgctgtggaagaactggcggctcaagaacatcaattctatcaacttcgataacccggtgtaccaaaaaacgaccgaagatgaggtccacatctgccacaaccaggatggctactcctacccgtcgcggcaaatggtgtcgttggaggatgatgtcgct

SEQ ID NO: 15986 - DNA, 2580 bp, Artificial Sequence
  Description of Artificial Sequence: Synthetic coding sequence
atgggaccatggggctggaaactgaggtggactgtcgccctcttgctcgccgccgcaggaaccgcggtgggagatcgttgcgagagaaacgagtttcaatgccaggatgggaaatgcatctcttacaagtgggtttgtgacggctcagccgagtgccaggacggcagcgatgaatcgcaagaaacttgtctgtctgtcacgtgcaaaagcggcgacttctcctgtggagggagagtgaacagatgcattccgcaattctggcgttgcgacggacaggtcgactgcgataacggatccgatgaacagggatgcccacctaagacttgcagccaggatgagttccgatgccatgacggcaagtgtatctcgcggcaatttgtgtgcgatagcgaccgggactgtctggacggctcggacgaagccagctgcccggtgttgacctgcggccccgcctccttccagtgtaattcgtcgacgtgcatccctcagctctgggcgtgcgacaacgatccggactgcgaagatggtagcgacgaatggccacaacggtgccggggtctgtacgtctttcaaggagattcgagcccgtgctcagcattcgagttccactgcctgtcgggcgaatgtatccactcctcgtggcggtgtgacggaggcccggattgcaaggacaagtctgacgaggaaaactgcgccgtcgcgacctgcagacccgatgaatttcagtgttcggacggcaactgcatccacggttcccgccagtgcgatagggagtacgactgcaaggatatgtcggatgaggtcggctgcgtgaatgtgaccttgtgtgaaggaccgaacaagttcaagtgtcacagcggagagtgtatcaccctggataaggtctgtaacatggctcgcgactgccgggattggtcggacgaaccgattaaagaatgcggcacgaacgaatgcctggacaataatggaggatgctcccacgtgtgtaatgagcttaagattgggtacgaatgcctctgtccagacgggtttcaattggtggcgcagcgccggtgcgaggacatcgacgaatgtcaggatccggacacctgctcgcaactgtgcgtgaatcttgaaggtggttacaaatgtcagtgtgaggaaggtttccaactcgaccctcatactaaggcgtgtaaggcggtcggatcaatcgcctatttgttctttaccaaccggcacgaagtgcgcaaaatgaccctggatagatccgagtacacctcgctcatcccgaatttgcgcaatgtggtcgcactcgacactgaagtcgcctctaatcgcatctactggtcggacttgtctcaacgcatgatctgttcaacccagctggatcgagcccatggagtctcgagctacgatactgtgatttcccgggatatccaggctccagatggacttgccgtagattggattcactccaacatctactggactgattcagtcctgggtactgtgtccgtggccgacaccaagggagtgaaacgcaagaccctgttcagagagaacggctcgaagccaagagcaatcgtcgtggatcctgttcacgggttcatgtattggactgattggggaactccggccaagatcaagaagggcggactgaacggagtggacatatacagcctggtgactgaaaacatccagtggcctaatggaatcacccttgacctgctgtcgggcagactgtactgggtggactcaaagctccacagcatatcctccatcgacgtgaacggaggcaaccgcaaaacgatccttgaggacgaaaaaagactggcccacccattctcgttggcggtgttcgaagataaggtcttttggactgacatcatcaacgaagcaatcttctccgcgaaccggctcactggttccgatgtgaatctcctggccgaaaacttgctgagccccgaggacatggtgctgtttcataacctgacccagccgcgcggcgtgaactggtgcgagcgcacgaccctctcaaatggaggctgccagtacctctgcctgccggcaccgcagatcaaccctcatagccctaagttcacctgcgcctgcccggacggaatgttgctcgcgcgggacatgaggtcctgccttaccgaggcggaagctgccgtggctacgcaggagacttcgaccgtgaggctgaaagtctcttctaccgccgtgagaacgcaacataccaccaccaggccggtcccggacacctctcgtctcccgggggcaactcctgggctcaccaccgtggagattgtgactatgtcacatcaagcgttgggagatgtcgccggaagggggaatgagaaaaagccatcgtccgtgcgcgcgctgtcaattgtgttgccgatcgtcctgctcgttttcctgtgtctcggggtgttcctcttgtggaagaactggcgcctgaagaacatcaattcaatcaatttcgacaatccagtgtatcaaaagaccactgaggacgaggtgcacatctgccacaaccaggacggctattcataccccagccgccagatggtgagcctggaggacgatgtcgcc

SEQ ID NO: 15987 - DNA, 2580 bp, Artificial Sequence
  Description of Artificial Sequence: Synthetic coding sequence
atgggtccgtggggctggaagttgcgatggaccgtagcgctgctgctcgccgcagcaggaaccgcggtgggagataggtgcgagcggaatgaattccagtgtcaggacggtaaatgcatctcgtacaagtgggtgtgcgatgggtcagcggagtgccaagacggatcggacgaatcacaggaaacctgcctgagcgtgacgtgcaaaagcggcgacttctcatgcggaggccgcgtcaacagatgcattccccagttctggcggtgtgatggacaggttgactgtgataacggtagcgacgaacagggatgtccgccaaagacttgctcccaagacgagttcaggtgtcatgacggtaagtgcatctcgaggcaattcgtctgcgattccgatcgcgactgccttgacggttcggatgaggctagctgcccggtgctcacttgcgggccggcctcattccagtgtaattcgtcaacttgtatccctcaactctgggcttgcgacaacgacccagactgcgaagatggatcggatgaatggcctcagcgttgtagaggactttatgtatttcaaggagactcctctccgtgttcggcattcgagttccattgcctgtcgggagaatgcatccactcatcctggagatgtgacgggggaccagactgcaaggacaagtctgacgaagagaattgcgccgtggctacctgccggccagacgagtttcagtgttcagacggcaactgtatccacggctcaaggcagtgcgaccgcgagtacgactgcaaggatatgtccgatgaagtcggatgcgtcaacgtgaccctgtgtgaagggccaaacaagttcaagtgccattccggcgaatgcattacgttggataaggtgtgtaacatggcccgagactgcagagattggtccgacgaaccgattaaggagtgtggaacgaatgaatgcctggacaacaacggtgggtgttcccacgtgtgcaatgaactcaaaatcgggtacgaatgcctctgtcccgacggatttcagctggtggcacaacgccgctgtgaggacatcgacgagtgccaggaccctgacacttgctcgcagctgtgcgtgaatctggaaggcggatacaagtgccagtgcgaagagggcttccagcttgaccctcatactaaagcatgtaaggcagtcggatccatcgcttacctcttcttcactaacagacatgaggtcagaaagatgacccttgacaggagcgaatacacgtctctgatcccgaaccttcggaatgtggtggcactggatactgaagtcgcctcgaatcggatttactggtccgacctgtcccagcggatgatctgcagcacccaactggatcgtgcccatggcgtctcttcctacgacactgtaatctcccgcgatattcaggcccccgatggtctggcggtggactggatacactcaaacatctactggacggatagcgtgctcggaaccgtgagcgtcgccgacaccaagggagtgaagcggaaaaccttgttccgcgaaaacggatcgaagccgcgggccatcgtcgtggacccggtccacgggttcatgtattggactgattgggggactcctgcgaaaatcaagaagggcggactgaacggggtggatatctactccttggtgaccgagaatatccaatggccaaatggcatcacccttgacctgctcagtgggcggctttactgggtggatagcaaactgcacagcatttcctcaattgatgtgaacggaggaaaccgcaagaccatcctcgaagatgaaaagcggctggcgcacccgttctcactggcggtgttcgaagataaagtgttctggacggatatcatcaacgaggccatcttttccgccaatagactcaccggcagcgatgtgaacctgttggccgagaatttgttgagcccggaggacatggttctcttccacaacctgacgcaaccgagaggagtgaactggtgcgagagaactaccctgtccaacggcggttgccaatacctctgcctgccagccccgcagatcaacccacactcgcctaaattcacttgcgcctgtccagacggaatgttgctggcgcgggacatgcgctcgtgcctgaccgaagctgaagcggctgtcgcaactcaggaaacttcgaccgtgcgtctcaaagtatcgtcaacggccgtccggacgcagcacactactacccgaccggtgccagacacctcccggctgccgggagcaacccccggccttactactgtcgagatcgtgaccatgtcgcatcaagccctcggagacgttgctggaagaggaaacgagaagaagcccagcagtgttcgtgccctctcaattgtgctgcccatcgtgctgctcgtgtttctgtgcctcggagtctttctcctgtggaagaactggcgcctgaagaatatcaatagcatcaactttgataatcctgtttaccaaaaaaccactgaggatgaggtccatatctgccacaaccaagacggctactcgtacccttctcgccagatggtgagccttgaagatgatgtcgcg

SEQ ID NO: 15988 - DNA, 2580 bp, Artificial Sequence
  Description of Artificial Sequence: Synthetic coding sequence
atgggtccatgggggtggaaacttaggtggacggtcgcactgcttctggcggccgcaggaactgcagtgggggataggtgtgaaagaaatgagttccagtgtcaagatggtaagtgcatttcatacaagtgggtgtgcgatggaagcgccgaatgtcaagacggctccgacgagtcccaggagacttgtctctcggtgacgtgcaagtcaggagatttctcttgcgggggaagggtgaacagatgcatacctcaattttggcgttgcgatggtcaggtggattgtgataacggaagtgacgaacaagggtgtcctccaaagacttgttctcaggatgagtttagatgccatgacggcaagtgtatttcgagacaatttgtgtgcgatagcgatagagattgcctcgacggatcagatgaagcaagctgtcctgtcctgacgtgcggccccgcttcctttcaatgcaactcgtctacttgtattccgcagctgtgggcgtgtgataacgatcccgattgtgaggacggttcggatgaatggccacagcgttgtcgggggctgtacgtctttcagggcgattcctcgccatgctccgcgttcgaattccattgcctgtcaggagagtgcatccattccagctggcggtgcgatggtggccctgattgcaaggacaagtcagatgaggagaactgtgcagtcgcaacgtgcaggccggatgagtttcaatgttcagacggtaattgcatccatggatcccggcagtgcgatcgcgagtacgactgtaaggatatgtcagatgaagttggatgtgtcaacgttaccctgtgtgaggggcctaataagtttaagtgccatagcggggagtgtatcaccctggacaaagtatgtaacatggcacgagattgtcgggactggagcgatgaacctatcaaggagtgcggaaccaatgagtgtcttgataacaacggtggatgctcccatgtgtgtaatgaactgaagattggctatgaatgtctttgccctgatgggtttcagttggtcgcacagcggaggtgtgaagatatagacgagtgtcaggatcccgatacttgtagccagctgtgtgtcaacctggaaggaggatataagtgtcagtgcgaggaaggattccagcttgacccccatactaaagcatgtaaggctgtgggatccattgcctacttgtttttcactaaccggcacgaagtcagaaaaatgactcttgatagaagcgagtacactagtcttattccaaaccttcggaatgtggtcgcactggatacggaagtggcatccaatcgcatctattggtccgatctttctcaacgtatgatttgttcgactcagctcgaccgagcacatggagtgagcagctacgacactgtgattagccgcgatattcaagcccctgatggtcttgctgtggattggattcatagcaacatttactggaccgacagcgtgcttggtactgtctcggtggcagacaccaagggggtcaaacgtaagaccctgtttcgagaaaatgggagcaaaccacgagcaatagtggtggatcctgtgcatggatttatgtactggaccgattggggcaccccagcgaagataaagaagggaggcctcaacggtgtggacatttactctctggtgactgagaatatccagtggccaaacggtattaccctggatctcctttcggggagactctactgggtcgattcaaaactccactctatttcgagcatcgacgtgaatggcggaaatcgaaagactattcttgaagatgaaaagcgcttggcacacccatttagccttgctgtattcgaagataaggtgttttggactgacattatcaatgaagcaattttctccgccaatcgtctgactggttccgatgtcaacctgcttgccgaaaacctcctttcacccgaggacatggtgctttttcacaatctcacccagcctagaggggtgaactggtgcgaacggactactctgtcgaacggcggatgtcagtacttgtgtctccccgctccccagatcaacccacatagcccaaagtttacttgtgcatgtcctgacgggatgctgcttgcccgcgatatgcgcagctgcctcaccgaagctgaagcagcagtcgcaactcaagaaacctctactgtgcgcctcaaagtgagctccaccgcagttcggactcagcacactaccactcgccctgtgccggatacctcccggctgccaggcgcaacgcctggtcttactacggtcgagatcgtgactatgtcacatcaagcactgggggatgtggccggaaggggaaacgaaaagaaaccgtccagcgtgagagcactttccattgtcctccccatcgtgcttctggtctttttgtgtctgggtgtgtttcttctgtggaagaattggagactcaagaacattaactcaattaacttcgacaaccctgtctaccaaaaaaccactgaagatgaagttcacatatgccacaaccaggatgggtactcatacccttcgagacagatggtgtcgctcgaggacgatgtggca

SEQ ID NO: 15989 - DNA, 2580 bp, Artificial Sequence
  Description of Artificial Sequence: Synthetic coding sequence
atgggtccttggggatggaaactcaggtggaccgtggccctattactagctgccgccgggaccgccgttggcgatcgttgtgagagaaatgaattccagtgtcaggacggaaaatgtatcagctataaatgggtgtgtgacggcagcgcagagtgtcaggacggttctgatgagtcacaggagacatgtctctccgtgacatgcaaatctggggacttcagttgtggcggccgcgttaatcggtgtataccgcaattctggcgatgcgacgggcaggtcgactgcgataatgggagcgacgaacaggggtgccctcctaagacatgctcccaagacgaattccgctgtcacgacgggaaatgcatttcacgtcagtttgtatgcgacagtgatcgggactgtttggatggctccgatgaggccagttgtccagtgctcacctgtggccccgcttcatttcagtgtaacagctctacttgcatcccacagctgtgggcgtgcgacaatgatccagattgtgaggacggttccgatgaatggccacagagatgccgagggctgtacgtgttccaaggggactcgagcccatgtagcgcctttgaatttcattgtttaagcggggaatgcatccatagctcatggcgctgcgacggcggtcccgattgcaaggacaagtcagatgaggagaattgcgccgtggcaacatgccgccccgatgagtttcaatgctccgacggcaattgcatacacggttcgaggcaatgcgaccgcgaatacgactgcaaagacatgtctgacgaggtggggtgtgtcaacgtgaccctgtgtgaagggccgaataagttcaaatgccactcaggagagtgtatcacactggataaggtgtgcaacatggctcgggactgccgcgattggtctgacgagcctattaaagaatgcggaaccaacgaatgtctggacaacaacggggggtgctcacacgtgtgcaacgaattaaagatcggttacgaatgtctgtgccctgacgggtttcagctggtggctcagagaaggtgtgaagacatagacgaatgccaggaccccgacacttgctcacagctgtgcgttaacctggagggtggctacaagtgtcagtgcgaggagggattccagctggatcctcacactaaggcatgcaaggcggtaggcagtattgcctacttatttttcaccaatcggcacgaggtgcggaaaatgaccctcgaccggtccgagtacacctccctgatacctaatcttcgcaacgtggtcgcactggataccgaggtggcaagtaataggatctactggagtgatctgtcccaacgaatgatttgttccacacaattagatagggctcacggtgtgagctcctacgacacagtgatttctagggacatccaggcacccgatggcttggccgtggactggattcattctaacatctattggacagattctgtccttgggacagttagtgttgccgacactaaaggagtaaagcggaagaccttatttagggaaaacggcagtaaaccaagggcaatcgtggtggatccagtgcacgggtttatgtactggaccgactggggtacaccggctaaaattaagaaaggtggtctgaacggggtcgatatttattccttagtgaccgagaatattcaatggccgaatggaatcaccctcgatctgctgtcggggcggctgtactgggtcgattcaaagctacattcaatctccagcatcgacgtgaacggagggaataggaagaccattctagaggatgagaaacgtctggcacatcccttctccctcgcagtattcgaagataaggtgttctggacagacatcataaacgaggctattttctccgcgaacagactgacaggaagcgatgttaaccttctggcagaaaatctactaagtcccgaggacatggtcctattccacaatcttacacagcctcgaggcgtcaactggtgcgaacgaaccacattgtcaaacggtggttgccagtatctgtgcctccctgctcctcagattaacccccacagccccaagttcacctgcgcttgccctgatgggatgctgctggccagggatatgcgctcttgtctgaccgaagccgaagccgcggtagccacacaggaaacatcaaccgttcggctgaaagtaagttcaactgccgtccgcacacagcacacaacaactaggccagtgcctgatacgtctcgcttacccggagctacaccaggacttaccacagtggaaattgtgaccatgagccaccaggctctgggagatgtggcaggaagaggaaacgagaaaaagcccagttctgtgagagccctaagcatagtgctgcccattgtactattggtgtttctgtgccttggcgtattcctactttggaaaaattggaggctgaagaatattaattctatcaactttgataaccccgtctaccaaaaaacgaccgaagacgaggttcacatctgtcataaccaggacgggtattcctacccctctcgccaaatggtgtcactagaagatgacgttgcc

SEQ ID NO: 15990 - DNA, 2580 bp, Artificial Sequence
  Description of Artificial Sequence: Synthetic coding sequence
atgggaccatggggctggaagttgcgctggactgttgcccttttgctggctgcagctggaactgccgtgggagacagatgtgaaagaaacgagtttcagtgccaggacggaaaatgtatcagctacaagtgggtttgtgatggctccgccgaatgccaagatggctccgacgagagccaggagacttgcctttccgtgacctgcaagagtggagatttctcctgcggaggacgcgtgaatcgctgtattcctcagttctggcgctgcgatggacaagtggattgcgacaatggaagcgatgagcaaggctgtcctcctaagacctgttcccaggacgaattcaggtgtcacgacggtaagtgcatctcaaggcaattcgtatgcgattccgaccgcgactgccttgacggaagcgacgaagcttcatgccctgtgctgacttgcggtccagctagctttcagtgtaacagttctacttgtattccccaactttgggcatgtgataacgaccccgattgcgaggacggctctgacgaatggcctcagagatgccgcggcctctacgtctttcaaggcgacagttcaccctgcagcgcattcgaattccattgcctgtctggcgagtgcattcacagcagttggaggtgtgatggtggtcccgattgcaaggacaagtccgacgaggaaaactgtgcagtggctacctgccgtcctgacgaatttcagtgtagcgacggtaattgtatccatggttctcgtcaatgcgacagagagtatgattgcaaggatatgtcagacgaggtgggttgcgtgaatgtcactctgtgcgagggtccaaataaattcaagtgtcacagcggcgaatgcataacactcgacaaagtgtgtaacatggctagagattgcagagattggtctgatgagccaatcaaagagtgtggaactaacgagtgtctggacaacaacggcggatgctctcacgtttgcaacgagctgaaaatcggctacgaatgtctgtgccctgatggcttccagctcgtggcccagaggcgctgtgaagacattgatgaatgtcaagatccagacacctgctcacaactgtgcgtgaacctggaaggcggctataagtgccagtgcgaggagggcttccaactggatcctcacaccaaggcttgcaaggcagtcggttccatcgcttacctgttctttactaatagacatgaagtccgtaagatgacactggaccgctccgagtacacttcactcatacctaatttgaggaacgtggtagctctggacacagaggtagcctccaacaggatatactggtctgacctgagccaacgtatgatttgctccactcagttggatagggctcatggagtatccagttatgatactgtcatctcccgcgatatccaggcaccagatggactggctgtggattggattcatagcaacatttactggacagacagcgtcctgggcactgtaagcgtagccgacaccaagggtgtgaagaggaagacactttttcgcgaaaatggctctaagcccagagctatcgtggtggatcctgtgcatggctttatgtactggaccgattggggtacccccgccaagatcaagaagggtggcctgaatggagtggatatctattctctggtgactgagaatattcaatggccaaatggcatcacattggatctgctttcaggccgcctttactgggtcgattcaaaactgcacagtatctctagcatcgacgtgaacggcggaaaccgtaagaccatcttggaggacgaaaaaaggctggcccaccccttcagtctcgcagtgtttgaagacaaggtcttctggacagacattatcaatgaagcaatcttttctgctaatcgtctgaccggttccgacgtgaatcttcttgctgagaatctgctttccccagaggacatggttttgtttcataatctcacccagccccgtggagtaaactggtgcgaaaggactactttgtccaacggcggctgccagtacctgtgcctgcctgcccctcagatcaaccctcacagtcccaaattcacctgtgcatgccctgacggcatgcttctggctcgtgacatgagatcctgtctcaccgaagcagaggcagctgtagcaacacaagagacttcaacagtgcgtctgaaggtctctagcactgctgttcgtacccagcacacaaccactcgccctgtgccagatacctcccgtcttcccggcgccactcccggcctgactacagtagagatcgtcacaatgtcccatcaagccctgggagacgtcgcaggccgtggcaacgagaagaagcccagttctgtccgtgctctgtctatagtgttgccaattgttctgctcgttttcttgtgtctgggagtgttcctcctgtggaagaactggcgcttgaaaaacatcaacagtattaacttcgacaaccccgtgtatcagaaaactaccgaagacgaagtgcatatctgccataatcaggacggttactcttacccaagcagacagatggtctctctggaggacgacgtagct

SEQ ID NO: 15991 - DNA, 2580 bp, Artificial Sequence
  Description of Artificial Sequence: Synthetic coding sequence
atgggaccgtggggctggaagttgcgctggactgtcgcacttctcttggcggcagcaggaactgcagtgggggaccggtgcgagaggaatgagtttcagtgtcaagacggcaagtgtataagctacaagtgggtgtgtgatggatcggctgagtgccaagatggatcagacgaatcgcaggaaacctgtttgtcagtgacgtgtaagtcaggcgatttttcatgtggtggcagggtgaacaggtgtatccctcaattttggagatgcgatggacaggtcgattgcgataatggatctgacgaacaaggatgtccacctaaaacctgtagccaggatgaattccgctgccatgatgggaagtgtatatcgcgccaatttgtctgcgactcagacagagactgcctggatgggtccgatgaagcatcatgtccagttctgacttgtggaccggcttccttccaatgtaactcctccacctgtatccctcagctctgggcctgtgataatgatcccgactgtgaagatggcagcgacgaatggcctcagcgttgtaggggtttgtacgtctttcaaggagactcgtccccgtgttcggccttcgaattccattgtctgtccggggaatgtattcacagctcgtggagatgtgatggtggaccagattgtaaagataaaagcgacgaggaaaactgtgccgtggcaacctgtcgccccgacgaattccaatgttccgacggaaactgcattcatggttccagacagtgtgacagagaatacgactgtaaggacatgtcggatgaagtgggttgtgtgaatgtgaccctgtgcgaaggtcctaacaagtttaagtgtcattcaggagaatgtataaccctcgataaggtctgtaatatggcacgggactgtagagattggtcagatgaacccatcaaagagtgtgggactaatgagtgtctggacaacaacggaggttgttcgcacgtgtgcaacgagcttaagattggttacgagtgcttgtgcccggatggatttcaactcgtggcacagcgcaggtgtgaagatatcgatgaatgccaggaccctgatacttgttctcaactgtgcgtgaacctcgaaggcgggtacaagtgccaatgtgaggagggctttcaactcgacccccataccaaggcgtgcaaagcagtgggcagcattgcatacctgtttttcaccaataggcacgaggtgagaaagatgaccctcgatcgatccgagtacacctcattgattcctaaccttcggaatgtcgtcgctcttgacaccgaagtggcatcgaacaggatctactggtccgatcttagccagcgaatgatatgttcgacccaattggatagggctcatggcgtctccagctacgataccgttatcagccgtgatattcaagctccagacggccttgcggtggattggatacatagcaacatttactggactgattcggtccttgggactgtcagcgtggcagatactaagggagtcaaaagaaagaccctgttcagagaaaatggatcaaaacctagggcaatcgttgtggacccagtccacggttttatgtactggaccgattggggaactccggcaaagattaagaaggggggactgaacggcgtggacatttactcattggtgactgagaatattcagtggccaaacggcattacgcttgatctgctcagcggtcgcctttactgggtggattccaaactccactccattagctccatcgacgtcaacggcgggaatcgcaagaccattcttgaagatgaaaaacgtctcgcacatcccttctcactcgccgtctttgaggataaggtcttttggaccgacattatcaacgaggccattttctccgcaaatcgtcttaccggatccgatgtgaatctgcttgcagagaatctgctctctccagaagatatggtgctgttccacaatctgacccagcctcgaggtgtgaactggtgcgaaaggactactctgtcgaacggcggatgccagtacctgtgtctgccagcacctcagattaatcctcattcgccgaagtttacgtgtgcctgccctgatggtatgttgctggcacgcgatatgcgcagctgcctgactgaagcggaggcagccgtcgccactcaagagacttccaccgtgagactcaaggtgtcctcgaccgccgtgcgaactcagcatactacgactcggccggtgccagacacttcgagactccccggagcaaccccaggactgaccacggtcgaaattgtcacgatgtcacatcaagcactcggggacgtggcaggacgggggaacgaaaagaagccgtcatcggtgcgggcactcagcattgtgcttcctatcgtgctcctcgtgttcctgtgtctgggtgtgtttcttctgtggaagaattggcgactgaaaaacattaactcgatcaatttcgataaccctgtgtaccaaaagactaccgaggatgaggttcacatttgccacaatcaagacggatactcgtacccatcccgacagatggtgagccttgaagatgatgttgca

SEQ ID NO: 15992 - DNA, 2580 bp, Artificial Sequence
  Description of Artificial Sequence: Synthetic coding sequence
atgggcccttggggatggaaactccgatggaccgtggctttactcttggctgctgccggtaccgccgtgggtgaccgctgcgaacgcaatgaattccagtgtcaggatggcaagtgcatatcttacaaatgggtgtgtgacggctctgcggaatgccaggatgggagcgacgagagccaggaaacgtgcctttctgtcacctgtaaaagtggtgacttcagttgtggcggcagagtgaaccggtgtataccacaattttggcggtgcgacggccaagtcgactgcgacaacggcagcgatgagcaaggatgtcccccaaaaacttgtagtcaggacgaatttaggtgccatgacggcaagtgcatcagccggcagtttgtttgtgacagtgacagagattgcctggacgggtccgatgaagccagctgccctgttctgacgtgcggccccgcctcttttcagtgcaacagctccacttgcatcccccagctctgggcttgcgacaacgatccggactgcgaggacggatccgatgaatggccgcaaagatgccggggactgtacgtcttccagggcgacagttcgccctgctcagctttcgagttccattgtctatctggcgaatgcattcactcttcctggagatgtgacggcgggcctgattgtaaggacaaaagcgacgaggaaaactgtgcagtggccacttgccggccggatgagtttcagtgtagcgatggcaattgtatccatgggtcacgccaatgcgacagggagtacgattgcaaggacatgagtgatgaagtagggtgcgttaacgtgaccctgtgcgaaggtcccaacaagttcaagtgtcactctggggaatgtataacactcgacaaggtttgtaacatggccagggattgccgcgactggagcgacgagccgattaaggagtgcggcacgaacgagtgcttggacaataatggagggtgtagccatgtgtgcaacgagctgaagattggctatgagtgcttgtgcccagatggctttcagctcgttgcacagaggcggtgcgaagatattgacgaatgccaagacccggatacctgtagccagctctgtgtcaacctggaggggggatacaagtgccaatgcgaagaaggctttcagctggatcctcacacgaaggcatgtaaggcggtgggaagtatagcatacttgttcttcacaaatagacatgaggtgaggaagatgacactggataggagcgagtacacctcactgatccccaatctgcgtaatgtagtggccctggacacagaagtcgcaagcaaccgcatctattggagcgatctgtcacagcgcatgatatgttccacccaactggatcgggcccatggtgtgtcctcgtatgacaccgtcattagtagagacatccaggcgccagatgggctcgcagtggactggatccattcgaacatttattggacggattcagttctcggcactgtttccgtggctgatacaaaaggggtgaagcgcaaaaccctgttccgtgaaaatggatctaagcctcgagcaattgtcgttgacccggttcatggcttcatgtactggacggattgggggactcccgccaaaattaagaagggcgggcttaacggggtggacatatatagccttgttacggagaacatccaatggcccaacggaattactcttgatttgctaagcggaaggctgtattgggtcgacagcaagcttcactccatttctagcattgatgtgaatgggggaaatagaaagacgatactggaggatgaaaagcgcttagctcacccattttcactggctgtgttcgaggataaggtgttttggactgacataatcaacgaggcaattttcagtgctaacagactcactggatccgacgtgaaccttctcgccgagaacctactgtctccagaggatatggtgctatttcataacctgactcagccccgcggagtgaattggtgcgagcggacgaccttgagtaatggggggtgtcaatatctttgccttccggccccccagatcaaccctcacagcccaaaatttacctgtgcatgcccagacgggatgttactcgccagggatatgagatcctgcctcactgaggccgaggccgcagtcgccactcaagaaacatccactgtaaggctcaaagtgtcctccaccgcagtgcggacacagcacacgaccactcgccctgtaccagatacctcacgcctccctggggccacgccggggctaactaccgtcgaaatagttaccatgtcgcatcaagcattgggggacgtggccggccggggcaacgaaaagaagccaagttccgtgagagccctgtcaatcgtgttgccaatcgtcctgctggtctttctatgcctgggggtgttcctactgtggaagaactggaggttgaagaatattaatagcataaacttcgataaccctgtatatcagaagacaactgaggacgaggtacatatctgccataatcaggatggctacagctacccatcccgacagatggtgtcactcgaagacgacgtcgcc

SEQ ID NO: 15993 - DNA, 2580 bp, Artificial Sequence; identical to SEQ ID NO: 15983
  Description of Artificial Sequence: Synthetic coding sequence

SEQ ID NO: 15994 - DNA, 2580 bp, Artificial Sequence
  Description of Artificial Sequence: Synthetic coding sequence
atgggcccatggggatggaagctaagatggacggttgccctgctgctggccgctgctggcacagctgtgggggaccgttgcgagagaaatgagtttcagtgccaggacggaaagtgcatctcttataaatgggtgtgcgacgggagcgctgaatgccaagacgggagtgacgagagtcaggagacctgcctgtcggtcacatgtaaatctggcgattttagctgtggaggtcgcgtgaaccgctgcattcctcaattttggcggtgtgacggacaggtcgattgtgacaatggaagcgatgaacaaggatgtccccctaagacttgctctcaggacgaatttaggtgccatgacgggaagtgtatttccaggcaattcgtctgcgactccgaccgggattgcctagatggatcagacgaggcctcctgcccggtcttgacatgtgggcccgcttccttccaatgtaattcttctacatgtattccacagttgtgggcttgcgacaatgatccagactgtgaggacgggtccgatgaatggccacagaggtgtaggggtctgtatgtgttccagggcgactcctccccttgttccgccttcgagtttcattgcctgtctggcgaatgcatccacagcagctggcggtgtgacgggggccccgattgcaaggacaagagcgatgaagaaaattgtgcagtcgcaacttgcaggcccgacgagttccagtgtagcgacggcaattgtattcatggttctaggcagtgcgaccgggagtacgactgtaaagatatgtcagacgaggtcgggtgcgtcaatgtgaccctctgtgagggtccaaacaaattcaaatgccatagcggcgaatgcatcacgctggacaaggtgtgtaacatggcacgcgactgccgcgattggagcgatgaacccattaaagagtgtgggaccaatgaatgtctggataataacggtgggtgcagccacgtgtgtaatgagctgaagattggctatgagtgcctgtgtccagatggcttccaactcgtcgcacagaggcgttgcgaggacatagatgagtgccaggatcccgacacgtgtagccagctgtgcgtgaacctcgaaggcggatacaaatgccagtgtgaggaagggttccaactggatccacacacgaaggcttgtaaggcagttggctccatcgcctacctgttcttcacgaacaggcatgaagttagaaagatgacgctcgatagatctgaatatacgtctcttatcccaaacctcagaaacgttgtggcattggacacagaagtggccagtaaccggatttattggtcagacctgtcccagcgcatgatctgcagtacacagttggatcgcgcccatggggtatcttcctacgacaccgtgatcagtagagatattcaagctccagacgggctagcggttgattggatccacagcaacatctactggaccgacagcgtgctcgggactgtttcagtggctgacaccaaaggggtgaaaagaaagacacttttccgggaaaatggatcgaaacctcgcgccatcgtggtcgaccctgtgcatgggttcatgtattggacggactgggggactcctgcaaagataaagaaaggagggctgaacggagtggacatttatagcttagttactgagaatatacagtggcctaacggtataacattggacttgctgtctggacgcctatattgggtggactctaaactccatagcatttcatctatagatgtgaacggtggaaatcgcaagaccatcctggaggatgaaaagcggcttgcccacccattttcactggctgtatttgaggataaggtgttctggactgatattataaatgaggcaatcttctccgctaatcgattgaccgggagcgacgtgaacctcctcgctgagaatctgctgtccccagaagatatggtcctgtttcataacctgactcagccgcggggcgtgaattggtgtgagcgcaccactctgtctaacggtgggtgtcagtatctatgcttgccagcaccgcagatcaatcctcactcacccaaatttacctgtgcctgtcccgacggtatgttgctagccagggacatgaggtcttgtctgactgaggcagaggccgccgttgcaacccaggagacaagcacggtgcgcctgaaggtgagctctacagcggttaggacgcagcataccactacccggcctgttccagatacgtcaaggctccccggagctacacccgggctgacaaccgtggagatagttacaatgtcgcatcaggcgctgggtgacgtggccggcaggggaaacgagaagaagccatccagcgtccgggcactttctatagttctgcccattgtcttactcgtgtttctttgtcttggtgtttttcttctgtggaaaaattggcggttgaaaaacattaactcaattaacttcgacaaccccgtttaccagaagaccacggaggacgaagtgcacatatgtcacaatcaggacgggtacagctaccctagcaggcaaatggtaagtttggaggatgatgtggca

SEQ ID NO: 15995 - DNA, 2580 bp, Artificial Sequence
  Description of Artificial Sequence: Synthetic coding sequence
atgggaccctggggctggaaactgcgctggaccgtggccctactgctggctgctgcaggcacggccgtcggcgataggtgtgaacggaacgagttccagtgccaagacgggaagtgtatctcctacaaatgggtgtgcgatgggtccgccgagtgccaagacggttccgatgagtcacaggaaacgtgtctttcggttacctgcaagtcaggcgactttagctgcggcggaagagtaaacagatgcatcccacagttctggagatgtgacggacaagttgactgtgataatggcagcgatgaacaagggtgcccacccaagacctgctcccaagacgagttcagatgtcacgacgggaaatgcatcagccggcaattcgtgtgtgactccgatagggactgcttagacggatcggatgaggccagctgccctgtgttaacatgcggacccgcctcctttcagtgtaattcctccacgtgcatcccacaactctgggcctgcgacaatgaccctgattgcgaggatggcagcgacgagtggccacagaggtgccggggcctgtacgtgtttcagggagatagcagcccatgtagcgcctttgagtttcactgcctgtctggcgagtgcatccattcctcatggaggtgtgacggtggccctgattgcaaagacaagagtgatgaggaaaactgtgcggtggccacctgccgccctgacgagttccagtgttccgacggaaattgtatccacggaagtcggcagtgcgacagagaatacgattgtaaggacatgtcagatgaggtgggatgtgtgaacgtgactctttgcgagggacctaacaaattcaagtgccattccggagaatgtatcacactggacaaggtctgcaacatggcccgagactgtcgtgactggtccgatgaaccaataaaagagtgcggtaccaatgagtgtctggacaacaatggtggttgttcacacgtatgcaacgaactaaaaatcggatacgaatgcctgtgccctgatggattccaattagtagcccagaggaggtgtgaggatatcgacgaatgccaggatccggacacctgctcgcagttgtgtgtgaatcttgaagggggttataagtgccagtgtgaagagggctttcaactggacccccatacaaaggcgtgtaaggcggttgggagcattgcatacttgttcttcactaaccgacacgaggtgcgcaagatgacactggaccgcagcgaatatacatccttgatccctaatctcaggaacgtggtcgcgttagacaccgaggtggcatccaacaggatatattggtctgatttatcgcaaaggatgatctgttcaacacagctggaccgggcccatggcgttagttcatatgacaccgtgatcagtcgcgatattcaggcccctgatggtctggcagttgattggatccacagtaatatatattggaccgattccgtactgggcaccgtgtccgtagcggacaccaagggcgtcaagcgtaaaaccttgtttcgggaaaatggaagtaagcctcgggccatcgtggttgatcctgttcatggatttatgtattggacagactggggcactcccgctaagataaagaaaggtggtctaaatggcgtggatatctactcattagtgacagagaacatccagtggcccaatgggattacactggatctgctgtctggccgtctctactgggtggatagtaagctccattccatcagttcaatcgacgtgaatggaggcaaccgtaagactatccttgaggacgagaagcggctggcacatccgttctccctagcggtgtttgaagataaggtgttttggactgacattatcaatgaagctatctttagtgcgaataggttaaccgggtcggatgtgaacctgttagccgaaaatcttctgtccccagaggatatggtcctgtttcataacctaacccagccgaggggtgtgaactggtgcgagcgcacgactctgtcaaatggcggatgtcagtacctgtgcctgccagctccacagattaacccgcacagcccgaagtttacctgcgcatgtcccgatgggatgctactggctagggatatgaggagctgccttacagaagcagaggcagcagtcgccacccaagaaacctccacagttaggctgaaggtttcatcgacagcagtcagaacccagcacactacaacacgtcccgtgcctgacacctcacggctgcctggggctactcccggactcacgacagtggaaattgtgaccatgagccaccaagcgcttggagatgtggctgggagagggaacgaaaaaaaacccagctccgtaagagccctgtctatcgtcttgccaattgttctgctggtcttcctgtgcttgggcgttttccttctatggaaaaactggcggctgaagaacatcaactctatcaattttgacaaccccgtatatcagaaaaccacagaggacgaggtacatatctgtcacaatcaggacggttattcttacccatcccgacagatggtgtcattggaagatgatgtcgcc

SEQ ID NO: 15996 - DNA, 2580 bp, Artificial Sequence
  Description of Artificial Sequence: Synthetic coding sequence
atgggaccctggggatggaaactgcgatggacggtggccctcctgctagccgccgccgggaccgccgtcggtgacaggtgcgagcgtaacgagttccaatgccaagatggaaagtgcatctcttataagtgggtatgtgatgggtcagctgagtgtcaggatggctcagatgagagccaggaaacttgcctgtccgttacttgcaagtctggcgatttctcatgcggcggacgcgtcaataggtgcattcctcagttctggaggtgcgacgggcaggtggactgcgataatgggagcgatgagcaaggctgcccaccaaaaacctgttcccaggacgaatttcggtgccacgacggcaagtgtattagccggcaattcgtgtgtgatagtgaccgggactgtctggatggctcggacgaagcgtcttgtcccgtgctcacctgtggaccagcgagcttccagtgcaattcaagcacctgcataccacagctttgggcatgcgataacgatcctgattgcgaggatgggtccgacgagtggcctcagcggtgccgcgggctgtacgtgtttcagggcgacagttccccctgttccgcctttgaattccactgcctttcaggcgagtgcatccatagctcctggcgctgcgacggaggccccgattgtaaggataaaagtgacgaggaaaattgtgccgttgctacttgccggccagatgagttccagtgttccgatggtaattgcatccatggttccagacaatgtgatagagaatatgattgcaaggatatgtccgacgaagtgggctgtgtgaatgtcacactgtgtgagggaccaaacaaattcaagtgtcactccggggagtgcattacactcgataaagtgtgtaatatggcccgtgattgtcgggactggtcggacgagccaataaaggaatgtgggacgaatgagtgtctggacaataacggtggatgttcgcacgtgtgcaatgagctgaagatcggttacgagtgcttgtgtcccgacgggttccagctcgtcgcacagcgtcgctgcgaggacatcgacgagtgccaggaccctgatacctgctcccagctgtgcgttaatctggagggaggatacaagtgtcagtgcgaggagggcttccagcttgatccccacaccaaagcttgtaaagccgtggggtccattgcttacctgttcttcaccaacagacatgaagtgagaaaaatgacactggaccgcagtgaatatacttccttgatccctaacttgcggaatgtggtagcgctggacaccgaagttgcatccaataggatctactggtccgaccttagccagcgcatgatttgctccacccagcttgaccgagcccacggagtatcctcttacgatacggtgatttcacgcgacatccaggcacccgacggacttgccgtggactggatccactcaaacatctactggactgactccgtactcggtaccgtgagcgtagccgataccaagggcgttaagcgcaaaacattgttccgtgagaatggcagcaagcctcgcgcaattgtcgttgacccagtgcatgggttcatgtattggaccgactggggcactcccgcaaagattaaaaaaggtggcctgaatggcgtggacatctactcattggttactgagaatatacagtggcccaatggcataacattggacctactgtctgggcggctatattgggtcgatagcaagctgcacagcatctcatcaatcgatgtcaatggcggtaatcggaaaaccatcttggaggacgagaaacggctggcccacccctttagtctggctgtatttgaagataaagttttctggaccgatatcattaatgaggctattttttcagctaatcgactcaccgggagcgacgtcaacttactggccgagaatctcctgtcaccagaagacatggttctatttcacaacctgacacagcctcggggcgtgaactggtgtgagcggacaactctctccaatggaggatgtcagtacctttgtcttccagctcctcagataaacccgcacagtcccaagttcacttgcgcctgccctgatggcatgctgttagctcgtgatatgcggtcatgcttaacggaggccgaagcggcggtggccactcaagaaacgtctacggtcagactcaaggtatcatctacagcggtgaggacacagcacacaacaaccagacctgtgcctgatacaagcaggctgccaggggccactccagggctcactactgtagaaatcgtgacaatgtcacatcaggccctaggggacgtggctggacgcggaaacgagaagaaaccaagctccgtccgggctctgtcaattgttctgcctattgtgctgttggtgttcttatgtctcggggtttttctgctctggaagaactggcggctgaaaaacattaactcaattaatttcgataacccagtttatcaaaaaactaccgaggacgaggtgcatatctgtcacaaccaggacgggtatagctacccctctcggcagatggtctcactggaggacgatgtggcc

SEQ ID NO: 15997 - DNA, 2580 bp, Artificial Sequence
  Description of Artificial Sequence: Synthetic coding sequence
atgggaccatggggatggaagctgcggtggaccgtcgctctcctccttgccgcggccggaactgcggtgggagacagatgtgaacggaacgaatttcagtgtcaagacgggaagtgcatctcgtacaagtgggtgtgcgatggtagcgcagagtgccaagacggctcagacgaaagccaagagacgtgcctctcagtgacgtgtaagtcaggcgacttctcgtgcggcggacgggtgaacaggtgcatcccgcaattctggagatgcgacggacaagtggactgcgacaacggcagcgatgagcagggatgtccccccaagacctgctcgcaggacgaattcaggtgccatgatgggaagtgtatctcgcgccagttcgtgtgcgactccgaccgcgactgtctcgacggatccgacgaagcctcctgcccggtcctgacttgcgggcctgcaagtttccagtgcaattcatcaacttgcatcccgcagctgtgggcttgcgacaacgacccagactgcgaagatggatcagatgagtggccgcagagatgcagaggactttacgtgttccaaggcgactcgagcccttgctccgcgtttgaattccattgtctctcaggtgaatgcatccattcgagctggagatgtgacggaggcccagactgcaaagataaatcggatgaagagaactgcgctgtagccacgtgccgcccggatgagtttcaatgttcagatggaaactgtattcacgggtccagacaatgcgacagggagtacgattgcaaagacatgtcggacgaggtcggatgcgtcaacgtcaccctctgcgagggacctaacaagttcaagtgccactcaggggaatgcattactctggacaaggtgtgcaatatggccagagactgtcgcgattggtcagatgaaccgatcaaggagtgcggcacgaatgagtgcctggataacaatggcggatgcagccacgtgtgcaatgagcttaagatcggatacgagtgcctttgtccggatggattccagttggtggctcagcgccgctgcgaggacattgatgaatgccaagatccggacacgtgctcgcagctctgcgtgaacctggagggcggatacaaatgccagtgcgaagagggatttcagttggatccacacactaaggcgtgtaaggcagtggggtccatcgcctacctgttcttcacgaacaggcatgaggtccgcaaaatgacgttggatcggtcagaatacacctcactgatcccaaatctcagaaatgtggtggcgctggacactgaggtggcatccaaccgcatctactggtccgacctgtcgcagcgcatgatctgctcaacccagctcgaccgagcacacggcgtgtcatcctacgataccgtcatttcacgtgacatccaggcgccggacggcctggccgtggactggatccattcgaacatttactggactgattcggtgctgggtaccgtgtccgtcgccgatactaagggagtgaagcgaaagaccctcttccgagagaacgggtccaagcctagagctatcgtggtggatccggtccatggtttcatgtactggactgactggggaaccccggcgaaaatcaagaaaggtggactgaacggagtcgatatctactcgctggtcaccgaaaacatccagtggccaaacggcatcacgctggacttgctgtcgggccggctctactgggtggactccaagctgcattcgattagttcaattgacgttaacggaggaaaccgcaagactatcttggaagatgagaaacgcctggcgcatccgttctctctcgccgtgttcgaggacaaggtgttctggacggatatcatcaatgaggcgatcttcagcgcaaataggttgactggcagcgacgtgaatctgctggccgagaacctcctctcgcctgaggatatggtgctctttcataacctcacccagccacggggagtgaattggtgtgaacggaccaccctctcgaacggcggatgtcagtacctctgcctccctgccccacagatcaacccacactcgccaaagttcacgtgcgcatgcccggacggcatgctgctggcgagagacatgcggtcctgcctgactgaagccgaggccgccgtcgcgacccaagagacttcgactgtgcgcctgaaagtgtcctccactgccgtgcggactcagcacaccacgacccggccggtcccggacacctcccggctccctggcgcgactccggggctcaccaccgtggagatcgtgactatgtcccaccaggccctgggtgacgtggctggccggggtaatgagaagaagccgagctccgtgcgcgcgctgagcatcgttctcccgatcgtgcttctggtgttcctgtgcctcggagtgtttctgctctggaaaaactggcgactgaagaacatcaattcaatcaatttcgacaatccggtgtaccaaaagaccactgaggacgaagtccacatctgtcataatcaagatggatactcgtacccgtcacgccagatggtgtccctggaggacgatgtcgca

SEQ ID NO: 15998 - DNA, 2580 bp, Artificial Sequence
  Description of Artificial Sequence: Synthetic coding sequence
atgggaccttgggggtggaaacttaggtggaccgtcgcactgctgcttgcagctgccgggaccgccgttggagatcggtgcgagagaaatgagtttcagtgccaggacggaaagtgtatatcatacaaatgggtgtgtgatggttcggctgaatgtcaagacggctccgatgagtcgcaagagacttgtctgtcggtcacttgcaagtcaggcgacttctcctgcggtggtcgggtcaacagatgtattcctcaattctggagatgcgatggtcaagttgactgtgataacggatcggatgaacagggctgtccaccaaagacttgctcccaagacgaatttcgctgccacgatggcaagtgcatttcaagacaatttgtctgtgactcggatagggactgtcttgacggtagcgatgaagcatcctgcccagtccttacttgcggtcccgcctcgtttcagtgtaattcgtcgacttgcattcctcagctttgggcatgtgataatgatcccgattgtgaagatggaagcgacgaatggccacaacgttgtaggggactctacgtctttcaaggtgatagctcaccgtgttccgcattcgaattccactgcctgtcgggagagtgtattcatagcagctggcgctgtgacggaggaccggattgtaaggataaatccgatgaggagaattgtgcagtggccacctgtcgcccagacgaatttcagtgttccgacggaaactgtattcatggatcccgacagtgtgacagggagtacgattgtaaagatatgtctgatgaagtcggatgcgtcaacgtcactctgtgcgagggacccaacaagttcaaatgccattcaggagaatgcatcaccctcgataaggtgtgtaacatggcccgtgattgtcgagactggagcgatgaacccatcaaagaatgtggaacgaacgaatgtcttgataacaacggtggttgttcccatgtctgcaacgagttgaaaataggttacgaatgtctctgtcccgacggattccaactcgtggcacagcgtagatgtgaagatattgacgagtgccaggatcctgacacttgctcgcaactctgtgtcaaccttgagggaggctataagtgtcagtgtgaagaaggttttcagctggatccgcatactaaggcatgcaaggccgtcggttcgattgcgtatctgttctttactaacaggcatgaagtgcgcaaaatgactcttgaccgatcagaatacacttcactcataccaaacttgagaaatgtggtggcactggacactgaggtcgcatccaataggatatactggtccgatctgtcccagcggatgatctgttcgacccagcttgatagagcgcatggcgtgtcgtcatacgacactgtgatttcccgggatatccaagcacctgacggtcttgcggtggattggatacactcgaacatatactggactgacagcgtgcttggaaccgtctccgtggctgacaccaagggagtgaagaggaaaactctttttcgtgaaaatggatctaagccgagggcaatcgtggtcgatcctgtgcatgggttcatgtactggaccgattgggggaccccggcaaagatcaagaagggcggactgaatggcgtggatatctactcgcttgtgacggaaaacatccaatggcccaacggaatcactctcgacctcttgagcgggcgattgtactgggtggattcgaaacttcactccatttcttcgatcgacgtcaacggcggaaatcgtaaaaccattctggaggatgaaaaacgacttgcacacccattttcgctggcggtctttgaagataaggtgttctggaccgacattatcaatgaggccatcttttcagcgaaccgactgaccggctcggatgtcaatctgttggcggaaaacctgctgtcgccagaagatatggtcctttttcataatctgacccaacctcggggagtgaattggtgtgagcgtactacgctctcgaacggtgggtgccagtacctgtgtctgcccgcaccccagataaacccccactcccctaagtttacttgtgcatgtcctgatggcatgctcctggcgagagacatgagaagctgcttgacggaggcagaggccgctgtggctacccaggaaacttccactgtcaggctgaaggtttcgtccaccgcagtccgtacccaacacacgaccactagacccgtgcccgatacctcacgccttcctggagccactccagggcttaccaccgtggaaattgtcaccatgagccatcaagcacttggggatgtggcaggtcgggggaacgaaaagaaaccgtcgtcggttcgcgccctttcgattgttctgcctatcgtgcttcttgtgttcctgtgcctcggcgtgtttttgctgtggaagaactggcgccttaagaacatcaactcaatcaactttgataatccagtctaccaaaaaactacggaggacgaagtgcacatttgtcataaccaggacggatactcatatccgtcccgccaaatggtttccctcgaggatgacgtggcc

SEQ ID NO: 15999 - DNA, 2580 bp, Artificial Sequence
  Description of Artificial Sequence: Synthetic coding sequence
atgggcccttggggttggaagctgcgctggaccgtggcactgctcctggccgctgccggcaccgcggtaggtgataggtgcgaaaggaacgaattccaatgtcaggatggtaaatgcatctcatacaaatgggtgtgtgatggctcagctgagtgccaggatggttcagacgagagccaagagacatgtctcagcgttacctgcaaatcaggagacttcagctgcgggggtcgtgtaaataggtgcatcccacagttttggaggtgcgatggacaggtggactgcgacaacggatctgatgaacaaggctgcccaccaaaaacctgttcacaggacgaatttcgctgccatgatggcaaatgcatcagccgtcagttcgtgtgcgattctgatcgggattgcttagacggctcagatgaggccagttgcccagtgctgacctgcggcccagcctcatttcaatgtaactcgtctacctgtattcctcagctgtgggcatgcgataacgacccagactgtgaggacgggtctgacgagtggcctcagagatgcagaggtctgtatgttttccagggcgactcttccccttgctctgcattcgagtttcactgtctgtcaggcgaatgcatccattcttcctggagatgtgacggtgggcctgactgcaaagacaaatctgacgaggagaactgtgcggtggctacctgtaggcccgacgaattccagtgcagcgatggcaattgtatccacggttccaggcagtgcgatcgggagtacgactgcaaggatatgagtgacgaggtaggatgcgtgaacgtcaccctgtgtgaaggtcccaataaatttaagtgccatagcggggaatgtataacccttgacaaagtctgcaatatggccagggattgccgcgactggagtgacgaacctattaaagagtgtggaacgaacgaatgtctggataataatgggggctgctctcacgtgtgtaatgaattgaagatcggatatgagtgtctctgccctgatggatttcagctggtcgcacagcgacgttgcgaagacattgatgagtgtcaggatccagacacttgttctcaactatgcgtgaacctagaaggagggtataaatgccaatgtgaggagggctttcaactcgaccctcacaccaaggcttgcaaggctgtgggcagcatcgcatatctgtttttcacaaatcggcacgaggtgcggaagatgacattagacagatcggaatatacgtcccttatccccaacctcaggaacgtggtagccctggatacggaagtcgcctctaacaggatatattggagcgatctctctcaaaggatgatctgcagcactcagctggaccgggcacacggggtttcttcctacgacactgtcatctcccgagatattcaggcccctgatgggctggctgtggactggatccacagcaacatctattggactgattcagtgttaggcaccgtgagcgttgcggataccaaaggcgttaaaaggaagaccttatttcgggagaatgggagcaaaccaagagccatcgtcgtggacccagtccacggttttatgtactggactgactggggcacgccagctaaaatcaagaagggcggactgaacggcgtcgacatttactcactagttacagagaatatccagtggcccaatggcatcacgctcgacctcctttcaggcaggctgtactgggttgatagtaagcttcacagcatcagcagcatcgacgtaaatggaggcaataggaaaacgatcctcgaggatgaaaaacgactagctcacccatttagtttagccgtgtttgaagataaagtgttctggactgatattattaatgaagccattttctcagctaaccgcctgactgggtctgatgtaaacttactggcagagaatttattgagccctgaggatatggtgctgttccataatcttactcagccacggggagttaactggtgtgaacgcaccaccttgagcaacggaggatgccagtacctatgcctcccagcaccacagattaacccacactcaccgaagttcacttgtgcatgccccgatgggatgctcttggccagagacatgcggtcgtgtttaaccgaagcagaagccgccgttgccacccaagaaactagtacagttagactaaaagtaagctcaaccgccgtgcgcacacaacataccactacccgtcccgtgccggatacctcccgcctgcctggcgctactcctggactgactaccgtcgagattgtcaccatgtctcaccaagccctgggcgatgttgcaggcagaggaaatgagaaaaaaccatccagcgttcgtgcactatccattgtcctgccaatagtcctgctggtgtttctctgtctcggcgtcttcctattatggaaaaattggaggttaaaaaatatcaatagtatcaactttgataaccctgtctatcagaagacgactgaggatgaggtgcatatttgtcataaccaggacggatatagttacccttctagacagatggtgagtcttgaagacgatgtagct

SEQ ID NO: 16000 - DNA, 2580 bp, Artificial Sequence
  Description of Artificial Sequence: Synthetic coding sequence
atgggcccgtggggatggaagctgcgctggaccgtggcgctgctcctggccgccgcaggcactgccgtgggggacaggtgcgaacggaatgaatttcagtgccaagatggtaagtgcatcagctacaagtgggtgtgcgatggttcggccgagtgtcaggatggctcggacgaaagccaggaaacctgcttgagtgtcacttgcaaatcaggcgacttttcgtgcggaggcagggtgaatagatgtatcccacagttttggcgctgtgatggccaggtggactgcgacaacgggtcggacgagcaaggctgccctcctaagacttgcagccaggacgaattcagatgccatgatggaaagtgtatctcgcggcagtttgtgtgcgattcggatagagattgcctggacggatcggacgaagcatcctgcccggtgctgacctgcggacccgcctccttccagtgtaacagctcaacctgcatccctcagctgtgggcctgtgacaatgatccggattgtgaggacggatcagacgagtggccgcagagatgccgcggcttgtacgtgttccaaggagactcctcgccgtgctcagccttcgaattccactgcctcagcggagaatgcatccattcgtcgtggcggtgcgatggcggaccagactgcaaagacaagagcgatgaagagaactgcgccgtggcaacctgtcgtccggatgaattccaatgctccgatggaaattgcatccatgggtcgcgccagtgcgaccgcgaatatgactgtaaagacatgagcgatgaggtgggctgcgtgaatgtgaccctgtgcgagggcccaaataagttcaagtgccactccggtgagtgcatcaccctggacaaggtttgcaatatggcacgggactgccgggattggtcggatgagccgattaaggaatgcggcaccaacgaatgcttggacaacaacggaggctgttcgcatgtgtgtaatgagctgaagatcggatacgagtgcctgtgtcctgatggattccagctggttgcccaacggcggtgcgaggacatcgacgagtgccaagatccagacacctgctcccagctgtgtgtgaatctggaaggtgggtacaagtgccagtgtgaggaagggttccaactggacccgcacactaaggcctgcaaggcggtgggttccattgcgtacctgttcttcaccaaccggcacgaggtccggaagatgaccctcgatcggtccgagtacacttcactgatccccaatctgcgtaacgtggtggcgctcgacaccgaagtcgcatcgaaccgcatatactggagtgacctgagccaaaggatgatctgctctacccagctcgatcgggctcacggtgtctcgtcctacgatactgtgatctcccgcgacatccaggccccggatggcttggcggttgactggatccattcaaatatctactggactgacagcgtgctgggcactgtcagcgtggcggatacgaagggcgtgaagcggaaaaccctgttccgcgaaaacggcagcaagccaagggccatagtggtggatccggtccacggattcatgtattggaccgattggggaaccccagccaaaatcaagaaaggaggcctcaacggagtggatatctacagcctggtcactgagaacatccagtggccgaacggaatcaccctggatctcctgagcgggcgcctctactgggtcgactcgaaactccactcaatctcgtccatcgacgtcaacggcgggaatcgaaaaactatcctggaggacgaaaagcggctcgcacacccgttctcgcttgctgtgttcgaagataaggtgttctggaccgacattatcaacgaagcgatcttttccgcgaaccgcctgactggtagtgacgtcaacctgttggccgagaatctgttgtcaccggaggacatggtgctgttccataacctgacgcaaccgaggggagtcaactggtgtgagcggaccaccctgtctaacgggggttgccagtacctctgtctgccggcgccacaaatcaacccccattcgcccaagttcacctgcgcctgcccagacggaatgctgttggcacgggacatgcggtcctgtctgaccgaagccgaagctgccgtggcgactcaagaaacgtcaaccgtgagactcaaggttagctcgactgccgtgagaacccagcataccactactaggccggtcccggacaccagccggctgcccggggccaccccgggactcaccaccgtggagatcgtcactatgtcacatcaggcactcggtgacgtcgcaggaagagggaatgagaaaaagccgagctccgtgcgggccctgtcaatcgtgctgccgatcgtgcttctggtgtttctttgtctcggagtgttcctcctttggaagaactggcgcctgaagaacattaactcgatcaacttcgataacccagtgtaccagaaaaccacggaggacgaagtgcatatctgtcacaatcaggatggttactcctacccttccagacagatggtatccctggaggatgacgtggca

SEQ ID NO: 16001 - DNA, 2580 bp, Artificial Sequence
  Description of Artificial Sequence: Synthetic coding sequence
atgggaccttggggctggaaactccggtggactgttgccttgctactcgccgcagctgggactgccgtcggggatcgatgcgagaggaatgagtttcagtgtcaggacggcaaatgtatctcatacaaatgggtgtgcgatggcagcgccgagtgccaggacggcagcgacgagagccaggaaacctgcttatccgtaacttgcaaatcgggcgatttctcttgtggcggccgagtcaatcgatgtattccacagttctggcgatgcgatggacaagtagactgcgacaatgggtccgatgagcaaggatgtccccccaagacctgcagtcaagatgagttccggtgccatgacgggaagtgtatctcccgccagttcgtgtgtgattctgacagagattgcctggatggttccgatgaggcctcctgcccggtgctgacatgcgggcctgcttctttccagtgcaatagctccacgtgcataccgcaactttgggcatgtgataatgatcccgactgcgaggatgggtccgatgagtggccacagcgctgcagaggcttgtatgtttttcagggggactcctcaccctgctccgcctttgaattccactgcctctcaggcgagtgcattcactccagttggaggtgcgacggcgggcctgactgcaaagacaaatctgacgaagagaattgcgccgtggccacatgccgtcccgatgaatttcaatgtagtgatggcaattgcatccacggcagccgccagtgtgatcgggaatacgattgcaaagacatgtccgacgaagtggggtgcgtgaatgttaccctgtgcgaaggtcctaacaaatttaagtgtcactctggggagtgtattacgctcgataaggtctgtaacatggctcgggactgtagggactggtcggatgagccaatcaaggagtgcggcacaaatgaatgtctcgataacaatggagggtgtagtcatgtgtgcaacgagttgaaaatcggctacgagtgtctctgccccgatggattccagctggtggcacaaagaaggtgtgaggacatagatgagtgtcaggaccctgacacctgctcacagctttgtgtaaacctggaaggaggatataagtgtcagtgcgaggaggggttccagcttgaccctcataccaaggcgtgcaaggctgttggcagcatagcatacctgttttttacaaaccggcacgaggtccggaaaatgaccttagacagatctgaatacacatcactcataccgaacctgcggaatgtagtggccctagatacagaagtggcatccaaccgcatctactggtccgacttgtctcagcgcatgatctgtagcacccaactagaccgagctcatggcgtctcatcctatgatacagtcatctctcgagacatacaggctcctgacggtttggcagtggactggatacattccaatatatactggaccgattccgtattgggcaccgttagtgtagctgatacaaagggagtgaaacgcaaaaccctgttccgcgagaacgggagcaaaccgagagccatcgtcgtcgaccccgtccacgggttcatgtattggacggactggggaacacctgcaaagataaagaaggggggtctgaacggcgttgacatctacagtttggtgacagagaatatccagtggccaaatgggattaccttggatctgctgtcgggacgactctactgggtcgactctaaactccatagcatttcctccatcgacgtgaatggcggcaaccgtaagacaattctggaggacgaaaagaggctggcacacccattctcccttgccgtgttcgaggataaagttttttggaccgacatcatcaatgaggcaatcttctctgctaacaggctcaccggatccgacgtcaaccttttggccgaaaatctcttgtcacccgaagacatggttttgtttcacaacctgactcaacccaggggcgtgaattggtgtgaaaggactactctgtccaatggaggctgccaatatctctgcctgcccgcccctcaaattaatccccactcgcctaagtttacctgcgcctgcccggatggtatgctgctagctagggatatgcgttcctgcctaacagaggccgaagccgccgttgctacccaggaaaccagcactgtgcgactgaaagtgtcttccactgccgttcgcactcagcatacaactactcgacccgtccccgacaccagcagactcccaggcgcaacgcctggtttaacaaccgtggaaatcgtgaccatgtcacatcaggcacttggtgacgtcgctggtcgggggaacgaaaagaagcctagctctgtgcgcgctctgagcattgttctgcccattgttctgctggtttttctgtgtcttggagttttcctcctatggaagaactggcgattgaaaaacataaattccatcaactttgacaacccagtgtatcagaagacgacggaggacgaggtccatatttgtcacaaccaggatggctattcatacccttccaggcagatggtgtcactggaggacgatgtggcc

SEQ ID NO: 16002 - DNA, 2580 bp, Artificial Sequence
  Description of Artificial Sequence: Synthetic coding sequence
atgggcccatgggggtggaagctcaggtggacggttgctctgctgcttgctgccgcgggtacagcagtcggcgataggtgcgaaaggaacgaatttcagtgccaggacggcaaatgtatctcatacaaatgggtttgcgacgggagcgcggagtgccaagatggctctgatgaatctcaggagacttgcttgtccgtcacatgcaagagtggagactttagctgcggcggccgggtcaacagatgtataccccaattttggaggtgcgatggacaggtggactgcgataacggctcagacgagcagggatgccctccaaagacttgttcacaagatgagtttcgctgccacgacggtaagtgcatctcccgccagttcgtgtgcgactccgatcgggactgcctagacggcagcgacgaggcttcctgtcctgtgctcacctgcggacctgccagtttccagtgcaactctagcacttgtattccacagctttgggcctgtgataacgatccagattgtgaggatggcagcgacgaatggccacaacggtgtcgcggactttacgtgttccagggggactcttctccctgttccgcatttgaatttcactgcctaagcggagaatgcatccattcctcctggagatgcgatggtggccctgactgcaaggacaagtcagacgaggagaactgtgccgtcgcaacctgtcgccccgatgagtttcagtgctccgatggtaactgcattcacggatcaaggcagtgtgaccgtgagtatgattgtaaggacatgagtgatgaggtcggctgtgtcaatgttacactgtgcgaaggtcccaataagtttaagtgccatagcggggagtgcatcactttagacaaggtctgtaatatggcacgtgactgcagggattggtccgacgagcccatcaaggagtgcggtaccaatgagtgcttagataataacggtggatgttcccatgtgtgcaatgaactgaaaattgggtatgagtgtctatgtcctgatggatttcagctagtggcgcagcgccgttgcgaagatattgacgaatgccaggaccccgatacatgtagtcagctgtgtgtgaaccttgaaggtggctacaagtgtcagtgcgaggagggttttcagctagatccacacacaaaagcatgcaaggccgtgggaagcattgcctatctgttttttaccaaccggcatgaagttcggaagatgactttggaccgctccgagtacacgtcactgataccgaacctgcgaaacgtcgtagctctggataccgaggtagctagcaaccgcatctactggtcagatctctcccagcgcatgatctgcagcacgcagctggaccgtgctcacggcgtctcttcctacgacacagtgatttctagagacatacaagctccagatggcctggctgtggattggatacacagcaatatctactggacagactcggtgctagggacagtctcagtggcggataccaagggagtgaagaggaagacattgttccgagaaaatggctcaaaaccgagagcaattgtagtggatcccgttcacgggtttatgtattggacggactggggcaccccggccaagataaagaagggaggcctgaatggagttgatatttactctttagtgactgagaacattcagtggcccaacggaattaccctggatctccttagtgggcgcctgtactgggtggactccaagctgcacagcatctcgagcattgacgtgaacggcggcaatcggaagactattcttgaagatgaaaagagattggcacaccctttctcccttgcagtctttgaggacaaggtgttttggacagatatcatcaacgaggcaattttttcagcgaaccggcttacggggtctgatgtaaacttactggccgagaatctgctgtcaccagaagatatggtgcttttccataaccttacgcagccccgtggtgtaaattggtgcgaaagaactactctgtctaatgggggctgccagtatctttgccttccagctccccagatcaatccccatagtcccaagttcacttgtgcttgcccggatgggatgctccttgctagggacatgaggagctgtctgaccgaggccgaagcggcggtggctacccaggagaccagtactgtgcggttgaaagtcagctccaccgctgtgcggacgcagcacacgacgacaagaccagtcccagacacatcacgcctgcccggagctacgccggggttaaccactgttgaaatcgtaacaatgagccatcaagccctcggcgacgtcgctggacgcggcaacgaaaaaaaaccctccagtgtcagggcactatctatcgtactgcccattgttctccttgttttcctctgccttggagtgttcctgctttggaagaattggcgtcttaagaatataaatagcatcaacttcgataaccccgtttaccagaagacaaccgaggacgaggtccacatctgtcataatcaggacgggtactcttacccgtcccgccagatggtcagcctggaggatgatgtggcc

SEQ ID NO: 16003 - DNA, 2580 bp, Artificial Sequence
  Description of Artificial Sequence: Synthetic coding sequence
atgggaccttggggctggaagttgcgttggaccgtggccttgctgctggcggctgccggaactgctgttggggacagatgtgaacggaatgaattccagtgccaggacggaaagtgcataagctataagtgggtgtgcgatgggtctgccgaatgccaggatgggtctgatgaatcacaggagacttgtctctcagtaacatgtaagagcggcgatttcagctgcggcggcagggtgaaccggtgtatacctcagttctggcggtgcgacgggcaggtggattgtgataatggttctgacgagcagggttgcccccctaaaacatgtagtcaggacgaatttaggtgccatgatggcaaatgcatctcaaggcagtttgtttgtgacagcgatagagactgcttggatggctctgacgaggcatcatgcccagttttgacatgcggcccggcatctttccagtgcaacagcagtacctgcattccacagctgtgggcctgtgacaatgatccggattgtgaggacggctccgacgagtggcctcagaggtgtcgcggtctctatgtctttcagggcgattcctcaccctgcagcgcttttgagtttcactgcctctcaggagaatgcattcattcttcctggcggtgtgacggtgggcccgactgtaaggataaaagcgatgaggagaactgcgctgtggcaacatgccgtccagatgagtttcaatgctctgatggcaactgtatccacggttccagacagtgtgaccgggagtatgactgtaaggatatgtccgacgaagtggggtgcgtgaacgtgaccctttgcgaaggtcctaataagttcaagtgtcatagtggtgagtgtattactctggacaaggtgtgtaacatggcccgtgactgccgcgattggtccgacgaacccatcaaggaatgcggcactaacgaatgcctagacaacaatggtggatgttcacacgtgtgcaatgagctcaaaatagggtatgaatgcctatgtcctgatggttttcagctggtggcccaacggaggtgcgaagatattgatgagtgtcaggacccagatacgtgctctcagctgtgtgtgaacctcgaggggggctacaaatgtcagtgtgaggagggatttcaactggatccgcatactaaggcctgcaaagctgttgggtccatcgcttacttgttctttaccaaccggcacgaggttcggaagatgactctggaccgatctgaatatacaagtctgatcccaaacctccgaaacgtcgtggccctggatacggaagtcgcctcaaacagaatttactggtcggatctctcccagaggatgatctgctccacgcagttggatagggcacatggagtgagttcgtatgacacagtgatctctcgggacatccaggctcccgatggcttggcagttgactggatccatagcaatatatactggactgattctgttctgggcactgtgagtgtcgccgatactaagggggtgaaacgaaaaactctctttcgggagaacggaagcaaacctcgggcaattgttgtggatcctgtgcatggatttatgtactggaccgactgggggacaccagcgaagatcaagaagggcggtttaaatggggttgatatttatagccttgtaaccgagaatatccagtggcctaatggtattacgctggacctgctctcgggtcgtctgtactgggtcgattctaaattgcacagcattagcagcattgacgttaatgggggtaacaggaagactattctggaggatgagaagaggttggcgcatccgtttagtttggcagtcttcgaggataaagtattttggaccgacataataaacgaggcaatttttagtgcaaaccgattgactggatccgatgtcaacctgttggccgagaacctcctgagtcccgaggatatggtgttattccataacctgacacagcctaggggcgtcaattggtgtgagagaacaaccttaagcaacggaggctgccagtacctttgtttgcccgcaccccaaattaatccacactcaccgaagttcacatgcgcctgtcctgatggtatgctactagctcgagatatgcgcagttgcctgactgaagctgaggctgcggtggctactcaggaaacttccactgtaaggctgaaggtgtcgtcaacagcggtccgaacacagcacaccacaacccgacctgtccccgacacatcacgactgcccggcgcaacacctgggctgactactgtcgagatcgtgactatgtcccaccaggccttgggggatgtggcgggccgtggaaatgaaaaaaagcctagcagtgtaagggccctctctatcgtgctccccattgtcttgctcgtcttcttatgcttgggagtgtttctcctttggaagaattggcgactgaaaaacatcaatagcatcaacttcgataaccccgtgtaccagaaaacaacagaagacgaggtgcatatttgtcataaccaggacggttactcctatccatctcggcagatggtgtcactcgaagatgacgtcgct

SEQ ID NO: 16004 - DNA, 2580 bp, Artificial Sequence
  Description of Artificial Sequence: Synthetic coding sequence
atgggaccctggggatggaagttgagatggactgtggcacttctcctggcagccgccggtaccgcagtgggagatcggtgtgaaaggaacgaattccagtgtcaagatggaaagtgtatctcctataagtgggtgtgtgatggttccgcagaatgtcaggacggatcggatgagtcccaggaaacttgcctgtcggtgacttgcaaatcgggagacttctcgtgtggaggtcgcgtcaacagatgtattcctcaattttggagatgcgatggccaagtggattgtgacaacgggagcgatgagcaaggttgtccccctaagacttgctcccaagatgaatttcgatgtcatgatggaaaatgtatttcccgtcagtttgtgtgcgattcggaccgcgactgcctcgatggcagcgacgaggcgtcctgtccagtgttgacctgcggtcctgcatcgtttcagtgtaattccagcacctgtattccccaactctgggcatgtgacaacgaccctgattgtgaggacggttcggatgaatggcctcagagatgtcgcggcctttacgtctttcagggagactcctcaccttgttcggctttcgaatttcattgcctgtcgggcgaatgtattcactcgtcgtggcgttgtgacggcggacccgattgtaaggacaagtcggacgaggaaaactgtgcggtcgcaacctgccgcccagatgaatttcaatgttcggacggtaattgcattcatggaagccgtcagtgcgaccgtgaatacgactgcaaggatatgtcagatgaagtgggatgcgtcaatgttaccctgtgcgagggccccaacaagttcaagtgtcattccggagaatgtattactctcgataaggtttgtaacatggcccgcgactgtcgggactggagcgatgaacctatcaaggagtgtggtactaacgaatgccttgataacaatggcggttgttcccatgtttgtaatgaacttaagattggatacgagtgtctttgtcccgatggatttcaactggtcgcacagaggcgttgcgaggacattgatgaatgtcaagacccagacacttgctcgcaactctgtgtcaaccttgaaggagggtacaagtgtcagtgtgaagaaggttttcagctcgacccacataccaaggcatgtaaggcggttggatcgattgcgtacctgttctttactaaccgtcatgaagtgaggaaaatgactttggatagatcggaatacacctcgctgattcccaacctccgcaacgtggttgccctcgataccgaggtggcaagcaacagaatctactggtcggatctgtcccaacgtatgatctgctccactcagctcgatagagcacatggtgtctcatcctacgataccgtgatttcccgggacattcaagcacccgatggcttggcggtcgattggatccatagcaacatttactggactgattccgtgcttggaaccgtgtcagtggcagataccaagggcgtgaagcgtaaaaccctctttagagaaaatggttcaaaaccaagggccattgtagtggatccggtccatggatttatgtactggaccgattggggaaccccagcaaagatcaagaagggtggcctcaatggagtggacatctactctctggtcaccgagaatattcagtggcccaacggtatcactctggatctgctgtccggtaggctctactgggttgactccaagctgcactccatttccagcatcgatgtgaacggcggaaaccggaaaactattctcgaggacgagaagagactcgcgcatcctttcagcctggcagtgtttgaggataaggtgttttggaccgacatcataaacgaggccattttctcggcgaatagacttaccgggtccgacgtgaatctgcttgccgagaacctgctttcacctgaagatatggtgttgtttcataaccttacccaaccgagaggggtcaattggtgtgagcggaccaccctgtcgaatggaggctgtcaatacctgtgccttcctgcgcctcagatcaacccgcactcccccaagttcacctgcgcctgtcccgatggtatgctgctggcaagggatatgagatcctgccttaccgaggcagaagctgcagtggctactcaggaaacttcaacggtgcgccttaaggtgagctcgacggcagtccggactcaacatactaccaccagacctgtccctgatacttcgcgccttccaggagcaacgccagggctcactactgtggaaatcgtgaccatgagccatcaggcactgggagatgtcgccggtcgtggtaatgagaagaagccttcgagcgtcagggcactctcgatagtgcttcctatagtgctgctcgtgtttctgtgtctcggggtctttctgctttggaagaactggcgactgaagaatatcaactccatcaactttgataaccctgtctaccagaaaactactgaagatgaagtgcatatttgccataatcaggacggctactcttacccatcgagacaaatggtgtcactcgaggacgacgtcgca

SEQ ID NO: 16005 - DNA, 2580 bp, Artificial Sequence
  Description of Artificial Sequence: Synthetic coding sequence
atgggcccatggggttggaagttgagatggaccgtggcactgcttctggcggctgcggggactgcagtgggggaccggtgtgagaggaacgaattccagtgccaggatggaaagtgtatcagctacaaatgggtgtgtgacggttcagcagaatgtcaagatggttcggacgagtcccaggaaacctgcctgtccgtcacttgtaagtcgggcgacttttcgtgcggcggaagggtgaacagatgtataccacaattttggcgctgcgacggacaagtggactgtgataacggaagcgatgaacagggctgtccccccaagacttgctcgcaagacgaatttaggtgtcacgacggcaagtgtattagcagacaatttgtgtgtgattcggatcgtgattgtcttgatggctcagacgaagcatcctgccctgtgcttacctgtggcccggcctcgttccagtgtaattcatccacctgtattccccaactttgggcttgcgataacgacccggattgcgaagatggctcagatgagtggcctcagaggtgtcgggggctgtacgtgtttcagggtgactcatccccatgctcggcatttgaattccattgtttgtcaggggaatgcatccactcctcatggcgctgtgatggagggccagactgtaaggataaatccgatgaggaaaattgcgcagtcgcaacctgccgacctgatgaatttcaatgttcagacggtaactgtattcacggatctcgccaatgtgatagagaatacgattgtaaggacatgtccgatgaagtgggatgcgtgaacgtgactctctgtgaaggaccaaataagtttaagtgccactctggagaatgcattactctggacaaggtgtgtaatatggcaagagattgtcgggattggtcggacgagcctataaaggaatgtggaactaatgagtgtctggataacaacggtggatgttctcatgtgtgtaacgagctgaaaataggatacgaatgcctttgtcctgacggttttcaactcgtcgcacagagacggtgtgaagatattgacgaatgccaagatccagatacttgtagccaactttgtgttaaccttgaagggggctacaagtgtcaatgtgaagaaggctttcaactcgatcctcacactaaggcatgtaaagcagtcggcagcatagcctatcttttctttactaataggcacgaggtccgaaagatgacccttgaccgctccgaatacacttcgctgataccaaacttgcggaacgtggtggcactggataccgaagtggcatcgaaccgaatatactggtcggatctctcccaacgtatgatttgctcaactcaactggatagagcacatggggtttcttcctacgataccgtgatcagcagggatattcaagctcctgacggactcgcggtcgattggattcattcaaacatctactggaccgactccgtccttggtactgtgtcggtggcggatacgaagggcgtgaagagaaagaccctgttccgggaaaatggtagcaagccaagagcaattgtggtggatccggtgcatggttttatgtactggactgactggggcactccagcaaaaatcaagaagggtggcctcaacggagtggacatctacagcctggtgactgagaatattcaatggccaaacgggatcactctggatcttctctcgggaagattgtattgggtggattcaaaactccacagcatctcgtctatcgacgtgaacggaggaaaccgtaagactatccttgaggatgaaaaacgtcttgcccatcctttttccctcgctgtgtttgaggacaaggtgttctggaccgatatcattaacgaggcaatcttttcggccaatcgacttaccggttcggatgtgaacctcctggcagaaaatctgctttcacccgaggacatggtcctgtttcacaacctcactcagcctcggggagtgaactggtgtgaacgcaccactcttagcaacggaggttgccagtacctctgcctgcccgccccccagattaatcctcacagcccaaagttcacctgcgcatgccccgacggaatgcttcttgcacgcgacatgcgctcctgtctgactgaagcagaggcagccgtggcaactcaggaaacttccactgtgcgtcttaaagtgagctcgaccgccgtgaggactcaacataccaccaccagaccagtccctgacacgtccaggcttcctggggccactcctggtcttacgaccgtggaaattgtaacgatgtcccaccaagccctgggagacgtggcggggcgaggcaacgaaaagaaaccctcctcggtgcgcgcactttcaatcgtcctgcctatagtgcttctggtgtttctgtgtctgggagtgtttctcctctggaagaactggagactcaagaatatcaatagcataaacttcgacaatcctgtctaccaaaagaccactgaggatgaagtccacatctgtcataatcaggacggctactcttatccttcgcggcaaatggtatccctcgaggacgatgtcgcc

SEQ ID NO: 16006 - DNA, 2580 bp, Artificial Sequence
  Description of Artificial Sequence: Synthetic coding sequence
atgggtccatggggctggaaactgagatggaccgtcgctcttctgttggcggcggcaggtaccgccgtcggtgaccgctgtgaacgcaacgagttccagtgtcaagatggtaaatgtatttcatacaaatgggtgtgtgatggttccgcagagtgtcaggacggatcagacgaaagccaggaaacttgcctgtcagtcacctgtaaatccggggacttctcctgcggtggacgcgttaaccgctgcattcctcagttctggcgctgtgatggacaagtcgattgcgacaacggctcggatgagcagggttgcccaccaaagacttgctcgcaagatgaattccgatgccatgacggaaagtgcattagccggcaattcgtctgtgattccgatcgcgattgccttgatggaagtgatgaggcatcctgtcccgtattgacctgcggtcctgccagcttccaatgcaacagctccacctgtattcctcaactttgggcttgcgacaatgacccagattgtgaagatggatcagatgagtggcctcaaagatgccgaggactttatgttttccagggggattcctccccttgttcagctttcgaatttcactgcctttcgggtgagtgtattcattcgtcctggagatgtgacgggggtccagactgtaaggacaagtcagatgaggaaaactgtgccgtggcgacctgtagacctgacgaattccaatgcagcgacggaaattgtattcatggatcgaggcagtgtgatcgcgaatacgattgtaaggatatgtcggacgaggtcggatgtgtcaacgtcactctttgcgaaggcccaaacaagtttaagtgtcacagcggagaatgcataacccttgacaaagtgtgtaacatggctagagactgcagggactggtcggacgagccaatcaaagagtgcggtaccaatgagtgcctcgacaacaacggaggttgtagccacgtctgtaatgaacttaagattggatacgaatgtctgtgtccagacggattccaactcgtggcacagagacgatgcgaagatattgatgagtgccaagatcccgacacttgttcccaactgtgtgtgaatctggaagggggctacaagtgtcaatgcgaagaaggatttcaacttgaccctcatacgaaggcatgtaaggcagtgggatccattgcatacctgtttttcaccaatcgccacgaggtgaggaagatgactcttgatcgtagcgaatacactagcctgattcccaatcttcgcaatgtggtggcactcgataccgaagtcgcatccaacaggatctattggtcggacctctcacaacgcatgatttgttcaacccagctggatagagcccatggtgtgtcctcgtacgataccgtgataagccgcgacatccaagcaccggatggcctggccgtggactggattcattccaatatctactggacggactcagtcctcgggactgtctcggttgcggacaccaagggtgtgaagcgcaagaccctgtttcgggaaaacgggagcaagcctagagcgatcgttgtggaccctgtgcatggtttcatgtactggaccgattggggaactccagctaaaatcaagaaaggaggccttaacggagtggacatctactcacttgtgacggaaaacattcaatggccaaatggaattactcttgatcttctttcaggtcgtctgtactgggtggattcaaaactccattccatttccagcatagatgtgaatggaggaaacagaaagactattctggaggatgagaaacggctcgcccatccttttagcctggcggtttttgaggataaagtgttttggacggacattatcaacgaggcaattttcagcgcaaataggcttaccggttccgatgtgaaccttctcgcagaaaacctgctttcacctgaggacatggtcctgttccataatcttacccaacctaggggcgtgaactggtgtgaacgtactactctgtcgaacgggggttgtcaatacctgtgtttgccagcgccgcagattaatccccattcgcctaagttcacgtgtgcatgtccagacggcatgctgctggccagggatatgagatcgtgcctcacggaagcagaagcagccgtcgcaacccaggaaactagcaccgtgcggctcaaggtgtcctcgaccgcagtgcgcacccagcatacgactactcgcccagtccccgatactagcagacttcccggggcaaccccgggactgactaccgtggaaattgtgactatgtcccatcaggcactgggagatgtggcaggaagaggcaatgagaagaagccttcgtcagtgcgagccctctcgattgtgctgcctattgtgcttctggtgttcctgtgccttggagtgtttcttctctggaaaaactggcggctgaagaacatcaatagcatcaactttgataaccctgtctaccagaaaaccaccgaagatgaagtccatatttgtcataatcaggacggatattcgtaccctagccggcaaatggtgagccttgaagatgatgtggcg

SEQ ID NO: 16007 - DNA, 2580 bp, Artificial Sequence
  Description of Artificial Sequence: Synthetic coding sequence
atgggtccttgggggtggaagctccgttggaccgtcgcactgctccttgcagctgcaggtaccgcagtcggtgacaggtgcgaacgcaacgagttccagtgtcaagatggaaagtgcattagttacaaatgggtgtgtgatggctcagcagaatgtcaggacggttccgatgaaagccaggaaacttgcctctcggtcacctgtaagtctggagatttttcgtgtggcggcagagttaaccgatgtatcccacaattctggcggtgcgatggccaagtcgattgtgacaatggttcggatgaacaaggatgtcctccaaagacctgttcgcaagatgaatttcgatgccacgatggtaagtgcatttccaggcaatttgtgtgcgattcggatcgagattgtttggacggatcggacgaggcatcgtgccctgtgcttacttgtggccccgcatcgtttcaatgtaactcctccacttgcattccccagctttgggcatgtgataacgatccagactgtgaagatggctcagatgagtggccacagcgctgcaggggactgtacgttttccagggcgattcctcgccgtgttcggcatttgaatttcattgcctgtccggtgaatgcatacatagctcgtggcggtgcgacggtggtcctgactgtaaggataagtcagatgaggagaattgcgcagtggccacttgtaggccggatgaattccaatgctcagatggtaactgtattcacggctcgcgccaatgtgaccgagaatacgattgtaaggatatgtcagatgaagtgggctgtgtcaatgtcactctgtgtgagggacctaacaaattcaaatgtcactccggagaatgtattactcttgataaggtgtgtaacatggcaagggactgccgcgattggtcggatgagcccataaaagaatgtggtactaacgaatgtctggataacaacggaggttgttcacatgtgtgtaatgagctgaagatcggatacgaatgcctttgcccagatggctttcagctggtcgcgcagcgcagatgcgaagatatcgacgagtgtcaagatccagacacgtgttcgcaactgtgtgtgaatctggagggaggatacaagtgtcaatgtgaagaaggtttccagttggatcctcatactaaggcatgtaaggcagttggctccattgcctacctcttctttacgaataggcatgaggtccgcaagatgaccctcgatagaagcgaatacactagccttattcctaacctgcgcaatgtggtcgcccttgatactgaagtggcatcaaatcggatttactggtccgatctgtcacaacgaatgatttgctcgacccagcttgacagagcccatggtgtctcctcgtacgataccgtcatttcacgggatatacaggcaccagacggcctggcggtggactggatccactcgaatatctactggactgactccgtcctgggaaccgtgtcagtggcagacactaagggcgtgaagagaaaaaccctgttccgcgaaaacggatcaaaaccccgggcaattgtggtggaccctgtccacggatttatgtactggactgattggggaacgcccgcaaaaatcaagaagggtggactcaatggagtggacatctattcactggtgactgaaaacattcagtggcccaatggtataactttggatctgctgtcggggcgcctctactgggtggacagcaaacttcattcgattagctcgattgatgtcaacggagggaatcgaaagaccatccttgaagatgaaaaacgacttgcccatccattttcgcttgcggtgtttgaagataaggtcttttggaccgatatcattaacgaagcaatcttctcagcaaatagacttaccggtagcgatgtcaacctccttgcagagaacctcctgagcccagaggatatggtgctgttccataacttgacccagcctagaggagtgaactggtgtgaacgcactactttgtcaaacggaggctgccagtacctttgtttgcctgcaccccaaatcaatccccattctcccaaattcacctgcgcatgtccagacggaatgctgttggcccgagacatgcgctcctgtctgaccgaagcagaagcggcggtggctactcaagaaacctccactgtccggttgaaggtgtcctcaaccgccgtgcgtacccagcacaccactactcgccctgtgcccgacacctcccggcttccaggcgcgacgcccggactcacgaccgtggagatcgtgaccatgtcccatcaagcactgggtgatgttgctggcagaggaaatgagaagaagccctcaagcgtcagagccctgtccatagtcctccccattgtgctgcttgtgttcctgtgtctcggggtgtttcttctttggaagaactggaggcttaagaacattaactccattaactttgacaaccccgtgtaccaaaaaaccaccgaagatgaggtgcacatttgtcacaatcaggatggatactcctacccctctaggcaaatggtgtcacttgaagatgatgtggcc

SEQ ID NO: 16008 - DNA, 2580 bp, Artificial Sequence
  Description of Artificial Sequence: Synthetic coding sequence
atggggccttggggctggaaactccgttggacagttgcactgctactagccgcagctgggaccgctgttggggacaggtgcgagagaaatgagtttcagtgccaggatggcaagtgcatcagttacaagtgggtgtgcgatgggagcgccgaatgccaggacggaagcgatgaatcccaagagacctgtctgtccgtaacctgtaagagtggagacttctcctgtggcggccgtgtgaaccggtgtataccacagttctggcggtgtgacggccaggtggactgcgataatggcagcgacgagcagggctgccctccaaagacctgctcccaggatgaattccggtgccacgacggtaagtgcatatcacggcagttcgtttgcgattccgaccgcgattgtcttgatgggtcagatgaagcctcttgtcctgtattgacctgtggcccagcttctttccagtgtaattccagtacatgtattcctcaactgtgggcatgcgacaatgatccagactgcgaggacggatccgatgagtggccacagaggtgtagaggcctgtacgtgtttcagggggattccagtccatgctccgcctttgagtttcactgcctgagcggcgaatgcatccacagctcttggcggtgcgacggcggcccagactgtaaggataagagtgacgaggaaaactgcgccgtggcaacatgtagacccgatgaattccagtgtagcgacggcaactgcatacatggctcaaggcaatgtgatcgggagtacgactgcaaagacatgagcgacgaggtcggctgcgtcaatgttacactatgcgagggaccaaacaagtttaagtgccacagtggagaatgtataaccctggacaaagtttgcaatatggctcgtgactgcagagattggagcgacgaacctattaaagaatgtggtactaacgagtgcctagacaacaacggcggctgcagccacgtttgcaatgagctaaaaataggttatgagtgcctatgtcccgacggcttccagctcgtggcacagcggcggtgtgaggatattgatgagtgccaggaccctgacacttgctcccagctatgtgtgaatctcgaaggtggttataagtgccagtgtgaagaggggttccagttagacccacatactaaggcctgcaaggctgtgggatctattgcctatctcttttttaccaaccggcatgaggtgaggaaaatgacactggaccggtctgaatacaccagtctgatacccaacctacggaatgtagttgcactcgacactgaagttgcctctaatcgaatctactggagtgatctgtcacaacggatgatatgcagcacacagctggatagggcccacggcgtatcttcttatgataccgttatctcacgcgacattcaggccccagatggacttgctgtcgactggattcactccaacatctactggaccgattctgtgctggggactgtttccgtggcagataccaagggcgtgaagagaaagactctattcagggagaacggatctaagccacgggctatcgttgttgaccccgtgcacggctttatgtattggacagattgggggaccccagctaaaataaagaaaggcggcctgaacggagtcgatatatattccttagttaccgagaacatccagtggccaaacggaattactctggatttactttctggcagactgtactgggttgatagtaagctacactctatcagctccatagacgtgaacggtggcaaccgcaaaaccattctagaagatgaaaaacgtctggcccaccccttcagcttagctgtgttcgaagacaaagtgttttggacagacatcatcaacgaagccatttttagcgccaaccggctaaccggtagtgacgtgaacttactggcagaaaatttactgagcccagaggatatggtgctcttccacaacctgactcagccacgcggggtgaactggtgtgaaaggaccactctgagcaacggaggctgccagtatctttgtctgccggctccccagataaacccacactctccaaaattcacctgcgcatgccccgacgggatgctactggctcgggacatgcggagttgcctgacagaagccgaagcagcagtggccactcaggaaaccagtactgtcagactgaaagtgagcagcactgcagtgaggacccagcacactaccacccgtcctgttcccgacacctcccgcctgcctggtgccacacccggccttaccacagttgagatcgtcaccatgtcccaccaggcattgggagatgttgcagggcgcggcaatgaaaagaaaccaagttccgtgcgcgctctgagcatcgtgttaccaattgttctgctggtgtttctgtgtctgggcgtgtttttactgtggaagaactggcgcctgaagaatataaatagtatcaatttcgacaatccagtttatcagaaaaccaccgaagacgaggtacacatttgccacaaccaagacggttatagctaccccagcagacagatggtgtccctagaagacgatgttgca

SEQ ID NO: 16009 - DNA, 2580 bp, Artificial Sequence
  Description of Artificial Sequence: Synthetic coding sequence
atgggcccctggggctggaagttgagatggacggtagcgctgctattggcagccgccggcactgcagtgggggataggtgcgaacgaaatgaatttcagtgtcaggatggaaaatgtatctcctacaaatgggtctgtgatgggtccgccgaatgccaggacggcagtgacgagtcacaggagacatgcttgtctgtcacctgcaagtctggcgacttctcttgcgggggacgggtcaaccggtgcattcctcaattctggaggtgcgatggccaggtcgactgcgacaatggaagtgatgagcagggatgtcctccaaagacctgtagtcaggatgaattcaggtgtcacgacggcaaatgcattagccgacagtttgtttgcgattccgacagagattgtctcgatggatctgacgaggcctcttgtccggtcctgacatgcggccctgcctccttccagtgtaatagcagtacatgcatccctcagttgtgggcttgtgataacgatccagactgcgaggatggctctgatgagtggcctcaacggtgcaggggtctctacgtgttccagggtgattcttccccctgcagcgctttcgaatttcattgtctaagcggtgagtgtatacattcgagctggaggtgtgacggtggaccagactgtaaggacaagagcgacgaggaaaactgtgcggtcgcgacgtgtcgcccagacgagtttcagtgttcagatggcaactgcatacacgggtcccggcagtgtgatcgggagtacgattgtaaggacatgtctgatgaggttggctgcgtgaatgttactttgtgcgagggacccaacaagtttaaatgccattccggggaatgcataacactggataaggtatgcaacatggctagggactgtagagattggagcgatgagcccatcaaagaatgtggaacgaacgagtgcctcgacaacaatggggggtgttctcacgtctgcaatgaactgaagatcgggtacgagtgtctctgtccagatggctttcagcttgtcgctcaaagaaggtgcgaggatattgacgaatgccaggaccccgacacctgctcccaactttgcgtgaaccttgagggtggatataaatgtcaatgcgaggagggattccagttggacccgcacaccaaggcttgcaaagccgtgggctctatagcttatctgttcttcacaaatcgacatgaggttcggaagatgaccctcgataggagtgagtatacaagcctgatacctaacctgaggaatgtggtcgcactggacacagaggtggctagtaataggatatattggagcgacttatcacaaagaatgatctgcagcactcagctggacagggcccacggtgtctcgtcatatgacacagttataagtagggatattcaagctcctgatggcctagccgtggattggattcatagcaacatttattggacggacagcgttctgggcacagtgtcagtcgcagacactaaaggagtcaaacgaaaaaccctctttcgagaaaatggctcgaaaccccgcgcaatagtcgtcgatcccgtgcacggttttatgtattggactgattggggaacaccagccaaaatcaagaagggaggactaaatggggttgacatctattcacttgttaccgagaatattcagtggcccaacggcattaccctcgatctgctgagtgggcggctctactgggtggattcaaagctccattccatttcctccattgatgtaaacggaggaaaccgtaaaaccatcctggaggatgagaagcggctcgcccaccctttttcactcgcagtcttcgaggataaagtgttttggaccgacatcatcaacgaagccatcttcagcgctaaccgactcaccggatcagacgtcaatctgttggcagaaaacctgttgtctcctgaggacatggtgctgtttcataatctcacccagcccagaggggtcaactggtgtgagcgaaccaccctcagtaatggagggtgtcagtatctctgcctccccgctccccagatcaacccacactcaccaaaattcacctgcgcgtgtcccgatggcatgctgttggctcgcgatatgcgctcatgtctcactgaggcggaggccgcagtcgcaactcaagaaacaagtacagtgcggttaaaggtgagcagtaccgctgtccgaacccagcatacaacaacgcggcctgtaccagataccagtagacttccaggcgccactcctgggttaacgaccgtggagatcgtgacaatgagccaccaggctctgggcgacgttgcagggagaggaaacgagaagaaaccgtcgtccgttcgggcccttagcatcgtgctaccgattgtcttgctggtgtttctgtgccttggggtgtttctgttgtggaaaaactggcgtttgaaaaacatcaactcgattaacttcgataaccctgtgtaccagaaaaccacagaggatgaagtgcacatatgccacaaccaggatggatattcttacccatctcgccagatggtgagcctggaggacgacgtcgcc

SEQ ID NO: 16010 - DNA, 2580 bp, Artificial Sequence
  Description of Artificial Sequence: Synthetic coding sequence
atgggcccttgggggtggaagctgcggtggacggttgccctgcttctcgctgccgccgggacggccgtgggcgaccgatgcgaacgcaacgagtttcaatgccaggatggcaaatgcatttcctacaagtgggtgtgtgatggcagcgctgaatgtcaggatggctctgatgagtcccaggaaacctgtctgtcagtgacttgtaagagcggagactttagttgtggaggtagagtgaatcgctgtatcccccagttctggcgatgcgacggtcaagttgactgcgataatggctctgatgagcagggttgtcctccgaagacttgctctcaggatgaatttcggtgtcatgacggcaaatgtattagccggcagttcgtctgcgattcagacagggactgcctcgatggtagcgacgaggcaagctgccccgtgctgacctgcggccctgccagcttccagtgcaacagctctacgtgtatacctcaactgtgggcgtgcgataatgatccagattgcgaagacggctctgatgaatggccccagagatgtcgcggactgtatgtgttccaaggcgacagcagtccatgcagcgcttttgaatttcactgcttgagcggagaatgcatacatagctcttggcgatgtgatggtgggcccgactgtaaggataagtccgatgaggaaaactgcgccgtggccacctgcagaccggacgagttccagtgttcagatggcaattgtatccacggcagcaggcagtgtgaccgagagtatgattgcaaggatatgagtgatgaggtcggctgcgtcaacgtgaccttgtgcgagggacccaacaagtttaaatgtcactctggcgagtgcatcactctcgataaagtgtgtaatatggccagagattgccgcgattggtccgacgagcctatcaaggaatgtggcactaatgagtgcctggacaataatggaggatgctctcacgtctgtaatgagctcaagattggatacgaatgtttgtgcccagacgggtttcagctggtcgcacagaggcgctgtgaggacattgatgagtgtcaggatcctgacacatgttcacagctgtgtgtaaatctcgagggtggctacaagtgccagtgcgaggagggtttccagctggacccacatacaaaagcttgtaaagccgttggctcaatagcctacttgtttttcacaaatagacatgaggtgcgcaaaatgaccctggacaggtccgaatatacatctctcatccccaacctgagaaacgtggtcgcccttgacaccgaggtcgcctcaaacaggatttattggagtgatttgagccagcggatgatttgtagcacgcagcttgaccgagcacacggtgtttcatcttatgacaccgtaatctctagggacattcaggcccccgacggcctggcggtggactggatccatagtaatatctattggacagatagtgttctgggcactgtttccgtcgcggacacaaaaggggtgaaacggaaaaccttgttccgggaaaacggatcaaaacccagggctatcgtggtcgatccggttcatggtttcatgtactggaccgactgggggacgcctgccaagatcaaaaaaggcgggctcaacggcgtggatatctacagtctggtgaccgaaaacattcagtggcccaacggcatcacccttgacctgctgtctggcagactctattgggtggattccaaactccatagtatcagttccatagatgttaacgggggaaacagaaaaaccatcctggaggacgagaagagactggcccacccattttccctcgcagtcttcgaagacaaagtgttctggactgacatcatcaatgaagccatcttttcagctaatagactgacggggtctgacgtcaatctgctcgcagaaaacttgctgtcccccgaggatatggtgctgtttcacaacctcactcagccgaggggcgtgaattggtgtgagcggaccactctgtccaatggggggtgccagtacctgtgcttgcctgccccccagatcaaccctcatagccctaagtttacttgtgcgtgccctgatgggatgctgcttgcgcgggacatgagatcctgccttactgaggcagaggcggctgttgcgactcaagagaccagcacagttcgccttaaggtaagcagtactgccgtgaggacacagcataccactaccagacccgtcccggacaccagccggctgcctggagctacacctggcctgacaacagttgagattgttactatgagccaccaagcattgggggatgtagccggacggggcaacgagaagaagccttcatccgttcgcgcgcttagcatagtccttccaattgtgctgcttgtgttcctttgccttggtgtcttcctcttgtggaaaaactggaggctgaaaaatataaatagcataaatttcgacaatcctgtgtatcagaagacgacggaggacgaggtgcatatatgccacaaccaggatggatatagctatccctctaggcaaatggtttctttggaggacgatgtggcg

SEQ ID NO: 16011 - DNA, 2580 bp, Artificial Sequence
  Description of Artificial Sequence: Synthetic coding sequence
atgggaccgtggggatggaagctgcggtggaccgtggcactgctcttggccgccgccggaacggcagtcggcgacaggtgcgagagaaatgaattccagtgtcaggacggtaaatgtatcagttacaaatgggtgtgcgacggtagcgccgaatgccaagacggatcggacgaatcccaagaaacttgtctgtcagtgacctgcaagagcggagacttttcctgcggagggagagtgaatcgctgcatcccgcagttctggcggtgtgacggccaggtagactgcgataacgggagcgatgaacaggggtgcccgcctaaaacctgcagccaggatgaatttcggtgccacgatggcaagtgcatctcacgacaattcgtttgcgactcggacagggattgtctcgatggatcggatgaggcaagctgtccggtgcttacgtgcggcccggcttcgttccagtgcaattcgagcacctgtatccctcaattgtgggcgtgtgataacgacccagactgcgaggacggaagcgatgagtggccgcaaaggtgccgcggactgtacgtgttccagggagacagctcgccgtgttccgcgttcgaatttcactgcctgtcgggagaatgcatccatagctcctggagatgcgacggcggaccagattgcaaagacaagtccgacgaggagaactgtgctgttgcgacttgtcgcccggatgagtttcagtgctcggatggcaattgcatccacggttcccgccaatgtgaccgggagtacgactgtaaagatatgtcggacgaggtcggatgcgtgaacgtgactctgtgcgagggaccaaacaagttcaagtgccactcaggcgaatgcattaccctcgacaaagtgtgcaacatggccagagattgtcgggactggtcggatgaaccgatcaaagaatgcggaactaatgagtgtcttgacaacaatggcggatgttcgcatgtctgcaatgaactgaagatcggatacgaatgcctctgcccagacggtttccaattggtcgcccagcggcgttgcgaggacattgacgagtgccaagaccccgacacgtgttcccagctgtgtgtgaatcttgaaggtggatacaagtgccagtgcgaagagggattccagttggatccgcatactaaggcttgcaaagcagtgggttccatcgcgtacctgtttttcactaaccgccacgaagtccgcaagatgaccttggaccgctccgagtacacttcgctcatacctaaccttaggaacgtggtcgccttggatacggaagtggcctccaaccggatctactggtccgatctgtctcaacgaatgatctgctcaacccagctcgacagagctcatggggtgtcgtcctacgataccgtgatctcgagagatatccaggcccccgacgggctggcagtggactggatccattcaaacatctactggaccgactcagtcctgggaaccgtctcagtggccgacacgaagggtgtcaagcgcaagacccttttccgggaaaatggctcaaagcctcgggctatcgtggtggaccccgtccacggattcatgtattggactgattggggcactcccgcgaagatcaagaagggaggcctcaacggggtggatatctactcccttgtgaccgaaaatattcagtggccaaatgggattaccctggacctgctgtctggccgcctgtactgggtcgatagcaagctgcatagcatttcctcaatcgacgtgaatggaggaaaccggaaaaccatcctggaggatgaaaagcggctggcacaccctttcagcctcgcagtgttcgaagataaggtcttttggaccgacatcatcaacgaggccatcttctcagctaacaggttgaccggaagcgacgtgaacctcctcgcggagaacctgctttcacctgaagatatggtgctcttccataacctgactcaaccacgcggggttaattggtgcgaaagaactactctgtccaatggaggatgccaatacctgtgcctgccggcgccacagatcaacccgcactcccccaagttcacctgcgcatgcccggacggaatgctgctggcgcgcgacatgcgctcctgcctgactgaagccgaagcggccgtggccacccaggagacttcgaccgtgagactgaaggtgtctagcactgccgtccgcacccagcatactaccactcggccggtcccggacacgtcccggctcccaggcgcgacccccggcctgactaccgtggagatcgtgactatgtcgcaccaggctctcggagacgtcgccggtagagggaacgaaaagaaaccatcaagcgtgcgcgccctgtccatcgtcctgcctattgtcctcctcgtgtttctgtgcctgggcgtgttcctcctctggaagaactggcgcctgaagaacatcaactcgattaatttcgataacccggtgtaccaaaaaaccactgaagatgaggttcacatctgccacaaccaagatggatattcgtacccatcgaggcagatggtgagcctcgaggatgacgtggct

SEQ ID NO: 16012 - DNA, 2580 bp, Artificial Sequence
  Description of Artificial Sequence: Synthetic coding sequence
atgggaccatgggggtggaagctcagatggactgtggcgctcctgcttgcggccgctggcactgccgtaggagatagatgtgagaggaacgaattccaatgtcaggatggtaaatgcatcagctacaaatgggtgtgcgacggaagcgctgagtgtcaagatggtagcgacgaatcgcaagaaacgtgcctgtccgttacttgtaagtcaggagacttcagctgcggcgggcgagtcaacagatgcataccgcaattctggaggtgcgatggacaggtggactgcgacaatgggtccgacgagcaaggatgcccgcctaagacgtgctcacaggacgagtttcgctgccacgatggaaagtgcatttcccgccagttcgtgtgtgacagcgaccgcgattgcctcgacggctccgacgaagcatcgtgtcctgtgttgacctgcggaccggcatcatttcagtgcaactcctctacctgcatcccccagctgtgggcgtgtgataacgaccctgactgcgaggacgggtcggatgaatggcctcaacggtgcagaggactgtacgtgtttcaaggcgactcatccccatgcagcgcgttcgagttccattgcctctccggtgagtgcatccactcgtcatggcgctgcgatggagggcccgactgcaaagataagtcagacgaagaaaactgcgcagtggccacctgtcgcccagacgaattccagtgctctgacggaaactgcattcacggatctcggcaatgcgatcgagaatacgactgtaaggacatgtccgatgaagtgggctgtgtcaatgtgacgctgtgtgagggaccgaacaagttcaagtgccactcaggcgaatgcatcactttggacaaggtttgcaatatggctcgggattgccgcgactggtcggacgaacccatcaaagaatgcggaaccaatgaatgtctggacaacaatggaggctgcagccacgtgtgtaacgagctgaagatcggctacgaatgcctgtgcccagatggttttcagctcgtcgcgcagagaagatgtgaggacatcgatgaatgccaggaccctgacacttgttcgcagctttgcgtcaacctggaaggtgggtacaaatgtcagtgcgaagaaggatttcagttggatccacacactaaggcgtgtaaggcggtgggctccatcgcttatctgttcttcacgaataggcacgaggtgcggaaaatgactctggaccggtcagagtacacctccttgatccctaatctgcggaacgtcgtggctctggacaccgaagttgcctcgaatagaatctactggtcagacctgtcccagcggatgatctgctcaacccagctggatagggcccacggggtgagctcatatgacacggtaatctcgcgggacatccaggcccccgatggacttgctgtggactggatccatagcaatatctactggaccgattcagtgctgggcaccgtctctgtagccgatactaagggagtgaaaagaaaaactctgttccgggaaaatgggagcaaaccacgtgccattgtcgtggatccggtgcatggtttcatgtactggactgactggggaacgccggccaagataaagaagggcggactgaacggagtggacatctactcgctggtgaccgagaacatccagtggccgaacggaattaccctggacctcctttcgggtagactctactgggtcgactccaagctccattcaatcagctccatcgatgtgaatggcggtaaccgcaagactatcctggaggacgagaaacgcctcgcccatccgttcagcctggccgtgttcgaggataaggttttctggactgatatcatcaacgaggcaatcttcagcgcgaaccggctcacggggtccgatgtgaacctgctggctgagaacctgttgagcccagaggacatggtactgttccataacttgactcagccccgcggagtcaattggtgcgaaaggaccaccctctccaacggtgggtgtcaatacttgtgccttcctgccccgcagattaacccgcacagccccaagttcacctgtgcgtgccccgatggaatgctgctcgcacgtgacatgcggtcgtgcctcaccgaagccgaagctgcggtggcgactcaagaaacttcaaccgtccgcctgaaagtgtcgtcgaccgcggtgcgcactcagcacacgaccacccggccggtgccagataccagccgcctcccaggagccactccggggctgaccaccgtggaaattgtcactatgtcgcatcaagctctgggtgacgtggcaggccgcggaaacgagaagaagccgagcagcgttcgggcgttgagcatcgtcctcccaatagtgctgcttgtctttctctgcctgggtgtctttttgctctggaagaattggcgcctgaagaacatcaactcgatcaatttcgataacccggtttaccaaaaaaccactgaagatgaggtgcacatctgtcacaatcaggatggatattcgtacccttccagacagatggtgtcgctcgaggacgacgtggcc

SEQ ID NO: 16013 - DNA, 2580 bp, Artificial Sequence
  Description of Artificial Sequence: Synthetic coding sequence
atgggtccttggggttggaagctgcggtggaccgtggcactccttcttgcggctgcaggcaccgccgtgggagacagatgtgagagaaatgagtttcaatgccaggatggtaagtgcatttcgtacaaatgggtctgcgacggctctgcagaatgccaagatgggtcggacgaatcgcaagagacttgtctcagcgtgacttgcaaatccggagatttttcgtgtggtggaagagtcaacaggtgtattcctcagttctggcgctgtgatggtcaggtcgattgtgacaacggctcggatgaacagggatgccctcccaagacctgttcgcaagacgagtttcgatgtcatgatggcaagtgtatctcgcgccagtttgtctgcgactccgatagagattgtcttgatggctctgatgaggcctcctgtcctgtgcttacttgtggtcccgcatcctttcaatgcaactcctctacctgcatcccacagttgtgggcgtgcgataatgatccagattgtgaggacggatcagacgagtggccgcagcggtgtaggggactgtacgtgtttcaaggagactcgtccccatgttcggcatttgagtttcactgcctctccggggaatgtattcattcttcctggcgttgcgacggaggccctgattgtaaagataagtccgacgaggaaaactgcgcagtggccacgtgtagaccagatgagtttcagtgttcggatggcaactgcattcatggcagccggcaatgtgatagggaatacgactgtaaggatatgtcagatgaggtcggctgcgtgaacgtgacgctgtgcgaaggcccaaacaaattcaaatgtcacagcggtgaatgtattaccctggacaaggtctgtaacatggcccgtgactgtcgcgattggtcggacgagcccattaaggaatgcggtaccaatgaatgcctcgataacaatggcggatgctcgcacgtgtgtaacgaactgaaaatcgggtacgagtgtctttgtccggacggttttcagttggttgcacagcgcaggtgtgaagatatagatgagtgtcaagatcccgatacttgctcacaactgtgtgtcaacctggagggtggctacaaatgtcagtgtgaggaagggtttcaactggaccctcataccaaggcatgtaaggcagtggggtccatcgcttacctcttctttaccaaccgccatgaagtccgcaagatgaccctcgaccgatctgaatacacgagcctgatccctaacctgaggaatgtcgtggcacttgatactgaggttgcaagcaaccgtatctactggagcgatctcagccaaaggatgatttgcagcactcagcttgatagagcacacggagtgtcctcatatgataccgtcatctcgcgggacattcaggctcccgacggtctggcggtggactggatccattccaacatttactggacggacagcgttctggggaccgtgagcgtggcagatactaaaggggtgaagcgaaagactcttttcagggaaaacggatcgaagcccagggccatcgtggtcgatcctgtgcacggttttatgtactggaccgattggggcaccccagccaagatcaagaaaggtggacttaacggagtcgacatatactcgctcgtgactgagaacattcagtggcctaacggcattactctcgacctgctttcaggccggctctactgggtcgactcaaagctccattcaatctcgtcaatagacgtaaatggcggaaaccgcaagacgattctggaagatgaaaagagattggcgcatcccttttcgcttgccgtgttcgaggataaggtgttttggaccgatatcatcaacgaagcaatcttttcagcaaatcggcttaccggatccgatgtgaacctgcttgcggaaaacctgctctcacctgaggacatggtgctgtttcataacctgacccaaccgaggggggtaaattggtgtgaaagaactaccttgtcgaatggtgggtgtcaatacctgtgccttcctgcgccgcagattaaccctcactcaccaaaattcacgtgcgcgtgtccagacggtatgctgctcgcacgagacatgagatcctgcctgactgaggcagaagccgccgtggccacgcaggaaactagcactgtgagacttaaggtcagctcgaccgccgtcaggacgcagcataccaccactcggcctgtgccagatacgagccgacttccaggagcaactcctggactgactaccgtggagatcgtgacgatgtcgcaccaagctctcggtgatgtggcaggacgagggaatgagaagaagccttcgtccgtccgggcactctcaatcgtgcttccaattgtgctgcttgtgtttctgtgtttgggcgtctttttgctctggaagaattggcgactcaagaacattaactcaattaacttcgacaaccccgtgtaccaaaagactaccgaagatgaggttcatatttgtcataaccaggacggttacagctaccctagccggcaaatggtgtcgctggaggacgacgttgca

SEQ ID NO: 16014 - DNA, 2580 bp, Artificial Sequence
  Description of Artificial Sequence: Synthetic coding sequence
atgggcccatggggatggaaactgaggtggactgttgccttgctgcttgccgctgcggggacagcagtcggtgatcggtgtgaacggaacgaatttcagtgccaggacgggaaatgcatttcctacaaatgggtgtgtgacggttctgctgagtgtcaggacgggagtgatgagagccaggagacctgtctgtccgtcacgtgtaaatcaggagatttcagctgcgggggacgcgtgaatcgatgtattcctcagttctggcgctgtgatggtcaggtcgactgcgataacggcagcgatgagcagggatgcccccctaaaacttgctcccaggatgagttcaggtgccacgatggcaagtgcattagcagacagttcgtctgcgactccgatagagattgcctcgatggctccgacgaggcttcctgtccagtactgacatgcggccctgcaagttttcaatgtaatagttctacctgtattccacagctgtgggcatgcgacaatgacccagattgcgaggatggtagtgatgaatggccacaaaggtgcaggggattgtatgtgttccagggagattcctcgccttgctccgccttcgaattccattgcctaagcggtgagtgcatccatagcagctggaggtgtgacggcgggcctgactgtaaggataagagcgatgaagaaaattgcgcagtggccacttgcaggcctgatgaattccagtgttctgatggcaactgcatacatgggtcccggcagtgtgaccgggagtatgactgcaaggatatgagtgatgaggtaggttgcgtgaatgtaaccttgtgcgaaggaccgaataaatttaaatgccactccggagaatgcatcacattagacaaggtctgtaatatggctcgggattgtcgggactggagcgacgaaccgattaaggaatgcggcactaacgaatgtttagacaacaatggtggctgctcccatgtgtgtaatgaactaaagatcgggtacgagtgcctgtgtcccgacggttttcaactggtcgcacagcggaggtgtgaagatattgacgaatgccaggaccctgacacttgttcgcaactgtgtgtgaatttggagggagggtacaagtgtcagtgcgaagaggggtttcagctcgacccacacacaaaggcctgcaaggcagtcggctctattgcttatctgttctttactaaccgccacgaggtgcgaaaaatgacacttgatcgtagcgagtatacctccctgattcctaacctccgcaacgtggtggccctggatacagaagttgcttcaaatcgtatttactggagtgacctttcccaaagaatgatatgtagcactcagctggatcgggcccatggggtctccagttacgacactgttatctcaagggacattcaagcgccagacggccttgccgtggattggatccatagcaacatttactggaccgatagtgtgctcggaaccgtgagtgtggccgacaccaagggggtcaagcggaagacactgtttcgggagaatgggtcgaagcccagagctatagtggtcgacccagtccacggcttcatgtattggaccgattggggcacgcccgccaagatcaagaagggaggtcttaacggggtagatatatactcccttgtgaccgagaacattcagtggcccaacggaattactctcgacctactgtcgggacggttatactgggtcgacagtaaactgcatagtatcagctccatcgatgttaatggaggaaacagaaagaccatcttagaggatgaaaaaaggctggctcacccatttagtctcgcagtgtttgaggacaaggtgttttggacggacatcattaacgaggccatcttctcggccaacaggttaaccggaagcgatgtaaacttgttagccgagaatctgctgagcccagaggacatggtgctgtttcacaacctcacacagccccggggagtgaattggtgcgagaggactaccctgagtaatggcgggtgccagtatctttgtctgccagcacctcaaatcaacccccacagcccaaagttcacctgcgcctgtccagacggaatgttgttagctcgtgatatgcgcagctgtctgaccgaagctgaagccgccgttgccacccaggaaacctccacagtgagattgaaggtgtcaagtacagccgtgcgaacccagcatactacaacccgccccgtacctgatacaagtcggctgccgggcgcaaccccgggcttaacaactgtggagatcgttacaatgtctcaccaggccctaggtgacgtagctgggagaggcaacgaaaagaagccttccagcgtaagagctctttccatcgtgctgcccatagtgttgcttgtctttctgtgtctcggggtgttccttctgtggaagaactggagactgaagaatattaattctataaacttcgataacccagtatatcagaagacaaccgaggatgaggtgcacatatgtcacaatcaggatggatacagttacccatcccgccagatggttagccttgaagatgacgtggcc

SEQ ID NO: 16015 - DNA, 2580 bp, Artificial Sequence
  Description of Artificial Sequence: Synthetic coding sequence
atggggccttggggatggaaattgagatggacagtagccctcttactcgctgcagcagggactgctgttggtgacagatgcgaacgcaatgaatttcaatgtcaggatggtaaatgtatttcctacaagtgggtttgtgacggaagtgctgaatgccaggacggatccgacgagagtcaagagacttgtttaagcgttacttgtaagtccggtgattttagttgcggtggacgcgtgaataggtgtattccacagttttggaggtgtgatggtcaagtggattgcgataacggatcagacgaacaggggtgccctcctaagacttgctctcaagatgagttcaggtgtcacgacggaaagtgcatttctaggcaatttgtttgcgatagcgatagggattgcttggatgggtcagatgaagccagctgcccggtccttacttgcggccctgccagcttccaatgtaactcgtcgacttgcatcccccaactctgggcttgtgataacgatccagattgtgaagatggtagtgacgagtggcctcagcgttgcagaggactttatgtattccaaggcgattcttcgccatgttcagctttcgaatttcattgccttagtggagaatgcattcattcctcatggagatgcgatgggggtcccgattgtaaagacaagtcggatgaagagaattgtgctgtggcaacctgtagaccagatgaatttcagtgctccgacggtaattgcatccatggttccagacagtgtgatcgtgagtatgactgtaaagacatgtctgatgaagtcggttgtgtcaacgttaccctttgtgaaggcccaaataagtttaagtgtcactccggagagtgcattacattggacaaagtttgcaatatggctagggattgtagggattggtccgacgaacctatcaaggagtgcggaacaaacgagtgcttagataacaacgggggttgtagccatgtatgtaacgaactgaaaataggatatgagtgcttgtgtccagatggctttcagcttgttgcacaacggcggtgtgaggatatcgatgaatgccaagacccggatacttgctctcaattatgcgttaatctggaaggggggtacaagtgtcagtgcgaggagggcttccagctagatccacatacaaaagcatgcaaagctgtaggaagtattgcttatcttttttttacgaaccggcacgaggtacgcaagatgactcttgacagatccgagtacacatccctaatcccaaatttaagaaatgtcgttgctctagacactgaggtggccagcaatagaatctattggtccgatctttctcaaaggatgatttgctcgacacaacttgacagagctcacggtgtgagttcgtatgacacggttatcagtagggatatacaagctccagatggcctggccgttgattggatccattctaatatttactggactgatagtgtgttgggaactgttagtgtggcggataccaagggagtaaagcggaaaactctttttcgcgagaatggttccaagcctagagcgattgttgtcgatcctgtgcatggctttatgtactggaccgattgggggactccggcaaaaattaagaagggcggattgaatggcgtcgacatctacagtctggttacggagaacatccagtggcctaacggcattactctagatctcctatcaggtcgtttatactgggttgattctaagcttcacagtatctcctccatcgacgtaaacgggggaaacagaaaaaccatattggaggatgaaaaaagactcgcacatcctttcagtctcgcagtttttgaggataaagtgttttggacagacatcataaatgaagctattttctccgccaataggctcacaggtagtgatgtgaatcttttggcagaaaatttactatcacctgaagatatggttttgtttcataaccttactcaaccaaggggggtcaattggtgtgaaaggaccactctctcgaacggtggatgccagtacttgtgtcttcctgctccacagattaacccccactcgccaaaattcacatgtgcttgtccagacggaatgcttctagcacgcgatatgcgtagttgcttgacagaagctgaagcggctgttgccacccaagaaacatctactgttcgattgaaggttagttccaccgctgtccggacgcaacacacgacgaccaggcccgttcctgatacaagtaggttgcctggtgccacccccggacttactacggtggaaatcgtgactatgtcgcatcaagcactaggagacgtagcaggtagaggaaacgaaaagaaaccatcttcagtgagggcgttatcgatcgtgttgcctatcgttctgttggtgtttttgtgtctgggcgtttttttactctggaaaaattggagacttaagaacatcaatagtattaatttcgataacccagtgtatcaaaagacaactgaggatgaggtccatatttgccataaccaggatgggtatagctatccatcccgccaaatggtgtcattggaagatgatgtagct

SEQ ID NO: 16016 - DNA, 2580 bp, Artificial Sequence
  Description of Artificial Sequence: Synthetic coding sequence
atgggtccttggggctggaaactcaggtggactgtcgccctgcttctcgccgccgcagggaccgccgtgggcgataggtgtgagcggaacgaatttcagtgtcaggatgggaaatgtataagctataagtgggtgtgcgatggaagtgccgagtgccaggacggtagcgatgaatcgcaggaaacatgcctgagtgtgacctgtaagtccggagacttctcatgcggaggacgcgttaaccggtgcataccccagttctggagatgcgacggtcaagtcgactgcgacaatggatcagatgagcaaggctgtcctcctaaaacctgctctcaggacgagttcaggtgccatgatgggaagtgtatttctcggcagttcgtatgtgattcagaccgggattgcctagatggttcagacgaagcctcctgtccagttctgacctgtgggccagctagctttcagtgtaacagctcaacatgcatccctcaattgtgggcatgcgacaatgatcccgactgcgaggatgggagcgacgagtggccacagcggtgtcgggggctgtacgtgtttcagggggattcttccccatgttcagcgtttgagtttcactgtttatctggagagtgcatccacagtagctggcggtgtgacgggggaccggactgcaaggacaagagcgacgaggagaattgtgcagtggccacgtgccgtcccgatgagtttcagtgttccgacggcaactgtatacatggtagtaggcaatgcgaccgggagtacgattgtaaagatatgtcagacgaagtcggctgtgttaatgtcactctgtgcgagggccccaataagttcaagtgtcactcaggtgaatgtattacccttgacaaggtgtgcaacatggcccgtgattgtcgagattggtcagacgagcccatcaaggagtgcggaactaatgagtgcctggacaataatggcggatgctcgcatgtatgcaacgagctcaaaataggttatgaatgtctgtgtcccgatggatttcagctagtggcacagaggcggtgtgaagatattgatgaatgccaggaccctgacacctgtagccagctgtgcgtaaacctggaaggcggctacaagtgccagtgtgaagaggggttccagttagacccgcacactaaggcatgtaaagccgtaggttcaatcgcgtacctttttttcacaaacagacacgaagtcagaaaaatgaccttagaccgctctgagtacacctctctcataccaaacctaaggaatgtagtcgctcttgacaccgaggttgctagcaatagaatctactggtccgatctatctcagagaatgatttgctccacgcagctggatcgcgcacacggggtgtccagttatgatacagttatatcgcgcgacatacaggcacctgacggtctcgccgttgattggatccactctaacatttactggactgactccgtgctgggtaccgtgagcgtggccgacacaaaaggtgtgaagagaaagaccctgttcagagaaaatggttctaaacccagggcaatcgtcgtggatccagtgcatggtttcatgtattggactgactggggtaccccggctaagatcaagaaaggcgggttgaacggtgtagatatatattctttagtcacagagaacattcaatggcccaatggcattactctggacctgctgagcgggcgactgtactgggtcgactccaaattgcactctatctcaagcatagacgtgaatggcggtaataggaaaacgattctcgaggacgaaaagcgcctcgcccatccgttcagcctggccgtcttcgaggacaaggtattctggactgatatcataaatgaggcaatattctcagcaaaccgacttaccggttctgacgtcaacctgctcgccgagaatttactctcccctgaagatatggtgctcttccataacttgacccagccacggggcgtgaattggtgcgagcgcacaactctgtccaatggaggttgtcagtacctctgtctaccggcgccccagatcaatccccactctcctaagttcacttgtgcttgcccggacggtatgttactggcgcgggacatgaggtcatgtttgaccgaggcagaggccgctgtggccacccaagaaacaagcaccgtgcgactgaaagtttctagtactgcagtgagaacccagcatacaacaaccagaccagtgcccgatacaagcagattacctggggcgactcccggtcttaccacagtggaaatcgtcaccatgagtcaccaggccctgggtgacgtggccgggcgcgggaatgaaaagaaaccgtcatccgtgagggcactttctattgtgttacctatagtccttctcgtgtttctgtgtctgggcgtgttcctgctatggaaaaactggcggcttaaaaacataaattcgatcaatttcgacaatccagtgtatcagaagaccacagaggacgaggtgcacatttgtcacaaccaagatggttatagctacccatctcggcagatggtgagtctcgaagatgatgtagct

SEQ ID NO: 16017 - DNA, 2580 bp, Artificial Sequence
  Description of Artificial Sequence: Synthetic coding sequence
atggggccatggggatggaaattgcggtggaccgtggctcttctcttggccgccgctgggacggccgtgggggaccggtgtgagagaaatgaattccagtgtcaggacggtaaatgcatcagctacaagtgggtgtgtgatggcagtgccgagtgccaggatggctctgatgagtcccaagagacatgcctgtccgttacctgtaagtctggggactttagttgtggcggacgggtgaaccgttgcatccctcagttctggcgctgtgatggtcaggtggattgcgataacggctctgatgagcagggttgtcctccgaaaacctgtagtcaggacgagtttcgatgtcatgatggaaagtgtatctcccgccagttcgtgtgtgatagcgatcgggactgtctggacgggtctgacgaggcaagctgtccggttctcacatgtggccctgcgtcctttcaatgtaattcaagcacctgtatcccgcagctctgggcatgcgataatgatcccgactgtgaggatggatccgatgagtggccgcagcgatgccggggcctttacgtctttcagggagactcaagcccatgttctgcctttgagttccactgtctgtccggcgagtgcatccactcatcctggcggtgtgacggcggccctgattgtaaagacaaatcagacgaggagaactgcgctgtcgccacctgccggcctgacgagttccagtgttcagatggcaactgcatccatgggtcccgtcaatgtgaccgcgagtacgactgtaaggatatgtccgatgaagtcgggtgcgtaaacgtcactctctgcgagggtcccaacaagtttaaatgccacagcggggagtgtatcaccttggataaggtctgtaacatggctcgagattgcagagactggtctgatgagccgattaaggaatgcggtaccaatgagtgcctggataataatggtgggtgttcacacgtgtgtaatgaactgaagatcggatacgagtgtttatgtcctgacggatttcagctcgtggctcagcgccggtgcgaagacattgatgagtgccaagacccggacacatgtagccagctctgtgtgaatttggagggaggttacaagtgtcaatgcgaagaaggtttccaactcgacccacatactaaggcctgcaaggccgtggggtctatcgcctacctcttctttaccaaccgccacgaagtcaggaagatgacccttgaccggagcgaatatacctccctcattcccaatttgagaaacgtagttgccctggacaccgaagttgcgtcaaataggatctactggagtgatctaagccaaagaatgatctgcagcacgcaactggacagagcgcacggggtatccagttatgataccgtcatctcccgcgacatccaggctcccgacggtctcgccgtggactggatccatagcaacatctattggaccgattcagttcttggaacagtgtctgtggcagataccaaaggcgtgaagaggaagaccctgttcagggagaatggttccaaacctcgagccatcgtagtggacccagtgcacggatttatgtattggaccgattggggcacacctgccaaaataaagaagggaggcctgaacggagtggacatttactcactggttacagaaaacatccagtggcccaacggcattacccttgacctattatccggtcgcctctattgggtggatagcaagctccactctatcagttcaatcgacgttaacggagggaaccgaaaaacgatcttggaggacgagaaaagactcgctcaccccttctccctcgccgtatttgaagacaaggttttttggaccgacatcattaatgaggcaatttttagcgccaacagacttactgggtccgacgtcaacctgctggcagagaatttgctaagtccagaagatatggtcctattccacaatttaacgcaacctagaggggtgaactggtgcgaacgcactaccctgtccaacggaggctgccagtatctgtgcctgccggctccacagataaatccacacagccctaaattcacatgtgcttgtcccgatggaatgctgctggcacgcgatatgagatcttgtctgacagaggccgaagcagcggtggctacacaggagacatccactgttcggctgaaggtgtcctctaccgccgtgcgaacacagcacaccactacccgtcctgtgcccgacacatcccgcttacctggtgcaaccccaggcctgaccacagtggaaattgtcacaatgagccaccaggcccttggagacgttgcaggacgtggaaatgaaaagaagcccagttcagtcagagccttaagcattgtgctgcccattgtcctgctcgtgttcctctgtctcggggtattcctattgtggaagaattggcgacttaagaacattaacagtattaatttcgacaacccagtttaccagaagacaacagaggatgaggtgcatatatgccacaatcaagacggctactcttatccgtcaaggcagatggtgtctcttgaagatgatgtagcc

SEQ ID NO: 16018 - DNA, 2580 bp, Artificial Sequence
  Description of Artificial Sequence: Synthetic coding sequence
atgggtccgtggggctggaagctcagatggacagtggcgctattgttggccgccgctggcacggcggtcggtgataggtgcgagaggaacgagtttcagtgccaggacgggaagtgcatctcctataagtgggtctgcgacggcagcgccgaatgccaggatggcagcgacgagtcgcaggagacctgcctatccgtcacgtgcaagagcggcgatttttcctgtggcggccgtgtgaaccgatgcatcccccaattttggcgatgtgatggacaggtcgactgcgacaacggctcggatgagcaaggatgcccccccaaaacatgtagccaagacgaattccggtgccatgacggtaagtgtatcagtcgccagttcgtctgcgactcggatagggactgtctagatggctcagatgaggcctcgtgcccggtccttacgtgcggccccgcctcatttcaatgcaactccagcacatgcattccacagctgtgggcgtgcgacaatgatccggactgtgaggacggatccgacgagtggccgcagaggtgtcgaggcctgtatgtgttccaaggagactcgtcgccatgctcggcctttgaatttcactgcttgtccggagaatgcatccatagcagctggcgatgcgacggcggccctgattgcaaggacaagagcgatgaggaaaactgcgcggtggcaacgtgccgcccagacgaatttcagtgctcggatggcaactgcatccacggctcgcgtcagtgtgaccgcgaatatgactgcaaggacatgtcagacgaggtcggctgcgtcaacgtgacactgtgcgagggccccaataagttcaagtgccactccggagagtgtatcacattagataaggtttgcaacatggcccgcgattgccgcgactggtcggacgagccaatcaaagagtgtggcactaatgagtgcctggacaataatggcggatgttcccacgtgtgtaacgagttgaagattggttatgagtgcttgtgtccagacgggttccagcttgttgctcagaggagatgcgaagatatcgatgagtgccaagacccggacacatgtagtcaactctgtgtcaacctggagggcggctacaaatgtcagtgcgaagagggatttcagttggatccgcataccaaggcatgcaaagctgtcggctcgatcgcgtacctattttttacgaaccgtcacgaagtccgtaaaatgactttggatcgctccgagtacacatctctaatccccaaccttcgcaatgtggtcgcgctggacactgaggtagccagcaataggatctactggagcgatttgtcccagcgcatgatatgctcgacacaattggatagggcacacggcgtcagttcgtacgacaccgtgatttcgcgcgacattcaggccccagatggccttgccgtcgattggatacattctaacatctactggacagactccgtgctaggcacggtaagcgtcgccgatacgaagggagtgaagaggaaaaccctgttccgcgagaacggcagcaagcctcgcgctatagtcgtggatccggttcacggattcatgtattggacggactggggcactccggcaaagatcaaaaaaggcggactgaatggtgtagatatttatagtcttgtgactgagaacatccaatggcccaatggcataaccttggacctcctctcaggccgcctgtattgggtagacagcaaactgcacagcatttcaagtatagatgtgaacggaggaaaccgtaagactatcctggaggacgaaaaacgtctcgcccacccctttagccttgctgtgttcgaggacaaagttttctggacagatataatcaatgaggccatcttcagcgctaatcgcctcacaggctccgatgtgaatctgctagctgagaacctactgtccccggaggatatggtcctgtttcacaacctaacccaaccacgtggtgtgaactggtgcgagaggaccaccctgtccaacggaggctgccagtacttgtgccttccggcaccccaaatcaatccccatagcccaaagtttacatgcgcgtgccccgatggtatgctgcttgccagggacatgaggagctgcctgaccgaggcggaggccgccgtggccacccaggaaacatcgaccgtccgcctgaaagtaagtagcaccgcggttaggacgcaacacaccacaacccgtcccgtccccgacaccagccgtttgcccggcgccacgcccggtctgactaccgttgagatagtgacaatgagccaccaagcgttgggagacgtagcaggacgaggaaacgagaagaaaccgagctcggtaagagccctgagcatagtactccctatagtgctactggtgttcctgtgtctgggggtgttcctgctgtggaagaactggcggttgaagaatattaacagtatcaacttcgacaacccagtgtaccaaaagaccacggaggacgaggtgcacatctgccacaatcaggatggttatagttatccgtcccgccagatggtgtctctcgaagacgacgtggcc

SEQ ID NO: 16019 - DNA, 2580 bp, Artificial Sequence
  Description of Artificial Sequence: Synthetic coding sequence
atgggcccctggggttggaaacttcgctggactgtggcgctgctgctggccgccgcaggtacagcagttggagataggtgcgaacgtaatgagtttcagtgccaggatggaaaatgcatcagctacaagtgggtgtgcgatggtagtgcggaatgtcaggacggatctgatgaaagccaagaaacctgtctctccgtgacttgtaaatccggagacttctcttgcggcggtagggtgaaccgatgtataccccagttctggagatgcgatggacaggttgactgcgataacggttctgatgagcaagggtgtccacccaagacctgctcacaggacgagtttcggtgccacgacggaaaatgtattagtagacagtttgtgtgcgactctgaccgtgactgcttagatggaagtgacgaggcgtcctgccccgtcttgacctgcgggcccgctagttttcagtgcaacagctccacgtgtattccccagctctgggcctgcgataacgatcctgactgtgaagacggcagcgatgagtggcctcagcggtgccgggggctgtacgtgtttcaaggggacagtagcccctgcagcgcatttgaatttcattgcttaagcggcgagtgtatccactcatcctggaggtgcgatgggggcccagactgcaaagacaagagtgatgaggagaattgcgccgtagcgacatgccgtcctgatgaatttcagtgcagcgatggcaactgcatccacggcagcaggcagtgcgacagagagtatgactgtaaggacatgtctgacgaggtggggtgtgttaatgtgacattgtgcgagggtcccaacaaattcaagtgccactcaggggagtgtattaccttggacaaggtgtgcaatatggcccgagattgccgcgactggtctgatgagcccattaaggaatgtggcacaaatgaatgtctggataacaacgggggctgctctcatgtctgtaacgaacttaaaataggatacgagtgtctctgccccgatggtttccagttggtggcacagcggcggtgtgaggacattgatgagtgccaggatcccgacacctgctcccagctctgtgtcaatctagaaggggggtataaatgccaatgtgaggaaggctttcagctcgacccacacacaaaggcctgtaaggctgtgggcagtatagcatacctgttctttactaaccggcacgaggtccgcaagatgacgttagacagaagcgagtatacaagcctcatccccaatctgcggaacgttgtggcacttgacacagaagttgcgagcaatagaatctattggagtgatctgagtcagagaatgatttgttctacccagctggaccgggcccatggggtaagtagctatgacacggtcatcagtagagatatccaagccccggacggacttgccgttgattggatccactccaatatatactggacagattctgttcttgggaccgtctcggttgccgacaccaagggagttaagcgcaagaccctgttccgcgagaatgggtctaagccaagagcgatagtggttgacccggttcacggcttcatgtactggactgattggggaacacctgccaagattaagaaaggggggctaaacggggtagatatctattctctcgtgactgagaacatacaatggcctaacgggatcactctggacctcctaagcggtcgactctactgggtggattcgaaacttcattcaatcagttccatagacgtgaacggcggaaaccgaaagactattttggaagatgagaagcgccttgcccatcccttctcactggcggtatttgaggacaaggtattctggacagacataatcaatgaagccatattttcagcgaatcgcttaacaggttcggacgtgaacttgcttgccgaaaatttactgagtcccgaggatatggttctgtttcacaatctgacacaaccccgaggagtcaattggtgcgaaaggactacgttatccaacggaggctgtcagtacttatgtcttccggctcctcagatcaatccccattctcccaaattcacctgtgcctgccccgatggcatgctcctggcaagagatatgcggagttgcttgacagaggcagaggcagcagttgcaacacaggagaccagcactgtaaggctgaaagttagttccactgccgtgcgtactcagcatactaccactcgccctgtccccgacaccagcagactcccaggagcgactcccggactgactaccgtggagattgtgaccatgtctcaccaggctcttggagacgttgcaggccggggtaacgagaaaaaaccttctagcgttagggcccttagtatcgtccttcccattgtactcttggttttcctatgcctgggcgtgttcctactgtggaagaactggagacttaagaacattaatagcataaatttcgacaacccggtgtaccagaaaactacggaagacgaggtgcacatatgtcacaatcaagacgggtatagttatccttctaggcaaatggtgagcctcgaagatgatgttgcg

SEQ ID NO: 16020 - DNA, 2580 bp, Artificial Sequence
  Description of Artificial Sequence: Synthetic coding sequence
atgggaccatggggctggaaactgagatggaccgtggcgctactattagccgctgcgggaacagctgtcggcgatagatgtgaacggaacgaattccagtgccaggatggcaaatgcatctcgtataagtgggtctgcgatgggagtgcagaatgtcaggatggctccgacgaatcgcaggaaacatgtctttctgtgacctgcaaatctggggatttctcatgtggtgggagagtgaaccgttgtattcctcagttctggaggtgtgacgggcaggtggattgtgacaatgggagtgacgaacagggttgcccgcctaagacgtgtagtcaggacgaattccggtgtcatgacgggaagtgcatatcaaggcagttcgtctgtgacagcgatcgcgattgtctggatggcagtgacgaggcttcttgccccgtgctcacgtgcggccccgcttcattccagtgtaactcttctacgtgcatcccccagctttgggcctgcgacaatgatcccgactgcgaggacggttcagacgaatggccccagcggtgcaggggtttgtatgttttccaaggcgattcctctccatgtagcgcctttgagttccactgcctctccggggaatgcatccactctagttggcgatgtgatgggggaccagactgcaaggataagtccgatgaagagaactgcgccgtcgctacatgtcggcccgacgaatttcagtgctctgacgggaattgtatacacggttctcggcagtgcgatagagaatacgactgcaaggacatgagcgatgaggtcggctgcgtgaacgtgaccctgtgcgaaggacccaacaagttcaaatgccactctggcgagtgcataactctcgacaaagtgtgtaacatggcccgcgactgtcgggactggtcagacgagcccataaaggaatgcggaacgaacgaatgcctagacaacaacggggggtgctctcatgtgtgtaacgaactgaagattggctacgaatgcctgtgtcctgatggcttccaacttgtcgcacagagaaggtgcgaggacatagacgagtgccaggaccctgacacatgcagccagctgtgcgtgaatttagaaggtggatacaagtgtcagtgtgaggaaggatttcaactcgatccacatactaaggcatgcaaagcagtgggctcaatcgcttatctcttctttaccaatcgccacgaagtaagaaaaatgaccctggaccggtcggagtatacctcattgatccctaatctgaggaatgtagtcgccctcgataccgaggtggcctcaaacaggatctattggtccgacctgagtcagaggatgatctgctctacccaacttgatcgggcacacggtgtttctagctacgacacggtcatctcaagggacatccaggctccagacggtctagcagtggactggatacacagcaacatatactggaccgattctgtacttggtacggtatcagtggcagacacgaaaggagtgaaacggaagacccttttcagggagaatgggtctaagccccgcgccatcgtggtggaccccgtacatgggttcatgtactggacagattgggggactcctgcaaagatcaaaaagggcggactgaacggagtcgacatctacagtctggtcacagaaaacattcagtggccaaacggaataaccctggatctcctgtccggtaggctgtactgggtagactctaaattgcactctataagctcaatagacgtgaatggcgggaatcggaagaccatcttagaggatgagaagaggctagcacaccccttctcactagctgtcttcgaagataaggtcttctggaccgacatcataaatgaagcgattttttcagctaatagattaaccggcagcgatgtgaacctactcgcggagaatctcttatcacccgaggacatggtgctttttcataatctcacacagcctcggggggtgaactggtgcgaacgtactaccctgagtaacggtggatgccaatacctttgcttgccggcgccacagataaacccccactccccaaaattcacgtgcgcttgtccggatggcatgctgctagcgcgtgacatgaggagctgcctcactgaggcagaagctgcagtggccacgcaggaaacatctaccgtgcggctgaaagtttctagcaccgccgtgaggactcaacatacaaccacgcgtcccgtccctgacacgtcacggctcccaggtgccacccccggattgacaaccgtggaaatagtgaccatgtctcatcaggctctcggagacgtagcgggccgagggaatgaaaagaagccgtcaagcgtccgggcccttagcatagtgctccctattgtgctcctcgtatttctatgtctgggggtcttcctcttgtggaagaattggcggctgaagaatatcaatagtattaatttcgacaaccctgtctatcagaaaacaacagaagacgaggtgcacatctgccacaatcaagacgggtacagttatccttcaaggcagatggttagtctggaggacgacgtggcg

SEQ ID NO: 16021 - DNA, 2580 bp, Artificial Sequence
  Description of Artificial Sequence: Synthetic coding sequence
atgggaccctggggctggaaactcaggtggaccgtagcgctgttgctggcggccgcaggcactgcagtgggcgaccggtgcgagcgcaatgagtttcagtgccaggacgggaaatgcatatcgtacaagtgggtctgcgatggctctgcagaatgtcaggacggaagcgacgaaagtcaggagacctgtctgtctgtgacgtgcaaaagcggcgatttttcttgtgggggacgggtcaatcggtgcattccacagttttggcgctgcgacggtcaggtcgactgtgacaatgggtcagacgaacaaggctgtccacctaagacatgttcccaggatgagttccgatgtcacgatggcaagtgtatttctcgccagttcgtatgcgattcggaccgcgactgtctcgacggatccgacgaagcatcttgccctgtcctgacgtgtggaccagcttcctttcaatgcaactcttctacctgtattccacagctttgggcctgtgacaacgatcccgactgcgaggatggttctgacgagtggccgcaaaggtgtcgtggactctatgtgtttcagggcgatagctccccctgttccgctttcgaattccactgtctctcaggggaatgcatccacagctcctggaggtgcgacgggggtcctgactgtaaggataagtccgatgaagaaaattgtgctgtggctacgtgtcggcctgatgaatttcaatgttccgatggcaactgtattcacgggtcccgacagtgtgatcgtgaatatgactgcaaggatatgagtgatgaggtcgggtgtgtcaacgtgaccctgtgtgaaggtcccaataagtttaaatgtcattccggcgagtgtatcacgctcgataaagtctgcaacatggcacgtgactgcagagactggagcgatgagcctataaaggaatgtgggaccaacgagtgcctggacaataacgggggatgcagtcacgtatgtaatgaattgaaaattggctacgagtgcctatgcccagacggcttccagctggtggcccaacgtcgctgcgaggatatcgatgaatgccaggaccctgatacatgctctcaactgtgtgtgaatctggaaggaggctataaatgtcagtgcgaagaagggtttcagctggacccacacaccaaggcatgtaaggcggtcggtagcatcgcttacctgttctttactaatcggcatgaggtgcgcaagatgaccttagatcggtccgaatacacctccttaatcccgaacctcaggaacgtggtcgcccttgacaccgaagtggcttcaaatcgaatctactggtctgatctgtcccagcgaatgatctgtagtacccagctagatcgggcccatggagtctcctcctatgataccgtgatctcaagagacatccaagcaccagatggcttagctgtcgattggatccactcaaacatctattggaccgactcagttttaggaacagtttccgtcgcagacaccaagggtgtcaagcgcaaaaccctctttcgcgaaaatggaagtaaacctcgcgcgattgtcgtggatccggtccacggatttatgtactggaccgactggggcacaccggcgaagattaagaaggggggactgaatggagtagatatctattcactcgttacagagaacattcagtggcccaacggcattacactagacttgctgagcggccgcctgtattgggtcgattccaaactgcactccatcagcagtatcgatgttaacggagggaatcgcaaaactatactcgaggacgaaaagagactggcacacccctttagcttggccgtcttcgaagacaaggttttctggaccgacattatcaatgaggcaatcttcagtgcaaatagacttacagggagtgacgtgaacttgctggcagaaaatttgctgagccctgaggacatggttctgttccataacctgacacagccacgaggagtgaactggtgtgagagaaccaccctttccaatggtggctgtcagtatctctgtttgccagctccacagattaacccacacagcccgaagtttacatgtgcatgccctgacgggatgctgctcgcacgcgacatgagaagctgcctgacggaggccgaggcggccgtggccacccaagagacaagcaccgtcagactgaaggtgtcctctaccgccgttaggacgcagcatacaacaaccaggccggtgccagataccagccgcctgcctggcgccacacctgggctgacaactgtggagatcgtaaccatgtcccatcaagcactgggagatgtcgctggccgcggaaatgagaagaaacctagctccgttcgggcgctttccatagtactcccgatcgtccttctggtttttttgtgcttaggagtgttccttctctggaagaactggcggctgaaaaatatcaactctataaattttgacaatccagtctaccagaagaccacagaagacgaggttcacatctgtcataaccaggatggctactcctacccgtcccgtcagatggtctccctggaagatgacgttgcg

SEQ ID NO: 16022 - DNA, 2580 bp, Artificial Sequence
  Description of Artificial Sequence: Synthetic coding sequence
atgggtccgtggggttggaaattacgatggacggttgcgttattattagcggcggcgggtacggcggtaggtgatcgatgtgaacgtaatgaatttcaatgtcaagatggtaaatgtatatcgtataaatgggtttgtgatggttcggcggaatgtcaagatggttcggatgaatcgcaagaaacgtgtttatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgatgtcatgatggtaaatgtatatcgcgtcaatttgtatgtgattcggatcgtgattgtctagatggttcggatgaagcgtcgtgtccggttctaacgtgtggtccggcgtcgtttcaatgtaattcgtcgacgtgtataccgcaactatgggcgtgtgataatgatccggattgtgaagatggttcggatgaatggccgcaacgatgtcgaggtttatatgtatttcaaggtgattcgtcgccgtgttcggcgtttgaatttcattgtttatcgggtgaatgtatacattcgtcgtggcgatgtgatggtggtccggattgtaaagataaatcggatgaagaaaattgtgcggttgcgacgtgtcgtccggatgaatttcaatgttcggatggtaattgtatacatggttcgcgacaatgtgatcgagaatatgattgtaaagatatgtcggatgaagtaggttgtgttaatgttacgttatgtgaaggtccgaataaatttaaatgtcattcgggtgaatgtataacgttagataaagtatgtaatatggcgcgtgattgtcgagattggtcggatgaaccgataaaagaatgtggtacgaatgaatgtctagataataatggtggttgttcgcatgtatgtaatgaactaaaaataggttatgaatgtttatgtccggatggttttcaattagtagcgcaacgacgttgtgaagatatagatgaatgtcaagatccggatacgtgttcgcaattatgtgtaaatctagaaggtggttataaatgtcaatgtgaagaaggttttcaattagatccgcatacgaaagcgtgtaaagcggttggttcgatagcgtatttattttttacgaatcgtcatgaagtacgtaaaatgacgctagatcgatcggaatatacgtcgctaataccgaatttacgaaatgtagtagcgctagatacggaagttgcgtcgaatcgtatatattggtcggatttatcgcaacgaatgatatgttcgacgcaactagatcgtgcgcatggtgtatcgtcgtatgatacggttatatcgcgtgatatacaagcgccggatggtttagcggttgattggatacattcgaatatatattggacggattcggttttaggtacggtatcggttgcggatacgaaaggtgttaaacgtaaaacgttatttcgtgaaaatggttcgaaaccgcgtgcgatagtagttgatccggttcatggttttatgtattggacggattggggtacgccggcgaaaataaaaaaaggtggtctaaatggtgtagatatatattcgctagtaacggaaaatatacaatggccgaatggtataacgttagatctattatcgggtcgtctatattgggtagattcgaaattacattcgatatcgtcgatagatgtaaatggtggtaatcgtaaaacgatattagaagatgaaaaacgtctagcgcatccgttttcgctagcggtatttgaagataaagtattttggacggatataataaatgaagcgatattttcggcgaatcgtctaacgggttcggatgtaaatctactagcggaaaatttactatcgccggaagatatggtactatttcataatttaacgcaaccgcgtggtgtaaattggtgtgaacgtacgacgctatcgaatggtggttgtcaatatctatgtctaccggcgccgcaaataaatccgcattcgccgaaatttacgtgtgcgtgtccggatggtatgttactagcgcgtgatatgcgatcgtgtctaacggaagcggaagcggcggttgcgacgcaagaaacgtcgacggttcgattaaaagtttcgtcgacggcggtacgtacgcaacatacgacgacgcgaccggttccggatacgtcgcgtctaccgggtgcgacgccgggtttaacgacggttgaaatagtaacgatgtcgcatcaagcgctaggtgatgtagcgggtcgaggtaatgaaaaaaaaccgtcgtcggtacgtgcgttatcgatagttttaccgatagtattattagtatttttatgtttaggtgtttttttattatggaaaaattggcgtctaaaaaatataaattcgataaattttgataatccggtttatcaaaaaacgacggaagatgaagtacatatatgtcataatcaagatggttattcgtatccgtcgcgtcaaatggtatcgttagaagatgatgtagcg

SEQ ID NO: 16023 - DNA, 2580 bp, Artificial Sequence
  Description of Artificial Sequence: Synthetic coding sequence
atgggaccttggggttggaagttgagatggactgtggccctgttgttggcggcggctggcaccgcggtgggagacagatgtgagagaaacgaattccaatgccaggatggcaagtgtatctcttataagtgggtctgcgatggttccgcagaatgccaagatggctctgacgagagccaggagacatgcctctctgtgacctgtaaaagcggagatttcagctgtgggggtcgcgtgaatcgttgcatcccacaattttggcggtgtgatggacaggtggattgtgacaacggtagtgacgagcaaggctgtccccctaagacctgttcccaagacgagttccgctgccatgacggcaagtgcatcagtaggcagtttgtttgcgattcagatagggactgtctggatggatctgacgaggccagttgtccagtgttaacctgcggcccggcgagcttccaatgtaatagctctacttgtataccccagctttgggcttgcgataatgacccggactgcgaagatggcagtgatgaatggccacaaagatgcagaggattgtacgtcttccagggagactctagtccttgcagcgcctttgagttccactgtctgagcggtgagtgcattcattctagctggcggtgcgacggcggacctgattgtaaggacaagagtgatgaggagaactgtgccgtggcgacatgtcgcccggatgagttccagtgctccgatggaaactgtatccacggatcacgacaatgcgacagggaatacgattgcaaggatatgagtgacgaggtagggtgcgtgaacgttacactttgcgagggaccaaacaaatttaaatgccattctggcgagtgtatcacactggataaagtctgcaacatggcccgcgactgtagggattggtccgacgagccaatcaaagaatgtggcacaaacgagtgtctcgacaacaacgggggttgcagccacgtttgcaacgagctgaaaatcggttatgagtgtctgtgccctgatggcttccagctggtggcgcagcggagatgtgaggacattgatgaatgccaggatccagatacatgttcccaactctgtgtcaatctggagggcggctataagtgccagtgtgaagaaggattccagctcgatccgcacacaaaggcgtgcaaagctgtaggatccatagcttatcttttcttcactaatcggcatgaggttagaaagatgaccctggatcgctcggaatatacctctctgatccctaacctccgcaacgtggtggcgcttgacaccgaggttgccagtaacagaatctactggagcgacctcagccagcgcatgatctgttcaacccagcttgacagggctcatggcgtgagcagctatgacacggttataagtcgagacattcaggctcccgatgggctggccgtggattggatccacagcaacatttattggaccgacagtgttcttggcactgtgagcgtggctgataccaagggggtgaaaaggaagaccctctttagggaaaacgggagcaagccccgtgccatcgtggttgacccggtccatggattcatgtactggaccgactggggaaccccagctaaaataaagaaaggaggactgaatggcgtggacatctactcactcgtgaccgagaacatccaatggcccaacggcatcacactagatctgcttagcgggcgcttgtactgggttgattccaaactgcacagcataagcagcatcgacgtgaacggaggaaaccgaaaaacgatactcgaggatgagaaacgcctggcacatcctttcagcctggcggtgtttgaagacaaggtgttctggaccgacatcattaatgaagctattttctctgcaaacagactcaccggaagcgatgtgaatcttcttgctgaaaacctgctgagtccagaagatatggttctgtttcataatctgacacagcctaggggagtcaactggtgtgaacggaccaccctctccaacgggggttgtcaatatttgtgcttgccagctcctcaaataaatccacatagccccaaatttacatgtgcctgccccgacggcatgctgctggcacgagatatgcggagctgcttgaccgaggcagaggcagccgtggctacacaggagacatctaccgtgcggctgaaagtgagtagtacagcagtcagaacccagcatactaccacccggccagtgccagatacttcaagactgcccggcgcaacacccgggctgacaacagttgagatagtgacaatgagccaccaggccctcggcgatgtggcaggacgcgggaacgagaagaaaccttccagcgtgagggccctcagcatcgtgttgccaatagtcctgttggtctttctgtgcctgggggtgttccttctctggaagaactggaggctgaaaaacattaactctatcaacttcgataatcctgtgtaccagaaaacaaccgaagacgaggttcacatttgtcacaaccaggacggatattcctaccccagccgccagatggtctcactggaggatgacgttgca

SEQ ID NO: 16024 - DNA, 2580 bp, Artificial Sequence
  Description of Artificial Sequence: Synthetic coding sequence
atgggcccgtggggctggaaactccggtggacggtggccctgttgctggccgccgcaggaaccgcggtgggagatcgctgcgaacgcaacgagttccagtgtcaggacggtaagtgcatctcctacaagtgggtgtgtgacggatccgccgaatgtcaagacggatcagatgagagccaggaaacctgtctgtccgtgacctgcaagtcgggcgacttctcgtgcggaggccgggtcaatcgctgcatcccacagttttggcggtgtgatggacaagtggactgtgataacggaagcgacgaacagggatgtcccccaaagacttgttcgcaagacgaatttcgatgccacgacggcaaatgtatctctaggcaatttgtctgcgattccgaccgggattgcctggacggatcggatgaagcgagctgccctgtcctgacttgtggaccagcgagctttcaatgtaactcctcgacctgtatcccgcagctgtgggcctgtgataatgatccggactgcgaggatggctccgacgaatggcctcaaagatgccgcggcctgtacgtcttccagggtgatagctccccctgctccgcttttgagttccactgcttgagcggagaatgcattcattcaagctggcgctgtgacggcggtccagattgtaaggataagtcagatgaggagaactgcgccgtggccacttgccgcccggatgaattccagtgcagcgacggcaactgcattcacggatcgagacagtgcgaccgcgagtacgactgtaaagatatgtcggacgaggtgggctgcgtgaacgtcaccctgtgcgagggacccaacaaattcaagtgtcactcaggcgaatgcatcactcttgataaggtgtgcaatatggcgcgggactgtcgggactggagcgatgaaccgatcaaggaatgtggcactaacgagtgcctggacaacaacggaggatgctcccatgtgtgtaacgaactgaagatcggatacgaatgcctgtgcccagatggttttcagctggttgctcagcggcgctgcgaagacatcgacgagtgccaggatccggatacctgtagccagttgtgcgtgaacctcgaaggcggatacaagtgccagtgcgaggagggatttcagctcgaccctcataccaaggcgtgtaaggcggtgggatcaatcgcctacctctttttcaccaatcgccacgaggtgcgaaagatgaccctggatagatccgaatacacttcgctcattcctaatttgcggaatgtcgtcgccctggatactgaggtggcatcaaatcggatctattggagcgatctctcacagcggatgatctgttcgactcaactcgaccgcgcccacggagtcagctcgtacgacaccgtgatatcgagagatatccaagcccctgacgggctggcagttgactggatccattccaacatctattggaccgactccgtgctgggtaccgtgagcgtggcagacactaaaggagtcaagcggaagaccctgtttagggagaacgggagcaaacctcgggccatcgtggtggacccggtgcacggatttatgtactggaccgattggggcaccccagctaagatcaagaaaggagggcttaatggagtcgacatctactcgctggtgaccgagaatatccagtggcccaatggcatcactctggacttgctgtctggccggctctactgggtggactccaagctgcactcgatctccagcatcgatgtgaacggcggtaacagaaagaccattctcgaagatgaaaagcgcctcgctcacccattttcgctcgcagtctttgaagacaaggtgttctggactgacatcatcaatgaagctatcttttcggcgaataggctgaccggctcagatgtgaacctccttgcggagaaccttctttcgccagaagacatggtgctcttccataatcttacccagccacgcggcgtgaactggtgcgaaaggactactctcagcaatggtggatgccaatacctctgccttccggccccgcagatcaatcctcactcgccgaagttcacttgcgcgtgcccagacggcatgctgctggcgagggacatgaggtcctgtctgactgaggcggaggcggccgtggccacgcaggagacttcaactgtgcgcctgaaggtgtcctccaccgccgtgcggacccagcataccactacccgtccggtgccggacacgtcacggctgccgggagcgaccccggggcttactaccgtcgagattgttaccatgtcccaccaggcactgggagatgtggccgggcgcggaaacgagaagaaaccaagctccgtgcgcgctctgtcaattgtgctgcctattgtactgctggtgttcctctgtctgggagtgtttctcctgtggaaaaactggagactgaaaaacattaacagcattaacttcgacaacccagtctaccagaaaaccactgaagacgaggtgcacatttgtcataaccaggacggatacagctacccatcccggcagatggtgtcgttggaggacgacgtggcc

SEQ ID NO: 16025 - DNA, 2580 bp, Artificial Sequence
  Description of Artificial Sequence: Synthetic coding sequence
atgggcccatggggctggaagctgcggtggactgtggcgcttctcctggcggcggcgggaactgcagtgggagatagatgtgaacgtaacgaatttcagtgccaagacggcaagtgtattagctacaagtgggtgtgcgacggttccgcagaatgtcaggacggatccgacgaatcgcaggagacttgtctctcagttacttgtaagtcgggagatttctcatgtggtggacgcgtgaatcgctgtattccgcaattctggagatgtgatggacaagtcgattgtgacaacgggagcgacgaacaaggatgccctccaaagacttgttcacaggatgaattccgttgtcacgacggaaagtgcatatccagacagtttgtgtgtgacagcgatcgggactgtcttgatggttcggacgaagcctcctgtccagtccttacttgtggacccgcgagctttcaatgtaatagctcaacgtgtatcccgcaactgtgggcgtgcgacaatgatccagactgtgaagatggaagcgacgaatggcctcagcgctgtagaggcctgtatgtgtttcaaggggattccagcccttgttcagcctttgagtttcattgcttgagcggcgaatgtattcattcctcatggcgctgtgatggagggcctgactgtaaagataaatccgatgaagaaaactgcgcagtggcaacttgccgtcccgatgagttccaatgcagcgacggcaattgcatacatggaagccgtcagtgtgatcgcgaatacgattgcaaagatatgtccgacgaagtgggatgtgtgaatgtgaccctgtgtgagggcccgaataagttcaagtgtcactcaggagagtgtattacgctggataaggtgtgtaacatggcccgtgattgtagggactggtcggatgaaccaatcaaggagtgtggtactaatgaatgtctggacaacaacggaggttgcagccatgtgtgtaacgagcttaagatcggttacgagtgcctgtgtcctgatggtttccagctggtggcacagcgacgctgtgaggacatcgacgagtgccaggaccccgacacctgctcgcagctttgcgtcaatctcgaaggcggatacaagtgtcaatgtgaagaaggatttcaactggacccccatactaaagcatgtaaagcagttgggtctattgcatacttgttctttaccaaccgtcacgaagtccgaaaaatgacgctggataggtcggaatacaccagcctcattccaaatctgcgcaacgtggtggcgctggataccgaggtggcatcgaataggatttactggtcggacctctcccaacgcatgatctgtagcacccagctcgatagagctcacggggtgtcatcttacgatactgtgatttcccgtgatattcaggcccctgatggcttggctgtcgactggatccatagcaacatatactggaccgattcggtgcttggtactgtctcggtggcagacaccaaaggcgtgaagaggaaaacgctttttagagagaacggatccaaacctagagcaatagtcgtcgatcccgtacacgggtttatgtattggacggactggggtacgcccgcaaaaatcaagaaaggaggcctcaacggcgtcgatatctactcgctggtgactgaaaacattcagtggcctaatgggatcacccttgatctgctttcagggcggctttactgggtggatagcaagctgcactcgataagctcgatagacgtgaacggcggaaatcgtaaaactatactcgaggatgaaaagcgattggcacatcctttctcactggcagtctttgaggataaggtgttttggaccgatatcatcaacgaagcgatcttttccgcaaacagacttaccggttcggacgtgaacctcctggcggaaaacctcctttcgcctgaggatatggtgttgtttcataacctcactcaaccaagaggcgtgaattggtgcgagaggaccacgttgtcaaatggaggatgccaatacctgtgtctcccggccccacaaatcaaccctcactcccccaaattcacctgcgcctgcccagatggtatgctgcttgccagagatatgcgaagctgcttgaccgaggccgaagcagcagtcgcgacccaagaaacttctactgtgaggctgaaggtatcgtctaccgcagtcagaacgcaacataccaccactagaccagttcctgatacctcgcggcttccgggggccaccccaggtctgacgacggtcgaaattgtgactatgtcgcatcaagcgcttggagacgtggcaggtcgcggaaacgaaaagaagccgagcagcgtccgggctctgtccattgtcctccccatcgtgcttcttgtgtttctttgcttgggagttttcctgctctggaagaactggagactgaaaaacatcaatagcattaacttcgataacccagtgtaccagaaaaccactgaagatgaagtccacatttgtcataaccaggacggttactcgtacccttctcgtcaaatggtgagcttggaggacgatgtggcg

SEQ ID NO: 16026 - DNA, 2580 bp, Artificial Sequence
  Description of Artificial Sequence: Synthetic coding sequence
atgggaccatggggatggaaactcaggtggacggtggctcttctattggccgcggcagggaccgcggtcggtgatagatgtgagcggaatgaattccagtgtcaggacggcaagtgtatctcttacaaatgggtctgtgatgggtctgcagagtgccaagatgggagcgacgagtcacaagagacatgtttgtccgttacgtgcaaaagcggcgatttctcgtgtggtggccgagttaatcgctgtatcccacaattttggcgttgcgatggacaggtcgattgcgataacggctcggacgagcagggttgcccgcctaaaacttgcagccaggatgagtttcgatgccatgacggcaagtgtatctcccgccagttcgtctgtgattccgatagagattgcctcgatgggtcagatgaagcatcctgcccagtgctgacctgtggcccggcatctttccagtgtaattcttctacatgcattccgcagctgtgggcatgtgataatgatccggattgtgaggatggctcggatgaatggccgcagcgctgccgcggactgtatgtcttccaaggtgattcctccccatgcagcgcgttcgagttccactgcctatccggagagtgtatccactcgtcgtggcggtgcgatggtggaccagactgtaaagacaaatcagatgaagagaactgtgctgttgctacctgcagacccgacgagttccagtgtagcgatggaaactgcatccacggcagccggcaatgcgatcgagaatatgattgtaaagatatgtcagacgaagtgggctgcgttaacgtcacactctgtgaagggccaaacaaatttaagtgccatagtggtgaatgcattaccctggataaggtatgcaatatggcacgcgattgccgggattggtcggatgagcccatcaaggaatgcggcactaacgagtgccttgataacaatggcggatgcagccatgtctgcaatgaacttaagatcggctacgaatgtctttgtccagatggatttcaactagttgctcaaaggcgatgcgaggacattgatgaatgtcaagaccctgacacttgtagccagctgtgcgtcaatctcgaaggtggctacaagtgtcagtgtgaggaaggttttcaacttgacccccacaccaaagcgtgcaaggcggtgggttccattgcctatttgttctttacaaatcgtcatgaggttcggaaaatgacgcttgaccgctctgagtataccagtcttataccaaacctccgcaatgtggtcgctctcgatacagaggtggcctccaatcgtatttactggtccgatttgtcccagcgaatgatttgttctacccagttggaccgggctcacggcgtctcttcctacgataccgttataagccgggacattcaggcccccgatgggttggccgtcgattggatccattcgaacatttactggaccgattctgtattgggcactgtctcggtcgctgacacaaagggtgtgaaacggaaaacgctgttcagagagaatggatccaagcctcgggccatcgtggtggatcccgtccacggcttcatgtactggaccgattggggcacgcctgccaagataaaaaaggggggtttgaacggagtcgatatctactcgttggttacggaaaatattcaatggcctaatggtatcaccttggatctgctttcaggacggctgtactgggtggactctaagctacattccatatcgtcgatcgatgtcaacggcggtaataggaaaacgatacttgaggatgagaagcggctcgcacaccccttctcactcgctgttttcgaggataaagtgttctggacggacattataaacgaagcaattttctcagctaatcgacttaccggcagcgatgtcaatctgctcgccgagaatctgctgagtcccgaagacatggtgcttttccacaacctaacccagcctcgtggggtcaattggtgtgagaggacaaccctgtccaacggcggttgtcagtatctatgcctgccagctccgcagatcaacccacactcacccaagttcacctgcgcttgccctgacggtatgcttttagcgcgcgacatgcgaagctgccttacggaggccgaagccgcagtggcaacccaagaaacatccactgtgagattgaaggtgtcttccacagcagtccggactcagcatactacgacccgaccggttcccgacacaagcaggctccccggtgccactccgggtttgactacagttgagatcgtgactatgagtcaccaggcactcggagacgtggcggggcgtggtaacgagaagaaaccttcgtcagtgcgagcattgtcgattgtgctaccaatagttcttcttgtcttcctgtgtcttggagtattcttactgtggaagaattggagactgaagaacatcaatagcattaacttcgataaccctgtttaccagaagacaacagaagacgaggtccatatttgccataatcaggatggctattcgtatccttcacgtcaaatggtctctcttgaagacgacgtcgcg

SEQ ID NO: 16027 - DNA, 2580 bp, Artificial Sequence
  Description of Artificial Sequence: Synthetic coding sequence
atgggaccctggggatggaaacttcggtggactgtggcacttctgctggcagcggcaggaaccgccgtgggtgatagatgtgagcggaacgagttccaatgtcaagatggtaagtgcatcagctacaagtgggtgtgtgatggatcggccgaatgtcaggacggctcggatgaatcgcaagagacttgtcttagcgtcacttgcaagtcgggtgatttttcgtgtggtggcagagtgaaccggtgtatcccccagttttggcgctgcgatggtcaggtcgactgtgataatggatcagatgagcaaggttgtcctccaaagacctgctcgcaagatgaatttcggtgccatgatggtaagtgtatatcgagacaattcgtctgtgattcagaccgggattgcctggacggctccgatgaagccagctgcccggtgcttacttgtggtccagcatcattccaatgcaattcctcgacttgtattcctcagctgtgggcatgtgataacgacccagattgtgaagatggatctgacgagtggcctcaacggtgtagaggtttgtacgtgttccaaggagatagcagtccttgttcagcattcgaatttcactgtttgtccggtgagtgcatccattcctcctggcggtgcgacggaggccctgactgtaaagacaagtcagatgaggaaaattgcgcagtcgcaacttgccggccagacgagttccagtgttcagatggcaactgtattcatggatcaagacagtgcgatagggaatacgattgcaaggatatgagcgacgaagtggggtgtgtcaacgtgactctttgtgaaggtccgaacaagtttaagtgtcattccggcgagtgtatcaccctcgacaaggtgtgcaatatggccagagactgtcgggactggtcggatgagcctatcaaggagtgtggaaccaacgaatgcctcgacaataacggtgggtgctcgcatgtgtgtaacgagctgaagatcggttacgaatgcctctgtcctgacggattccaattggtggcacaacgccgctgtgaggacatagatgaatgtcaagatcctgacacgtgttcgcaactttgcgtgaacctcgaaggtggctacaagtgccagtgcgaagaggggttccagctggatccacacaccaaagcctgtaaggcagtaggatcgattgcatatctgttctttactaaccgtcatgaggtccgcaagatgactcttgacaggtcagagtacaccagcctgattcctaatctgcggaacgtggtggcacttgacaccgaagtcgcttcaaatcgaatttactggtcggacctcagccagagaatgatttgtagcacccagctcgaccgtgctcatggtgtgtcgagctacgataccgtgatctccagagatattcaagcaccagatggtcttgctgtggattggatccacagcaatatctactggaccgattcggtcttgggaaccgtgtcggtggctgacacgaagggcgtcaagagaaagaccttgtttagggaaaacgggtcgaagcccagggcaattgtggtcgatcccgtgcacggctttatgtattggaccgattggggaactcctgcaaagattaagaaaggagggctgaacggtgtggacatttactcgcttgtcaccgagaacatacagtggcctaatggaattactcttgatcttctttcagggagactgtactgggtggattcaaagttgcactccatcagctcaatcgacgtgaacggtggaaacagaaagactattcttgaagatgagaaaagactggctcatccttttagccttgccgtgttcgaagataaggtcttttggaccgacattatcaatgaagcaatcttcagcgccaacagactgaccgggagcgatgtgaatttgcttgctgagaatctcctctcgcctgaggacatggtcctcttccataaccttactcaaccaaggggtgtgaactggtgtgaacgaaccaccctgtccaacggggggtgccagtacctttgtctcccggcaccacaaatcaaccctcattcgcctaagtttacctgtgcatgtccagatggaatgctgctggcaagggatatgagatcatgtctgaccgaggcagaagcagccgtggcgacccaagagactagcaccgtgcggctcaaagtttcctccacggccgtgaggactcagcataccactaccaggcctgtcccagacacctcgagactccccggagccacgcccggtctgaccacggtcgaaatagtcaccatgtcgcatcaggcattgggagatgtggcaggaaggggtaatgagaaaaagccctcgtcggtgcgagcattgtccattgtgcttcctatcgtgctcctcgtttttctctgcctgggggtctttctgctttggaagaactggcgactcaagaacataaactccatcaattttgataatcctgtgtaccaaaagaccactgaagatgaggtgcacatttgtcataaccaggacgggtattcatacccgtctcgtcagatggtgagccttgaggatgatgtcgca

SEQ ID NO: 16028 - DNA, 2580 bp, Artificial Sequence
  Description of Artificial Sequence: Synthetic coding sequence
atgggtccgtggggttggaaattgcgctggacggtcgcgcttctcctcgcagccgccggaaccgcggtgggagatcggtgcgaaaggaacgagttccagtgccaggatgggaagtgtatcagctacaagtgggtctgcgacggttcggccgaatgccaggacggaagcgacgaatcgcaggagacgtgcctgtccgttacttgtaagtcgggagacttctcgtgcggtggacgcgtgaatcgctgcattcctcagttctggaggtgtgatggacaagtcgactgcgacaacggatccgacgaacagggctgccctcctaagacctgctcccaagacgagttcagatgccacgacgggaagtgcatctctcgacaatttgtgtgcgattcggaccgcgattgcctggatggctccgatgaagcatcctgtcctgtgctgacttgcgggccagccagcttccagtgcaattcgagcacttgcatcccacaactttgggcgtgtgacaacgacccagactgcgaagatggttcagacgagtggccacagcgttgccggggactgtacgtctttcaaggcgacagctccccgtgctcagcctttgagttccactgtctctcgggcgaatgcatccattcctcatggagatgcgatgggggccctgactgcaaggataagtcagacgaagagaattgtgccgtggctacctgccgcccggacgagttccaatgcagcgacggaaactgcatacatgggtcacggcaatgtgatagagaatacgattgcaaggatatgtcggatgaagtcggatgtgttaatgtcaccctttgcgaaggacccaacaagttcaagtgccactccggcgagtgcatcactttggataaggtgtgtaatatggccagggactgccgggattggtcagacgagccgatcaaggaatgcggaaccaacgaatgcctcgacaacaacggcggatgtagccacgtgtgcaacgaactgaagatcggttacgaatgtctgtgcccagacggcttccagcttgtggcccaacggaggtgcgaggacatcgacgagtgtcaggatcccgacacttgcagccagctgtgtgtcaacttggagggagggtacaagtgtcagtgtgaagaagggtttcaacttgatcctcacactaaggcttgcaaggccgtcggttcaatcgcttaccttttctttaccaatcgccacgaggtgagaaaaatgaccctcgatcgcagcgagtacacttcgctgatcccaaacttgcggaacgtggtcgcgctggacaccgaagtggcttccaatagaatatactggtctgacctgtctcagaggatgatctgctccacgcaattggatcgggcacatggagtgtcgtcctacgacacggttatctcaagggacatccaagctccggacggcctcgcggtggactggattcactctaacatctactggacggactccgtgctgggaaccgtctccgtcgccgatactaaaggcgtgaagcggaaaactctgtttcgggaaaatggcagcaaaccccgagccatcgttgtggacccagtccacggattcatgtactggactgactgggggaccccagcaaaaatcaagaagggcggactgaacggagtggacatctattcccttgtcactgagaatatacagtggccgaacggcattacgctggatttgctgtcgggccgactgtactgggttgactcgaaactgcatagcatttccagcatcgatgtgaatggaggcaaccggaaaactatcctcgaggacgaaaagcgccttgcacacccgttcagcctggccgtgtttgaggacaaggtcttttggacggacattatcaacgaggccatcttctcagcaaatagacttactggatccgatgtgaatctcctcgcagagaaccttttgtctccggaagatatggtgctcttccataacctcacccaaccgcgcggagtgaattggtgtgagcgcactaccttgagcaatgggggttgccagtacctctgcctcccggctccccagatcaatccgcatagcccaaaattcacctgcgcctgtcctgatgggatgctgctcgcgagagacatgcggagctgcctgaccgaagccgaagcggccgtggccacgcaagaaacgtcaaccgtgcgccttaaggtcagctcaactgcagtgagaactcagcataccaccacccgccctgtcccggacacctcccggctgccaggagccacccccggcctgacgaccgtggaaattgtgaccatgagccaccaggcgctgggcgacgtggcgggacgcggaaacgagaagaagccgtcatctgtgcgcgcgctgtcaatcgtgctgcctattgtcctgcttgtgttcctgtgcctgggcgtgttcctgctgtggaaaaactggaggctcaaaaacatcaactcaatcaatttcgataacccggtctaccagaaaaccactgaggacgaggtgcacatttgccataaccaggacggatactcctatccgtccagacaaatggtgtctctggaagatgacgtggcc

SEQ ID NO: 16029 - DNA, 2580 bp, Artificial Sequence
  Description of Artificial Sequence: Synthetic coding sequence
atgggcccgtggggatggaagctccgctggaccgtggctctcctcctcgctgccgccggaactgccgtgggtgatcgatgcgagcggaacgagttccaatgccaggatggaaagtgcatttcatacaaatgggtgtgtgacggcagtgcggaatgccaggacggttccgatgagtcgcaagagacttgtctgtcggtcacttgcaaaagcggagacttcagctgtggtggacgagtgaaccggtgcatcccgcagttctggagatgcgatggccaggtcgattgcgacaacggttcagacgaacagggatgcccaccgaaaacctgctcccaggacgagtttaggtgccacgatggcaaatgtatttcccgccagttcgtgtgtgattccgacagggattgtctggacggctcggacgaggcgtcatgcccggtccttacttgtggtccggcctcattccaatgcaattcaagcacctgcatcccccaactgtgggcatgcgataacgatccggactgcgaagatggtagcgacgaatggccacagagatgccggggactctacgtttttcaaggggatagctcgccttgctctgcatttgagtttcactgtctttccggagagtgtatccactcctcgtggcgctgtgacgggggacctgactgcaaagacaaatcggatgaggaaaattgcgcggtcgctacctgcagacccgacgaatttcagtgttccgatggcaactgtatccacgggagtcggcagtgcgaccgtgagtacgattgcaaggacatgtcggacgaagtggggtgcgtcaatgtgacgctgtgcgaagggcccaacaaattcaagtgccactctggagagtgcatcaccctggacaaggtctgcaatatggcacgcgactgcagggattggtcagatgagccgataaaggaatgtggaactaacgagtgtttggataacaacggcggttgctctcacgtgtgcaatgaattgaagatcgggtacgaatgcctgtgcccagacggttttcagctggttgcgcagcgcagatgtgaggacatcgacgaatgccaagacccggacacttgttcacagctgtgcgtcaatcttgaaggtggatacaaatgccagtgcgaagaaggtttccaacttgacccgcacactaaggcctgcaaggcagtcggatcgattgcttatctcttcttcaccaaccgccatgaggtgcggaagatgaccttggaccggtcagaatacacgtccctcatcccgaatctcagaaacgtggtggccctcgacaccgaagtggcctccaaccgcatctactggtccgacctttcacagcggatgatctgctcgacgcaactcgaccgggcacatggagtgagtagctacgacactgtgatctcgcgggatatccaggcaccagatgggctggctgtggattggatccattcaaacatctactggaccgactccgtgctgggcactgtgagtgtggccgacactaagggagtcaagcgcaagaccttgttcagggaaaacgggagcaaacccagggctatcgtggtggaccccgtgcacggcttcatgtactggaccgattgggggaccccggcaaaaatcaagaagggcggactgaatggagtggacatctactcgctggtgaccgagaacattcagtggccaaatggaatcactctggatctgctgtcaggtaggttgtattgggtagactcgaagctgcattccatctcctcaatcgatgtgaacgggggaaacaggaaaacgatcctcgaggacgaaaaacggctggcgcacccattttcactggccgtgttcgaggataaggtcttttggactgacatcattaatgaagctatcttctccgcaaatcgcctcacgggctccgatgtgaatctgctcgcagagaatctgctgtcgccagaggacatggtgctgttccacaaccttacccaacctcgcggggtcaactggtgcgaaagaactaccctgtccaatggtggatgccagtacctttgtctcccggcgcctcagatcaacccgcatagcccgaagttcacgtgtgcatgcccggacggaatgctgctcgcccgggacatgagatcgtgcctgactgaagcggaggccgccgtggccacgcaggaaacttcaactgttaggctcaaggtgtcgtcgacggccgtcagaacgcaacataccactacccgccctgtgcctgacactagcagactcccaggagccaccccgggactgactactgtggaaatagtgactatgtcgcatcaagcactcggagatgtcgcgggacgcggaaatgagaagaaaccgtccagcgtgcgagcgctgtcgattgtcctcccgatcgtcctgttggtgttcctgtgtctcggagttttcttgctctggaagaactggcgtctgaagaatatcaatagcattaacttcgacaacccggtttaccagaaaactaccgaggacgaagtgcacatctgtcataaccaggacggatactcgtacccaagccggcagatggtatccctggaagatgacgtggcc

SEQ ID NO: 16030 - DNA, 2580 bp, Artificial Sequence
  Description of Artificial Sequence: Synthetic coding sequence
atgggcccctgggggtggaagctgcgttggaccgtggcgctgttgctggccgccgcggggacggctgtgggggatcgatgtgagcggaacgagtttcaatgccaggacggtaaatgtatatcctacaaatgggtgtgtgatggtagcgctgaatgtcaggatggaagtgacgagtctcaagagacttgcctgagcgtaacctgcaagtctggagacttttcttgtggcggaagggtcaacaggtgcataccacaattttggcgctgtgatggccaggtcgactgcgataatggcagcgatgagcagggttgtccacccaagacatgcagtcaggacgaattccggtgtcatgatggaaagtgtatctctaggcagtttgtgtgtgatagtgatcgggattgtctggatggcagcgacgaagctagctgccctgtcttgacttgtggacccgcttcattccagtgcaattctagcacttgcattccacagttatgggcgtgcgataacgatcccgattgtgaggatggcagcgacgagtggcctcaaagatgtcgcgggctctacgttttccagggggactcatccccatgctctgcattcgagttccactgtctatccggagagtgcattcacagcagctggaggtgtgacggcgggccagactgcaaagataagtcagatgaggagaattgcgcagttgccacctgtaggccagatgagttccaatgtagtgatgggaattgtatacacggctccaggcagtgtgatagagagtacgactgcaaggacatgtctgatgaagttgggtgcgtgaatgtaacactgtgcgagggaccaaataaattcaagtgccatagcggcgagtgtattacgctggataaagtttgcaacatggctagagactgtcgggattggtctgacgaacccattaaagaatgtggcactaatgaatgcctcgataacaatggggggtgcagccatgtttgtaacgagctgaagatcggatacgagtgtctgtgtcctgacgggtttcagttggttgcccaacgcaggtgtgaagatattgatgagtgccaggatcctgatacgtgcagccagctctgcgttaacttagagggtgggtacaaatgtcagtgcgaggagggatttcaattagaccctcatacgaaagcatgcaaggctgtggggtctatcgcttatctcttttttacaaatcgacatgaggtgaggaagatgacgttagatcggagtgagtatacctccctgattcccaatctgcgcaatgttgtcgcgcttgacactgaggtcgcatctaatcgcatctattggagcgatctgagccaaaggatgatctgttccacccagctggatcgagcccacggggtcagttcctatgataccgtgatttccagagacattcaggccccagacggcctggccgttgactggatccactccaatatctactggactgattccgttctggggactgtgtccgtggctgacactaaaggggtcaaaagaaagactctgtttagagagaatggttccaaaccaagagcgatcgtcgtggaccccgtgcatgggtttatgtattggacagactggggaacacccgccaaaatcaagaaaggtggcctgaacggcgtcgatatctatagtctcgtcaccgaaaatatccaatggcccaacgggattactcttgatctgctctccgggcggttatactgggtcgacagtaagttacacagtattagttccatcgacgtgaacgggggcaatagaaagaccatcctggaggatgagaaaagactggctcatccattctccctggccgtgtttgaggataaggtgttctggaccgatatcattaatgaagccattttcagtgcaaatcggcttaccggttctgacgtaaatttgttagccgaaaatctactcagtcctgaagatatggtcttgttccacaatctcactcagcctcgtggggtgaattggtgcgagaggacgacgctttccaacgggggttgtcagtatctctgcctgcctgctccgcagataaatccgcatagtccgaaatttacttgcgcctgcccagatggcatgctgctagcccgagacatgagaagctgcttgacggaggctgaagccgctgtagccacccaggagacgagcacagtccgactaaaagtgagctcaaccgctgttcgcactcagcacacaaccaccagaccggtgcccgatacatcacggctccctggtgcaactccaggcctcaccaccgttgaaatagtgacaatgtcccaccaagccctaggcgacgtggcaggccgcggcaacgagaaaaagccgagttcggttcgggccctaagtattgttttacctatcgtcctgctggtcttcctgtgcctgggagtgttccttctgtggaaaaactggaggctgaaaaacattaacagcatcaactttgacaacccggtctaccagaagactaccgaggacgaagtgcacatttgtcacaatcaggatggctactcctaccccagtagacaaatggtcagcttggaggatgacgtcgcc

SEQ ID NO: 16031 - DNA, 2580 bp, Artificial Sequence
  Description of Artificial Sequence: Synthetic coding sequence
atgggcccttggggttggaagctgcggtggaccgtcgctctgcttttggcagcggccgggaccgcagtgggcgatcgctgcgaacggaacgagttccagtgtcaggatggaaagtgtattagctacaaatgggtatgcgacggtagcgcggagtgccaggatggcagtgatgagtcccaggaaacgtgcctatcagtcacgtgtaagtccggcgattttagttgcggcgggcgggtgaacagatgcatccctcagttctggcgttgcgatggtcaggtcgattgcgacaacggatctgacgagcagggctgcccgccaaaaacctgttcgcaggacgagtttagatgtcacgacgggaaatgcatatctagacagttcgtttgtgactcagatcgagactgcctggacgggagtgatgaggcctcctgccctgttctcacgtgtgggccagcctctttccagtgcaattcttccacttgcatccctcagctgtgggcttgcgacaacgatcctgactgtgaggatggatctgatgaatggcctcagaggtgccgcggactgtatgtcttccaaggggatagctccccatgcagcgccttcgaattccactgtctgagcggtgaatgcatccacagtagctggcgttgcgacggtggacctgactgcaaagataagagcgatgaggaaaactgcgccgtagcgacctgcaggccggacgagttccagtgtagtgacggtaactgtatccacgggtcccgtcagtgtgatcgggagtacgactgtaaggacatgtccgatgaagtcggctgtgtgaacgtgacactctgtgaaggcccgaacaagttcaagtgtcactctggggagtgcattacgctagacaaagtatgcaatatggctcgggattgtcgggactggagcgatgaacctatcaaagagtgtggtaccaacgaatgtcttgataacaatgggggctgctcacacgtgtgcaatgaattgaagatcgggtatgaatgcctctgtccggacgggtttcaactagtggcacagcgccgttgcgaggacattgacgaatgccaggaccctgacacgtgcagccagctgtgtgtgaacctggagggcggctacaagtgtcagtgcgaagagggcttccagctcgatccccacaccaaggcctgtaaggccgtaggcagcattgcatatctgttttttactaatagacacgaagtccggaagatgacgttggacaggtccgagtacacctcactgatcccaaatctgagaaatgtcgtggcgctggataccgaggtagcttcgaacagaatctattggagcgatctgtcgcaacggatgatctgctccacccagctggaccgggcccatggtgtcagtagctatgacactgtcatcagccgggacattcaggcgcctgacggcctggccgtggattggatacattccaacatctactggactgattctgtgcttggcaccgtttcagtggccgacacaaaaggtgtcaagaggaaaaccctttttagagagaacggttcaaagcccagagccatcgtggttgaccccgtgcatggcttcatgtactggaccgattgggggactccagcaaaaataaagaaaggtggccttaacggagtggacatctactctctcgtgactgaaaatatacagtggcctaatggcattaccctggacctgcttagcggtcggctgtattgggtggactctaagctgcattcaatttctagtatagacgtaaatggggggaacagaaagaccattctggaggatgagaaacgccttgctcacccgtttagcctggcggtatttgaagacaaggttttctggacagacatcattaacgaggcgatcttctccgccaacaggctcacagggtctgatgttaacctgttggctgaaaacctgcttagccccgaggacatggtgctttttcacaatctgacacagccccgcggcgtgaactggtgcgaacggacaacactgtccaacggaggatgtcaatatttgtgcctcccagccccccagattaatcctcacagtccgaaattcacatgcgcttgccccgatggaatgctcctggctcgcgatatgcgaagctgcctgacagaggcagaggctgccgtcgccacccaagaaaccagtactgtgcgattaaaagtctccagcaccgcagttagaacccaacataccaccacgcgtccggtgcccgacaccagcaggctccctggcgcaaccccaggcttgactacagtcgagattgtgacaatgagccaccaagctttgggggacgttgccgggcgaggaaatgagaagaaaccctcttcggtccgcgccctgagcatcgtgttacctattgttttactcgtttttctatgccttggagtgttcctgctctggaagaactggagactgaagaatatcaacagcattaattttgacaatccagtgtatcagaagacaaccgaggacgaagtccatatttgccacaatcaggacggttactcatacccatcacggcagatggtttccttggaggatgatgtggcc

SEQ ID NO: 16032 - DNA, 2580 bp, Artificial Sequence
  Description of Artificial Sequence: Synthetic coding sequence
atggggccgtgggggtggaagctgcgctggaccgtggcattgttgctcgcagccgccgggacggccgttggtgacagatgtgaaaggaatgagtttcagtgtcaagatggcaaatgtatttcatataaatgggtgtgtgacggatctgctgaatgccaagacggttcagacgagtctcaggaaacgtgcctgagcgtgacgtgtaagtctggggattttagttgtggaggccgggtgaatagatgcattccccagttttggcgctgcgacggacaggttgactgcgacaatgggagtgacgagcagggctgcccgcctaagacctgctcccaggacgagttccgctgccatgatggtaagtgtatttcacggcagttcgtgtgtgactccgatcgggactgcctggatggctccgacgaagccagctgccccgtgctgacatgcggtcccgcctccttccagtgtaactcatctacctgcatcccccaactgtgggcctgtgataatgaccccgattgtgaggatggatccgacgagtggcctcagcggtgtagggggttatatgtgttccaaggcgactccagcccctgtagcgcatttgagtttcattgcctgtctggagagtgcattcattcctcttggaggtgcgacggggggccagactgcaaggataagtcagatgaggagaattgtgccgttgctacttgtcgcccagacgagtttcaatgctctgatggtaactgcatccacgggtctaggcaatgcgatcgggaatacgactgcaaggatatgtctgacgaagttggttgcgtaaatgtgacattgtgcgaggggcctaacaagtttaaatgtcattcaggggagtgtattacgttggacaaagtgtgtaacatggctcgcgactgccgagactggtctgacgaaccaattaaagagtgcggcaccaacgagtgcctcgataacaatggtggctgttcgcatgtctgcaacgagctgaaaatcgggtacgagtgcctgtgccccgatggatttcagttggtggctcaacggcggtgtgaagacattgacgagtgtcaggacccagatacatgttcccagctttgcgttaacttggagggagggtacaaatgccaatgcgaagaggggttccaactcgacccccacaccaaagcgtgcaaggccgtgggttctatcgcatacctcttcttcacaaatcgtcacgaggtccgtaaaatgacccttgatcggagcgaatataccagcctcattccaaacctgcgcaacgtcgtggctctggatactgaagtcgccagcaatcgaatttattggtccgacctctctcaacggatgatctgttccacacagctggatagggctcatggggtgagctcctatgataccgtgatcagcagggacatccaagcccccgacgggctggcagtcgactggatccactccaatatctattggactgattccgtgctgggcaccgttagcgtggccgacacaaagggagtgaagcggaagaccctgtttcgcgaaaacggttctaaacccagagcgattgtggtggatcctgtgcatgggtttatgtactggaccgattggggcaccccagctaagatcaagaagggaggcttgaacggggtcgacatttattctctggtgacagagaacatccagtggccaaatggcatcaccctggacttattatctggcagactatactgggtggattccaagttgcactccatttcatcaatcgacgtcaatggtggcaatagaaagacgatcctggaggatgagaaacgcctagctcacccattcagtctggcagtctttgaggataaagtgttttggaccgatatcatcaacgaggcaattttctcagccaatcgcctcaccggaagcgatgtcaacctactggccgagaacctgttatccccagaagatatggtcctgttccacaatctcactcagcctcggggcgttaattggtgcgaaagaaccactctatcaaatgggggctgccagtatttgtgcctacccgccccgcaaatcaatccccacagtcctaaatttacctgcgcatgtccggatgggatgctcctggcccgggatatgcgtagttgccttacggaagctgaggccgcggttgcgactcaggagacctctacagtgaggctgaaggtctcgtccactgcggtcaggacgcagcacactaccacccggccagtccccgataccagccggcttcctggggcaacccctgggctgaccacagtggagatagtcactatgagccatcaggccctcggcgatgtggccggcagagggaatgagaagaagccttcttcagtgagggcgctgtccatcgtactccctatcgttctactggtattcttatgtttgggcgtgttcctcctgtggaagaactggaggctcaagaatattaattccataaattttgataatccggtttaccagaagacaaccgaggacgaggtacacatatgtcacaatcaggacggctatagctacccctctagacagatggtctccctggaggacgacgtagcg

SEQ ID NO: 16033 - DNA, 2580 bp, Artificial Sequence
  Description of Artificial Sequence: Synthetic coding sequence
atgggtccctgggggtggaagttgcgatggactgtggcccttttgttagctgccgccggcacagctgtaggcgaccgttgcgaacgcaatgagtttcagtgccaggacgggaaatgcatcagttacaagtgggtgtgcgacggttcggccgaatgtcaggacggctccgacgaatctcaggaaacctgcctatctgttacctgcaaatcaggcgatttctcttgtgggggtcgagtgaacagatgcataccgcagttctggaggtgcgacggacaggtagattgcgacaatggatcagatgagcagggctgcccaccaaaaacctgtagccaggatgagttcagatgtcacgatggtaaatgcatatcccggcagtttgtatgtgactctgatcgcgattgcctggatggctctgacgaagcaagctgccctgtgctcacctgcggtcctgccagtttccaatgtaactccagcacctgcatcccccagctgtgggcgtgcgacaacgaccctgactgtgaggatggttctgacgagtggccacagcggtgcagaggcctgtacgtattccaaggcgactcaagtccttgtagtgctttcgagttccactgcctgtccggggagtgcatccacagttcttggcgctgcgacggcgggcctgattgtaaggacaagtcagatgaggagaattgtgccgttgcaacttgtcggcctgacgaattccagtgctctgatggaaattgcattcacgggtccaggcagtgcgaccgagaatacgattgcaaagatatgtccgatgaagtagggtgtgtgaatgtaacattatgtgagggtcccaataaatttaagtgccacagtggcgagtgcattacattggacaaggtgtgcaacatggctcgcgactgtagggactggtccgacgagcccatcaaggagtgtggtaccaacgaatgcctggacaataacgggggatgttctcatgtctgtaacgagttaaagattggctacgaatgcttatgcccggatggctttcagctcgtcgctcagaggaggtgcgaagacatcgacgagtgccaggatccggatacctgctcccaactatgtgtgaatctggagggtgggtacaaatgccagtgtgaagaggggttccagctcgaccctcatactaaggcctgtaaggccgtgggcagcatagcttatcttttcttcacgaacaggcacgaggttagaaagatgacactcgataggtctgagtacacttcactgattccaaacctgcggaacgtggtggccctggatacggaggtcgcgagtaatcgcatttattggtcggacctctcgcagcgaatgatatgtagcactcagctggaccgcgctcatggtgtaagtagctatgatactgtcatctctcgggatatacaggctccggacgggctggcggttgactggatccattcaaacatttactggactgatagcgtgctgggaaccgtaagcgttgccgacacaaaaggcgtgaagcgaaaaaccttgtttagggaaaacgggagcaagccaagggccattgtcgtcgaccccgtgcacggatttatgtactggacagattggggaaccccagcgaagattaagaagggcggattgaacggcgttgatatttacagtttagtgacagagaatatccagtggccgaacggcatcacacttgacctactgagcggccgattgtattgggtcgactctaaactgcatagtatcagcagtatagacgtgaacggagggaataggaagactatccttgaggatgagaagcgactagctcaccctttcagcttggcggtgttcgaagacaaggtgttttggaccgatattataaatgaagcaatttttagtgcaaaccgactaacagggagtgacgtcaacctgctagcagaaaacctgttgtctccagaggatatggtgctttttcacaacctgacccaacctagaggcgtcaactggtgcgagcgtactacactgagtaacggtggctgtcagtatctgtgtcttcccgccccacagattaaccctcattctcccaagtttacttgtgcatgtccagatggtatgctgctagcgcgggacatgcggtcttgcttaacagaggccgaagctgcagtggcaacacaagagaccagtacagtacgcttgaaggtctcttccacggccgtacgaacgcaacacaccaccacccgtccggtcccagacactagccgtctgccaggagcaacaccagggctgaccacagtggaaatcgtgacaatgtctcaccaggccctgggggacgtcgctggccgggggaatgagaaaaaaccgagcagcgtgcgagccttgtctatagttctgcctattgtgttgctggttttcctttgcctgggcgtgtttcttctgtggaagaattggaggcttaagaatattaacagcataaatttcgacaaccccgtgtaccaaaagacgaccgaggacgaagtgcacatttgccacaatcaggatggctacagctatccttcccggcagatggtgtccctcgaggacgacgtggct

SEQ ID NO: 16034 - DNA, 2580 bp, Artificial Sequence
  Description of Artificial Sequence: Synthetic coding sequence
atggggccctgggggtggaagctcagatggaccgtggccctcctgcttgccgccgccggcactgcagttggtgatagatgcgaaaggaatgagttccagtgccaggacggcaagtgcattagctataagtgggtttgcgacggttctgcggagtgtcaggatggctcagatgagtctcaggagacttgtctctccgtgacgtgcaagagtggagacttcagctgtggtggcagagttaaccgctgcattcctcaattttggcggtgtgacggccaggtggattgtgacaacggttccgatgagcagggatgcccaccgaagacttgctcccaggacgagtttcgctgccacgacggtaaatgcatttctcggcagttcgtgtgcgactctgatcgtgactgccttgacggttccgatgaggccagctgcccagtgctcacgtgcgggcccgcttcgttccagtgtaactcctccacatgcatccctcagctctgggcgtgtgacaacgatcccgactgcgaggacggatcagacgagtggccacagcgttgccggggcctgtacgtctttcagggtgactcgtccccttgctcagccttcgagttccactgcttatcgggcgagtgcattcactcgtcgtggagatgcgacggcggacctgattgcaaggacaagtctgacgaggagaactgtgccgtggccacctgtcggcccgacgagtttcagtgtagtgatggtaactgtattcatgggagccgacagtgcgatagggaatacgactgtaaggacatgtccgacgaggtgggctgcgtgaacgtcaccctgtgtgagggccctaacaagttcaagtgtcacagtggtgagtgcatcactcttgataaggtttgcaacatggctcgggattgtcgtgattggagcgacgaacccatcaaggagtgcgggaccaacgaatgcctggacaataacggcggctgttctcatgtttgcaatgagctgaagatcggttacgaatgcctttgccccgacgggtttcagctcgtagcccagcgtcggtgcgaggacattgatgagtgtcaggacccagacacctgtagtcagctttgcgttaatcttgagggcggttacaaatgtcagtgcgaggaaggtttccagctggacccccacaccaaggcctgcaaggccgtaggtagcatcgcttacctgttctttaccaaccgccacgaggtccgcaagatgactcttgaccgtagtgaatacacgagcctgattccgaacctgagaaacgtcgtcgccttagacaccgaggtggcaagcaaccgcatctattggagcgatttgtcgcagcgcatgatttgctccacccagctcgatcgcgctcacggcgttagcagctatgatactgttatctcgcgtgacatccaggcaccggatggcctcgccgtcgactggatccacagcaacatctattggaccgattcggtcctgggtacggtctccgtcgccgataccaagggtgttaagcggaagaccctgttcagagagaacggctctaagccccgtgcgattgttgtcgacccagtccatggtttcatgtactggaccgactggggcacacccgccaagataaagaaaggcggtctaaatggtgtcgacatctactcccttgtcaccgagaatatccagtggccaaatggtataacattagacctgctcagcggtagactttactgggtggattccaagctccatagcatctcctcgatcgacgtaaacggtggcaaccgtaaaactatcttggaggatgagaagagacttgctcatccattctctctggctgtcttcgaagacaaagtgttttggacggatatcatcaacgaggcgattttctccgccaaccgcctgaccggctccgacgtcaacttgctggcagagaatctcctctcccccgaggacatggtgctctttcacaacctgacccagcctcgcggcgtcaactggtgtgagcgcaccacgttgtccaacggcggctgccagtatctttgtctgcccgctccccagatcaacccacactcacccaagttcacttgcgcttgccccgatggcatgttgctcgcccgcgatatgaggtcttgcctcacagaggccgaggcggccgttgctactcaggagacgtcgaccgtacgactgaaggttagctccacggccgtcagaacccagcacaccacgacccgcccagttcctgatacctcccgtctgccgggcgccacccccggactgaccaccgtcgaaatcgtcaccatgtcacatcaggctctcggcgatgtcgccggccgcggtaacgaaaagaaacccagcagtgtccgagctctgtccatcgtgctacccattgtcctgctcgtgttcctgtgtcttggggtctttctgttgtggaagaactggaggctgaagaacataaattcgatcaacttcgacaacccggtgtaccagaagacgactgaagatgaggtccacatctgccacaaccaggacggctactcctacccctctaggcagatggtgtccctcgaggacgacgtcgct

SEQ ID NO: 16035 - DNA, 2580 bp, Artificial Sequence
  Description of Artificial Sequence: Synthetic coding sequence
atgggcccttggggttggaagctccggtggacggtggccctgcttctcgccgcggcggggactgcggtgggcgaccgttgcgagcgaaacgagttccagtgccaggacgggaaatgtatctcctataagtgggtgtgcgacggctccgcggaatgccaggatggctcagatgaatcccaagaaacctgcctgtcggtgacgtgtaagtcgggagacttctcctgtggtggaagagtgaatagatgcattccgcagttctggcgctgtgatggtcaagtggactgtgacaacggctccgacgaacagggctgcccaccaaaaacctgctcccaagatgagttccgctgccatgacggaaagtgcatctcacggcaattcgtctgcgacagcgatagagattgcctggatgggtccgacgaagcctcctgcccggtgctcacctgcggtccggccagcttccaatgcaactcctcgacttgcatccctcagctttgggcatgcgacaatgacccggattgcgaggacgggtctgatgagtggccccagcggtgcagaggactgtacgtgttccagggcgacagttcgccatgttccgctttcgagtttcattgcctgtcaggagagtgcatccactctagctggcggtgcgacggggggcctgattgtaaggacaaatcggatgaggaaaactgcgcggtggcgacttgcaggccggacgagtttcagtgctccgacggcaattgcatccatggatcgcgccagtgcgaccgcgagtacgactgcaaggatatgagcgacgaagtcggatgtgtcaatgtgactctgtgtgaaggaccaaacaagtttaagtgccactccggagaatgcatcaccctcgacaaggtctgcaacatggctcgcgattgccgagattggtcggacgagccgatcaaggaatgtggtaccaacgagtgtctggacaataacggcgggtgctcacacgtttgcaacgaactgaagatcggatatgagtgtctttgtcctgatggctttcagttggtggctcaacgccggtgcgaggacatcgacgaatgtcaagatccagacacctgttcacaattgtgcgtcaatctcgagggagggtacaagtgccagtgcgaagaaggattccagttggatccgcatacgaaggcctgtaaagccgtgggatccatagcttatctgttcttcaccaaccgacacgaggtcagaaagatgaccctggacagatcggaatacacctcgctcatcccgaacctgcgcaatgtggtggcgcttgacactgaagtggcatccaaccggatctattggtcagacctctctcagaggatgatctgctccactcagctggaccgcgcgcatggagtctcatcatacgataccgtgatctcgcgcgatatccaggcaccggacggcctcgccgtcgattggatccacagcaacatttactggactgattccgtgcttggcaccgtgtccgtggcggacactaaaggagtgaagcgcaagacgttgttccgggagaacgggtcaaagccgcgagcaattgttgtcgatccggtgcacggatttatgtactggaccgactggggcactccagcaaaaatcaagaagggcggactgaacggtgtggacatctactccctggtgaccgaaaacattcaatggccgaacggcattaccctcgacctcctttccggtcggctgtactgggttgattccaaactccattcaatttctagcatcgacgtgaacggaggaaatagaaagacgatcctggaggacgaaaagagactcgcgcacccgttctcactggccgtgtttgaggacaaagtgttctggactgacatcatcaatgaggccatcttctccgcaaaccgcctgaccggcagcgacgtgaacctgctggccgaaaacttgctgagcccagaggatatggtgctgttccataatcttacccagccaaggggggtgaactggtgcgaaagaaccacgctctcgaatggcggatgtcagtacctgtgcctgccagcaccgcagataaacccgcattccccgaagtttacctgcgcgtgcccggatgggatgctgctcgcgcgggacatgaggagctgtctgactgaggcggaagccgccgtggcaacccaggaaacctctactgtgcgcctgaaggtgtcgtccaccgcggtgcgcacccaacataccaccactcgccctgtcccagatacttcacgcctgcccggcgccaccccgggcttgaccactgtggagattgtgactatgtcgcaccaagccctgggtgatgtggctgggcgcggaaacgaaaagaagccaagctcggtgagggccctctcgattgtgctgccaatcgtcctgctcgtgttcctgtgcctgggtgtgttcctcctttggaagaactggcggttgaagaacatcaacagcatcaatttcgacaatccagtgtaccaaaaaaccactgaggacgaagtgcatatctgccacaaccaagatggctacagctacccaagccggcagatggtgtcgcttgaggacgacgtggcc

SEQ ID NO: 16036 - DNA, 2580 bp, Artificial Sequence
  Description of Artificial Sequence: Synthetic coding sequence
atgggtccgtggggttggaagctgcggtggactgtggcattgctcctggctgcggcgggaactgcagtgggggatcgctgcgagcggaacgagttccagtgccaggacggaaagtgcatctcctataagtgggtgtgcgatggctcagccgagtgtcaagacggtagcgacgaatcgcaagagacttgcttgtcggtgacgtgcaaatcaggggatttctcgtgcggaggacgggttaaccgctgcatccctcagttttggaggtgtgatggacaggtggattgcgacaatggaagcgacgagcagggttgtccgccgaaaacctgttcccaggacgagttcagatgtcatgatgggaagtgcatctcgcggcaatttgtgtgtgatagcgaccgcgactgcctcgatggatcagacgaggcgtcgtgcccggtcctcacgtgtggcccggcctcctttcaatgtaacagctcgacctgtattccccaactctgggcgtgcgacaatgacccggattgcgaggacggctctgacgagtggccgcaacgctgcaggggactgtatgtgtttcaaggggatagctccccgtgctcggcattcgaatttcactgcctcagcggggaatgcatacactcatcctggcgctgcgacggaggccctgactgcaaagacaagtccgacgaagaaaattgcgcagtggccacgtgccgcccggatgaatttcagtgctcggacgggaactgcatccacggatcacgccagtgtgaccgcgaatacgattgcaaggatatgtcggacgaagtgggatgcgtgaacgtgactctctgtgagggaccaaacaagtttaagtgccattcaggcgagtgtatcactctggacaaggtgtgcaacatggccagagattgccgggattggtcggatgaacccatcaaggagtgtgggactaacgagtgcctggataacaatggagggtgctctcacgtgtgcaacgaactgaaaatcggatacgaatgcctgtgcccggatggtttccagctggtggctcaacggcgttgcgaggatattgacgaatgtcaggacccggacacctgtagccagctgtgcgtgaacctggaaggcggatacaagtgccaatgtgaggaaggcttccaattggaccctcataccaaggcctgtaaagcagtcggttcaatcgcttacctcttcttcactaatagacacgaagtgcgcaagatgaccctggataggtcggaatacacttcgctcatccctaatctgcggaatgtggtcgcactggataccgaagtggcttcaaaccgcatctactggtcagacctctcgcagcgcatgatctgctctactcaactcgacagggctcacggtgtgtcatcctacgacaccgtgatctcccgcgatatccaggcaccagatggactggctgttgattggatccacagcaacatctattggactgacagcgtgctcggaactgtgtcggtcgcagacaccaaaggggttaagcgcaaaaccctgtttcgcgaaaatggctcaaagccacgggccatcgtggtcgatccggtgcacggattcatgtactggactgattggggaacccccgctaaaatcaagaaggggggacttaacggagtggacatctattccctcgtgaccgaaaacatacaatggcccaatggaattaccctggacctcctctctggacgcctctactgggtggattccaaactgcactcgatctcatcaatcgatgtcaatggaggaaacagaaagaccatcctggaggacgaaaaaaggctggcacacccgttctcgctggccgtctttgaggacaaagtattttggaccgacatcattaacgaggccatcttctcggcgaatcggctgactggctccgacgtgaacctcctggcagaaaatctgctttcgcccgaggacatggtcctctttcataacctgactcagccgaggggcgtgaactggtgcgaacggaccactctttcaaatggcggttgccagtacctgtgccttccggctcctcagataaatccgcacagcccaaagttcacttgtgcctgccctgacggcatgctcttggctcgcgatatgcgctcatgtctgacggaggcagaagccgcggtggccacgcaggaaacctctactgtccggctcaaggtgtcgtcaaccgctgtccggactcagcacactactacccgcccggtgccggataccagccggctcccaggagcgacccctggacttaccaccgtggaaatcgtgactatgtcccaccaggcccttggagacgtggcgggcagagggaacgagaaaaaaccgtcgtccgtccgcgcgttgagcattgtgctcccaatcgtgctgctcgtgtttttgtgcctcggagtgttcctgctgtggaagaattggcggcttaagaacatcaactccatcaacttcgacaaccccgtctaccagaaaactacggaggacgaggtgcatatttgccacaaccaggatggctactcctacccttcgcggcagatggtcagcctggaagatgatgtcgcg

SEQ ID NO: 16037 - DNA, 2580 bp, Artificial Sequence
  Description of Artificial Sequence: Synthetic coding sequence
atgggtccctggggttggaaattgcgctggaccgtggccttactccttgccgctgcagggacagccgtgggagatcggtgtgaaaggaacgaatttcaatgtcaggatggcaaatgtatcagttacaaatgggtttgtgatggatccgcagagtgccaggatggaagcgatgagagccaagagacatgcctgtctgtcacatgtaagagcggcgattttagctgtgggggccgtgtaaacaggtgcatcccacaattctggagatgcgatggacaagtggattgcgataatggcagcgatgaacaggggtgtcccccaaagacgtgttcacaggatgagtttcgatgccacgatggcaaatgtattagcagacagttcgtttgtgacagcgaccgcgactgcctcgacggaagcgacgaggcctcctgtcctgtgctcacctgcggccccgctagcttccagtgtaatagctccacctgcatcccacagctgtgggcttgtgacaacgatcctgactgcgaagacggtagcgatgaatggccccaaagatgtagaggactatatgtgtttcagggagatagtagcccatgttccgcgttcgaatttcattgcctgtccggcgagtgcattcactctagctggagatgcgacggcggccctgactgcaaggataagtctgacgaagaaaactgtgctgtggccacctgccggccagatgagttccagtgtagcgatggcaactgcatccacggttctcgtcaatgcgatagagagtacgactgcaaagatatgtctgacgaagtcgggtgcgttaacgtgaccctttgtgaaggaccaaataagtttaagtgtcactcaggcgagtgtatcactctggataaggtgtgcaacatggccagggactgcagggattggagcgacgaaccaattaaagaatgcggcaccaacgaatgcctggacaacaacggaggttgttcccacgtgtgcaacgagcttaaaatcggctatgaatgcctgtgcccagatggattccagctagttgctcagaggagatgtgaggacattgatgagtgccaggaccctgacacatgttcacaactttgtgtcaacctggaaggcggctacaaatgtcaatgtgaggaagggttccagctcgacccccacactaaggcttgtaaggcggttggctctatagcatacttgttcttcacaaatagacacgaagtacggaaaatgaccctcgaccgctcagagtatacctctctcatccctaatctgcgcaacgtcgtggcattggacactgaagttgcctccaatcgcatctattggagcgacctatcgcagagaatgatttgttcaacacagctggatcgcgctcacggagtgtccagctacgacacggtcatctctagggacatacaggcacccgatggactcgcggtcgattggatacactcaaacatctactggacggattctgtcctcggaacagtgagcgtggcagataccaaaggggtgaagaggaagacattattcagggagaacggatctaagccgagagctatcgtagtggatccagtccatgggttcatgtactggacagactgggggacccccgccaaaatcaaaaagggcgggctcaacggcgtggacatctatagcttggttactgagaatatccagtggcccaatggaataactcttgatctcctgagcggacggctctattgggtagacagcaaattgcattcaataagctccatagatgtcaacggaggaaaccgcaaaaccatactggaggacgaaaagcgcctggcacatccattttcgctggccgtgtttgaggacaaggtgttctggacagatatcatcaacgaagccatattcagtgcgaacaggttgacaggatccgatgttaacctgctggctgaaaacctgttgagcccagaggatatggtgctgtttcataacctgacccagcccaggggagtgaactggtgcgaacggactaccctgtcaaatgggggttgtcaatacctgtgcctgcctgctccccagataaaccctcacagcccaaagtttacctgcgcctgcccggacggaatgctcctcgctagggacatgaggtcctgcttaacagaagcggaggccgcagtggctacccaggagacatccactgtccgattgaaggtgagctccacagctgtccgcacccaacataccactacccgcccagtacccgatacctccaggcttccaggagccaccccaggactgacaaccgtcgagattgttaccatgagccatcaggcactgggcgacgtagctggacgaggaaacgaaaaaaagcctagcagcgtcagagcattatcaattgtgctgcccatcgttttactggtgttcctctgtctcggagtctttctactgtggaagaactggcggctcaagaatatcaactctattaacttcgataacccagtgtaccagaaaactaccgaggatgaagtgcatatttgccataaccaggacgggtactcctatccttcccgacaaatggtctcactggaggatgacgtggca

SEQ ID NO: 16038 - DNA, 2580 bp, Artificial Sequence
  Description of Artificial Sequence: Synthetic coding sequence
atggggccatgggggtggaagctgcgttggacagtggccttgctcctcgctgcggcgggcaccgctgtcggtgataggtgcgaacgaaatgagttccaatgtcaggatggaaagtgtatttcttacaagtgggtgtgcgacgggtctgctgagtgccaggacggttccgacgaaagtcaggaaacttgtttgagtgtgacttgtaagagtggggacttcagctgcgggggacgagtaaataggtgcatcccacaattctggagatgcgacggacaagtggactgcgataacggatccgacgaacagggatgtcccccaaagacatgctctcaggatgagtttcgttgtcatgacggaaagtgcatcagccggcaatttgtttgcgactccgatcgcgactgcctagatgggagcgatgaggccagctgcccagtgctgacatgcggtcctgcctcttttcagtgtaattcttcaacatgcattccacaactgtgggcgtgtgacaatgaccccgactgcgaagacgggtcagatgagtggccccagcgctgccgcggactctacgtgtttcaaggtgattctagcccatgcagcgcgtttgaattccactgcctcagcggggaatgcatccatagttcctggcggtgtgacggcgggccagattgcaaagataagagcgacgaggaaaactgcgcggtggcaacgtgccgcccagatgagttccagtgcagcgatggtaactgcattcacggctccaggcagtgcgatcgcgagtatgattgcaaagacatgtcagacgaggtcggctgtgttaacgtgactctgtgcgaaggacccaataaattcaaatgccacagcggagagtgtataactctcgacaaggtatgcaatatggcgagggactgtagggactggagcgatgagcctataaaggaatgtggcaccaatgaatgtctcgataataatgggggctgctcacacgtatgcaacgaattgaaaatcggatatgaatgcctctgtccggatggattccaactcgtcgcccaaagacgctgcgaggatattgacgagtgccaagacccagacacgtgctcacagctctgcgtcaatttagagggcggctataagtgccagtgcgaggaggggttccaactcgatccccacaccaaagcctgcaaagctgtgggaagcattgcatacttgttctttacgaatcgacacgaggtcagaaagatgactttagacagatcagagtacacctccctgattcctaacctgaggaatgttgtggcgctcgacactgaggtcgcatccaaccgaatctattggagcgatctgtcccaacgtatgatttgttctactcagctcgatcgagcccacggggtcagcagttacgacacagtgatatcccgggacatccaagctcccgatggactggccgtggattggatccattcgaacatctactggactgatagtgtccttggaacagtgtcagtggcggacaccaagggcgtgaagaggaaaacactatttcgagaaaacggtagtaaacctcgagccatagtggtcgacccggtccacggatttatgtattggaccgactggggcactccggccaagataaaaaaaggcggcctgaatggggtggatatctactcgcttgtgactgagaacatccagtggcccaatgggataaccctagacttacttagtggcaggctatactgggtggatagtaagctgcactcgatttcaagcatcgacgtcaacgggggaaaccgaaagacaatcctggaggacgaaaaacggcttgcgcaccccttttctttagcagtgttcgaggataaggtcttctggaccgatatcatcaacgaagcgatcttcagcgcaaaccgattgacaggttcggatgtaaacttgcttgcagagaatctgctaagtccagaagatatggtgctgtttcacaacttgacccagcctcggggcgtgaactggtgtgagaggaccaccctgtctaatggtggatgtcagtacctgtgcttgccggcccctcagattaatccacattccccaaagtttacctgcgcctgcccggacggaatgctcctggcgagagacatgcggagctgcttaacagaagctgaagcggccgtagcaacgcaggagactagtacggtccggctaaaagtgtcctctacagctgtgcgcacccagcacactactacccgcccagtgcccgatacatccaggctgccaggcgcaacaccaggattaactacggtggagatcgtgacaatgtctcaccaggcgctgggtgacgtggccggaaggggtaatgaaaaaaaacctagctctgtcagagccctgagtatagtacttccaatagttctgctggtctttttatgcctgggtgtgttcctgctgtggaaaaattggcgccttaaaaacattaatagcatcaacttcgacaaccctgtttatcagaaaactaccgaagatgaagttcatatctgccacaaccaggacgggtatagctaccccagccgccagatggtgagcctggaggacgacgtggcc

SEQ ID NO: 16039 - DNA, 2580 bp, Artificial Sequence
  Description of Artificial Sequence: Synthetic coding sequence
atgggaccctggggctggaaactcagatggaccgttgccctactgctggccgccgctgggactgctgttggagatagatgcgaacggaatgagtttcaatgccaggacggtaaatgcatctcatacaaatgggtgtgtgacggatccgccgagtgccaggatgggagcgatgaatcccaagaaacctgcctgtccgtgacctgtaaaagcggggatttctcatgcggaggaagggttaatcggtgcatcccacagttctggcgctgcgacggtcaggtggattgcgacaacggtagtgatgaacagggatgccctcctaagacatgctcacaggatgagtttaggtgccatgatggtaaatgtatttctcggcagttcgtttgtgactcagaccgggactgtctcgatggatcagatgaagcctcctgtcctgtgctgacctgcggcccggcatcgtttcagtgtaatagtagtacctgcattccccagttgtgggcctgcgacaacgatcccgactgcgaggatggcagtgatgagtggcctcagcgctgccgtggactttatgtgttccagggagacagttctccatgctcagcctttgagtttcattgtctatctggcgaatgtattcactcctcatggagatgtgatggcggcccggattgcaaggataagtccgacgaagaaaactgcgctgtagccacatgtagacccgatgagtttcaatgctcggacggcaattgcattcatggatcccgtcagtgcgatagagagtatgactgtaaggacatgtcggatgaagtcgggtgtgttaatgttacgttgtgcgagggcccaaacaaattcaaatgtcatagtggcgaatgcattacactcgacaaggtgtgcaatatggctagggactgtagagactggtccgacgagccaatcaaggagtgcggaaccaacgagtgtctcgacaataatggcggatgttcacatgtttgtaacgaactcaagattggctacgagtgcctttgccctgacggttttcagctcgttgcgcagagacgctgcgaagatatcgacgaatgtcaggacccggatacctgtagccaactgtgcgtcaacttagaaggaggctacaagtgccagtgtgaagagggtttccagttggatccgcacactaaagcctgcaaggcagtcggttccatcgcatacttgttctttacaaaccgtcacgaagtacgcaaaatgactcttgaccgctccgagtacacctcactgatccctaatctacgcaacgttgttgctttggacaccgaagtggcctctaaccgcatctactggtcagatctatcccaacgtatgatctgtagcacacagctcgacagggctcacggagtgagctcctacgataccgtgatcagccgagatatacaggcccccgacggtctggctgtggactggatccactccaacatttactggactgactctgtgctcgggaccgtgtccgtcgctgacactaaaggagtcaagcggaagacactgtttcgggagaacggaagcaagcctcgagcgatcgtggtcgatcccgttcatggctttatgtattggaccgactgggggactcctgcaaaaattaaaaagggaggacttaatggcgttgatatatactctcttgtcactgagaacatccaatggcctaatggtataacgctggacctattgagtggtaggctctattgggtcgattctaagctgcactctataagtagcatcgacgtgaatgggggtaatcggaagaccatcctagaagacgagaagagattggctcacccgtttagtctggccgtgttcgaggataaagtgttctggactgacattattaacgaagccattttctcggccaatcggctgactggttctgatgtgaacctgctcgcagagaacctcttgtccccagaagacatggtactgtttcacaacttaacccagccgagaggggtgaactggtgtgaacgaaccacattgtctaatggcggctgtcagtacttgtgcctgccagcgccccagatcaacccacacagtccaaaattcacttgcgcgtgcccagacgggatgcttctcgcccgggatatgaggagctgcctcaccgaagctgaggctgccgtggcaacacaagagactagcactgtacgcctgaaagtctcgtcaacagccgttcgaacacagcacacgactaccaggccagtgcctgacacatcacggcttccaggggctacaccgggacttaccaccgtggagattgtcaccatgagccaccaggccttgggagacgtggccgggcgcggaaacgagaaaaagccatcttccgtgcgggctttatctatagtgttgccaatcgtcttgttggtctttctctgccttggcgtcttcctgctttggaaaaattggaggctgaagaatattaacagtatcaactttgacaatccggtataccaaaaaaccactgaagatgaagtgcatatttgtcataaccaggacggctatagttatccaagccggcagatggtgtctctggaggacgatgtcgca

SEQ ID NO: 16040 - DNA, 2580 bp, Artificial Sequence
  Description of Artificial Sequence: Synthetic coding sequence
atgggaccctgggggtggaagctgcgctggacagtggcactgcttttggcagccgctggaactgctgtgggagataggtgtgagagaaacgaatttcagtgccaagatggaaagtgcatcagttataagtgggtttgtgacggcagcgcggaatgccaggatggcagtgacgagtcgcaggaaacttgtttgagcgtgacctgcaagagtggcgacttttcttgcgggggtcgggtcaaccgatgtatccctcagttctggaggtgcgatggtcaggtggactgtgacaacggttcagacgaacagggatgcccccccaaaacctgctcccaggatgagttccgctgtcacgacgggaaatgtataagcaggcagttcgtctgtgactccgatcgggattgcctggatgggtcggacgaggcctcatgccccgtgctcacgtgcggtccagcctcttttcaatgtaacagcagcacatgtattccccagttgtgggcttgtgacaatgatccagactgcgaagacggatctgatgagtggccgcagagatgtcgaggattgtacgtttttcagggcgattcttcaccatgcagcgcctttgaattccactgcttgtctggggagtgcatccattcctcttggcgatgcgacgggggccctgattgcaaggataaaagcgatgaggagaattgcgccgtggcaacctgcaggcccgatgaatttcaatgctcagacggcaattgtatccatggcagcagacagtgcgaccgagagtatgattgtaaagacatgtccgacgaggttggctgtgttaacgtgacactgtgcgagggccccaataaattcaagtgtcacagcggggaatgtattactctggataaggtgtgcaatatggctagggactgcagggactggagtgatgaaccaataaaggagtgtggcactaatgagtgcctagataataacggcggttgcagtcatgtgtgcaacgagctcaaaatcggctacgagtgcctgtgcccagacggattccagctggtggctcagcggagatgtgaggatatcgatgagtgccaggatccagacacatgcagccagctgtgcgttaacctggagggcggatacaagtgccagtgcgaggagggttttcagctagatccccacacgaaagcgtgtaaggcggttggttccattgcctacctcttcttcacgaaccgtcatgaggtgagaaaaatgacacttgacagatctgagtacacctccctcattccaaacctgaggaacgttgtcgctctggataccgaagtcgccagcaacagaatttactggtcagacctgtcccagcgcatgatatgctccacccaactggacagggctcatggagtttccagctacgacacagtaatctctagggatatccaggcccccgacgggctcgcagtggactggattcactccaacatctactggacagacagcgtactgggcaccgtttcagtggccgacaccaagggagttaagcggaagactttgttcagggaaaacggaagtaagcctagagcgatcgtcgttgacccagtccatggctttatgtactggaccgattgggggactccggcaaagatcaagaaggggggtctgaatggcgtggacatctacagcctggttacagaaaatatccagtggccaaacggcatcacccttgatctgctgtcaggtcgactctattgggtggattcaaaactacattccatttcaagcatcgatgtcaacggggggaacagaaaaactatcctagaggacgaaaagcgactcgcacatcccttcagcctagcagtcttcgaagacaaagtattctggactgacatcatcaacgaagccattttctcggccaacaggctgaccgggtcagacgtgaatctgttggccgagaatctactgagtccagaagatatggtgttattccacaatctaacccaacccagaggggtgaactggtgtgagcgtacaaccctcagcaacggcggttgtcagtacctgtgcctgcctgccccacagatcaacccccactcccccaagttcacttgcgcgtgcccagacgggatgctcctggctcgcgatatgcgctcttgtcttacagaagccgaagccgctgtagctactcaggaaacctccaccgtccgcctgaaagttagcagcactgccgtgaggacccagcacacgacaactagaccggtgcccgacacaagcagactcccaggggctacccccggtttaaccacggtagagatcgtgacaatgtcacatcaggctcttggggatgtggccgggcgcggcaacgaaaagaagcctagtagcgtgagagctctgtccattgtgctgcctatcgttctgctagtgttcctgtgtttaggcgtgtttttgctctggaagaactggcgtctgaagaacataaactccattaacttcgacaaccccgtctatcagaagaccaccgaggatgaagtccacatctgtcacaaccaggatggctactcctaccctagtaggcaaatggttagcttggaggatgacgtggca

SEQ ID NO: 16041 - DNA, 2580 bp, Artificial Sequence
  Description of Artificial Sequence: Synthetic coding sequence
atggggccctgggggtggaaactgaggtggactgtggcactccttctggcagccgctgggactgctgtgggagatcggtgtgaacgcaatgaattccagtgtcaggatgggaagtgcatctcttataaatgggtttgcgatgggtccgccgagtgccaggatgggtctgatgaatcccaggagacatgtctctccgtcacatgcaaaagtggggatttctcgtgcgggggaagggtgaaccggtgcatcccccagttttggcggtgtgacggacaggtcgattgcgataacgggtccgatgagcaggggtgcccacctaagacatgctcgcaggatgaattccggtgccatgatggaaaatgtatatctcgccagtttgtatgtgacagtgatagggattgtctggatgggagtgatgaagcatcttgtcccgtgctaacatgtggaccagcaagttttcagtgcaatagttctacttgtatacctcagctctgggcttgtgataatgatcccgattgcgaagatgggtcagatgaatggcctcagaggtgcagagggttatatgtctttcagggagattcatctccctgctctgccttcgaatttcactgcttatccggggaatgtatccacagttcttggcgctgtgatggagggccggactgtaaagataaaagtgatgaggagaattgcgcggttgctacatgccggcccgatgaatttcagtgttccgatgggaattgcatccacggaagtagacagtgtgatagggagtatgactgtaaagatatgagtgatgaggtgggatgcgttaacgtaacactctgcgagggacctaataaattcaagtgtcattcaggagaatgcatcacactcgacaaggtgtgtaacatggctagagattgtagagattggtcagatgaacccatcaaagaatgtgggactaacgaatgcctcgataataacggggggtgttctcatgtttgtaatgaactcaaaataggatatgaatgcctgtgtcccgatgggtttcagttagtggcccagcgccgatgcgaggatattgatgaatgtcaggatcctgatacttgcagtcagctgtgtgtaaatctcgaggggggatataaatgccagtgcgaagaagggtttcagctggatccccacactaaagcttgcaaagctgtgggatctatagcctacctattttttacaaatcggcatgaagtgaggaagatgacactggatagatctgaatatacatctctcatcccaaacctacgcaatgtggtggccctggatactgaagtggcctcaaaccgaatctattggagtgacttaagtcagcgaatgatatgctcaactcagctggatagagcccatggagtttcaagttatgatacagtgatatctcgagatatacaggcccccgatggactagctgtggattggatacattcaaacatatactggacagattcagtcttgggaactgtgagtgtggctgatactaaaggggttaaacgcaaaacactgtttagagaaaacgggtctaaaccccgggccattgttgtcgatcctgtccatgggttcatgtattggactgattggggaactcctgcaaaaatcaaaaaagggggactcaacggagttgatatctacagtctcgtcacagaaaatatacagtggccaaacgggattacactagatttattgtccggaagactatattgggtcgatagtaaactgcactcaatttcttctatagatgttaatggggggaacaggaaaacaatacttgaagacgaaaaacggctcgcccacccattctccttggctgtgttcgaagataaagtgttctggactgatattataaacgaggccatattttcggcaaacagactcactggatcagacgttaacctcctggctgaaaacctgctctcccccgaggatatggttcttttccataatcttactcagccaaggggggtcaattggtgtgagcggactactctcagtaatggggggtgtcagtatctctgcttacccgcaccccagattaacccacacagtccaaagttcacatgtgcctgcccagatggaatgttattagcccgcgacatgcggagttgcctcacagaagccgaggccgctgtggccactcaggaaactagtacagtgcgccttaaggtgagtagtacagcagtgcggacacagcacacaacaactaggccagttcctgatacatctcgccttccaggagccactcccgggcttacgactgtcgaaattgttacaatgtctcaccaagcacttggagacgtggccggacgaggaaacgagaaaaaacctagttccgtgcgcgctctttccatagtgctaccaatagtattactcgtcttcctatgcctcggagtatttcttctctggaaaaactggaggcttaaaaacataaactcaatcaatttcgataatcccgtttatcagaaaacgacggaagatgaggtccatatctgtcacaaccaggatggatattcttatccttccaggcagatggtgtctttagaggacgatgtggca

SEQ ID NO: 16042 - DNA, 2580 bp, Artificial Sequence
  Description of Artificial Sequence: Synthetic coding sequence
atggggccttggggttggaagctcaggtggactgtggctcttcttcttgcagcggcagggacggctgtgggcgaccgctgcgaacggaacgaatttcaatgccaagatggaaagtgtatttcctacaagtgggtgtgtgatgggtctgcagaatgtcaagacggttcagatgaatcacaggaaacctgtctgtcagtgacttgtaagtctggagactttagctgtggtggacgtgtcaacaggtgcattccccagttctggcggtgtgacgggcaagtggattgcgataacgggtcagacgagcaaggatgccctccaaagacgtgttcgcaagacgaatttcgttgccatgacggaaaatgtatcagccgccaattcgtctgtgactccgatcgggattgtctcgatggatcggacgaagcatcatgtccagtgcttacttgtggccccgcttcctttcaatgtaacagctcgacctgtatccctcagctttgggcgtgcgacaacgatccagactgtgaagatggttccgacgagtggccccaacggtgtcgaggcctctacgtgtttcaaggagattccagcccgtgctccgcatttgagttccactgtctctcgggggagtgtattcattcgtcatggaggtgtgatgggggtccagattgtaaggataagtcggacgaagaaaattgtgccgtcgcaacctgtcgccctgatgaatttcagtgttcggatggtaactgcattcacggtagccggcagtgtgacagagagtacgattgcaaggacatgtcggatgaggtgggttgtgtgaacgtgactctgtgtgaaggcccaaacaagtttaagtgtcattcaggggaatgtattaccctggacaaggtgtgtaacatggccagagactgccgagattggtccgatgaaccgattaaagaatgcgggaccaatgagtgcctcgataacaatggaggttgtagccacgtgtgcaacgaactcaagataggatacgaatgcctgtgtcctgatggtttccaactcgtggcgcagcgacgctgcgaagatattgatgaatgccaggaccccgatacctgctcccaactgtgtgtcaacctggaaggaggatacaagtgccaatgcgaggagggtttccagctggatcctcacactaaggcatgtaaggccgtgggttccatcgcatacctgttctttacgaatcgacatgaagtgaggaagatgactcttgataggtcggaatacacctctctgattccaaatcttcgcaacgtggtggcgctggatactgaagttgcatccaatcgcatttactggtcggatctgtcgcaaaggatgatttgttctacgcagctggacagagcgcatggagtgtcatcgtacgatacggtgatcagccgtgatatccaggctcctgatggccttgctgtggattggatccattcgaacatttactggaccgatagcgtgcttggcaccgtcagcgtggcagatactaagggtgtaaagcgcaagaccctgtttagggaaaatggatccaagcctagagcaatcgtcgtcgacccagtccatggttttatgtactggactgattggggaacgccagcaaagatcaagaaagggggacttaatggcgtggacatttactcattggtcactgaaaacatccagtggcccaacggaatcaccctggacttgttgtctggtagactgtactgggtggactcgaaactgcatagcatttcctcaattgatgtgaacggaggaaatcggaaaactatcctggaggacgagaagaggcttgcacaccccttttccctggcagtgtttgaagataaggtgttctggaccgatatcattaacgaggcgatattctcagcaaacagactgactggaagcgacgtgaatcttctggctgagaatctcctgtcccccgaagatatggtgctgtttcataacttgacccagccaaggggcgtcaactggtgcgaaagaaccaccctctcaaacggtggttgtcaatacctgtgtttgccagcaccccagattaaccctcactcaccaaaattcacctgcgcatgtccagatggcatgctccttgcaagagatatgagatcctgtctcaccgaggccgaagccgcagtcgcaacccaagagactagcactgtgcgtctcaaggtgagctcgactgccgttcggactcaacatacgaccactaggccggtacctgatacctccaggctccccggagcaactcctggccttactaccgtggaaattgtgaccatgtcacatcaagcgctcggagatgtcgccggcagaggtaatgaaaagaaaccttcgtcagtgcgtgccttgtcgatagtactgccgatagtgctgttggttttcctgtgtctcggagtctttctgctttggaagaactggaggctcaagaacatcaactccattaacttcgacaaccctgtgtaccaaaagaccactgaggacgaagtgcacatatgccacaatcaggacgggtactcttacccatcgcgccaaatggtgtcgcttgaagatgatgtcgcc

SEQ ID NO: 16043 - DNA, 2580 bp, Artificial Sequence
  Description of Artificial Sequence: Synthetic coding sequence
atggggccttggggatggaaactgagatggaccgttgctctgctgttagccgccgctggtaccgcagttggagacaggtgcgaacgcaatgagtttcagtgccaagacgggaaatgcatctcctataagtgggtctgtgacggatctgctgagtgccaggatgggagcgacgagtctcaggaaacatgtctgtctgtaacctgcaagtccggtgacttcagctgcggcggccgggtaaatcggtgtatcccacaattttggcgctgtgacggccaggtggattgtgacaacggatctgatgaacagggatgcccccctaagacctgctcacaggacgaattcagatgtcacgatggtaaatgcatttcaagacaatttgtgtgtgactctgacagagactgcctggatggtagcgatgaggcaagctgccccgtgttgacttgcggaccagcttcttttcaatgcaactcaagtacatgtattccccagctttgggcctgcgacaatgaccctgattgcgaggatggtagtgatgagtggccacagaggtgcaggggtttatatgtgttccagggtgatagttcaccttgctctgccttcgagtttcactgtctgagcggtgagtgtatacattcctcctggcgctgcgacggagggcccgactgcaaggataaatccgacgaggagaactgcgccgtggccacgtgtaggcctgacgaattccaatgctccgacggtaattgtatccacggatctcgtcagtgtgaccgcgaatatgactgcaaagatatgtccgatgaagttggctgcgttaacgtaactctctgcgaggggcctaacaagtttaagtgtcattccggcgagtgtatcacgctggacaaggtgtgtaatatggcgcgtgactgcagagattggtccgacgaacctattaaggaatgcggcacaaatgagtgtctcgacaataacgggggatgcagccatgtctgcaatgagctcaagatcggctacgagtgcctgtgcccggacggctttcagctggtcgcccaacgaagatgcgaggacattgatgagtgccaggacccagacacatgttcacaactgtgtgtaaatctggaggggggatacaaatgtcagtgcgaagaaggatttcaactagacccacataccaaggcctgcaaggcggtaggatccatagcctacctgtttttcactaaccgacacgaggtgagaaagatgactcttgacagaagtgaatacacctctctgatcccaaacctgcgaaatgtcgtggctctggacactgaagtcgcctccaatcgcatctactggtcagatctgtctcagaggatgatatgttccacccagctggacagggctcacggagtgtccagttacgacacagtgatttcccgagatatccaggctcctgacggactggccgtggactggattcactcaaatatctactggacggatagtgtgctgggcactgtgtctgtcgcggacacgaagggggtcaagcgcaagacgcttttccgtgagaatgggtccaaaccccgcgcaatcgtcgtcgacccagttcatggttttatgtattggacagattggggtacccccgcaaagattaaaaaaggcggcctcaacggggtcgatatctatagcctcgtgaccgagaacatccagtggcctaatggcattacactcgacctgcttagcggacgactgtattgggtggactctaaacttcactccatcagcagcatcgatgttaacggaggcaaccgcaagacgatcttagaggatgaaaagaggctcgcccaccctttctccctagccgtgtttgaagacaaggtgttttggactgacatcataaacgaggctatctttagtgcaaacaggttgacggggagcgatgtgaatttgctcgccgagaaccttctcagtcccgaggacatggtcctgttccataacttgacccaaccaaggggagtcaactggtgtgaaagaaccacgttaagcaacggagggtgccagtacctgtgtttgccagccccacaaatcaatcctcattcaccgaagttcacctgcgcctgtcccgatgggatgctcctggcgcgggacatgagaagttgtctgaccgaagccgaggcggccgtcgccacacaagagacttctactgtccgcctgaaggttagttccaccgctgtgcggacacagcacaccacaaccagaccagtgccagacacttcccgcctccctggcgccacacctgggctgactaccgtagaaatcgtaactatgtcccatcaagccctcggagacgtcgctggtcgggggaatgaaaagaagccctcgtctgtgagggcgctgtccattgtcctgccgatagtgctgttggttttcctctgccttggggtgttcctactttggaagaactggcggctcaagaatattaatagcatcaatttcgataatccggtgtaccagaagaccaccgaggacgaggtgcacatttgccacaaccaggacggctactcttacccctccaggcaaatggtgtccctggaggatgacgtcgca

SEQ ID NO: 16044 - DNA, 2580 bp, Artificial Sequence
  Description of Artificial Sequence: Synthetic coding sequence
atgggtccgtggggatggaagctcaggtggaccgtcgccctgctcctggctgccgcgggaacggcggtcggagacaggtgcgagcggaacgaattccaatgccaagacggcaagtgcattagctacaagtgggtctgcgacggaagcgccgaatgtcaggatggctccgacgaaagccaggaaacctgcctgtccgtgacttgtaaatccggtgacttctcctgcggcggaagggtgaaccggtgtatcccgcagttttggcggtgtgatgggcaggtcgactgtgataacggatccgatgagcagggttgccctccaaagacttgctcacaggacgagttcaggtgccacgatggaaaatgcatctcccgccagttcgtatgcgatagcgacagagactgtctcgacggctcggatgaggcaagctgcccagtccttacctgcggtccagcgtcgttccaatgcaactcctccacctgcatcccccagctttgggcatgcgacaacgaccccgattgcgaggatggatcggatgaatggccgcagcgctgtcgggggctctacgtctttcagggggactcatcgccgtgctccgccttcgaatttcattgtctgtcgggcgaatgcattcattcgtcctggcgctgcgatggaggaccagactgcaaggacaagtcagacgaggaaaattgcgccgtggcgacgtgccgccctgatgagttccaatgttcggacggtaactgcatccacggctcccggcagtgcgatcgcgaatacgattgcaaagacatgagcgacgaggtcgggtgtgtcaacgtgaccctgtgcgagggaccgaataagttcaaatgccactccggtgagtgcataactctcgataaggtgtgcaatatggcccgcgactgcagggactggagcgacgaaccgatcaaggaatgtgggaccaacgagtgtctcgataacaacggaggctgtagccacgtgtgcaatgacttgaagatcggatacgagtgcgattgtcctgatggatttcagctggtggcacaacgccgctgcgaagatatcgatgaatgccaggacccagatacgtgctcccagttgtgtgtgaacctggaaggcggttataagtgccaatgtgaggagggtttccagctggacccgcacaccaaggcgtgcaaggccgtcggatccatcgcttacctcttcttcaccaacagacacgaggtgcgcaagatgactctggatagatccgaatacacttcgctgatccccaatctccgcaacgttgtggctctggacaccgaagtggcttcaaatagaatctactggtcggatctgagccagagaatgatttgctcgacgcaactcgaccgcgctcatggagtcagcagctacgacaccgtgatctcaagagatattcaggcaccggacgggctcgctgtagactggatccactccaatatctactggaccgattcggtgctgggtactgtgtcagtcgccgataccaagggagtaaagcgcaagactctgttcagggaaaatggaagcaaaccaagagcgatcgtcgttgacccggtgcatggcttcatgtattggaccgattggggcacgcctgccaagatcaaaaagggaggtcttaatggagttgatatctacagcctggtcaccgagaacatccagtggcccaacggcatcacgctggatctgctgtcaggacggctgtactgggtcgactcgaaactgcattcgatttcctccatcgatgtgaacgggggcaacagaaagactatcctggaggacgagaagcgccttgcccatcccttctcgctcgctgtgtttgaagataaagtgttctggaccgatatcatcaacgaagccatcttttccgctaatcggctgacggggtcagacgtgaatttgctggctgagaacctgctgtccccagaagatatggtcctgtttcataacctgactcaaccgagaggagtgaattggtgtgaacgcactacgctctctaacgggggatgccagtacctctgcctccctgcaccgcaaatcaacccacactcgccgaagtttacgtgcgcgtgtcccgatggaatgctcttggcgcgggacatgcggtcctgcctcaccgaggcggaggcagccgtggccactcaagaaaccagcactgtccggcttaaggtgtcaagcactgctgtccgcacccagcatactaccactaggccagtgccggacacgtcccggctgcctggagccactccgggcttgaccacggtggagattgtgaccatgtcccaccaggcgctgggagacgtcgcgggtcgcggtaacgaaaagaagccgagctccgtgcgcgcgctctccatcgtgctgccaatcgtcctcctggtgtttctgtgtctcggcgtgttccttctttggaaaaactggcggctcaagaacatcaatagcattaacttcgacaacccagtgtaccagaaaactaccgaagatgaagtgcacatctgccacaaccaagatggttactcatacccatcaaggcagatggtgtcgctggaagatgacgttgcc

SEQ ID NO: 16045 - DNA, 2580 bp, Artificial Sequence
  Description of Artificial Sequence: Synthetic coding sequence
atggggccatgggggtggaagctacgttggacagtagccctgctgctcgccgcagctgggacagccgtgggagacaggtgtgaacggaatgagttccaatgtcaggatggaaaatgtatctcctataaatgggtgtgtgatgggtccgcagaatgccaggatgggtccgatgaatctcaagaaacatgtctgagtgttacttgtaaatctggggacttctcatgcgggggaagggtcaacaggtgtattccacagttctggcggtgtgatgggcaggtggactgcgacaatggaagtgatgagcaggggtgcccacctaagacatgctctcaggatgaatttcgctgtcacgatggaaagtgtatttcaaggcaattcgtctgtgactctgatcgagattgccttgatgggtccgatgaagcctcttgtcctgttctcacatgcggaccggcttctttccagtgcaactcttccacatgtataccccagctgtgggcgtgtgacaacgaccccgattgtgaagacggatcagatgaatggcctcagcgatgtcgggggctgtatgtcttccagggagattcttcaccttgcagtgcattcgaattccattgcctctccggagagtgtatccatagtagttggcggtgtgatgggggacccgattgtaaagacaaatccgatgaagaaaattgtgctgtggcaacatgccgcccagatgaatttcagtgttctgatgggaattgtatccacgggtccagacagtgcgatagggagtacgattgtaaggatatgtccgacgaagtgggatgtgtgaatgttacactgtgtgaagggcctaataaattcaagtgccacagtggagaatgtatcacattagataaagtctgtaacatggcccgggactgccgggattggtctgatgaacctataaaagaatgtgggacaaacgagtgcctcgataacaacggaggatgttctcatgtatgcaatgacctgaaaatagggtacgaatgcgactgtcccgatggattccagctcgttgcccagcgccgttgtgaagatatagatgagtgccaggaccctgatacatgtagtcaactatgtgtgaacttagaagggggatataaatgccagtgtgaagagggattccagctcgatccccacacaaaagcctgcaaagcagtggggtctatcgcatatcttttcttcactaaccgccatgaagtgcgcaaaatgacattagatcggtctgaatatacatctctcatacccaatctccgcaacgtggtggctctcgatactgaagtagcttcaaatcggatttattggtcagatctgagtcagagaatgatctgctctactcagctcgatcgagctcatggggtgtctagttatgatactgtgatttcccgcgatatacaggcccccgacgggctagccgttgattggatccattcaaatatttactggacggattccgttctgggaactgtgtctgtggcagatactaaaggagtcaagcgaaaaactctttttagggaaaacgggagtaaacccagggctatcgtcgtggacccagtccacggatttatgtactggactgattgggggacacctgcgaaaatcaaaaaaggaggactcaatggggtcgacatatattctttggtgacagagaacattcagtggcctaacggaatcacactggatctcctgagtggacggctgtactgggtagattccaaactccactctataagttctatagacgtgaacggagggaatagaaaaacaattctcgaggatgaaaaacgccttgcacaccctttcagtctcgcagtcttcgaggataaagtgttctggactgatattatcaacgaagccattttctctgccaatagacttacaggatcagatgtcaacctattggctgaaaacctcctgagtcctgaagatatggtgctgttccacaatctgacacagcccaggggagtgaactggtgcgagcgcacaacactgtctaacggggggtgccagtatttatgtcttcctgctccacagataaaccctcactctcccaaatttacatgtgcctgcccagacgggatgctactagcaagggatatgagatcttgcttgactgaggcggaggcggctgtagcaactcaggaaacatccacagtaaggttaaaagtctcttctactgccgtgcgaacacagcacacaacaactaggccggtcccagatacatctcgccttcctggagctactcctggattgactactgtcgaaatagtgactatgtcacatcaggcgctaggagatgtagcagggcgtgggaacgaaaaaaaaccatcttccgtcagggcactcagtatagtgctgcccatagtgctactcgtatttctatgtctgggagtattcctcctgtggaaaaactggcggttaaaaaatatcaattccatcaatttcgataaccccgtgtatcagaaaacaacagaagatgaggtacatatctgccataatcaagatgggtactcatacccttctcgccagatggtgtctcttgaggatgatgttgcc

SEQ ID NO: 16046 - DNA, 2580 bp, Artificial Sequence
  Description of Artificial Sequence: Synthetic coding sequence
atgggaccctggggctggaagctgcggtggaccgtggcgcttctgttggcggcggcaggaaccgcggtcggtgacaggtgcgaaagaaacgaattccaatgccaggacgggaaatgcatctcgtacaaatgggtctgtgatgggtcagctgaatgccaggatggaagcgacgagtcgcaggagacttgcctctcagtgacgtgcaagtcaggagatttctcgtgcgggggtcgcgttaatcggtgcatcccgcagttctggcggtgtgacggccaggtggactgcgataacggatccgacgaacagggctgtcctcccaagacctgcagccaggacgagttcagatgccatgacggcaagtgtatctcccggcaattcgtgtgtgactcagaccgcgactgcctggacggttctgatgaagcatcctgccctgtgcttacctgtggccccgcgtcatttcaatgcaactcctcgacctgcatcccgcaactctgggcttgcgacaacgatccggactgcgaagatggatcagacgagtggccacagagatgccgggggctttacgtttttcaaggtgatagctcgccgtgctcggcattcgagttccattgtttgtccggcgagtgcattcactcatcctggcgctgcgacggaggtccggactgcaaggacaagagcgacgaggagaattgcgcggtggcgacttgcagaccggacgagttccaatgttctgatggaaattgtatccacgggtccagacagtgcgacagagaatacgattgtaaggatatgtcggatgaagtgggatgcgtcaacgtcaccctctgtgaaggtcccaacaaattcaagtgccactcgggagaatgcatcacccttgacaaagtgtgcaacatggcgcgggactgccgcgattggtccgatgagccgatcaaagaatgcggtactaacgaatgcctcgacaacaatgggggttgcagccacgtgtgtaacgacctcaaaatcgggtacgaatgcgattgtccagacggattccagcttgttgcgcaaaggcgatgcgaggacattgacgaatgccaagacccggatacctgttcgcagctctgtgtgaatctggaaggagggtacaagtgccagtgcgaagagggattccaactcgaccctcataccaaagcatgcaaggccgtgggaagcattgcttacctgttctttaccaaccgacacgaagtccgcaaaatgactctggaccgcagcgaatacacctccctgatcccgaatctgcggaacgtggtggccctcgacactgaggtggcttccaacaggatctactggtccgacctgtcgcagaggatgatctgtagcacccagctggatcgcgcacacggtgtgtcctcgtatgataccgtcatctcacgggacatccaagcaccagatggactggcggtcgactggatccactcgaacatctactggactgactccgtgcttggaaccgtgagcgtcgccgacactaagggggtcaaacgcaagacgcttttccgcgaaaacggatccaaaccccgggccattgtcgtcgaccctgtccacggatttatgtactggactgattggggcaccccagccaagatcaagaagggagggctgaatggcgtcgacatatactcactggtgaccgagaacatccagtggccaaatggcatcactctcgatttgctgtcgggcaggctgtattgggtggatagcaagctccattcaatctcgtcgatcgatgtgaatggaggaaatcgcaagactatactggaggatgagaaacggctcgcgcatccgttttccctggctgtgttcgaggacaaagtgttttggaccgatatcatcaacgaggccatcttctcggccaatagactcactggatcggatgtcaatttgcttgccgagaatctgctgtcaccggaagatatggtgctgttccacaacctcacgcagcctcggggcgtcaattggtgtgagcgcactaccctgtccaacggaggatgtcagtacctgtgccttcccgcgccacaaatcaacccacacagcccaaaattcacttgcgcatgcccggacggtatgctgctggcgagggacatgaggtcatgtctcaccgaagccgaagcagcggttgcgactcaagaaacttcaaccgtcagactgaaggtgagctcaactgccgttcgcactcagcacactactactcgaccggtgccggatacctcgagactgcctggcgcaacgcccggactgaccactgttgaaatagtgactatgtcgcaccaggccctcggggacgtggcaggacgcggaaacgaaaagaagccgtctagcgtgcgcgcgctttcaatcgtgctccctattgtgctcctggtgttcctgtgcctgggcgtgtttctcttgtggaagaattggagactgaagaatatcaacagcatcaattttgacaatccggtgtaccaaaagaccaccgaagatgaggtccatatctgccataaccaggatggctactcgtacccgtctaggcagatggtgagcttggaagatgacgtggcc

SEQ ID NO: 16047 - DNA, 2580 bp, Artificial Sequence
  Description of Artificial Sequence: Synthetic coding sequence
atgggaccatggggctggaagctcagatggactgtggcactgctgctggccgccgccggaacggcagtgggtgatcgctgtgaacgcaacgaattccaatgccaggacggtaagtgtatttcatataagtgggtctgcgatgggagtgctgagtgtcaggatggatccgacgaatctcaagagacttgtctttccgtgacctgtaagtctggagacttctcgtgcggtggtagagtgaaccgctgtatcccccaattttggcggtgtgatgggcaggtggactgtgataacggcagcgacgaacagggctgtcctcctaaaacctgttcacaagatgaattccgttgtcatgatggaaagtgtatttctcgacagttcgtgtgcgattcggaccgggattgcctcgacggttcggacgaagcctcatgtccggtgctgacttgtggacctgcttcctttcagtgtaactcatcgacttgcattccacaactctgggcatgtgataatgatccggactgcgaagatggatcggacgagtggcctcagagatgtaggggtttgtacgtgtttcagggggattcatcgccatgctcagcctttgaatttcactgtctttcaggcgagtgcatccattcgtcgtggcgatgcgatggaggtcctgattgcaaagacaaaagcgacgaggagaactgtgccgtggcgacttgtcgcccggacgaatttcaatgttcagatggcaactgcatccatggaagccgtcagtgcgaccgagaatacgattgtaaggacatgtcggatgaagtgggatgcgtgaacgtaactctgtgtgagggacctaacaagttcaagtgtcatagcggtgaatgtatcacccttgataaggtgtgtaacatggctagagattgtagagactggagcgatgaacccatcaaagaatgtggtactaacgagtgcctggataacaacggtgggtgttcacatgtctgcaacgatctgaaaattgggtacgaatgtgactgcccggacggttttcagttggtggcacaaaggaggtgcgaagatatcgatgaatgccaggatccagatacctgctcccaactttgcgtcaacctggaaggaggatacaagtgtcaatgtgaagaaggatttcaacttgacccacatactaaggcctgtaaggcagtagggtccatcgcatacctgttctttaccaaccgtcatgaagtgcgaaagatgacccttgatagatccgagtacacttcgctcattcctaaccttagaaatgtcgtggcactcgacaccgaagtcgcgagcaacagaatatactggtccgatctttcccagagaatgatctgttcaactcaactggatcgtgcgcatggtgtgtcgtcgtatgatacggtcatcagccgggatatccaagccccagatggcctggcagtcgattggatccattcaaacatttactggactgattccgtgctcgggaccgtttctgtggcagatactaagggagtgaagcgaaagaccctgttcagagagaacgggtcgaaacctagagcgattgtggttgatccagtgcatgggtttatgtactggactgactgggggaccccggcaaagataaagaaagggggtctgaacggtgtcgacatctactcacttgtgaccgagaacatacagtggcccaacggtataactcttgatctcctttctggacgcctttactgggtggattcaaaattgcactcaatttcctctatagatgtgaatggaggcaatcggaaaactattctggaggatgaaaagcgtctggcacatcctttctcacttgcggtgttcgaggacaaggtgttctggactgacatcatcaatgaggcaatcttttccgccaatcgacttactggcagcgacgtcaatcttctcgcagagaatctgctttcaccagaggatatggtcctgtttcataatcttactcagcctagaggagtgaactggtgcgaaagaaccacgctcagcaatggcggatgtcaatacctgtgtctcccagcgcctcaaatcaatccccattcgccaaagtttacttgtgcatgtcccgatggcatgctgctggccagagacatgaggtcatgtctcactgaagccgaggccgccgtggcaacccaggaaacctcaacggttagacttaaggtgtcgtccacggctgtgcggacccaacatactaccactcggcctgtgcccgacacttcccggctccctggtgcaacccctggtctgaccaccgtggaaattgtgactatgtcgcaccaggcacttggcgatgtggcaggtagaggaaacgaaaagaaaccctcatcagtaagagcactttcgatcgtgcttccaatagtgctgctcgtgtttctgtgcttgggagttttcttgttgtggaagaactggcggctgaagaacatcaattccattaactttgacaaccccgtgtaccagaaaaccaccgaggacgaagtccacatctgtcataatcaggatggctattcctacccttcgcgtcaaatggtcagcctggaagatgatgtggca

SEQ ID NO: 16048 - DNA, 2580 bp, Artificial Sequence
  Description of Artificial Sequence: Synthetic coding sequence
atgggaccgtggggatggaagctgcgctggaccgtggcactcctgctcgctgccgccggtaccgcggtcggtgacagatgcgagcgcaatgagttccagtgccaggatggcaagtgtatttcatacaagtgggtgtgtgatgggtcggcggaatgccaggatggatcggacgaatcacaggaaacgtgtctgtccgtgacctgcaaatccggggatttcagctgcggtggtcgcgtgaatcggtgcatccctcagttctggcggtgcgacggacaagtggattgcgacaacggcagcgacgaacaaggatgccctccaaagacttgctcccaggatgaattcaggtgccacgacggaaagtgtatctcacggcagttcgtgtgtgactccgatagagattgtctggacgggagtgacgaagcctcctgccctgtgctgacttgcggaccagcttccttccagtgcaatagctctacttgcatcccccaactctgggcctgtgacaatgaccctgactgtgaggacgggtcggacgagtggccgcagcgctgcagaggactctatgtgttccagggagactcctcgccgtgctcggcattcgagtttcactgcctctccggagaatgtatccactcctcgtggcgctgcgacgggggaccagactgcaaggataaatctgacgaagagaactgcgctgttgcgacctgccggcctgacgagttccaatgttccgacggaaactgcatccatggttcccgccaatgcgaccgggagtacgactgcaaggacatgtcggatgaggtgggatgtgtcaatgttaccctctgcgaagggccgaataagttcaaatgccactcaggcgagtgtatcaccctggataaggtgtgcaatatggcgagggactgccgggattggagcgacgaaccgatcaaagaatgtggtactaatgagtgcctcgacaataatggcggctgcagccacgtgtgcaatgatctgaaaattggatacgaatgtgactgcccagacggattccaattggtcgcacagcggcgctgcgaggacattgacgagtgccaggaccctgatacttgttcgcagctgtgcgtgaaccttgaaggtggatacaagtgccaatgtgaagaaggcttccaactcgacccgcataccaaagcgtgcaaagctgtgggatcaattgcatacttgttctttactaatcgccatgaagtccgcaagatgactctcgacagatctgaatacacttcccttatcccgaacctccggaacgtcgtggctctggacaccgaagtcgccagcaacagaatttactggtccgatctgtcacagcgcatgatttgctccacccagttggaccgggcacatggagtgtcgtcttacgataccgtgatttcaagggacattcaggcaccggatggactggcggttgactggatccattcaaacatctactggactgattcggtgttgggaacggtatcagtggccgatactaaaggggtcaagagaaagactctgtttagagaaaacggatcgaaaccacgggctatcgtcgtggatccggtgcacggatttatgtactggaccgactggggcaccccagcaaagatcaaaaagggaggtctgaacggcgtggacatttactctctggtcactgagaacattcagtggccaaatgggatcacgttggacctgttgtcgggaaggctttattgggtggactctaagctgcactccatttcctccatcgacgtcaacggaggaaatcggaaaactatcctcgaggacgaaaagaggctcgctcacccgttctcactggctgttttcgaggacaaggtcttttggactgacatcatcaacgaggcgatattctcagctaatcggttgaccggatccgacgtgaacctccttgccgagaacctgctttcgccggaggatatggtcctgttccacaaccttactcagccgcgcggagtgaactggtgtgaacgaactaccctcagcaatggagggtgccagtatctgtgcttgccggcgccgcagatcaacccacactcaccgaaattcacctgtgcgtgcccggatggtatgctgctggcgcgcgatatgcgatcatgcctgaccgaggctgaagccgcggtcgctacgcaagagacttccacggtgcgtctcaaggtgagcagcacggcagtgaggactcaacatactaccacccgtcctgtgcccgatacctcgagactgccgggcgccacccctggcctgactaccgtcgaaatcgtaaccatgtcgcatcaggcgctgggagacgttgccggtcggggaaatgaaaagaagccgagctccgtgcgcgcgctgtcaatcgtactgcccatcgtgctgcttgtgtttctgtgcctcggagtgtttctcctgtggaagaactggcggctgaaaaacatcaactcgatcaacttcgacaaccctgtgtaccaaaagacgaccgaggacgaagtgcatatctgccacaatcaagatgggtactcgtacccctcccgacagatggtgtctctcgaggacgatgtggcc

SEQ ID NO: 16049 - DNA, 2580 bp, Artificial Sequence
  Description of Artificial Sequence: Synthetic coding sequence
atgggaccttggggatggaagttgagatggaccgtagctctgctcctggcggctgccggcaccgccgtgggtgatcgatgcgagaggaatgagtttcagtgccaagatgggaagtgtattagctataaatgggtgtgtgacggatcagcagaatgccaggacggaagcgatgagagccaggaaacttgtctgagtgttacatgcaaaagcggcgacttttcctgcggggggagagtaaatcgctgcatcccacagttttggcgttgcgacgggcaggtggactgtgacaacggatccgatgaacaggggtgccctccgaaaacctgctcgcaggatgagttccgctgtcacgacggtaagtgcatctcccgacagttcgtctgcgattctgatcgcgactgtctggacgggtccgacgaggccagctgccccgtgctaacatgtggtccagccagttttcagtgtaatagtagtacttgcataccacagctttgggcctgcgataatgatcccgactgcgaggatggatcagacgagtggccccaacgctgccggggcctgtatgtgtttcaaggggactctagtccgtgcagtgcttttgagtttcattgtctttccggtgagtgtatccactcttcgtggagatgcgatggcggaccagattgtaaagacaaatcagacgaggagaattgtgcagtagctacttgtagacctgacgaattccagtgctctgacggaaattgcattcatggctcaagacagtgtgaccgggaatatgattgcaaggatatgtccgatgaagtgggatgcgttaatgtcaccctgtgcgagggaccaaacaaatttaagtgccactccggggagtgcataacgctggataaggtgtgtaatatggcaagagactgccgagattggagcgatgagccgatcaaggagtgtggtaccaatgagtgtctggataacaacggagggtgctcacacgtgtgtaacgatctgaagataggatatgaatgcgactgcccagatggtttccagctggttgcccagaggcgatgtgaggatatcgacgaatgtcaggatccagacacctgctcccaattatgtgtgaacctcgaagggggctacaagtgccagtgcgaggagggattccaactcgatccgcacacaaaggcatgcaaggccgttggaagtatagcttatttgttctttacaaaccggcacgaagtgcggaagatgaccctggatagatccgaatatacatcacttatcccaaatcttcgaaacgtcgtggcgttggacaccgaggtggcctccaatcgaatctactggagtgatctgagccagcggatgatttgctccacgcagctcgaccgcgcgcatggtgtctcctcttacgacaccgtaatcagccgtgatatacaggcgccagatggcctggcggtggactggatccattcaaatatctactggactgactccgtcctggggactgtgtccgtggccgacacaaaaggcgtgaaacgtaagacactgtttcgggagaacgggtctaagccgagggccattgtagttgaccctgtacacggctttatgtactggaccgattggggaacccctgccaaaatcaaaaagggcggcctgaatggagtcgatatctacagcctggtcaccgagaacattcagtggcccaacgggattacgttagacctgctctcagggcggctatattgggtagattccaagttgcactccatctcttcaatagacgtaaatggtggcaatcgaaaaaccattctggaggatgagaagcgtctggcccacccattcagccttgctgtgtttgaggataaagtgttttggactgacattatcaatgaggccatctttagcgccaatcggctcaccggttctgacgtgaacctgctagccgagaacctcctgagccccgaagatatggtattgtttcacaacctgacccagccgcgcggggtgaactggtgtgaaagaacaaccctcagtaacggtggttgccagtacctgtgcctgcctgcacctcagataaatcctcactctcccaaattcacctgcgcgtgccctgacggcatgctgttagcgagggacatgcgatcttgtctgacagaggccgaggccgcggtcgctacacaggagacttcaactgtaaggctcaaagttagttcgactgccgtgagaactcagcacaccactacgcggcctgtgcccgacacctcaaggttgcccggtgcaactccagggttaaccaccgtcgagatcgtcactatgagccaccaggcactcggggatgtggcaggcaggggaaacgagaagaagccctcttccgtgcgcgctctgtcaatcgtcttacccattgtgcttcttgtatttctgtgccttggggtatttttactgtggaagaattggaggctgaagaatattaacagtataaattttgacaatccagtctaccagaagacaactgaggacgaggtgcatatttgccataatcaagacgggtattcctacccttctcggcagatggtctctctcgaagatgacgtggcc

SEQ ID NO: 16050 - DNA, 2580 bp, Artificial Sequence
  Description of Artificial Sequence: Synthetic coding sequence
atgggcccttggggttggaagctgcgctggactgtggcactgctgttggcagcagctggaactgccgtgggagatagatgcgaacgcaacgaattccagtgccaggacggaaaatgcattagctacaaatgggtctgcgacggctcagcggagtgtcaagacggaagcgacgagagtcaggaaacctgtctgtcagtgacttgtaagtccggcgacttctcgtgcggcggtcgggtgaatagatgcatccctcagttctggcgttgcgacggtcaggtggactgtgacaatggatccgacgagcaggggtgtccacccaagacttgttcgcaggatgaattcagatgccatgacggaaagtgcatttcgcgccagttcgtgtgcgactcggatcgcgattgcctcgatgggtcagacgaagccagctgtccggtcctcacctgcggaccggcttccttccaatgcaactcgtccacgtgtatcccacagctctgggcgtgcgacaatgaccccgattgtgaggacggatccgatgaatggccgcagagatgtcgcggactctacgtgtttcaaggagactcgtcaccgtgctccgcgttcgagttccattgcctgtccggagaatgcatacacagctcatggaggtgtgacggaggcccggattgcaaggacaagtcggatgaggaaaactgcgcggtggcgacttgccgcccggatgaatttcaatgtagcgatggaaactgcatccatggctcacgtcagtgtgaccgggagtacgactgcaaagatatgtcagacgaagtggggtgcgtcaacgtgacgctctgcgaaggaccaaacaagttcaaatgccattccggcgaatgcattactctggataaggtctgcaacatggcgcgggactgccgggactggtcggacgaacctatcaaggagtgtggaacgaatgaatgcctcgataacaatggaggttgctcacacgtgtgcaacgacctgaagataggctatgagtgtgactgccccgatggcttccagctggtcgcacagcgccggtgtgaagatatcgacgaatgccaagatcccgacacctgctcccagctctgtgttaacctggaaggaggctacaagtgccagtgcgaggaggggtttcagctggatcctcacactaaggcttgcaaagcggtgggatcgattgcctaccttttcttcactaatagacacgaggtccgcaagatgactctggaccggtcggagtacacctctctgattccaaacttgcggaacgtcgtggccctggacactgaagtggcgtcaaatagaatttactggtccgatctgagccagaggatgatctgtagcactcagttggaccgtgctcacggagtctcgtcgtacgatacggtaatctcgcgcgatattcaagcaccagatggcctggcggtggactggatccactcgaacatttactggactgattccgtgctcggcaccgtttcagtggccgataccaagggggtcaaacgcaagactctgttcagagaaaatggatccaagccacgggcgatcgtggtggatccggtccacgggtttatgtactggactgactggggtactccggcgaaaatcaaaaagggagggcttaatggagtcgacatctactcgctcgtgactgaaaacatccaatggccgaacggaatcaccctggatctgctgtcgggccgcctctactgggtggactcgaaacttcactcgatctctagcatcgacgtcaatggcggaaataggaaaactatcttggaggatgagaagcggctggcgcaccctttcagcctggccgtgttcgaggacaaggtgttctggacggacatcatcaacgaggccatcttcagcgccaatcgtctcactggctccgacgtcaacctgcttgctgagaatctgctttcgcccgaggatatggtgctgtttcataaccttacccaaccacggggcgtgaattggtgcgaacggaccaccctgtccaacggtggctgccagtacctctgcctcccggcccctcaaatcaacccgcactcgcctaaattcacttgcgcatgcccggacggtatgttgctggcgagagacatgcggtcgtgccttaccgaagccgaggccgccgtggccacgcaagaaacctccaccgtgcgcctgaaggttagcagcaccgccgtgagaacccaacataccaccaccagaccagtgccggacacctcccgactcccgggggccacccctgggttgaccaccgtggaaatagtgaccatgagccatcaggcacttggggatgtggctggacgcggaaacgaaaagaagccttcctcggtgcgggctctgtcaatcgtcttgcccatcgtcctcctcgtctttctctgcctgggagtattcctcttgtggaagaactggcgcctgaagaacatcaactcaataaactttgataacccagtgtaccagaaaaccactgaggacgaagtgcatatctgtcacaatcaagatggatattcttacccgagcaggcagatggtgagcttggaggacgacgtggca

SEQ ID NO: 16051 - DNA, 2580 bp, Artificial Sequence
  Description of Artificial Sequence: Synthetic coding sequence
atgggcccttggggatggaagttgcggtggaccgtggcactcctacttgcggcagcaggaacggctgtaggtgataggtgcgagaggaatgagttccagtgtcaggatggaaaatgcatttcctacaaatgggtgtgcgacggttctgccgagtgccaggatggatcagatgaaagccaagaaacttgtctgtcggtcacttgtaagtcgggggatttctcttgcggcgggagggtaaatcgatgtattcctcagttctggcgctgcgacggacaagttgattgcgataacggcagcgatgaacagggatgccctcctaagacttgttcccaggatgagttccgatgtcacgatggaaaatgtattagccgccaatttgtgtgcgatagtgacagagattgcctggatgggagtgatgaggcatcttgccctgtgttaacctgcggcccagccagtttccagtgtaattcatcgacatgcatcccacagctgtgggcatgtgataacgaccccgattgtgaggatggtagtgacgaatggccacagcgctgccgaggattgtatgtctttcaaggcgatagtagcccgtgttccgcttttgagttccactgtcttagcggcgagtgtattcactcctcttggcgctgcgacggaggccctgactgtaaagataagagtgatgaggagaattgcgcagttgctacatgtcgcccagatgagtttcagtgttccgacggaaactgtatacacgggagcaggcagtgcgaccgtgagtacgattgcaaagacatgtcagatgaggttggctgcgtgaacgtcacgctctgtgaaggacccaacaaatttaagtgtcacagcggtgagtgtattaccctggataaagtgtgtaatatggccagagattgccgagactggagcgacgaaccgataaaagagtgcggcacaaacgagtgccttgacaataatggcggttgttcacacgtgtgcaacgatctgaagatcggatatgaatgcgattgtcctgatggatttcagctagttgcacagcggcgctgcgaggatattgacgagtgtcaagatccagatacatgtagccaactatgcgtgaatctggagggcggatataagtgccaatgtgaggaggggtttcagcttgatccacatacaaaggcttgtaaggccgtgggctctattgcgtacttgtttttcactaatagacacgaggttcgcaaaatgactttggacagatcggaatacacttccctcatcccaaaccttagaaatgttgtcgccctggatactgaggtggccagtaaccgtatttactggtccgatctgagccagagaatgatatgcagcactcagctggaccgcgcacatggagtgtcttcttacgacacagtgatttctcgagatatacaggcccccgacggcctggcagtggattggattcacagcaacatttattggaccgattctgtccttggaacagtcagcgtggcggacacaaaaggcgtcaagcggaaaacattgtttcgggaaaacggcagtaagcctagagctatcgtagtcgatcccgtccatggtttcatgtactggaccgactgggggacaccagccaaaatcaaaaaaggtggtttaaatggagtggacatttattccctggtaacggagaacattcagtggcccaacggtataactttggatttactttctggacgcctttactgggtggatagtaaactacacagtatcagttcaattgacgtcaacggaggtaatcgtaaaactatcctggaggatgaaaaacgtcttgcccacccattctcactcgctgtcttcgaggacaaggtattctggaccgacataatcaacgaagcaatctttagcgccaaccgtctgactggcagcgatgtgaaccttcttgccgaaaatttattgagccccgaggacatggtactgtttcacaatttgacacagccccgaggagtgaactggtgtgaacgaactaccctgagcaacggaggttgtcagtacttgtgcctgccggctccacaaattaatccccatagtccaaaatttacatgtgcctgtcccgacggaatgctgctagcacgggatatgcgctcgtgtcttaccgaggctgaggcagcagtcgccacccaggaaacctccaccgtgagactgaaagtctctagcaccgcagtgcgcacacaacacaccacaacccgtcccgtgcccgatacatcccggctgccaggggcaacaccaggtctgacaaccgtggaaatagtaaccatgagccaccaagcgctgggggacgtggccggacggggcaacgagaagaagcctagttccgtcagagcactttctatcgtgctgccaattgtcctgctagtgttcctctgcctgggcgtctttctgctgtggaaaaattggagactgaaaaatattaacagcattaactttgacaaccccgtgtaccaaaagacaactgaggacgaagttcatatctgccacaaccaggatggatattcctaccccagtcgccagatggtttctctggaagacgacgtggcc

SEQ ID NO: 16052 - DNA, 2580 bp, Artificial Sequence
  Description of Artificial Sequence: Synthetic coding sequence
atggggccttggggatggaagctgcgctggacagtcgctctgctcctggctgcggcgggtaccgccgtgggggataggtgcgagagaaatgaattccaatgccaggacggaaagtgcatcagctacaaatgggtatgtgatggctcagcagagtgccaggacggaagtgacgaaagtcaagaaacctgtctatcggtgacatgtaagtctggcgactttagctgcggaggccgagtgaatcgatgtattccacagttttggaggtgtgatggccaagtggattgcgacaacggttcagacgagcaggggtgtcctccaaagacctgtagccaggatgaattcagatgccatgacgggaagtgcatctcaaggcagtttgtctgcgacagtgatagggactgcctggatggctccgatgaagcgtcatgtcccgtgttaacttgcggccctgcgtcattccaatgtaattcatcgacctgcattccccagctctgggcctgcgacaatgaccctgattgcgaagacggtagcgacgaatggccccagaggtgtcggggcctgtacgtttttcagggtgattcatctccttgttcagccttcgagttccactgcctgtctggggagtgcatacattcgtcttggcggtgcgacggaggtcccgattgtaaggataaatcagacgaagagaactgtgctgtagctacatgcaggccagatgagttccagtgcagcgacgggaactgcatacacggatctaggcagtgcgatcgggaatatgattgtaaagacatgtctgacgaggtcgggtgtgtgaatgtgacactgtgcgaaggtccgaataagttcaagtgtcactctggggagtgtatcaccctggataaagtctgcaatatggcacgagactgcagagattggagcgacgagcctataaaggagtgcgggaccaatgagtgtctggacaataacggaggatgcagccacgtctgcaacgatctcaagatcgggtacgaatgcgactgtcctgacggtttccagctagttgcgcaaagaagatgtgaggatatagatgaatgtcaggaccccgatacgtgcagtcaactctgtgtgaacctcgaaggcggatataagtgtcaatgcgaggagggcttccagctcgatccccatacaaaagcctgtaaggcggtcgggagcatagcctacctgttcttcactaacagacacgaggtacggaaaatgacattagacagatcagagtacacatctcttattcctaatcttaggaatgtggtggccctggatacagaagtcgcttctaatcggatctattggagtgacctaagtcagcgcatgatctgttccacccagctagatagagcccacggcgtgtcttcatacgacaccgtgataagcagggatatacaagccccagatggactcgcggtcgactggatccacagcaatatctattggacagattcggtgctgggcacagtaagcgtagccgatactaagggggtgaagcgcaagacgctcttcagggaaaatggttccaaaccgagagccatcgtggtagatccagtccacgggtttatgtactggaccgactggggaacaccggcaaagataaagaagggtggccttaatggggtcgacatctacagcctggtgactgaaaacatccaatggcccaacggcataaccctcgacttactgtcaggccgactctattgggtcgattccaagcttcatagtatttcttccattgatgtgaacgggggcaatagaaaaacaattctcgaagatgaaaaacggctcgctcatcctttctccttggcggtgtttgaagacaaggtgttctggactgacataataaacgaggcgattttttccgctaatagactgaccggctcagatgtgaatttgctggcggaaaacctgctgtcgccagaggatatggtccttttccacaacttaacccagccacggggcgtaaactggtgcgagagaacaacattgagcaacggtggctgccagtatctatgcctgcccgctccacagataaacccccacagtccgaagtttacttgtgcatgccctgacggaatgctgcttgcccgtgatatgcgatcgtgcctgaccgaagcagaagccgcagtagctacacaagaaacatcaaccgttcggctgaaggtgtcttcgactgctgttagaacacagcacaccaccacccggccggtcccggatacaagcaggctccccggagccacaccaggactgaccaccgtggaaattgtcaccatgagccatcaagcccttggagatgtggccggccgcgggaacgaaaaaaaaccctctagtgttagagctctgtctatcgttttgcctattgtacttctcgtcttcctgtgcctgggagttttcctgctgtggaagaactggcgcctcaaaaatatcaactcaatcaattttgataaccccgtctatcaaaagacaactgaagatgaggtccatatctgtcacaatcaggatggatattcatacccctctcggcagatggtctcgctggaagatgacgttgcc

SEQ ID NO: 16053 - DNA, 2580 bp, Artificial Sequence
  Description of Artificial Sequence: Synthetic coding sequence
atgggaccttggggctggaaattgcggtggacggtcgctctcttacttgccgccgcaggtaccgcagtcggtgataggtgtgagcgcaacgaattccagtgtcaggacggaaaatgtattagttacaagtgggtgtgcgacggatctgccgagtgtcaggatggaagcgacgagtctcaggaaacctgtctcagcgtaacctgtaaatccggcgactttagttgcggcgggcgggtgaaccgctgcatcccccaattctggaggtgtgacggccaggtggactgcgataatgggagcgatgaacaagggtgtccaccaaagacttgcagccaggacgaattccggtgtcatgatgggaaatgcataagccgccagtttgtctgtgactccgatcgcgactgccttgacggctcggatgaggcctcttgcccggttctgacatgcgggcctgcgtccttccagtgcaatagttcaacctgcattccccagctgtgggcttgtgacaacgatccggattgtgaggatggctccgatgaatggccccagcgatgccgtggactttacgttttccagggggacagcagcccctgcagtgctttcgagtttcactgcttgagcggcgagtgcatccacagctcttggcggtgtgatggaggacctgattgtaaggataagtctgacgaggagaactgcgcagtggctacctgtaggcccgacgagtttcagtgttccgacggaaactgtatccacggtagcaggcagtgcgatcgagaatacgattgcaaagacatgtccgacgaggtggggtgtgtaaatgtgactctctgcgagggaccaaacaagttcaaatgtcatagtggggagtgcattactctggataaagtgtgtaatatggcacgggattgcagagactggagtgatgaacccattaaagagtgcgggactaatgaatgcctggacaacaacggcggctgtagtcacgtttgtaacgacctgaagatcggttacgaatgtgattgcccagacggcttccaactggttgcccagcggcgatgcgaagacatcgacgagtgtcaggatcctgatacatgttcacagctctgtgtaaatctggaagggggttataagtgtcagtgcgaagaagggttccagctggacccccacactaaagcatgcaaagctgtcggctctatcgcctacttgttcttcacaaaccggcatgaggtcaggaaaatgactttggataggtctgagtacaccagtctgatccccaacctcaggaacgttgtagcgttggacacagaagtggctagtaatcgtatctactggagtgacctgtcacagaggatgatatgtagcacccagctggacagggcccacggggtgagctcttacgacaccgttatcagtagagatatacaggccccagatgggcttgctgtagattggatccatagcaatatttactggaccgattcagttttagggacagtgagtgttgctgacacgaaaggagtcaagaggaaaaccctgttccgtgagaatgggagtaaaccgcgagcaattgttgtggacccagttcacggcttcatgtattggaccgattggggtaccccagccaaaatcaaaaaaggtgggctgaacggtgtggatatctatagcctggttactgaaaacatccagtggccaaacggcatcactctggacctgctttctggtcggttgtattgggtagattcgaagctgcacagcattagctccatagatgtgaacggaggcaatcgaaagaccattctcgaagatgaaaaaaggcttgcccatcctttttctctcgctgttttcgaagataaggtgttttggaccgacatcatcaacgaagctatcttttccgctaaccggctaaccggctccgacgtgaatctgctggccgagaatctgctctctcctgaggatatggtgttgtttcacaatctgacccaaccacgtggtgtgaactggtgtgagcgaaccacactctctaatggtgggtgccagtatctatgcctgccggctccccagattaatccccattcacctaaatttacctgcgcttgtcccgatggaatgctgctggcccgggatatgcgatcctgcctcaccgaagccgaagccgcggtggctacacaggagacatccacggtccgcctgaaggtctcaagtactgcagtgcgtactcagcacacgacgacacgccctgtcccggatacttcacggctccccggggccaccccgggcctgaccactgtggaaattgtaacaatgtcacaccaagctctgggcgacgttgctgggaggggaaacgagaagaaaccgtcaagtgttcgcgccctatcgattgttttaccaatagtgttgctggtctttctgtgtctgggtgtgttcctcctatggaaaaactggcggctcaagaatattaattcaatcaattttgataacccagtctaccagaaaactacggaagatgaggtccacatttgccacaaccaagatggctactcatacccttctagacagatggtgtcattggaggacgatgtcgct

SEQ ID NO: 16054 - DNA, 2580 bp, Artificial Sequence
  Description of Artificial Sequence: Synthetic coding sequence
atggggccctggggctggaagttacgctggaccgtggctttgctgttggccgccgccggcacagctgtaggagatcgctgtgaacggaacgagtttcagtgtcaagatgggaaatgtatcagctataagtgggtgtgcgatggcagcgctgaatgtcaagacggcagtgacgagtctcaagagacttgcctgagtgttacctgcaaatctggcgactttagctgcggcggcagagtgaatagatgtataccacaattctggcggtgtgatggccaggtggattgtgacaatggaagcgacgagcaaggatgcccgcccaaaacctgctctcaggacgagtttcgatgtcacgacggtaagtgtatctccaggcaattcgtatgtgactcagaccgtgactgcctcgatggcagtgacgaagcatcatgcccagtattaacctgtgggcccgcatccttccaatgtaattcctcaacttgtattccacagctctgggcctgcgacaacgacccagattgcgaagacggctccgatgagtggccgcagagatgtaggggcctctacgttttccagggcgacagttctccttgcagcgccttcgaatttcactgcttgagtggagagtgtatccactccagctggagatgtgacggcggtccagattgtaaagacaagtcggatgaggagaattgcgcagtagccacatgcagacccgatgaattccaatgttccgacggaaactgcatccacggaagtcggcagtgtgatagagagtacgattgcaaggacatgtctgacgaagtaggatgtgtgaacgtaaccctgtgcgaaggccctaataaattcaagtgccacagtggggagtgtatcactttggataaggtgtgcaatatggctagggactgcagggattggtccgacgagccaatcaaagagtgcggcactaatgagtgtcttgacaacaacggcgggtgtagtcatgtctgcaacgatctcaagatcgggtacgagtgtgactgtccagatgggttccagttggtggctcaacgccgatgcgaagatattgatgagtgtcaggatcctgacacttgttcccagctgtgcgttaatctggaggggggatacaaatgccagtgcgaggaagggttccagctcgatccacatacaaaggcgtgtaaggcagtgggtagcatagcctatctgttttttaccaaccgccatgaggttaggaaaatgacccttgatcgttcggaatataccagccttatcccaaacttgagaaatgtggttgccttggacactgaggtggcctctaaccgcatatactggtccgacctgagtcagcggatgatctgttctacacagctggaccgcgcccatggtgtctcctcatatgataccgtcataagccgcgatattcaagcccctgatggactggcagttgattggatccatagcaacatatactggacagattcggtcctgggcacagttagcgtggcagacaccaagggcgtcaaaagaaagaccctctttcgagaaaacggatcgaaaccgcgagcaatcgtggtggaccccgtccatgggtttatgtactggactgattggggtaccccggccaaaatcaagaaaggcggattgaacggagtcgacatttactctctggttacagagaacattcagtggccaaacggtatcacactggacctgctctcaggccgtctctattgggtcgacagtaaactgcattccatcagctccatcgatgtaaatgggggaaaccgtaagaccattctggaggacgagaagcggttggctcaccccttctccctcgccgttttcgaagacaaggtattttggaccgacattatcaacgaggctatattttctgccaataggctcacaggctcagacgtcaacttgctggcggaaaacctcttgtccccggaagacatggtactgttccacaacttgactcagccccgcggagtcaactggtgcgagcggactactcttagcaacggggggtgccagtacctgtgtcttccggccccccaaattaacccccactcacctaagttcacctgcgcctgtccagatggcatgctgctggcccgagatatgaggtcatgtcttactgaggcagaggccgccgtagctacccaggaaacctcaactgtgagactgaaggtatcctctactgctgtgaggacccagcatacaaccactcgacctgtcccagacacgagcaggctgcccggtgcaacacccgggctgaccacggtggaaattgttactatgagccaccaagccctgggcgatgtggctggccggggcaatgagaagaagccctcttccgttcgggccttgagcatcgtccttcctattgtgctgttggtatttctttgtctcggcgtattcctgctgtggaaaaactggaggttgaagaacatcaactctattaattttgataaccctgtgtatcagaagaccacagaagatgaggttcacatctgccataaccaagatggctactcttatccatcccgacagatggtttccctcgaagacgatgtcgct

SEQ ID NO: 16055 - DNA, 2580 bp, Artificial Sequence
  Description of Artificial Sequence: Synthetic coding sequence
atggggccctggggctggaaactgcgttggactgttgcccttctgctcgccgccgccggcaccgcggtcggtgaccggtgcgaacgaaacgagtttcagtgccaggacggaaagtgtatctcctacaagtgggtctgcgacggctctgcggagtgtcaggacggctctgacgagagccaggagacttgcctctctgttacgtgcaaatcaggcgatttcagttgcggcggtcgagtaaaccggtgcataccacaattctggaggtgtgatggacaggttgactgtgacaacggcagcgacgaacaaggctgcccacccaaaacctgctcccaggatgagtttaggtgtcacgacggaaagtgtatttcccggcaattcgtgtgtgactctgaccgtgattgtctggacggctcagacgaggcttcatgccccgtgctcacgtgcgggcccgccagttttcaatgcaacagcagcacctgtatcccccagctttgggcttgcgataatgaccctgattgtgaggacggctccgatgagtggcctcaacgctgccggggtttgtatgtatttcagggcgactccagtccctgttccgcatttgagttccactgtttgtccggcgagtgtatccattcctcttggagatgcgatggtgggcccgactgcaaggacaaatcagacgaagaaaattgtgccgtggcaacgtgccgcccagatgaatttcaatgttccgatgggaattgcattcacgggtccaggcagtgtgatcgagaatacgactgcaaagatatgtccgatgaggtggggtgcgtgaatgtcacgctctgcgaggggcccaataagttcaagtgtcatagcggagagtgcatcacattggataaggtgtgcaacatggcacgggattgcagggattggtctgacgagcctatcaaggagtgtggcacgaatgaatgtttagacaataacggaggttgcagtcatgtgtgcaacgatttgaagatcggctatgagtgcgactgtcccgatgggttccaactggtggctcagcgtcgttgcgaagatatcgatgagtgtcaggaccctgatacctgcagccaactctgtgtgaacctggaaggcggatataagtgtcagtgtgaagagggtttccagcttgaccctcacaccaaagcatgtaaagccgttggcagcatcgcttacctcttttttactaaccggcatgaggtgaggaagatgaccctcgaccggagcgaatacacctcgctgattcctaacctgaggaacgtagtagctctcgataccgaggtggcctccaaccgcatctattggtcggacctcagtcaacgtatgatttgcagtacccagctggaccgtgctcacggcgtgagctcgtacgataccgtgatcagccgcgacatccaggccccggacggcctggccgtcgattggatccatagcaatatatattggacagacagcgtgctcggtacagtgtctgtggccgacacaaaaggggtgaagcgcaagacactgttccgcgagaacggttccaagccgcgcgctatcgtagtggatccagttcatggcttcatgtactggactgactggggtactcccgctaagatcaaaaaaggcgggctgaacggagtggatatatatagtctggtgacagagaacatccaatggccgaatggaattacattagacctgctgtccgggcgactctattgggtcgatagcaaactccactctatttcttctatcgacgtcaacgggggcaaccgaaagactatactggaagatgagaagcgtttagcacaccctttctctctcgctgtgttcgaggataaggtgttttggactgatatcatcaacgaggccatctttagtgctaacaggctcacgggaagcgacgtcaatttactggcagagaacttgctgagccccgaggatatggtgctgttccacaacctcactcaaccccgcggagtgaattggtgcgagcgcacaaccctaagcaatggcggctgtcaatacctgtgccttccagccccacagataaatccccactcgccaaaatttacctgcgcttgcccagacggaatgcttctagcccgcgacatgcgctcatgcctgacagaagccgaggcggccgtcgcaacccaggagacatcaacagtcagactgaaagtgagctctacggctgtgcgcacacagcataccacaactcgacccgtgcctgatacttcccggcttccaggcgcgacgcctgggctgacgaccgtagagatcgtcaccatgtcccaccaggccttaggagacgtcgcgggaagggggaacgagaagaagccttcgagtgtgagagctctgagcatcgtgctccctatcgtcctcctcgtcttcctgtgtttgggagtgtttctgctgtggaagaactggagattgaaaaacataaactcaatcaattttgacaacccagtgtaccagaagacaacagaggacgaagttcatatctgccataatcaggacggctacagctacccatcgcggcaaatggtttcattggaagacgacgtggcg

SEQ ID NO: 16056 - DNA, 2580 bp, Artificial Sequence
  Description of Artificial Sequence: Synthetic coding sequence
atgggaccatgggggtggaaacttcggtggaccgtggccctgctcctggccgcagcgggtacggcagtgggagatagatgcgaacggaatgagttccagtgtcaggatgggaagtgtatcagttacaagtgggtgtgcgatggatcagccgaatgtcaggacggttccgacgaatcccaagaaacctgcctgagcgtcacttgcaaatctggggacttttcgtgcggagggcgggtgaaccgctgtataccgcaattctggcgctgtgatggtcaggtcgactgcgataacggatccgacgaacaaggctgcccaccaaagacctgctcgcaagatgaattccggtgccacgacggcaagtgcatctcccgccagtttgtgtgtgatagcgatcgggactgtctggacggaagcgacgaagcgagctgtccagttctgacgtgcggcccggccagcttccagtgcaattcgtcgacctgtatcccgcagctctgggcatgcgacaacgatcctgactgcgaagatggctcggacgaatggccgcaaagatgcaggggactgtacgtttttcagggagactcgagcccttgctcggctttcgaattccactgcctctccggtgagtgtatccactcaagttggcgttgcgatggcggcccggattgtaaggataagtcagacgaggaaaattgtgccgtggcgacctgccgccctgacgagttccagtgcagcgatggaaactgcatacacggcagccggcagtgtgaccgcgagtacgattgcaaagacatgtcggacgaggtggggtgcgtcaacgtgaccctttgcgagggacctaacaaattcaagtgtcactcgggagaatgtatcactctggataaggtctgcaatatggctcgcgactgccgggattggtccgatgagcccatcaaggaatgcggaaccaacgaatgcttggataacaatggaggttgctcccacgtgtgcaacgatttgaaaatcgggtacgagtgcgattgccctgacggattccaattggtggctcagcgccggtgcgaagatatcgacgagtgccaggatcctgatacctgttcccagttgtgtgtcaacctcgaaggaggttacaagtgccagtgtgaggagggattccagttggacccccacactaaagcgtgcaaagcagttggctcgatcgcgtacctgttcttcactaatcgacatgaggtgcgcaaaatgaccttggacagatcggaatacacgtcgctcattccgaaccttcgcaacgtagtggccctggacactgaggtggcttccaatcgcatctactggtcagatctgtcgcagaggatgatctgttccactcagctcgatagagcacatggagtgtcgtcgtacgacaccgtgatctcacgcgacatccaagccccggatggattggctgtcgactggatccacagcaacatctactggaccgactccgtgcttggaactgtgtcggtggccgataccaagggtgtcaagagaaaaaccctgttccgcgagaatggaagcaagcctagagcgatcgtggtcgacccggttcacggatttatgtactggaccgattgggggacgccagcaaagatcaagaagggaggactgaacggtgtcgatatctactctctggtcactgagaacatccagtggccaaacggaattaccctggatctcctttccggaagattgtactgggttgattccaagctccattcgatctccagcatcgacgtgaacggcggcaataggaaaactattttggaggatgaaaagcgcctcgcgcatccgtttagcttggccgtctttgaagataaggtgttctggacggacatcatcaacgaagctatcttcagcgcgaatagactgaccggatcggatgtcaacttgctggcggaaaacctcctgagcccagaggatatggtgctctttcacaacctgacccaaccgcggggcgttaactggtgcgagcgcactaccctgtccaatggcggctgtcagtacctgtgtctgccagcaccgcagattaatccacactcacctaaattcacctgcgcctgcccggatggtatgctcttggcccgcgacatgaggtcatgtctgaccgaggcagaggctgcagtcgccactcaggagacttcgacggtgcgcttgaaagtcagcagcactgcggtgagaacccagcacactaccacccgcccagtgcccgacacgtcccgcttgccgggagccaccccaggactcaccaccgtggaaatcgtgaccatgtctcatcaagcgcttggagacgtggctggacggggaaacgagaaaaagccgagctccgtgcgagccctctccattgtcctgccgatcgtgctgctggtgttcctgtgcctgggagtgtttcttctctggaagaactggcggctcaagaatatcaactccatcaatttcgataatcccgtgtaccaaaagactactgaagatgaagtgcacatctgccacaaccaggatggatattcgtatccgagccggcagatggtttcactggaggatgatgtggct

SEQ ID NO: 16057 - DNA, 2580 bp, Artificial Sequence
  Description of Artificial Sequence: Synthetic coding sequence
atgggtccttggggatggaaacttaggtggactgtggcgctgctcctggctgcggcgggtaccgcagtgggtgatcggtgcgagcggaatgagttccagtgccaagacggaaagtgcatttcgtacaagtgggtctgcgacgggtcagccgaatgtcaagatgggtctgatgaatcccaagaaacctgcctttccgtgacgtgtaagagcggtgatttctcatgcgggggacgggtgaatagatgtatacctcagttctggcgttgtgacggacaagtggactgcgataatggctcggatgaacaaggctgccctcctaagacctgctcacaagacgaatttagatgccacgatggaaaatgtatttcccggcaatttgtgtgtgacagcgatcgggactgccttgatggatcggacgaagcatcctgtcccgtgctgacctgtggtccagcatcgtttcagtgtaatagctcaacttgcatccctcagctgtgggcatgcgataacgaccctgactgcgaggatggttcagatgaatggcctcagagatgtcgcggtctgtatgtgtttcagggagattcatcgccatgctccgcgtttgaattccattgcctgtcaggagaatgtattcatagcagctggcgctgtgacggtggaccggactgtaaggataagagcgatgaagaaaactgtgcagtcgcaacttgtagaccagatgagttccaatgttcggatggaaactgtatacatggctcgagacaatgcgatcgagagtacgactgtaaagacatgtcggatgaagtggggtgtgtcaatgtcactctgtgtgaaggacccaataagtttaagtgccatagcggtgaatgtataaccctggacaaggtgtgcaacatggcgcgagattgtagagactggtcggatgagccaattaaggaatgcggaactaacgaatgtctcgacaataatggaggatgttcccacgtctgtaatgatctcaaaatcggatacgaatgtgactgtcctgatggatttcaactcgtggcacaacgaagatgtgaggatattgatgaatgccaagatccagatacttgctcacagctgtgtgtgaatctcgagggagggtacaaatgtcaatgtgaagaaggattccagctcgatccacataccaaggcatgtaaggcagtgggatcgatcgcatacctgtttttcaccaaccggcatgaagtgcggaaaatgactctggataggtccgaatacacttccctgattccaaaccttagaaatgttgtcgcacttgataccgaggtggcctcgaatcgaatctactggtccgatctgtcgcaacgcatgatctgtagcacccaactggacagagcgcatggggtgtcgtcctacgatacggtgattagcagggatatccaagccccggatggattggcagtcgactggatacattcgaacatttactggaccgattcggtccttggaactgtctccgtggccgatactaaaggagtgaagagaaagacccttttccgggaaaacgggtcaaagcccagagccatcgtggtggatcctgtgcacggcttcatgtactggaccgactggggaactccagcaaagattaagaaaggggggcttaacggtgtcgatatctacagcctggttactgagaacattcaatggcctaatgggatcactctggacctgctgtccggtcgactgtactgggtggattccaaactgcattcgatttcgtcgattgacgttaacggcggaaatcgcaaaaccatactggaagatgaaaagcgtctcgcacatcccttctccttggcggtgttcgaggacaaggtcttttggacggatatcataaacgaagcaatctttagcgcaaacagattgactggatcagatgtcaacttgctggcagaaaacctgctttccccggaagatatggtgctttttcacaacctcactcagccccggggtgtgaactggtgtgagagaaccacgctgtccaacggaggctgccagtacttgtgcctgcctgcacctcagataaatccccattcccctaaattcacctgtgcgtgcccagatggaatgcttcttgcaagggatatgcgttcctgtcttaccgaagccgaggctgcagtggccacgcaggaaacttcgaccgtcagactcaaggtgtcatcgactgcagtccgcacccagcataccaccacccgtcccgtcccagacacctcaaggttgccaggcgcaaccccaggcttgactacggtcgagatcgtcaccatgtcacaccaggcactgggagatgtggcaggacgaggtaacgaaaagaaaccatcgtctgtgcgggcactgtcgattgtgctccctatagtgctgcttgtctttctctgtcttggagtgtttctgctttggaaaaactggaggcttaagaacattaactccataaacttcgataacccagtgtaccagaaaacgactgaggacgaagtgcacatttgtcacaatcaagatggatacagctatccatcgcgccaaatggtgtcgcttgaagatgatgtggcg

SEQ ID NO: 16058 - DNA, 2580 bp, Artificial Sequence
  Description of Artificial Sequence: Synthetic coding sequence
atgggaccctgggggtggaaactgcggtggaccgtggctctgctgctggccgctgccggcaccgccgtgggagaccgctgtgagaggaatgagttccagtgccaagacgggaaatgtatttcttataaatgggtgtgtgatggctcagcagagtgccaggacggttccgatgaatcacaggagacctgtctgtctgtgacctgcaagagcggggatttcagctgcggaggccgcgtgaataggtgtattccacagttctggaggtgcgacggccaggttgactgcgataatggctccgacgaacagggctgcccacctaaaacatgcagccaggatgaattccgatgccatgacggaaaatgcatttctcggcagtttgtatgcgactccgatagggactgcttagacggaagcgatgaggccagctgtcccgtgctcacctgcggtcccgcttcattccagtgcaattcctcgacttgtatcccccaactgtgggcttgtgacaatgaccccgactgcgaggacgggagtgacgagtggccacaacgctgtcggggactttacgtgttccagggggattcttccccctgttccgcctttgaattccattgcctatccggagagtgcattcatagttcttggagatgtgatggcggcccggactgtaaggataaatctgatgaagagaattgcgcagttgctacctgcaggccggatgagtttcagtgctccgatgggaactgtatccatggaagccggcagtgcgatagagagtacgactgcaaggacatgagcgatgaggttggttgcgtgaacgtaaccttgtgcgaggggcccaataaatttaaatgtcactcgggcgagtgtattactctcgacaaagtttgcaacatggctagggactgtcgtgattggagcgatgagcccattaaggaatgtgggactaacgaatgcctggacaacaacggaggatgttctcacgtgtgtaatgatctcaagatcggatatgagtgcgattgccctgatgggttccagctggtggcccagcgaagatgcgaggatatcgacgaatgtcaggaccctgacacatgttcccagctctgcgttaaccttgaagggggttacaaatgtcagtgcgaagaaggcttccagctggacccccatactaaggcctgcaaggcagtggggagtattgcatatctttttttcactaaccgccatgaggttcgaaagatgacattggatcgatccgagtacacgagcttgatcccaaacctgcgcaatgttgtagctttggacacggaagtcgccagcaacagaatttactggtcagacttgagccaaagaatgatctgtagcacgcagttagaccgcgctcacggggtgtcgagctacgacaccgtgatatctcgggatatccaagcccccgacggactcgcggtggactggatccacagtaacatctactggactgatagcgtcttgggtacagtctccgttgccgacactaagggcgtgaagcgcaagactctttttcgtgaaaatggatcgaaacctcgagcaatcgtcgtcgatcccgtgcacggattcatgtattggacagactggggtacgcccgcaaagattaaaaagggcggactcaatggggtggacatctactccctggttacagagaatattcagtggcctaatgggataacactcgacttacttagcggcaggctgtattgggtagatagtaagcttcacagcatcagtagtattgatgtgaacggaggtaatcgcaagactattctcgaggatgagaaacggctcgctcacccgttttccctcgcggtgtttgaggataaggtgttttggactgatatcattaacgaggccattttcagcgccaaccgccttactggaagcgacgtgaaccttttagccgagaacctcctcagccccgaggatatggtcctgtttcacaatctgacccagcccaggggagtcaactggtgcgagaggacaacactgtctaacgggggctgccagtacctgtgcttgcccgccccccaaattaacccccactcacctaaatttacttgtgcctgtcctgatggcatgctgttggccagggacatgcggagctgtctgacagaagctgaagctgccgttgctacccaggagacttctacagtgcgcctgaaagtgagtagtaccgctgtcaggacacagcacacaactactagacccgtccccgataccagcaggttgcccggggcaaccccaggattaacaaccgttgagattgtaaccatgtcgcatcaagcactcggtgacgtggccggcagaggtaatgagaagaaacccagcagcgtccgcgccttgagcatcgtcctgcctattgtgctcctcgtctttctatgcctaggagtctttctactgtggaagaattggagactgaaaaacatcaattctatcaatttcgataaccccgtataccagaagaccaccgaagatgaagtccacatttgccataatcaggacgggtactcttatccctccagacagatggtatcactagaggacgatgtggcg

SEQ ID NO: 16059 - DNA, 2580 bp, Artificial Sequence
  Description of Artificial Sequence: Synthetic coding sequence
atgggaccatggggttggaaacttcgttggacagtagctctccttcttgcagctgcaggaactgcagttggagatagatgtgaaagaaatgaattccaatgtcaagatggaaaatgtattagttataaatgggtatgtgatggatctgcagagtgtcaagatggatctgatgaaagtcaagaaacatgtttgagtgtaacatgtaaatcaggtgacttttcttgtggtggaagagttaatagatgtattcctcaattttggagatgtgatggacaagttgactgtgataatggttcagacgaacaaggatgtccaccaaaaacttgttcacaagatgaatttagatgtcatgatggaaaatgtatatcccgtcaattcgtttgtgattcagatagagattgtttagatggtagcgatgaagctagttgtccagttttaacttgtggaccagcatcttttcaatgtaatagctcaacatgcattccacaactttgggcatgtgataacgatccagactgtgaagatggatctgatgaatggccacaaagatgtagaggactttatgtttttcaaggagatagttctccatgtagtgcattcgaattccattgtttgagtggtgaatgtatacattcatcttggaggtgtgatggaggaccagattgtaaagataaaagtgacgaagaaaattgtgctgtagctacatgtagaccagatgaatttcaatgctcagatgggaattgtattcatggatctagacaatgtgatagagaatatgattgtaaagacatgtctgacgaagttggttgtgttaacgtaacattatgcgaaggtccaaataaatttaaatgtcattctggagaatgtatcacactcgataaagtttgtaatatggctagagattgtagagattggtcagatgaaccaattaaggaatgtggaactaacgaatgtcttgataataatggaggttgttcacacgtttgtaatgatcttaagattggatatgaatgtgactgtccagatggttttcaacttgttgcacaacgtagatgtgaagatattgatgaatgtcaagatccagatacatgtagtcaattatgtgttaatttagaaggaggttataaatgtcaatgtgaagagggttttcaattagacccacatacaaaggcatgtaaagcagtgggatctattgcttatctttttttcactaatagacatgaagtcagaaaaatgactttagatagatccgagtatacctctttaataccaaatttaagaaatgttgttgcccttgataccgaagttgcatcaaatcgtatttattggtcagacctttcacaaagaatgatttgttcaacacaacttgatcgtgctcatggagtatcttcttatgatacagtaatttctcgtgacatacaagcaccagatggattagctgtagattggattcatagtaatatttattggacagattcagttttaggaactgtttcagttgcagacactaaaggagttaagagaaagacattattcagagaaaacggttccaaaccacgtgcaattgttgtagatcctgtacatggatttatgtattggacagattggggtactcctgctaaaattaagaaaggaggtttaaacggagtagatatctattcacttgttacagagaatattcaatggccaaatggaataacacttgacttattgagtggacgactttattgggttgacagtaaattgcattcaatttctagcattgatgttaatggaggaaatagaaagacaattttggaagatgaaaaaagacttgctcatccattctcattagcagtttttgaagataaagttttttggacagatataattaacgaagcaattttttcagctaatagacttacaggatcagatgtaaatttattagctgaaaatttacttagtccagaagatatggttttatttcataatcttacgcaaccaagaggggttaattggtgtgaaaggactactctttcaaacggtggttgtcaatatttatgtcttccagctccacaaattaatccacattcaccaaaatttacatgtgcatgtccagatggaatgttacttgcacgagatatgcgtagttgtttaacagaagctgaagctgcagttgcaacacaagaaacttcaacagtaaggttaaaggtaagttcaactgctgttagaacacaacatacgacaacaagacctgttccagatacatcaagattacctggagctacgccaggattaacaactgttgaaattgtcactatgtcacatcaagcccttggagatgttgctggacgtggaaatgaaaaaaaaccttcttctgttagagcacttagtattgttttaccaattgttcttttagtcttcttatgtttaggtgtttttcttttgtggaagaattggagacttaaaaatattaacagtataaattttgacaatccagtatatcaaaaaacaactgaagatgaggttcatatttgtcataatcaagatggatattcatatccttcaagacaaatggtttcattagaagatgatgttgct

SEQ ID NO: 16060 - DNA, 2580 bp, Artificial Sequence
  Description of Artificial Sequence: Synthetic coding sequence
atgggaccgtggggatggaagttgagatggaccgtggcccttttgctggcagccgccggcactgctgtgggagacaggtgcgagcggaacgaatttcagtgtcaagatggcaagtgcatatcatacaaatgggtctgcgacggatcggctgaatgccaagatggctccgacgaatcccaggaaacttgcctgtccgtgacctgcaagtcgggcgacttcagttgcggaggtcgagtgaaccggtgcatcccgcaattctggcgttgcgacggacaggtagattgcgacaacggtagcgatgaacagggttgtccgccaaagacgtgctctcaagatgaattccgctgccacgacggaaaatgcatcagcaggcagttcgtgtgcgactcggaccgcgactgtcttgatggaagcgatgaagccagctgcccggtcctgacttgtggaccagcctcattccagtgcaacagctccacgtgcatcccacaactttgggcttgtgataacgaccctgactgtgaagatggcagcgatgagtggcctcagcgctgtagaggactttacgtctttcagggtgacagcagcccatgctcggccttcgaattccactgcctctcgggggaatgcatccactcctcatggcggtgcgacggagggcccgactgcaaggataaaagcgacgaagaaaactgcgccgttgccacttgcaggccggacgagtttcagtgctcggacggcaactgcatccacggaagccgccagtgcgacagggagtatgattgcaaagacatgtccgacgaggtcggatgcgtcaacgtcactctgtgcgagggaccgaataagttcaaatgtcattccggagaatgcatcactctggacaaagtgtgtaatatggcccgagattgccgcgactggtctgatgaaccgatcaaggaatgcggaactaacgagtgtctggacaataatggtggatgtagccatgtgtgcaatgacctgaagattggatacgaatgtgactgtccggatgggttccagctcgtggcgcagagacggtgcgaagatatcgacgagtgtcaggatccggacacctgctcgcaactctgcgtgaatcttgagggaggctacaagtgccaatgcgaagagggattccaactggacccccataccaaggcgtgtaaagcagtcgggtcgattgcctacctgtttttcacgaatcgccacgaggtgcgcaagatgaccctggatcggtcggagtacacctcgctgatcccgaacctccggaacgtggtggcactcgacaccgaagtcgcatccaatcgcatctactggtcagatctgtcacagcgcatgatctgctccacccaacttgatagagctcacggtgtgtcgtcatacgacaccgtgatcagcagagacattcaagccccggacggcctggcggtggactggatccattcaaatatctactggaccgacagcgtcctgggaaccgtgtcggtcgccgatactaagggcgtcaagcgcaagactctcttccgcgagaatggaagcaaaccccgggccatcgtcgtggatcctgtgcacggattcatgtactggactgattggggaaccccggcgaagatcaagaagggcggcctgaacggcgtggacatctactcactggtgaccgagaacattcaatggcctaacggcattactctggacctgctctcgggacggctgtattgggtggactccaagctccactcgatctcctccatcgacgtgaacggggggaacagaaagactattctggaagatgagaagcggctggctcatcctttctcactcgcggtgttcgaggataaggtgttctggactgacatcatcaatgaggcaattttctccgccaatcgcctgactggttccgacgttaacctgctggcagagaacctgctcagtccggaggacatggtgttgtttcacaacctgacgcaaccacggggtgtgaactggtgcgaacggactaccctgagcaacggaggctgtcagtacctctgcctcccggcaccccaaatcaacccacattcaccaaagtttacttgtgcgtgcccggacggtatgctgctggcgagagacatgagatcctgcctcaccgaagcagaggcagccgtcgctacgcaggaaacctccactgtccggttgaaggtgtcgtcaaccgccgtgcggacccagcatacgaccactcgccctgtcccggatacttcgaggctcccgggggccaccccagggttgaccaccgtcgaaatcgtgactatgtctcaccaggctctgggagatgttgcgggacgcgggaacgagaagaagccatcgtcagtgcgcgcgttgtcgatcgtgctcccaatcgtgctgctggtgttcctctgtttgggagtgttcctcctttggaaaaactggaggctcaaaaatatcaactcgatcaattttgacaaccccgtgtaccagaaaaccaccgaagatgaagttcacatctgccataatcaggacggctactcatacccttccagacagatggtgtccctggaggatgatgtcgcg

SEQ ID NO: 16061 - DNA, 2580 bp, Artificial Sequence
  Description of Artificial Sequence: Synthetic coding sequence
atgggtccctggggatggaagctcagatggacagtggcccttcttttagccgccgcaggaaccgctgtgggtgatcgctgtgagcggaacgaattccaatgccaggacggaaagtgcatctcttataagtgggtttgcgacgggagcgcagagtgtcaggacggatcggatgagtcacaggaaacttgcttgtccgttacttgcaaatccggggattttagttgtggagggagggtgaacagatgtattcctcagttttggcgctgtgacggtcaggtggactgtgacaatgggtcggatgaacaaggctgccccccaaaaacctgcagccaggatgagtttcggtgtcatgatgggaaatgtatctcccggcagttcgtctgtgactcagaccgcgactgccttgacggttcagatgaagccagctgtccagttctgacttgcgggccagcgagcttccagtgtaactcatccacttgcattccacagctatgggcctgtgataacgatcctgactgtgaggatgggagtgatgagtggccccagaggtgccggggactctatgtgtttcagggggattcaagtccctgctcagccttcgagtttcattgcctctcaggagagtgcatccatagttcctggaggtgcgatggaggcccagactgcaaggataagagtgatgaggagaactgtgccgtggcgacatgccgaccagatgagtttcagtgtagtgacggaaattgtatccacggctccaggcaatgtgaccgagagtatgactgcaaagacatgagtgatgaggtcggctgcgtaaatgtcactttgtgcgaggggccgaacaagttcaaatgtcatagcggtgagtgtattactctcgacaaggtgtgcaacatggcaagggattgtcgggactggagcgacgaaccgatcaaagaatgcggcaccaacgagtgtctggacaataatggaggatgtagccatgtctgcaacgatctgaagatcggatatgagtgcgactgcccagacggctttcagcttgtcgcacaaaggcgctgcgaagacattgacgaatgccaagatcccgacacctgtagccagctgtgcgtgaacctggaaggtggatataagtgccagtgcgaggaagggtttcagctggaccctcacaccaaagcatgcaaggccgtcgggtccattgcatatctgtttttcacaaaccgccatgaagttcggaaaatgaccctggacagatccgagtatacctctctgatccctaacctgagaaatgttgtggcattagacaccgaggtggcttccaaccgaatctattggagcgacttgtctcagcgaatgatatgctcaacgcagctggacagagcccacggagtcagtagctatgataccgtcatttccagggatattcaggctccagacggtttggccgttgattggatccacagcaacatatactggactgattctgtcctcggcacagtgtccgtggctgatacaaagggagtcaagcgaaaaacgctatttcgtgagaacggttctaaacccagagccattgtggttgatcccgtccatgggttcatgtactggacagactggggaacccccgccaagattaagaagggtggcttaaacggcgtcgatatctactccttagtcacggagaacatccagtggccgaatgggataactctggatctgctgtctgggagactgtattgggtggactcaaagcttcactctatctcaagcattgatgttaacggtgggaatcgaaagacgatcctggaggatgagaagcgtctggcacaccccttttctctcgccgtttttgaagacaaagtgttctggaccgatattatcaacgaggctatcttcagtgcaaatcggctgaccgggagcgatgtgaacctgctcgccgaaaatcttctttccccagaagacatggttctctttcataatttgacacagccacgcggagtcaactggtgtgagcggactactctgtccaatggcggctgccagtacttgtgcctgccggcaccgcagattaacccgcattcacctaagtttacctgtgcctgtccggatgggatgcttttggctagagatatgagatcctgcctgacggaggcagaggctgcagtggcgacacaagagaccagcactgtgcggctgaaagtgagtagcaccgccgtgcggacccagcatacaaccactcgacccgttcccgacaccagtaggctccccggcgctacacccgggcttaccactgtagaaatcgtgactatgtcgcatcaggccttgggtgatgttgcagggcggggaaacgagaagaagccctcatccgttagagctctatcaatcgtgctgccaatagtcctcctcgtgttcctctgcctgggggtctttctgctgtggaagaactggaggctgaagaacattaacagcatcaattttgacaatccggtttaccagaaaactacagaggacgaagtgcacatttgccataatcaggacggatacagttacccaagcaggcaaatggtcagcttggaggacgatgtggcc

SEQ ID NO: 16062 - DNA, 2580 bp, Artificial Sequence
  Description of Artificial Sequence: Synthetic coding sequence
atggggccctggggctggaaactgagatggaccgtggccctcctgctcgcggcagccggaaccgccgtcggggaccgctgcgagcggaacgaattccagtgtcaagacggaaaatgtatcagctacaaatgggtgtgtgacggctctgctgagtgccaggacggcagcgacgagagccaagagacctgcctctccgtgacctgcaagtcaggggatttttcctgcggaggacgtgtgaaccgctgtatcccccagttctggcgctgcgatggtcaggtggactgcgacaatggatccgacgaacagggctgtccgccaaaaacgtgtagccaggatgagtttcggtgccacgacggtaagtgtatcagccgacagttcgtgtgtgactcagaccgggactgcctcgacgggagcgacgaagcctcctgccccgtattgacttgcggacccgcaagttttcaatgcaatagcagcacctgtatcccccagctctgggcctgcgacaatgatcccgattgcgaagacggaagtgatgagtggccccagcggtgcaggggcctgtacgtttttcagggagactcgtcgccttgtagtgccttcgagttccactgcctgagtggcgagtgcatccattccagttggagatgcgatggaggaccagattgtaaggataagtccgacgaggagaactgtgcggtcgcgacatgtcgcccagacgaattccaatgctccgacggtaattgtatccacggctctcgccaatgtgaccgggaatacgactgtaaagacatgtcagacgaagtgggatgtgtcaatgtgactttatgtgagggccccaataaattcaaatgccactctggagagtgtattaccttggacaaggtgtgcaacatggcaagagattgccgggactggagtgacgaaccaataaaggagtgtggcacaaatgagtgtctggataacaacggtggctgctcacacgtgtgcaacgatctcaaaattgggtatgaatgcgattgcccagatggctttcagctcgtggcacagaggcggtgtgaagacatcgatgagtgtcaggatcctgacacctgttcccaattatgcgtgaacttggagggaggctataagtgccaatgtgaagagggctttcagttggatccccacaccaaggcttgtaaagcggtcggctcgatagcttatttgttttttaccaaccgtcatgaggtaagaaagatgaccctggaccggtcggaatacactagcttgatccctaacctccgcaacgtggtcgcactggatacagaggtggcctctaataggatctattggagcgacttgagccagcgcatgatttgctctacacagttggatcgggcccatggggtgtcctcctacgatacggtgatttctagggacatacaggcgccagacggacttgcagtggattggatccactctaatatctactggaccgatagcgtactgggtaccgtgagcgtggccgataccaagggagtgaaacgtaaaaccctgttccgggaaaatgggtcaaagcctcgagctattgtggttgaccctgtgcatggatttatgtattggactgactggggcactcccgctaaaattaaaaagggtggcctcaatggtgtcgacatttacagcctggtcacagagaatatccagtggcctaatggaataacccttgatctgctaagtgggcggttgtattgggtcgattcgaagttacactcaatttcaagcatcgatgtgaatgggggaaaccggaagacaattctcgaagatgagaaacgactcgcccaccccttctcactggccgtattcgaagacaaagtgttttggaccgatattattaacgaggctattttctctgccaacagactaaccggctctgacgtaaatctgctagcagagaacttgctatctcccgaggatatggtccttttccataatctgacgcagccacgcggcgtgaactggtgcgagagaacaaccctgtccaacgggggctgtcaatacctctgcctcccggcgcctcagatcaatcctcactcaccgaagtttacctgtgcctgccccgatggcatgcttctggcccgggacatgcgtagctgtctcaccgaggccgaagctgccgtggccacccaggaaacctcaacagtacgactgaaggtgtctagtacggctgtcagaacacagcacacaacaacccgcccagtgccggatacttcacggctacccggggccacacctggtttgactacagtcgagattgtaacaatgtcccatcaagccttgggagatgtggcaggtagggggaatgagaagaagccatcctccgtccgggccctgtctatcgtgctgccaatcgtactgttggtgttcctatgccttggagtgtttctcctgtggaagaactggagactcaaaaacatcaattctataaattttgataacccggtgtaccaaaagacaaccgaggacgaggtgcatatctgtcataatcaggacggttactcttatccgagtcgccaaatggtgtctcttgaagacgacgtcgcc

SEQ ID NO: 16063 - DNA, 2580 bp, Artificial Sequence
  Description of Artificial Sequence: Synthetic coding sequence
atgggaccgtggggatggaaattgaggtggaccgtcgcccttctgctcgcggctgctggcacggctgtcggcgaccgctgcgaacgcaatgagtttcaatgccaagacgggaagtgcatctcatacaagtgggtctgcgacggatcagcggaatgccaagatgggtcggacgaatcgcaggaaacctgcctctcagtcacctgtaagtcgggcgatttcagctgcgggggccgggtgaaccgctgcatcccccaattctggcggtgcgacgggcaggttgactgcgacaacggttctgacgaacaaggctgccctcctaagacctgttcccaggatgaattcaggtgccatgatggaaaatgcatctcgcgccaattcgtgtgcgattccgacagagactgtctggatggaagtgacgaggcatcgtgcccagtcctgacttgcgggccggcttccttccagtgcaactcgtcaacttgtatcccgcagttgtgggcctgtgataacgaccccgattgcgaggacggctcggatgaatggcctcagagatgccgtggactgtacgtttttcaaggtgattcttcaccgtgcagcgcttttgagttccattgtctgtcaggcgaatgtatccactcgagttggcgatgcgacggcggacccgactgtaaggataagtcagacgaggagaattgcgccgtggccacttgccgcccggacgagtttcagtgctcagatggaaactgtatccatggatcacgccagtgcgaccgcgaatacgattgtaaggatatgtctgatgaggtcggctgcgtgaatgtgaccctgtgcgaaggtccgaacaagttcaaatgtcacagcggagaatgcattacgctcgataaggtgtgtaacatggcccgggattgtcgcgattggtcggacgagccaattaaggaatgcggtacgaatgagtgcctggacaataacggaggttgttcgcacgtgtgcaatgacctcaagatcggatatgagtgcgattgcccggacggattccagctggtggcacagcgcagatgcgaggacatcgatgaatgtcaggatccagacacttgttcacagctgtgcgtgaacctcgaaggaggctacaaatgtcagtgcgaagagggattccagctcgacccacacaccaaagcctgcaaggcggtggggagcatcgcctacctgttcttcaccaatcgccacgaagtgcgcaaaatgaccctggatcggtccgaatacacgtccctcatccctaatctgcgcaatgtggtggctctggacaccgaggttgcaagcaaccgcatctattggtccgatctgtcgcagcggatgatctgctcgactcagctggaccgcgcgcacggcgtgagttcctacgatactgtaatctcgcgggacatccaagcgcccgacgggctggcggtggattggattcacagcaacatttactggaccgactcggttcttggcactgtgagcgtcgcggacaccaaaggagtcaagcgcaagacgttgtttcgggagaacggaagcaaaccgcgcgccatcgtggtggatccagtgcatgggttcatgtactggactgattggggcaccccggccaagatcaagaaaggtggattgaacggagtggacatatactccctcgttaccgagaatatccaatggccgaatggaattactctggaccttctcagcggacggctgtactgggtcgactcgaaactccattcaattagttccattgatgtgaacggaggaaacagaaaaaccatcctggaagatgagaagagactggcgcatccgttttccctggccgtgttcgaggacaaagtgttctggaccgacatcatcaacgaggcgatcttctcggcgaatcggctgaccggatcggacgtgaaccttctggccgagaaccttctgtccccggaggatatggtgctgtttcacaatctcactcagccacggggggtgaactggtgcgaacggactaccctctccaatggtggatgccagtacctgtgcctgccggctccgcaaatcaatcctcactcacccaagttcacttgcgcctgccctgacggaatgcttttggcgagggacatgagatcgtgcctcactgaagcagaagccgcggtggccacccaggaaacgtccactgtgagactgaaagtgtcgtccactgctgttagaacccagcacactaccactcgccccgtcccagacacttcgagattgccaggtgctaccccgggactcactaccgtcgaaatcgtgaccatgtcgcatcaggctctcggggacgtcgccggacgtggaaatgaaaagaagccttcctcggttagagccctgtcgattgtgctgccgatcgtgctgctcgtattcttgtgcctgggagtgttcctgctctggaagaactggagactgaagaacatcaattcgatcaactttgacaatccagtgtaccagaaaactactgaagatgaagttcacatctgtcataatcaggacggatactcatacccttcgagacaaatggtgagcctcgaggacgacgtcgct

SEQ ID NO: 16064 - DNA, 2580 bp, Artificial Sequence
  Description of Artificial Sequence: Synthetic coding sequence
atgggaccctggggctggaagctgagatggactgttgccctgctcctcgctgcagcgggtacagctgttggggaccggtgtgagcgtaacgagtttcagtgtcaggacggaaaatgcatttcctataaatgggtgtgcgatggaagtgccgaatgccaggatgggtcagatgaatctcaggaaacctgtttgagcgtgacatgcaagagcggcgacttctcatgtgggggaagagtgaaccggtgtatcccccaattttggcgttgtgatggacaggtggactgcgataacggaagcgatgaacaaggctgcccgcctaaaacctgtagccaagatgagttccggtgtcacgacggaaaatgcatctctagacagtttgtatgcgacagcgatcgggactgtctcgatggctcagacgaagcctcttgcccagtgctgacttgcggcccagcatccttccagtgcaacagcagcacttgtattcctcagctgtgggcatgtgacaacgatccagattgcgaggacggaagtgatgagtggccccaaaggtgtcggggactttatgtcttccagggggactcctctccctgcagtgcctttgaattccactgtctctcgggagagtgcatccactcaagttggcgttgtgacggcggccctgattgtaaagataagagcgatgaggagaattgtgctgtagctacttgtcgtcctgatgaatttcagtgttccgacggcaattgtattcatggcagcagacagtgcgacagggaatacgattgcaaggatatgtcagatgaagtaggatgcgtgaatgtgaccttgtgtgaagggcctaacaaatttaagtgccattccggcgaatgtataaccctggacaaagtttgcaacatggccagggattgcagagattggtcagatgaacccattaaggaatgtggcacaaacgagtgcttggataacaatgggggttgttcccacgtttgtaatgacttgaaaatcggatatgagtgcgattgcccagacggatttcagcttgtggcccaacgccggtgtgaagacatcgacgaatgccaggaccccgacacatgctcccaactgtgtgtcaatcttgagggagggtataagtgtcagtgcgaggagggtttccagctggaccctcataccaaggcgtgcaaggccgtcggtagcatagcctatttgttctttaccaacagacatgaggtacggaagatgacactcgacaggtcagagtacaccagccttattcctaaccttagaaacgtggtggctctggacacggaagtcgccagcaatcgaatctactggtcagacttatcccagcgaatgatatgctcgactcagctggatagagctcatggtgtgagctcctacgatacagttatctcccgcgatatccaggctccagacgggctcgccgtcgattggatacattctaacatatactggaccgactccgttctggggacagtttccgtcgctgacaccaagggggtgaaacgcaaaacgctctttcgggagaatggaagtaaaccacgcgcgatcgtcgtggatcctgtgcacggctttatgtattggacagactggggaacccctgccaagattaaaaaaggtggcctcaacggcgttgacatttatagcctggttactgaaaatatccagtggccaaacggcattactctcgatctcctgagcggccgcctctactgggtggactcaaagttacattcaatcagcagcatagatgtgaatggcggtaatagaaagaccattctcgaagatgaaaagcggcttgctcatcctttttcgttggccgtgtttgaggataaggtattctggacagatattatcaacgaggccatcttttccgccaataggctcaccgggtccgatgtgaaccttctagccgaaaacctactttccccagaggacatggtcttatttcacaacctgacccagccccgaggagtgaattggtgcgaaaggacaacactgtccaacgggggctgccaatacctttgtctgcctgccccacagatcaacccacattcccctaaatttacttgcgcctgccccgatggaatgctgcttgctcgcgacatgcggagttgcctgaccgaagctgaagctgcagtcgccacccaggagacctccaccgtgagactgaaggtgtcatctaccgccgtacggacacaacatacaacaactcgtcccgtcccagatacttcccggttgccaggcgctacacccggactgactaccgtggaaatcgtcacaatgagtcaccaggcactgggagatgttgctgggcggggaaacgagaaaaaaccttccagtgttagggcactgtctatagtgcttccgatcgtgcttctggtgttcttgtgcctgggcgtgtttctgctgtggaaaaattggcgcttgaaaaacattaattctattaattttgacaaccctgtgtaccagaaaacaactgaagacgaggttcatatctgccacaaccaggacggctattcttacccttcaagacagatggtatctctggaggacgatgtcgca

SEQ ID NO: 16065 - DNA, 2580 bp, Artificial Sequence
  Description of Artificial Sequence: Synthetic coding sequence
atgggcccatggggatggaaactcaggtggaccgtggctctcttgctggcagccgcggggaccgcagtgggtgacagatgcgaacgaaacgagtttcagtgtcaagacggcaagtgcatcagctacaaatgggtgtgcgacgggtccgctgaatgtcaagatggaagcgacgagtctcaggagacatgtctaagcgtgacctgcaagtctggcgacttttcttgcggtggtcgtgtgaacaggtgcattcctcaattctggcgttgcgacggccaggtcgattgtgacaacggttcagacgagcagggatgcccacccaagacgtgtagccaggatgagttccgttgccatgacggtaaatgcatatcaaggcagtttgtgtgcgatagcgaccgcgattgtcttgacgggtccgatgaagcttcttgcccagtgctgacttgcgggccagccagtttccagtgcaattcgagcacatgcattccacagctttgggcctgtgataatgaccccgactgcgaagacggctctgatgaatggccgcagagatgtagaggactctatgtctttcaaggcgattcgagtccttgtagtgcgttcgaatttcactgcctgtctggagaatgcatccattcatcatggaggtgcgacggcggtccggactgcaaggacaagagcgacgaagaaaattgcgcggtcgcgacatgcaggcccgatgaattccagtgtagcgacggtaactgtattcatgggtcccggcagtgcgaccgtgagtacgattgcaaagatatgtcagacgaagttggatgtgtgaacgtgacactgtgcgaagggcccaacaagtttaaatgccattcgggagagtgcataaccttggacaaagtttgtaacatggcacgagactgccgagattggtcagacgaaccaattaaagagtgtggcacaaacgagtgtctagataacaacggggggtgtagccatgtctgcaacgatctaaagattgggtacgaatgtgactgtcccgacggtttccagttggtagctcagcgacggtgcgaggacatagacgaatgccaagatccagacacttgctcacaactgtgcgtaaatttagaaggaggatataagtgccagtgtgaagaaggtttccagttagacccccacacaaaggcctgcaaggctgtcggctcgattgcctacctcttttttacgaaccgtcatgaggtgcgtaaaatgacattggatcggtcagaatatacttccctcatccctaacctgcgcaatgtcgtcgcgctcgatactgaggttgccagcaacagaatctactggtccgacctgtcacagaggatgatttgctctactcagttggacagagcgcatggagtgtccagttatgacacagtgatctctcgggatattcaggcccctgacggtctggcagtggattggatccattcaaacatctactggaccgattccgttctcggtacagtgtcagttgctgatactaaaggcgttaagaggaaaactttattcagggagaatggatctaaaccccgcgccatcgtcgtggatcctgtacatgggtttatgtactggactgactggggcacacccgcgaaaataaaaaaaggggggctgaacggcgtggacatctattctctggtcacggaaaatatccagtggcccaatggaatcactctggacttactctccggacgactttactgggtggacagcaaactgcatagtatttcaagcattgacgttaatggaggaaacaggaagacgatcctcgaggacgagaaaaggctggcgcatccctttagtcttgctgtatttgaagataaggttttttggaccgacataataaacgaggctatatttagtgcgaacaggctgacagggtccgatgtaaatcttttagctgagaacctgctcagcccagaagacatggtgctctttcacaacttgacccagcctcgaggggtgaactggtgtgagcgaacgactttgagcaacggcggctgccagtacctgtgcttgcctgccccacagatcaaccctcacagccctaaatttacctgcgcatgcccggacggtatgttgctggcccgagacatgaggtcatgcttaacagaagcggaagccgcggttgctactcaggagacctctactgtgagactgaaagtgtcctctaccgcggttcgcacccaacataccaccacccgaccagtgccggatacttcacgactgcctggcgccacacctgggctgactaccgtggagattgtgacgatgtcacaccaggccctgggtgatgtagccggcagaggaaatgagaaaaaaccctcatccgtccgagcactgtccatcgtgcttcctatagttttgctggtgtttctctgcctgggtgtgtttctgctgtggaaaaattggaggctgaaaaacataaattcaattaatttcgacaaccccgtgtaccaaaaaactaccgaagacgaagtgcacatttgccataatcaagacggatacagttatccatctagacagatggttagtttggaggacgatgttgct

SEQ ID NO: 16066 - DNA, 2580 bp, Artificial Sequence
  Description of Artificial Sequence: Synthetic coding sequence
atgggaccctgggggtggaaactcaggtggactgttgccctcctgcttgcagccgccgggactgcagttggcgatcggtgcgagcgcaacgagttccaatgccaagatggtaaatgtatttcgtataagtgggtttgcgacggttctgctgagtgccaggatggatcggatgaatcccaggaaacttgcctgagtgtaacctgcaaatctggtgatttttcctgcggagggagagtgaatagatgcattccccagttttggaggtgtgatggccaggttgactgtgacaatggatcagacgaacagggctgcccgcccaagacgtgctcccaggatgaattccgctgccatgacggtaagtgcatttcacgccagttcgtgtgtgacagtgacagagactgcctcgacggctccgatgaagcgtcctgtccagtcttaacatgtggtccagcatcattccagtgtaattcaagtacttgcataccccaactatgggcttgcgataacgaccccgattgcgaagacggaagtgacgaatggccccagcggtgtagagggttgtacgtgtttcagggtgattcaagcccatgctctgcattcgaattccactgtctgagcggggaatgcatccatagttcatggcgctgcgatggaggccccgattgtaaagataaaagcgatgaggaaaactgcgctgtggccacatgcaggcctgatgagtttcagtgtagtgacggaaattgtatccatggatcacggcagtgcgatagggagtacgactgcaaagatatgtccgatgaggttggctgcgttaacgtgacactgtgtgagggacccaacaagtttaagtgtcacagcggggaatgtattactctggacaaggtgtgcaacatggctcgagactgtagagactggagcgatgaacctatcaaggagtgtgggaccaatgagtgtttggacaacaatggagggtgtagccacgtctgtaatgatctgaaaataggctacgaatgcgactgtccggatgggttccagttagtggctcaacggcgatgtgaggacatcgacgagtgtcaggatcctgacacatgcagccaactctgcgttaacctggagggcggctataagtgccaatgtgaggagggctttcaactcgacccccataccaaagcctgcaaggctgtagggtccatagcctatctgttctttactaatcgacacgaggtgcggaagatgaccctggaccgatcggagtacaccagcctgattcccaatttgaggaacgtcgtagccttggacacggaggtcgcctctaataggatctattggagtgacctgagccagcgaatgatctgcagtacccagctggaccgagcccacggtgtgagttcatacgataccgtgatatcccgggacatccaggccccagatggactggccgtggattggattcactctaacatctactggactgactctgtactgggcaccgtgagcgtagctgatacaaagggtgtaaagagaaagactctgtttagggagaatggcagtaagcctagggctattgtagttgaccccgtgcacggattcatgtattggacggattggggtacccccgccaaaataaaaaagggaggactgaacggggtggacatttatagcttagttacggaaaatattcagtggccaaacgggatcacactggatctgctgtcaggccgtctgtattgggtcgactcaaaactgcactcgatctcctcgatcgatgttaacgggggcaacaggaaaactattctcgaagatgagaaaaggctcgcacatccctttagtcttgccgtgtttgaagataaggtgttctggaccgacatcattaatgaggccatctttagtgcaaaccgtttgactgggagcgacgtgaacttactggcagagaacttgctgtcacccgaggatatggttctgtttcataatttaacgcagcctcgcggagtcaactggtgtgaaagaactaccttatcaaacggcggatgtcagtatctgtgccttcccgcccctcagatcaacccccacagtcccaagttcacatgcgcctgtcccgacggaatgctgttggcccgagatatgaggagctgtcttactgaagcagaagctgctgtggctacccaggagacctcgacagtgaggctgaaagtgtcttcaaccgcagttcgaacacagcacacaactacccgcccagtgcctgacacctctcgcctgcccggagcaacgcccggcctgaccaccgttgaaattgttactatgtcacatcaggccttgggggacgtcgccggacggggaaacgaaaagaagccaagctccgttagggccctatctatagtcttaccaattgtgctactggtgttcctgtgtcttggagtgtttctgctgtggaaaaattggcggctgaagaatattaattctatcaatttcgataacccagtgtatcagaagaccaccgaagacgaagtgcacatctgtcacaatcaagatgggtactcctacccctcgcgacagatggttagcctcgaagatgatgtggct

SEQ ID NO: 16067 - DNA, 2580 bp, Artificial Sequence
  Description of Artificial Sequence: Synthetic coding sequence
atggggccctggggatggaagctgaggtggaccgtggcactgcttctggcggcagcgggaactgcagtgggagacagatgtgagagaaatgaatttcaatgccaagacggcaagtgcatatcgtacaagtgggtgtgtgacggatccgcagaatgccaggacggttcggatgagtcgcaagaaacttgtctttccgttacctgtaagtcaggcgatttttcatgcggaggccgtgtgaaccgatgtatccctcaattttggcgttgcgatgggcaggtggattgtgacaatggttccgacgagcagggttgtccgcccaagacctgctcgcaagacgaatttcgttgtcatgatggaaagtgcatctcccggcaatttgtatgtgactcagatagagactgtctggatggttccgatgaagcgagttgccctgtgctgacctgtggtcctgcatcctttcagtgtaactcatctacctgcataccccaactttgggcctgcgacaacgatcctgattgtgaagatggatcggacgaatggcctcagaggtgtaggggattgtacgtgtttcagggtgacagctccccatgttccgcctttgaattccattgtctttcgggggagtgtatacattcgtcgtggcgctgcgacgggggccctgattgtaaggacaaatcagatgaggagaactgtgcggtggccacttgtcgacctgatgagtttcagtgttcggatggtaactgcatccatggctcgcgacagtgtgatagagaatacgattgcaaggatatgtcggatgaggtgggttgcgtgaacgttaccctttgcgagggacctaacaaattcaagtgtcattcgggagagtgtattacccttgataaagtgtgcaacatggcacgggattgtagagactggtctgatgaacctattaaggaatgcggtaccaatgagtgtcttgacaacaacggaggatgtagccatgtgtgcaacgaccttaagattggttacgaatgtgattgccccgatggttttcagctggtggcccaaagacggtgcgaggacattgacgaatgtcaggaccctgatacttgttcgcaactttgtgtcaatcttgaaggtggatacaagtgtcaatgtgaagaagggttccaactcgacccacatactaaggcatgtaaggcggtcggatccattgcttatcttttctttaccaacagacacgaggtgagaaaaatgacgctcgatcggtcggaatacacctcgctcatccctaatttgcgcaacgttgtggcactggataccgaggttgcaagcaatcgcatttactggtcggatcttagccaaagaatgatttgctcaacccagttggacagggcgcatggagtgagttcatacgatacggttatttcaagagatatccaggcgcctgatgggctcgctgtggactggattcactcgaacatttactggaccgactccgtgcttggaactgtctccgtcgccgacactaagggtgtcaagcggaaaaccctgttcagagagaatggttcgaagcccagagcgatcgttgtggaccccgtccacggattcatgtattggaccgattggggcacgcctgccaagatcaagaagggcgggctcaatggtgtggacatttacagcctcgtcactgaaaacattcaatggcccaacggtataaccctggacctgctttcgggacgcctttactgggtcgactcgaagctgcactccatctcctcgatcgatgtgaacggaggaaataggaaaaccatcttggaggatgaaaagcggctggcacatccattttccctggcggtctttgaagataaggtcttttggactgatatcattaatgaagcaattttctcagccaaccgattgactggttcagatgtgaaccttctcgcagaaaacctcttgtccccagaggatatggtgctctttcataaccttacccaacccaggggagtcaactggtgtgagagaactacccttagcaacggtggttgtcaatacctgtgccttccggccccccaaatcaacccacattccccaaagtttacttgtgcatgtccagacggaatgctgcttgcccgggatatgaggtcatgccttacggaggccgaagccgcagtggccacccaggagacttcaaccgtcaggcttaaagtgtcctcgaccgcagtgcgaacccaacataccaccactcgtcccgtgccagacacttcaaggctcccaggagccaccccggggcttactactgtggagatcgtgactatgagccatcaggcacttggagatgtcgccggaagaggtaatgagaaaaaaccctccagcgtgagagcactgagcattgtgcttccaatcgttctgctggtgtttctgtgtcttggtgtctttcttctgtggaagaattggagactgaaaaacataaacagcattaactttgataacccagtgtaccaaaaaacgactgaggacgaagttcatatctgtcataatcaagatggatactcatacccgtctcgccaaatggtcagccttgaagatgatgtggcc

SEQ ID NO: 16068 - DNA, 2580 bp, Artificial Sequence
  Description of Artificial Sequence: Synthetic coding sequence
atgggaccatggggctggaaacttcgatggaccgtggccttactgcttgcagccgccgggacagctgtgggggataggtgtgaaagaaatgagttccaatgtcaggacgggaaatgcatttcatataaatgggtgtgtgatggctcggctgaatgtcaggacggatcagatgaaagtcaagagacatgcctgtcagtgacatgtaaaagcggagatttctcctgtggcggacgcgtaaatcggtgcattccgcagttctggcgctgcgatgggcaggttgattgtgacaacggttctgatgaacaaggttgtcccccgaaaacgtgctcacaggacgaatttagatgccatgacggcaagtgcatcagcaggcagttcgtttgtgacagcgacagagattgccttgatggaagtgatgaagcgtcatgccctgtattgacgtgcggacctgcatcatttcagtgtaattcatcgacgtgcattccgcagctatgggcctgcgacaatgacccggattgtgaggacggctctgacgagtggccccaaagatgtcgaggtttatacgtctttcaaggcgattcgtcaccatgtagcgcgttcgagtttcattgcttatccggggagtgcatccactcttcatggcggtgtgacggaggccccgactgcaaagacaaaagtgacgaagaaaattgtgctgtcgctacctgtagaccggatgaattccagtgctctgacggtaactgcattcatggctcacgtcagtgcgatcgggaatatgattgcaaagatatgtctgatgaagtaggttgcgttaatgtaacgctttgtgagggcccgaacaaatttaagtgtcattcaggcgaatgtatcacattagataaagtgtgcaatatggcgcgtgattgtagagattggagtgacgaacctattaaagagtgcggaacaaatgaatgcttagataacaatgggggatgcagtcatgtctgtaatgatttgaaaataggatatgagtgtgactgtcccgatggttttcaactggtagcgcaaagaagatgcgaagatatcgatgaatgccaagatccggatacctgtagccagctttgcgtgaatcttgaagggggttataaatgccaatgcgaggaaggatttcagctggatccgcacaccaaagcatgcaaagccgtcggttctatcgcgtatctgttttttacaaatagacatgaggtcagaaaaatgacgctcgatcgttcggagtatacctctctgattccaaatctcagaaatgtggtggcactcgacacagaagtcgcgagcaatcgaatctattggtcagatctctcacaacgcatgatctgttcgacacagttagacagggcgcatggggtttcttcatatgatacggtaatctcgcgcgatatccaagcgccggacgggcttgcggtcgattggattcatagcaatatttactggactgatagtgtcctgggaacagtaagtgttgctgatacaaaaggcgtcaaaagaaagacactctttcgggaaaacggatcgaaacctagagcaattgttgttgatccagttcacggttttatgtattggacagattggggaaccccggccaaaattaagaaaggcggcctgaatggagttgacatctacagtttagtgactgaaaacattcagtggccgaatggaatcactttagatctgctgagcggccgtttatactgggttgattctaagctgcatagtattagctccatagatgtaaacggtggcaaccgcaaaacaattcttgaagatgaaaaacgtttggctcatccgttttcactggcagtttttgaagacaaagtgttctggaccgacattatcaatgaggcaatattttcagctaacagattaacagggagtgatgtaaacctgctggccgagaacctcctatccccggaagatatggtcctttttcataatcttactcaacctcgaggtgttaattggtgcgaacggacgacactctctaatggggggtgccagtacctgtgtctgccggcaccccagattaacccgcattccccgaagtttacatgcgcgtgccctgatggcatgttactggctcgggatatgagatcatgccttacggaagccgaggcagcggtagcaacacaagaaacatcaaccgtgcgtttaaaggtctcgagtacagcggtcagaactcaacatacgacgacacgaccggtgccagatacttcaagactacctggggccacaccgggacttacaacagtggaaattgtcacaatgtctcatcaagctcttggggatgttgcgggaagaggaaatgaaaaaaaaccgagtagtgtccgtgccctttcaatcgttctgccaattgtgctcctggtttttttgtgcctgggagtctttctgctttggaaaaattggcggcttaagaacatcaattcgattaatttcgacaacccggtctaccagaaaacgacagaggatgaggtccatatttgccataatcaggatggctattcttacccgtctcggcagatggtcagtctggaggatgatgtggca

SEQ ID NO: 16069 - DNA, 2580 bp, Artificial Sequence
  Description of Artificial Sequence: Synthetic coding sequence
atgggtccttggggatggaagttgcgctggaccgtggcgcttctccttgccgcggcaggcaccgcggtcggcgacagatgcgagagaaacgaattccagtgtcaggatgggaagtgtatttcatacaaatgggtgtgtgatggttcggccgaatgtcaggacggctcggacgagtcgcaagagacttgcctctcagtcacttgcaaatcgggagactttagctgtggaggacgcgtcaacaggtgtatcccgcagttctggcggtgtgatggccaggtcgattgtgataacggttcggatgaacagggatgtccgccaaagacgtgctcccaagatgagtttagatgtcacgatggaaaatgtataagccgtcagttcgtgtgtgattcggaccgcgattgtctggatggatcggatgaggcatcgtgtcctgtgctcacctgcggtccagcctcgttccagtgtaattcctcaacttgtatcccccaactctgggcttgcgacaacgaccctgattgcgaggatggaagcgatgagtggccgcaacgctgtcgggggctgtacgtgttccaaggcgactcctcgccttgctcggcttttgaatttcattgcctgtcgggagaatgcatccattccagctggcgatgtgatggcgggccagattgtaaggataagtcagatgaggaaaactgtgcagtggctacgtgtagaccagacgagtttcagtgtagcgacggcaattgtatccatggatccaggcaatgcgatagagaatacgattgtaaagacatgtcggacgaggtcggatgtgtgaacgtgactctctgtgaaggccccaataagttcaaatgccattcaggagaatgtatcaccctggacaaggtgtgcaacatggctcgggactgtcgtgactggtcggacgaacctatcaaggaatgcggcactaacgaatgtctcgacaataatggtggatgttcccacgtgtgcaacgacttgaaaatcggatacgaatgtgactgtcctgatggatttcagcttgtggcccaaagacggtgtgaggacatcgacgagtgccaagatccagacacctgtagccaactgtgtgtgaaccttgaaggaggttacaagtgtcaatgcgaggaaggatttcaactggacccgcatactaaggcctgcaaggcagtcggctcgatcgcatatctgtttttcactaatcgtcacgaggttaggaagatgaccctcgaccgctcggagtacacctcacttattccaaacctgagaaatgtggtggcgcttgataccgaagtggcatcgaatagaatttactggtcggatctgagccaacggatgatttgttcgacccaattggaccgtgctcacggagtgtcctcatatgataccgtgattagcagagatatccaagcgcccgatggactggctgtcgattggattcattcaaatatctattggaccgactccgttctgggaaccgtctcggtggcagacacgaagggagtgaagaggaaaactctgtttagggagaatggaagcaaacctcgcgcaattgtggtggaccccgtgcacggctttatgtactggaccgattggggaactccggcaaagattaagaaagggggacttaacggagtggacatatacagcctggtgactgaaaacatccagtggcctaacgggataacccttgatttgctctccggacggctttactgggtggatagcaagctccattctatttccagcattgatgtaaatggcggcaatcgaaagacgatcttggaggatgaaaagcgattggcacaccccttttccctggccgtgtttgaggataaagtgttctggaccgacattatcaacgaagcaattttctcggcaaaccgtcttaccggctcggatgtgaacttgctggccgaaaacctcctgtcacccgaagatatggttctttttcacaaccttactcagccccggggagtgaattggtgcgaacgaacgactctgtcgaacggaggatgtcagtacctgtgtctcccggcaccacagattaacccccatagcccaaagttcacctgcgcttgtcccgatggaatgcttctcgcaagggatatgcgatcatgtctgacggaggccgaagcggcagtcgcgacgcaagaaacttctacggttagactcaaagtgtccagcactgccgtgcggacccagcataccaccactcggcctgtgcctgacacctccagactgccaggtgcaaccccagggttgaccactgtggagattgtgaccatgagccatcaagccctgggagatgtggccggtcgcggaaatgaaaagaagccttcgtcggtgcgcgccctctcaatcgtgcttccaattgtcctgctcgtgttcctgtgccttggcgtgtttctcctttggaagaactggcggcttaagaacatcaattccatcaattttgataatccagtgtatcaaaagactaccgaagatgaagtgcatatttgtcataaccaagatggatactcatacccctccagacaaatggtgtccttggaagatgacgtggca

SEQ ID NO: 16070 - DNA, 2580 bp, Artificial Sequence
  Description of Artificial Sequence: Synthetic coding sequence
atggggccgtggggttggaagctccggtggaccgtcgctctgctgcttgccgcggccggtaccgccgtgggtgacaggtgcgagcgtaatgaattccagtgccaggacggtaaatgcatttcatacaaatgggtatgcgatgggtcggccgaatgtcaagacggcagcgacgaaagccaggagacttgcctctccgttacctgcaagtctggagacttttcatgcggaggacgcgtaaacagatgtattccgcagttttggcgctgcgacggacaggtggactgcgacaacggatcggacgaacagggctgcccgcccaagacttgctcacaggatgaattcagatgccatgacggaaagtgcatctccaggcaattcgtgtgcgactccgaccgggattgcctggatggcagcgatgaggcctcctgccccgtcctcacgtgtggccccgcctccttccaatgcaattcgtcaacttgcattccgcaactttgggcatgcgataatgacccagattgcgaggacggatccgacgagtggccacagcggtgccgcggactgtatgtgtttcaaggtgattccagtccgtgcagcgctttcgaattccattgcttgtcaggagaatgcatacactcgagctggcgatgcgatggcggaccagattgcaaggacaagtcggatgaggagaactgtgcagtcgccacctgcagaccagatgagttccagtgttcagatggaaattgtatccacggctcgcggcagtgcgaccgagaatacgattgtaaggacatgtccgacgaagtgggatgcgtcaatgtgaccctctgtgagggcccgaacaagttcaagtgtcacagtggtgaatgcatcactcttgacaaagtctgtaacatggcccgcgactgccgtgattggtcagatgaacctatcaaagagtgcggcactaacgaatgcctggataacaacggagggtgttcacatgtctgtaacgacctgaaaatcggatacgaatgcgactgcccggacggctttcaactcgttgcgcaaagacgctgcgaggatatcgacgaatgccaggaccccgacacctgctcgcagctctgcgtgaatctggaaggggggtacaaatgccagtgtgaggaaggtttccaattggatcctcacaccaaggcatgtaaagcagtgggaagcatcgcgtaccttttcttcaccaacagacacgaggtgcgcaagatgaccctggataggtcggagtacacttctctcatccctaacctgcggaatgtggtggcgttggacacggaagtcgctagcaaccgcatctattggtcggacctgtcccaacggatgatctgttccactcagctcgaccgggcacacggcgtttcaagctacgacactgtgatcagtcgcgacatccaagcccccgatggactcgctgttgattggattcattccaacatctactggaccgactcggtgcttgggactgtgtcggtggcagataccaagggcgtgaagcgaaagaccctgtttcgcgaaaatggatccaaaccacgcgccatcgtggtcgacccagtccacgggttcatgtactggaccgattggggcaccccggccaagatcaaaaagggaggattgaatggagtggacatctactcccttgtgaccgaaaacatccagtggccgaacggaatcacgcttgacttgctgtcagggaggctgtactgggtcgactcgaaactccactcgatttcctcaattgatgtcaacggcggtaatagaaagacgatactcgaggacgagaagcggctggcgcatccattcagcttggcggtgttcgaagataaggtgttctggaccgacattatcaacgaagccatattcagcgctaaccgactgacgggatcggacgtaaatctgcttgctgaaaacctgctgagcccggaagatatggtcctttttcataacctgacccagccgagaggcgtgaattggtgcgagcgcaccaccctcagcaacggtgggtgtcagtacctgtgtctcccagcaccgcagatcaacccgcactcgcctaagttcacttgcgcctgtccagacggaatgctgctcgccagggatatgcggtcgtgcctgactgaagctgaggcagcggtggcaactcaagaaacgtccactgtgcgcctgaaggtgtcatctaccgcggtgaggactcagcacactaccactcgccctgtccctgataccagccgcctgccaggagctactccgggactcaccactgttgagattgtgactatgagccaccaagccctgggagatgtggcgggacgcggcaacgagaagaagcctagttccgtgcgggcgctgtccatcgtgctgcccatcgtgctcttggtgttcctgtgcctgggagtctttctgctttggaaaaactggagactgaagaacatcaattcgatcaatttcgataatccggtctaccaaaagaccactgaggacgaggtgcatatctgccataatcaggacggatactcatacccgagccggcagatggtttcgctggaagatgatgtcgcc

SEQ ID NO: 16071 - DNA, 2580 bp, Artificial Sequence
  Description of Artificial Sequence: Synthetic coding sequence
atggggccatggggctggaagctgagatggacggtcgcgttgcttctggccgcagcaggtaccgcagtgggcgatcggtgcgagagaaatgaattccaatgccaagacggtaagtgcatttcatacaagtgggtatgcgacggcagcgctgaatgccaagacggctcggatgaaagccaggaaacatgcctttcagtaacatgcaagagtggggatttctcatgtggaggacgggtgaacagatgcatcccgcagttctggcgatgtgacggccaggtcgactgtgataatgggtctgatgaacaaggatgccccccaaagacatgttcccaagacgaatttcgctgccacgacggtaaatgcatcagcaggcagttcgtgtgcgactcagatagagattgtctcgatggcagtgatgaagcatcttgtcctgtactgacctgcggcccggcctcgtttcagtgtaattctagcacatgtatcccgcaactgtgggcctgcgataatgacccagactgcgaggacggttctgacgagtggccacagcgttgtaggggactgtacgtcttccagggggatagctcaccgtgtagtgctttcgagtttcattgcttgtctggggagtgtatccatagttcatggcgttgtgatggcggacccgactgcaaggataaatcagatgaagagaattgtgcagtcgcgacttgcaggccggacgagttccagtgctccgatgggaattgcatccatggctcgcgacagtgtgatcgtgaatatgactgtaaagacatgtcggatgaggttggatgtgtcaacgtgacgctctgcgaggggccgaacaaatttaagtgccactcaggagaatgcataaccctggacaaagtttgcaatatggctcgagattgtcgcgattggtcggacgagcctattaaggagtgtggcacgaacgagtgtctggacaacaacgggggctgtagtcacgtttgcaatgatttgaagatagggtatgagtgcgactgtcctgatggtttccaattggtcgctcagcgccgttgtgaagatattgatgagtgtcaggaccccgacacctgctcgcaactgtgtgtgaacctagagggcgggtataagtgccagtgtgaggaggggtttcaactggatccacatacgaaagcatgcaaggccgttggctcaatcgcttacctgtttttcaccaatagacatgaggttcgcaagatgaccctcgacaggtcagaatacacgtctctgatcccgaacctgaggaacgtggttgccttggatacagaggttgcgtctaacagaatctactggtcagacctgtctcagcggatgatttgctccacacagctcgatcgagctcatggcgtttcttcatatgataccgtgatcagcagggatatccaagcacctgatgggcttgccgtggactggatacactctaatatctattggacagattccgttctaggcactgtttctgtggcagacaccaagggcgtgaaacggaaaaccctgttcagagaaaatggctctaaaccgcgggccattgtggtcgaccccgtgcatggattcatgtactggaccgattggggcactccagccaagattaaaaagggaggcctaaacggtgtcgatatttactccctcgttacagagaatatacagtggccaaatggcatcacccttgacctgctctcaggtaggctatattgggttgacagcaagctgcattctatttcttccatcgatgttaacggaggcaacagaaaaacgatccttgaggatgaaaagcgactggctcacccgttcagcttggctgtgtttgaggacaaggtcttctggactgacattattaacgaagccattttttccgccaaccgccttacgggctctgacgtcaacctgctcgccgaaaaccttctcagccccgaggacatggtgctttttcataatctcactcagccccgcggcgttaactggtgcgaacgcaccaccttgtcaaacggcggctgtcaatatctgtgcctccccgcaccgcagataaaccctcacagcccaaaattcacgtgcgcgtgtccagatggtatgttgctggcgcgagacatgcgttcctgcctgaccgaagctgaggcggccgttgctacacaggagaccagcactgtccggctcaaggtcagttcaacagcggttagaactcaacacacaacaactagacccgtgcctgacacatcccggttaccgggtgcgacaccaggtctaactacggtggagattgtaaccatgagccaccaggccctgggggatgtggccggtagaggcaacgagaaaaagccttccagtgttagagccctgagcattgtgttgccaatcgtgctgctggttttcttgtgcctgggggtcttcctactctggaaaaactggcgcctcaaaaatataaattccattaattttgacaaccctgtgtaccagaagacaacagaagacgaggttcacatctgtcacaatcaggacggatattcatatccctcacgacagatggtatccctggaagatgacgtggcc

SEQ ID NO: 16072 - DNA, 2580 bp, Artificial Sequence
  Description of Artificial Sequence: Synthetic coding sequence
atgggaccgtgggggtggaagctgcggtggaccgtcgccctgcttctcgccgccgcgggaacggccgtgggcgatcgctgcgagcggaatgaattccagtgccaggatggcaaatgcatctcctacaaatgggtgtgcgacggctcggccgaatgtcaagatggatcggacgagtcacaggaaacctgcctgtcagtgacttgtaaatctggcgacttctcatgcggaggacgcgtcaatcgctgtatcccgcagttttggagatgtgacggacaggtggactgcgacaatgggtcggacgagcagggatgcccaccgaaaacttgttcccaagatgagttccggtgccacgacggaaaatgcatttcgcggcagttcgtgtgcgattcggacagagactgcctcgacggatcagacgaagcaagctgcccggtgctgacttgcggaccggcctcattccaatgcaatagcagcacttgcataccacagctctgggcctgcgataacgatccggattgtgaagatggatctgacgagtggcctcagcgctgccgaggactctacgtctttcaaggagactcgtcgccttgctccgcattcgagttccactgcctgtccggagaatgtatccactcgtcttggcgatgcgacggaggcccagattgcaaggataagagcgatgaggaaaactgcgccgtcgctacctgtcgtcctgacgaatttcagtgttccgatggcaattgcatccatggatctcgacagtgtgatagggaatacgattgcaaggacatgtccgatgaagtcggatgtgtgaacgtgactctgtgtgagggcccgaataagtttaagtgccattccggggagtgcatcactctggacaaggtgtgtaacatggcgcgcgactgccgggactggtccgacgaaccgatcaaagaatgtggcaccaatgagtgcctggacaacaacggaggatgcagccatgtgtgcaatgacctgaagattgggtacgaatgcgattgcccggatggattccagctggtggcgcagcgccgctgcgaagatatcgacgagtgtcaagacccggatacttgctcgcagctttgtgtgaatctcgaaggaggatacaagtgccaatgcgaggaggggttccaactcgacccgcacaccaaggcatgcaaggccgtgggttccatcgcctaccttttcttcactaatcggcacgaggtgcgcaaaatgactctggaccgaagcgagtacacctcgttgatcccaaatttgaggaatgtggtggcactcgataccgaggtcgcttcgaaccgaatctactggagcgacctgtcacaacgcatgatctgctcgactcagctggatcgggcgcatggtgtctcctcctacgacactgtgatctcacgagatattcaggcccccgacggactggccgtcgactggatccactcgaacatctactggacggacagcgtcctgggaacggtgtcggtggctgatactaaaggcgtgaagcggaaaactctgttccgggagaacgggtccaagccgagagctattgtggtcgatcccgtccatgggttcatgtattggacggattggggaactccggccaagatcaagaagggaggcctgaacggagtggacatttactccctggtgacggagaatatccagtggccgaacggaatcaccctggacctgctgtcgggacgcctgtactgggtggactcgaagctccatagcatctcgtccatcgatgtgaatggcggaaacagaaagactatcttggaagatgaaaagcgcttggcacatcctttctcgctggccgtgttcgaagataaggttttctggacggatatcattaacgaagccatcttctccgcaaaccgtctgaccggcagcgacgtgaacctgctggcagagaacctgctctcaccggaagatatggtcctcttccataaccttacccagccgagaggggtgaattggtgcgaacggaccactctgtccaatggaggatgccagtacctgtgcctcccggcgcctcaaatcaaccctcactcgccgaagttcacgtgcgcttgcccggacggcatgctcctggccagagatatgcgctcgtgtctgacggaagctgaagctgccgtggccacccaggaaacctcaaccgtcaggttgaaggtcagctcgaccgcagttcgcacgcaacacaccaccacccggccagtccctgacacctcacgattgcctggggccactccaggtttgactaccgtggagatcgtgaccatgtcccaccaggccttgggagacgtcgcagggaggggcaacgagaagaagccttcgtcagtgagagcgctgtccatcgtgctgccgattgtgctgctggtgttcctgtgcctcggtgtgttcctgctgtggaagaattggcgcctcaaaaacatcaactccatcaacttcgacaacccggtgtaccagaaaaccaccgaagatgaggtgcatatctgccacaaccaggacggatactcctacccgtcgagacagatggtgtcgctcgaggacgacgtggct

SEQ ID NO: 16073 - DNA, 2580 bp, Artificial Sequence
  Description of Artificial Sequence: Synthetic coding sequence
atggggccgtggggctggaaactgcggtggactgtggcactgctgctggctgctgctggtaccgccgtcggggacaggtgcgagcgaaacgagtttcagtgccaagacggcaagtgtatatcttataagtgggtctgtgacggatcagctgagtgccaggatgggtcagacgaaagccaggagacttgtctgtctgtaacatgcaaatcaggagacttcagctgcggcggtagagttaatagatgcataccccagttttggaggtgcgacggacaggtggattgtgacaacggtagtgatgagcaaggatgcccgcccaaaacttgctcacaggacgagtttaggtgccacgacggtaagtgtatcagcagacagtttgtttgtgattcagacagggattgtttggatgggtccgacgaggcttcttgcccagttttgacctgcggacctgcctctttccaatgcaactcttctacatgtatacctcagctttgggcatgtgataatgaccccgactgcgaggacggctctgacgagtggcctcagcgctgtaggggcctgtacgtcttccagggcgattccagtccttgcagtgccttcgagttccactgcctcagcggggagtgtatccattcctcctggaggtgcgacggcgggcctgattgtaaagataaaagcgatgaggagaattgcgctgttgccacatgtcgacccgatgaattccagtgcagtgatggaaactgcatccacggctctaggcagtgcgatagggaatacgactgtaaagacatgtccgacgaagtcgggtgcgtcaatgtgacattgtgtgagggccctaacaagttcaaatgccatagtggagagtgtatcactctggataaggtgtgtaatatggcccgagattgtagggactggagcgatgagcccattaaagagtgcggcaccaacgagtgtctggacaacaatggaggatgtagtcatgtgtgcaacgatctgaagatagggtatgagtgcgactgccctgatggcttccagctggtggctcaaaggcgatgcgaggatattgatgagtgccaggatccagacacatgtagccaattgtgtgtcaatctcgagggcggctacaaatgtcagtgtgaggagggatttcagctcgacccccacactaaggcttgtaaggccgtaggatcaatagcctatctgttttttactaacagacatgaggtgcggaagatgaccctggacagatcagaatacacatctttgatacctaatctgagaaatgttgtcgcactggacaccgaggtcgcctcaaacagaatctactggagtgacctctcccaacggatgatctgcagtacacagcttgatcgcgctcatggcgtctctagttacgacacagttataagccgcgacattcaggcgccagacgggctcgccgtggactggatccattccaacatttattggacagattctgttctcggcactgtatctgtggccgataccaaaggtgtgaagcgcaagactctctttcgggaaaacgggagcaagcctagggccatcgtagtggaccctgtgcatgggttcatgtattggacagactggggcacccctgccaagatcaaaaagggaggtctcaacggtgtggatatctattccctggtcacggaaaatatccagtggcctaatggcatcacgctggatctgctctctggcaggctgtattgggtcgatagcaaactgcactccatctcaagcattgacgtaaacgggggaaaccggaagaccatcctcgaggacgaaaagcggctggctcatccattttccctcgctgtgttcgaggataaggtgttctggactgatattatcaatgaggcaatcttcagtgctaatcgactgactggatcagatgtgaacttgttggctgagaatctcctttccccggaggacatggtcctttttcataatttgactcaacccaggggtgtgaactggtgcgagcggactactcttagcaatggcgggtgtcaatatctgtgtcttcctgccccccagatcaatccccactctccaaagtttacatgcgcctgccctgatggaatgctgcttgcgagagatatgcggagctgtctgactgaagcagaggctgctgtggccacgcaggagacctccacggtgaggctgaaggtcagctctaccgcagtccgcacacagcatactactacgcggcctgtccccgacacctcacggctgcctggagccacacccggcctgacaaccgttgagatagtgactatgtcccaccaagcactgggggacgtcgccgggcggggcaatgagaagaaaccatcaagcgtgagggcgctgagtattgttttgcctattgtactgctggtctttctctgcctgggagttttcctgctgtggaaaaattggagactcaaaaacattaacagcatcaactttgacaatccagtctaccaaaaaactactgaggacgaggtccatatctgtcataatcaagatggctacagctacccgagtaggcagatggtgtctctcgaggatgacgtggct

SEQ ID NO: 16074 - DNA, 2580 bp, Artificial Sequence
  Description of Artificial Sequence: Synthetic coding sequence
atgggcccatggggctggaaattgaggtggacagtagcactgttgctagccgccgcaggtaccgccgttggagatcggtgtgaaaggaacgagttccagtgtcaggatgggaagtgtatttcttataagtgggtgtgcgatgggagcgctgaatgccaggacggatccgatgagagtcaggaaacttgtctgagtgtgacatgtaaatcaggggacttctcctgcgggggacgagtgaataggtgtattccacagttctggaggtgtgacggccaggtagactgcgataatggttcagacgagcaggggtgtcctcccaagacgtgcagccaggatgaatttaggtgccacgatgggaaatgtatctcacggcagttcgtttgcgatagcgatagagactgtctggacggctccgacgaggcttcttgtcctgtcctaacatgtgggcccgcaagctttcagtgcaacagctctacttgcattcctcagctgtgggcatgtgataacgacccagactgcgaagatggaagtgacgaatggccacagcgttgccgcggcctgtatgtgtttcagggcgacagtagtccctgttccgcattcgaattccattgcctgtccggcgaatgcatacactcgtcctggcgatgcgacggtggtccagactgtaaggataagagcgatgaagagaactgcgcagtggccacctgccgcccagacgaattccagtgttctgatggaaactgcatccacggaagcaggcagtgcgaccgggagtacgattgcaaagatatgagtgacgaggttgggtgtgtgaacgtcacattgtgtgaggggcccaataagttcaaatgtcacagcggggagtgtataaccttggataaagtatgtaacatggcccgcgattgccgggactggagcgacgagccaataaaagagtgcggcaccaacgaatgtttggataacaacggcggatgctctcatgtttgtaatgatctgaaaattgggtacgaatgtgactgccccgatggatttcagttagtggctcagcggcgttgtgaagacatcgacgaatgccaggatcccgacacctgtagccaactgtgcgtgaaccttgaaggtggttataaatgccagtgcgaggaggggttccagctggatccgcacacaaaagcttgcaaggcagtcggatcaattgcttacttgttcttcacgaatcgccatgaggtaaggaagatgactctagacaggtcagagtacacctccttgatcccaaatcttaggaacgtagttgcactggacacagaagtcgcctctaatcgaatatattggagcgacctctcccaaagaatgatctgctcaacacagctggatcgggcacacggcgtttcttcatatgatacggtcatttcaagggacatccaggcccccgacggcttagccgtagattggatccattctaacatatactggacagacagcgtgctgggcactgtgagcgtagccgacacaaagggggtaaagcgcaagactttgttccgagaaaacggttcaaaaccaagggccattgtggtagatccagtgcacggattcatgtattggactgattggggaactccagctaaaataaaaaaaggaggcctgaacggcgtagacatctattctttggtcactgagaacatccagtggcccaatggtatcaccctggatctgcttagcgggaggctctactgggtcgattctaagctgcattcaatcagctctattgacgtgaacggggggaaccgaaaaacgattcttgaagacgaaaaaagactagcacacccattcagcctggctgtgtttgaggacaaggtgttctggactgacattataaacgaggcaatcttctcagctaatcggctaacaggctctgacgtaaacttgctggccgaaaatctgctgtctccagaggatatggtgctgttccacaacctgactcagccccgcggcgtgaattggtgcgaacggaccacactgtccaatggtgggtgtcagtatctctgcctgccagcgccacagattaaccctcactcccctaagttcacttgcgcgtgccctgacggaatgcttctggccagagatatgagatcatgtctcacagaagctgaagccgcagtggctacccaggaaacgtccaccgtgagattaaaagtctcttccaccgcagtgagaacgcaacatacgaccacacggcccgtaccagacacatctcggctgcctggagcaacccctggactgacaaccgtggaaatcgtgaccatgtcccatcaggccttaggagacgtggcagggagaggcaacgaaaaaaagccaagtagtgtccgcgccctgagcattgttctgcccatcgtcctgctggtcttcctgtgcctgggggtgttccttctttggaaaaattggagactaaaaaatattaatagcattaactttgataaccccgtttatcagaagacgacggaggatgaggttcatatctgccataaccaagacgggtattcgtacccatcccggcagatggtgtcacttgaggacgatgttgcc

SEQ ID NO: 16075 - DNA, 2580 bp, Artificial Sequence
  Description of Artificial Sequence: Synthetic coding sequence
atggggccatggggctggaagctccgttggaccgtagcattacttctcgctgccgctgggacagcagttggggatcggtgcgaacgcaacgaatttcagtgtcaggatggcaagtgcatcagttataaatgggtgtgtgatgggagtgcagagtgccaggatggcagcgatgaatcccaggagacatgcctgagcgttacatgcaagtctggagattttagttgtggcgggagagtcaacaggtgtattccccagttctggcggtgtgacgggcaggttgactgcgacaacggcagcgacgagcaggggtgtccgcctaagacctgttcacaggatgagtttcggtgtcatgacggaaagtgcataagtcgccagtttgtctgtgactctgaccgtgactgcctggacggctctgacgaagccagttgcccagtgctgacctgcggtccagcttccttccagtgtaattcctccacatgtatccctcagctttgggcatgtgacaatgatccagactgtgaagacggaagtgatgaatggccacaacgatgccgcggcttatacgtgtttcaaggagactcatcaccgtgcagcgcttttgagttccattgcctgtctggtgaatgtattcacagctcttggaggtgtgacggcgggcctgattgcaaagataaatcagacgaggaaaactgtgctgtcgctacctgtagacccgatgagtttcaatgttcagatgggaactgcattcacggcagccgccagtgcgatagagagtatgattgcaaggacatgtcagacgaagtggggtgtgtgaacgtgaccctatgcgaagggcctaataagtttaagtgccacagcggagagtgcatcaccctggacaaagtctgtaatatggctagggattgccgcgattggtcagacgagcccataaaggaatgtggtacaaatgagtgtctggacaacaatggtggatgtagccatgtttgtaatgatctgaagattggctacgagtgtgactgccccgatgggttccagctcgtcgcacagagaagatgcgaagatatcgacgaatgccaggatccagatacctgcagccagctctgcgttaaccttgagggaggctacaagtgtcagtgcgaggagggttttcagttagatcctcataccaaagcctgcaaagccgttggctcaattgcatatctgttcttcaccaatcgccatgaagtgagaaagatgaccctagacagaagcgaatatacaagtctaatacccaatctgcgcaatgtggtggctcttgatacagaggtagcatctaacagaatttattggtccgatctgtcacagcgtatgatttgtagtacccagctggatcgagcccatggcgtttccagctacgataccgttattagccgggatatacaggcccccgacggcctggccgttgactggatacactccaatatttattggacagatagtgtgctgggcaccgtcagcgtggctgacactaagggggtgaagaggaaaaccctattcagggagaacggttcaaaacctcgagccattgtggtcgatcctgttcatggctttatgtactggactgattggggcacccccgccaagattaaaaaagggggcttgaacggagtggacatttatagcctagtgaccgagaacatccagtggcccaatggtattactctggatttattatctggtcgattatactgggtcgacagcaagttgcacagtatatcatccattgacgttaatggcggtaatagaaagacaatcctggaagacgagaagaggctggctcatccattctccctcgccgtttttgaggataaagtcttctggactgacataataaacgaggccatatttagtgccaataggctgaccggcagtgacgtgaacctgctcgccgagaatctgctcagccccgaggacatggtgctgttccacaatttaacccagcccaggggggtcaattggtgcgagagaaccacattatccaatggcgggtgtcaatacctgtgcctgccagctccccaaataaacccacatagccctaaattcacctgtgcctgcccagatgggatgctcctcgcccgggacatgcggagctgtctgaccgaggccgaagccgcagtggcaacccaggagacatccacagtcagactgaaagtcagttccactgcagtccgcacccagcacaccaccaccaggccagtgcctgacactagtcggctgcccggagcaactcctgggctgacaactgtggagatcgttacaatgagtcatcaagccctgggggatgtggccgggagaggcaatgaaaaaaagccttcttcagtgcgtgcactgtccatagtgctaccaatagtgttgctggtgttcctatgcctgggcgtgttcctactgtggaagaactggcggctaaaaaatattaattcaatcaactttgacaatccagtgtaccagaaaacaactgaggatgaagttcacatatgtcacaatcaggatggatattcttaccccagcaggcaaatggtttctctggaagatgacgtcgct

SEQ ID NO: 16076 - DNA, 2580 bp, Artificial Sequence
  Description of Artificial Sequence: Synthetic coding sequence
atgggcccttggggatggaagctgcggtggacagtagctctcttattggcagccgctggaaccgcagttggagatcggtgtgagaggaacgaattccagtgccaggacgggaagtgtatctcatacaaatgggtgtgcgacgggagcgctgaatgccaggacggcagcgatgaatcccaggaaacgtgcctgagcgtgacatgcaaatctggggatttctcttgtggtgggcgcgtgaataggtgcatcccgcagttctggaggtgcgatggccaggtcgattgcgataatggttccgatgagcaggggtgccctcccaagacatgttcgcaggatgagttccgctgccacgatggaaagtgtatctctaggcagttcgtctgcgattcagacagggattgcctcgatggctctgacgaagccagctgtccagtgctgacgtgcggaccggccagcttccagtgcaattctagtacctgcattcctcagctttgggcttgcgacaacgatccagactgtgaagatggtagtgatgaatggccccagcgatgccggggcctgtatgtattccaaggggactcgagcccttgcagcgcgttcgagttccactgcctgtctggagaatgtatacactcttcctggcgatgcgatggcggcccagactgtaaagataaatcggatgaagagaactgtgcagtggccacgtgccggccagacgagttccagtgttccgatgggaattgtatacacggctctaggcagtgtgatcgggagtacgactgcaaggatatgagcgatgaggtggggtgcgtgaatgtgactctttgtgagggacccaacaaattcaaatgtcactcgggtgagtgtatcacactggataaagtatgcaatatggctcgcgattgccgcgactggagcgatgaacccattaaagagtgtggcacaaatgagtgtctggataataacggaggatgctcacacgtgtgcaatgacctgaagattggctacgaatgtgattgccctgatggcttccaattggttgctcagaggcggtgcgaggacatagacgaatgccaggaccctgacacttgtagtcagctgtgcgttaacctggagggaggatacaagtgtcagtgcgaagagggctttcagttggaccctcatacaaaggcttgcaaagcggtgggaagcatcgcatatctcttctttacaaaccgccatgaggttcggaagatgaccctagatagatcagagtacactagcctcatccctaacctgaggaatgtggtggctctggacacagaggtagcgagcaatcggatatactggtccgatctgagccagagaatgatatgcagcacccagctggatagggcacacggcgtctcttcctatgacacagtgatcagcagagacattcaagcccctgatggtctggccgttgattggatacattccaatatttattggacggattcggtacttggaaccgtttcagttgctgatacgaaaggcgtgaagaggaaaaccctgttcagggaaaacggctcaaaaccaagagcaatcgtggtggaccccgttcacggatttatgtattggactgattggggtacgcctgctaaaatcaagaaaggcggattgaacggagtggacatctacagcttagttaccgaaaacattcagtggcccaacggcattaccctggatttgctgtccgggagactgtactgggtggattccaaacttcattcgatctcgagtatagacgtgaacggtggcaaccggaaaaccattctggaagacgaaaagaggctcgcccacccatttagtctggcagtgtttgaggacaaagtgttctggaccgacattattaacgaggctatcttttctgctaacagacttacgggatcagacgtgaatttactcgcggagaacctgttaagtccggaagatatggtgctctttcacaatttaacacagccgaggggcgtgaactggtgtgagaggacgaccctgtctaacggcggctgtcaatatctgtgtttacccgccccacaaataaacccacatagccccaagtttacctgcgcttgccccgacgggatgcttttagctcgggacatgagatcctgtctgaccgaagccgaggcagcggtcgcaacccaagagaccagcaccgtccggctgaaggtgtcatctaccgccgtgcgcacccaacataccacaacccgcccagttcccgacacatctcgtctgcccggcgcaactccgggcctgacaacagtggaaatcgtgactatgtcccaccaagcattaggagatgtcgccgggcggggaaatgagaaaaagccttcttccgtccgggctctgagcatcgtgcttcctatagtcctcctagtgttcctgtgtctcggcgtcttcctgctctggaaaaactggaggctgaaaaacatcaacagtattaactttgataatcccgtctatcagaagaccaccgaagatgaagttcacatctgtcacaaccaggacggctactcctaccccagccggcaaatggtatcacttgaggacgacgtggcc

SEQ ID NO: 16077 - DNA, 2580 bp, Artificial Sequence
  Description of Artificial Sequence: Synthetic coding sequence
atggggccctggggctggaaactgcggtggacagtggctttactgctggcggctgccggcacagccgtgggagacaggtgcgaacggaacgaattccaatgccaggacggcaagtgcattagttataaatgggtctgcgacggaagcgccgagtgccaggatggcagcgacgaaagtcaagagacgtgcttgagtgttacctgtaaaagcggggatttctcttgcgggggccgtgtaaacaggtgcataccacaattctggcgttgtgatgggcaagttgactgcgacaatggctctgacgaacaaggctgtcctcctaagacttgtagccaggacgagtttaggtgccacgatggaaaatgcatatctaggcaatttgtctgtgatagtgaccgggattgcctagacggtagtgacgaggcgtcatgccccgtgctcacttgtggccctgcaagtttccagtgtaactcctcaacttgtatacctcagctgtgggcctgcgacaatgacccagactgtgaggatggatcagatgagtggcctcagcggtgtagaggattatacgtgtttcagggggattccagcccatgttcagcctttgagtttcattgcctcagcggtgagtgcattcactcatcatggagatgcgacggcgggcccgactgtaaagacaaaagcgatgaagagaactgtgccgtagccacctgccggccagacgaatttcagtgttccgacgggaactgtatccatggctcccgacagtgcgaccgtgagtatgactgcaaggacatgtctgatgaggtggggtgcgtgaacgttactctctgcgaagggccaaacaagttcaagtgccactctggggagtgcatcaccctggataaagtgtgcaacatggctcgggactgcagggactggtcagatgagccaataaaggaatgcggtaccaatgagtgccttgataataatggcggttgtagccatgtgtgtaacgacctcaaaatcgggtacgaatgcgactgccccgacggctttcagcttgtagctcaacgtcgctgtgaagatatcgacgagtgccaggatccagatacatgttctcagttatgcgtaaatctcgaaggcggttataagtgccagtgtgaggagggcttccagctggatccccacacaaaggcttgtaaggcagtcggctctatcgcatatctgttttttactaacaggcacgaggtcagaaaaatgactctggataggtctgagtacacctccctgatccctaacctccggaacgtcgtagcattggataccgaggttgctagcaacaggatttactggagcgacttgtcccaaaggatgatatgttctacgcaactcgaccgggctcacggagtaagttcttacgatacagtcatttcccgagacatccaggcacctgacggcctcgcagtcgactggattcattcaaatatctactggactgatagtgtgttaggcactgtcagcgtcgcggataccaaaggagtgaagcggaaaactttattccgggaaaacgggtccaaaccccgcgccatcgtggttgaccctgtccatgggtttatgtattggacagactggggtacaccggcgaagatcaagaaaggcggactaaacggcgtagacatctattcattggtcactgagaacatacaatggccaaacggcatcacgctcgacctgctttctggccggttgtactgggtggattcgaagttgcacagtatcagctcaattgatgtgaacggcgggaatcgaaaaaccattctcgaggatgagaaacggctggcacaccccttctctctggctgtgtttgaagataaggtgttctggactgacattatcaacgaggctattttttccgctaatcggctgacagggtctgatgtgaacctgttagccgagaatctgctttctcctgaggatatggtcctgtttcataacctgacccagcctcggggggtgaactggtgtgagaggacgactttgtccaatggcggctgtcagtacctctgcttgccggcgcctcaaatcaaccctcactctcctaaatttacctgcgcctgccccgatgggatgctgctcgctagggacatgagaagctgcttgactgaggccgaggctgcagtggctactcaggaaacaagcacagttcggctaaaagtcagcagcacagccgtgagaactcagcacaccaccacacgacctgttcccgacacaagcaggctgcctggagccactcccgggttaaccacggtggagatcgtgactatgtcacatcaggcactaggggatgtggcgggaaggggcaatgaaaaaaagccctcttcggtccgcgcgctgtcaatagttttaccaatcgtgctgctggtctttctgtgtttaggagtgttccttctctggaaaaattggcggctcaagaacattaattcgatcaatttcgacaatcctgtctatcagaaaacgacagaggacgaagtgcacatctgccataaccaggatgggtatagctacccttcgcgacagatggtcagtctggaggacgacgtagca

SEQ ID NO: 16078 - DNA, 2580 bp, Artificial Sequence
  Description of Artificial Sequence: Synthetic coding sequence
atgggtccgtgggggtggaaacttcgctggacggtggcactgctgttggcagccgccgggacggccgtcggggaccgctgtgagcggaacgagtttcaatgtcaggatgggaaatgtatttcgtacaaatgggtgtgcgacggatcagctgaatgccaagatggttcggatgagagccaagagacttgcctgtcagtgacttgtaagagcggcgacttttcatgcggaggaagagtgaaccgctgtattcctcaattttggcggtgtgatggccaagtggactgtgataacggaagcgatgagcaagggtgtccccccaagacttgttcgcaggacgaatttagatgccatgatggcaaatgcatttcacgtcaatttgtgtgtgattcggacagggattgtctggacggcagcgatgaagcatcgtgccctgtcctgacttgcgggccggcatcgttccaatgtaacagctcaacctgcattcctcagctctgggcctgcgacaacgatcccgattgtgaggatggatcagatgaatggccacaaagatgcaggggtctgtatgtgtttcagggtgatagcagtccatgttccgcatttgaatttcattgtctgtcaggcgagtgcattcactcgagctggcgttgtgatggaggtcctgactgtaaagataaaagcgatgaggaaaactgtgcggtggcaacttgtcgccccgatgaatttcaatgcagtgatggtaattgtattcatggtagccgtcagtgtgatagggagtacgactgcaaggatatgtccgatgaagtgggttgcgtgaatgtgaccctgtgcgagggccctaacaagtttaagtgtcactccggcgagtgtatcactctggacaaggtgtgcaatatggcgcgcgactgtcgggactggagcgacgagcctattaaggaatgcgggactaacgaatgtctggacaataatggaggctgtagccatgtttgtaacgacctcaaaattggatacgagtgtgattgcccggatgggtttcaacttgtcgcacagcggagatgtgaagatatcgacgagtgccaggatccagacacctgctcacaactttgtgtgaatctggaaggtggttacaagtgtcaatgtgaggaaggattccaactggacccacataccaaggcgtgtaaagcagtgggatccattgcatacctctttttcaccaataggcatgaagtgagaaaaatgactttggatcgttctgagtacacttccttgattcctaaccttagaaatgtggtggcactggacacggaagtcgcatctaacagaatttactggtccgatttgtcccaaagaatgatatgctcgacccagcttgatcgtgcccatggagtgagttcgtacgataccgtgatttcccgagatatacaggcccccgatgggctggccgtggattggatccattcgaacatctactggactgactccgtccttgggaccgtttccgtggcagatactaagggagtcaaacgtaagactcttttcagggaaaatggctccaaaccacgcgccatcgtggtggaccccgtccatgggttcatgtactggactgattggggaaccccagcgaagattaagaagggaggtcttaacggagtggatatctattcgctggtgaccgagaatattcagtggcccaatggaatcactctcgacctgctttccggaaggctgtactgggtggattccaagctgcattccatatcctcaatcgacgtcaacggaggtaaccgtaagactatacttgaggacgagaagagacttgcacatccattttcgctggcggtgttcgaggataaagttttttggaccgatatcattaacgaagccatattctcggcgaatagactgaccggttccgacgtgaaccttctggcagagaacctgctctccccagaggacatggtgcttttccataaccttactcagccgcgcggggtcaactggtgtgaacggaccactctttcaaacggaggctgtcagtacctgtgtttgccggcacctcaaatcaatccacattccccaaagtttacgtgtgcctgccccgacggaatgctccttgctagggatatgcgctcttgcttgactgaagcagaggcagcggtggctacccaggaaacttccactgtgaggctgaaggtttcgtccacggccgtccgaacgcaacacaccaccactcgtccggtgcctgatactagcaggctccctggagccacccctgggcttaccaccgtcgaaattgtgactatgtcgcaccaagcactcggcgatgtcgcaggtcgtggcaatgaaaagaagccatcgtcggtcagagccctgtcgatcgtcctgccaatcgtcctgctggtgttcctgtgcctgggtgtctttcttctttggaagaactggcgactcaagaacataaactccatcaatttcgacaaccctgtctaccagaaaaccactgaggatgaagtccacatctgtcacaatcaggacggttacagctacccttcacgtcagatggtatcccttgaggatgatgtggcc

SEQ ID NO: 16079 - DNA, 2580 bp, Artificial Sequence
  Description of Artificial Sequence: Synthetic coding sequence
atgggcccctggggttggaaattgaggtggaccgtggccttgctgctggcggccgcgggcactgctgtgggagatcggtgcgagcgcaatgagttccagtgtcaagacggaaagtgtatcagctacaagtgggtgtgcgacggttccgcagaatgtcaggacggatctgatgaatcacaggaaacgtgcctgtcggttacgtgcaagtcaggagatttctcctgtggcggcagggtgaacagatgcatcccacagttttggcgatgcgatggacaggtcgactgcgacaacggatccgacgagcaaggatgcccacctaagacttgttcgcaggatgaatttagatgccacgacggaaaatgcatttcgcggcagttcgtgtgcgactcagaccgcgattgtttggacggctccgatgaggccagctgcccagtgttgacttgcgggccggcttccttccagtgtaactcgtctacctgtattccgcagctgtgggcgtgcgacaatgatccggattgcgaggacggatcagacgaatggcctcaacggtgtcgcggactctacgttttccagggagattcatccccttgctccgcttttgagtttcactgcctgtcaggagagtgcatccactcttcgtggcgctgtgacggcggtcccgactgtaaggacaagtccgatgaggagaactgcgccgtggcaacttgccggcctgacgagttccagtgctccgacggaaactgcattcacggatcgcggcagtgtgaccgggaatacgattgcaaggacatgagcgatgaagtagggtgcgtgaacgtcactctctgcgaaggccctaataagttcaaatgtcactctggagaatgcatcactctggataaggtgtgcaatatggctcgggattgcagagactggtcggatgaaccgatcaaggagtgcggtaccaatgagtgcctggataacaatggtggatgcagccacgtgtgcaacgatctgaagatcggatacgagtgcgattgccccgatggattccagctggtggcacaacggcggtgcgaggacatcgatgaatgtcaagaccctgacacttgctcccagctgtgcgtgaatctggagggcggatacaagtgtcagtgtgaggaaggattccagctcgacccacataccaaggcgtgtaaggctgtgggctcaattgcgtacctgtttttcacgaaccgccatgaggtccggaagatgactttggatcgcagcgaatatactagcctgatcccgaatctcagaaatgtggtggcccttgatactgaagtggcctcgaaccgcatctattggtccgatctctcgcagcgcatgatatgttccacccagcttgacagggcccatggagtcagcagctacgacaccgtgattagccgggacattcaggcgccagacggactcgctgtcgactggatacactcgaacatctactggaccgattcggtcttgggtacggtcagcgtggcggacactaagggagtgaagcgcaagaccctgtttcgtgaaaacggctccaaaccccgggccatcgtggtggatccagtgcatggcttcatgtactggacggactggggaaccccggccaagattaagaagggcgggctgaacggagtcgacatctactcccttgtcactgagaacatccaatggccgaacggaatcaccctggatttgctgtcgggccggctgtactgggtcgactcaaaactgcactcgatctcctcgatcgacgttaatggggggaatagaaagactatactggaagatgaaaaaaggctggctcaccctttcagcctggcggtctttgaggacaaggttttctggactgacatcatcaacgaagcgatcttctccgcgaaccgcctcaccggatcggatgtgaatttgctcgccgaaaacctgctcagcccggaagatatggtcctgttccacaacctgactcagccgcgcggggtgaattggtgcgagaggaccactctttccaatggcggctgtcagtacctgtgcctgccagcgccgcaaatcaatccgcattctccaaagttcacctgtgcctgtcctgacggaatgctgctggcgagggacatgagatcttgcctgaccgaggcggaagcagcggtggccactcaggaaacttcaactgttcgcctgaaagtctcgtcaaccgccgtgcgtactcagcataccacgactcgcccagtcccggacacttcccgcctgccaggcgcaacgccgggcttgactactgtcgaaattgtcactatgtcccaccaggcactcggagacgtcgcaggccgcgggaacgaaaagaaaccaagcagtgtgcgagcgctgtccatcgtcctgccaatcgtgctcctcgtgtttctctgcctcggtgtgttcctgttgtggaagaactggagactcaagaacatcaactcaatcaattttgataatcccgtgtaccagaaaactaccgaggacgaagtgcacatttgccataatcaggacgggtactcgtacccttccagacagatggtgtcacttgaggacgacgtggcc

SEQ ID NO: 16080 - DNA, 2580 bp, Artificial Sequence
  Description of Artificial Sequence: Synthetic coding sequence
atgggaccttggggctggaaactccggtggactgtggcgcttttgcttgccgctgcagggacggccgtgggagatcgctgtgaacgcaacgagtttcagtgtcaggacggaaaatgcataagttacaaatgggtttgcgacggcagtgccgagtgccaagacgggtctgacgagtcccaggagacatgtctcagtgttacctgtaagtcaggcgatttttcctgcggaggacgcgttaaccgctgtatcccccaattctggcgctgtgacggccaagtggattgcgacaacggctccgatgagcaaggttgtcctcctaaaacctgttctcaggatgagtttcgatgccacgacggtaaatgtatctcacgacagtttgtgtgcgactccgatcgggactgtctggacgggtccgatgaggcttcctgccctgtgttgacgtgtggacctgcctccttccaatgtaatagcagtacctgcataccacagctatgggcctgtgacaatgatcctgattgcgaggacgggagcgacgagtggcctcagcgatgccgtggactctacgtgttccagggcgatagttccccatgtagcgccttcgagtttcactgtctgagcggcgaatgtatccattcaagctggagatgtgatggcggtccagattgtaaggacaaatctgatgaggagaactgtgctgtggctacatgtaggcctgatgagtttcagtgtagtgatgggaactgtattcatgggagccgccagtgtgaccgcgaatatgactgtaaagacatgtctgatgaggtggggtgcgtgaatgtgacattatgcgagggtcccaataagtttaagtgtcatagcggcgaatgtatcaccctggacaaagtttgcaatatggcacgcgattgtcgggattggtccgacgagcctataaaagagtgcggcacgaatgagtgcctggacaataacggtggatgttcgcatgtctgcaatgacctgaagattggatatgagtgtgattgccctgacggattccagctggttgcgcagaggcggtgcgaagacattgacgaatgtcaggaccctgacacttgttctcagttgtgcgtcaatctcgaaggcgggtacaaatgccaatgtgaggaaggctttcagctcgatccacacaccaaagcctgcaaagcggtgggatccatcgcctacttatttttcacgaaccgacacgaggtccgtaaaatgactctggatagaagtgagtacactagtcttatccccaatctcagaaacgttgtggctttggatacagaggtcgcttccaataggatttattggtcagatctttcgcagcgcatgatttgttctactcaacttgacagggctcacggcgttagcagttacgatactgtcattagcagagacatccaggccccagacggcctggccgtggactggatacacagcaacatctactggactgatagcgtgttagggactgtatccgtggcagatactaaaggcgtgaagcgcaaaacgctgttcagagagaatggtagtaaaccacgcgcaatcgtcgtcgatccagttcacggttttatgtactggactgactggggcaccccagccaaaattaagaaaggcgggctcaatggcgtggatatttactctttggtgactgagaacatacagtggcctaatggtatcactctcgacctgcttagtgggaggctgtattgggtcgactccaagctgcactctatctctagcatcgacgtgaatggcggtaacaggaaaaccatcctggaggatgaaaagagactcgcccacccttttagcttggccgtcttcgaagacaaggtcttttggactgatataatcaacgaggctattttcagtgccaatcgtctgaccggctccgacgttaacctgctcgccgaaaaccttctctcccctgaggacatggtgttatttcacaacctaacacagcctagaggagtcaactggtgcgagcgcactaccctgtctaacggcgggtgccagtatttgtgcctgcccgcacctcagatcaaccctcacagtcctaagttcacgtgtgcgtgtccggatgggatgttgctcgcaagggacatgcgctcctgtctgacggaggccgaggccgcggttgcaactcaggagacatccactgtgcgcttaaaagtgtctagtactgcagtcaggacgcaacacacaactacccgccctgtgcctgacacatctaggctgcccggcgctacgccaggcctgaccaccgttgaaatagtgaccatgtcccaccaggccctgggagatgtagcgggtaggggcaatgaaaaaaagccatcttccgtcagagcactgagcatcgtactccccatcgttctgctggtgttcctctgcctgggagtgttccttttgtggaaaaactggagattgaagaatatcaacagcatcaacttcgacaatcctgtgtaccagaagacaaccgaagatgaggtccacatatgccacaatcaggacggttactcatatccatcccgccagatggtgagcttggaagacgacgtcgct

SEQ ID NO: 16081 - DNA, 2580 bp, Artificial Sequence
  Description of Artificial Sequence: Synthetic coding sequence
atggggccctgggggtggaaacttcggtggacagtggctctgctcctagctgccgctggaacagctgtgggagatcgatgcgagcggaatgaattccagtgccaggatggaaaatgtatcagttataaatgggtctgtgacgggagtgccgaatgtcaggatgggtcagacgaaagtcaggaaacatgcctttctgttacttgtaaatctggagattttagttgcggagggagagtaaaccggtgtatacctcagttctggcgctgtgatggacaggtggattgcgataatggatctgatgagcagggatgcccccctaagacatgttctcaggatgaatttcgatgtcacgatggaaaatgtataagtagacaattcgtttgcgattctgatagagattgcctcgatggatccgatgaagccagttgtccagtgctaacttgtggacctgcatccttccagtgtaactctagtacatgcatcccccagttgtgggcttgtgataacgatcccgattgtgaagatggatcggatgaatggccacagcggtgtaggggactctacgtgttccagggggattcttctccttgctctgcatttgaattccactgcctctcaggggaatgtattcattctagttggcggtgtgatggaggaccagactgtaaagataaatccgatgaagagaactgtgccgtggcaacttgtcggccagatgaattccagtgctccgatgggaactgcatccacgggtcccgacagtgtgatagggagtacgattgcaaagatatgtccgatgaagtagggtgcgtaaacgttacgctctgcgaagggcctaacaaattcaaatgtcattccggagaatgcatcacattagataaagtttgtaacatggctagagattgtagggattggtctgatgaacctataaaagaatgcgggacaaacgaatgccttgataataatggaggatgctcccatgtgtgtaatgatttaaaaatagggtacgaatgcgattgtccagatgggttccagctcgtggcacagcggcggtgtgaagatatcgatgaatgtcaggatcctgatacatgttctcaactatgcgtgaacctcgaaggagggtataaatgccaatgcgaggaagggtttcagctagatcctcacacaaaagcctgtaaagctgttgggtccattgcctatctcttcttcacaaatcgacacgaagttaggaaaatgactctcgatcgcagtgaatacacatcactcattcccaaccttagaaacgtagttgcactggatactgaagtagcctctaatcgaatttattggtcagatctttctcagagaatgatctgttcaactcagctcgatcgggctcatggagtttcctcatatgatacagtcatttctcgagacatccaagcccccgatgggctagctgtagactggatccactctaatatatattggactgattccgttctcggaactgtaagtgtggccgacacaaaaggggtaaaacgcaaaacactctttagggagaatgggtctaaaccccgcgcgattgtggtggatccagtgcacggatttatgtattggactgattgggggactcccgctaagattaaaaaaggggggttaaacggggtagatatctatagtcttgtaacagagaatattcagtggcccaacgggatcacacttgatctgctatctgggaggctttattgggtggattctaaactccactccatatcttccatcgatgtcaatgggggaaatcggaagacaatcctagaggatgaaaaacgccttgcccatccattttcactggctgtcttcgaagataaagtgttctggactgatataattaatgaagccatcttttcggctaaccgattgacaggatcagacgtgaacctactcgcagagaacttactatctcctgaggatatggtgcttttccacaacctcactcagccccgtggggtgaattggtgtgaacgaactactctgtcaaacggggggtgccagtacctatgtctgccagctccccaaatcaaccctcattcccctaaattcacttgcgcctgccccgatggaatgcttctggccagagatatgcggtcctgcctgacagaagctgaagcggctgttgctactcaagaaacatctacggtacgattaaaagtgtcttccacagcagtgaggactcagcatactactacacgccccgtgccagatacttctagattacccggagctactcctgggctgactactgtagaaatagtaacaatgtcccatcaggctcttggagacgttgcaggaagggggaacgaaaaaaaaccctctagtgtgagggccctgtcgatcgtgttacctatcgtactgctagtctttctatgtctaggagtgttcttactttggaaaaattggagactcaaaaacattaactcaattaattttgacaacccagtctatcagaaaacaacagaggacgaagtacacatttgtcacaaccaggacgggtattcctatcccagtaggcagatggtgagtctggaggatgatgtggca

SEQ ID NO: 16082 - DNA, 2580 bp, Artificial Sequence
  Description of Artificial Sequence: Synthetic coding sequence
atgggaccatggggatggaaattacggtggacggtcgctctcctcttggctgctgccggtactgcggtgggagaccgttgcgaacggaatgagtttcagtgccaggatggtaagtgcatttcttacaagtgggtatgcgacggatcggctgagtgccaggacgggagtgatgaatcgcaagaaacatgtttatcggtaacttgcaagtcaggagactttagctgtggcgggagagtcaaccgctgcattccccaattctggaggtgcgacggacaggtggactgcgataatggttccgatgagcaaggttgccccccaaaaacgtgctcccaagatgaatttcgttgtcacgatgggaagtgcatcagtcgtcagttcgtgtgtgatagcgaccgcgactgcctcgatggttcggacgaagcctcgtgccctgttttaacttgcgggccggcatcgttccaatgcaactcaagcacatgtattccacagttgtgggcctgcgataatgatcccgactgtgaggacggcagcgatgagtggccacaaagatgccgcgggctgtatgttttccaaggtgattcgagtccgtgctcggccttcgaattccactgcctttccggggaatgcattcatagttcgtggaggtgtgatggcggacccgattgcaaggataagtcagacgaggagaactgcgcggttgctacttgtcgacctgatgagtttcagtgttccgatgggaactgcatccacgggtctaggcaatgtgaccgggagtatgactgtaaggacatgtcagatgaagtcggctgtgtgaacgttacattgtgtgaaggcccgaacaaatttaagtgccattctggtgaatgcatcacattagacaaagtgtgcaatatggcaagagactgcagggattggtctgatgaacccattaaggagtgcggaacgaatgagtgcttggataataatggcggttgtagccacgtctgcaacgacttgaaaatcggttacgagtgtgattgccccgatggtttccagcttgtcgcccaaaggcggtgcgaggatatcgacgaatgtcaggaccctgatacctgctcacaactatgtgtaaatctcgaaggagggtacaagtgccagtgcgaggagggtttccaattggatccgcatacgaaagcgtgtaaggctgtaggtagtattgcgtatttgttcttcacaaaccgacacgaggtacgtaagatgaccctggaccgttcagagtacacgtctttaattccgaatctgcggaatgtcgttgcactcgatactgaagttgcgtctaatcgaatttattggtccgacctgtcccagcgcatgatctgcagcacccagctcgacagggctcatggcgtgagttcgtatgatactgttatttcacgggacattcaggctccagatgggctggcggtcgactggatacactctaacatctactggacagattctgttctaggaactgtgtccgttgctgatacgaagggagtgaagcgcaagacactctttcgggagaatggcagtaaaccacgtgcaattgtcgttgatccggtccacggatttatgtactggaccgattggggcacacccgcaaagatcaaaaaaggcggcttgaacggcgtcgacatatatagcttggtgactgagaatatccagtggcctaacggaattacgctggatttactttctggcagactctattgggtggattcaaagttacatagtatctcctctattgacgttaatggaggcaatcgaaaaactatcctggaggacgagaagcgcctagcccatcctttcagtctagctgtcttcgaagacaaagtcttttggactgatatcattaacgaggcaatattctccgccaatcgtttaaccggttctgacgttaatctcctcgctgagaacctgctctccccagaagacatggtattattccataacctcacccagccacgtggggttaactggtgcgagcgcaccacactatcgaacggaggatgccagtatctctgcttaccggccccgcaaattaatccccacagccccaagttcacgtgcgcatgtcctgatggaatgcttttggcacgagacatgcgaagctgcctaaccgaagcggaagccgcggtggcaacgcaggagacttcaacggttcgtctcaaggtctcctctactgccgtgcgaactcagcacacaactacccggccagtgcctgacacctctcgcctgccgggagccacaccggggttaacaacagtggaaatcgtgaccatgtcccaccaggccctcggcgatgttgcgggtcgtggaaacgagaagaaaccttcgtccgtccgcgcgttgtctatcgttctgcctatcgtcttactagttttcctgtgtctgggcgtcttcctcttgtggaagaattggaggttaaagaacattaactccataaatttcgacaaccctgtctaccaaaagactactgaggacgaagtgcatatttgccacaaccaggacggttacagctacccatccagacaaatggttagcttagaggacgacgttgcc

SEQ ID NO: 16083 - DNA, 2580 bp, Artificial Sequence
  Description of Artificial Sequence: Synthetic coding sequence
atggggccttgggggtggaaattgaggtggacggttgccctgctgctggcagccgcggggacggctgtgggagataggtgcgaaaggaatgagttccaatgtcaagacgggaagtgcatttcatacaagtgggtgtgtgatgggtcagcagaatgtcaagacggcagcgacgagtctcaagagacatgtctgagtgtcacctgtaaatctggagacttttcttgtggagggcgtgttaaccggtgcatcccacagttttggcggtgcgatggccaagtcgattgtgacaacgggtcagatgagcaggggtgtccaccaaaaacgtgctctcaagacgaatttcggtgccacgatggaaagtgcatatcccggcagttcgtgtgcgattctgatagagactgcctggacggctcggatgaagcatcctgccccgtgctgacatgcgggcccgcctcttttcagtgcaatagcagtacatgcatcccccagctttgggcatgcgataatgaccccgactgtgaagacggctccgacgagtggccacagaggtgccgaggcctctatgtgtttcaaggagacagttccccttgtagtgcatttgaatttcattgcctttccggagagtgcatacactcttcctggaggtgtgacggcggtcccgactgcaaagacaaaagcgacgaagagaattgtgccgttgccacatgtcgtcccgacgaattccagtgctcggatggcaattgcatccatgggagcagacaatgcgatagagaatatgattgtaaggacatgtcggatgaggttggctgtgttaatgtgactctttgcgagggacctaataagttcaaatgccatagcggggagtgcatcaccctggacaaagtctgtaacatggccagagattgtcgagattggagcgacgaacccattaaggagtgtggtacaaacgaatgcctggataacaacggcggttgttctcacgtgtgtaacgatctgaagattggatacgagtgtgactgtccagacgggttccagctggtagcccagcgccgctgtgaggacattgatgagtgccaggatccagacacttgcagccagttgtgcgttaatctggagggagggtacaaatgtcagtgcgaagagggcttccagttggatccacacactaaagcttgcaaggccgtgggctcgatagcttatttgttttttactaataggcacgaggttcgaaagatgaccctcgatcggagtgaatacacaagtctaattccaaacctccggaacgtggttgctctggacaccgaagtcgctagcaatagaatctactggagtgatttgagtcaacgaatgatatgctccacccagcttgacagagctcacggtgtctccagctatgataccgttatctcaagggacatacaggcccccgatggactcgcagtggattggattcactctaatatctactggaccgactccgtactaggaacggtgtccgtggcagacaccaagggtgttaagcgcaagacactgttcagggagaacggcagtaaacccagggccatagtcgtggacccagtgcacggatttatgtactggaccgactggggcactccagccaaaattaaaaaggggggcctgaacggtgtggacatctactcccttgttacagaaaacatccagtggccaaacggaattactttagatctgttgagtgggagattatattgggtggatagtaagctgcacagtatcagttctattgatgtgaatggagggaaccggaaaacgatccttgaagatgagaagcggctcgcccaccctttttccttggcagtgttcgaagataaggtgttttggacagatattattaacgaggccatcttttctgccaaccgcctaacggggtcagatgtgaatctacttgctgagaatttgctctcaccagaagatatggtgttgtttcataatctcacccagccacgcggcgtaaattggtgcgagaggacgaccctgtccaatggtggatgccagtacctgtgcctgcccgcgccacagatcaatccccactcacccaagtttacttgtgcatgtccagacgggatgctgctagctcgcgacatgcgatcctgtctgacggaggccgaggctgcggtggccacccaggaaaccagtactgttcggctgaaagtgtcctcgacagcagtgcgtacgcagcacaccaccactcggccagttcccgacacttctaggctccctggcgccacccccggactgaccacggtggaaatagttaccatgtcccaccaggctttgggcgacgtggcgggcaggggcaacgaaaagaaaccttctagcgtacgggccctctccatcgtgttgcccatagtcctcttggtattcctgtgtctcggcgtatttttgctctggaagaattggagactcaaaaacatcaactctatcaattttgataaccccgtgtaccagaagaccactgaagacgaggtacacatttgccataatcaagacgggtattcctacccctccagacagatggtgtccctcgaagatgatgttgcc

SEQ ID NO: 16084 - DNA, 2580 bp, Artificial Sequence
  Description of Artificial Sequence: Synthetic coding sequence
atgggaccgtggggatggaagctgcggtggaccgtggcgctcctcctggcggcagcaggaacggcagtgggtgaccgctgcgagaggaatgagttccaatgtcaggacgggaagtgcatctcctacaagtgggtgtgcgacggatcggccgaatgccaagacggctcagatgaatcgcaagaaacttgcctgtcagtgacctgtaaatcgggcgatttcagctgtggaggcagagtcaatcggtgtatccctcagttctggagatgtgacgggcaagtggactgcgataacggtagcgacgaacagggatgccctcccaagacttgttcccaagatgaattccggtgtcatgacggcaaatgcatttccaggcagtttgtgtgcgactcagatcgggactgcctggacgggtccgatgaggcttcctgcccggtcctcacctgcgggccggctagcttccaatgcaattcatcgacctgcatcccccaactttgggcatgcgacaacgaccccgattgtgaagatggatcagacgaatggccccagaggtgccgaggactgtacgttttccagggcgactctagcccgtgctcagcgttcgaattccactgcctctcgggagagtgcatccatagttcctggaggtgcgacggtggtccggactgtaaagacaaatccgacgaggagaactgcgcagtggctacgtgccggcccgacgaattccagtgctccgatggtaactgcatccacggaagcagacagtgtgaccgcgagtacgactgcaaggatatgtcggatgaagtgggctgcgtcaacgtgactctgtgcgaaggtccgaacaagtttaagtgccactcgggtgagtgcatcaccctcgacaaggtgtgtaatatggccagagattgtcgtgactggtccgacgaacctatcaaagagtgcggaactaatgaatgcctcgacaacaatgggggatgttcccacgtttgcaatgacctgaagatcggttacgagtgtgactgcccagacggcttccaactggttgcgcagcgccgctgcgaggacatcgacgagtgccaggatccagatacctgcagccagctgtgcgtgaacctcgaaggaggatacaagtgccagtgcgaggaaggattccagttggaccctcacaccaaggcgtgcaaggcagtcgggagcatcgcttatttgttcttcaccaatagacatgaggtgaggaagatgaccctggatcgctctgagtatacgtccctcatcccaaacctgcggaatgtcgttgcattggacaccgaagtggcctccaaccgaatctactggagcgacctctcgcagaggatgatctgctcaactcagctggaccgagctcatggagtgtcgtcttacgatactgttatctcccgggatatccaggctccggatggcctcgccgttgactggatccattcgaacatttactggaccgattccgtgctcggaaccgtctcagtggcggatacgaagggcgtgaagcgcaaaaccctgttcagagagaatggatcgaagccaagagcgattgtcgtcgacccagtgcatggctttatgtactggaccgactggggaaccccagcaaaaatcaaaaagggcgggcttaatggcgtcgacatctacagtctggtcactgaaaacattcaatggccgaatggaatcacccttgacctgctttcgggacgactctactgggtggattccaagctgcactccatctcctcgatcgacgtgaacgggggaaaccgcaagacgattctcgaggacgagaagcggcttgctcacccattctcattggctgtattcgaagataaagtgttttggaccgatatcatcaatgaggcgatcttcagcgcgaaccgcctcactggaagcgatgtgaacctcctggcggaaaatctcctgtcgcccgaggatatggtgctctttcataacctcactcaaccacgcggagtgaactggtgtgagcggacgactctgagcaacggaggttgccagtacttgtgcctcccggctccccagattaatcctcactcccctaaattcacgtgtgcttgtccggacgggatgctcctggcacgcgatatgagatcatgcctcaccgaagcggaagccgcggtcgcaacccaggagactagcactgtgcgcctgaaggttagttccactgcagtccgcacccagcacaccaccactcgccctgtcccggacacctcccgccttcccggggcgaccccaggacttactactgttgaaatcgtgacgatgagccaccaggccctgggcgacgtagccgggcgtggcaacgaaaagaaaccgtcctcggtgcgcgccctgtccattgtgttgcctatcgtgctgctggtattcctgtgcctgggcgtgtttctgctctggaagaattggcggctgaagaacattaactcgatcaactttgataacccggtgtaccaaaaaactactgaggatgaagtgcatatatgtcacaaccaagatggctacagctacccatcgagacaaatggtgtcattggaagatgatgtggcc

SEQ ID NO: 16085 - DNA, 2580 bp, Artificial Sequence
  Description of Artificial Sequence: Synthetic coding sequence
atggggccttgggggtggaagctgcggtggactgtcgctctgctgttggcggcggccggcactgctgtgggagatcgttgcgagcgcaacgagttccaatgccaggacggaaaatgcatcagctacaagtgggtctgcgatgggtcagccgaatgccaagacggatccgacgaatcccaagagacttgtcttagcgtcacgtgtaaatccggcgacttctcgtgtggtggccgtgtgaatcgctgcataccccagttctggcggtgtgatggtcaggtggactgtgataacgggtccgatgaacaaggatgtccaccaaaaacgtgctcccaagatgagttccgatgccacgacggaaagtgcatctcgagacaattcgtgtgtgactccgaccgagactgcttggatggctcggatgaagcctcctgccctgtgctcacttgcggccccgcgtctttccagtgcaacagctctacttgtatcccgcagctgtgggcctgtgacaatgacccggactgtgaggacggatcggatgaatggccacagagatgtcgcgggctgtacgtgttccagggggacagctcgccttgctcggccttcgagttccactgcctgagcggagagtgcatccactcctcatggcggtgtgacggaggcccagattgcaaggataagtccgatgaagaaaactgcgccgtggcgacgtgtagacctgacgaatttcaatgctcagatggcaactgcatccacggaagcaggcagtgtgatcgcgaatacgactgcaaagatatgtcagacgaggtgggatgtgtgaacgtgactctgtgcgaaggtcccaacaaattcaagtgccactcgggggagtgcattacgctggataaggtgtgcaatatggcccgggactgcagagactggtctgacgagccaatcaaggaatgcggaaccaacgaatgcctcgacaataacggtggctgctcgcacgtctgcaacgatctgaaaatcggctacgagtgcgattgcccagatggttttcaactcgtggcccaacgcagatgcgaggacatcgacgagtgccaagacccggacacttgctctcaactgtgtgtgaatttggaaggcggatacaagtgccagtgcgaagagggattccagttggatccacacaccaaggcgtgcaaggcggtgggatccattgcctatcttttctttactaacagacatgaagtcaggaagatgactctcgacagaagcgaatacacgtctctgatccccaatctccgcaacgtggtcgcgctggacacggaagtggccagcaatcgcatctactggtcagatctctcgcaacggatgatctgttcgacccagctggatcgcgcccacggagtctcgagctacgacaccgtcatctcgcgggacatccaggcacctgacggactggcagtggattggatccattccaacatttactggactgactctgtcttgggcaccgtgtcggtcgcggacactaaaggagtgaagagaaagaccctgttccgggaaaacggcagcaagcctcgcgcgatcgtggtggaccctgtccacggtttcatgtattggaccgactggggaactccggccaaaatcaaaaagggaggtcttaacggagtggacatttactcgttggtcaccgaaaacatccagtggccgaacgggattaccctggacctgctgtccggtagactttactgggtggatagcaagctccacagcatcagcagcatcgatgtgaacggagggaaccgcaagactattctcgaagatgagaagcggttggcacacccatttagcctcgcggtgttcgaggataaggttttttggacggatatcatcaacgaggcgatcttctccgcaaaccggctgaccggctccgacgtgaatctcctcgccgaaaatctgctctcgccagaggacatggtcctgtttcacaatctgacccaacctagaggggtcaattggtgcgagcgcaccaccctcagcaacggaggatgccagtacctttgtctgccggccccgcagattaatccgcactcgcctaagttcacttgcgcatgccccgatggaatgctgctggccagagatatgcgctcctgtctgactgaagctgaggcggcagtggcaactcaggagacttccaccgtgcgcctcaaagtctcctctaccgcggtgcggacccagcataccactactcgcccggtgccggacacctcccgcttgcctggcgccaccccaggattgactaccgtggaaatcgtgaccatgtcacaccaggctctgggcgatgtggctggtcggggaaacgagaagaaaccctcctccgtgcgggctctgtcgatcgtcctgccgattgtgttgcttgtgttcctgtgtctgggggttttcctcctctggaagaactggcggttgaagaacatcaactcaatcaattttgacaatccggtgtaccagaaaactaccgaagatgaagtgcatatctgtcacaaccaggacggatactcctacccgagcaggcagatggtgtcactcgaggacgatgtcgcg

SEQ ID NO: 16086 - DNA, 2580 bp, Artificial Sequence
  Description of Artificial Sequence: Synthetic coding sequence
atgggtccgtgggggtggaagctccggtggactgtggccctgctgctggcagccgctgggactgctgtcggcgacagatgcgaaagaaacgagttccagtgtcaggacggcaagtgtatctcatacaagtgggtctgcgacggcagcgccgagtgccaggacggatcagacgagtcgcaggagacttgcctgagcgtcacttgtaagtcaggagatttctcgtgcggaggtagagtgaatcggtgcatccctcagttctggcgctgtgatggacaggtggactgtgacaatggatccgacgagcaaggatgcccgccaaaaacgtgctcccaagatgagttcaggtgccatgacggaaaatgcatctcacggcaatttgtctgcgattccgatagggattgcctggatggtagcgacgaggcctcttgccctgtgctgacctgcggaccggcctcttttcagtgcaattcctctacttgcattcctcagctctgggcatgcgacaatgatcccgactgtgaggacggatccgacgaatggccgcagcggtgccggggactgtacgtgttccaaggagactcctcaccctgttccgcgtttgagttccactgcctgtccggagagtgtatccattcctcctggcggtgcgatggaggacccgactgcaaggacaagtcggatgaggaaaattgcgcagttgccacttgtcggccggacgagttccaatgctcagacggcaactgtatccacggatcgaggcaatgtgatcgggagtacgactgcaaagatatgtccgacgaagtgggatgcgtgaacgtgactttgtgcgaaggtccgaataagttcaagtgccactcgggtgaatgcattaccctcgacaaagtgtgcaatatggcacgcgactgtcgcgactggtccgatgaaccgatcaaagaatgcggtacgaatgagtgcctcgacaacaacgggggatgttcacacgtgtgtaacgatctcaagatcggttacgaatgcgactgcccggatggctttcagcttgtggcgcagcggaggtgtgaagatatcgatgagtgccaagacccggatacttgcagccaactgtgcgtgaacctggaaggaggatacaagtgtcagtgcgaagaaggttttcagctcgatccacataccaaagcgtgtaaggctgtcggctcgatcgcctacctgtttttcacgaatagacatgaagtgaggaagatgaccctggaccggtcggaatacacttcgctgattccgaacctgagaaacgtggtggccctggacaccgaagtggcctccaaccggatctactggtcagatctgagccaacggatgatctgttccacccaactggaccgagcccacggcgtctcgtcctacgataccgtcatatcgcgggacattcaggcgccggacggactggcggtggattggatccactccaacatctactggaccgattcagtgctgggaaccgtctcggtcgcggacaccaagggcgtgaagcgcaagaccttgttccgggagaatggatcaaagcctcgagccatcgtggtggaccctgtgcacggcttcatgtactggacggactggggaacccctgcaaagatcaaaaaaggtggtttgaatggagtggacatttactcgcttgtgaccgaaaacatacaatggcccaatggcatcaccctggacttgctgagcggccgcctgtactgggtggactccaagttgcattccatctcatcgattgatgtcaacggaggaaacagaaaaaccatcttggaagatgagaagagactggctcatcccttctccctcgctgtctttgaggataaggttttctggaccgacatcatcaacgaagctatcttctcggccaacaggctgaccgggtcggacgtgaacctgctcgccgaaaatctgctgagcccagaagatatggtcctgttccacaacttgactcagccacgcggcgtgaactggtgcgagaggaccactctgtcaaatggaggctgccaatacctctgtctcccggcgccgcagatcaacccgcactcaccgaaattcacctgcgcctgtcctgatggcatgctgctggcccgggatatgcggtcctgcctgacggaggccgaggctgcggtggccactcaggaaacctccactgttcgcctgaaagtgtccagcaccgcagtgcggacccagcatactacgacccggcctgtgccggatacttcgcgcctgcctggagccaccccgggactgacgactgtcgagatcgtgaccatgtcgcaccaagcgctgggtgatgtggccgggaggggaaacgaaaagaaaccatcctcagtcagagcgctgagcatcgtcctccccatcgtgctgctggtgttcctttgcctcggggtctttctgctgtggaaaaactggcggctgaagaatatcaattccattaacttcgacaacccagtctatcaaaagacgaccgaagatgaagtgcacatctgccacaaccaagacggttattcttacccatcacgacagatggtgtctttggaagatgacgtggcg

SEQ ID NO: 16087 - DNA, 2580 bp, Artificial Sequence
  Description of Artificial Sequence: Synthetic coding sequence
atgggtccgtggggttggaaactacgttggacggtagcgctactattagcggcggcgggtacggcggtaggtgatcgttgtgaacgaaatgaatttcaatgtcaagatggtaaatgtatatcgtataaatgggtttgtgatggttcggcggaatgtcaagatggttcggatgaatcgcaagaaacgtgtctatcggtaacgtgtaaatcgggtgatttttcgtgtggtggtcgtgtaaatcgatgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgttgtcgtggtctatatgtatttcaaggtgattcgtcgccgtgttcggcgtttgaatttcattgtctatcgggtgaatgtatacattcgtcgtggcgttgtgatggtggtccggattgtaaagataaatcggatgaagaaaattgtgcggttgcgacgtgtcgaccggatgaatttcaatgttcggatggtaattgtatacatggttcgcgacaatgtgatcgtgaatatgattgtaaagatatgtcggatgaagttggttgtgtaaatgtaacgctatgtgaaggtccgaataaatttaaatgtcattcgggtgaatgtataacgctagataaagtttgtaatatggcgcgagattgtcgtgattggtcggatgaaccgataaaagaatgtggtacgaatgaatgtttagataataatggtggttgttcgcatgtatgtaatgatctaaaaataggttatgaatgtgattgtccggatggttttcaactagttgcgcaacgacgttgtgaagatatagatgaatgtcaagatccggatacgtgttcgcaattatgtgtaaatttagaaggtggttataaatgtcaatgtgaagaaggttttcaattagatccgcatacgaaagcgtgtaaagcggtaggttcgatagcgtatctattttttacgaatcgacatgaagttcgtaaaatgacgttagatcgatcggaatatacgtcgctaataccgaatctacgtaatgtagtagcgctagatacggaagttgcgtcgaatcgaatatattggtcggatttatcgcaacgtatgatatgttcgacgcaactagatcgagcgcatggtgtatcgtcgtatgatacggtaatatcgcgagatatacaagcgccggatggtctagcggttgattggatacattcgaatatatattggacggattcggtattaggtacggtatcggttgcggatacgaaaggtgtaaaacgtaaaacgctatttcgtgaaaatggttcgaaaccgcgtgcgatagtagtagatccggtacatggttttatgtattggacggattggggtacgccggcgaaaataaaaaaaggtggtttaaatggtgtagatatatattcgctagttacggaaaatatacaatggccgaatggtataacgttagatctattatcgggtcgtttatattgggtagattcgaaactacattcgatatcgtcgatagatgtaaatggtggtaatcgaaaaacgatactagaagatgaaaaacgtttagcgcatccgttttcgctagcggtttttgaagataaagttttttggacggatataataaatgaagcgatattttcggcgaatcgattaacgggttcggatgtaaatttattagcggaaaatctattatcgccggaagatatggttttatttcataatctaacgcaaccgcgtggtgtaaattggtgtgaacgtacgacgttatcgaatggtggttgtcaatatttatgtttaccggcgccgcaaataaatccgcattcgccgaaatttacgtgtgcgtgtccggatggtatgttactagcgcgagatatgcgatcgtgtctaacggaagcggaagcggcggttgcgacgcaagaaacgtcgacggtacgtttaaaagtatcgtcgacggcggtacgtacgcaacatacgacgacgcgaccggtaccggatacgtcgcgtttaccgggtgcgacgccgggtctaacgacggtagaaatagtaacgatgtcgcatcaagcgctaggtgatgttgcgggtcgtggtaatgaaaaaaaaccgtcgtcggtacgagcgctatcgatagtattaccgatagtattactagtatttctatgtctaggtgtttttctactatggaaaaattggcgactaaaaaatataaattcgataaattttgataatccggtatatcaaaaaacgacggaagatgaagtacatatatgtcataatcaagatggttattcgtatccgtcgcgacaaatggtttcgctagaagatgatgtagcg

SEQ ID NO: 16088 - DNA, 2580 bp, Artificial Sequence
  Description of Artificial Sequence: Synthetic coding sequence
atgggcccatggggctggaagctgaggtggaccgtggccctgctccttgccgctgccggaaccgccgtgggtgaccgttgcgagagaaacgagttccaatgccaagacggcaaatgtatttcctacaagtgggtgtgtgatggctctgccgagtgccaggacggctcagatgagagtcaggaaacctgcctgagtgtaacttgtaaatctggtgacttttcatgtggaggcagggtgaacagatgtattccccagttctggcgctgcgatggacaggtcgactgtgataatggcagcgatgagcagggttgcccaccaaaaacttgttcccaagacgaatttcgttgtcacgatggcaagtgcatatcaagacagtttgtctgtgattcagaccgcgattgtctggacggttctgacgaggcaagctgtccagtcctgacatgcggtcctgcttcttttcagtgcaatagctctacatgtattcctcagctctgggcttgtgataacgaccccgattgtgaagacggaagcgacgaatggccacagcgctgccgtggactgtacgttttccaaggtgactcttccccctgctcagctttcgaattccactgtctgtccggcgagtgtatccattcaagctggcgttgtgacggcggacctgactgtaaggataaaagcgacgaggagaattgtgccgtcgcaacttgccgtccagacgaattccagtgctcagatggtaattgtattcatggtagtcgtcaatgcgacagggagtatgactgcaaagacatgtcagacgaagtgggttgcgtgaatgtaaccctctgtgagggacccaacaaatttaagtgtcattctggtgaatgtattacccttgacaaggtctgcaatatggctcgcgattgcagagattggtccgacgagcccatcaaagaatgtggtactaacgagtgtctcgataataatggtggttgctcccacgtttgcaacgacctcaaaatcggatatgagtgcgactgcccagacggcttccaattggtggcacagagacgttgcgaagatatcgacgagtgccaggaccctgacacttgtagtcagctgtgtgtcaacctcgagggcggatacaagtgccaatgtgaggagggtttccaacttgacccacacacaaaggcatgcaaggctgttggcagtatcgcctacctgtttttcaccaatcgccacgaggtgcgtaagatgactctcgatcgttctgaatacactagtcttatccccaacctcaggaacgttgtggccttggatacagaagtagccagcaatcgcatctactggtctgacctgtcacagaggatgatatgctccacccagttggaccgcgcccatggtgtttcctcctacgacactgtcatctctcgtgatatacaggccccagatggacttgccgtggactggatacactctaacatttactggactgattctgtgcttggaaccgtttctgtggccgatactaagggagttaaaagaaaaaccctgtttagggaaaacggcagtaagccacgtgcaattgtggttgatcctgtccacggctttatgtactggaccgattggggcacccctgcaaagattaagaaaggcggtctgaacggcgtagacatctattctttggtgactgaaaacattcagtggcctaatggtattactctggaccttctctccggtaggctctactgggtagacagcaaactgcattccatttcaagcatcgacgtcaacggaggcaacaggaaaaccattctcgaggacgagaagagactcgctcatccattttctcttgctgtgtttgaggacaaagtgttctggaccgatattatcaatgaggccatttttagtgctaacagactgactggtagcgatgtgaacctgcttgctgaaaacttgctctctcctgaggacatggtattgtttcacaatctgacccagccaagaggtgtgaattggtgtgaacgcaccactctgtcaaacggtggatgccagtatctgtgcctgcctgctccacagatcaaccctcactctccaaagtttacatgcgcatgcccagatggtatgctcctcgctagggacatgagatcctgcctcacagaggcagaggctgcagtggcaactcaggaaacttcaaccgtgaggctgaaggtgagctctaccgctgttcgcacacagcacaccacaacacgtcctgtccccgatacttctcgtctcccaggcgccacacctggtttgacaaccgttgaaattgtgactatgtctcaccaggctttgggagatgtagccggccgtggcaatgaaaagaagccctcttccgttcgcgcactgtccatagtgttgcctattgtgctgttggtgtttctctgtcttggtgtgtttctcctgtggaagaattggagactgaagaacattaactcaatcaatttcgataacccagtgtatcaaaagactactgaggacgaagttcacatttgccacaaccaagacggctactcatacccctctcgccagatggtatccctggaagacgacgtggct

SEQ ID NO: 16089 - DNA, 2580 bp, Artificial Sequence
  Description of Artificial Sequence: Synthetic coding sequence
atgggaccctggggctggaaactgcggtggactgttgctttgctgttggcggccgcgggaacggccgtgggcgatagatgcgagcggaatgagttccagtgccaagatggaaaatgcatctcatacaagtgggtgtgcgacggatccgccgaatgtcaagacggctcggacgaatcacaagaaacttgcctgtcagtgacttgtaagtccggggacttctcctgcggtggccgggtgaaccgctgcattccacagttctggcgctgcgatggacaagtggactgcgacaatggctcggatgaacagggatgcccaccaaagacctgttcacaggatgaattccgctgccacgatggaaagtgtatctcaaggcagtttgtctgcgacagcgacagggactgcctggacgggagcgacgaagcatcatgtccggtgcttacttgcggacctgccagcttccaatgcaatagctcgacgtgcatccctcagctgtgggcctgtgacaatgatccggattgcgaagatggctcggacgagtggcctcaaagatgcaggggactgtacgtgttccaaggagactcgtccccttgctcggctttcgagtttcattgccttagcggagaatgcattcattcatcctggaggtgtgacggagggccggactgcaaagacaagtcagacgaggaaaattgtgccgtcgcgacgtgcaggcctgacgaattccagtgctcggacggcaactgtatccacggttcccgacagtgcgatagagaatacgactgtaaggacatgtcagacgaggtgggttgcgtgaacgttactctgtgtgagggtcctaacaagtttaagtgccacagcggcgaatgcatcactcttgacaaagtctgtaacatggcgcgagactgcagagactggtccgacgaaccaatcaaagagtgtggcactaatgaatgtcttgataacaacggtggatgctcccacgtgtgcaacgatctgaaaatcgggtacgagtgtgactgtccggacgggtttcagctcgtggcgcaacggcggtgcgaggatatagacgaatgccaggatcctgacacgtgctcacagctctgtgtgaacctcgagggcggatacaaatgccagtgcgaagagggattccagctggacccgcataccaaggcatgcaaggctgtcggctcgatcgcttatctgttctttactaaccgccacgaggttagaaaaatgactctcgaccgctcagagtacacctcgctgataccgaaccttcgcaacgtggtggctctggacactgaagtggcaagcaatcggatctactggtccgatttgtcgcagagaatgatctgctcaacccagctggacagagctcacggcgtatcatcatacgacaccgtgattagccgcgatatccaggcaccggacggcctcgcagtcgactggatccattcgaacatctactggaccgactctgtcctcggaaccgtgtcggtggccgataccaaaggggtgaaacggaaaacgctgtttcgggaaaacggctcgaaaccgcgggccatcgtcgtcgatccggtgcacggattcatgtactggaccgattgggggaccccggcaaagatcaaaaagggcggacttaatggggtggacatctactccctggtgaccgaaaacattcagtggccgaacggaatcactctggatctgctcagcggtcgcctgtattgggtcgactcgaagctgcactccatatcatcaatcgatgtgaatggaggcaacaggaaaaccatcctcgaagatgaaaagaggttggcccatcctttctcgctggccgtgttcgaggacaaggttttctggaccgatatcattaatgaagctatcttctcggcgaaccgcctgaccggaagcgacgtgaacctgctcgcagaaaacctgctgtccccggaggatatggtgctgttccacaatctcacccaaccgcggggtgtgaactggtgcgaacgcaccactctgtctaatggaggatgtcaatacctgtgtttgccggcgccgcagatcaatccacattcgcccaaattcacctgcgcttgcccggatggaatgctgctggcacgcgatatgagatcctgtctgactgaggctgaagccgcagttgccactcaggaaacttcgacggtccgcctgaaggtatcgtcaactgccgtgagaacccagcatacgaccacgcgcccggtccccgatactagtagactgcctggtgccaccccaggacttactaccgtcgagattgtcacgatgtcccatcaggcgctcggcgacgtggccggacgggggaacgaaaagaaaccgtcgtccgtgcgggctctgtcaattgtgctgccgatcgtcctgttggtgtttctctgcctgggggttttcctcctgtggaagaactggagactgaagaacatcaactcgatcaatttcgataatccagtctaccaaaagaccactgaggatgaggtgcacatctgtcacaatcaggacggatactcatacccgtcgcgccagatggtgtcactggaggacgacgtggca

SEQ ID NO: 16090 - DNA, 2580 bp, Artificial Sequence
  Description of Artificial Sequence: Synthetic coding sequence
atggggccatggggatggaagctgcgttggacagttgccctacttctcgcagcggcgggaacagcagttggagacagatgtgagcgtaatgaattccagtgccaggatggaaaatgcattagttacaaatgggtctgtgatggcagtgctgagtgccaagacggatcggatgaatctcaagagacgtgccttagtgtcacgtgcaagtctggggacttctcctgtggtggaagagttaatagatgtattccacaattttggcgctgcgatggtcaagtggattgtgacaacggatcagatgaacaaggatgtccacccaaaacatgttctcaggatgaattccgttgtcatgacggaaagtgtatctcgcgccagttcgtgtgcgacagtgatcgagattgtctggatggatctgatgaagcgtcttgcccagttctcacttgcggtccagcatcattccagtgtaattcaagtacatgtatcccacagttgtgggcctgtgataacgatccggattgtgaagatggtagcgacgagtggccacaacgttgtcgcggactttacgtatttcagggagatagttcaccgtgtagtgcttttgaatttcattgtctctctggagaatgcattcacagttcatggagatgcgatggaggtccggactgtaaagataagtcagatgaggagaactgtgctgtggccacctgccgtccggacgagttccaatgtagcgacggtaattgcattcacggatcgagacaatgcgatcgagaatacgattgcaaggatatgtcggatgaagtggggtgtgttaatgttacactttgtgaaggaccaaacaagtttaaatgccattcgggggagtgtatcacattggataaggtctgtaatatggcgcgtgattgtcgtgattggtcagacgaaccaataaaggaatgcggaacgaatgagtgtttggataacaacggtggatgctcccacgtttgcaatgatctgaaaataggatacgagtgtgactgtcctgatggttttcaattagtggcacaaagacgttgcgaagatatcgatgagtgccaagatccagatacatgctcgcaactttgtgtaaatttggagggaggatacaaatgtcaatgtgaagaaggattccaacttgatccacatacaaaggcctgtaaggcagttgggagcattgcataccttttcttcacaaaccgccatgaagttcgaaaaatgacactcgacaggagcgagtatacttcgctgataccgaatctaaggaatgtggttgcgctggacacggaagttgcatccaaccgaatttactggagcgacttgtcacaaagaatgatttgctctacacagcttgatagggcccatggagtgtcatcatatgatactgtcatttcaagagatattcaagcccctgacggactcgcagtggattggattcattcgaatatctattggaccgatagcgtgttgggaaccgtctccgtggccgatactaagggtgttaaaaggaagaccctctttagggagaacgggtctaagccgcgagcaattgtcgttgatcctgtacatggatttatgtactggacagactggggaactccagctaaaataaagaaaggaggtctgaatggagttgatatttactctctggtcacagaaaatatccagtggccgaatggtatcaccttggatttattgagtggcagactttactgggtggactcaaagctccactctattagctcgattgacgttaacggagggaataggaagacaattttagaggacgagaaaagactcgctcacccattttccttggctgtgttcgaggataaagtcttctggaccgacatcatcaatgaagcaattttctccgcaaatcgactgacaggaagtgatgtgaatctgctcgctgagaacttgctctccccagaggacatggtactgttccacaatctcactcaaccacgaggagtaaattggtgcgaacgtactaccctatcgaacggaggatgtcaatatttatgtttgcctgcaccacaaattaacccgcattctccgaagtttacatgtgcttgtccagatggaatgctgttggctagagatatgcgatcctgccttacagaggctgaagctgcagttgcgacgcaggagacaagtacggttcgtctcaaggtctcttcgacagccgttagaacgcaacatactactactagaccagtaccggatacttcacgactcccaggagcaacaccaggtctgaccaccgtggaaattgttactatgtcgcatcaggcattaggtgatgtggctggacgaggaaacgaaaagaagccaagttcagtgcgagcactctctatcgtgctcccaatagtgttgcttgttttcctttgcttgggagtttttctcctttggaaaaattggcgactcaaaaatattaatagcatcaactttgataacccagtctatcagaaaacgacggaagatgaagtccacatttgccataaccaggacggatatagttatccaagccgtcagatggtatcacttgaggatgatgttgct

SEQ ID NO: 16091 - DNA, 2580 bp, Artificial Sequence
  Description of Artificial Sequence: Synthetic coding sequence
atgggaccttgggggtggaaactgcgctggactgtggccctccttctggccgctgccggcaccgcagttggcgacagatgtgagcggaacgagttccaatgccaagatggcaagtgcatatcgtacaaatgggtgtgcgatggatcggcagagtgtcaggatggctccgatgagtcgcaagagacttgtctgagcgtgacttgtaagtcgggagatttctcgtgtggaggtcgcgtgaaccgatgtatcccacagttctggagatgcgatggtcaagtcgactgtgacaatgggagcgacgaacaaggttgccctcccaagacctgctcccaggatgaatttcgatgccatgacgggaagtgcataagccggcaatttgtctgcgatagcgatcgggattgtcttgacggcagcgacgaagctagctgtcctgtgttgacctgcggccccgcatcgttccaatgcaattcgtctacctgcattcctcagctgtgggcctgtgataacgatccagattgcgaggacggaagcgacgaatggcctcagcgttgccggggtctgtacgtgttccagggagattcctcgccttgttccgccttcgagttccactgtctttccggcgaatgtatccatagctcgtggaggtgcgatggcggccctgactgtaaggataagtcggacgaagaaaattgtgctgtggcaacctgtcgtcctgatgaatttcagtgttcagacggtaactgcatccacggatcacgccaatgtgatagagaatacgattgcaaggacatgagcgacgaagtcggatgtgttaacgtgaccctctgtgaagggcctaacaagtttaagtgtcattccggtgaatgtattacgctggataaggtgtgcaatatggccagggactgtcgcgactggtccgatgaacctatcaaagaatgcggaactaacgaatgtctggataacaacggaggctgctcgcatgtgtgcaatgatcttaagattggatatgaatgtgactgccctgatggattccagctcgtggcacaacggaggtgtgaagatatcgacgaatgtcaggatccagacacttgctcgcaactgtgcgtgaaccttgaaggaggatacaagtgccagtgcgaggaaggtttccaactggatcctcatactaaagcgtgtaaggcggtcggctccattgcatacctgtttttcactaatagacatgaagtgcgaaaaatgaccctggatcggtcggaatacacctcgttgatccccaaccttaggaacgtcgtggcccttgataccgaggtggcatcaaaccgaatatactggtcggatctgagccaaagaatgatttgctcaactcagcttgatcgagcacatggagtttcctcctacgacaccgtcatttcgcgggacattcaagcaccagacgggcttgcggtggattggatccatagcaacatctactggaccgatagcgtcctgggcaccgtctccgtggcagataccaaaggagtcaagcgtaagactctgtttcgagagaacggaagcaagccgcgagcgattgtggtggatcctgtgcacggctttatgtactggacggattggggtaccccggccaaaatcaagaaggggggcctgaacggagtggatatctatagtcttgtgactgaaaacattcaatggccaaacggaatcactcttgacttgctctcaggacggctctactgggttgactccaagctccactccatttccagcattgacgtgaacggaggaaaccggaaaacgattctggaagatgaaaagcgtctggcacaccctttttcccttgcagtgttcgaggataaagtgttttggacggacattatcaatgaggcgattttctctgcaaacagattgaccggtagcgatgtcaatcttcttgccgagaacctcctttcgcctgaggatatggtcctgttccataacctgacccagcctcgcggcgtgaactggtgtgagagaaccacgctgagcaacggcggatgtcaatacttgtgtctgccagcaccacaaatcaatccccattcaccaaagttcacctgtgcatgccctgatggcatgttgctggcccgggatatgcgctcctgccttaccgaggcagaggccgcagtcgctacccaggaaacgtcaactgtgaggcttaaggtttcgtcgaccgcagtccggactcaacataccaccactcggccagttcccgatacctcgagactgcctggcgccactcctgggttgacgaccgtcgaaattgtgactatgagccaccaagcacttggggatgtcgcaggacgcggtaacgaaaagaaaccatcgtctgtgagagcactgagcattgtgctccctatagtccttctggtgttcctgtgtcttggggtgtttcttctttggaagaactggagacttaagaacatcaactccataaactttgataacccagtctaccagaaaaccacggaggatgaggtgcatatttgccacaaccaggacggttactcatacccttcgcggcagatggtgtcattggaagatgatgtggca

SEQ ID NO: 16092 - DNA, 2580 bp, Artificial Sequence
  Description of Artificial Sequence: Synthetic coding sequence
atggggccttggggatggaagctgaggtggacggtcgcccttctcttggctgccgctgggactgccgttggagatcgttgcgaaagaaacgagttccagtgccaggatggcaagtgtatctcatacaaatgggtttgcgacggcagcgctgagtgtcaggacggttcagacgagagccaggagacttgtctctcggttacgtgtaagtcgggtgatttctcttgtggtggacgggtgaaccgttgcatcccgcaattctggcgttgtgacggccaggtggattgcgataatggctccgatgaacagggctgccccccaaagacttgcagccaagatgagttccgatgccacgatggcaagtgcatttccagacagttcgtctgcgacagcgacagagactgtctcgatggaagcgacgaggcgtcgtgccccgtcttgacctgcggccctgcttcgttccagtgcaattcctccacgtgcatcccccagctgtgggcgtgcgacaatgatcctgattgcgaggacggatcagacgagtggcctcaaaggtgtcgcgggctctatgtgtttcaaggcgatagctcgccatgctccgccttcgagttccactgcctgtccggcgaatgtattcatagctcttggcgttgcgacggtggccccgactgcaaggacaaatccgatgaagagaactgtgccgtcgcgacttgccgtcccgacgagtttcagtgcagcgatggtaactgcattcatggttcacgtcagtgcgatcgagagtacgattgcaaggatatgagcgatgaggtcggttgcgtcaatgtaaccttgtgtgagggtccaaacaagttcaagtgccatagtggagagtgcatcactctggacaaggtgtgcaacatggctcgtgactgcagggattggtcggacgagccaataaaagaatgtggaaccaatgagtgcttggacaataacggcggatgctcccacgtatgcaacgatcttaagatcggctacgagtgcgactgtcccgatggctttcaactagtggcccagaggcgctgcgaagatatcgatgagtgccaggatcccgatacctgttcgcagttgtgtgtcaatctggagggcggctacaagtgtcagtgcgaggagggttttcaacttgacccacacactaaggcgtgcaaagccgtgggatccatcgcttacctcttcttcactaacaggcacgaggtcagaaagatgactctggatcggtccgagtatacttcgctcattcctaatctacgcaacgttgtggccctggacaccgaggtcgcctccaacaggatctactggtcggatctctcccagcgtatgatctgtagcacccagctggatcgcgcgcatggtgtctcgtcgtacgataccgtcatctctcgggacattcaggcacctgatggccttgccgttgactggattcatagcaacatttactggaccgattctgtcctcgggaccgtttccgtggccgataccaagggagtcaagcgaaaaaccctctttcgcgagaatggttccaaacctcgtgctatcgttgtcgatcccgtgcatggcttcatgtattggacggactggggtaccccggccaagatcaaaaagggcggcctcaacggtgtggacatctacagccttgtaactgagaacatccagtggcccaatggaattacgctggatctattgagcggacgcctatactgggtcgattcgaagctgcactctatctctagcatcgacgtcaatggcggcaaccggaaaactatcttggaggacgagaagcgcctggctcatcccttctcgctcgccgtgttcgaggacaaagtgttctggaccgacatcatcaatgaagccatcttctccgctaaccgtctgaccggctccgacgtcaatcttctggccgaaaacctcttgtcccccgaggatatggtgctcttccacaaccttacccagccccgcggagtgaactggtgcgagagaacgacactaagtaacggaggatgccagtatctgtgtctacccgcgccccagattaacccccactcccccaagtttacctgtgcctgccccgatggtatgctgttggcacgcgatatgcgctcctgcctgactgaggccgaggccgctgtggcgacccaggagacgtccactgtacgcctaaaagtgtccagcaccgcggttcgaacccaacacaccacgacccgacccgtgcccgatacaagtcgtttgcctggcgcaacaccagggctgaccacagtggagatagtcaccatgtcccatcaggcactgggagacgtcgccggccggggcaacgagaagaagccctcatccgtccgtgccttgtcaatcgtcctccccattgtgttgctggttttcctctgtctgggggtttttctactttggaagaactggcgcttaaagaacattaactccataaacttcgataaccctgtctaccaaaagaccactgaggatgaggttcacatctgccataaccaagatggctactcttatccatcgcgccagatggtgtctctcgaggacgacgtcgcc

SEQ ID NO: 16093 - DNA, 2580 bp, Artificial Sequence
  Description of Artificial Sequence: Synthetic coding sequence
atgggaccctgggggtggaaacttcgatggactgtggcactgcttctggccgcggcgggaaccgcagtgggagatcgctgcgaaagaaatgagtttcagtgtcaggatggaaaatgcatctcatacaagtgggtgtgtgatggtagcgctgagtgtcaagatggatcagatgaatcgcaggaaacttgtctgtccgtgacctgcaagagcggtgactttagctgtggcgggcgcgtcaatcggtgtataccacaattctggcggtgtgacggccaagtggactgtgataacgggtcagatgagcagggttgtccaccaaagacttgttcacaggatgaatttaggtgccatgacggaaagtgcatttcccgccagtttgtgtgtgattccgatcgagactgtctcgacggatcggatgaagcatcttgccccgtccttacctgcggaccggcatcatttcagtgcaacagctcaacttgtattccgcaactgtgggcttgcgataatgaccccgactgtgaagatggctcagatgaatggccccagcggtgcaggggcctttacgtgtttcagggtgattcttcgccatgctcggcattcgaattccattgcctctccggtgaatgtattcattcatcatggcgatgtgatggaggcccagattgtaaggataagtcggacgaagagaattgtgccgtggcaacgtgtcgaccagatgaatttcaatgctcagatggaaattgcatacacggttcgaggcaatgcgaccgcgaatacgattgtaaagatatgagcgatgaagtcggttgtgtcaacgtgactctttgtgagggtccgaataagttcaaatgccattcgggcgaatgtattactcttgataaagtttgtaacatggcacgtgattgcagagattggagcgatgaacctatcaaggaatgtgggactaacgaatgtctcgataacaatggaggatgctcgcatgtgtgcaacgaccttaagattggatacgaatgcgattgccctgatggatttcaacttgtggcccagcggcgctgtgaggacatcgatgaatgccaggatcctgacacctgttcccagttgtgcgtgaatctggagggaggttacaagtgtcagtgtgaagagggatttcagctggacccacacactaaggcttgcaaagcggttggatccattgcatacctgtttttcactaaccgacatgaagtgcgtaagatgactctcgatcgcagcgagtacactagccttattcctaacctgcggaacgtagtcgccctggatactgaggtggcaagcaacaggatatactggagcgacctgtcgcagcgaatgatttgctcaacccaacttgatagagcgcatggtgtgtcaagctacgatacggtcatttcgcgcgatattcaagcacctgacggtcttgcagtggattggatccattccaacatttactggaccgactccgtgctgggtaccgtctcggtggctgacaccaaaggggtcaagagaaagactctcttccgcgagaacggttccaagccaagagcaattgtcgtcgatccagttcatggatttatgtactggactgattggggcacgccagccaagataaagaagggaggactcaatggtgtggacatttactcgcttgtgacggaaaacatccagtggccaaacggtataactctggatctgctttcaggcagactctactgggtcgattccaagttgcactcaatctcgtcgatcgatgtgaacggaggtaataggaaaaccattctggaggacgaaaagcggctcgcacatccattctccctggcagtctttgaagataaggtgttctggaccgatatcatcaatgaagcaatcttttccgccaaccgactcactggttcggacgtcaaccttctggccgaaaatcttctgtcccccgaggacatggtgctgttccataacctcactcaacctcgcggagtgaattggtgcgagcgcactactctgtcgaacggtggctgtcaatacttgtgcctccctgcaccacaaatcaaccctcattccccgaagttcacctgcgcatgcccagatggaatgttgctggcaagggacatgagatcctgtttgactgaggccgaggcagccgtcgcaactcaagaaacctccactgtcagactcaaagtctcgtctactgcagtccgcacccagcatactaccacccggccggtgcctgacaccagcagactccctggagcaacccccggactgactactgtcgaaatagtgactatgtcacatcaagcacttggggacgtggcaggacgcgggaacgagaaaaaaccctcctctgtccgcgcactctctattgtgcttcctatcgtccttctggttttcctttgcctgggagtgtttcttttgtggaaaaactggagactgaagaacattaactcgatcaactttgataaccctgtctatcaaaagaccaccgaagatgaagttcatatttgccacaaccaagacggatactcgtacccgtccaggcaaatggtgagccttgaggatgatgtggcc

SEQ ID NO: 16094 - DNA, 2580 bp, Artificial Sequence
  Description of Artificial Sequence: Synthetic coding sequence
atgggcccttggggctggaaactgaggtggacagtggcgctgctcctggctgctgccggcaccgccgttggtgacaggtgcgaaaggaatgagttccagtgtcaagatggcaaatgcatcagttataaatgggtctgtgatgggtccgccgaatgtcaggacggcagcgacgagtcgcaggaaacatgtctgagtgtgacctgtaaatcaggagatttcagctgtggcggaagggttaataggtgtatcccacagttttggcgctgcgacggccaggtggattgcgacaacgggagtgacgagcaagggtgtccccccaaaacctgttctcaagacgagttccgatgtcatgacgggaagtgcatctcacgtcagtttgtgtgtgactctgacagagattgcctggatgggagtgatgaggcctcctgtccggtattgacatgtggccccgcgtcattccagtgcaattcttccacctgtattccccagctctgggcctgcgacaacgatccggactgtgaagacggatctgacgaatggcctcagaggtgcagaggactgtacgtttttcagggggattcgagtccatgctcagcattcgagttccactgcctgtcgggtgaatgcatccactccagctggaggtgcgatggggggcctgattgtaaggataaatctgacgaagagaattgtgcggtggcaacctgtaggcccgatgagttccagtgctctgatggcaactgcatacatgggtccagacagtgtgaccgagagtacgattgcaaggatatgtctgatgaagttgggtgtgttaatgtcactctctgcgaggggcccaacaagttcaaatgtcactccggcgaatgcataaccttggataaagtttgcaacatggccagggattgtagggattggtccgatgagccgatcaaggaatgtggaaccaacgagtgcctggataataacggcgggtgctcccacgtatgcaacgatctgaaaatcggctatgagtgcgattgtcctgacggatttcagcttgtagcccagcggcgatgtgaagatatcgacgaatgccaggatccagacacgtgttcccagctgtgtgtgaatctggaggggggttataaatgccagtgtgaggaaggattccagctggatcctcacacaaaggcttgtaaggccgtaggatctatagcttacttgttttttacaaacaggcacgaagttagaaaaatgaccctcgatagatccgaatacacttcccttattccgaatctccggaacgttgttgccctggacactgaagtggcttcaaatcgaatttactggagcgatctcagtcagaggatgatctgcagtacccaacttgacagggcccatggggtgtctagttatgataccgtaatttccagagacatccaggccccagacggtttagcggtggactggattcactcgaatatctactggactgactccgtccttggcaccgtgtccgtggccgataccaagggtgtgaagcgcaaaacccttttcagggaaaatggcagcaagccgcgcgctatcgttgtcgatcctgtacatggattcatgtactggacagactggggtacacccgccaagatcaagaaagggggacttaacggcgtagacatctacagcctcgttaccgagaacattcagtggccgaacggaatcacacttgatctgctgagcggcaggctgtactgggttgattccaaattgcattccatcagtagtattgatgtgaacggaggtaaccgtaaaacaatccttgaagatgaaaagaggctggcgcatcctttttcgttggcagtgtttgaagacaaggtgttctggacagacatcataaatgaagctatcttcagcgccaatagactgacaggtagcgacgtgaacctgctggctgagaacttgctgagcccggaggacatggttctgttccacaatctcactcaacccaggggcgttaactggtgcgaacgaacaaccctgtccaatggtggctgccagtacctctgtttgcctgctccccagatcaacccccatagcccaaagttcacatgcgcttgcccagatggaatgttgctagccagagacatgcgatcgtgcctgacagaggcagaagcggccgtggccacacaggaaacttccactgtgcgacttaaggtgagctccacagccgtacgaacccagcatacgacgactcgccctgtccctgacaccagcaggctgcccggagccacccctggactaactacggtggagatagtaactatgtcacatcaggccctgggcgatgtagctggtcgcgggaacgagaaaaagcccagctctgtgagggccctctcaatcgttttacccattgtgcttttggtgttcttatgtctgggtgtgttcctcttgtggaaaaactggagactgaagaatattaacagtattaattttgataaccccgtttatcaaaagaccaccgaagatgaagtgcacatctgccataatcaggatggctacagttacccgtcacgacagatggtttctctcgaggatgacgttgct

SEQ ID NO: 16095 - DNA, 2580 bp, Artificial Sequence
  Description of Artificial Sequence: Synthetic coding sequence
atggggccgtggggatggaaactccgttggaccgttgctctcttgctggctgcggcaggcacggccgtgggcgaccgttgcgaacgcaatgagttccagtgccaggatggtaagtgcatcagctataaatgggtgtgtgatggctccgccgaatgccaggatggctctgatgaaagccaagagacctgcctcagcgtcacctgcaaatctggtgatttttcgtgcggcggacgagtcaataggtgcataccgcagttctggcggtgcgatggccaagtcgactgtgataacggcagcgatgagcagggctgtcctccaaaaacctgctcccaggacgaattccggtgccacgatggaaaatgcataagtcgccagttcgtgtgtgactcggaccgcgattgcctggatggctccgacgaggcgtcgtgtcccgtgctgacatgtgggcccgcttcctttcaatgtaactcctccacctgtataccccaattgtgggcgtgcgacaacgatcccgactgtgaggatggctcggatgagtggccgcaaaggtgccgaggactgtatgtttttcagggcgattcgtctccgtgctcagcgttcgaattccactgcctgtcgggtgaatgcatccactcaagttggcgctgcgacggggggccagactgcaaggataaatcggatgaggaaaattgcgctgtcgcgacatgtaggcccgatgaattccagtgctccgacggaaattgcatccatggcagtcgccaatgcgatcgggagtacgactgcaaagatatgagtgacgaagtgggatgtgtcaacgttaccctatgtgagggtccgaacaagttcaagtgccacagtggcgagtgcattaccttggacaaggtttgtaacatggcgcgagattgcagagactggagtgacgagcctatcaaggagtgtggaacaaacgagtgcttagacaataacgggggatgctcccacgtgtgtaacgacctgaagatcggatatgagtgcgattgtcctgacggtttccagctcgtggcgcagcggcgatgcgaggatattgacgagtgccaagaccctgatacctgttcacagttatgcgtgaaccttgagggtggatataaatgtcagtgtgaggagggctttcagctcgatccccacacaaaagcgtgcaaggccgtgggttccatcgcttacctgttcttcacgaaccgtcacgaggtgcggaaaatgactcttgatagatcggagtatacttcgcttatccctaacttgcgtaacgtcgtggccctggacacagaagtcgcttcgaaccgcatttactggagtgacctctcccaacgcatgatctgcagcacgcaactggatagggcgcatggcgtgagctcctacgataccgtgatctcgagggatattcaggccccggatggcctcgctgtggattggatccactccaacatatactggaccgactcggttttaggcaccgtcagcgtggccgataccaaaggagtaaagcggaagacgcttttcagggaaaacggaagtaagccccgggccatagtggtggatcccgtccacggatttatgtactggacggattggggaactccggctaagatcaaaaagggcggcctgaatggagtggatatctactccctggtgacagagaatatccagtggcccaatggcataactctggatttgctttcgggccgcttgtattgggtggactccaaattacattctatttctagcatcgacgtgaacggtggcaatcgtaagacgatcctggaagatgaaaaacgtctagcgcacccattttcactcgccgtctttgaagacaaggttttttggactgacatcattaacgaagctattttttccgcgaaccgtctcacgggatccgatgtgaatctgctggcagagaatctgctctcgcccgaggatatggtcctgttccataatctcacccagccaaggggagtaaactggtgcgaacgcacgacgctcagcaatggaggctgccagtacctgtgtctgcccgccccccaaataaatccgcattccccaaagtttacgtgcgcctgccctgatggtatgttgcttgcgcgcgatatgcggtcgtgcctgaccgaggcagaggccgcggtggccacacaggaaacgtccaccgtgcgcttgaaggtgagtagtactgcggtgcgcacccagcacacgacaacccgtccggtcccggacacatctcgcttgccgggcgcaaccccgggactgacaacggtggagatagtcactatgtcacaccaggctctgggcgatgtcgcgggtcgagggaatgagaagaagccaagttctgtccgggctctatccattgtgttgccgatcgtgctgcttgtcttcttgtgccttggtgtctttttgctgtggaagaactggcggttgaagaacatcaactccataaatttcgataacccagtttaccagaaaaccactgaagacgaggttcacatctgtcataatcaagatggctactcgtatccgtctcgccagatggtcagcctggaggatgatgttgca

SEQ ID NO: 16096 - DNA, 2580 bp, Artificial Sequence
  Description of Artificial Sequence: Synthetic coding sequence
atggggccttgggggtggaagctgcgctggactgtggcattgctgctcgctgcagcgggaaccgcggtgggagatcgatgcgaaaggaatgagtttcagtgtcaagatggcaagtgtatttcgtataagtgggtctgtgatggttcggctgagtgccaagatggatcggatgaatcgcaagaaacgtgcctctcagtgacctgcaagagcggggacttttcgtgcgggggaagagtcaacagatgtatcccgcaattttggcgttgcgatggtcaagttgactgtgacaatggctcggacgaacaggggtgtccccctaagacctgctcccaagatgaatttaggtgtcatgatggaaaatgtatcagccgccaattcgtgtgtgacagcgacagagactgtctggatgggtccgatgaggcttcctgccccgtgttgacctgtgggcctgcctcctttcaatgtaatagctccacctgcataccgcagttgtgggcatgcgacaatgaccctgactgtgaagatggttcggatgaatggccccagagatgccgggggctctacgtattccagggagattccagtccatgctcggcatttgaattccactgtctgagcggagaatgtattcattcatcgtggagatgtgatggcggtcccgattgtaaggataagagcgatgaggagaactgtgcagtggcaacctgtcgtccagacgaatttcaatgttcggatgggaactgcattcatggatcgcgacaatgtgatcgtgagtatgactgtaaggatatgtccgatgaagtgggatgcgtgaacgtgactctttgtgaaggtcccaacaaattcaagtgtcattcgggggagtgtattacgctcgacaaggtctgtaatatggccagggactgtagagattggagcgacgaaccgattaaagagtgtggaacgaacgaatgtctcgataacaatggaggatgcagccatgtgtgcaatgaccttaagattgggtacgagtgtgattgtccagacggttttcaactcgtcgcacaacggcgctgcgaggacatcgatgagtgccaggacccagatacctgctcccagctgtgtgtgaacctcgagggtggctacaagtgtcaatgcgaagaggggttccagctggatccacataccaaagcatgtaaagcggtgggttccattgcctacctgttctttactaaccggcacgaagtgcgcaagatgaccctggatcgttctgaatacactagcctcattcccaaccttagaaacgtggtggccttggacacggaagtggcctccaatcgcatctactggtccgatctttcgcaaagaatgatctgctccacccagctggatcgcgcacatggagtgtcatcgtacgacacggtgatttcacgcgatatccaagcaccagatggccttgcggtcgattggattcacagcaacatatactggactgattcagtgctggggaccgtgtcagtggcagatactaagggagtgaagagaaaaactctgtttcgagagaatgggtcaaaaccaagggcgattgtggtggaccctgtgcacggctttatgtactggaccgattggggtacgccagcaaagatcaaaaagggcgggctcaacggtgtggacatttactcgctcgtgactgaaaacattcagtggccaaacggtattactcttgatcttctgagcggacgcctgtactgggtggattccaagttgcactcgatttcatcgattgatgtcaacggcggaaaccgtaagaccatcttggaggatgaaaagagacttgcccacccattttcgcttgcagtgttcgaggataaggtgttctggaccgacatcataaatgaagccatcttcagcgcaaatcgtctcactggctcggacgtcaaccttcttgctgaaaacctcctttcgcctgaggatatggtgttgttccacaacctgacccagccaagaggcgtcaactggtgtgaaaggaccactctctccaacggaggatgtcagtacttgtgcttgcctgcaccacaaatcaatccgcattccccgaaattcacctgtgcgtgtcctgacggtatgctgcttgcacgggacatgaggtcatgcctgactgaagccgaagcagcagtcgcaacccaggaaacgtccacggtgcgcttgaaggtcagcagcaccgcagtgagaacccagcatactactactagacccgtgcctgatacctcgaggcttccaggagccactccaggcttgaccaccgtggaaatcgtgactatgtcccatcaagcccttggcgacgtggcaggtaggggaaatgaaaagaaaccatcgagcgtgcgagcactttccatcgtccttccaattgtgctcctggtgtttctctgccttggtgtgtttctgctgtggaaaaactggagattgaagaacattaactcaattaactttgacaatcccgtgtaccaaaagaccaccgaagatgaagtgcatatctgtcataaccaagatggatactcgtacccgtcccgccagatggtgtccctggaagatgatgtggca

SEQ ID NO: 16097 - DNA, 2580 bp, Artificial Sequence
  Description of Artificial Sequence: Synthetic coding sequence
atgggcccatgggggtggaaactgcggtggactgtggcgctgctcctggcggccgccgggactgcagtgggcgatcggtgcgagcgtaacgaatttcagtgccaagatggcaagtgtatctcatacaagtgggtgtgcgatgggagcgccgaatgtcaagatgggtccgatgaatcccaggaaacttgtctgtccgtgacgtgcaagtcgggagacttcagctgtggaggaagagtgaatcggtgtataccgcagttttggagatgcgatggccaagtcgactgtgataacggatcggatgagcagggatgcccacctaaaacctgttcgcaagatgaatttcgatgtcacgatggaaaatgcatttcgcgacagtttgtgtgcgactccgatcgggactgtcttgatggatccgacgaagcatcatgtccagtgcttacttgcggaccggccagctttcaatgtaatagctccacttgtatccctcaactttgggcatgcgataacgatcctgattgtgaggacggaagcgatgagtggcctcagagatgtagaggactttatgtgtttcaaggagactcctcgccatgtagcgcatttgaattccattgtcttagcggcgaatgtatccattcctcgtggcgatgcgatggcggtccggattgtaaggacaaatctgatgaagagaactgcgctgtggccacttgtcggcctgacgaattccagtgtagcgatggaaactgcattcatggatcacgccagtgtgatcgagaatacgattgcaaagacatgtcagatgaagtcggttgcgtgaatgtgactttgtgtgaaggacccaataagtttaagtgccattccggtgaatgtataacgcttgataaggtgtgtaatatggcaagagactgcagagactggtcggatgaaccaattaaggaatgtgggacgaacgaatgcctcgacaataacgggggctgttctcatgtgtgtaatgatctgaagatcggatacgagtgtgattgccctgatggttttcaactggtcgcccagcggagatgtgaagatatagacgagtgtcaggatccagatacctgttcccaactgtgtgtgaacctggagggtggctataagtgccagtgtgaggagggatttcagctggacccccataccaaggcctgtaaggccgtgggaagcatcgcgtacctcttcttcactaaccgccacgaagttaggaagatgacgcttgaccgcagcgaatatacttccctcattcccaacctgcgcaacgtcgtggcacttgacactgaggtggcatcaaaccgcatatactggagcgatctgtcgcagagaatgatttgttcaactcaactcgatcgcgctcacggtgtgtcaagctatgacaccgtcatttcgcgggatattcaagcacccgacggactggcggtcgattggatccattcaaatatctactggacggactcagtcctggggactgtgtctgtggcagacacgaagggcgtgaagcgcaagactctgtttcgggagaatggttccaagccacgtgccattgtcgtcgatcctgtgcacggattcatgtactggactgactggggcaccccagcgaagataaagaagggtggacttaatggagtcgacatttactcgcttgtcaccgagaacatacagtggccaaatgggataaccctggatcttctttctggtcgtctctactgggtggactcgaagctccattccatttcctcaatcgatgtgaacggtggtaaccgaaagaccattctggaagatgaaaaacgtctggctcatccatttagccttgcagtgtttgaggacaaggtgttttggactgatatcattaacgaggcaattttctcggccaatcgccttacggggtcagatgtgaacctgctggcagaaaacctgctttcgccagaggacatggtgcttttccataatctgacccaacctcgaggtgttaattggtgtgaaaggaccaccctctccaacggaggctgtcaatacctttgtctgcctgcccctcagatcaaccctcattcgcccaagtttacttgcgcatgtccggatggaatgcttctcgctcgggatatgaggtcgtgtttgactgaggcagaagctgcagtggccacccaggaaacgagcactgtcagacttaaggtgagctcgactgcagtccggacccaacatactactacccggccagtgcctgatacctcgcgcctgccgggtgcaaccccagggctcaccaccgtcgagattgtcactatgagccaccaggcgcttggtgatgtggcaggcaggggaaacgagaaaaagccgtcctccgtgcgggcactctccatagtgctgcccatcgtgctgcttgtctttctttgtcttggagtgtttttgctttggaagaactggaggctcaagaacatcaactcgatcaactttgacaacccagtgtaccaaaaaactaccgaagatgaagttcacatttgccacaaccaggatggatactcatacccatccaggcaaatggtttcacttgaggatgatgtggcc

SEQ ID NO: 16098 - DNA, 2580 bp, Artificial Sequence
  Description of Artificial Sequence: Synthetic coding sequence
atgggcccgtggggctggaagctccgctggaccgtggcgctcctgctggccgccgcggggaccgcagtgggggaccgctgcgaacggaacgagttccagtgccaagacggaaaatgtatttcgtacaaatgggtgtgtgacgggtctgctgagtgccaggacggctcagatgagtctcaagaaacctgcctgagcgtcacttgcaagtccggcgatttctcctgcggagggagagtgaaccggtgcatcccccagttttggcgctgtgacggccaggtggactgcgacaacggcagcgatgaacaggggtgcccgccgaaaacctgctcccaggatgagtttcgctgccatgatggtaagtgcatcagcagacaatttgtgtgtgattcggatcgtgactgcctcgacggaagcgacgaggcgtcctgtccagtgctcacttgtggacctgcatccttccagtgtaacagctccacctgcattccgcagctgtgggcctgcgacaacgacccggattgcgaggacggatcagacgaatggccccagcggtgccgcggcctgtacgtctttcagggggactcctcgccttgctccgcgttcgaatttcactgcttgtcaggagaatgcatccactcatcctggagatgcgacggaggtcctgactgcaaggacaaatcagacgaagaaaactgcgccgtggctacctgccgcccagacgaattccagtgctccgacggcaactgtatccacgggtcgcggcagtgcgaccgcgagtacgactgcaaagacatgtcggacgaagtcggctgcgtgaatgtgaccttgtgcgaaggaccgaacaagttcaagtgtcacagtggtgagtgcatcactttggataaggtgtgtaacatggcgcgcgattgcagagactggtccgacgaacctatcaaagaatgtggaaccaacgagtgcctggataacaatggcgggtgttcccatgtgtgtaacgatctgaagatcggttacgagtgcgactgtccggacggctttcagctggtggcgcagcgacgctgcgaagatatcgacgaatgtcaggatccggacacgtgctcccagctctgcgtcaatctggagggaggttacaagtgccaatgcgaagagggatttcagctcgatccgcataccaaggcgtgcaaggccgtgggctcgattgcctacctgtttttcacgaaccgccacgaagtgcggaaaatgaccctggatagatccgagtacacctccttgatccccaaccttagaaacgtcgtcgccctggataccgaagtcgcatcaaatcggatctactggtccgacctgtcgcagaggatgatctgctcaactcaactggaccgcgcgcacggagtttcttcgtacgatactgtcatttcgagagacatccaagcgccagatggactggcagtggattggatccactctaacatctactggaccgactcggtcctgggaactgtgtccgtcgccgacaccaagggtgtcaagcggaaaaccctgttccgcgaaaatggatcgaagccgcgcgcgatcgttgttgacccggtccatggattcatgtactggactgactggggaactccagccaagatcaagaagggaggcctgaatggagtggacatatactcgctggtgaccgaaaacatccagtggcctaatggcattactcttgatctgctgtccgggcgcctctactgggtcgactcgaagctgcattccatctcgtcgatcgatgtcaatggaggtaaccggaaaaccatcctcgaggacgagaagcgcctggcgcacccgttcagcctggcggtattcgaggacaaggtgttctggaccgatatcattaatgaggcaatcttctcggcaaacagacttaccggatccgacgtcaacctgctggcagaaaatcttctttcgccggaagatatggtgctgttccacaacctcactcagccacgcggcgtcaactggtgcgagcgcactactctctccaacggaggatgccagtacctttgcctgccagctcctcaaatcaatccacactcgccgaaattcacctgcgcgtgcccagacggcatgctcctggcccgggatatgagaagctgcctgactgaggccgaagcagcggtggcaacccaggagactagcactgtgagactgaaggtgtcgtcgaccgctgtgaggacccaacatactacgactcgtcctgtgccagatacttcccggctgccgggtgccactccggggctgactactgtcgaaattgtgactatgtcccaccaagccctgggcgatgtggccggacgcgggaacgagaaaaaaccttcctcggtgagagcgctgagcatcgtccttcccatcgtcctgctcgtgtttctgtgtctgggcgtctttctgctgtggaagaactggaggctcaaaaacatcaattccatcaattttgataatccggtgtaccagaaaactaccgaagatgaagtgcacatctgccacaaccaagatgggtactcgtacccgagcagacaaatggtgtccctggaggatgatgtggct

SEQ ID NO: 16099 - DNA, 2580 bp, Artificial Sequence
  Description of Artificial Sequence: Synthetic coding sequence
atggggccatggggctggaaactgaggtggacagtcgcgcttctacttgcagcggctgggacagcagtgggtgataggtgcgagagaaacgagttccagtgtcaggatgggaaatgcatttcgtacaaatgggtgtgcgatggatcagcagagtgtcaagatggatctgatgagagtcaagagacatgtctctccgtcacttgcaaatcaggggactttagctgcggaggacgcgtcaaccggtgcattcctcagttctggcggtgtgacggccaggtggattgcgacaacgggtctgatgaacaaggatgtcccccaaaaacatgttcacaggacgagttcaggtgccacgatggaaagtgtatttctagacaatttgtgtgcgactcagatagggactgtttggacggaagcgatgaagccagctgccccgttctgacatgtggccctgctagctttcaatgcaacagcagcacctgtattccccaactttgggcctgcgataacgacccagactgtgaggatgggagcgatgaatggcctcaaagatgtaggggtttgtatgtattccagggcgactcgagtccgtgctccgctttcgagttccactgccttagcggcgagtgtatccacagctcatggcggtgcgacggtggacccgattgcaaagacaagagcgatgaagaaaactgtgccgttgctacctgccgccccgatgaatttcaatgctccgatggcaattgcatacatgggtccagacagtgtgatagagaatatgactgtaaagacatgtccgatgaggtgggctgcgtgaacgtgactttgtgcgaaggacccaacaagtttaagtgccatagcggtgaatgcatcacactggataaagtctgcaacatggcaagagattgcagggactggtcagatgagcctattaaagagtgtggaacaaacgaatgtctcgacaacaatggaggctgctctcatgtatgtaacgatttgaaaatcggatacgagtgcgattgtcccgacggctttcaacttgtggcccaacgcaggtgcgaggatatagatgaatgtcaggatccggatacctgcagccagctgtgcgtcaacctggaaggggggtataaatgtcagtgtgaagaaggttttcaactcgatcctcacactaaagcatgtaaggctgtcgggagtatcgcttatcttttttttacgaataggcatgaggtgcgtaaaatgacactggacagaagcgagtatactagccttatcccaaatctgcgcaatgtggtggctttggataccgaggtagccagcaaccgcatatactggtctgacctgtctcaaagaatgatatgctcaacccagctggatagagcacatggagtgtcctcctacgacactgtcatctcaagagatatccaggcacccgacggacttgctgtcgattggatacatagcaacatttactggacagattcagtacttggaacagtctctgtcgcggatacaaaaggagttaagcgcaagaccctgttcagggagaacggctcaaaacctcgcgcaattgtggtggatccggtacatgggtttatgtactggactgattggggaactccagctaagatcaagaaaggcggtctcaatggagttgatatctattctctcgtgaccgagaacattcagtggcctaatggcattaccctcgatttgctgagcggacggttgtattgggtggacagcaagcttcacagcatcagctctatcgacgtaaacggcggcaacagaaaaacaattctggaagatgaaaaaaggctggcccacccattttcgttagctgttttcgaggacaaagtcttttggactgatatcatcaacgaagccatctttagcgctaaccggcttacaggtagcgacgtgaatctgctagccgaaaacctgttgtcacctgaggatatggttctgttccataaccttacacaaccgcggggagtcaactggtgcgagcggactaccttatctaacggaggttgtcaatacttgtgcttgccggccccccagataaacccacacagccccaagttcacttgcgcttgccctgatggaatgctgcttgcaagagatatgaggagctgtctgactgaggctgaggctgcagtggctacccaagagacctccacagttcgactcaaagtcagcagcacggccgtgaggacccagcacacgacgaccaggcctgtgcccgacacatcgcggctccctggcgctacgccaggtctgacaaccgtcgagattgtcacaatgagccaccaggcactgggcgatgttgccggcaggggtaatgaaaaaaagccgtccagtgtgagagcactttctatagtgttacccatcgtattgcttgttttcctctgccttggcgtctttctgctctggaagaactggcggctcaaaaacatcaattcaatcaactttgataaccctgtttatcaaaagacaaccgaagacgaggtgcacatctgtcacaaccaggatggatatagctatccatcccgtcaaatggttagcctggaggatgacgtggca

SEQ ID NO: 16100 - DNA, 2580 bp, Artificial Sequence; identical to SEQ ID NO: 16076
  Description of Artificial Sequence: Synthetic coding sequence

SEQ ID NO: 16101 - DNA, 2580 bp, Artificial Sequence
  Description of Artificial Sequence: Synthetic coding sequence
atgggtccatggggctggaaactgcgctggactgtagcactgctgctggcagccgcgggcacggcggtgggtgatcgatgtgagcgcaacgagttccagtgccaggatggtaaatgcatttcctacaaatgggtgtgtgatggctccgctgagtgccaggacggcagcgatgaaagccaggaaacctgtcttagcgtcacctgtaaaagcggtgacttttcctgtggcggacgggtcaatcgttgtatcccgcaattttggcgctgtgatggccaagtggactgtgataatgggtctgatgaacagggttgtcctccaaagacctgctctcaagacgaatttcgctgccatgatgggaagtgcatcagccgccagtttgtctgcgacagcgatcgcgactgtctggatggttcagacgaagcttcctgcccagtactgacctgtgggcccgcaagttttcaatgcaattccagcacctgtatcccccagttgtgggcgtgcgacaacgacccagactgtgaggacggtagcgatgaatggcctcagcgctgtagaggtctgtacgtgtttcagggcgattcgtcaccatgctccgcgttcgagtttcattgcctgagcggcgaatgtattcatagcagttggcggtgcgacgggggcccggattgtaaagacaagtctgatgaggaaaactgcgcagtggccacatgtcgcccagacgagttccagtgttccgacgggaactgcatccacggcagccgccaatgcgatcgcgaatacgattgcaaggacatgtcggacgaggtcgggtgcgtaaatgtcactctgtgcgagggccctaacaagttcaagtgccactctggcgagtgtattacgttagataaggtctgcaatatggctagggattgtcgtgactggagcgatgaaccgattaaagagtgcggtaccaatgagtgtttagacaacaatggtggttgctcccacgtgtgtaacgatctgaaaatcggttatgaatgcgattgtccagacggtttccagctggttgcccaacgtcgctgcgaagatatcgatgaatgccaggatccagacacctgctcccagctctgcgtgaacttggagggcgggtacaagtgccagtgcgaggaaggcttccagttagatccacacactaaagcttgcaaggccgtcggttctatcgcatacctgttcttcactaatagacacgaagtgcggaaaatgaccctggatcggagcgagtatacgagcctgataccgaatctgcgcaatgtcgtcgccctggacactgaagtcgcgagcaaccgcatctactggagcgatctgtcacagcgcatgatttgttcaacccaacttgatcgcgcccacggggtgtcaagctatgataccgttatctctcgggacattcaggctccggacggtctggcggtcgactggatccacagcaacatttactggacggatagcgtcttgggtacggtgagcgtggccgacacgaagggcgttaagcgtaaaaccttgttccgcgagaacggcagcaagcctcgcgcaatcgttgtcgaccctgtccacggtttcatgtactggactgattgggggacccctgcaaagattaaaaaaggaggcttgaacggcgtggacatctactctctggtcacggagaatatccagtggcctaacggaattactctggacctgctgagcgggcgcctatactgggttgattcaaagctgcacagcattagcagcattgacgttaacgggggcaaccggaaaacgattctggaagacgagaagaggttggcccaccctttttcacttgctgtgttcgaggataaagtgttttggaccgatatcatcaatgaagcaattttcagcgcgaaccgcctgaccgggagcgacgtcaatctgctagccgagaatctgctgagccctgaagatatggtgctgttccacaatctgacccaaccacgcggtgttaactggtgcgaacgcaccactcttagcaacggcggatgccagtacctgtgcctgcctgctccacaaattaacccacactctccgaaatttacctgcgcttgcccggacggtatgctcttggcccgcgacatgcgctcctgcctgactgaggcggaggccgcggtggctacgcaggagacttctactgtccgcctgaaggtcagcagcactgccgtccggactcaacataccacgacccgcccggttcctgatacttcccgattaccgggtgccaccccgggcctgaccactgtggaaatcgtgacgatgtcacaccaagccctgggggatgtcgctggacgcggtaatgaaaagaagccttccagcgttcgcgctctgagcattgtgctcccgatcgtcctgctggtctttctgtgcctcggggtatttctgctgtggaagaactggcggctgaagaatattaacagcatcaactttgacaatcctgtctaccagaaaacaaccgaggatgaggtccatatctgtcacaaccaggatggttacagctatccttcccgccagatggtttcactggaggacgatgtcgct

SEQ ID NO: 16102 - DNA, 2580 bp, Artificial Sequence
  Description of Artificial Sequence: Synthetic coding sequence
atgggaccatggggctggaagctgcgctggaccgtcgcactcctcctggcagcggcaggtaccgcggtcggcgatcgatgtgaacgaaacgaatttcagtgccaagatggcaagtgtatatcatataagtgggtgtgtgatggttcggctgaatgtcaggacggaagcgatgaatcgcaagaaacgtgtctctcggtgacctgtaagtccggcgacttcagctgtggtggaagagtcaacaggtgcatcccccagttctggaggtgtgatgggcaagtggactgcgataatggcagcgacgaacaagggtgtcctccaaaaacctgctcccaggacgaatttaggtgtcatgatggcaaatgtatatcacgtcaatttgtgtgcgactcggaccgagattgcctcgatggatccgatgaagcctcctgtcctgtgctcacctgtggccctgcatcgtttcaatgcaattcatcaacttgtattccccaactgtgggcctgtgataatgacccagattgtgaagatgggtccgacgagtggcctcaacggtgtcgggggctgtacgtgtttcaaggggactcgtcaccctgtagcgcattcgaatttcattgcctttccggtgagtgtatccatagcagctggcggtgtgacggtggaccagactgtaaggataagagcgacgaagaaaactgtgcagtggccacttgtcgcccagacgaattccaatgcagcgatggaaattgcatccatggtagccgccagtgcgatcgcgaatacgattgtaaggatatgtccgacgaagttggatgtgttaatgtcaccctctgcgaagggccaaacaaattcaagtgtcatagcggcgagtgcattaccctggacaaggtgtgtaatatggcaagagactgtagagactggtcggatgagccaatcaaggaatgtggcactaatgagtgtctcgataacaacggaggttgttcgcacgtgtgtaacgatctcaaaattgggtacgagtgtgactgtcctgatggatttcagctggtggcgcaaagaagatgtgaagatatcgatgagtgccaggatcccgatacctgcagccaattgtgcgtgaacctggaaggaggatacaaatgccaatgtgaagagggattccaactggaccctcacaccaaggcctgtaaagcagtcgggtcgattgcatacctgttctttaccaatcgccatgaagtgaggaagatgaccctggatcgatctgaatacacttcgctgattccgaatttgcgtaatgtggtcgcattggataccgaggtggcaagcaaccgaatctactggtcagatttgagtcagagaatgatttgctcgacccagctggatcgagcccatggagtctcctcatacgacactgtgatctcgagggatatccaagcaccagacggtctggcagtggattggatacactcgaacatttactggaccgacagcgtccttgggaccgtgtcagtggctgacactaagggagtcaagcggaaaactctgttccgggaaaacggctcgaagccccgagcaattgtggttgatcccgtccatggattcatgtactggactgactggggcacccccgccaagattaagaagggaggtcttaacggcgtggacatttactcgcttgtcacggagaatattcagtggcctaatggtataaccctggacttgctttccggccgcctttattgggtggattcaaagttgcatagcatctcttcgatagatgtcaacggaggaaaccgcaaaactatcctcgaagatgagaagaggcttgcgcatccattttccctggcagtgttcgaggacaaagtcttttggacggatatcatcaatgaagcgatattctccgcaaaccgacttaccggaagcgacgtcaacctgctcgcagaaaatctgctgagccctgaagatatggtcctgtttcataatctcactcaaccccgcggcgtgaattggtgtgaaaggaccaccctgtccaacggtggctgtcagtacctttgtctgcccgctccacagattaaccctcattcgcctaagtttacctgtgcatgcccagacggcatgctcctggcaagagatatgcgttcctgtctcaccgaagccgaagcagcagtcgcaacccaagaaacttcgactgtgaggctgaaggtatcctcgactgcagtgagaacccagcatactaccactcgcccagtgcctgatacgtcgagactgccaggtgcaactcctgggctgaccactgtggaaatcgtcaccatgtcacatcaggcacttggggatgtggccggccgtggaaacgaaaagaagccttcatcggtccgggctttgtcgattgtgctccctatcgtgctgctggtttttctttgtctcggagtctttctcctctggaagaactggcggctgaaaaacataaacagcattaactttgataaccctgtctaccaaaagactactgaggatgaagtgcatatctgtcataaccaggacggttactcttacccatccaggcaaatggtcagcctggaggatgatgtggcg

SEQ ID NO: 16103 - DNA, 2580 bp, Artificial Sequence
  Description of Artificial Sequence: Synthetic coding sequence
atgggaccttgggggtggaaactacgctggaccgttgcactgctgcttgctgctgctggaacagctgtgggagatcggtgcgagaggaatgagttccagtgtcaggacggcaagtgtattagctacaaatgggtgtgtgatgggtctgcagagtgccaggacgggtcggatgagagtcaggagacctgcctatctgtaacgtgcaaaagcggggacttttcttgcggcggaagagtcaaccgttgtattccacagttctggagatgcgacggccaggtcgactgcgataacggctctgacgagcagggctgcccccccaagacttgctcacaggatgagttcagatgtcatgacggaaagtgcatctcacgccagtttgtatgtgatagtgatagggattgcctggacggatctgacgaggcctcgtgcccggttcttacctgcggacctgcctcattccagtgtaattcatcaacttgtatcccacagctgtgggcttgtgacaatgaccctgactgcgaggacggaagtgatgagtggccacagcggtgtcggggtctctacgtatttcagggggatagctctccctgctccgccttcgagtttcactgtctctctggagagtgtatccactctagctggaggtgtgatggcggtcctgactgtaaggacaaatcagacgaggaaaactgtgctgtggcaacctgccgccctgacgagtttcaatgtagtgacgggaactgcattcacggctcccgccagtgtgaccgggagtatgactgtaaagacatgagcgacgaggtcggttgtgttaatgtcactctctgtgaaggcccgaacaagtttaagtgtcatagtggcgaatgcatcacgctagacaaggtgtgtaatatggccagagactgcagagactggtcagatgagccaattaaggagtgcgggaccaatgagtgccttgataacaatggggggtgctcacacgtgtgtaacgatcttaaaatcggttatgagtgcgattgtccagatggttttcagctcgtggcacagcgacgttgcgaggacatcgacgaatgccaggaccccgatacatgttctcagctgtgcgtgaatcttgaaggcggttataaatgtcagtgtgaagagggctttcagctcgacccacataccaaagcctgcaaggccgttggctcaatagcctacctctttttcacaaacaggcatgaagtgaggaagatgacgctggacaggagtgagtacacgagtctgatacccaatctgcggaatgtggttgcactggatacagaggtggcgagcaaccgaatctactggagcgatttgtcacaacggatgatctgctccacccagctcgaccgagcacacggtgtgagctcttacgatacagtcatcagtcgggatatccaggctcctgatggactggcagtcgactggatacattcaaatatctactggaccgactccgtcttggggaccgtgtctgtcgcagacacaaagggcgtgaaacgcaaaaccctttttagggaaaacggctcaaagccccgagcaattgtcgttgatcccgtccatggtttcatgtactggactgattggggtacaccggcaaagataaaaaaggggggactcaacggagtcgatatttattctctggttaccgagaatatacaatggcccaatggcattacactggatctcttaagtggccggctgtactgggtggactctaaattgcacagcattagctctatagacgtgaatgggggcaaccgtaagaccattcttgaggatgagaaaagactggcccacccattttctctagccgtcttcgaggacaaagtcttttggacagatattattaatgaggccattttttctgccaacaggctgactggctccgacgtgaacctccttgctgaaaatctattgagtccggaggatatggtcctgtttcacaacctgacacagccacgtggcgtgaactggtgtgaaagaacgacccttagtaatggcggctgtcaatatctttgtcttccagctccacagatcaatccacactctcctaagttcacctgcgcatgtcctgatggcatgctgctcgcccgcgacatgaggagctgtttgacggaagccgaagcagctgttgcaacccaggagacatccacggtccggctgaaggtaagcagcactgccgtaagaacgcagcacacgaccacacggcccgtgcccgatacgagccggctccctggcgcaactccgggactgactactgttgagatcgttaccatgagtcaccaggctctgggagacgtggctggcagaggtaacgaaaaaaaacccagctctgtgcgcgccctcagtatcgtgttacccatcgtgctcctggttttcctgtgcttaggggtcttcctattatggaagaactggcggctgaagaacatcaacagtatcaacttcgacaatcccgtttatcagaagaccactgaagatgaggtacatatatgccacaatcaggatggatactcctacccttctcgtcagatggtaagtctagaggacgatgtggcc

SEQ ID NO: 16104 - DNA, 2580 bp, Artificial Sequence
  Description of Artificial Sequence: Synthetic coding sequence
atgggtccatgggggtggaagctgcgctggactgtagccttactcctagcagcagcagggaccgcggtgggagaccggtgcgagcgcaatgagttccaatgccaagatggtaagtgcatcagttacaaatgggtgtgtgatggttcagccgaatgccaggacggcagtgatgagtctcaagaaacatgcctgtccgtgacatgtaagtcgggggacttcagttgcggcggccgcgtaaaccggtgcattccccaattctggagatgcgacgggcaggtggactgcgacaacggcagcgacgaacagggctgcccacccaagacctgttctcaggatgaattcaggtgtcatgacggcaaatgtattagtcgacaattcgtctgtgactcagatagggattgcctggatggatcagatgaagcatcctgccctgtgctcacatgcggaccagcatctttccaatgtaattcctccacctgcatcccccagctgtgggcgtgcgacaatgaccccgattgcgaggatggcagcgatgagtggccccaacgatgcagaggactgtacgtttttcagggggactccagcccatgcagtgccttcgaattccactgtctgagcggtgaatgcatacattctagctggcggtgcgatgggggtcctgattgcaaggacaaatctgatgaggaaaactgcgcagtagctacctgtcggcctgatgagtttcagtgcagtgatggaaactgcatacatggttctaggcagtgtgatcgcgagtacgattgcaaagatatgtctgatgaggtgggctgcgtgaatgtgacactgtgcgagggtccaaacaagtttaagtgtcatagtggagagtgtataactctcgataaagtgtgcaatatggccagggattgccgcgattggtctgatgagcctatcaaagagtgtggaactaacgagtgtttggacaacaacggtggttgcagtcacgtctgtaacgatttaaaaatcgggtacgaatgtgattgtccagatggcttccagctagttgcccaacgccggtgcgaggacatcgatgagtgtcaagatcctgacacctgttcccagctttgtgttaacttggaaggaggatacaagtgtcagtgtgaagaaggattccaattggacccccacactaaggcctgtaaagccgtcggcagcatcgcatatttgttctttaccaacaggcatgaagtgagaaaaatgactttggatcgctctgagtatacctccttgatacctaacttacggaatgtggtggccttggatacagaagtcgcttctaaccgcatttactggagcgacctcagccagcggatgatttgcagcactcaactggaccgggcgcatggtgtctcctcatatgatacagtgatttcccgcgacattcaggcccccgacggcctggctgttgattggattcactccaacatctattggacagacagcgtgttgggcactgtgtccgttgccgacaccaagggagtcaaaagaaagaccctgttcagggagaatggatctaaaccccgcgccattgttgtagaccccgtccacggtttcatgtactggacagattggggtaccccagccaaaattaagaaaggggggttaaacggtgtggacatttacagcctggtgaccgagaatattcagtggcctaacggcattactcttgatctcctgtctggccgcctctattgggttgattctaaactgcatagtatctcctcaatcgatgtcaatgggggaaaccgcaaaactatccttgaggacgagaaaaggctagctcaccctttctcactggctgtattcgaagataaagtgttttggactgatatcataaatgaagcgattttttccgccaacaggctgacaggaagcgatgttaatcttcttgcggagaatttgctaagccccgaagatatggtgttgtttcataacttaacccagccccgaggtgtcaactggtgcgagaggaccactctttccaatggtggatgtcagtacttgtgtctgccggcgccccagataaatccgcactcacctaagtttacatgtgcgtgccccgacggaatgctgcttgctagagatatgcgatcctgcttaacagaagccgaggccgctgtggccacccaggagaccagtactgtgaggcttaaggtgtcttccaccgccgtacgcacacaacacacaacgactaggccagtgcccgacacgagtagactccctggcgccacaccgggattgaccactgtggagatcgtgaccatgtcacatcaagcacttggagatgtcgcggggcgaggaaacgaaaagaaaccttcatcagtgagagcactgagcattgtcctgcccatcgtactactggtgtttttatgcctgggggtgttcttgctgtggaaaaattggcgcctgaagaatatcaacagcatcaactttgataaccccgtatatcagaaaactaccgaggatgaggtgcacatatgtcataaccaggatggctattcctacccctcccgccagatggtctccttggaggacgatgtcgca

SEQ ID NO: 16105 - DNA, 2580 bp, Artificial Sequence
  Description of Artificial Sequence: Synthetic coding sequence
atggggccatgggggtggaaactgcggtggacagttgcgcttctactagctgcggcagggaccgccgttggggatagatgtgagcggaatgagttccagtgccaggatggtaaatgtattagttataagtgggtctgcgatggttcagccgaatgccaggatggtagtgatgaatcccaggagacatgtctcagcgttacatgtaaatccggagatttcagctgcggagggcgggtgaatcgctgtatccctcaattctggaggtgtgatggacaggtcgattgcgacaacggatctgacgaacagggatgcccaccaaagacctgtagtcaagacgaattccggtgccacgacggcaagtgtatctcccggcagttcgtctgtgacagcgatcgggactgcttggacgggtcggatgaagcctcatgccccgtgctgacatgcggcccagcttcctttcagtgtaattcctccacatgtatcccacaattatgggcgtgcgacaacgaccctgattgcgaggacgggtcggatgaatggccccagagatgccggggcctgtacgtgttccagggtgacagcagtccctgctcagccttcgaattccactgtcttagcggcgaatgtattcactcttcctggagatgtgacgggggcccagactgtaaggataagtccgatgaggaaaactgcgccgtggccacctgtcgtcccgacgagttccaatgctccgatggaaactgcatacacggctctagacagtgtgatcgcgaatatgattgcaaggacatgagcgacgaagtgggctgtgtcaatgtgacactctgcgagggccctaacaagtttaaatgccacagcggtgagtgtatcaccctggataaggtctgcaacatggctagagattgccgagactggtctgacgagcctatcaaagaatgcggaaccaacgaatgcctggacaataatgggggatgctcccatgtgtgtaacgacctgaagatagggtacgagtgtgattgccctgatggattccagctggttgcacaaagaagatgtgaggatatcgatgagtgccaggatccagacacctgttcccagctatgcgtgaacctcgagggaggttataagtgccagtgcgaagaaggcttccagctcgacccccatacgaaggcatgcaaagcggtgggcagtatagcttatttgttttttactaataggcacgaggttcgaaaaatgacactggatcgatctgagtatacctcgcttattcctaacctacgcaatgtcgtggctctggacaccgaggtagcttctaaccggatctattggtccgacctatcccagcggatgatctgctccactcagctggatcgcgcacacggtgtctcctcatacgacaccgtgatttctcgggacatacaggccccggacggcttggctgtcgactggatacactcaaacatctactggactgattcagtccttggtacggtgtcagtggcagatacaaagggggtgaagcggaagacactgtttcgggagaatggctccaaacctagagcgatcgtggtggatcccgtccacggcttcatgtactggacggactggggcacaccagcaaaaattaaaaagggtggcctcaacggcgtggacatttactctttggttacggagaacattcagtggcctaatggtatcaccctggacctccttagtggacgcctctactgggtggacagcaagcttcactctattagctccatcgacgtgaatggcggcaacaggaaaactattctggaagatgagaagcgtttggcgcacccctttagcctggctgtgtttgaggataaggtattctggacggatattattaacgaggccatctttagtgcaaaccgcttgacagggagtgacgtgaatcttctggctgaaaacctgctgtcccccgaggatatggtcctgttccacaacttgacacagccaaggggcgtcaattggtgtgaaagaacaacactgagcaatggtggctgtcagtatctgtgcctcccagcgccacaaattaacccacactcacccaaattcacctgcgcctgccccgatggtatgctcctcgcgcgggatatgaggtcatgtctcacagaggcggaagccgcagtggccacacaagaaacctcaactgtgagactgaaggtatcctctacagcagtccgaacacagcacaccacgaccaggccagtgcctgacacttcacggctgcctggagctacccctggcttaactacagtcgaaattgtaaccatgtcacaccaggcgcttggcgacgtcgcggggagaggcaatgagaagaagccctcaagcgtaagagccctcagcatcgtcttgccgatcgtcctgctggtcttcctgtgcctgggagtgtttctcttgtggaagaactggagactaaagaatataaattcaatcaatttcgacaaccctgtgtaccagaagaccacggaggatgaagtgcatatttgccacaaccaggacggatatagttacccaagcagacagatggtgtccctggaagatgacgtcgcc

SEQ ID NO: 16106 - DNA, 2580 bp, Artificial Sequence
  Description of Artificial Sequence: Synthetic coding sequence
atgggaccctggggttggaaacttaggtggaccgtcgcactgcttcttgccgcagccggaactgctgtgggtgatcgctgtgaaaggaacgaatttcagtgtcaagatggcaagtgtatctcctacaagtgggtgtgtgatggatccgcagagtgtcaggatggatcagatgaatcccaagaaacttgcctctccgtgacttgtaagtcgggggactttagctgcggtggtcgagtcaatcgatgcatccctcaattctggagatgtgatggacaggtggattgcgataacggatcggacgaacagggatgcccaccaaagacctgtagccaagatgaattcagatgtcatgacgggaagtgtattagccgacaatttgtgtgtgacagcgaccgggattgccttgacggctcagacgaggcctcttgcccagtgctgacttgcggaccggcctcgttccagtgcaactcgtccacctgtattcctcagctttgggcgtgcgacaacgatcctgattgcgaggacggatccgatgagtggccccaacgttgtagagggctctacgtgtttcagggagactcatccccatgctctgcctttgaattccattgtctttccggcgaatgcatccattcctcgtggcgctgcgatgggggacctgattgcaaggataagtcggacgaagaaaactgcgcagtcgcaacgtgccgcccagatgaattccagtgttcagacggtaattgtattcacggctcaaggcaatgcgaccgcgaatacgactgtaaggatatgtccgacgaagtcggttgtgtgaacgttaccctgtgcgagggtcccaacaagtttaagtgccattcgggagagtgtataacccttgataaggtgtgcaacatggcacgggactgtcgggattggtccgatgaacctatcaaagaatgtgggaccaacgagtgtctggacaacaacgggggctgctcgcacgtgtgtaacgatttgaaaattgggtacgaatgcgattgtcctgatggttttcaactcgtcgcacagaggcgctgtgaggacatcgatgagtgtcaggaccccgacacttgctcccaactttgtgtgaatctggaaggtggatacaagtgtcaatgtgaagagggctttcagctggacccacatactaaagcatgcaaagcagtgggttcgattgcatacctgttctttaccaatagacatgaagtccgaaagatgaccttggaccggtcggagtacaccagcctgattccgaatctgagaaatgtggtcgcactggataccgaagtcgcatcaaaccgcatatactggagcgatttgtcgcagaggatgatttgtagcactcagctggacagagcacatggcgtttcgtcatacgataccgtcatttcgagggacatacaggcgcccgatggtcttgccgtggattggattcactcgaatatctactggaccgatagcgtgctgggcacggtgagcgtcgcagacaccaagggtgtcaagcggaaaaccctctttcgcgaaaatggttcaaaaccaagagccatcgtggtggatccagtgcatggatttatgtactggactgattggggaactccagcaaagataaagaaaggtgggctgaatggagttgatatctattcgttggtgaccgagaatatacaatggcctaatggaatcaccctggacctgttgtcaggacggctgtattgggtggattccaagctgcattcgatttcgtccatagatgtgaatggcggtaacaggaaaaccattcttgaagatgaaaagagacttgcgcatcccttttccctcgcagtgttcgaagataaggtgttctggaccgacattatcaatgaggcaatcttttccgcaaaccggctgaccggttcggacgtgaatctgcttgcggaaaacctgttgtcgcccgaggacatggtcctgtttcataacctgacccagccacggggagtgaactggtgcgaacgcactactctttcgaacggaggatgccaatacctctgtctccctgcacctcagattaaccctcatagccctaaattcacttgtgcatgcccagacggtatgctgcttgcaagagatatgagatcgtgcctgacggaggcagaagcagcggttgcaacccaagagacttctactgtgcgactgaaagtcagcagcaccgccgtgcgcacccaacacacgaccacccgccctgtgccggatacctcccgtttgccgggcgcgaccccagggcttaccaccgtggaaattgttaccatgtcacaccaggcgcttggcgatgtcgcgggccggggaaatgagaagaagccttcctcggtgcgcgcgctgtcgattgtccttcccattgtgttgctcgtgtttctttgcctcggagtctttctcctttggaagaactggcggctgaaaaacattaactccatcaactttgacaacccagtctaccaaaaaaccacggaggacgaagtccacatatgtcacaaccaagatggttactcgtacccttcccggcaaatggtttcacttgaagatgatgtggcc

SEQ ID NO: 16107 - DNA, 2580 bp, Artificial Sequence
  Description of Artificial Sequence: Synthetic coding sequence
atgggtccgtggggctggaagctgcgttggactgtggctcttctcctggctgccgccggaacggcggttggcgaccgctgcgaaagaaacgaattccagtgccaagacggcaagtgtataagctacaagtgggtgtgcgacggatcggccgaatgtcaggatggatcagacgagtcccaggagacttgcctgagcgtgacctgcaagtccggagacttctcatgcgggggacgggtcaatcggtgcatcccacagttttggagatgcgacggtcaggtggactgcgataatggaagcgacgaacagggctgtcctccaaagacttgttcgcaggacgagtttcggtgtcatgatggaaagtgtattagccggcaattcgtgtgcgattcagacagagattgcctcgacggatccgatgaagcctcctgccccgtgctgacctgcggacctgcgtcgttccagtgcaattcgtcgacctgcatccctcaattgtgggcctgtgacaatgatccggactgcgaagatggctcggatgaatggccacaacggtgccggggcctttacgtgttccaaggggactcatccccgtgctcggcgttcgaattccactgcttgtccggcgaatgcatccactcatcgtggagatgcgatggaggaccggactgtaaggataagtccgacgaggaaaactgcgccgtggcgacttgtagaccggatgagttccagtgttccgatggcaattgcatccacggatcgaggcagtgcgaccgggaatacgattgcaaagacatgtcagatgaagtgggatgtgtgaatgtcactctttgcgaaggccctaacaaattcaaatgccactctggggaatgcatcaccctcgacaaggtgtgcaatatggcgcgggattgcagagattggagcgacgagcctatcaaggaatgtggcactaacgagtgtctcgacaataatggagggtgcagccacgtgtgcaacgacttgaagatcggatacgagtgtgattgcccggacggatttcaactggtcgcccagcgccggtgtgaggatattgatgagtgccaagacccagatacctgctcgcaactgtgcgtgaatctggagggtggatacaagtgccaatgcgaggagggcttccagcttgatccgcacactaaggcgtgcaaagccgtgggatccatagcgtacctgtttttcaccaaccgccacgaagtccgcaagatgaccttggacagatccgaatacacttcactcatcccaaacctgcgaaacgtggtcgccctggacactgaagtggcatcgaacagaatctactggagcgacctgagccaacgcatgatctgctcaactcagcttgatcgcgctcacggcgtgtcaagctacgacaccgtgatctccagagacatccaagcgccggatggactggctgtggactggatccacagtaacatctactggacggattcagtgctgggaactgtctcggtggcagacaccaagggagtgaagcgcaagactctgttccgcgaaaatggctccaagccaagagccattgtggtcgacccagtccatggattcatgtactggaccgactggggaaccccagccaagatcaagaaggggggcctgaatggcgtcgacatttactcactcgtcaccgaaaacatccaatggcctaacggaataaccttggatttgctgagcgggcgcctgtattgggtcgactcgaaactgcattcgatctcgagcatcgatgtgaacggaggaaaccgcaaaaccatcctggaagatgaaaagcgactggcgcatccgttttcgctggccgtgttcgaggacaaagtgttctggaccgacatcatcaacgaggccatcttctccgcgaaccgcctcaccggctcggacgtgaacctcctggcggaaaacttgctctcacccgaagatatggtgctctttcacaacctgactcagccacggggagtgaattggtgcgagcgcaccactttgtcgaacggaggctgtcaatacctttgtttgccagccccgcaaatcaatccgcacagccccaagttcacttgcgcatgcccagacggtatgctcctggcacgcgatatgcgctcctgcttgactgaagccgaagcagccgtggctacccaggaaaccagcaccgtgcgcctcaaggtgtcaagcactgcagttagaactcaacacactaccacgcgccccgtcccggacactagccgtctcccaggcgcgactccgggcctgacgaccgtggaaatcgtgaccatgtcgcatcaggctctcggtgacgtggccgggaggggaaatgaaaagaagccctcgtcggtgcgcgccctgtccatcgtgctcccgattgtcctgctcgtgtttctgtgcttgggcgtgttcctgctgtggaaaaactggcggctgaagaacatcaactcgatcaactttgacaatccggtgtaccagaaaactactgaggacgaggtgcatatctgccacaaccaagacggttactcgtacccgtcgcggcaaatggtgtcgttggaggacgacgtggct

SEQ ID NO: 16108 - DNA, 2580 bp, Artificial Sequence
  Description of Artificial Sequence: Synthetic coding sequence
atggggccctggggatggaaactgagatggactgtggccctgctgctcgcggctgctggcactgccgtgggcgacagatgcgagaggaatgagtttcaatgccaggacggcaagtgtattagctacaagtgggtctgtgatggcagtgccgagtgccaggatggctccgatgaatcccaggaaacgtgtttgtctgttacgtgtaaatcaggggacttcagctgtggaggacgagtgaatcgctgcatcccccagttttggcggtgtgacggccaggtcgactgtgacaatggaagcgatgagcaagggtgtccacccaagacctgcagccaggatgagtttagatgtcacgacgggaagtgtatttcaaggcagttcgtgtgtgactccgacagggattgcttggacggtagcgatgaagcatcctgcccagtactgacatgtggacctgcatcatttcaatgtaactctagtacctgcattcctcaactgtgggcctgtgacaacgacccggattgtgaggacggtagcgatgaatggccacagcgatgtcggggactgtatgtgttccagggtgactcctcaccctgttccgcttttgaatttcactgcctgagtggggagtgcatccacagttcctggcgctgtgacggcgggccagactgtaaggataagtctgatgaagaaaactgtgccgtggcaacctgcaggccagatgagttccagtgttctgacggtaactgcatccatggcagtaggcaatgcgaccgggaatacgattgcaaggacatgtccgacgaagtgggttgcgtcaacgtgacattgtgtgaggggccaaacaagtttaaatgccactccggcgagtgcataacccttgacaaggtatgtaatatggccagagactgcagggattggagcgatgaacccatcaaagaatgtgggacaaacgagtgtctggataataatggtggttgcagccacgtgtgtaatgacctcaaaatcggctacgagtgcgactgccccgacggattccagctggtggcccaaaggcgctgtgaggacatcgacgagtgtcaggacccagatacctgctcccagctgtgcgtgaaccttgagggaggctataaatgtcagtgcgaagaaggcttccagctggatccccacacaaaagcctgcaaggccgttgggtctatagcgtacttgttctttaccaatcggcacgaagtgaggaagatgacccttgaccgctctgagtatacctcactgattcccaacctccggaatgtcgtggctctggacacagaagtggctagcaatagaatctactggtcagacctgagccagcggatgatctgctcaacccagcttgacagggcccacggcgtttcaagctacgatacggtgatcagtagagacattcaggcacccgacggtctggccgtagactggatccattctaatatctattggactgatagtgtcttgggcacggtatccgtggccgacaccaagggtgttaaaaggaaaaccttgttccgagagaatgggtctaagccccgagcaatcgtggtcgacccggtgcacggttttatgtactggactgactggggaacgcccgccaagattaagaaaggtggcctgaatggtgtggacatttacagcctggtaactgaaaatatccagtggccgaacggcatcacccttgacctgcttagcgggagactctactgggtggactcaaagctgcacagcataagtagcatagatgtgaatggaggtaatcgaaaaaccatactcgaagacgagaaaagactggcccatcccttttccctggcagtgtttgaagataaagtattctggacagatattattaacgaggccatttttagtgccaataggctgaccggttccgacgtaaatctgctggcagagaatcttttgtctccagaggacatggtgttgtttcataatttgactcagccgcggggcgtaaactggtgcgaacggactaccttgagtaatggaggatgtcagtatctgtgcctgccggccccacagatcaaccctcatagccccaagttcacctgtgcctgtcccgatgggatgctgcttgcccgggatatgcgcagctgcttgactgaagcggaagccgctgtagctactcaggaaacctcaaccgtgaggcttaaggttagttccactgctgtgcgcacacaacacacaactacgcgccccgtgccagatacttctcgcttgccaggtgctacccctggactcaccacagtggagattgtgaccatgtcccaccaggccctcggagacgtcgctggtcgcggcaacgagaagaaaccatcctccgttcgggctctctcaattgttctgccaattgtgctgcttgttttcctgtgcctgggcgtattcctgctgtggaaaaattggcgcctgaaaaatatcaactccatcaatttcgataaccccgtataccagaaaacaacagaggatgaagttcacatatgtcataaccaagacggctacagctatccatccaggcagatggttagtttggaggacgatgtggcc

SEQ ID NO: 16109 - DNA, 2580 bp, Artificial Sequence
  Description of Artificial Sequence: Synthetic coding sequence
atgggaccctggggctggaagcttcggtggacagttgccctcttgctggcggcggccgggaccgcagtgggagaccggtgcgagcgcaacgaatttcagtgccaggacggtaagtgtatctcatacaagtgggtctgcgacgggtccgcagagtgtcaagacggctcagatgaaagtcaggagacttgtctttctgttacctgtaagtctggcgacttttcttgcggagggagggtgaacaggtgcatccctcagttctggaggtgcgatggtcaggtcgattgtgataacgggtcggacgagcaggggtgcccaccaaagacgtgttctcaggatgagtttcgctgccacgatggtaagtgcatttcacggcaattcgtttgcgatagtgatagagactgcctcgatggaagtgatgaggcttcttgtcctgtgctgacatgtggccctgcctcttttcagtgcaatagcagcacctgcatccctcagctgtgggcgtgcgataacgacccagattgtgaagatggaagcgatgaatggccccagaggtgtcggggtctctatgtattccagggggattcctccccttgttcagcttttgagtttcactgcctttccggggagtgcatccacagttcctggaggtgcgatggtgggccagactgcaaggacaaaagtgacgaggagaactgtgccgtggcaacatgtcggccagatgagttccagtgctccgacgggaactgtatccacggctctcgccagtgcgatagagaatatgactgtaaggatatgtccgatgaagtgggctgcgtcaatgtgaccctgtgtgaggggccgaataaatttaagtgtcatagtggcgaatgtattacgctggacaaggtctgtaatatggccagagattgccgtgactggtcggacgagccaataaaggagtgtgggacaaacgaatgccttgataacaacggtggatgctcgcacgtctgtaacgatctgaaaattgggtatgagtgcgactgccctgacgggtttcagttggtggctcagcggcgctgcgaggacattgatgaatgccaggacccagacacatgttctcagctgtgtgtgaatctggaaggaggatacaagtgccagtgtgaagagggcttccaactcgatccccacactaaggcttgtaaggccgttggcagtatagcgtacctctttttcacaaatcggcatgaagtgcgtaaaatgacgctggacagatcggagtatacatcgttgattccaaacctccgtaatgttgtggcactggatactgaggttgcatccaaccgcatatactggtctgatttgagccagaggatgatttgttcgacccaattggatcgcgcacacggagtgtcatcgtacgataccgtcatctcaagggatatccaagcacccgatggccttgctgtcgattggatccactccaacatctactggacagattctgtgcttggtacagtgagcgtggccgacaccaaaggagtcaagagaaaaaccctgttccgcgagaacggatcaaagcccagggcaattgtcgtcgatccagtgcatggtttcatgtactggaccgattgggggacccccgcgaaaatcaaaaagggaggactgaacggcgttgacatctacagcctagtgacggaaaacatacagtggccaaatgggatcaccctcgatcttctaagtgggcgtctgtactgggtcgatagtaagctgcattccatctcatctatcgacgttaatggaggcaacaggaagacgattctggaagatgagaaaaggctggcccatccattttctctggccgtgttcgaagataaggtattttggacggacattattaacgaagcgatcttttcggcgaatcggcttacagggtccgatgttaaccttttggccgaaaatctgctgtctcccgaggacatggtgcttttccataacctgactcagccccgaggagtgaactggtgtgaaaggactacattgtccaatggaggctgccaatacctctgtctgccagccccacagataaatccgcacagccctaagttcacttgtgcctgccccgacggtatgctgcttgctagggacatgagaagttgtttaaccgaagctgaggctgcagtggccacacaagagacctcaaccgtgagactcaaagtctcttccaccgcagtgaggacacagcatactaccactcgtccggtgcccgacaccagccgcctccctggcgcgactcccggtctgacaactgtggagattgttaccatgtctcaccaggccctgggggatgtagcgggtcgagggaacgagaagaaaccatcttcagtccgagcactatcaatcgtcctgccaatcgtcctgttggtatttctgtgcctgggagtgtttttattgtggaaaaactggagacttaagaatattaatagcatcaacttcgacaatccggtttaccagaaaacaaccgaggatgaggtccacatttgccacaaccaggatggctactcctacccatcgcggcaaatggtgtcgctggaggacgatgtagcg

SEQ ID NO: 16110 - DNA, 2580 bp, Artificial Sequence
  Description of Artificial Sequence: Synthetic coding sequence
atgggaccatggggatggaagctgcggtggactgtggcacttctccttgctgccgcaggcaccgcggtcggtgatcgctgcgagaggaacgagttccaatgccaggatggcaagtgtattagctataagtgggtgtgtgacggttccgcagaatgccaggacggcagcgatgaaagccaagaaacctgtctgagcgtcacttgtaagtcaggtgattttagctgtggaggacgcgtaaatcgctgcatcccacaattttggcggtgcgatggccaagtggactgtgataacggatcggacgaacaaggatgcccacctaagacctgttcccaggacgagtttcgatgccatgatggtaagtgtatttcgagacagtttgtgtgcgatagcgatcgcgattgtcttgatggttccgatgaagcgtcgtgcccagtgcttacgtgtggacctgcctcgtttcagtgtaatagctcaacctgtatccctcaactttgggcctgtgacaatgatcctgattgtgaggacggttcagacgaatggccccagaggtgcagaggactttacgtgttccaaggtgattcctccccctgttcagcattcgaattccactgtctgagcggggagtgcatccacagctcctggcgttgtgatggaggccctgattgcaaggataagtccgatgaggagaactgcgcggtcgcaacctgtagacctgatgaattccagtgttcggatggcaattgtattcatgggtctaggcaatgcgacagagagtacgattgtaaggatatgtcagatgaggtgggttgtgtgaatgttactctgtgcgaagggccaaataagttcaagtgtcattctggtgagtgtatcacgctggacaaggtgtgcaacatggctcgggattgccgcgactggagcgacgaaccaatcaaagagtgcggtaccaatgaatgcctggataacaacggtggatgttcccatgtgtgcaacgatcttaagattggatacgaatgtgactgtcctgacggatttcaattggtcgcacagcggcggtgtgaagatatcgatgagtgtcaggatccggacacttgttcacaactttgtgtgaacctggaagggggatacaaatgccaatgtgaagaaggatttcaactggaccctcacactaaggcctgcaaggcggtgggaagcatcgcttatctgtttttcaccaacagacatgaggtgagaaaaatgactcttgataggtccgagtacacttccctcatccccaacctgagaaatgtggtagcactggacaccgaagtggcttcaaacagaatttactggtccgacctctcccagaggatgatctgctctactcaacttgatcgggcacacggagtctcttcgtacgatactgtgatctcccgggacattcaggcaccggacggtcttgccgttgattggatacattccaacatctattggactgattccgtgctggggactgtgagtgtggctgataccaaaggagtgaagcgcaagactctgtttagggaaaatggctcgaaaccacgcgcaatcgtggtggatccagtgcacggttttatgtactggactgattgggggactcctgcgaagataaagaaaggtggcctgaacggtgtggacatatactcacttgtgaccgagaacatccagtggccgaacggaataactcttgaccttctcagcggacgactttactgggtggactcgaaacttcattcgatatcgtcgattgacgtgaatggaggaaatcgaaagaccattctggaagatgaaaaaagactcgcacacccgttttcgctcgctgtctttgaggacaaggtcttttggaccgatatcataaacgaagcgatattctctgcaaatagacttaccggatcggacgtcaacctccttgcagagaaccttctctccccagaggacatggtgctgtttcacaacctcacccagcccaggggggtgaactggtgtgagcggaccactttgtccaatggtggatgtcagtacctttgtctgcctgcaccacagatcaaccctcactcgccgaaattcacgtgcgcatgccccgatggtatgctccttgcacgtgacatgcgcagctgtcttaccgaggcggaggcagcagtggcgactcaagaaaccagcaccgtgaggttgaaggtgtccagcaccgcggtgaggactcagcataccacgactagaccagtcccagatacctcgagactcccgggcgcaacccctggacttactactgtggagattgtcactatgtcccaccaggccctgggcgacgtggcaggtcgcggtaacgagaaaaaaccatcgtcggtgcgagcactgtcaatcgtgcttccaattgtgctgctggtctttttgtgcctgggggtgtttcttctgtggaagaattggcggctgaagaacattaactcaattaactttgataacccggtctaccaaaagaccaccgaggatgaagtccacatttgtcataaccaagatggatactcgtacccctcacggcagatggtgtcactcgaggacgatgtcgca

SEQ ID NO: 16111 - DNA, 2580 bp, Artificial Sequence
  Description of Artificial Sequence: Synthetic coding sequence
atgggaccttgggggtggaagctgagatggactgttgctttgcttctcgcagcagccggcacagctgtcggcgacagatgtgaacgaaacgagttccaatgccaggatggaaagtgcatatcttacaagtgggtttgcgatggatctgcagagtgccaagacggctctgatgagtcccaggagacatgcctaagtgttacctgtaagagcggagacttcagttgcgggggcagagtgaacagatgtatccctcagttctggagatgcgatggacaggtggattgcgataatggcagcgatgaacagggttgtcccccaaagacctgttctcaggatgaatttcgatgccacgatgggaaatgtatcagcagacagttcgtgtgcgattccgacagagattgcctggatggcagcgatgaagcttcttgcccagtcttgacctgcggcccggcctcattccagtgtaactcatccacctgcatcccacagttatgggcttgcgataacgaccctgattgtgaagacgggagcgatgagtggccccagaggtgtagaggcttgtacgtcttccaaggtgactcatccccatgttctgctttcgaattccattgcctcagtggcgagtgcatacatagcagctggagatgcgatggaggacctgactgcaaggataagagtgatgaggagaattgcgcggtagcgacatgccgtcctgacgagttccagtgttcagatggaaactgtattcacggctctcgccaatgtgatagagagtatgattgcaaggacatgagcgatgaagttggctgcgttaacgtgacattatgtgaaggaccaaacaaatttaagtgtcacagcggagaatgcattacactggataaggtctgcaacatggcacgcgactgccgcgactggagtgacgagcctatcaaagaatgcggcactaatgagtgtctcgataacaacggggggtgtagccatgtgtgcaacgatctaaagataggctacgaatgcgactgcccagatggattccagctggttgcacagaggaggtgcgaagatatcgatgaatgccaggatcctgatacctgcagtcagctctgtgttaacttggagggtgggtataaatgtcaatgcgaagagggatttcagctcgacccccatacaaaggcctgcaaggctgtgggctctatcgcctacctgttcttcacaaataggcatgaggtgagaaagatgaccctcgacaggtccgagtacactagcttgataccaaacctgagaaacgttgtggcgcttgacacagaggtcgctagtaatcggatatactggagcgatctgtcacagaggatgatctgtagtacacagctcgatcgggcacacggagtcagtagctacgacacagtgataagccgcgatatccaagcacctgatggccttgcagtggattggatacatagcaacatctattggacagacagtgtgttggggaccgtcagcgtggccgatactaagggagtgaagaggaagacactgttccgtgaaaacggctcgaaaccgagggctatcgtggtcgatccagtacacgggtttatgtactggactgattggggcactcctgcaaaaatcaaaaaagggggactgaacggcgtggatatctacagcctggtcactgaaaacattcagtggccaaatggcatcacactagacctgttgagtggcagactttactgggtcgattccaagcttcacagtatctcttcaattgatgttaatggtggaaatcggaagaccatcctcgaagacgagaagcgactggcccacccctttagcctggccgtattcgaggataaagtcttctggaccgacatcataaacgaagcaattttttccgccaacagactcaccggatccgacgttaatttactagccgagaacctgctgtccccagaagacatggtgctattccataacctgacccagcctcggggggttaattggtgcgaacgcacaaccctcagcaacggcggatgccaatatttatgcctcccagctcctcagattaatccccacagccccaaattcacttgcgcgtgccctgatggaatgcttctggcaagagacatgcggagctgtctcacagaggccgaggctgctgttgctacccaagagacaagcaccgtccgattgaaagtttccagtaccgcggtccggacacaacacactactaccaggcctgtgcccgatacatctcggctgcctggggctacgccagggctaaccactgtcgagatagtcacaatgagccaccaggcattgggcgatgtggcaggccgcggcaatgagaagaaaccgagctccgtcagagcactcagtatcgtcctgcctattgtgctgttagtgttcctgtgtctgggagtcttccttttgtggaagaactggcgtctgaaaaacatcaacagtatcaattttgataacccagtctaccagaagaccacagaggacgaggtccatatttgccacaaccaagatgggtactcctatccgtcccggcagatggtgtctctggaggacgatgtggcc

SEQ ID NO: 16112 - DNA, 2580 bp, Artificial Sequence
  Description of Artificial Sequence: Synthetic coding sequence
atgggaccatggggttggaagctgagatggactgtggcgctccttctggcggccgccggtactgcagttggtgacagatgtgaacgcaacgaatttcaatgtcaagacggtaaatgcatttcctacaagtgggtgtgcgacggatcagcagaatgccaggatggttcagacgaatcccaagaaacctgcctgagcgtgacttgtaagtcgggagatttcagctgcggagggcgggtgaatcggtgtatcccccaattttggaggtgcgatggtcaagtggattgtgataatggatcagatgagcagggatgtccccctaagacctgttcacaggacgagtttaggtgtcacgacggaaaatgtatcagcagacaattcgtctgtgattcggatagagattgtctggatggctccgacgaagcatcatgcccagtgctcacgtgtggacctgcgtcgtttcagtgtaactcctctacttgtattccacaactttgggcatgtgataacgatccggattgtgaagatggcagcgatgaatggccacaaagatgccggggactgtatgtgtttcagggagattcgtccccttgttccgcctttgaatttcattgtctttcgggagaatgtattcattcgtcgtggcgatgcgacggtggccctgactgtaaggataagtctgatgaagagaactgtgccgtggcaacttgcagacctgacgagtttcaatgttccgatggaaattgcattcatggttcgagacaatgtgatagagagtacgattgtaaggacatgtcggatgaagtcgggtgtgtgaacgtgacgctgtgtgaaggcccaaacaagttcaaatgccatagcggcgaatgcatcaccctggataaggtttgcaatatggcaagggactgcagggactggtccgacgaacccatcaaggaatgcggaaccaatgagtgcctggacaacaacggtggatgttcgcatgtatgcaacgacctcaagattgggtacgaatgtgactgtcccgatggcttccaactggtggcacaaagaagatgcgaggatattgacgaatgtcaagacccagatacctgcagccaactttgtgtgaaccttgagggaggatacaagtgtcagtgtgaagaaggttttcaattggatccacacaccaaggcgtgcaaggcagtaggttcaattgcctacctgtttttcaccaatcggcatgaagtcaggaagatgacgctggatcggtcggagtatacctcccttatccctaaccttagaaacgtggtggcacttgataccgaggtggcctcaaacagaatatactggtcggatctgtcgcagcggatgatttgctccactcagcttgaccgggcacacggggtcagctcctacgatactgtcatttcaagggacatccaagcacctgacggtctggcagtggactggattcactccaacatttactggacggactcggtcttgggaactgttagtgttgccgatactaaaggggtgaagcgcaaaaccctgtttcgggaaaacgggagcaagccgcgcgccattgtcgtggaccctgtgcatggattcatgtactggaccgactgggggaccccagctaagatcaagaaagggggacttaatggagtggatatctacagccttgtgacggaaaacattcagtggcctaatgggattacccttgatctgctgtccggccgcctgtactgggtcgattcaaaactgcattcaatttcctcgatcgatgtaaatggtgggaataggaaaactattctggaggatgagaaaagacttgctcatccctttagcctggccgtgtttgaagataaggtattctggaccgatatcataaatgaagcaatcttcagcgccaaccgccttactggttcggacgttaatcttcttgctgaaaacctgctgagccctgaagatatggtgctcttccacaacctcacccagcctagaggtgtgaattggtgtgaaagaactaccttgagcaatggaggttgtcaatacctctgtctccccgctcctcagattaatccacattcaccgaaattcacttgtgcctgtccggacggcatgctccttgcgagagatatgagaagctgtttgactgaggccgaggcagctgtggcaacccaggaaacgagtactgtgagactgaaagtttccagcactgcagtgagaacccagcataccactacccgtcctgtccctgacacttccaggcttcctggcgcaaccccaggcctcaccaccgttgagattgtgaccatgtcgcaccaagcactcggtgatgtggctggccgcggcaacgaaaagaagccttctagcgtgcgtgccttgtcgattgtgctgcccattgtcctgctcgtgtttctgtgtcttggtgtgttccttttgtggaagaactggaggttgaaaaacataaactccatcaatttcgataaccctgtgtaccagaaaactacggaggacgaagtgcacatctgccataaccaggatggatacagctaccctagcagacagatggtcagccttgaggatgacgtggca

SEQ ID NO: 16113 - DNA, 2580 bp, Artificial Sequence
  Description of Artificial Sequence: Synthetic coding sequence
atggggccctggggttggaaactgcggtggactgttgcccttctgctagctgctgcaggcaccgccgtgggggacagatgcgaacgcaatgaatttcagtgccaggatgggaagtgcatatcctataaatgggtttgtgacggcagcgcagagtgccaggacggtagcgacgaatcacaagaaacctgcctgagtgtcacctgcaaaagcggggactttagttgtggcggacgtgtcaacaggtgcattccccagttctggcggtgcgacgggcaggtggactgcgataacggatctgatgagcagggatgtccccccaagacttgctctcaggatgagtttcggtgccatgacggcaaatgcatatccagacagttcgtgtgcgattctgatcgagattgtctggatgggtcggatgaggcctcctgccccgtgctgacgtgtggtccagcatccttccagtgcaactcttcgacatgtatcccacagctgtgggcgtgcgacaacgatcccgattgcgaggatggttctgacgagtggccccagcgttgtcggggcctctacgttttccaaggcgattcttccccgtgtagcgcattcgagtttcactgcctctctggggaatgcatccactccagttggagatgcgacggcggacctgattgcaaagacaagagcgacgaggagaattgcgcggtcgcaacctgtaggcctgatgagtttcaatgctcagacggaaattgtattcacggaagtcggcagtgtgaccgcgaatatgactgtaaagatatgtctgatgaggtagggtgtgtgaacgtaacactgtgcgagggacctaacaagttcaaatgccactcgggggaatgtatcaccttggacaaggtttgcaacatggctagggattgtcgggattggagtgacgagcccatcaaggagtgcggaacaaatgagtgcctggataacaacggtggatgcagtcatgtgtgcaatgacctgaagatcggctatgagtgcgattgtccggatgggtttcagctcgtggcccaacgacgttgcgaagacatagacgagtgtcaggatccagatacttgctcccaattatgtgtcaatctagagggaggctataagtgtcagtgcgaggagggcttccagctggaccctcatacgaaggcctgcaaagctgtcggatccattgcgtacctgttcttcaccaaccgtcacgaagtccgaaagatgactctcgataggagtgaatacaccagcctaattcctaacctgaggaatgtcgtggcactggacaccgaggtggcctcgaatcgcatttactggagcgacctgagtcaacgtatgatctgcagtacccaactggatagggcacatggagtttcatcatatgatactgttatctcgagagacattcaggcacccgacggcctggcggtggactggatccatagcaatatctactggacagacagtgtgctggggaccgtatcggtggccgacacaaaaggagtgaagcgtaaaaccctgttcagagaaaatgggagtaagcccagggccatcgttgtggaccctgtacacggcttcatgtactggacagattggggcacacccgcaaaaatcaaaaagggtggactcaatggcgtcgacatatactctttggtaaccgagaatatccagtggccaaatggcatcaccttggaccttttatctggccggctctattgggtggattctaaactgcattctatcagcagtatcgacgtaaatggaggcaatcgcaagactatcctcgaagatgaaaaacgactagcccatccattctcactggctgtgtttgaagacaaggttttttggactgatattattaatgaggccatcttcagtgccaaccgcctaaccgggagcgatgtgaatttgttggccgaaaatttactgtcccctgaggacatggttctctttcataatctgacccagcctaggggcgtgaactggtgtgagcgcacaacactaagcaacggagggtgtcagtatctctgcctgccagccccacagattaacccacatagtccaaagtttacctgcgcttgtcctgacggcatgctgctggcccgggatatgagatcatgtttgaccgaggctgaggctgcggtggcaacgcaagagacaagtaccgtacgtctgaaggtttctagcaccgccgtacggacacaacacaccactactaggcccgtccctgacacctcccgactgcctggtgctaccccgggacttactacggttgaaatagtcactatgtcgcaccaggcactgggcgacgttgccggccggggtaatgaaaagaaaccgtcatccgtgagggcactgtcgattgtgctgcctatcgttctactggtgttcctgtgtttgggggtgttcctgctatggaaaaattggcgcctgaaaaacattaactccatcaacttcgataatcctgtatatcaaaagaccaccgaagacgaagtacacatatgtcacaatcaggatggttacagctacccaagtcggcagatggtgtcactcgaagatgacgtggcc

SEQ ID NO: 16114 - DNA, 2580 bp, Artificial Sequence
  Description of Artificial Sequence: Synthetic coding sequence
atgggaccttgggggtggaagctgcggtggaccgtggcgctgctccttgccgccgcggggactgccgtcggggatcgctgcgaacgcaatgaattccagtgccaagatggaaagtgtatctcctacaagtgggtgtgcgacgggtccgccgaatgtcaggatggttcagacgagtcacaggaaacctgcctgtccgtgacttgtaagtcaggagatttctcgtgcggaggaagggtgaatagatgtatcccgcagttctggaggtgcgatggacaagtggattgcgacaacggatcggatgagcagggatgcccgccgaagacctgcagccaggatgaattcagatgccacgatggtaaatgcatttccagacaatttgtgtgtgacagcgacagggactgcctggacggatcagatgaggctagctgcccggtattgacctgtggacccgccagcttccagtgcaacagctccacctgcatacctcagctgtgggcgtgcgataatgacccagattgtgaagatggatcagatgaatggccgcaaaggtgccggggcctgtacgtgttccagggtgactcctccccctgcagcgcgttcgagttccactgcctgtcgggagaatgtatccactcctcctggcggtgcgatggaggcccagactgcaaggacaagagcgacgaagagaactgcgcagtcgctacctgtcgcccggacgagtttcagtgctcagacggcaattgcattcatggatctcggcagtgcgacagagaatacgactgtaaagacatgtcggacgaggtggggtgcgtgaacgtgactctctgtgagggacccaataagtttaaatgtcattcgggagagtgtattacccttgacaaggtgtgcaacatggcccgcgactgtcgggattggtcagatgagccaatcaaagagtgcggtaccaatgagtgtctggacaacaacggaggttgcagccacgtgtgcaatgatttgaagattggttacgaatgcgactgcccggacggtttccaacttgtggcacaacggagatgcgaggatatcgacgaatgccaagatccggatacttgctcccaactctgtgtgaacctcgaaggagggtataaatgccagtgtgaagaaggattccagctcgacccgcacaccaaggcctgcaaggcagtgggatccatcgcctacctgtttttcaccaaccggcatgaagtcagaaagatgacgctcgaccgcagcgagtacactagcctcattccaaatctccgcaatgtggtggcactggatacggaagtggcctctaacagaatctactggtctgatttgagccaacgcatgatctgcagcacccaactggatcgggcccatggcgtgtcttcgtacgacaccgtgatctcacgggatatccaggccccggacgggttggcagtcgattggatccacagcaacatctattggactgactccgtcctcgggactgtctcagtcgctgacactaaaggagtgaagagaaaaaccctgttccgcgaaaacggctcaaaaccaagagcgatcgtggtggacccggtccacggattcatgtactggaccgactggggaaccccggcgaaaatcaaaaagggaggactcaacggggtcgacatctactccttggtgaccgaaaacatccagtggccaaacggaataaccttggatctgctttccggtagactgtactgggttgacagcaagctccatagcatcagctcgatcgatgtcaacggaggtaatcgaaaaacgattttggaagacgaaaagcgcctcgctcaccccttttcgctggcggtgttcgaagataaagtcttttggactgacatcatcaacgaggcgattttctccgccaaccggctgacgggatcggacgtgaatctcctggccgagaatttgctcagcccggaagatatggtgcttttccataaccttacccaaccgcggggcgtgaactggtgtgagcgcacgactctttccaacggcggatgccagtacctttgcttgccagcccctcaaatcaatccgcattctcctaagtttacctgcgcctgcccagatggaatgctccttgcgcgcgatatgcggtcctgcctgaccgaagccgaggctgcagtggcgacccaggagactagcactgtgcgcctgaaagtctccagcaccgccgtcaggacccagcatactaccactcgcccggttccggacacctcgcggctgcccggagctacccctggactgaccactgtcgagatcgtcacgatgtcacatcaggcgttgggtgacgtggccgggcgcggcaacgagaagaagcccagctcagtgcgcgctctctcaatcgtgctcccgatcgttctgctggtgttcctgtgccttggagtgttccttctttggaagaactggcggctcaagaatatcaactcaatcaacttcgacaacccggtgtaccagaaaactaccgaggatgaggtgcatatctgccacaatcaggacggatactcctacccttcacgtcagatggtcagcctggaggacgatgtggcc

SEQ ID NO: 16115 - DNA, 2580 bp, Artificial Sequence
  Description of Artificial Sequence: Synthetic coding sequence
atgggaccatggggctggaagttgagatggactgtggccctccttctcgcagcagcggggacggcagtcggcgataggtgcgagcgtaacgagttccaatgccaggacggcaagtgcatctcatacaagtgggtctgtgacggtagcgcagagtgtcaagacggatcagacgaatcacaggaaacctgcttgtcggtgacctgtaagtccggggatttcagctgtgggggtcgggttaatcgatgcattcctcagttttggagatgcgatggacaagtggattgcgataatggatccgacgaacaagggtgtcctcctaaaacctgttcccaagacgagttccgctgtcatgatggtaagtgcatatcacgccaatttgtgtgcgattccgatagagattgtctcgatggctcggatgaagcaagctgtccagtgctcacctgcggacccgcatcgtttcagtgtaatagctcaacgtgcatcccgcagctctgggcctgtgataacgatcccgattgtgaagatggatcggacgaatggcctcagcgatgtcggggtctttacgtgtttcaaggagattcctcaccctgcagcgcttttgaattccactgcctctcgggggagtgcatccattcatcgtggagatgtgatggaggacctgattgtaaagacaagtcggatgaagaaaactgtgcggttgcaacctgcagacctgatgagtttcaatgctcggatgggaactgcatccatgggtcccgacaatgcgaccgggaatacgattgtaaagatatgtcggatgaggtgggttgtgtcaacgtgactctctgtgaaggccctaacaaattcaagtgtcatagcggcgaatgtatcaccctggataaggtctgtaatatggccagggattgtagggattggtccgatgaaccgattaaagaatgtggtaccaacgaatgccttgataacaatgggggctgtagccatgtgtgcaatgacctcaaaatcggatacgaatgtgattgccctgatggttttcaactggtggcacagcgtagatgtgaggacattgatgaatgtcaagatccagacacctgttcacaactgtgcgtgaatctggaaggggggtacaaatgtcaatgcgaggaaggattccaacttgatccgcatactaaggcctgcaaggcagtgggaagcattgcataccttttctttaccaatcgccacgaagtgcgaaaaatgaccctggatcggtcggaatacaccagcctcattcccaatctccggaatgttgtggccctggacactgaagtggcatccaatagaatatactggagcgatctttcacagcgcatgatttgttcaacccagttggaccgcgcacacggtgtgtccagctacgacacggtgatctcaagagatattcaagcgccagacggccttgccgttgactggattcacagcaacatttactggactgattccgtgcttgggactgtgagcgtggcagatactaagggggtcaagcggaaaactctgtttagagaaaacggctcaaagcctcgcgctatcgtggtggaccctgtccacggtttcatgtactggactgactggggtactccagcaaagataaagaaaggaggtcttaacggggtggacatttactccctcgtgacggaaaacattcagtggcctaacgggattaccctggatcttcttagcggacggctgtactgggtcgattctaaacttcactccatctcctcgattgatgtcaacggaggcaacaggaaaactattctcgaagatgaaaagaggcttgctcatccctttagcctggccgtttttgaagataaagtgttctggaccgacatcattaacgaggcaatcttcagcgcaaacagattgactggttcagatgtcaatcttctggcagaaaacctgctgtcccccgaagatatggtgctctttcataatcttactcagccccggggcgttaattggtgtgagcggaccaccctctccaatggtggatgtcagtacctttgtctcccagcaccacagattaatccgcactcgccaaagttcacctgtgcctgccccgatggcatgctcctggcacgcgacatgcgttcgtgtcttacggaagcggaagcggcagtggcgacccaggaaacttcgacggtccggctcaaggtgtctagcaccgcggtccgcacccaacataccactaccagacccgtgcctgacacttcacgacttcctggagcaactcctgggctcacgaccgtcgaaattgtgaccatgtcccatcaggccctcggtgacgtggctggaaggggcaatgaaaagaaaccttcgtcagtgcgagcactttcgattgtcctgcctatcgtgctgctggtgtttctttgtcttggtgtgttcctgctctggaaaaactggcggctcaagaacatcaactccattaacttcgataaccctgtctaccaaaagactacggaagatgaggtccatatatgtcataatcaggatgggtacagctatccctcacgacagatggtgagcctggaagatgacgttgcg

SEQ ID NO: 16116 - DNA, 2580 bp, Artificial Sequence
  Description of Artificial Sequence: Synthetic coding sequence
atgggcccttggggatggaaactgcgctggacagtggcactgctgttggccgcagccggaaccgccgtcggagaccggtgtgaaaggaacgaatttcagtgccaggatggcaagtgtatttcatataaatgggtctgcgatggttccgctgaatgccaggacggcagtgatgaaagtcaggagacttgtctgtccgtgacctgcaagagcggcgattttagttgcgggggccgtgttaatcgttgcattcctcagttttggagatgcgacggtcaggtagactgcgataacggttccgatgagcagggatgcccaccaaagacatgttcccaggatgaattccggtgtcatgacgggaaatgcatctctcgccagttcgtgtgtgattccgaccgcgactgccttgacgggtctgacgaagcctcttgccccgtacttacatgtggtcctgcctctttccagtgcaactcgtctacatgcattccccagctgtgggcatgtgacaatgacccagattgcgaagatggcagtgatgagtggccccagcgatgcaggggactgtacgtgtttcagggtgacagcagtccctgttccgcttttgaattccattgtcttagtggcgagtgcattcactcttcatggagatgcgacggcggtccagactgcaaggataagtctgatgaggagaactgtgccgtcgccacctgtcggcccgacgagttccagtgttcagacgggaactgcatccacggaagccgtcagtgtgatcgcgagtacgattgtaaggacatgtctgacgaagtcggttgcgtgaatgtcaccctctgcgagggacctaacaagtttaaatgtcactctggggagtgcatcaccctcgataaagtctgtaacatggcccgggattgtcgggattggtcagatgaaccaataaaggaatgcggaaccaatgaatgcttagataataacgggggctgcagtcacgtttgtaatgatttgaagattggttatgaatgtgactgccccgacggcttccagttggtggcccagcggcggtgtgaggacattgacgagtgccaagaccctgatacatgtagccagttatgcgtcaatctggagggtggctataagtgtcagtgcgaagagggctttcaactggacccgcatacaaaggcctgcaaggccgtgggcagtatcgcctatctattttttaccaatcgccacgaagtgaggaaaatgacacttgatcgctctgagtacacatctctcatccctaatctccgcaatgttgttgcgctggatactgaggtcgcctcaaatcggatttattggtctgatcttagccagaggatgatctgttctactcagctcgaccgagcccatggagtctcttcatacgatactgtcatatctagggatatccaggccccagatggtttggctgtagattggatccattccaacatctattggaccgacagcgtgttggggactgttagcgtggcagacacaaaaggcgtcaagcgaaagaccctcttcagagagaacggatctaaacctcgagccattgtcgtggaccccgtgcatggcttcatgtactggactgattgggggactcccgctaagatcaagaagggaggcttgaacggggtcgacatatatagcctcgtgactgagaatattcagtggcctaacggcatcaccctcgacctgctgtctgggcggctctattgggtggatagcaagttacattcaatctcaagcatcgatgtaaacggtggcaacaggaaaaccatcctggaagatgaaaagcggctggcacatcctttcagcctggccgtgtttgaggataaggttttctggactgacatcatcaacgaagccatcttttccgccaataggcttacaggatcggacgtcaacttgctggcagagaacttgctctcacctgaagatatggtgctgttccataacctaactcagcctcggggagtcaattggtgtgaaaggactactctgtctaatggaggatgccagtacctttgtttacctgcaccgcaaatcaatccccactcaccaaagttcacttgcgcctgtcctgatgggatgttgttggcccgagatatgagatcctgccttaccgaagctgaagctgctgtggccacacaagagaccagtactgttagactgaaggtgagttcaactgccgtacggacacagcacaccaccacccgacctgttcccgataccagtaggttgcctggcgctacacctggtctgacaacggtggagattgtgactatgtctcaccaggctttgggggatgtggctggacgtggtaatgaaaaaaaaccttcttccgttcgagccctgtccatcgttctgcctattgtgttactcgtgttcctgtgtcttggagtatttctgctgtggaagaattggcgcctcaagaatatcaattcaattaacttcgataacccagtgtaccagaaaacaaccgaggatgaggtgcacatctgccataaccaagatgggtattcatatcccagccgtcaaatggtaagcttagaggatgatgtggct

SEQ ID NO: 16117 - DNA, 2580 bp, Artificial Sequence
  Description of Artificial Sequence: Synthetic coding sequence
atggggccttggggctggaaactaagatggaccgtcgccctgctcctggctgctgcggggacagcagtgggagataggtgcgaacgaaacgagtttcagtgccaggacggtaagtgcatttcctataaatgggtttgtgatggatctgcagagtgccaggatggcagcgatgagagtcaagagacatgtctttccgtgacatgcaagagtggggacttctcctgcggagggagggttaatcggtgcattccccagttttggcgctgtgatggccaggtggactgtgacaatggatcggacgaacaagggtgcccacccaagacatgctcccaggacgaatttcggtgccacgatgggaaatgcattagtcgacagtttgtttgtgacagtgatcgtgattgcctggacgggtccgacgaagcctcttgccccgtattgacttgcgggccagcctctttccaatgcaacagctccacctgcatcccccagctttgggcttgtgataacgaccccgactgtgaagacggttcggatgaatggcctcaacgatgtcgagggctgtacgtcttccaaggggattcgtccccctgtagcgccttcgaattccattgtctctctggagaatgcattcatagttcctggaggtgcgatggggggcctgattgtaaggataaatcagacgaggagaactgtgccgtcgctacctgcaggccagacgaattccagtgttccgatggcaactgtatccacggaagtaggcaatgtgacagagagtatgattgcaaggatatgagcgacgaagtcgggtgtgtgaatgtgacactgtgtgaaggcccgaataagttcaaatgtcactccggcgagtgtattaccttggacaaggtctgtaacatggccagggactgtcgcgattggagtgacgagcccatcaaagagtgcggcacaaacgaatgcttagacaataatggcggctgctcccatgtctgtaatgacctgaaaatcggctatgagtgcgactgtccggatgggttccagctggtcgcacagcggagatgtgaggacatcgacgagtgccaggacccggacacatgttcccaattgtgcgtgaacctcgagggggggtacaagtgccagtgcgaagaaggttttcaattggacccacacactaaagcctgcaaagcggtggggagcattgcttacctcttttttaccaacaggcatgaagtgagaaaaatgaccctcgacagatcagaatacacctcactgatccccaacctcaggaacgtcgtggcactagacaccgaggtcgcctcaaatagaatttattggagtgacctgtcccagcgcatgatctgctcaacacagctcgaccgagcgcatggcgtcagctcttacgatactgtcatttcccgtgatatccaggcacccgacgggctcgccgtggattggattcactctaatatttactggacagactcagttctggggaccgtaagcgtggccgataccaaaggggtcaagaggaagaccttattccgagaaaacgggtccaagccccgcgctattgtggtagaccctgtgcatggttttatgtattggaccgattgggggacccctgccaagatcaagaaggggggcctgaatggggtggatatttacagtctggtgaccgagaacattcaatggccaaatggtataaccctagatctgttgtccggccgtttatattgggtggactctaaactgcattccatcagcagcattgacgtaaacggagggaaccgcaagacaatattggaggacgagaagaggttggcgcaccccttctcgctggccgtattcgaggataaggtcttctggacagacattataaacgaagctattttctccgccaatcggctgacgggctccgacgtgaatctactcgcagaaaaccttttaagtcctgaagacatggtgctatttcacaaccttacacaacccaggggggtcaattggtgtgagagaaccactttatccaacgggggctgtcagtatctgtgtctgcctgccccccaaattaacccccacagccctaagttcacctgtgcttgccccgacggtatgcttctggcaagggatatgcgatcctgcctgaccgaagccgaggccgccgtcgcaactcaagaaacttctactgtccggttaaaagtttcatctacagcggtcagaacacagcatacaactacccgccctgtccccgacaccagcaggctgcccggcgccaccccaggattgacaacagtggagattgttacgatgagtcaccaagccttgggggacgttgccggaagggggaatgaaaaaaaaccctcatccgttagagcgctgtcaattgtactccctatcgtattgttagtgttcctctgcctcggcgtctttttactttggaagaattggagactgaaaaatatcaactccatcaactttgataacccagtatatcagaaaaccacagaggacgaggtccatatttgtcataatcaagatgggtactcttacccgtccagacaaatggtctccctagaagacgatgttgca

SEQ ID NO: 16118 - DNA, 2580 bp, Artificial Sequence
  Description of Artificial Sequence: Synthetic coding sequence
atgggaccgtggggctggaagttgcggtggaccgtggcactcctgctggctgcggccgggaccgcggtgggcgatagatgcgaacgtaatgagttccaatgccaagacggtaagtgtatttcgtacaaatgggtctgtgatggatcagccgagtgtcaagacggctccgatgagtcgcaagaaacgtgcctttcagtcacttgcaaatcgggagatttctcatgcggaggacgcgtcaaccggtgcatcccgcagttctggcggtgtgatggacaagtggattgcgataatggaagcgatgagcaagggtgtcccccgaaaacttgctcccaggacgaatttaggtgccacgatgggaagtgcatctcgaggcaatttgtgtgcgactccgatagagattgcctggacggttcggacgaggcgagctgtccagtgttgacctgcggaccagcctcttttcaatgcaactccagcacctgcattcctcagctgtgggcgtgtgacaatgatccggactgtgaggacgggtcggatgagtggccacagcggtgtcggggtctttacgtgttccagggagactcttccccgtgctcggcgtttgaatttcactgcctgtccggagagtgtatccattcgagctggcggtgcgacggaggaccggactgtaaggacaagtcagacgaggagaactgtgccgtcgccacttgccggccagacgaattccagtgctcagatggaaactgtatccacggcagccggcagtgcgaccgggagtacgattgcaaggacatgtccgatgaagtgggatgtgtcaatgtgactctgtgcgaaggcccaaacaagtttaagtgccactccggagaatgcattactctggataaagtgtgcaacatggcccgcgattgccgcgactggtccgacgaaccgatcaaagaatgcggcaccaacgagtgtttggacaataacggaggctgtagccatgtctgcaatgacctgaagatcggatacgaatgtgactgcccagacggatttcaactcgtcgcgcaacgccgctgcgaggatatcgatgaatgccaggatcctgacacttgttcacaattgtgtgtcaacctcgagggcggatacaagtgccagtgtgaggaagggttccagctggacccgcatactaaggcatgtaaggccgtgggatcgatcgcgtacctgttcttcacgaatcggcacgaagtgcggaagatgactctggacagatcggaatataccagcctgattccgaacctgcggaacgtggtcgcactggacaccgaagtggcgtccaatagaatatactggtcggacctctcccagcggatgatctgctcaacccaacttgaccgcgcgcatggcgtctcctcatacgacaccgtgatctcacgcgatattcaggccccggacgggctggcagttgattggattcattcgaacatctactggacggacagcgtgctgggtacggtgtcagtggccgatactaagggggtcaagcgcaagaccctgttccgcgaaaatgggtcgaagcccagagccatcgtggtcgacccagtgcacggattcatgtactggaccgactggggcactccagccaagatcaagaaagggggattgaatggagtggacatttacagcctggtgaccgagaatatccaatggccgaacggaatcaccctggatctgctgtcggggcgcctttactgggtcgattcaaagctccattccatcagctcaatcgatgtgaatggggggaaccgcaaaaccattctcgaagatgaaaagcgcctggctcacccgttcagtctggcggtgttcgaagataaagtgttctggaccgacattatcaacgaagccatcttctccgccaaccggctgactggctccgacgtgaacctgctcgccgagaacctcttgtcgccggaagatatggtgctctttcataacttgacccagccacggggcgtgaactggtgtgagcgcaccactctctcaaatggaggatgtcaatacttgtgtctgccagccccccagatcaacccgcactcgccaaagttcacttgcgcatgtcccgacgggatgctgctcgctcgcgacatgcggtcctgcctcaccgaggcagaagctgcagtcgcgacgcaggaaacctcaaccgtgagactcaaggtgtcgtcgaccgccgtacggactcagcacactaccacccggccagtgccggatactagccggctgcctggagcaaccccgggactgaccacggtcgaaatcgtcactatgtcccaccaagccttgggagacgtcgccggccgcggtaatgagaagaagccctcgtccgtccgggccctcagcatcgtgctgccaatagtgctcctggtgttcctgtgcctgggagtgtttctgctgtggaagaactggcgtctcaagaatatcaattcaattaacttcgacaacccggtgtaccaaaaaactaccgaggacgaggtgcatatctgccataaccaggacggttacagctacccgtctcgccaaatggtgagcctggaggacgacgtggct

SEQ ID NO: 16119 - DNA, 2580 bp, Artificial Sequence
  Description of Artificial Sequence: Synthetic coding sequence
atgggaccttgggggtggaagctgagatggactgtggcccttcttctggccgcagccggaactgcagtcggtgacaggtgtgagcgcaacgagtttcaatgtcaagacggaaaatgtatatcatacaagtgggtgtgcgacgggtccgcagaatgccaggatggatcagatgagtcacaagaaacttgcctctcggtgacctgtaagagcggagatttttcgtgcggaggacgcgtcaacagatgtattcctcagttttggaggtgtgatggacaagtcgattgtgacaacgggtcggacgagcaaggttgtccacccaagacctgcagccaagatgaattcagatgtcacgacggcaagtgtataagtaggcagttcgtatgcgattcagatagagactgcctggacggaagcgatgaggcttcgtgtccagtgctgacctgtggcccagcctcgtttcagtgcaactcaagcacctgtatccctcagctttgggcatgtgataacgatcctgattgcgaggacggttcagacgaatggccacaaagatgccgaggactgtacgtctttcagggtgatagctcaccttgttccgcattcgagtttcactgcctgtcaggggagtgcatacactcttcgtggaggtgcgatggtggccccgactgcaaggataagtccgacgaggaaaactgcgcagtggcgacctgtaggccggatgagtttcaatgctccgatggtaactgcatccacggtagcagacaatgcgatagggagtacgactgtaaggatatgtcggatgaggtggggtgtgtgaacgtgactctctgtgaaggacctaacaagttcaagtgccattccggtgagtgtattactcttgataaggtgtgtaatatggccagggactgtcgggactggtccgatgaacccattaaggagtgcggcactaacgaatgccttgacaacaacggcggatgttcacacgtctgcaacgatctgaagattggatatgaatgcgattgtcctgacggtttccaacttgtggcccaaagaagatgtgaagatatagatgaatgtcaagaccctgacacttgcagccagctgtgcgtcaacctcgaaggtgggtacaaatgtcagtgtgaagaaggttttcagctggacccgcacaccaaagcatgtaaggctgtggggtcgatagcatacttgtttttcaccaaccgccatgaggtgcgtaagatgaccctcgaccgatcggaatacacctcactgattcccaatcttcgcaacgtggtcgcactggataccgaggtggcttccaatcgcatatactggtcagacctgagccagagaatgatctgcagcacccaactggacagggcacatggggtgtccagctacgacactgtcatttccagggacatacaggcacccgatggcctcgcagttgattggattcattcaaacatttactggaccgattccgtgctgggcacggtttctgtcgcagataccaagggtgtgaagagaaagaccctgtttcgagagaatggatcgaagcctcgcgcaatagtggtagatccagtgcacggattcatgtactggactgattgggggaccccggcaaagatcaagaagggagggcttaatggtgtcgacatttactccctcgtgactgagaacattcaatggcctaatggaattaccctggacctgctctcgggccgcctttactgggttgactcaaaacttcattcgatctcctcgatcgacgtcaatggagggaacaggaaaactattttggaagatgagaagcgacttgcacatccattctcactggcagttttcgaagataaagtgttttggactgacatcataaacgaggctattttctcagcaaacagacttacgggatcggacgtgaatttgctcgcagaaaatctgctgtcccccgaagatatggtgctctttcataaccttacccagccacgcggcgtgaactggtgcgaacgcaccactctttcgaatggagggtgccagtatctttgcctgcctgcgccacagattaacccacactccccaaagttcacttgtgcatgcccggatgggatgctcctcgccagagatatgcgatcctgcttgacggaggcagaagcagctgtcgcgacgcaggaaacttccaccgtgcggcttaaggtgtcaagcactgccgtgagaacccagcatacgactacccggccagtccctgatactagccgacttcctggtgccactcccggacttaccaccgtggaaatcgtgaccatgtcacatcaagcattgggcgatgttgcaggcagaggaaacgagaaaaagccttcgtcggtccgggcactctccatcgtgctgccaattgtgcttctcgtgttcctgtgtcttggagtgtttcttctctggaagaactggcgcctcaaaaacattaactcgatcaactttgataatcctgtttaccagaaaactactgaagatgaagtgcacatttgccacaatcaggatggatactcgtaccctagtagacagatggtgtcgctggaagatgatgtggca

SEQ ID NO: 16120 - DNA, 2580 bp, Artificial Sequence
  Description of Artificial Sequence: Synthetic coding sequence
atgggcccttggggttggaaactgcgatggaccgttgcactgttgctcgccgccgctgggactgcagtgggcgaccgttgcgagcggaatgaatttcagtgtcaggacgggaagtgcatatcatacaaatgggtgtgtgacgggtcagccgagtgccaagatgggtctgatgagagccaggagacctgcctcagtgtaacctgcaagtctggagatttttcatgcggtggcagggtgaatagatgtattccacaattttggcgatgtgacggccaggtcgattgcgacaatggatctgacgagcagggctgccctcctaaaacgtgttcacaggatgaattccggtgccatgatggtaaatgtatctctcgccagttcgtctgcgacagcgatagagactgtctggatggttcagatgaagcctcctgtccagtgctaacctgtggtcccgcctcttttcagtgcaactcctctacttgcattccacaactgtgggcatgtgataatgatcccgattgtgaagacggatctgacgagtggcctcagagatgcagggggctgtatgtgtttcagggggatagtagcccctgtagcgcttttgagtttcactgtctctccggcgagtgcattcacagtagctggagatgcgatggaggcccagattgtaaagataaatcggacgaggaaaattgcgccgtcgcaacttgcagacccgacgagtttcagtgctctgatgggaattgtatccacggatcaaggcagtgcgaccgggaatatgattgcaaggacatgagtgacgaggtcgggtgtgtgaacgttactttgtgcgaagggcccaacaaatttaagtgccactccggagaatgcataaccctagacaaagtgtgtaatatggcccgggattgtagagactggagtgacgaacccattaaagagtgtggcaccaacgaatgtttagataataatgggggatgttcacatgtgtgtaacgacctgaagatcggctatgaatgcgattgccctgacggtttccaactggtcgctcagcgcagatgcgaggatatcgacgagtgccaggacccagatacatgtagtcaactgtgcgtaaatctggaaggaggatataagtgccagtgcgaggaaggcttccagttggacccccatactaaggcctgcaaggccgttggatcgatcgcctatctattctttacgaatcggcatgaggtgaggaagatgaccttggacagatcggaatacacctcactcatccccaacctcaggaacgtggtggccttggataccgaggtggccagcaaccgcatctactggagcgacctttctcagcggatgatttgttcaacacagctggatcgggctcacggagtgagctcgtatgatactgtgataagtcgagacatccaggctcccgatggcttggcagtggattggattcatagtaacatatattggaccgattccgtgctgggaaccgtcagcgtggccgataccaagggtgtgaaacgcaagactctttttcgcgagaacgggtcgaagccaagagcgattgtagttgacccagtccatggctttatgtattggactgattgggggaccccagccaagattaagaagggcggacttaatggagtggacatctattcactggtgacagagaatatccagtggcctaatggtattactttggatctgctgtccggccgactatactgggttgattcgaaactacactcaataagtagtatcgacgtcaatgggggtaatcgaaaaacaattctggaggacgaaaaaaggctcgcccatccctttagcttagccgtattcgaagataaggtattctggacagacattatcaatgaggccattttctctgctaatcgtctgaccggcagcgatgtgaatctgctagctgaaaatctcctgtcccccgaagacatggtcctgttccacaacttgacgcagcctcgaggcgtaaactggtgtgaacgtacaaccctgtcaaatggcggctgtcagtacctttgtctgccagctccacagatcaatccccactcccccaagttcacctgcgcctgccctgatggaatgctactcgccagagatatgcggagctgcctcacggaggctgaagcagccgtggcaacacaggaaacttccactgtccggttgaaggtttccagcaccgctgtccggactcaacataccacaacccgtcccgtgcctgacacgtctagacttcctggagccacacctgggttgaccacagtggagattgtcactatgagccaccaagctctgggggacgttgccggtaggggaaacgagaaaaagcccagtagtgtgcgggccttgagtattgtactgcccatagtgttgctggtgttcttgtgcctcggcgtgttccttctctggaaaaactggaggttgaaaaacataaacagcatcaacttcgataatcccgtataccagaagacaactgaggacgaggttcacatttgtcacaaccaagatggctactcttatccatctaggcagatggtgagcctcgaggacgacgtggca

SEQ ID NO: 16121 - DNA, 2580 bp, Artificial Sequence
  Description of Artificial Sequence: Synthetic coding sequence
atgggcccatggggctggaagttgaggtggacggttgcgctgctccttgcggctgccggcaccgccgtgggagatcgctgcgagcggaacgaatttcaatgccaggacggcaaatgcataagttataagtgggtgtgcgacgggagtgccgagtgtcaagacggctctgacgagtcccaggaaacttgcttgagcgttacctgcaagtccggagatttcagttgcggaggccgcgtaaataggtgcataccccagttttggaggtgtgatgggcaagtggattgcgacaacggctctgatgagcagggctgtccccctaaaacctgctcacaggatgaattcaggtgccatgatggtaaatgtatcagcaggcagtttgtttgtgattccgatagggactgcctggacggatctgacgaagccagttgcccggtcctgacttgtggtccagcgtccttccaatgcaactcctccacgtgtatcccccagttgtgggcgtgtgataacgaccctgactgcgaagacgggagtgacgagtggccccagagatgtaggggactgtacgtgtttcaaggggactcaagcccatgttccgcctttgagttccactgcctctccggcgagtgtattcactcaagctggagatgtgatgggggcccagattgtaaagacaaaagcgacgaggagaattgtgccgtggctacctgtcgccccgatgagttccagtgttccgacggtaactgtatacacggatcacgccaatgcgaccgagaatatgactgcaaggacatgagcgatgaggtgggatgcgtgaatgtcacgctgtgcgaggggcctaacaagttcaaatgccactccggtgagtgtattactcttgataaggtttgcaatatggctcgagattgcagagattggtccgatgagcccataaaagagtgtggcaccaatgaatgtttggataacaacggcgggtgctctcacgtgtgcaacgatctcaagattggctacgagtgtgattgtccagatgggttccaactcgtggcgcagcgccgctgcgaagacattgatgaatgtcaggatcctgatacgtgctctcagctttgcgtgaaccttgaagggggttataaatgtcaatgtgaggagggttttcagctggatcctcacacaaaagcatgcaaggctgtcggttcaatcgcatatctttttttcacgaatcgacatgaagttcgcaagatgaccttggaccgaagtgagtacacctccctgatcccaaacttgaggaacgtggttgctttggacactgaggtggcctccaataggatttattggtctgatctgagccagcgcatgatctgtagtactcagctcgaccgggctcacggcgtgtctagttatgatacagtcatctcccgggacatccaggctcctgacggccttgcggtagactggatccattctaacatctactggacagactccgttctcggtacggtctccgttgccgataccaaaggtgtgaagagaaaaaccctgtttcgcgaaaatggatccaaacctcgcgcgattgttgttgatccagtgcatggcttcatgtactggaccgactggggcactcccgccaagattaaaaaggggggtctcaatggcgtggacatttacagcctggttaccgagaatattcagtggcccaacggaatcaccctggacctgctgtctggcaggctgtactgggtggactccaaactgcattccatcagttcaattgatgtgaacggtgggaaccgaaaaaccatcctcgaggatgagaagcgcctggcacatccgttcagccttgccgtgttcgaagacaaggttttctggactgacattattaacgaagccattttcagcgctaaccgactcacggggagcgacgtgaatctgctggccgaaaatctgctctcaccagaagacatggtcctgttccataacctgacgcagccccggggagtaaattggtgtgagaggactaccctgtcaaatggggggtgtcagtacctgtgtctgccggcgccccaaatcaatccccacagccccaaatttacctgtgcctgccctgacggaatgctgctggccagagatatgagatcctgtctgacagaagcagaggctgccgtggccactcaggaaacttccacagtgaggcttaaggtgagtagtaccgccgtgcgcacgcagcacaccacaaccaggcctgttccggatacgagtagactgcctggcgccacaccggggctcactacagttgagattgtcacaatgtcacaccaggcgctgggagatgtcgctggtcggggtaatgagaagaagccatcatccgttagagcactgagcattgtgttgccaattgtgctgctggtgtttctctgtcttggtgtgtttcttctgtggaagaattggcgcctcaagaacatcaacagcattaacttcgacaatccagtttaccagaaaacaacagaagacgaagtacacatttgtcataaccaggatggctacagctatccctcacgccagatggtttctcttgaggacgatgtggct

SEQ ID NO: 16122 - DNA, 2580 bp, Artificial Sequence
  Description of Artificial Sequence: Synthetic coding sequence
atgggcccctggggttggaagttaagatggacagtagcactccttttggctgctgcaggaacagctgtgggggaccggtgcgagagaaacgagttccagtgtcaagatggtaagtgcatttcgtacaagtgggtttgcgatggtagcgccgaatgccaagatggttccgatgaaagtcaggagacttgcttgtcagtcacctgtaaatctggggatttctcgtgtggaggtcgtgttaacagatgcataccacagttctggcgttgtgacggtcaggttgattgtgacaatggtagcgacgagcagggctgtcccccaaagacttgctcccaagacgaatttcgatgccatgatggaaagtgcatctcaaggcagttcgtttgcgatagcgaccgtgattgtctcgacggttcagacgaggctagctgtcccgttctaacttgcggaccggctagctttcagtgcaactcctcaacttgcattccacaattatgggcctgcgacaacgatcccgattgcgaggatggtagtgacgagtggccgcaacggtgcaggggtctgtacgtatttcagggtgattcctccccatgctcagccttcgaattccattgtttgtcgggggagtgtattcactcatcatggcgatgtgacggaggacccgattgtaaagataaaagcgatgaggagaactgcgcagttgcaacctgtcgtcccgacgagttccaatgttcagacgggaactgtatccatgggtcccgtcagtgtgatagagaatacgactgcaaagatatgagtgatgaggttggttgcgtcaatgtaaccctttgtgagggaccgaacaaatttaagtgccacagcggggaatgcataactttggacaaggtttgtaatatggctagggattgcagggattggtcagatgaaccaatcaaggaatgtggtacaaatgagtgcctcgataataacggaggatgcagccatgtttgtaatgacctcaagatagggtatgagtgtgactgtcctgatgggttccaacttgttgcccaaaggagatgtgaggacatcgatgagtgccaggatcccgacacctgttcacagttgtgcgtgaatcttgaaggaggttataagtgtcagtgcgaagaaggtttccaattagatccacacaccaaggcttgcaaagccgttggttctattgcttacctttttttcactaaccgtcatgaagtcagaaaaatgactttggatagaagcgagtacacttcgctgatacctaatttgcggaatgttgtcgcacttgatacggaagttgcttcaaatagaatttattggtcggacctttcacaacggatgatttgctcgacccaattggacagggctcatggcgtatctagttacgatactgtcatctctagagatattcaagcaccagacggcttggctgttgactggatccattcaaacatctactggacagattcggtccttggtaccgttagcgttgccgacacaaagggggtcaaacggaagacgttgttccgggaaaacggttctaagccccgagccatcgtggtcgacccagtccatggcttcatgtattggactgattggggtactcctgctaagataaaaaagggtggtcttaacggagttgatatttattcccttgtgacagaaaatattcagtggcccaatggtatcacgctggatttgctctcgggtcgtctatactgggttgattctaaactccactcaatttcaagcattgatgtgaatggcggtaataggaaaacaatccttgaggatgagaaaaggttggcacacccattctctcttgctgtgtttgaagataaggtattttggactgatattatcaacgaagctattttctccgctaataggcttactggctccgacgttaatttgttggcagaaaatctactttcccctgaggatatggtccttttccataatttgacgcagccaagaggtgttaattggtgtgaaaggactacgctttcgaatggaggatgtcagtatctgtgtttacctgccccacaaattaatccacactcaccaaagttcacgtgcgcatgtccagatgggatgttgcttgcaagagatatgagatcctgcttgactgaagctgaagctgcagtcgctacacaagagacttccaccgttagacttaaagttagtagtactgccgtgcgtactcagcatactacaaccagacctgtgccagatacctcaaggcttccaggggctactcctggactaaccaccgttgaaatcgttactatgtcgcaccaggcgttgggagatgttgccggaaggggtaatgagaagaaaccttcttcagttagggcattgtcaattgtgctccctattgtcttgcttgtgtttttgtgtcttggcgtctttctcctatggaagaactggcgacttaagaacataaactcgatcaactttgacaatcctgtttatcaaaaaactaccgaagatgaagtgcatatctgccataatcaggacggttacagctatccgtctcgtcaaatggtttctctagaagatgatgttgcg

SEQ ID NO: 16123 - DNA, 2580 bp, Artificial Sequence
  Description of Artificial Sequence: Synthetic coding sequence
atgggaccttggggctggaagctgcgctggactgtcgcccttctgctcgccgccgctggcacagccgttggtgaccgctgcgagaggaatgagtttcaatgtcaggatggaaaatgtattagttacaagtgggtgtgtgatggtagcgccgagtgccaggatggttcagatgagtctcaagaaacttgcttgtcagtcacgtgcaaaagtggcgacttttcttgtggaggcagggttaaccgctgtattccccaattctggaggtgcgacggccaggtcgattgcgataacggttctgacgagcaaggttgtcctcccaaaacgtgctctcaggatgaattcaggtgccacgacggtaagtgcatatcaaggcagtttgtgtgtgatagcgaccgcgattgcctggatggatccgatgaagcaagctgccctgtccttacctgcggtcccgcgtccttccagtgtaactcctccacctgcatcccacagctgtgggcttgcgataacgatcccgactgcgaagatggttcagatgaatggccccagagatgccgcggtctctacgtcttccagggcgactccagcccatgtagcgctttcgaattccattgcttgtccggtgagtgtatccattcaagttggaggtgtgacggaggtcccgactgtaaggacaagtcagacgaagaaaactgcgcggtggccacttgccgccctgacgaattccagtgcagtgatggaaactgtatccatggcagcaggcagtgtgatagggaatacgattgtaaagacatgagtgatgaggtgggatgcgtaaacgtgaccttgtgcgagggtcctaacaagtttaaatgtcactccggagagtgtatcacgctcgacaaggtgtgtaatatggccagggactgtcgcgattggagcgacgagcccatcaaagagtgtggcacgaacgagtgccttgacaacaacggcggctgctcacacgtctgcaatgatctcaagattggttacgaatgcgactgcccagacggatttcagctggttgcccagaggcgctgcgaggatatcgatgagtgccaggacccggacacctgctcccaactgtgcgtgaacctggagggaggctataagtgccagtgtgaagagggcttccagttggatccgcataccaaagcatgcaaggctgttggttctatcgcatacttgttttttaccaacagacatgaggtccgcaaaatgactctggacaggagcgagtacaccagcctgatccccaacctccgcaacgtggtggctttggacaccgaagtagcctctaaccgcatatattggtccgacttgagccagaggatgatctgctcaacacagctggacagggcacacggcgtgtctagttacgatacagtgatttctagggatatacaggcgcccgatggtcttgcggtcgactggatccacagtaatatttactggacagactctgtcttgggcactgtcagtgtggccgacacaaaaggagtcaaaaggaagacgttgtttagggagaacggatccaagcctagagccatagttgtggatcctgtgcacggcttcatgtactggaccgactggggcacccctgctaagattaaaaaaggtggacttaacggtgttgatatctattccctggtgactgaaaatatccagtggcccaatggtattaccctcgacttgctctcaggtcgcctctactgggtggattctaagctgcattccatttcaagcatcgatgtgaacggcggaaacagaaagaccatcctcgaggatgagaagcgcctggctcacccttttagcctggcagtcttcgaggacaaggtcttctggactgacattatcaatgaggctatcttctcagcaaacaggttgacaggttctgacgtgaacctgctcgcggaaaatttgctgagcccagaggacatggttcttttccacaacctgacgcagcctcgcggcgtaaattggtgtgagaggacaacactgtctaacggaggttgccaatacctgtgcttgccggcacctcagattaatccccattcacccaaatttacgtgcgcctgcccggacggtatgttgctcgctagagacatgcgctcctgcctcactgaggcagaggccgcagtagcaactcaagagacctctactgtgagactcaaggtatcctctaccgctgtcagaacgcagcacactacaactagaccagtgccggacacctcaaggctgcccggcgcaactccaggcttgacaacggtcgagattgttacaatgtcccaccaggccctgggagatgtggcgggaaggggcaatgaaaagaagccttctagtgtccgcgcgctcagcatcgtgctgccaatagtactgttggtgttcctgtgtctgggtgtgtttttgctgtggaagaactggcgcctcaaaaacattaattcaatcaattttgataatccagtgtatcaaaaaactactgaagacgaggtgcatatatgtcataatcaggacggatatagttacccctcccgccagatggtgagcctcgaagatgatgtcgcc

SEQ ID NO: 16124 - DNA, 2580 bp, Artificial Sequence
  Description of Artificial Sequence: Synthetic coding sequence
atgggaccttgggggtggaaactgagatggactgtggccttgctgctggcagcggcgggcactgctgtgggagacagatgcgagagaaacgagttccagtgccaggatggaaagtgcatctcatacaagtgggtctgcgacggctcagcagaatgtcaggacgggagcgacgaatcacaggagacttgtctgtctgtcacctgcaagtcaggcgatttctcatgcggcggacgagtcaacaggtgcatcccgcagttttggcgctgtgacgggcaggtggattgcgacaacggatcagatgaacaggggtgccccccaaagacgtgctcgcaagacgagttccggtgtcatgacggtaaatgtatttcccgtcagttcgtgtgcgactcggaccgcgactgcctggacggatctgacgaagcgtcgtgtccggtgctcacttgtggaccggcctcattccagtgcaatagctccacgtgcattccccagctgtgggcctgcgataacgacccggactgcgaggacgggtcagacgaatggccacagagatgtagaggactgtacgtctttcaaggcgattcgagcccgtgcagcgcctttgagttccactgcctgtccggagagtgcatccactcatcgtggaggtgtgacggtggacctgattgcaaggataaatcagacgaagaaaattgcgcggtggcaacgtgccgaccggatgagtttcaatgcagtgacggaaactgcattcacggctctcgtcaatgcgatcgggagtatgactgcaaagacatgtccgatgaagtcggctgcgtcaacgtgaccctgtgcgagggtcctaacaaattcaagtgccattcaggagaatgtatcactctggacaaggtgtgcaacatggccagagactgtcgcgactggtcggatgaaccaattaaggagtgtggcaccaacgaatgcctcgacaataatggcggatgttcgcacgtgtgcaatgatctcaaaatcggctacgagtgtgattgcccagatggctttcagcttgtggcacaacgccggtgcgaggacatcgatgaatgtcaggatccagacacttgctcccagctctgcgtcaatttggagggaggatacaaatgtcagtgcgaagaaggattccagctggacccgcacactaaagcatgtaaagcagtgggctccatcgcttacctgttcttcaccaaccggcatgaagtgagaaagatgactttggacaggagcgagtacacctcgcttatccctaatctcagaaacgtggttgcactggacaccgaagtcgccagcaatcgcatctactggtcggatctgtcccaacgcatgatttgctcgacccagctggaccgcgcgcacggagtgtcctcatacgacaccgttatctcccgggatatccaggcgcctgacgggctggcggtggattggatccactccaacatctactggaccgactccgtgctgggaaccgtctcggtggctgatactaaaggagtgaagagaaagaccctgttcagagaaaacggatcgaagccccgcgccatcgtggtggacccggttcacggatttatgtactggacggattggggcactcctgccaagatcaaaaagggtgggttgaatggagtggacatctactcactggtgaccgaaaacatccagtggcctaacgggatcacccttgacctcctttcgggtcgtctttactgggtggattctaagctccactcgatctcctccatcgacgtgaacggcggtaaccgcaagactattttggaggacgaaaaaaggcttgcgcatccgttctcccttgccgtctttgaggacaaggtgttctggacggacattatcaatgaggccatcttctcggcgaatcgcctcaccggttcggatgtgaaccttctcgctgaaaacctgctgagcccagaggacatggtgctgttccacaacctcacgcagccacgcggagtgaattggtgcgaaaggaccactctgtcgaacggggggtgccagtacctgtgcctgccggccccccagatcaatccacattcgcctaagtttacttgcgcctgcccagacgggatgctcctcgccagagacatgcggtcctgtctgaccgaagctgaagccgctgtggctacccaagaaacgtctaccgtgcgcctcaaggtgtcgagcaccgctgtgagaacccaacacaccaccacccgcccggtgcccgacaccagcaggctccccggagctactccggggctgactactgttgaaattgtgactatgagccaccaggccttgggcgatgttgccggaagaggcaacgaaaagaaaccttcctctgtgcgggccctctcgatcgtgctgcctatcgtgctccttgtgttcctgtgtctgggggtgttcctgctctggaagaattggaggctgaagaacatcaattcgatcaattttgacaaccctgtctaccagaaaaccaccgaggacgaggtgcacatctgtcacaaccaagatggctactcttacccgtcccgccaaatggtgtcgctggaggacgacgtcgcc

SEQ ID NO: 16125 - DNA, 2580 bp, Artificial Sequence
  Description of Artificial Sequence: Synthetic coding sequence
atgggtccatggggttggaagctccgatggactgtcgcacttctgctggccgcagctggtactgcagtaggagatcggtgtgagagaaatgaattccagtgccaggatgggaagtgtattagctataagtgggtctgtgacggatcggcagaatgccaggatggcagcgacgagtctcaggaaacctgtctgagtgtcacgtgcaagtctggtgacttcagctgtggaggtcgcgtgaaccgctgcatccctcagttttggcggtgtgacggccaagtagattgtgacaacggatccgacgagcaaggatgcccgcccaagacctgctcgcaagatgagtttcggtgtcatgacggaaagtgcatctcccgtcagttcgtgtgtgatagcgacagggattgtctggacggctccgatgaggcttcctgtccagtgctcacatgcggcccagcctcattccagtgtaacagcagcacttgtataccccaactgtgggcttgcgacaacgaccctgattgcgaggacggctcggatgagtggccgcaacgatgccgcgggctgtacgtctttcagggcgactcatccccatgttctgcgttcgagttccactgccttagtggggaatgcattcactcaagctggaggtgtgacggcggccccgattgcaaggataaaagtgacgaggagaattgcgctgtggcaacttgccgacccgacgaattccagtgcagcgacgggaattgcatacatggatcacgccagtgtgaccgtgaatatgattgcaaagacatgtccgatgaggtgggctgtgtcaacgtgacgctctgtgaggggccaaataaattcaagtgtcactctggagagtgcatcactttggataaggtctgcaatatggctagggactgcagagactggtccgatgaacctatcaaagagtgcgggacgaacgagtgcctggacaacaacggagggtgtagccatgtgtgtaacgatctgaagattggttatgagtgtgactgcccagacggatttcagttagtcgcacagaggaggtgcgaggacattgacgagtgtcaggatcccgatacctgtagtcagctgtgcgtgaacctggagggtgggtacaagtgccagtgtgaagaaggctttcaacttgatcctcataccaaagcctgcaaggctgtaggtagtatcgcataccttttctttaccaaccgccacgaggttaggaagatgaccctggatcgaagtgagtacacatcccttattccaaacctacggaatgtggtggctcttgacactgaagtcgcgagtaaccgcatctactggtctgacctgtctcagcgcatgatatgctcgacccagttagaccgggctcacggggtatcatcctacgacaccgtcatctctcgggacattcaggcccctgacggtctcgctgtggattggatccactccaatatctattggacagattcagtgctcggaactgtatctgtggccgacactaagggtgtgaagcgtaagacactgttccgagagaacggatccaagccacgagctattgtggtcgatcccgtccacggcttcatgtactggaccgactggggtaccccggcgaaaattaaaaagggggggcttaacggtgtggacatctactccctcgtcaccgagaacatccaatggcccaacggcatcacccttgacctgctgagtggccggctatactgggtggattctaagctacactctatttcctccatagatgtgaatggaggaaaccggaagacaatccttgaggatgaaaagcggctggcgcacccatttagtctggcagttttcgaggacaaggtgttttggactgacattattaacgaggccatttttagcgcaaacaggctgaccggaagtgacgtgaacctcctggcagagaatctgctgagtccagaggacatggtacttttccataatcttacccagcctaggggggttaattggtgcgagcggaccacccttagcaacggcgggtgccagtatctctgcctaccagccccgcagatcaacccccatagtcctaaatttacttgtgcctgccccgacggcatgctactcgcgagggatatgcggagctgcctgactgaagcggaagctgcagtagctacacaggagacctcaaccgtacgactgaaagtgagttcaacggctgtgcggacacagcacactactacgcgccctgtgcctgacacatctcgccttccaggggccactcccggcctgaccaccgttgagattgtgacaatgtctcatcaggcattgggggatgtggctggaagggggaacgaaaagaaaccctcaagcgtgagagccctgtccatcgtcctgcctatcgtcctcctggtgttcctttgtttgggcgtcttcctactatggaagaactggcgcttgaagaatataaactcaattaatttcgacaatcctgtgtaccaaaagactacggaggacgaggtccatatttgccacaatcaggatggctatagctacccttcacgtcaaatggtgtccctggaggacgacgtggct

SEQ ID NO: 16126 - DNA, 2580 bp, Artificial Sequence
  Description of Artificial Sequence: Synthetic coding sequence
atgggcccgtggggctggaagttgcggtggaccgtggcactgctactggctgcggccgggactgcagttggggacagatgtgagcgcaatgagttccagtgtcaagacggaaaatgcatatcttataagtgggtgtgtgacgggagcgccgagtgtcaggatggctcagacgagagtcaggagacatgtctctcagtaacatgcaagagcggggacttcagctgcgggggtagagtgaaccgttgtatcccacagttttggcgctgtgacggacaggtggattgcgataatggcagtgatgagcagggctgtccgcccaaaacttgtagtcaagacgagttccgttgtcacgacggtaaatgcatctccaggcagtttgtttgcgacagcgatcgcgactgcctcgacggctcagacgaggcctcttgtcccgtgctcacgtgtggtccagctagctttcagtgtaacagttcaacctgcatcccacaactttgggcttgcgataacgaccctgattgtgaggacgggtccgacgaatggccccagagatgccgcggactgtacgtgttccagggcgacagctctccttgttcagcctttgagtttcattgcctgtctggcgagtgtatacactcctcatggaggtgcgatggggggccggattgcaaagacaaatcagatgaggagaattgcgccgtcgccacatgccggcccgacgagtttcaatgttctgatggcaactgcatccacggctccagacagtgtgatcgggagtacgactgtaaggacatgagtgacgaggtgggctgtgtgaacgtaaccctgtgtgagggcccaaacaaatttaagtgccactctggcgagtgcatcacccttgacaaagtgtgcaatatggcacgagactgtcgggattggtcagacgagcctattaaggaatgtgggaccaacgagtgcctagacaacaatgggggttgttctcacgtgtgcaatgatctgaagattggctacgagtgcgattgccccgatggatttcagctggtggctcagcgcaggtgcgaagatatcgatgagtgtcaggaccctgatacctgctctcagctgtgcgtaaatcttgaaggagggtacaaatgccagtgtgaggagggtttccagttagacccacacaccaaagcttgcaaagcagtaggctccatcgcatacctgttcttcactaatcggcatgaggtgcgcaaaatgactctcgataggtcagaatatacgtccctcataccgaatttaagaaacgttgtggcactggacaccgaagtagcaagtaatcgaatctactggagcgacctctcacagcgaatgatctgttctacacagctcgatcgcgcacatggcgtttcctcatacgatacagtgatcagtagggacatccaagcacccgatgggctggcagtggattggattcactctaatatttactggacggactccgtcctagggacagtgtccgtcgctgacacaaaaggagtgaaacgaaagacactgtttcgagagaacggatccaagccacgggccatcgtggtggatcctgttcacggattcatgtactggaccgactggggaacacccgccaaaatcaaaaaaggaggattaaacggcgtcgacatctactcccttgtcactgagaatatccagtggccgaacggtataacattggacctgctttcaggtagactgtactgggtagatagcaagctccattccatcagctcgattgacgtaaatgggggaaacaggaagaccattcttgaagacgagaagcgactcgcacaccccttttctctggcagtgttcgaagacaaagtgttttggaccgacataatcaacgaggccattttttctgcgaacagactgaccggaagtgatgtaaaccttctggcagagaacttgctgtcgccagaagacatggtcctctttcacaacctgactcaaccccggggtgtaaactggtgcgagaggacaaccttgtcaaatgggggatgtcagtacctctgcctacccgccccgcagatcaacccacattcaccaaagttcacctgcgcttgtccagatgggatgctgctggctagggatatgaggagttgtctgacggaggccgaagctgccgtcgccacgcaggaaactagtaccgttagactgaaagtcagtagcaccgccgtgcggacccaacacaccactacaagacctgtcccggacacttccagactccccggagcaacacctggcctgacaacagtggagatagtcacaatgagtcaccaggccctcggagacgtggccggacggggtaatgaaaaaaagccttctagtgtgcgcgcccttagtattgtgttgccgatcgttcttctagtgttcctgtgcttaggggtcttcctactgtggaagaactggaggcttaaaaatatcaactctattaatttcgataacccggtttatcaaaaaaccacagaagatgaggtgcacatctgccataaccaggatggctacagctaccctagtcggcagatggtcagtttggaggacgatgttgcg

SEQ ID NO: 16127 - DNA, 2580 bp, Artificial Sequence
  Description of Artificial Sequence: Synthetic coding sequence
atgggcccctgggggtggaaactacgctggacagtggcgctgttgctggctgcagcaggaaccgccgtcggagacaggtgtgagaggaacgagtttcagtgccaggatggtaaatgtatttcatataagtgggtgtgcgatggctcggccgaatgccaggacggctcagacgagagtcaggagacatgcctctccgtgacatgtaaatcgggtgattttagttgcggaggtcgcgtgaacagatgcattccccagttttggcggtgtgacggccaagtggactgtgacaacggatctgacgagcaggggtgtccccccaagacctgttcccaagacgaattcaggtgccacgacggaaagtgcattagtagacagttcgtgtgtgactccgatagagattgcctggacggatccgatgaagcctcatgccccgtattaacctgtgggccagctagtttccaatgcaacagctctacttgcattccccagctgtgggcctgtgacaacgatcccgactgtgaagacggtagcgacgagtggcctcagcggtgcagaggcctgtatgtgtttcagggcgactcgtccccctgcagcgcttttgaatttcactgcctgtctggggagtgcatccatagctcctggagatgcgatggcggcccagactgcaaggacaagtccgatgaggagaattgtgccgtggcgacctgccgaccagacgagtttcagtgctcagatggaaattgtatccacggctcaaggcaatgtgatcgggaatatgattgcaaggatatgtccgatgaagtaggatgcgttaacgtcacattgtgtgaaggcccaaacaagttcaaatgtcattcaggcgaatgtattacactggataaagtgtgtaatatggcacgcgactgcagagactggagcgacgaacctattaaggagtgcgggactaatgagtgtctcgataacaacggcggatgcagccacgtgtgcaatgacctgaagattggatatgaatgtgactgtcccgacggttttcagcttgttgcacaaaggcgatgcgaggacatcgacgaatgccaggacccagacacgtgttcccagctttgtgtgaaccttgaaggaggttataaatgtcagtgcgaggaaggctttcagctggatcctcataccaaagcgtgcaaagcagtgggcagcattgcctatttattctttaccaacagacacgaagtgcgcaagatgacactcgatcgctccgagtacacgagcctgattcccaacctgcgcaacgtcgttgccctggatactgaagtggctagcaaccgtatatattggtctgacctctctcagaggatgatatgttctacacagctggatagggctcacggggtgtccagctacgacacggtcatctcacgcgacatccaggcccccgacggtctggccgtggactggatacactccaacatatattggacagattctgtgctgggcacagtctccgtggccgatacaaagggcgtgaagagaaaaactctgttcagagagaacggttcaaagccacgtgcaatcgttgtggaccccgtgcacgggttcatgtactggactgattggggaacgcctgcaaagataaaaaaggggggcctcaatggtgttgacatatattcccttgtgaccgagaatattcagtggccaaatgggatcaccctggatcttctgtctggacggctctattgggttgatagcaagctccattcaatcagctctatcgacgtcaacggaggtaatcgcaaaaccattctggaagatgaaaagcgcctggcccacccatttagtctggccgtttttgaagataaagtgttttggaccgatatcatcaatgaggccattttcagtgcgaataggctgacgggcagtgatgtaaacctgctagcagagaacctgctgagtcccgaggatatggtgcttttccacaatcttacgcagcctagaggggtgaattggtgtgaacgtaccaccctatccaacgggggttgccagtacctttgcctacccgctccccagatcaacccacactcgcccaaattcacctgtgcctgtcctgatggaatgttattggctcgcgacatgaggagttgtcttacagaagcagaagctgccgtggccacccaggagacttcgacagtaaggctgaaggtttccagtacagcagtgcgaactcagcatactactacccgtcccgtgcccgacacctcccggcttcctggggcgacgccaggcctgacaactgtcgagatagtaacaatgtcgcaccaagccctgggagatgtggctgggcgcgggaatgagaagaagccctcatctgtgcgtgccttgagtatcgttttgccgattgtgctgctggtcttcctgtgtttgggagtatttctcctttggaagaactggagactaaagaatatcaatagcatcaacttcgacaacccagtctatcagaaaaccactgaagacgaagtgcatatttgtcataatcaggatggctactcttatccctcccgacagatggtctccttggaggacgatgttgct

SEQ ID NO: 16128 - DNA, 2580 bp, Artificial Sequence
  Description of Artificial Sequence: Synthetic coding sequence
atgggcccctggggctggaaattgcggtggaccgtggcgctcctactcgcagcagcaggaacggccgtcggtgatcgatgcgagcgcaatgagttccagtgccaagacggaaaatgtataagctacaagtgggtgtgtgacggctccgctgagtgtcaagacggcagtgatgaaagtcaggagacatgtctcagtgtgacttgcaagtccggcgatttcagttgcggcggccgggttaaccggtgcataccccagttttggcgttgcgacggccaagtcgactgtgacaacggttcagatgaacagggatgcccgccaaaaacgtgctctcaagatgagtttcgatgtcacgatgggaagtgcatcagccggcagttcgtatgtgattcagaccgagattgcttggacggatcagatgaggcctcttgtcctgtgctcacttgtggtcccgcctcatttcagtgtaattcttcaacctgtattccccagctctgggcctgcgataatgatccagattgcgaagacggatcagacgaatggccacagagatgccgtggactttacgtgttccagggcgattcgtccccctgcagcgcttttgagttccactgcctgagcggggagtgtatccacagttcctggagatgcgacggcggaccagactgcaaagataagagcgatgaggagaactgcgctgtggccacatgtaggccagatgagttccagtgctctgacggcaattgcattcacgggagtcggcagtgtgacagggagtacgactgtaaagacatgagcgatgaggtcggttgtgttaacgtcactctctgtgaaggcccaaacaaattcaaatgtcactccggggagtgtataactctggacaaggtttgcaatatggcccgggactgtcgcgactggtcagacgaacccatcaaagagtgcggaacaaacgagtgtcttgacaataacggaggttgtagccacgtctgtaacgatcttaaaattgggtacgaatgcgactgccctgacggcttccagctcgtggctcagcgaaggtgcgaagacattgacgaatgccaggacccggatacatgctcccagttgtgtgtgaatctggaggggggttataagtgtcaatgcgaagaaggattccagctggatccgcatactaaggcctgtaaagctgttggttctatagcttacctgttttttacaaaccgtcacgaggtgaggaagatgacactagaccgcagcgagtacactagccttattcctaacctccgtaatgtggtggccctggacacagaagttgcgagcaataggatttactggagcgacttgtctcagcgaatgatttgttctacccagttagaccgcgcacacggcgtttctagctacgacaccgtcatcagtcgcgacattcaggcccccgacggactggccgtcgattggatccatagcaacatctattggactgacagcgttcttggcacagttagcgttgcagacacaaaaggagtgaagaggaagaccctctttcgcgagaacgggtccaaacctcgcgccatagtggtcgaccctgtgcatggattcatgtactggacagactggggcacacctgctaagatcaaaaagggtggactcaacggcgtcgatatttactctttggtgactgaaaatatccaatggcccaatggtatcacactggacctactgagcggacgcctctattgggtagatagtaaactgcattccatcagcagcatagacgtcaatggaggcaacaggaagacaatccttgaagacgagaaaagactggctcacccgttttctctggcggttttcgaagacaaggttttctggacagatattattaacgaagccatattctcagctaataggctgactggttctgatgtgaatctcttggccgaaaatctcctctcgcctgaggacatggtcctcttccataacctgacccagcccagaggcgtcaactggtgcgagcgcaccactctcagtaatggagggtgccagtatctttgtctgcctgcgccgcaaattaaccctcatagccctaaattcacatgtgcgtgtccagacggcatgctgctcgccagggatatgcgtagctgcttgacagaagcggaagcagccgtggccacccaggagacctcaacagtgcgactgaaagtctcatcgactgcggtccgtacgcagcatactactacaagaccagtgcctgacacatcccggctgcctggggcgactcctggactgacaacagtcgaaatcgtcaccatgtcacaccaggcattgggcgatgtcgccggccgtggaaacgaaaaaaaaccatcaagcgttcgtgcactgagcattgtgctccccatcgttctcctagttttcctgtgtctgggtgttttccttctttggaagaattggagactaaagaacatcaacagtattaacttcgataaccccgtgtaccagaaaaccactgaggatgaggtgcatatttgccacaaccaggacggctatagctacccatcacggcagatggtatcactggaagacgacgtcgcg

SEQ ID NO: 16129 - DNA, 2580 bp, Artificial Sequence
  Description of Artificial Sequence: Synthetic coding sequence
atgggaccttggggctggaaactccgctggaccgtggcactcctcctcgcggcagcaggaactgcagtgggagatcgttgtgaaaggaacgaattccagtgccaggacggtaaatgtatttcgtacaagtgggtctgtgacggatcagccgaatgccaggacggctccgacgaatcacaagaaacttgtctgtcggtcacttgtaagtcgggtgatttctcatgcggtggacgcgtgaatagatgtattcctcaattctggaggtgcgatggccaagttgattgtgataacggatcggatgaacagggttgcccaccaaaaacgtgttcccaggatgaattccgttgtcatgatggtaaatgcattagccgacaatttgtgtgtgacagcgacagggattgccttgacggatccgacgaagcaagctgtcctgtgcttacctgcggccccgcctcgttccaatgtaatagctccacttgtattccgcagctttgggcatgtgataatgatccggattgcgaggacggatccgatgaatggccacaaagatgtcgcggcctttacgtctttcagggcgattcgtccccgtgctccgcattcgagtttcattgtttgtcgggggaatgtatccattcctcgtggcgttgtgatggtggtccagattgtaaagataaatccgacgaagaaaattgcgcggtggctacttgtaggcccgatgaatttcagtgtagcgatggtaactgcatccatggcagcagacagtgtgatcgggaatacgattgtaaggatatgtccgatgaagtggggtgtgtgaacgtcacgctttgtgaaggaccaaataagtttaagtgtcattctggtgagtgtatcactctcgacaaggtgtgcaatatggcacgagattgtcgggattggtcagacgaacctattaaggaatgcggtaccaacgagtgtctggacaataatgggggatgtagccacgtgtgtaacgacctcaaaattggatacgaatgtgattgccccgacggttttcaactggtcgcacaacggagatgtgaggatattgacgaatgtcaagatcctgacacgtgttcgcaactgtgtgtgaatctcgaaggtggctacaagtgccaatgtgaagagggctttcagctggaccctcatactaaagcgtgtaaggccgttggatcaattgcttaccttttctttactaataggcatgaagtcagaaagatgacgctggaccgctcggaatataccagccttattccaaaccttcggaacgtggtcgctcttgatactgaggtggcctcgaatcgaatttactggtcagacctgtcccaacgaatgatctgtagcacccagcttgatcgcgcacatggtgtgtcgagctacgatactgtgatttcccgcgatattcaggcgccggatggtcttgccgtcgattggattcactccaatatctactggaccgattcagtgcttggaaccgtgtcggtcgcagatactaagggagtgaaaagaaagactctctttagggaaaacggaagcaaacctcgtgcaattgtggtggatcctgtccacggttttatgtactggactgactggggaactcctgcgaagattaagaaaggaggactgaacggtgtcgacatttacagcctcgtgaccgagaatatccaatggcctaatggcatcaccttggatcttctttccggccgactttactgggtggactctaaattgcactcgatctcatcgatcgacgtcaacggaggcaacagaaagactattctcgaggatgaaaagagacttgcacatcctttttcccttgcagtctttgaagataaggtcttttggactgatatcataaacgaggcaattttctcggcaaacagactgactggatccgacgtcaaccttcttgcggaaaatctgctctcaccagaagatatggtgctgtttcataacctcacgcaacccagaggagtgaattggtgtgaacgcacgaccctttcgaacgggggatgtcaatacctttgccttccagcacctcagatcaacccacattccccaaagttcacctgtgcatgtcccgacggcatgctgctggcacgcgatatgcgttcctgcctgaccgaagcagaggccgccgtcgctacccaagaaacctcgacggtgcgacttaaggtgtcgtcgaccgcagtgaggactcaacatactactacgcggcctgtgcccgacactagccggcttccaggagcaacccccggcctcaccactgtggagattgtcaccatgtcccaccaggctcttggagacgtggcaggtcgtggaaacgagaaaaaaccttccagcgtccgagctctgtcgatcgtactgcctatcgtgctgctcgtgtttctgtgccttggggtgttccttctttggaagaattggagactcaagaatatcaactcgattaactttgataatcctgtctaccaaaaaactaccgaagatgaagtccacatctgtcacaaccaggacggttacagctacccatcccgccagatggtatcgctcgaggacgatgtggca

SEQ ID NO: 16130 - DNA, 2580 bp, Artificial Sequence
  Description of Artificial Sequence: Synthetic coding sequence
atgggaccttggggatggaaattgcgatggaccgtcgcactccttcttgcggcagcgggtaccgcggtgggagatcgctgtgaacggaacgaatttcagtgccaggatggcaaatgtatctcctacaagtgggtgtgcgacggtagcgcagaatgtcaagatggatccgatgaaagccaggaaacgtgcctgtcggtgacctgtaagtccggtgacttttcctgtggtggtagagtgaataggtgcatacctcaattctggcggtgtgacggccaagtcgattgtgataacggatcggatgagcagggatgcccacctaaaacttgttcgcaagatgagtttaggtgtcatgatggtaagtgtatttcgagacagtttgtgtgtgactcggaccgggactgtcttgacggaagcgatgaagctagctgtccagtgctgacttgtggtcccgcaagttttcaatgtaatagctcaacttgcatccctcaactttgggcctgtgacaacgacccagattgtgaagatggctcggacgagtggccgcaacgttgccgtggactttacgtgttccagggggattcgtcgccatgctcggccttcgagttccattgcctgagcggggagtgtattcactcgtcgtggcggtgcgacgggggccccgattgcaaggacaagtcggatgaagagaactgcgccgtcgccacttgtcgcccagacgagttccaatgttcagatggaaactgtatacacggatctcgacagtgtgatcgggaatacgattgtaaggatatgtccgatgaagtcggttgtgtgaatgtgactctctgtgaaggtcctaacaagttcaagtgtcattcaggagaatgtatcacccttgataaggtgtgtaacatggcccgagactgtagagattggtcggacgaaccaattaaggagtgtgggactaatgaatgccttgacaataatggcgggtgttcccacgtgtgcaacgacctgaagattggatacgaatgcgattgtcctgatggttttcaactcgtggcccaaagaaggtgtgaagatattgatgagtgtcaggacccggacacttgttcccagctttgcgtgaacctggaaggggggtacaagtgccagtgcgaagagggatttcagcttgacccacatactaaggcatgcaaggcagtgggatcgatcgcgtacctgttcttcaccaatcgccatgaagtccgaaagatgacgctcgatcgttccgaatacaccagccttataccaaatcttagaaacgtcgtggcgttggataccgaagtggcctctaaccgcatttactggtcggatttgtcacagcggatgatctgttcgactcaactggatagagcacatggggtcagttcgtacgatactgtcatctcccgagatatccaagcacccgatggattggcagtggattggattcattcaaacatttactggacggatagcgtgcttgggactgtttcggtcgcagatactaaaggagtgaagcgaaaaacgcttttccgcgagaacgggtcgaaaccccgcgctattgtggtggaccccgtgcatggttttatgtactggaccgattggggtactccagcgaagatcaaaaagggaggactcaacggtgtggacatatacagcctggtcactgagaatattcaatggcctaatgggatcactcttgatcttcttagcggcaggctgtactgggtggattccaaactgcattccatctcatcaatcgatgtcaacggcggcaatcgaaagacgatcctcgaggacgagaagagactggcacatccattttcgcttgcggtctttgaagataaggtcttttggaccgacataatcaatgaagctattttcagtgcaaatagacttactggctccgacgtgaatctgctggcagaaaatcttctctcgcccgaggacatggtgctttttcacaaccttacccaacctagaggagtgaactggtgtgaaagaaccaccctgtcaaatggaggatgtcagtacctctgtctgcccgcaccacagattaatcctcattcacccaagtttacctgtgcgtgccccgatggcatgctcctggctcgggacatgcgttcctgcttgactgaagctgaagcagcggtcgccacccaagaaaccagcaccgtgagacttaaagtctccagcaccgcagtgagaacccaacacaccactaccaggccagtccccgacacttcccgcctcccaggcgcgacgcccggtcttactaccgtggaaatcgtgaccatgtcgcatcaagccctgggtgacgtggccggtagggggaatgaaaagaagccatcctctgtgcgtgccttgtcaattgtgctgccaattgtgcttctggtgtttctctgtcttggagtgtttcttctgtggaagaactggagactgaagaatatcaattcgatcaacttcgataaccctgtttaccagaaaactaccgaggatgaagtccacatttgccataatcaagatggctactcctacccatcaaggcaaatggtgtcacttgaagatgatgtggcg

SEQ ID NO: 16131 - DNA, 2580 bp, Artificial Sequence
  Description of Artificial Sequence: Synthetic coding sequence
atgggtccttggggctggaaactgcgttggacggtggcactgctccttgccgcggcaggtaccgccgtcggggatcgttgtgagcgaaacgaattccagtgtcaggacggaaaatgcatttcgtataaatgggtgtgcgacggttctgccgagtgtcaggacggttcagatgagagtcaggagacctgtttgtcagtgacttgcaagagtggggatttttcctgtggggggcgtgtgaatagatgtataccccagttttggagatgcgatggtcaagtggattgtgataatgggagtgatgagcaaggatgccctcccaaaacctgctctcaggacgagttcaggtgccacgatggtaagtgcatatccagacaattcgtgtgcgacagcgaccgggactgtctggacgggagtgatgaggcctcttgcccagttctcacctgtggcccagccagctttcagtgcaatagcagtacttgcatcccccagctctgggcttgcgacaatgatcccgactgtgaggacggatctgatgagtggccacagcgttgcagagggctgtatgtgttccaaggagatagtagtccgtgttctgcttttgagtttcactgcctgagtggcgagtgcatccattcctcatggcgttgcgatggggggcctgattgcaaggacaagtccgacgaagaaaattgtgccgtggccacctgccgaccagacgaatttcaatgctccgacggcaattgtatccatgggagccgacagtgtgatcgagagtacgactgtaaggacatgtccgatgaggttggctgtgtgaatgtgacgttatgcgagggccccaataaattcaaatgccacagcggagaatgcatcaccctggataaggtctgtaacatggcccgagattgccgagactggtctgatgagccaataaaggagtgcggcactgcagaatgtctagataacaacggtggctgttcccatgtgtgcaacgacctgaagatcgggtatgaatgtctttgcccagatggttttcagttggttgcccagagaaggtgtgaagacattgacgaatgtcaggatcccgacacctgttctcagttgtgtgttaatctggagggtggatataaatgtcagtgtgaggaaggtttccagctggatccgcataccaaagcttgcaaagcagtaggtagcatagcctacctgtttttcactaatcgacatgaagtacgaaaaatgaccctcgatcggtcggaatacacctccttgatacctaaccttaggaatgtcgtcgcccttgacaccgaggtggcctcaaatcgaatctattggagcgacttgtcacaaagaatgatttgcagcacacagcttgaccgggctcacggtgtaagctcgtacgatacagtcatatcacgcgacattcaggcgccggacgggctggcagtggattggattcactccaacatctactggacggacagtgtgctgggaaccgtgagcgtggccgataccaagggcgtaaagcgaaagactctgttcagggaaaacggatcaaagcctagagccatagtcgtagacccagtccatgggttcatgtactggacagattggggcacccctgcaaagatcaagaagggggggctgaatggggtggacatctactctctggtaactgaaaatatccaatggccgaacggaatcactttagacctgctctctggccgactctactgggttgattctaagcttcattctattagctccattgacgtcaatggcggtaacaggaaaaccatactcgaggatgagaaaagactggctcatcctttctccctggctgtctttgaagataaggtcttctggactgacataataaacgaagccatcttttccgcaaatcggttgaccggatctgacgtgaacttgcttgcagagaatctgctctccccagaagacatggttctattccacaaccttacgcagcctagaggggtcaattggtgcgaaagaactactctctctaacggcgggtgtcagtacctgtgcctgcccgcccctcaaatcaatccccatagccctaagtttacatgcgcatgccccgatggcatgctgctggccagagacatgcgatcttgtcttacagaggcagaggccgcggtcgccacccaagaaacctcgactgtcagactaaaggtgtcgagcaccgcagtgcgaactcagcacacaacaacccgccccgtgcccgatacgagtcgactgcctggagccacccctggtctgacaaccgtggaaatcgtgaccatgtcacatcaggccctcggcgacgttgccgggcgtggtaacgagaagaagccaagctccgtgcgagccctttctatcgtcctgcctattgtgttgctggtgtttctctgcctcggagtgtttctgctgtggaagaactggagactcaaaaatatcaattccattaatttcgacaatcctgtctatcagaaaaccaccgaagatgaagtgcacatttgccacaatcaagatgggtatagctatccttcacgacagatggtcagtttggaggacgatgtagcc

SEQ ID NO: 16132 - DNA, 2580 bp, Artificial Sequence
  Description of Artificial Sequence: Synthetic coding sequence
atgggtccttggggctggaagcttcgctggacagttgcactgctcctggcggcagcaggtactgcagtcggtgacaggtgtgaacgcaatgagttccagtgccaggacggaaagtgcatcagttataagtgggtctgtgacggttccgcagaatgccaggacggtagtgacgaaagtcaggagacatgcttgagtgtcacctgtaagagcggcgatttctcatgtggcggtagggtcaacaggtgcatcccacaattctggagatgtgacggccaggtcgactgcgataacggctcagatgagcaaggatgcccccccaagacttgctcccaagatgagtttcgctgccacgatggcaagtgcatttccaggcaatttgtgtgtgattctgatcgcgactgcctcgacggaagtgacgaagcatcctgtcctgtgctgacatgtggccctgccagctttcagtgcaattcttctacatgtattccccaattgtgggcatgtgataacgaccctgactgcgaggatggcagtgatgaatggccacagagatgtaggggtctgtatgtattccagggagatagctccccctgttcagcgtttgagtttcactgcttgtctggtgaatgcatccacagttcctggagatgcgacggtggacccgactgtaaagacaaaagtgacgaggaaaattgcgcagttgctacatgtagacctgacgaatttcagtgttcagacggaaactgtatccacggtagtaggcaatgtgaccgcgaatacgactgcaaagacatgtccgatgaggtcggctgcgttaacgtgaccctgtgtgagggtccaaacaagttcaagtgccactcaggcgagtgcatcactctggataaggtctgtaatatggcaagggactgtagggactggtccgacgagccgatcaaggagtgcggcaccgctgaatgcttggataacaacggcggttgctctcacgtgtgtaacgacctgaaaatcggctacgaatgcctgtgtcccgatggctttcaactcgtcgctcagaggagatgtgaggacatcgacgagtgccaggaccctgatacatgctctcaactctgtgtgaacctcgaaggtggttataagtgtcaatgcgaggagggcttccagctggacccccacaccaaggcttgcaaagccgtaggctccatcgcatacttgttttttacaaacaggcatgaagtgagaaaaatgactctggataggagtgaatacacatccctgatccctaacctccgcaacgttgttgcactggacaccgaggtggcctccaacagaatctactggtcagacctgtcacaacgcatgatttgctctacacagctggaccgcgcgcacggcgtgagttcctatgatactgtaatctctagagacatccaggctccagacggtcttgcggtcgattggatccactctaatatatactggacagattctgtcctgggaaccgtgagcgtcgctgataccaagggcgtaaagaggaaaacactgttcagggaaaacggatctaagccccgcgcaatagtagttgaccctgttcacggcttcatgtactggaccgattggggaacaccagccaaaattaagaagggaggactgaatggtgtcgatatatactctttggttacagaaaatattcagtggccgaacggtatcacccttgatctgctgtctggaaggctctactgggtggattcaaaactgcactctatcagctccatagatgttaatggtggaaatcgcaagaccatccttgaagatgagaagcgcctggcccatcctttctccttggccgtgttcgaggataaggttttctggaccgatattatcaacgaggctatcttctctgctaatcgcctgacaggctccgacgttaacctgcttgctgaaaatctgctttcacctgaggacatggtactgtttcacaatctgacacagccaagaggagtaaactggtgtgaaaggactacactttctaatggtggttgtcaatacctttgcctcccggcgcctcaaattaatcctcactctcctaagttcacatgcgcttgccccgacggaatgcttctggcacgcgatatgcgcagttgccttaccgaagcggaggctgctgttgctacccaggaaacttcaacagttcgcctgaaggtctcaagtaccgcggtgaggactcagcataccaccaccaggcccgtgccagatacgagtagattgccaggcgcgactcctggacttaccactgttgagattgtaacgatgtcacaccaagctcttggtgacgtggccggtcgcggaaacgagaagaagcctagctctgtcagagccctcagtatagttctgcctatcgtgctgctggtgttcctgtgtcttggagtctttttgctgtggaagaactggaggctgaagaacataaattccatcaattttgacaacccagtataccagaagactacggaggacgaagtgcatatttgtcacaaccaggacggttactcatacccttcccgccagatggtctctttggaggatgatgttgcg

SEQ ID NO: 16133 - DNA, 2580 bp, Artificial Sequence
  Description of Artificial Sequence: Synthetic coding sequence
atggggccttggggatggaagctgcgctggactgtggcactgctgctggctgcagcgggaacggccgtgggcgacaggtgtgagcgtaatgaattccagtgccaagacggcaagtgtatttcatacaagtgggtgtgtgatggatcagccgaatgtcaggatggctcggacgaaagccaagagacgtgcctgtccgttacttgtaagtcgggcgacttctcgtgcggcggacgcgtgaatcgctgcatcccgcagttctggcggtgcgacgggcaagtcgactgcgacaacggcagtgacgaacaaggatgcccgccaaagacttgctcgcaggacgaatttcgttgccacgacggtaaatgtatctcacgccaatttgtctgcgactcagatcgggattgcctggacggctctgatgaggcgtcgtgcccggtcctgacctgtggaccagcgagtttccagtgcaactcctccacttgcatcccgcaactgtgggcatgcgacaatgacccagattgcgaggacggttcggacgaatggccgcagcgctgcagagggctgtatgtgttccagggtgactcaagcccatgctcagcctttgagttccactgtttgagcggagagtgtatccactcctcatggcgctgcgatggaggtcctgattgcaaagacaagtccgacgaagaaaattgtgcagtagccacctgccggcccgatgagttccagtgttccgacggcaactgcatccatgggagccggcagtgcgacagagagtacgactgcaaagatatgtcagacgaagtcggctgcgtgaacgtgaccctctgcgagggaccaaataagttcaaatgccactcaggagaatgcataactctcgacaaagtgtgcaatatggccagggactgcagggactggtcagatgagccgattaaggaatgcggtactgcggaatgcctggacaataacggcgggtgtagccatgtgtgtaacgatctgaagattggatacgagtgcctctgtccagatggattccagctggtggctcagcggagatgtgaagatattgatgaatgccaggaccctgatacctgttcgcagttgtgtgtgaatctggagggaggctacaagtgccaatgcgaggagggattccaactggatccacacactaaagcctgcaaggccgtcggatctatcgcgtacctgttcttcacgaacaggcatgaagtccgcaagatgactctggatagaagtgaatacacctctctcatcccgaacctgcgcaacgtggtggccctggataccgaagtggcttccaaccggatctactggtccgacctgtcccagcggatgatctgctcgacccagctggatcgggcccacggagtgagctcgtacgacaccgtgatctccagagatattcaagccccggacgggttggctgttgattggatccattcgaacatctactggacggactccgtgctgggaacggtgtccgtggctgatacgaaaggagttaagcggaaaaccctgttcagggagaacggatcgaagccacgtgcaatcgtggtcgacccggtccacggtttcatgtactggaccgactggggaaccccggctaagatcaagaaaggcgggctcaacggcgtcgacatctacagcctggtgacggagaacatccagtggcctaacggaattactctggatttgctgtcaggtcgactctactgggtggactccaaactgcactccatcagcagcattgacgtgaacggaggaaatcgcaagactatcctggaggacgaaaagagactggcacacccgtttagccttgcagtgtttgaagataaggtgttctggaccgatatcatcaacgaagccattttctcggccaaccggctgactggatctgacgttaacctcctcgccgagaatctgctttcgccggaggacatggtgttgttccataacctgacgcaaccacggggagtcaactggtgcgaacggaccactctcagcaatggcggttgccagtacctctgtttgccggcgccccaaatcaaccctcattcacccaaattcacctgcgcttgtccggatggaatgctcctggccagggacatgcgctcgtgcctgacggaagccgaagccgctgtcgcgacccaagaaaccagcaccgtcagactgaaggtgtcctccaccgcagtgcgcactcaacacaccacgacgaggcccgtgcctgatacctcgaggctgcctggcgcgacccctggacttactaccgtcgagatcgtgactatgtcgcatcaggcactgggcgacgtggctggcaggggaaatgaaaagaagccgtcgtcagtgcgggccctgtctatcgtgctcccgatcgttctcctcgtctttctgtgcctcggggtctttctgctctggaagaattggcgactcaagaatatcaactcgatcaactttgataaccctgtgtaccaaaaaacgactgaagatgaggtgcacatctgccacaaccaggatggttattcctacccgtcccggcagatggtgagtctggaggatgacgttgcc

SEQ ID NO: 16134 - DNA, 2580 bp, Artificial Sequence
  Description of Artificial Sequence: Synthetic coding sequence
atgggaccatggggatggaaactcagatggacggtcgcgctgctgctggcagccgctgggacggccgtgggagacagatgcgaaaggaatgaattccagtgtcaagatggcaagtgcatctcttacaaatgggtctgcgatggctctgcggaatgtcaggatggctccgacgaatcacaggaaacctgtctaagcgtgacctgcaaatcaggcgacttcagctgcggcggacgggtcaaccgatgtatccctcagttttggaggtgcgatggccaggtcgattgcgataacggttcagatgagcagggctgtccgcctaaaacctgttctcaggacgaatttaggtgtcacgacggcaaatgtatatctagacagtttgtgtgcgactctgaccgcgactgccttgacggctcggacgaggcatcttgtccagtgttgacgtgcggccccgcctcttttcagtgcaacagttctacctgcatccctcaactgtgggcgtgtgacaacgaccctgattgcgaagatggatccgatgagtggccccagcgctgtagggggctgtatgttttccagggtgacagctccccttgttcagcatttgagttccactgcctaagcggcgaatgcatccatagctcatggcgctgtgacggaggacccgattgcaaggacaaaagcgacgaagaaaattgcgcggtggctacgtgccggcctgatgaatttcagtgttctgacggtaattgtattcacggtagccgtcagtgcgacagagaatatgattgcaaagacatgagcgacgaagtgggctgtgttaacgtgacgctgtgcgagggcccgaataaattcaagtgtcattcgggggagtgcataacgctggataaagtctgtaacatggctcgagattgtcgtgactggtctgacgagcctattaaagaatgtggaacagctgagtgtctggataataacggaggatgttctcacgtgtgcaatgatctgaagattggatacgagtgtttatgtccggatggctttcagttggtggcgcagcggcgctgtgaagacatcgacgaatgccaagatcccgacacttgttctcaattatgtgtcaatctggaggggggatacaagtgccaatgcgaggaaggcttccaactcgacccccataccaaggcgtgcaaagccgtgggctctatagcatatcttttctttaccaaccgccatgaagtgcgtaagatgaccttggacaggtccgagtacaccagtcttatccctaacctgcggaacgttgtcgctcttgatacagaggtagcctcgaatagaatctactggagcgacttgagtcagcgtatgatttgtagtacccagctcgatcgggcccacggcgtctctagttatgacacagtaatctcgcgggacattcaggccccggacggcctggctgttgactggattcactcaaacatatactggactgattccgtcctcggtactgtaagcgtggcagacacaaaaggcgtgaaacgcaagactctattcagggagaatgggtccaagcctcgggcaattgtcgtggacccagtgcatggcttcatgtactggaccgattggggaactcccgccaaaattaaaaagggcggactgaatggtgtggacatttatagcttggtgacggaaaatattcagtggcctaacggaattactctcgatctgctgtctgggcggctgtactgggtggattccaaacttcattccatctccagtatcgacgtgaatggggggaacaggaaaacgatcctcgaagatgagaagcgccttgcgcaccctttctcgctcgcggtctttgaggacaaagtcttttggactgatatcatcaatgaggcgattttctccgcaaatcgcctgaccggatctgatgtcaatcttctcgcagaaaatctcttatcaccagaggatatggtattatttcacaacttgacccaaccaagaggcgttaactggtgcgaacggaccaccctctccaacggcgggtgtcagtatttgtgtctgccagcccctcagataaacccacacagtccgaaattcacctgcgcctgccccgacggcatgctgttggcacgagacatgaggtcctgtctcaccgaggccgaggccgccgtggctactcaggaaacaagcaccgtaaggttgaaggtgagctctacagccgtgcgtactcagcacacaacgacaaggccagttccggatacgtcccgcctgccgggtgcgacgccgggattaacgaccgtcgagatcgtaactatgtcacatcaggcattgggagatgtcgccggacgggggaatgagaaaaaaccttcttccgtccgagctctgagcatcgtgttgcccattgtgctcctggtgtttctgtgcctcggggttttcttgttgtggaaaaattggcgactaaaaaacatcaattccatcaacttcgataatccggtgtatcagaagactaccgaggacgaagtccacatctgccataaccaggacggctacagctacccatcccgacagatggtatccctagaggatgatgtggcg

SEQ ID NO: 16135 - DNA, 2580 bp, Artificial Sequence
  Description of Artificial Sequence: Synthetic coding sequence
atgggtccttggggatggaagctccgctggactgtggcgctgctccttgctgccgccggaactgcggtgggagacaggtgcgaacgcaatgaattccaatgtcaggatggaaagtgtattagctacaagtgggtgtgtgatggctcggcggagtgccaggacggcagtgacgagtcgcaggaaacctgcctgtccgtcacttgtaagtccggagacttttcctgtggaggacgtgtgaacaggtgtatcccgcagttttggcgttgtgacggccaggtggactgcgacaacggatccgatgagcaaggatgcccgccgaagacttgtagccaagatgagttccggtgccacgacggcaagtgcatctcacggcaattcgtgtgcgattccgaccgcgactgtctggatggatcagatgaggcatcgtgccctgtgttgacctgcggcccagcatccttccagtgtaactcctccacctgcatccctcagctgtgggcctgcgataatgatccagattgcgaagatggtagcgacgaatggccgcaaagatgccgcggtttgtacgtgtttcagggcgactcatccccatgcagcgccttcgaatttcactgcctctcgggagagtgtatccactcctcctggcgctgcgatgggggaccagattgcaaggacaaatcggatgaggaaaactgtgctgtcgctacttgcaggccggacgagttccaatgctcggatggaaactgcattcatggatcgcgccagtgtgatcgggaatacgattgtaaggacatgtcagacgaggttgggtgcgtcaatgtgaccctgtgcgagggaccgaacaagtttaagtgccattcgggagaatgcatcacgctggataaagtgtgtaatatggcccgcgactgtcgggactggtccgacgaacctatcaaagagtgtggaactgcagagtgcctcgacaacaacggcggatgctcgcacgtgtgcaacgacttgaagattggatacgaatgcctgtgcccagacgggtttcagctggtcgcgcagcgccggtgcgaagacatcgatgagtgccaggatccagatacgtgcagccaactgtgcgtgaatctcgaaggaggctacaaatgccagtgcgaagagggctttcagctcgatccgcataccaaagcgtgcaaggccgttggaagcatcgcatatctcttcttcactaacagacacgaggtgaggaaaatgacccttgaccggtcagagtacacctccctgatcccgaatctgagaaacgtggtggcactggacaccgaggtcgcctcgaacagaatctactggtcggatctgtcgcaacgcatgatctgctcgactcagctggaccgcgcacatggagtgtcttcctacgacactgtgatctcccgcgacatccaagccccggatggactggcggtggactggatccacagcaacatctactggacggattcggtgctcgggactgtatcggtggctgacaccaagggtgtgaaacggaagaccctgttccgcgaaaacgggagcaaaccgcgcgccatcgtcgtggaccctgtgcatggattcatgtactggactgattgggggacgccagcgaaaatcaaaaaggggggtcttaacggagtcgatatctacagcctcgtgaccgagaacatccaatggcctaatggaatcaccctcgacctgctctccggaagactttactgggtggactcgaagctgcattccattagttcaattgacgtgaacggcggcaataggaaaactatactcgaggacgagaaacggctggcacacccattcagtctcgccgtgttcgaagataaagtcttctggactgatatcatcaacgaagctatcttcagcgcgaatcggctgacgggatccgacgtcaacttgctggccgaaaacctgctgtcgccggaggacatggtgctgtttcacaaccttactcagccgcgcggcgtcaactggtgcgagcgcaccacgctttccaatggcggctgccaatacttgtgcctgcccgccccgcaaattaacccgcattcgcctaagttcacttgcgcgtgccccgacggaatgctgctggctcgagacatgcggtcctgcctcaccgaggcagaggcagcggtggctacccaggagacttccactgtgagactgaaggtgtccagcaccgcagtgcgcactcagcatactactactcgccccgtgccggacacctccaggctgccgggtgcaacgccgggcctgaccaccgtcgaaatagtgactatgtcgcatcaggccttgggtgatgtcgcaggccgggggaatgagaagaagccgtcctcggtccgagccctgtcaatagtgctcccaatcgtcctcctcgtgttcctctgtctgggagtgttcctcctgtggaagaattggagactcaagaatatcaactcaatcaactttgataatcccgtgtaccagaagactacggaagacgaagtgcacatctgccacaatcaggatggctactcctacccttcccggcagatggtgtccctggaagacgatgtggcc

SEQ ID NO: 16136 - DNA, 2580 bp, Artificial Sequence
  Description of Artificial Sequence: Synthetic coding sequence
atgggcccatgggggtggaaacttaggtggaccgttgcgctgctgctcgcagccgctggcactgctgttggtgatcgatgcgaacggaatgagtttcagtgtcaggatggtaagtgcatctcatacaagtgggtgtgtgacggttcagccgagtgccaggacggaagcgacgagtcccaggagacttgcttgtcggtgacttgcaaatcgggagacttcagctgcggaggacgagtcaaccgctgtatcccacagttttggagatgtgacggtcaagtcgattgcgacaatggatcggacgaacagggatgtccaccgaaaacctgttcccaggacgagttccggtgtcatgacggaaaatgcattagccggcagttcgtctgcgattccgatcgggactgtctcgacggatcggacgaggcctcatgtccagtgcttacctgcggacccgcgagcttccagtgcaactcgtcgacctgcatcccccagttgtgggcctgtgataacgacccggattgcgaagatggttcagacgaatggccgcaacgctgccgcggtctgtacgtgtttcagggagattcgtccccgtgctcggcgttcgaattccactgcctgtcgggagaatgtatccacagctcttggaggtgcgatggaggtccagattgcaaagacaagtccgacgaagaaaactgcgccgtcgcaacctgccgcccggacgaatttcagtgttccgacggcaactgcatccatggaagcaggcagtgcgaccgcgaatacgattgcaaggatatgtctgatgaggtcggctgtgtgaacgtgactctgtgcgaagggcccaataagttcaaatgtcactccggagagtgtattacgctggacaaggtgtgtaatatggctcgcgactgcagagattggtcggacgaaccaatcaaagaatgcggcaccgccgagtgccttgacaacaacggtggatgctcgcacgtgtgcaatgatctgaaaatcggctacgaatgcctttgccctgacggttttcaactggtcgcccagcgcaggtgtgaagatatcgacgaatgccaagatccggacacttgctcgcaactctgcgtgaacctggaggggggatacaagtgccagtgcgaagagggattccaacttgacccgcacaccaaggcttgtaaggccgtgggatccatcgcgtacctcttctttacgaataggcatgaggtcagaaaaatgaccttggatcggtccgagtacacctcgctgatcccgaaccttcgcaacgtcgtggccttggacaccgaagtcgcatcgaaccggatctactggtccgatctgagccagaggatgatctgctcgactcaactcgaccgcgcccacggagtgtcgagctacgacaccgtgatttcacgcgacatccaggcccctgacggactcgccgtcgactggatccactctaacatttactggaccgattcggtgctggggactgtgtcagtggctgacactaaaggtgtgaagagaaagacgctgttcagagaaaacggaagcaagcctagagccattgtggtggaccctgttcatggattcatgtactggactgactggggcactccggccaagattaagaaaggaggcttgaacggagtggatatctactcgctggtcaccgagaacattcaatggcctaatggaatcaccctggacctcctttccggccgcctgtactgggtcgactccaagctgcactccatctctagcatcgacgtgaacggaggcaacagaaagaccatcctggaagatgagaaacgcctcgcccatcccttttcgctggcggtgttcgaagataaagtcttttggaccgacatcatcaacgaagcgatcttttccgcgaacagacttaccggcagcgacgtgaatctgctcgccgagaatctgctgtctccggaagatatggtcctgttccacaatctgactcagccacgcggagtgaactggtgcgaaagaactaccctctcaaacggaggctgccaatacctctgtttgccagccccacaaatcaatccgcactcgccgaagttcacctgcgcctgtcctgacggcatgctcttggcccgcgacatgcggtcttgcctgaccgaagctgaggcagccgtcgcgactcaagaaacgtccactgtgaggttgaaggtgtcctccaccgctgtcagaactcagcataccaccactcggcctgtcccggacactagccgcctgccgggcgctaccccgggcttgaccaccgtggagatcgtgacgatgtcacatcaggccctgggagatgtggccggccggggaaatgagaagaagccatcatcggtccgcgccctgtcgatcgtgctgccgattgtcctgctggttttcttgtgcctcggagtgttcctcctctggaaaaactggaggctgaagaacattaactcgatcaatttcgataatcctgtgtaccagaaaacgaccgaagatgaagtgcatatctgccataaccaggatgggtacagctacccgtcgcgccaaatggtgtcgcttgaagatgacgtggct

SEQ ID NO: 16137 - DNA, 2580 bp, Artificial Sequence
  Description of Artificial Sequence: Synthetic coding sequence
atgggtccgtggggttggaaactacgatggacggtagcgctattattagcggcggcgggtacggcggtaggtgatcgatgtgaacgaaatgaatttcaatgtcaagatggtaaatgtatatcgtataaatgggtatgtgatggttcggcggaatgtcaagatggttcggatgaatcgcaagaaacgtgtttatcggttacgtgtaaatcgggtgatttttcgtgtggtggtcgtgttaatcgatgtataccgcaattttggcgatgtgatggtcaagttgattgtgataatggttcggatgaacaaggttgtccgccgaaaacgtgttcgcaagatgaatttcgatgtcatgatggtaaatgtatatcgcgacaatttgtatgtgattcggatcgtgattgtctagatggttcggatgaagcgtcgtgtccggttctaacgtgtggtccggcgtcgtttcaatgtaattcgtcgacgtgtataccgcaactatgggcgtgtgataatgatccggattgtgaagatggttcggatgaatggccgcaacgatgtcgtggtttatatgtttttcaaggtgattcgtcgccgtgttcggcgtttgaatttcattgtttatcgggtgaatgtatacattcgtcgtggcgttgtgatggtggtccggattgtaaagataaatcggatgaagaaaattgtgcggtagcgacgtgtcgtccggatgaatttcaatgttcggatggtaattgtatacatggttcgcgacaatgtgatcgtgaatatgattgtaaagatatgtcggatgaagtaggttgtgtaaatgttacgctatgtgaaggtccgaataaatttaaatgtcattcgggtgaatgtataacgctagataaagtatgtaatatggcgcgagattgtcgagattggtcggatgaaccgataaaagaatgtggtacggcggaatgtctagataataatggtggttgttcgcatgtttgtaatgatttaaaaataggttatgaatgtctatgtccggatggttttcaactagttgcgcaacgacgttgtgaagatatagatgaatgtcaagatccggatacgtgttcgcaattatgtgtaaatttagaaggtggttataaatgtcaatgtgaagaaggttttcaattagatccgcatacgaaagcgtgtaaagcggtaggttcgatagcgtatttattttttacgaatcgtcatgaagttcgaaaaatgacgctagatcgatcggaatatacgtcgttaataccgaatttacgtaatgtagttgcgttagatacggaagtagcgtcgaatcgtatatattggtcggatttatcgcaacgtatgatatgttcgacgcaactagatcgagcgcatggtgtatcgtcgtatgatacggttatatcgcgagatatacaagcgccggatggtctagcggttgattggatacattcgaatatatattggacggattcggttttaggtacggtttcggtagcggatacgaaaggtgtaaaacgaaaaacgttatttcgagaaaatggttcgaaaccgcgagcgatagtagttgatccggttcatggttttatgtattggacggattggggtacgccggcgaaaataaaaaaaggtggtttaaatggtgttgatatatattcgctagtaacggaaaatatacaatggccgaatggtataacgttagatctactatcgggtcgtctatattgggtagattcgaaattacattcgatatcgtcgatagatgtaaatggtggtaatcgtaaaacgatattagaagatgaaaaacgtttagcgcatccgttttcgttagcggtttttgaagataaagttttttggacggatataataaatgaagcgatattttcggcgaatcgtctaacgggttcggatgtaaatctactagcggaaaatctattatcgccggaagatatggttctatttcataatctaacgcaaccgcgtggtgtaaattggtgtgaacgaacgacgttatcgaatggtggttgtcaatatttatgtttaccggcgccgcaaataaatccgcattcgccgaaatttacgtgtgcgtgtccggatggtatgttattagcgcgagatatgcgatcgtgtttaacggaagcggaagcggcggttgcgacgcaagaaacgtcgacggttcgactaaaagtttcgtcgacggcggtacgaacgcaacatacgacgacgcgtccggtaccggatacgtcgcgtctaccgggtgcgacgccgggtttaacgacggtagaaatagtaacgatgtcgcatcaagcgttaggtgatgtagcgggtcgtggtaatgaaaaaaaaccgtcgtcggttcgagcgttatcgatagttttaccgatagttctactagtttttttatgtctaggtgtatttctattatggaaaaattggcgtttaaaaaatataaattcgataaattttgataatccggtatatcaaaaaacgacggaagatgaagtacatatatgtcataatcaagatggttattcgtatccgtcgcgtcaaatggtatcgttagaagatgatgtagcg

SEQ ID NO: 16138 - DNA, 2580 bp, Artificial Sequence
  Description of Artificial Sequence: Synthetic coding sequence
atgggaccatggggctggaaactgaggtggacagtggctttgctgcttgccgccgctggtactgctgtgggagaccgctgtgagcgtaacgagtttcagtgccaagacggaaagtgtatttcatacaagtgggtgtgtgacggctcagcagagtgtcaggatggaagtgacgaaagccaagaaacctgtcttagcgtaacatgtaaatccggagacttttcctgcggtggtcgcgtgaatcgctgtattcctcaattttggcgctgtgatggacaggtggattgcgacaacggatccgatgagcaaggttgtccccctaaaacctgttcacaagacgagtttaggtgtcacgatggaaagtgtatctcacgtcagttcgtgtgcgacagtgatcgtgattgtttggacggatcagatgaggcctcatgtccagtcctgacctgcggaccagcctcatttcagtgtaattcatccacttgtatcccccagctctgggcatgcgacaatgaccctgactgcgaggatggctccgacgagtggccacagagatgtaggggactctatgtttttcagggagattcctccccttgctctgctttcgaattccactgtctcagtggtgagtgtattcatagttcctggagatgcgacggcggccccgattgcaaggacaagagcgatgaggagaactgtgctgttgctacatgccgccctgacgagttccagtgctctgatggtaactgcattcacggcagccgtcaatgtgaccgtgaatatgactgcaaggatatgtccgacgaagtgggctgcgttaatgtgaccctgtgcgaaggaccaaataagtttaagtgccactcaggcgagtgtattactctggacaaggtgtgtaatatggctcgcgactgtagggattggagcgacgagcccattaaggaatgcggaactgctgagtgcctggataacaatggtggctgtagtcatgtgtgcaacgacctcaagataggctacgagtgcctttgccctgatggtttccagctggtagcccagagacgttgcgaagacattgacgagtgccaggatcccgacacatgctcacagctctgcgtgaacctcgaaggcggctacaagtgccaatgcgaagaaggttttcagctggacccacacaccaaagcatgcaaagcagtaggatctattgcatacttgttcttcacaaatagacacgaagttcgcaagatgaccctggataggtccgagtacacttcacttatacctaatctgcgcaatgttgttgcactcgacactgaggtagcctcaaacagaatttactggtccgatctttctcagcgcatgatttgctctacacaactcgaccgcgcccacggtgtaagtagttacgatactgttatctcccgcgatatccaagcccctgacggactggccgtagactggattcactccaacatctattggaccgatagtgtgctcggtaccgtaagcgttgctgacacaaaaggagtgaaacgcaaaaccctcttccgcgagaacggttccaagcccagggctatagtcgtcgacccagtacatggattcatgtattggacagactggggaacaccagctaagatcaagaagggcggcttgaacggcgtagatatttactcacttgtgaccgagaatatccaatggcccaacggtataactctcgacctcctgagcggacgtttgtactgggttgatagcaagcttcactctatctcctcaatcgacgttaacggtggtaacagaaagactatcctggaggatgagaagcgtcttgcccacccattctctctggccgtattcgaggacaaggtcttttggactgatattatcaacgaagcaattttttctgctaatagactcactggatcagacgtgaaccttctggccgaaaacctgctctcacctgaagacatggtgctgtttcacaacctgacccagcctcgtggcgtcaactggtgcgagcgcactactctgagtaacggaggatgccagtacctgtgtttgcccgccccacagataaaccctcatagccctaaattcacatgtgcatgcccagatggtatgctcctggcccgcgatatgcgttcttgtctgaccgaagccgaagctgccgttgccacccaagagaccagcactgttagactcaaggtgtcttccactgctgtgcgtactcagcacactacaaccaggccagtacccgacaccagccgtctgcccggagccacacctggactgactactgtagagatcgtgacaatgtctcaccaagccctgggtgacgtggccggccgtggcaacgagaaaaagccttctagcgttcgcgctctgtctattgttcttccaatcgtactgctggttttcctttgtctcggagtattcctcctctggaagaactggagactcaagaacatcaactcaattaattttgacaatcctgtttaccagaaaacaacagaggatgaagtgcacatctgtcacaatcaggacggctattcatacccctcacgtcagatggtgtcccttgaggatgacgtggcc

SEQ ID NO: 16139 - DNA, 2580 bp, Artificial Sequence
  Description of Artificial Sequence: Synthetic coding sequence
atgggtccttggggttggaaacttagatggactgtggcactccttctggcagcagcaggtacggccgtgggcgaccgctgcgagagaaacgagtttcaatgtcaggacgggaagtgcatcagctacaaatgggtgtgcgacggatcggcagagtgtcaggacggaagcgatgaatcccaagaaacctgtctttcggtcacctgcaagtccggtgacttttcctgtggaggacgcgtgaataggtgcatccctcagttttggcgctgtgatgggcaggtggactgtgataacggatcagacgagcaaggttgcccacctaaaacctgttcgcaggatgagttccgctgtcatgatggaaagtgtattagccgacagtttgtctgcgattcggacagagattgcctggatggctccgatgaagcctcctgccctgtgcttacctgtggaccggccagctttcagtgtaacagctccacgtgcattccacaactttgggcctgcgacaacgacccagattgtgaagatggtagcgatgaatggcctcaacgttgtagaggactctacgtgtttcaaggtgactcttcaccctgtagcgcattcgaatttcattgtctttccggagaatgcatacactcatcgtggcgttgtgatggcggtccggattgtaaagacaagtccgatgaggagaactgtgcagtggccacttgtcgccctgatgagtttcagtgctcggatgggaattgtattcacggatcccgacaatgtgatcgcgagtacgactgtaaagacatgtcggacgaggtgggatgtgtgaatgtgaccctgtgcgaaggtcccaacaagttcaaatgccacagcggggaatgtatcactctggacaaggtctgcaacatggccagagactgtagggattggtccgacgaaccaattaaggaatgcggaactgcagaatgtcttgataacaacggcggatgttcccacgtgtgcaacgatctcaaaattggatatgagtgtctgtgccctgatggctttcagcttgttgcacagagacggtgtgaagatattgacgaatgccaagatccagatacttgttcacaactctgtgttaatctggaggggggctacaaatgtcagtgcgaggaagggtttcaactggaccctcataccaaggcctgtaaggcggtcggttcaatcgcataccttttcttcactaaccggcacgaagttaggaagatgactctcgataggtcagaatacacctccctcattcccaatcttcgtaacgtggtggcactggatactgaagtggccagcaatagaatctactggtcagatctctcgcaacggatgatttgctcgacccaactggatagagcacatggagtgagcagctatgataccgtcatctcgcgggacatccaagcaccggacggtctggcggtggattggatacattcgaacatctactggacggactcggtccttggcaccgtgtccgtggcagatactaagggcgtgaagagaaagacgctgtttcgggaaaacggatcgaagccacgggctattgtcgttgaccctgtgcacggttttatgtactggaccgattggggaacccctgcgaagattaagaagggtggccttaacggtgtggacatatactctctggtgaccgaaaacattcagtggccaaacggaattaccctggacctcctttccggacggctgtactgggtcgattccaagctccatagcattagctcaattgatgtaaacggaggaaatcgcaagaccatcctcgaagatgaaaagcggctcgcccatcctttttcgctcgcagtgtttgaggataaagtattctggaccgacataatcaacgaggccatattctctgctaaccgtcttacgggttccgacgtgaacctccttgcggagaatcttctgtcccccgaggacatggtccttttccacaacctgacccagccgaggggcgtgaactggtgtgaaagaaccaccctctccaacggaggatgccaatacctgtgtttgcctgcacctcagataaacccacatagccctaaattcacttgcgcgtgccccgatggcatgctgctcgcacgggatatgagatcgtgcctcaccgaagccgaagcggctgtggcgacccaggagacttcaactgttcgcctcaaggtcagctccaccgcagtgcgcacccaacataccactacgcgccctgtgccagacactagtaggttgcctggggccactccaggcctgactactgtcgaaatcgtcaccatgagtcatcaagcacttggtgacgtcgccggtcggggtaacgagaagaagccctccagcgtgcgggcactttctattgtgttgcccattgtgctgcttgtctttctttgtcttggagtgtttctgctgtggaaaaactggagactcaagaacatcaactcaataaacttcgacaatccagtgtatcaaaaaaccaccgaggacgaggtgcatatttgccataatcaagatggttacagctacccttcgcgccagatggtttccctggaggacgatgtggca

SEQ ID NO: 16140 - DNA, 2580 bp, Artificial Sequence
  Description of Artificial Sequence: Synthetic coding sequence
atgggtccttggggttggaagctgcgctggacggtggcactgctgttagcggccgcaggcactgccgtcggcgaccggtgcgaacgcaatgagtttcagtgccaggacggcaaatgcatctcttacaaatgggtgtgcgatggttccgctgaatgccaagatggcagcgatgagagccaggaaacctgcctcagcgtcacctgtaagtctggtgacttttcttgtggcggcagggtcaaccgctgcatccctcagttctggcggtgcgacgggcaagtggattgcgataacggatcggacgaacaaggttgcccgccaaaaacctgcagccaggacgagttccgttgtcacgacggtaagtgcatcagccgtcaatttgtgtgcgattcggaccgagactgtctggacgggagcgacgaagcgagctgccctgtcctgacttgtggtcctgcttcgttccagtgtaactcatccacttgcattccacagctttgggcttgcgacaacgacccagactgtgaggatggaagcgacgagtggccccagcggtgtcgcggcctttacgtgttccagggagattccagcccttgcagcgcattcgaatttcattgcctgagcggcgagtgtatccacagcagctggcgttgcgatggtggcccggattgcaaggataaaagcgatgaagaaaactgcgcagtggccacgtgtcgccccgacgagttccagtgctccgacggcaactgtatccacgggtcccgccagtgcgatcgcgaatacgattgcaaggacatgtccgatgaggtgggttgtgtcaacgtcactctgtgtgaaggtcctaacaaatttaaatgtcatagcggcgaatgcatcaccctggacaaggtatgcaatatggcgcgtgattgtcgtgactggtctgatgagcctatcaaggaatgtggtacggcagagtgcctggataataatggagggtgtagccatgtgtgtaacgacctgaagatcggttatgagtgtttgtgtccagatggcttccagttggtggcccagcgcagatgcgaggatatcgatgagtgtcaggatcctgatacttgcagccaactgtgtgtcaacctggaaggcggttacaagtgccagtgcgaggaaggattccagctggaccctcataccaaggcctgcaaggctgtcggtagcattgcctatctgttctttaccaatcgtcatgaggttcgcaaaatgacgctggatcgaagcgagtacacgagcttgattccgaatttgcgcaacgtggtggcgctggacaccgaagtggccagcaaccgaatttactggagcgacttgtcccagcgcatgatttgctcaacgcagctggaccgcgcacatggcgtttcatcttacgacacagttatttcacgcgacattcaagcaccggacggattggcagtggactggatccactctaatatctattggacggatagtgttctgggcactgttagcgtcgcggatactaaaggtgtaaaacgaaagaccctattccgcgaaaacgggtctaaaccgcgcgcgattgtggtggaccctgtacatggctttatgtattggaccgattggggtaccccggccaagatcaagaaggggggtctgaatggcgttgatatctacagcttggtgactgagaatatccagtggcctaacggcataacgctggatttgctgagcggacgactgtattgggtggattccaagctacactcgatctcttcaattgacgttaatggtggcaatcggaagactattttggaagacgaaaagcgcctggcccatccatttagcctagccgtttttgaggataaggttttttggacggatatcatcaatgaggccattttctccgctaaccgcttgacaggttcggatgtgaacctgctggccgagaatctgttgagcccagaagatatggtcctgttccacaacctgactcagcctcgcggtgtcaattggtgtgaacgtaccactctgtcaaatggtggctgccagtatctctgcctaccggccccgcagatcaacccgcatagccccaagttcacctgtgcatgcccagacggtatgcttctcgcgcgtgacatgcgcagctgcttgacggaggccgaggcagccgtggccacccaagaaacttctactgtgcgcctgaaggtctcctcaactgccgtaaggacgcagcatacgacgacccgtcctgttccggatacgtcacgcctgcctggggccacgccgggtcttaccaccgtggaaattgtgactatgtcgcatcaagcccttggtgacgtggctggtcggggcaacgagaaaaagccttcttcagttcgagccctgagcattgtactgccaatcgtcctgctggtgtttctgtgcctgggtgtctttttactgtggaagaactggcgtttaaaaaacataaactctattaactttgacaaccctgtttaccaaaaaacaacggaagatgaggtgcacatatgtcacaatcaggacggttattcctacccaagccgccagatggtttctttagaagacgatgtggcg

SEQ ID NO: 16141 - DNA, 2580 bp, Artificial Sequence
  Description of Artificial Sequence: Synthetic coding sequence
atgggtccttggggctggaaactgaggtggactgtggcattgctactagctgcggctggaactgcagtaggagatcgttgcgaacgaaatgaattccaatgtcaagatggaaaatgtatctcgtataaatgggtatgtgatggatccgcagagtgccaagatggatccgatgaaagtcaagagacttgtttatctgttacatgtaagtcaggagatttctcatgtgggggtcgtgttaatcgatgtattcctcagttttggcgctgtgacggtcaagtagattgcgacaatggttcagacgagcagggatgtccaccaaagacatgttctcaagatgagttcagatgccatgatggaaagtgcatatcccgacagtttgtctgtgatagtgaccgtgactgcctcgatggatccgatgaagcttcatgcccggtgctcacatgcggcccagcctcattccaatgtaacagtagcacttgtatccctcaactttgggcttgcgataatgatccagattgcgaagatggatccgatgagtggccacaacgttgcagaggattgtatgttttccagggagatagttctccttgttcagcatttgagtttcactgcttgagcggagagtgcatccattctagttggagatgtgatggcggaccagactgcaaagataaaagcgacgaagaaaactgtgctgtagctacatgtcgtcctgacgaattccagtgctccgatggaaactgtattcacggtagtcgacagtgtgatagagagtacgattgtaaagacatgtcagatgaagttggatgtgtgaacgtaacactttgtgagggacctaacaagttcaagtgtcattcaggagaatgtatcacgttggataaggtctgcaatatggcaagagactgcagggactggtctgatgaaccaattaaggagtgtggaactgcagaatgccttgacaataatggaggatgttcacatgtttgtaatgatctgaaaattggttacgaatgcttgtgcccagatggattccaacttgttgcacaacgaagatgcgaggacatcgatgaatgtcaggatccggacacatgttctcaactttgtgtgaatttagagggaggctacaaatgtcaatgtgaagagggatttcaactcgatccacatacaaaagcatgcaaggcagttggatcaattgcatatctcttctttacaaaccgccacgaggttcgcaagatgactcttgatcgatctgaatatacctcacttataccgaacctgcgtaacgtagtagcattggacacggaggttgcttcgaatcgaatttactggtctgatttgtctcaacggatgatctgcagcactcagcttgacagggcacatggtgttagctcctacgataccgtcatttctcgggatatccaagctccagacgggttagctgtggattggatacattctaacatttattggacagattccgttctcggtaccgttagcgttgctgatacaaagggagtgaagcgaaaaactttgttcagagaaaatggctcaaagccacgagctatcgttgttgatccagtccatggattcatgtactggactgactggggaaccccggcaaagatcaagaaaggaggacttaacggagtcgacatatatagtttggtaactgagaatattcagtggccgaacggcataacacttgatcttctgtcaggtcggctgtattgggtcgactctaaactccactctatctcttccattgacgtgaacggaggaaaccgtaaaactatattggaggatgaaaaaagactggcccatccgttctcgctcgctgttttcgaggacaaggtgttttggacagatattatcaacgaagctattttttcagcaaaccggttaactggaagtgatgtgaatctcctcgcagagaatctgttaagtccggaagatatggttcttttccacaacttgacacaaccaagaggcgttaattggtgtgaacgaaccacattatcaaatggaggatgccagtacttgtgcttaccagcaccacagatcaatcctcacagccccaaattcacatgcgcttgcccagatgggatgcttttagcaagggatatgcgttcatgcttaaccgaagctgaggctgcggtggctacacaagaaacgtcgacagtccgtctcaaagtttcatctacagctgttcgtacccaacatacgacgacacgaccagtcccggatacttcgagacttccgggtgctacacccggtcttacgaccgtagagatcgttaccatgtctcaccaggcattgggtgatgttgctggacgaggaaatgagaagaaaccaagttcggtgcgagcattgtcaattgttctacctattgtgttattagttttcctctgccttggcgtgttcttactgtggaagaactggcggctcaaaaacatcaattccatcaatttcgataatccagtgtatcagaaaacaacagaagacgaagtgcatatctgccacaatcaagacggatactcatacccatcacggcagatggtttcgctggaagacgacgtggct

SEQ ID NO: 16142 - DNA, 2580 bp, Artificial Sequence
  Description of Artificial Sequence: Synthetic coding sequence
atgggtccttgggggtggaagctgcggtggactgtcgctttgttactagccgccgcggggaccgccgtgggagaccggtgcgagcgcaatgagtttcagtgtcaggacggcaaatgcatatcatataagtgggtgtgcgacgggtcggcggaatgccaggacggaagtgacgagtctcaggagacatgtctgagcgtaacttgcaagtctggcgacttttcctgtggtggacgtgtgaacaggtgtatcccacagttctggcggtgtgacgggcaggtagactgtgataacgggagtgacgaacagggatgcccacctaaaacctgctcacaggacgagttccgatgtcacgacgggaaatgcatcagccggcagtttgtctgtgactccgaccgagactgtctggacgggagcgacgaggcctcttgccccgtgttgacatgcggccccgcaagctttcagtgtaactccagcacctgtataccacagctgtgggcttgtgacaacgacccggactgtgaggacgggagtgatgaatggccccaaaggtgccggggcctgtacgttttccagggagacagtagcccctgtagcgcgtttgaatttcattgcctgagtggggagtgcatccatagctcttggcgctgtgacgggggacctgattgcaaggataagagtgatgaagaaaattgcgccgttgcaacttgccgtccggatgagtttcagtgcagtgacggaaattgcattcatgggagtcgccaatgcgaccgggaatatgattgcaaagatatgtctgacgaggtcggatgtgttaacgtgacgctttgtgaagggcctaataagttcaagtgccactcaggcgagtgtatcactctggacaaggtctgcaatatggcaagagactgtcgcgattggagcgacgagccgatcaaggagtgtgggactgccgaatgtcttgataataacgggggttgttctcacgtatgcaatgatctgaagatcggttacgagtgtctgtgtccggatggtttccagctagtggcacagcgcagatgcgaagacattgacgagtgccaggacccagatacatgttcccagttgtgtgtaaacctggaaggcggatataaatgccagtgcgaggagggtttccagctggatccccatacgaaggcgtgtaaggctgttgggagcattgcgtacctgttcttcactaatcggcacgaggtgcgaaagatgaccctcgatcggtccgaatacacgagtctaatcccgaacctgaggaacgtggtggcactcgatactgaggtcgcctcaaaccgaatttattggtcagatctcagtcagagaatgatctgctctacccagctggaccgagcccatggcgtgtccagttatgacacagttatctccagggacatacaggctcctgatggcctggccgtcgattggattcatagtaacatatattggactgattcagtgttaggcacggtaagcgtcgccgatacaaaaggcgtaaaacggaagactctgttccgggagaatggcagcaagccgcgggccattgtggtggaccctgttcacgggtttatgtattggaccgactgggggacacccgcaaaaatcaaaaaggggggactcaacggagttgatatctatagccttgtaactgaaaatatacagtggcccaacgggattacgctagacctcttgtcaggccgtctgtactgggtggactccaagcttcatagtatctcctccatcgacgttaacgggggcaacagaaagacaattttggaagatgaaaaacggctggctcatccgttttccctcgcggttttcgaagataaagtgttttggacagacattattaatgaagccatattctccgcaaacagactaaccggaagcgacgtcaatcttctggccgaaaacttactgtcccctgaagacatggtgctctttcataatctgacgcagccccgaggcgtgaactggtgtgagcgcacaaccctgtctaacggcgggtgccaatacctttgcctccccgccccgcagatcaatccccactcaccaaagtttacgtgtgcttgtcccgatgggatgctgctggcgcgggatatgcgaagctgtcttacagaagctgaagcagccgtggctactcaggagacctccaccgtcaggctgaaggtcagtagtactgccgtgcggacacagcatacaacgacaagacctgttcctgacacatcacgcttgcccggcgcaactccgggcctgacaacggtggaaatcgttacaatgtcacaccaggccctcggggatgtggctgggagggggaatgagaagaaaccctcaagcgtgcgggccttgagtatcgtgctgcccattgtcctgctcgtgtttctctgtttgggggtgttcttgctatggaaaaattggagattgaaaaatatcaacagtattaattttgacaaccctgtctaccaaaagacgacagaagacgaagtccacatctgccataatcaagatggctactcctatccgtccaggcaaatggtgagtctggaggacgacgtggca

SEQ ID NO: 16143 - DNA, 2580 bp, Artificial Sequence
  Description of Artificial Sequence: Synthetic coding sequence
atgggcccctggggatggaaactgaggtggacggtcgcactcctcctagccgccgccggaacggccgtaggggacaggtgtgaaagaaatgagttccaatgtcaggacggtaaatgcatatcctataagtgggtgtgtgacgggtctgcagagtgccaagacgggagcgacgagtctcaagagacctgtcttagcgtcacctgtaagtcaggtgacttttcctgcggaggaagggtaaacagatgcatcccacagttctggcgatgcgacggacaagtggactgtgataatggcagtgatgagcagggctgtccaccaaaaacatgcagtcaagatgagtttaggtgccacgacggaaagtgcattagtcgtcagtttgtgtgtgactcagatcgtgactgcttggatggctcggacgaggcttcttgcccagtgctcacctgtggtcccgcctcctttcaatgcaatagctctacgtgtataccccagctctgggcctgtgataatgacccggattgtgaggacgggagcgatgaatggccacagcgttgtaggggtctctacgtttttcagggagatagctctccctgtagtgcattcgaattccattgcctgtccggcgagtgcattcactcctcttggcgatgcgatggaggccccgattgtaaggataaaagcgatgaagaaaattgtgctgtggcaacctgtaggcccgatgagtttcagtgctccgacgggaattgcatccatgggtcaaggcagtgtgaccgagagtacgactgcaaggatatgagtgacgaagtgggatgcgtgaatgttacgctgtgtgaagggcctaacaagtttaagtgtcattccggcgaatgtattactttagacaaggtgtgtaatatggctagagattgtagggattggtctgacgagccaatcaaagagtgtggaaccgcagagtgcctggataataacggcgggtgctctcacgtctgcaacgatctgaagattggttacgaatgtctctgccccgacggcttccagttggttgctcagaggcggtgtgaggacattgatgaatgccaggatccggatacttgctctcaactgtgcgtgaaccttgaggggggctataaatgccagtgcgaggaaggattccagctggatccacatactaaagcgtgtaaagcagtggggtcaatcgcttatctgttcttcaccaatcgtcacgaggtgcggaaaatgacgctcgatcgatcagagtacacctctttgatccctaatctgagaaatgttgtcgcactggatactgaggtggcaagtaatcgaatctactggagcgatctgtcccagaggatgatttgtagtactcagctagatcgagcccacggagtctcctcctatgacaccgtcatttcacgagatattcaggccccagacggccttgctgtggattggattcactcaaatatctattggacggattcggtccttggtacagtttccgttgcagacacaaagggtgtgaagaggaagaccctctttagggaaaacggctcgaagcctagagctatcgttgtggaccctgtgcatggattcatgtactggacagactgggggactcctgcgaaaattaagaaggggggactgaatggcgtggatatttattccttagttacagagaatatccagtggcccaacgggatcactctggaccttctctctggtagattatactgggttgattctaaacttcattcaatcagtagcatcgacgtgaatggtggcaacaggaagacaattttggaagatgagaagagactggcccaccctttttccttggccgtctttgaggacaaggtgttctggacagatataataaacgaggccatcttcagtgccaacagattgaccggatccgacgttaatcttctggccgagaacctgctgagtcctgaagacatggtcctctttcataacctaacccagcctagaggggtcaattggtgcgaaagaactacgctctctaatggcggctgccagtacctttgtctacccgcgccacagatcaacccacattcaccgaagtttacttgcgcatgccctgacgggatgcttcttgctagggacatgagaagctgtctgactgaggccgaagccgccgtggctacccaagaaacaagcacggtgaggttgaaggtaagcagcaccgcggtgcggacccagcatactacaacgagacccgtgcccgacacatccaggcttccaggggctactccaggcctgacgacagtcgaaatagtgaccatgagccaccaggcccttggtgacgtggccggcagaggtaatgagaagaagccgagtagtgtgcgagcgctttccatagtgctgccgattgtgttgcttgtgttcctctgtttgggagtttttctgctgtggaagaactggaggctcaagaatataaacagtattaactttgacaatccagtgtaccagaagaccaccgaagacgaagtccatatttgccacaatcaggacggctattcatatccaagtaggcagatggtaagcctggaagatgatgtggcc

SEQ ID NO: 16144 - DNA, 2580 bp, Artificial Sequence
  Description of Artificial Sequence: Synthetic coding sequence
atgggcccttggggatggaaactccgatggaccgttgctctcctgctcgcagcagcaggcaccgctgtcggagataggtgcgaaagaaacgagttccagtgtcaggacgggaagtgcatctcatacaaatgggtctgcgatgggagcgcagaatgccaagacggaagcgatgagtcacaagagacatgtctgtccgtgacctgcaagagcggagacttcagctgtgggggaagggtgaacaggtgtatcccccagttctggcgatgtgacggccaagtggactgcgacaacggaagtgacgaacaaggatgtccacctaaaacttgcagtcaagacgagtttcgctgccacgatggcaaatgtatcagccggcaattcgtgtgcgactcggaccgggactgccttgatggctctgatgaggcttcttgccccgtcctcacatgtggacccgctagcttccagtgtaacagttcaacatgtattccccagctgtgggcatgcgataacgatcccgactgcgaagatgggagcgacgagtggcctcagagatgccgcggactctacgtgtttcaaggcgacagtagcccctgttcagctttcgagttccattgcctctctggcgagtgcatccatagctcttggagatgcgacggggggcctgactgcaaggataagtccgatgaggaaaactgtgcagttgcaacatgcaggcccgatgagttccagtgtagcgatggaaactgcattcatggcagccgccaatgcgaccgcgaatacgattgcaaagacatgagcgacgaagtcgggtgtgtgaacgttactctgtgcgagggcccaaacaagtttaagtgccattccggggagtgcataacgctggacaaagtctgcaatatggccagggattgtcgggactggagcgacgaaccaattaaagaatgtggaacagccgagtgtctggataacaacggaggatgcagccacgtgtgcaatgaccttaaaattggttacgagtgcctgtgccccgacgggtttcagctggtcgcacaaaggagatgtgaagacatagatgaatgccaagatccagacacctgttcccagctctgcgtgaacctggagggcggttataagtgccaatgcgaagagggattccagttagatccccacactaaggcctgtaaggctgttggcagcatcgcttacctgtttttcaccaacaggcatgaagtcaggaaaatgactctggataggagcgagtacacctcactgatccccaatctccgcaacgtggtggcccttgacacagaggttgcttctaataggatctactggagtgacctgagtcagcgtatgatatgctctactcaactggatcgggcacacggcgtgtcaagctatgataccgtgatcagtcgggatatccaagcgccagatggcttggctgttgattggatacatagcaatatttactggaccgacagcgtacttggtacggtgagcgtggctgacaccaagggcgtgaaaaggaaaacattattccgcgaaaacggaagcaagccacgcgcaatcgtggtggaccctgtgcatggatttatgtattggactgattggggaaccccagctaagatcaagaagggtggactgaacggagtggacatctactctcttgtgaccgagaatattcagtggccgaacggcattaccctggatctccttagtggcaggctgtattgggtcgattctaagttgcattccatcagctccatagacgtgaacgggggaaacaggaagaccatccttgaagatgaaaagagactggcccacccatttagtctggctgtatttgaagataaagtgttttggaccgacatcatcaacgaggcgattttttccgctaatcgtctaactggcagtgatgtgaacttgctggccgagaacctgctttcacctgaagacatggtgctgttccacaacttaacccagccgaggggagtcaattggtgtgagcgcaccacactgtcgaacggcggatgccagtacctttgcctgcctgctccacaaatcaacccacattccccgaagtttacgtgcgcctgcccagatggcatgctgttggccagagacatgcgcagctgtcttacagaggcagaagctgccgttgccactcaggagaccagtactgttaggcttaaagtgagtagcaccgctgtaagaacccagcacacaacaacacggcccgtgccagacacctctagattgcctggagccacccccggtcttaccactgtggaaatagttacaatgtcccaccaggcactcggtgatgtggccggaagaggcaacgagaagaagccaagcagcgtgagagctctgtcaatcgtgttgcctatcgtgctcctggtgtttctgtgtctgggcgtctttttgttgtggaagaactggcgcctgaaaaacatcaactcgattaacttcgacaaccccgtttatcagaaaacaacagaagacgaggttcacatatgtcataaccaagacggatatagttatccctcaaggcaaatggtctccctcgaggatgatgtagca

SEQ ID NO: 16145 - DNA, 2580 bp, Artificial Sequence
  Description of Artificial Sequence: Synthetic coding sequence
atgggtccttgggggtggaaattgaggtggacagttgcgttgctgctggcggctgccggcactgccgtcggagataggtgtgaacggaatgagttccagtgtcaagacggcaaatgtatctcttataagtgggtgtgcgatggcagcgccgagtgtcaggacggttctgacgagagtcaagaaacttgtctcagtgtgacctgtaagagtggggatttctcttgtggagggcgcgttaatcggtgcatcccccagttctggagatgtgacggccaggttgattgcgacaatggcagtgatgagcaaggctgtccaccaaagacttgctcccaggatgagttccggtgtcacgacggaaaatgtatcagccggcagtttgtgtgcgattccgatagggattgcctggacgggtccgacgaggcttcatgccctgtgttgacttgcggtccagcctcgtttcagtgcaatagttcaacctgcatccctcagctgtgggcatgtgataacgatccggactgcgaggatggatctgacgaatggcctcagagatgccggggattatatgtattccaaggcgattcctccccttgcagcgccttcgaattccattgtctgtccggggagtgtattcactcctcgtggcgctgtgacgggggcccagattgtaaggataagtccgacgaagaaaactgcgcagtggctacttgcagaccggacgaatttcagtgttcagacggtaattgcatccacggcagccgccaatgcgacagagaatacgactgcaaggatatgtctgatgaggtcgggtgcgttaacgtgaccctgtgtgaaggccccaacaagtttaagtgtcattcgggcgagtgtatcacactggataaagtgtgcaacatggccagagattgtcgagactggtcagatgagccaatcaaagagtgtgggaccgcagaatgcctcgataacaacggtgggtgctcacatgtgtgcaacgatttaaagatcggctacgagtgtctgtgcccagacgggttccagttagtcgcccaacggagatgtgaagatattgatgagtgtcaggaccctgatacttgctcacagctctgcgtgaacttggagggaggctataagtgccagtgcgaagaagggtttcagctcgatccccacacgaaggcttgcaaagcagtcggctccatagcatatctgttcttcaccaaccgtcatgaggtcaggaagatgacccttgacagatccgagtacacatctctgattcccaacctgagaaatgtggtcgctcttgatactgaggtggcatctaaccgcatttattggtctgacctgtctcagcgtatgatatgtagtacacagttagatcgcgctcacggggtttccagttacgataccgtcatcagtcgagatattcaggcaccagatgggctggccgtggactggatacattccaatatttactggaccgattcagtactggggaccgtgtcggtcgccgataccaaaggtgtgaaacgtaagacactgtttcgggagaacggcagcaagccacgggctatagtggtggatcccgtgcatgggttcatgtactggactgattggggcacaccggccaagattaagaaaggggggttgaatggagttgacatatactccctggtcaccgaaaacattcaatggccaaacgggataaccctcgacctgctgtctggacgtctgtactgggttgactccaaactgcattccatttctagcatcgacgtcaacggcggcaatcgaaaaaccattctggaagacgaaaaaagacttgctcatccattcagcctagccgttttcgaggataaggtgttctggaccgatattattaacgaggcgattttcagcgcaaaccgcctaacaggatctgacgtcaaccttctcgctgagaacttactatcaccagaggacatggtcctgttccataacttaacccagccaagaggcgtgaactggtgcgaacgaaccactctcagtaacggaggctgccagtacctatgcctcccggcccctcagatcaacccacactcaccaaagttcacgtgtgcctgtcccgatggtatgctccttgccagagatatgcgaagctgtttgactgaggccgaggcggcagtcgcgacacaggagacttccacggtcagactgaaggtgtcgtctaccgcggtgaggacacagcacacaacaactcgcccagtcccggatacatcacggctgcccggcgctaccccgggcctcaccacagtagagattgtgactatgtctcatcaggctctcggggatgtcgccggcagaggaaatgaaaaaaaaccgtctagtgtgcgtgcgcttagcatagtcctgccaattgtactgctcgtctttctttgtcttggggtgtttctgctgtggaaaaattggcggctgaagaacatcaacagtattaatttcgataatcccgtgtaccaaaaaacaaccgaggatgaggttcatatttgtcacaatcaggatggttactcatacccctcgcgccaaatggtctcactggaagacgacgtggct

SEQ ID NO: 16146 - DNA, 2580 bp, Artificial Sequence
  Description of Artificial Sequence: Synthetic coding sequence
atgggcccttggggatggaagctgcgctggaccgtggcgctgctgctggcagccgcggggactgccgtcggtgacagatgcgagagaaatgaattccaatgccaggacggtaagtgcatctcctacaagtgggtgtgcgatggaagcgccgagtgccaagacggtagcgacgaaagccaggaaacgtgtctgtcggtgacctgtaaaagcggagacttctcctgcggaggccgggtcaacagatgtatcccgcagttttggaggtgcgacgggcaggtggattgcgataacggatcagatgagcagggatgcccacctaagacttgctctcaggacgagttcagatgccacgacggaaaatgcatctcgagacaattcgtttgcgattctgaccgggactgcctggacggatctgacgaagcgtcctgcccggtgttgacttgtggcccggcgtcgtttcagtgcaactcgagcacctgcatccctcagctgtgggcatgcgacaatgatccggactgcgaagatgggtccgacgaatggccacagcgctgccggggtctgtacgtctttcagggagattcctcgccgtgctcggccttcgaattccactgcttgagcggagagtgtatccacagttcatggcgctgtgatggagggcctgattgcaaggacaagagcgacgaagaaaactgtgctgtggctacctgccgcccggacgaattccagtgttcagacggaaactgcatccacggatcgcggcaatgcgatcgcgaatacgactgtaaggatatgtccgatgaagtgggatgtgtgaacgtgactctgtgcgagggcccaaataagttcaagtgccactcgggcgagtgcatcaccctggacaaggtgtgcaacatggcacgagattgccgggattggtcggatgaacccatcaaggagtgcggaactgctgaatgccttgacaataatggaggatgcagccatgtgtgtaatgacctgaagatcggctacgaatgcctgtgtccagatggtttccagcttgtggcgcagcggcgctgcgaggacatcgacgagtgccaggatcccgacacttgcagccagctgtgcgtgaacctggaaggaggttacaagtgccagtgtgaggaaggattccagttggaccctcataccaaggcctgtaaggccgtcggatcgatcgcctatctcttctttaccaatcggcacgaggtgcgcaagatgactcttgaccgctccgaatacacctcgctgattcctaacctccggaacgttgtcgctctggatacggaggtggcgtccaatcggatctactggtccgacctgagccaacgtatgatctgctcgacgcaactggatcgcgcacatggcgtgtcatcatacgacaccgtgatctcaagagacatccaggccccagatggcctcgctgtcgactggatccactcaaacatttactggaccgacagcgtgctcggaaccgtgtccgtggccgacactaagggagtgaaacgcaagactctcttcagagaaaacggatcgaaaccacgcgcgatcgtggtggatcccgtccacggtttcatgtactggactgactggggcaccccggcaaaaatcaaaaagggtggcctgaacggagtggatatctattccctggtgactgagaacatacaatggccaaatgggatcactctcgacctcctgtccgggcgcctctactgggtcgactcaaaactccattccatctcgtccatcgacgtcaatggaggcaaccgcaaaactattttggaggatgaaaaacggctcgcgcacccattctcattggccgtgttcgaggacaaagtgttctggacggacattatcaatgaggcgatctttagcgccaacagactgaccggcagcgatgtcaatctcctcgctgaaaacctgctctccccagaggatatggtgctctttcataacctgactcagccgcgaggcgtcaattggtgtgaacgcaccaccctgtccaacggagggtgtcaatacctgtgcctgccggcgccgcaaattaacccccattccccgaagttcacctgcgcttgccctgatggaatgcttctcgcccgggacatgcggtcgtgcctgactgaggccgaagcagccgtggccacccaagaaaccagcaccgtccggctgaaggtatcgtcgaccgcagtgaggactcagcatacgaccactaggcctgtgccagatacctcgcgactgccgggagcaactccgggactcaccaccgtggaaattgtcacgatgtcacaccaagcccttggcgacgtggccggtaggggcaacgaaaagaaaccctccagcgtcagggcactttcgatcgtccttccgatcgtgctcttggtctttttgtgtctgggggttttcctcctgtggaagaactggaggctgaagaatatcaactcaatcaacttcgacaatccggtgtaccaaaagactactgaggatgaggtccatatttgtcacaaccaggatgggtactcatacccgtcaagacaaatggtgagtttggaggacgacgttgcg

SEQ ID NO: 16147 - DNA, 2580 bp, Artificial Sequence
  Description of Artificial Sequence: Synthetic coding sequence
atgggaccatgggggtggaagttgcgttggactgtggcactgttgctggcagccgccggcaccgcagtgggcgaccgctgtgagaggaatgaatttcaatgtcaggacgggaaatgtatttcttacaaatgggtctgtgatggatctgccgagtgccaagacggatctgatgagtcccaggaaacctgcctgtcagtgacctgcaagtctggcgattttagttgcggtggtagagttaaccgctgcattccccaattttggagatgcgatggccaggtggactgtgataatggctccgacgagcagggttgtcctccaaaaacgtgctcccaagacgagtttcgttgccacgatgggaagtgcatatcacgccagttcgtctgcgactctgatcgcgactgtcttgacggatctgatgaagcatcatgcccagtcctgacctgtggaccagcctcatttcagtgtaacagttccacatgcattccccaactctgggcgtgcgacaatgatcccgactgcgaggacggaagtgacgaatggcctcagcgctgtcgtgggctgtatgtctttcagggggacagttcaccctgctctgcatttgagttccactgtttaagcggagagtgcattcattccagttggcgttgcgacggagggcctgattgcaaagataaatccgacgaagagaactgcgcagtagctacttgcagacccgatgagttccagtgttccgacggaaattgtattcatggaagccgccagtgcgacagggagtacgactgtaaggacatgagcgatgaagtggggtgcgttaacgtgactctttgcgagggcccaaacaagtttaagtgtcacagtggggaatgtattacactggataaagtctgcaatatggcccgcgactgcagagattggtcagacgagcccattaaagagtgcgggacagcagaatgtctggacaataacggaggatgcagtcacgtatgcaatgatctaaagatcggctacgagtgcttgtgccctgatggatttcagcttgtagcacagcgccgctgtgaagacatcgacgagtgccaggaccctgatacatgtagccagctgtgcgtcaacttagagggaggatataaatgccagtgtgaggaaggtttccaactagatccccatactaaggcctgcaaagcggtggggtctattgcctacctcttcttcacaaatcgccatgaggtcagaaaaatgactctcgatagatccgagtacactagccttatccctaatctcagaaatgtggtcgccctcgatacagaagtggcaagtaatcggatttactggtccgaccttagccaaagaatgatttgttccacccagcttgacagagctcacggggtcagcagctacgataccgtaataagccgcgacatacaggcccccgatggtttagcagttgactggatacactcaaacatttactggaccgactccgtgctaggtaccgtgtcagtcgccgacacaaagggtgtgaaacgcaagaccctctttagagaaaacgggagcaaaccacgagccatcgttgtggatccagtgcacggtttcatgtattggacagactggggtactccagctaaaataaagaaagggggtctaaatggtgtggatatttactctttggtgacagaaaacatccagtggcctaatggcatcacactggaccttctgtccggtagattgtactgggtggactccaaactgcattcaattagctctatagatgtgaatggggggaatcgaaagacaattctggaggatgagaaaagactggcccacccttttagtctggccgtctttgaggataaggtcttttggacagatatcatcaacgaggcaatattctcagcgaatcggctgacgggctctgatgtgaacctccttgccgagaatctcctgtctccagaggacatggtgctcttccataatcttacacagcctaggggcgtcaattggtgtgaacgaacgacgctgtcaaatggcggctgccaatacctgtgtctccccgccccacagataaatccgcactcccccaaattcacttgcgcctgcccggacggtatgttactcgcccgggatatgagatcgtgtctgaccgaggcagaggctgccgtggccacacaagaaactagcacagtacggctaaaggtatcctctacggcggtgcgaacgcagcacaccactacccgtccagtaccagacacatcgcggctgcccggggctaccccaggactgacgactgtcgagatagtgactatgtcccatcaggctcttggggacgtagcgggaagggggaatgagaaaaagccctcgtctgtcagagccctgtctattgtcttgcctattgtgttactggtcttcctgtgcctgggcgtgttcttattatggaagaattggcgccttaaaaatatcaactctatcaacttcgataaccccgtctatcagaagacgactgaggacgaggtacatatttgccataatcaagacggatattcatatccgtccaggcagatggtttccctagaagatgatgtagca

SEQ ID NO: 16148 - DNA, 2580 bp, Artificial Sequence
  Description of Artificial Sequence: Synthetic coding sequence
atgggaccttggggttggaagttgagatggacagttgctttactattggctgccgccggaacagcagtaggcgatcgctgtgaaaggaacgaatttcaatgccaggatgggaagtgtatcagctataaatgggtctgtgatggaagcgccgagtgtcaggacggaagtgacgagtctcaggagacatgcttgagcgtgacatgcaagtccggggatttttcctgtgggggtcgggtgaatcgctgtattccacagttctggcgctgtgacggtcaggtggactgtgataatgggtcagatgagcagggatgtcctccaaagacgtgttcccaggatgaatttcgctgtcatgatggcaaatgtattagccgccagttcgtttgtgattctgaccgagattgccttgacggatccgacgaggcatcgtgcccggtgctgacttgtggccctgcaagttttcagtgtaacagttccacgtgtatacctcagttgtgggcatgcgacaacgaccccgactgcgaagatggttccgatgagtggccgcaacggtgcagaggactttatgtgttccagggtgacagttcaccttgttccgcctttgaatttcactgtctgtcaggcgagtgcatccactcatcgtggaggtgtgacggcggccccgactgcaaagataagtccgatgaggaaaattgcgcagtcgctacctgtcggcctgatgagttccagtgcagcgacggcaattgcattcatggcagtcgacagtgcgacagagagtatgactgcaaagatatgagtgacgaggtaggatgtgtcaacgttactctgtgcgagggccccaacaagttcaaatgtcactcgggcgaatgtattacactggataaggtctgcaacatggctcgtgactgcagagactggagtgacgagcctatcaaggaatgcggaacggcggaatgtctggacaataatggggggtgctcacacgtgtgcaacgacctaaagatcgggtatgaatgtctgtgccccgacggcttccagttggtggctcagcggcggtgtgaagatattgacgagtgtcaggaccccgatacctgctcacagttatgcgtgaatctggagggcggctacaaatgccagtgcgaggaggggttccagttggacccccatactaaggcttgtaaggctgtgggttcaatcgcctatttgttttttaccaacagacatgaggtacgcaagatgacattggatagatccgagtacacatcactgatccccaatctgagaaacgttgtggcgctggatacagaggtggccagtaatagaatttactggtcagatctctctcaacggatgatatgctccactcagttggaccgagctcatggtgtgtctagctatgacacggtgatatccagggatatccaggctcctgacggtctcgccgtggactggatacattccaatatctactggacagattcagtcctagggacagtaagcgttgcagatactaaaggcgtcaaacggaaaaccttatttcgagaaaatggctctaaacctcgtgctatcgtcgtggaccctgtgcacggatttatgtattggactgactggggcacccctgctaaaatcaagaagggcggattaaatggcgtagatatatacagcttggtaaccgagaacatccagtggcccaatggcattactctagacttactgtctggccggctctactgggtggacagtaagcttcactcaatctccagcatcgatgtaaacggcggcaaccgcaaaacaattttggaggacgagaagcgactggctcatcccttctccttggcagtcttcgaagacaaggtgttctggactgatatcataaacgaagccatattttccgctaaccggctgacaggcagcgacgttaacctccttgccgaaaatctcctgtcccccgaggacatggtcctgtttcacaatttaacccagcctagaggggtgaattggtgtgaacgaactactctgagtaacggtggctgccagtacctgtgtctgccagctccacagatcaatccacactcacctaagtttacttgtgcgtgtccagatggcatgctattggctcgagacatgcgcagctgcctcactgaggctgaagccgccgtcgccactcaagaaacatctaccgtacgccttaaggtgtctagcacagctgtgcgcactcagcacaccaccacccgacccgtaccagacacatcccggctgccgggagcaacgccggggctcaccactgtggagatcgtgacgatgtcccaccaagccctgggtgatgtggccggtcgtggcaacgagaagaaaccctcctccgtgcgggcgctctccattgtcctgcccatcgtactgctcgtatttctatgcctgggtgtctttctgctgtggaaaaactggcggttgaagaacatcaacagcattaattttgataacccagtgtaccaaaaaaccacagaggacgaggtgcatatttgtcacaaccaggacgggtattcttatccctccagacagatggttagtctggaagatgacgttgct

SEQ ID NO: 16149 - DNA, 2580 bp, Artificial Sequence
  Description of Artificial Sequence: Synthetic coding sequence
atgggaccttggggatggaaactgcgttggaccgtggccctgcttctggctgcggccgggactgctgtgggggatcggtgtgagcgcaacgagttccaatgtcaggacggaaagtgtatatcgtacaagtgggtctgcgatgggtcggctgaatgtcaagatgggtccgatgaaagccaagaaacttgtctgtcggttacctgtaagagtggggacttttcctgtggaggtagagtaaaccgctgtattccacaattttggcgctgcgacggacaggtcgattgcgacaacggatcagacgagcaaggatgtcccccgaaaacgtgtagccaagatgagtttaggtgccatgatgggaagtgtattagcaggcagttcgtgtgcgacagcgacagggattgtcttgatggatcggatgaagcatcatgtcctgttctgacttgtggtcccgcatcctttcagtgcaactcgagcacttgtatcccccaactttgggcgtgtgataatgaccctgattgcgaggacggatcagatgaatggcctcagcgctgccgtgggctttacgtgtttcaaggcgatagctccccatgctctgcattcgaatttcattgtctctctggcgagtgcattcactcatcctggagatgtgacggtggaccggattgtaaagataagtccgacgaagaaaactgtgcagtcgcaacctgtagacctgatgaatttcagtgtagcgatggtaactgtatacatggatcgagacaatgtgaccgcgagtacgattgtaaggatatgtccgatgaggtgggatgcgtcaatgtgacgctttgcgaaggtcctaataagttcaagtgtcattcaggagaatgtataactctcgacaaagtgtgcaatatggccagagattgtcgggattggtcggacgagccaatcaaggagtgtggcacggcagaatgcctggacaacaacggtgggtgctcccatgtctgcaatgacctgaagataggatacgaatgcctttgcccggatgggttccaactggtggcacagaggcgttgtgaggacattgatgaatgccaggatcccgacacttgctcgcaactttgtgtaaatctggaaggaggttacaagtgtcaatgcgaggaaggatttcagctggacccacacaccaaggcttgcaaggccgttggttcgattgcatacctctttttcacgaacagacacgaagtgcggaagatgacgctggatcggagcgaatacacctcactgatccctaacctccgtaacgttgtggcactcgatactgaagttgcctcgaatcggatctactggtctgacctgtcgcagaggatgatctgttctacccaactggaccgcgcacatggagtgtcgagctacgataccgtgatcagtagagatattcaggcaccagacggtctggccgtggactggatccattcaaatatctactggaccgattcagtgcttggaaccgtcagcgtggcagacactaaaggtgtgaaacgcaaaaccctctttagagagaatggttctaagccaagggcgattgtggtggatcctgtgcacggcttcatgtattggactgactgggggacccctgctaagattaagaaggggggactcaacggcgtggatatctactcgttggttaccgaaaacattcaatggcctaacggtattactcttgatcttctgtccggccgactttattgggtcgattcgaagctccactccatctcttcaattgatgtgaacggagggaatcgaaaaactattttggaggacgagaagagactcgcacacccgttttcactggcagtgttcgaagataaagtgttttggacggacatcattaatgaagccattttcagcgccaaccgcctcactgggtcggatgtcaatcttctggcagaaaacctcctgagcccagaagatatggtgctctttcacaacttgacccaaccgcgcggtgtgaactggtgcgaacgcaccactctgtcaaatggtggctgccaatacctgtgccttccggccccacagataaacccgcatagccctaagttcacgtgtgcatgtcccgatggaatgctcttggccagagacatgaggtcctgtctgaccgaggcagaagcggcagtcgcgactcaggagacttccaccgtcagacttaaggtgtcctccactgcggtccggacccaacataccactacccgcccagtccctgatacctcccggcttccgggtgcaactcccggtcttacgaccgttgagatcgtgaccatgtcacatcaagcgctgggcgatgtcgcgggaagaggaaatgaaaagaagcccagctcggtgcgagcactttcaattgtgttgcccattgtgctgttggtatttctttgccttggcgtgtttctgttgtggaaaaactggcgactgaagaacataaactctatcaattttgataaccccgtctaccaaaagactactgaagatgaggtgcatatttgtcataaccaggatgggtactcgtacccttcgagacagatggtgagcctggaagatgatgtggca

SEQ ID NO: 16150 - DNA, 2580 bp, Artificial Sequence
  Description of Artificial Sequence: Synthetic coding sequence
atggggccgtggggatggaagctgagatggaccgtggcactgcttctcgcagctgctggaacggccgtgggagatcgttgtgagcgcaacgagttccaatgtcaggacggaaagtgcatttcgtacaagtgggtttgtgacggaagcgctgaatgtcaagacggatcggacgagagccaagaaacgtgcctttccgttacctgtaagtcaggtgatttctcctgcggtggaagggtgaaccgttgtattcctcagttttggaggtgtgacggacaagtggactgcgataacggctctgatgaacagggttgtccacctaaaacttgttctcaagacgagtttagatgtcatgacggaaagtgtatctcgagacaattcgtgtgcgattcggacagagattgtcttgatggatcggatgaagcctcgtgcccagtgctgacttgtgggcccgcctcgtttcaatgtaattcgtcaacgtgtattcctcaactctgggcatgtgacaacgaccctgactgtgaggatggtagcgatgagtggccgcaacggtgtcgaggcctgtacgtctttcaaggagatagctcaccttgctcagcgtttgagttccactgtctctcgggtgaatgcatacattcgtcgtggagatgcgacggcggaccggactgtaaagataaatcagacgaagagaattgcgccgtggcaacgtgtaggccagatgaatttcagtgttcagatggaaattgtattcatggttcgcgacagtgtgatcgggagtacgactgtaaagacatgagcgatgaggtggggtgtgttaacgtcactctttgtgaaggcccaaacaaattcaaatgccattcgggagagtgtatcaccctcgataaggtttgtaacatggccagagattgtagggattggagcgatgagcctataaaggaatgcggaactgccgagtgtcttgacaacaacggaggctgttcacacgtgtgtaacgacctcaagattggctacgaatgcctgtgtcctgacggattccagctggtcgcacagcgacgctgtgaagatattgatgagtgccaagatcctgacacttgcagccagctgtgtgtgaatctggagggtggatacaaatgtcagtgtgaagaaggatttcagctcgacccacatacgaaggcatgcaaggccgtgggttcaattgcataccttttcttcaccaacagacatgaggtccggaagatgacccttgacaggtccgaatacacttccctgatccctaatctgaggaacgtggtggcactggatactgaagtcgcctccaacagaatttactggtccgatctttcgcaaagaatgatctgcagcactcagttggatcgcgcccatggcgtgagctcctacgataccgtgatttcgagagacatacaagcacccgacggtcttgcagtcgattggattcactccaacatttactggaccgatagcgtcctgggcactgtgtccgtcgccgataccaagggagtgaagcggaaaactttgttccgcgaaaacggttcgaagcctcgagccattgtggtggaccctgtgcacggttttatgtactggaccgactggggaactccagcaaagattaagaaggggggacttaacggggtcgacatttactcacttgtcactgaaaacatccaatggccaaacggtatcactcttgaccttttgagcggtaggctctactgggtggattccaagctccatagtattagcagtatcgacgtgaacggaggaaacagaaagaccatccttgaagatgaaaagcggctggcacatccgttttcactcgccgtgtttgaagataaagtgttttggactgacatcattaatgaagccatattctcagctaaccggctgactggctcggacgtgaacttgcttgctgagaacctgctgtcgcctgaggacatggtgctttttcataaccttacccagcccagaggcgtgaactggtgtgaacgcactactctcagcaatggtgggtgccagtacctctgtctccctgcacctcagatcaaccctcatagccccaagttcacgtgcgcatgtccggatggaatgctcttggcaagggatatgcgctcctgtcttactgaggcagaagcagcagtggccacccaggaaacttcgaccgtacgccttaaagtctcatcaaccgccgtgcggacccaacacactacgaccagacctgtgcccgatacctcccgcctccctggagcaactcccggactgactaccgtcgaaatcgtgaccatgtctcatcaagccctgggagatgtggcgggccgtggtaacgagaaaaaacctagctcggtgagagccctgtcaatcgtccttccaattgttctcctggtgtttctgtgtctcggtgtgttcctgctctggaagaattggcgtctgaagaacatcaactcgattaacttcgacaatcctgtctaccaaaagactactgaggacgaagtccatatctgtcacaatcaggatgggtacagctacccttcgcggcaaatggtgtcactggaggacgatgtcgca

SEQ ID NO: 16151 - DNA, 2580 bp, Artificial Sequence
  Description of Artificial Sequence: Synthetic coding sequence
atgggaccatggggatggaagctccggtggacagtggccctgctgctagccgccgccgggacagctgtgggggatcggtgtgaaaggaacgagttccaatgccaggatggcaaatgtatctcgtataagtgggtctgcgatggatctgccgagtgccaggacggctccgatgagagccaggaaacttgcctatccgtgacctgcaagtccggtgacttctcgtgtggcggaagggtcaacagatgtataccccagttttggcgctgtgatggccaggttgattgcgacaatggatcagatgagcaggggtgtccacctaagacatgttcccaggatgaatttcgctgccatgacggtaagtgtatctcacgtcagttcgtctgtgacagcgatagagattgcttagacggaagtgacgaggcaagttgccctgttcttacttgcggcccagctagtttccagtgcaactcctcaacctgcatacctcagctctgggcctgtgataatgacccggactgcgaggatggatccgacgagtggccacagagatgcaggggtctgtatgtgtttcagggggactcctctccttgctccgccttcgagtttcactgcctttctggcgaatgcatccatagtagctggcgctgcgatggcggtccagactgtaaagataagagcgacgaagagaactgcgccgtagcaacttgtcggcctgacgagtttcagtgcagtgacggcaactgcatacatgggtctaggcagtgtgacagggagtacgactgtaaggacatgagcgacgaggtcggatgtgttaatgtgactctgtgcgagggcccaaataagttcaaatgccactcaggcgagtgcatcacgctcgacaaggtgtgcaacatggccagggattgtcgggactggtccgatgagcctatcaaggagtgcggtaccgcggagtgtttggacaacaacggcggctgctcacacgtgtgcaatgacctcaagattgggtacgaatgcttgtgtccagatggctttcaattggtggctcagcggcgttgcgaggacatcgacgagtgtcaggacccggacacgtgtagtcagctttgtgttaaccttgaagggggctataaatgtcagtgtgaggaaggcttccaactggatccacataccaaggcgtgcaaggctgtaggatctatagcctatttgtttttcactaacaggcacgaagtgaggaaaatgaccctggacaggtccgagtatacttcactcattcctaacctgcgtaacgtcgtcgcactcgacactgaggtggcctctaaccgcatttactggtcggatttgagccagagaatgatctgctcaacacagttggacagggcacacggagtttcgtcatatgatacagtcattagccgggacatccaagcccctgacggtctcgcagttgactggatacactctaatatatactggacagattcagtgcttgggaccgtgagcgtagcagacacgaaaggcgtgaagcggaagacgctgtttcgtgagaacggttcaaaaccccgcgcaatcgtcgtggaccccgtccatgggtttatgtactggaccgactggggtacccccgctaagattaaaaagggtggactcaacggggttgacatttattcccttgtgaccgaaaatatccaatggcctaacgggataacacttgatctattgtctggaagactgtactgggtggactcaaagctccactccatcagctccattgatgttaacggcggaaataggaagaccattctcgaggacgaaaaaagactggcccacccgttctctcttgcagtgttcgaagacaaggttttttggacagacattatcaatgaggctatattttcagctaacaggctaacaggcagcgacgtgaacttactcgcggaaaatctgctgtcccccgaggacatggtactgtttcataatctcacacagcccaggggtgtcaactggtgcgaacgcacaacactatcaaacggcgggtgccagtacctgtgcctaccggctccccagatcaatcctcacagccctaaattcacgtgcgcttgcccagacggtatgctgttggctagagacatgcggagttgtttgactgaggccgaagccgcagtggccacccaggagactagtaccgtccgcctaaaagtaagctccactgccgtccggacgcaacatacaacgacacgacctgtacccgatacatcccgtctccccggtgcaaccccgggactgacaaccgtcgagatcgtgaccatgagtcatcaggcactgggagacgtcgcaggtagaggcaacgaaaagaaaccttcctccgttcgtgcgttgtcgattgtgctgccaatcgtcctccttgtgttcctgtgtctgggtgtgttccttctctggaagaattggcgactgaagaacataaactccataaatttcgataatcctgtatatcaaaaaactacagaagatgaagtacacatctgccataaccaggacggctacagctacccatcccgacagatggtgtcgcttgaagacgacgtggca

SEQ ID NO: 16152 - DNA, 2580 bp, Artificial Sequence
  Description of Artificial Sequence: Synthetic coding sequence
atgggcccctgggggtggaagctgcgctggacagtggccttgctcctggcggcagccggcactgccgttggtgaccgctgtgaaagaaacgaattccagtgtcaggatggaaagtgtatctcttataaatgggtatgtgacggctctgccgaatgtcaggacgggtcagatgagtcgcaggaaacctgtcttagcgtcacttgtaagagcggtgacttttcttgcggcggcagagtcaaccgatgcatccctcagttctggcgctgtgacggccaggttgactgcgacaatggctcagacgagcagggttgccccccgaagacgtgcagtcaggacgagtttcgatgccacgacggtaagtgtatctcaaggcagttcgtttgcgattcagatcgcgattgtctggacggctcagacgaagccagctgtcccgtgctgacatgtggaccagccagttttcaatgcaatagctctacgtgcatcccccagctgtgggcctgtgacaatgatccagattgtgaggatggttctgacgagtggcctcaacgatgtcgtgggttgtacgtcttccagggggactcgtcaccctgcagcgctttcgagtttcattgcctctctggggagtgcattcactcatcatggcgttgcgacgggggacctgactgtaaagacaagagcgatgaagagaactgtgctgtcgccacatgcaggccggatgaatttcagtgctccgatggcaactgtattcatggctctcggcagtgtgatcgcgaatacgattgcaaggatatgtccgatgaggtcggctgtgtgaacgtcacactgtgcgaaggaccgaataagttcaaatgccattccggggaatgtattacactcgacaaggtgtgcaatatggcaagggattgccgcgattggagcgacgaaccaattaaagagtgcggcacagccgaatgcctcgataacaacggcggctgctctcatgtgtgcaacgatcttaagattggatacgaatgtctatgccctgatggttttcagctggtggctcaacggcgatgtgaggacatcgatgaatgccaggacccggatacatgttcccaactctgcgtgaatctggaaggcggctacaagtgccagtgtgaagagggttttcagctcgatccacacacaaaggcatgtaaggcagtgggaagcattgcttatctcttttttactaatagacacgaggtacggaagatgaccttggaccgaagtgagtatacctcactcatccccaatctcagaaacgtcgtcgctcttgatacggaggttgcaagcaacaggatttattggtctgaccttagtcagcgcatgatatgttctacccagctggatcgcgcgcacggcgtctcttcctacgatacggtgatttctcgggacatccaggctccagacggattggcggtggactggattcactcaaatatttattggaccgactctgtgctgggtactgtctcagtcgccgatacaaagggtgtgaaacgcaagaccctcttccgtgagaatgggtctaagccccgggctatcgtcgtggaccccgtacacgggttcatgtactggaccgactggggaacacccgccaaaatcaagaagggcggcctgaatggcgtagacatctacagcctggtgaccgagaatatccagtggcctaacgggatcaccctggacctgctttcgggccgactctactgggtggattctaaactgcattccattagtagcatcgatgttaatggaggcaataggaaaacgatcctagaggacgagaagagactcgcccacccctttagtctggctgtgttcgaagacaaggtgttctggacagacatcatcaatgaggccattttctctgctaaccggctgacagggagcgacgtgaacctattggccgagaacttgctgtcccctgaagacatggttctgtttcacaatctgacccagccgagaggcgtgaattggtgcgagagaacaacactatctaacggcgggtgccagtatctatgtctgccagcccctcaaataaacccccactctccaaagttcacgtgcgcctgccccgacgggatgttgttggctagggacatgaggagttgcctcactgaggctgaggctgccgtcgccacccaggaaacttccaccgttcggttaaaggtcagcagtaccgccgtccgcacccagcacaccactacgagacccgtcccagacaccagtcgactccccggcgccactcccggcctgactaccgtggaaatcgttacgatgagtcaccaagccctgggcgacgtggccggaagagggaatgagaagaaaccctccagcgtgcgggctttgtccattgtcttgcctatagttctgctagtgttcctgtgtctcggtgttttccttctgtggaagaactggagactcaagaacattaacagtatcaattttgataaccccgtctatcagaagaccactgaggacgaagtgcacatttgtcacaatcaagatgggtatagttatccgtcgagacagatggtgtcgctggaagacgacgtcgca

SEQ ID NO: 16153 - DNA, 2580 bp, Artificial Sequence
  Description of Artificial Sequence: Synthetic coding sequence
atgggaccgtggggttggaaactgcgctggaccgtggcgcttctcttggccgccgctggtaccgctgtgggcgatcgatgcgagcgcaacgaattccagtgtcaggacggcaagtgtataagctacaagtgggtgtgcgacggaagcgctgagtgccaagatggctccgatgagtcgcaggagacctgtctctccgtcacgtgcaagtcaggagacttcagttgtggaggtagagtaaataggtgtatcccgcagttctggcgttgcgatgggcaggtggactgtgataacggcagcgatgaacagggctgccccccaaagacatgctcgcaagacgagtttaggtgtcatgatgggaagtgcatctcccggcagtttgtctgcgactccgatcgagactgtctggacggctccgacgaagccagttgtcctgtgttgacatgcggtcccgcttctttccagtgtaatagttcgacatgcattccacagctgtgggcatgcgataatgaccctgactgcgaggatgggagtgacgaatggccccagcgatgtcgaggcctgtatgtgttccagggcgactcatctccgtgctcagcttttgagttccattgcctgtccggtgagtgtattcattcctcttggcgctgcgatggcggccctgactgcaaggataagagcgatgaggaaaactgtgctgtggctacttgcagacctgacgaatttcagtgttcagatggtaactgtatccacgggtctagacaatgtgatagggaatacgactgcaaggatatgagcgacgaggtgggatgtgtcaacgtgactttgtgtgaagggcctaacaaatttaaatgtcactcaggtgaatgtatcactctagacaaggtctgcaatatggcacgtgactgcagggactggtcagatgaacccatcaaagaatgtggtactgcggagtgcctggataacaatggcggatgttcacacgtctgtaacgacctaaagatagggtatgagtgcttatgtcccgatggcttccaactggtggcccaacgtcgttgcgaggacatcgatgaatgtcaagatccagacacctgctcacagctctgcgtgaatttggagggcggctataagtgtcaatgcgaagagggtttccagctggacccacatactaaggcctgtaaggccgtgggttccatagcgtacctcttttttacaaatagacacgaggttaggaaaatgactctggacaggagtgagtacacgtctctgattccaaatctgcggaacgtcgtagccttggataccgaggttgcatccaaccgcatctattggtctgaccttagtcagaggatgatctgctctacccagctcgacagagcgcacggtgtgagcagctatgatacagtgatttcccgggacatccaagccccagacgggctggccgtagactggattcactctaacatctactggacagattcagtgctcgggaccgtttccgtggcagacactaagggcgtcaagagaaagaccctcttccgagagaatggatctaagccccgagctatcgtcgtcgatcccgtgcacggattcatgtactggacggactggggcacacctgcaaagatcaagaagggcggactgaacggcgtggacatctactcactcgtgacagaaaatatccagtggccgaacggcataactctcgaccttctgtccggccggttatactgggtcgactctaaactgcacagtatctcatccatcgatgttaacggtggcaaccgtaaaaccattttagaggacgaaaaacggctggcacaccccttcagtctcgcagtttttgaagataaggtgttttggaccgacatcatcaatgaggccattttctctgcaaataggctgacaggatctgacgtgaacctgctggccgagaatctgctgtcacctgaggacatggtgttgtttcacaacctgactcaacccaggggcgtcaactggtgtgaacgcaccaccttatctaacggcggctgtcaatacctgtgcttgccagccccacaaataaacccccactcaccgaaatttacatgcgcctgccccgatggaatgctgcttgcccgtgacatgcgaagctgcttgacagaagcagaagcggccgtggcgacacaagaaaccagcaccgtgaggctcaaggtgagctcaacagccgttcgaacacagcacacgacaacccgccctgtgccagacacttctagactgcccggcgccactcctggactaacaaccgtggaaatagtgaccatgtcacaccaggcccttggagacgtggccggacggggaaacgagaagaagccctcctccgtgcgagcactctccattgtgctcccaattgtgctgcttgtttttctgtgtctgggtgtgttcttgctctggaagaattggcggctcaaaaacataaactccataaacttcgataacccagtctatcagaagactacagaggacgaagtacacatctgccataaccaagatggatactcttacccaagcagacaaatggtcagtttagaggacgacgtagcc

SEQ ID NO: 16154 - DNA, 2580 bp, Artificial Sequence
  Description of Artificial Sequence: Synthetic coding sequence
atgggcccatggggctggaagctaagatggacagtagccctcctcctggcggcagccggtacagcagtaggagacagatgcgaaaggaacgagttccagtgccaggacggaaaatgtatctcatacaagtgggtttgtgacggcagtgccgagtgccaggacggctccgatgaatcccaggaaacctgcttgtctgtgacctgtaaatctggggatttttcatgcggtggacgtgtgaatagatgcattccccagttttggaggtgtgacggccaggtcgactgtgataatggatccgatgaacagggctgccccccaaagacgtgctcccaggatgagtttagatgtcatgatgggaagtgcatctctcggcagttcgtttgcgacagcgaccgggactgtcttgacggttcagatgaggcctcctgtcctgtgcttacgtgcggcccagccagtttccagtgtaatagttccacctgtatcccccagctgtgggcttgcgataatgacccggattgtgaagatggctctgatgaatggccccagagatgtcgcggattatatgtattccagggagattcctctccctgctccgcatttgaatttcactgtctgtccggtgaatgtattcattcaagctggaggtgtgacggaggcccagattgcaaggacaaatctgacgaggagaattgcgcagtagctacgtgccgacccgacgaattccagtgctccgatggaaattgtattcacggctctcggcaatgcgatcgggaatatgattgtaaggacatgtctgatgaggtgggttgcgtgaatgtaaccctgtgcgaaggccctaacaaatttaaatgccatagcggggagtgtatcacactggataaagtatgtaacatggcccgggactgtagggattggtcggacgagccaattaaagagtgcggtacagccgagtgtttagacaataacggcggctgttctcacgtatgcaacgatctgaagataggctatgaatgcctatgcccagacgggtttcagttggtggctcagaggcggtgcgaggacatcgacgaatgtcaggaccctgacacctgttcgcagttatgtgtgaacctggaaggtgggtataagtgccagtgcgaggaaggattccagctggaccctcataccaaggcctgtaaggccgtaggcagcatagcatacctcttcttcacaaatcggcacgaagtgcggaaaatgaccctcgataggagcgaatacactagcttgatccccaacctccgtaatgtcgtcgcactggacactgaagttgcctcgaaccgaatttactggtccgatctttcacagagaatgatatgcagtacccagcttgacagagcccacggggtctcctcctacgacacagtcatcagtcgcgatattcaagctccagacgggctggccgtggactggatccacagcaacatatattggacagactcggtcctcggtactgtatctgtggctgacaccaaaggtgtgaagcgcaagacactgttccgtgaaaacggctctaagcctcgcgctatagtggttgaccctgtacacggcttcatgtactggaccgattgggggacccccgcaaagattaagaagggcggactaaacggcgttgacatctattcactggttaccgagaatatccaatggcctaatgggattactcttgacctgttgtcaggtcggctgtactgggtggattccaagctgcattctatttcctccatcgacgtcaacggtggaaacagaaaaacgatcctagaagatgagaaacggctagcgcaccctttctctctggcagtgttcgaggataaggttttctggactgatattattaatgaagcgattttcagcgccaatcggcttacgggctccgacgtaaaccttctggccgaaaatctcctctctccggaagatatggtgctgttccacaacttaactcagcctcggggtgttaattggtgtgaaagaaccacgctgagcaatggagggtgtcagtacttgtgcctgccagcgccacaaatcaatcctcacagcccaaaatttacatgtgcttgccccgacgggatgctcctggccagagacatgcgctcatgtctgacagaggcggaagctgctgtggctacacaagaaacctctaccgtccggctgaaagtgtctagcacggccgtgaggacccagcatacaacaacccgcccagtacccgacactagcagattgccaggggccacaccaggactcactaccgtcgagatcgttacgatgtcacatcaagcgttgggagatgtcgctgggaggggcaacgaaaaaaagccaagctctgtaagggccttaagtattgtgctcccaatcgtccttctagtgttcctgtgcctgggcgtgtttctgctgtggaaaaattggaggttgaaaaacatcaattctatcaacttcgacaatccagtctaccagaaaacgaccgaagacgaggtgcacatttgccacaaccaggatggctattcttatccttccagacagatggtgtcccttgaagacgacgtggca

SEQ ID NO: 16155 - DNA, 2580 bp, Artificial Sequence
  Description of Artificial Sequence: Synthetic coding sequence
atgggaccctggggctggaagttgcgctggaccgtggcgctcctcttggctgccgcggggaccgcggtgggagatcgttgcgagaggaacgagttccagtgccaggacggcaagtgcatcagctacaagtgggtgtgcgacggctccgccgaatgccaagacggctcagatgaatcccaggaaacttgtctctcagttacttgcaagagcggagactttagctgtggaggtcgagtgaaccggtgcattccgcagttctggagatgcgacggacaggtggactgcgataacgggtcggacgagcaggggtgtccaccgaaaacttgttcacaagacgaattccggtgtcatgacggaaagtgtatcagcagacaattcgtctgcgattcggaccgcgattgcctcgacgggtcggatgaggcatcgtgccccgtgctcacttgcggaccagcctccttccagtgcaattcaagcacctgtataccccagctgtgggcctgcgacaacgacccggactgcgaggatggttccgacgaatggccgcagcgctgccggggactttacgtgttccagggagactcctcaccttgtagcgctttcgagttccactgtctgagcggagaatgcattcactcaagctggcgctgcgacggcgggcctgactgcaaagacaagtcagacgaggaaaattgtgccgtggcgacctgccgcccggatgaattccagtgctctgacggcaactgtatccacggctcgcgccagtgcgaccgggagtacgactgcaaggatatgagcgacgaagtgggatgcgtgaacgtcaccctctgcgagggacctaacaagttcaagtgccactccggagagtgcatcaccctcgacaaagtgtgcaacatggcgcgggattgccgcgactggagcgacgagccgatcaaagagtgcggaacggcggaatgtctggataacaatggaggatgttcacacgtctgcaatgacctcaagatcgggtatgagtgcctctgcccggacgggttccaacttgtcgcgcagcggcgctgcgaggatattgatgagtgccaagaccccgacacctgctcgcaactgtgtgtcaaccttgaggggggatacaagtgtcaatgcgaggaaggattccagctggacccgcatactaaggcgtgtaaagcagtcggatcgatcgcctacctgttcttcaccaaccggcacgaagtccgcaagatgaccttggatcgctcggaatatacctcactcatcccaaacttgagaaatgtggtggccttggataccgaggtggcctccaaccggatctactggtcggacctgtcccaaagaatgatctgctcgacccaactggatcgggcgcatggcgtctcgagctacgacactgtcatctcccgggacatccaggcgccggacggcctcgcagtggattggatccactcgaatatctactggactgattcagttctgggaactgtgtccgtggccgacactaagggagtcaaaagaaagactctctttcgggaaaatggatccaagccacgggccatcgtggtcgatccggtgcatggattcatgtattggaccgactggggtacccctgctaagatcaagaagggaggcctgaacggcgtcgacatctactctctggtgacggagaacatccaatggcccaacggtatcaccctggacctgctgtcaggccgactgtattgggtggacagcaagctgcacagcatctcctcgatcgatgtgaacggtggaaaccgcaagaccattctggaagatgaaaagcgcctggctcacccgttcagcctcgctgtgttcgaggacaaggtgttctggaccgatatcatcaacgaagccatcttttcggcaaaccggctgaccggctccgatgtgaatctgctcgctgagaacttgctgtcaccggaagatatggtcctgttccataacttgactcagcctcgcggcgtcaactggtgcgagcgcaccactctgtcgaacggcggctgccagtacctctgcctccctgcaccacagatcaatccacactcgcccaagttcacctgcgcttgcccggatgggatgttgttggcacgcgatatgcggtcctgtctcaccgaagccgaagccgcagtggcaacccaggagacttccactgtcaggctgaaggtgagctcgacggcagtgagaacccagcacactactacgcgccctgtgccggacacttctaggctgcccggcgcgactcccggactgaccaccgtggaaattgtgaccatgtcacaccaggcccttggtgatgtggcgggtagaggtaacgaaaagaaaccatccagcgtcagggccctgtcaatcgttctcccgatcgtcctgctggtctttctctgcctcggggtgttcctgctgtggaagaattggagactgaagaacatcaattcgatcaatttcgataatcccgtgtaccagaaaactactgaagatgaggtgcatatctgtcacaatcaggacggatactcgtacccatcaagacagatggtttcgttggaggatgacgtggcc

SEQ ID NO: 16156 - DNA, 2580 bp, Artificial Sequence
  Description of Artificial Sequence: Synthetic coding sequence
atgggtccgtggggttggaaactgcggtggaccgtcgccctcctgctggctgcggcaggaaccgccgtgggggacagatgcgaacggaatgaatttcagtgtcaggatggcaaatgtatcagctacaagtgggtgtgcgatggttcagcggaatgtcaggacggcagcgacgaatcacaggaaacttgcctcagcgtgacttgcaaatcgggagacttctcgtgcggaggaagggtgaatcgctgtatcccccaattttggcgctgtgacggccaggtggactgtgataacgggtcggacgaacaaggctgtccgcccaagacctgctcacaggatgagtttcggtgccacgacggaaaatgtatcagtcgccaatttgtctgcgactcggacagagactgcctggacggatccgatgaagcctcctgcccggtgttgacctgcggcccagcctcgtttcaatgtaactcaagcacctgtataccgcagctttgggcgtgcgataatgacccggactgcgaggacgggtcagatgagtggccgcaacggtgccggggtctgtacgtgttccaaggagattcctctccttgttcagcattcgaattccattgcctttccggtgaatgcatccattcttcgtggaggtgcgatggaggcccggactgcaaagacaagagcgacgaagaaaactgtgccgtggctacttgccggccggatgagttccaatgcagcgatggtaattgcatccacgggtcccgccagtgcgacagagagtacgattgtaaggatatgagcgatgaagtgggttgtgttaacgtgactctgtgcgaaggaccgaacaagttcaagtgccattccggggaatgtatcactcttgacaaggtctgcaatatggcacgggattgccgcgattggtcagatgagccgatcaaggaatgcggcaccgccgagtgcttggacaataatggcgggtgttcccatgtgtgcaacgacctgaagatcgggtacgaatgcttgtgtccagatggatttcagctcgtggcccagagacggtgcgaggacatcgatgaatgccaggacccggacacgtgttctcagctctgtgtcaatctcgagggaggatacaaatgccagtgtgaggagggcttccagttggacccccataccaaggcgtgtaaggccgtcgggtcaatcgcatatctgttcttcaccaaccggcatgaagtgagaaagatgactctggaccgctcggagtacacttcgctcatcccaaacctccggaacgtggtcgccttggacactgaagtcgcatccaatcgcatctactggtcagacctttcccagcgcatgatctgctcaactcaactggatcgcgctcacggcgtcagctcgtacgacaccgtgatctcacgggacatccaggcaccagacgggctcgcggtggattggatccactcgaatatctactggaccgactcggtgctgggaactgtttcggtcgcagacactaagggggtgaaacgaaagacccttttccgggagaatggttctaagccgcgcgccattgttgtggacccggtgcatggtttcatgtactggactgattggggtactccagccaagatcaagaagggagggctcaacggcgtggacatctactcacttgtgaccgagaacatccaatggccgaatggaatcaccctggacctgttgtcgggtagactgtactgggtcgactcgaaattgcattcgatctcgtcaatcgatgtcaatgggggaaatcggaaaacgatcctggaggacgaaaaacggttggcccacccctttagcttggccgtgttcgaggacaaggtgttttggactgacatcataaatgaggccatcttctccgccaatcgcctgactggcagcgacgtgaacctgctcgcagaaaacctcctgagcccggaagatatggtccttttccacaatcttacgcagcctagaggtgtgaactggtgcgagcgcactaccctgtccaacggaggatgccagtatctgtgcctcccagcgccacaaatcaacccccattcgcccaaattcacctgcgcgtgccctgacggtatgctcctggctagagacatgcggtcatgcctcactgaagcagaggcggccgtggccactcaggagacttccacggtgaggctcaaggtgagctcgactgcagtgaggactcaacacaccactacgaggccagtgcccgatacttcccgcctgccgggcgctactccgggactgactaccgtggagatcgtcaccatgtcgcatcaggctctgggggatgtggcgggtcggggcaacgaaaagaagccgtcatccgttcgcgccctctccattgtgctgccaatcgtgctgctggtgttcctctgtctgggagtctttctgctgtggaagaactggcgactgaaaaacatcaactcgatcaacttcgacaaccctgtgtaccagaaaacgaccgaggacgaagtccacatctgtcataatcaagacggctactcgtatcccagcaggcagatggtgtcgctggaggatgatgtggct

SEQ ID NO: 16157 - DNA, 2580 bp, Artificial Sequence
  Description of Artificial Sequence: Synthetic coding sequence
atgggaccatggggctggaagcttcgatggaccgtggcgctactcctcgctgcagcagggactgcagtcggggatagatgtgaacgtaacgaatttcagtgtcaagacgggaaatgcatttcatacaagtgggtgtgtgatgggtcagcagagtgccaggacggatccgatgagagccaggagacgtgcctcagcgttacctgcaagtcaggtgacttctcttgcggaggacgggtgaacaggtgcatcccccaattttggagatgcgatggtcaagtggattgcgacaatggcagtgatgagcagggatgcccgcccaagacctgttcacaagatgaattcagatgccacgatggtaagtgcatatcccgccagttcgtgtgtgattctgatagggactgcttagacggttctgatgaggcgagctgtcctgtactgacttgtgggcccgcctctttccaatgtaacagctccacgtgtatcccccagttgtgggcatgtgataacgacccagattgtgaggatggtagtgacgaatggccccagaggtgcagaggcttatatgtgttccagggagactcatcaccctgttctgccttcgaattccactgtctgagcggcgagtgtatccactctagctggcggtgcgacggcggtccagactgcaaggataagtcagacgaggagaactgcgcagtcgccacctgtagacctgatgagttccagtgctcggatggcaactgtatacacgggagccgccagtgcgatcgagaatacgactgtaaagatatgtcggatgaagtaggatgtgtcaatgtgacactttgcgagggacctaataagtttaagtgtcactccggtgagtgcataacattggacaaggtgtgtaatatggccagagactgtagagactggagcgatgagccgatcaaggagtgcggaaccgctgaatgtctagacaacaatggcgggtgtagccacgtgtgcaacgatctgaaaattgggtacgagtgtctctgcccagatggctttcagctcgtcgcccaaaggcgctgtgaggatatagatgaatgtcaggaccccgatacatgctcgcagttatgtgtgaatctggagggcggctacaagtgtcagtgtgaggaggggttccagctcgatccgcatacaaaagcttgtaaggccgtgggctccattgcctacctcttctttaccaacagacatgaggttcggaagatgaccttggaccggtctgagtacacctctctgatcccaaacttgaggaatgtagtggcactggataccgaggtggcttccaataggatctactggtcggacctctcacagcgcatgatttgctcaacccagctggatcgcgcccacggcgtctctagctacgacactgtgatctccagagatattcaggctcctgacggacttgccgtcgattggatccactctaacatatactggaccgattccgttctcgggaccgtcagcgtggctgataccaagggagtgaaacggaaaaccttattccgcgagaacggatccaaacctcgggccatcgtggtggacccggtgcatggattcatgtactggaccgattgggggactccagccaagattaaaaagggtgggctcaacggggtcgacatttactccctcgttaccgagaacatccagtggccgaacggaattacacttgatcttctgtcaggaaggttatattgggtggactctaaactccatagcattagcagtattgacgtcaatggcgggaaccgaaagaccatcctagaggatgaaaagagactcgcacatccattttctctggccgtgtttgaggataaggtcttttggacagacattataaatgaagcaatatttagtgcaaatcgcctgactggcagcgacgtgaacctgctagcggaaaatctgctgtcaccagaagatatggtcctcttccataatctgacccagccccgtggagtgaattggtgcgagcgcacgactctctcaaatggcgggtgtcaatacttgtgcctgcctgccccacaaattaacccccactctccaaaattcacatgcgcctgtccagatggaatgctcctcgcgagggacatgcgttcttgtttaactgaagccgaagctgcagtagccacccaggaaactagcaccgtccgattaaaagtaagttccactgctgttcgcactcagcatactacaacgaggccagtccctgatacgagcaggcttccaggtgctactccaggccttactacagtcgaaatcgtgactatgtcccaccaggccctcggcgacgtggctgggaggggaaacgaaaagaagcctagtagtgtgagagccttaagcatagtcctgcctattgttcttttggtgtttctatgcttgggggttttcttgctgtggaagaactggagactgaagaatatcaactccatcaacttcgataatcccgtgtaccagaagaccacggaagacgaggtgcacatctgccacaatcaggacgggtattcttatccgagccgtcagatggtgtctcttgaagacgatgtggcc

SEQ ID NO: 16158 - DNA, 2580 bp, Artificial Sequence
  Description of Artificial Sequence: Synthetic coding sequence
atgggcccttgggggtggaagctgcggtggacagtggctctcctcctggctgctgccggaactgccgtgggcgatcgatgcgagcgcaacgagtttcagtgccaggatggtaaatgtatctcttacaaatgggtctgtgacgggagcgctgaatgccaggacggatccgatgagtcacaagaaacatgcctctccgtgacctgtaaatctggagactttagttgcggggggcgcgtgaatagatgcatcccacagttttggcggtgtgacggtcaggtggactgcgataatggcagcgatgagcagggttgcccccccaaaacatgcagtcaggatgagttcaggtgccacgatgggaagtgcatatctagacagttcgtgtgcgatagcgatcgcgattgcctggacggttctgacgaagcctcatgccccgtgctgacatgcggccctgcgtccttccagtgtaactcaagtacgtgcatcccacaactgtgggcctgcgacaacgatccagactgcgaggacggaagcgatgaatggccacagagatgtcgcggcctctacgtgttccagggggactcttccccttgtagtgcattcgagttccattgtctcagcggcgagtgtatccactccagctggcgctgcgacgggggacccgattgtaaagacaaatccgacgaggagaactgtgccgttgcaacatgtagaccagacgagttccagtgttccgacggtaactgcatccacggttcccgccagtgtgacagagaatacgactgcaaagacatgtcagatgaggtgggatgtgtcaacgtgacactgtgtgaaggccctaataaattcaaatgccacagcggcgagtgcataactctggataaggtatgtaatatggcccgcgactgtagggactggtctgacgagcctattaaggagtgcggcacagctgagtgcctcgataacaacggcggctgctctcacgtttgtaacgaccttaaaatcggctatgagtgcctttgccccgacggtttccaactggttgcacagcgccgctgtgaagacattgatgaatgtcaggatccagatacgtgcagtcagctgtgtgttaacctcgagggagggtacaaatgtcaatgtgaagaaggattccagctggatccacataccaaggcttgcaaggcagttggctccatagcctatctcttcttcaccaataggcacgaggtacgcaaaatgacgctcgatcggagtgaatatacgtctctgattcccaatctgcgcaatgttgtcgcactggatacagaagtggcttcaaaccggatttattggtctgaccttagccagcgcatgatctgctccactcagcttgacagggcccatggcgtatcatcatatgacactgtgatttcacgggacatccaggcgcccgatggcctggccgttgactggatccacagcaatatctattggacagatagcgtactgggtaccgtgtctgtagccgatacaaagggagtgaagaggaagaccctgtttcgagaaaacgggtctaagcctagggctatcgtagtcgaccctgtccacggttttatgtactggactgactggggcactcccgcaaagatcaaaaagggcgggttgaatggcgttgacatatatagcctggtgaccgagaacatccaatggcctaatggaataacacttgacttgctgagcggcagactgtactgggttgactctaagctgcacagtatttcttctatcgatgttaacggcgggaaccggaagacaatactggaggacgagaaaagattggcccatcctttctctcttgctgtgtttgaggataaagttttttggaccgatattattaacgaagccattttctcagcaaatagactgactggttccgacgtcaacctgctggccgagaacctgttgtctccagaagatatggtcctgtttcacaacctgacacaaccaagaggagtcaactggtgtgagaggacgactctctccaacggcggctgtcagtacctgtgcctgcctgcaccacagatcaaccctcattcccccaagttcacttgtgcctgccccgacggaatgcttttggctcgggatatgcgaagttgccttacagaggcagaggccgcggtcgcaacgcaagaaacatcaacagttcgactgaaggtatctagcaccgccgtccggacacagcacactacaaccagacccgtcccagacaccagtagacttccaggcgctacacccggcttgactacggtggagattgtcaccatgtctcatcaggcccttggagatgttgcgggacgaggcaacgaaaaaaaaccctcttccgtgcgagccctcagcattgtacttccaatcgtgcttctggtgtttctgtgcctgggcgttttcctcctgtggaagaattggcgcctgaaaaatattaactcaattaatttcgacaaccccgtgtaccagaaaacaacagaggacgaggtccatatatgtcacaaccaagatggctattcatacccaagtcgacaaatggtctccttggaggacgatgtggcg

SEQ ID NO: 16159 - DNA, 2580 bp, Artificial Sequence
  Description of Artificial Sequence: Synthetic coding sequence
atgggtccgtggggttggaagctgcggtggacggtggccctgctactggcagcagccggcaccgccgtgggtgaccgctgcgagcgcaatgagttccaatgccaggatggcaaatgcatcagctacaagtgggtgtgcgacggctcggcggaatgccaagatggctccgacgagagccaggagacgtgtctgtcggtgacctgcaaaagcggagatttcagctgcggcggccgagttaatcgctgcattccccagttttggaggtgcgatggacaggtggactgcgataatggctccgacgagcaggggtgcccgccaaagacctgttctcaggatgaattccgttgtcatgatggcaagtgtatctctcgccagtttgtctgtgatagcgatagagactgcttggatggcagcgacgaggcaagttgcccagtgctgacgtgtggaccagcttccttccagtgtaattcgagtacgtgcatcccccagctatgggcgtgtgataacgatccagattgcgaggacggcagcgatgaatggcctcagcggtgccgcggactgtatgtctttcaaggcgacagctcgccatgctcggcgtttgagttccattgcctgtccggcgagtgcatacacagctcctggcgttgtgacggcggacccgactgcaaggataagtcggacgaggagaattgtgctgtggcaacgtgccgcccagacgagttccagtgctcagatggcaattgcatccatggctcccggcaatgcgatagagagtacgattgcaaagacatgagtgatgaggtcggctgcgtgaacgttaccctatgtgagggccccaataagtttaagtgccacagcggcgagtgcattaccctcgataaggtctgcaacatggctcgtgactgtagggattggtcggatgagcccatcaaagagtgcggcactgccgagtgcctggataataacggcggctgttcccacgtgtgtaatgatctgaaaataggctatgagtgcctctgcccagacggctttcagttggtggcacagcggcgctgcgaggacatcgatgagtgccaggaccctgacacttgctcccagctctgcgtgaatcttgagggtggctacaagtgccaatgcgaggagggcttccagttggacccccacaccaaagcctgcaaggctgtcggctcgatagcctacctgttcttcacaaaccgacatgaggtccgcaagatgaccctggacagaagcgaatacacatcgctaatccccaacctacgaaacgtggtggcacttgacacagaggttgcatcgaatcgtatatactggagcgacctgagccaaaggatgatttgctccacccagcttgaccgcgcgcatggcgtcagtagctatgacacagtgatcagccgtgacattcaagcccccgacggactggctgtcgattggatccattcgaatatctattggactgattctgtgttgggaactgtaagcgtcgctgataccaagggagtcaagcgcaagacgctatttcgagagaacggcagtaagccacgcgccatcgtggtggacccggtgcacggcttcatgtattggacagactggggaacgcccgccaagattaaaaaaggcggactgaatggcgtcgatatctactctctagttaccgaaaatatccagtggccaaatggtattaccctagatctgctgagtggacgcctgtattgggtggatagtaagctgcactctatctcatctatagatgtgaacggtggcaatcggaaaacaatcttggaggacgagaagcgcttggcccaccccttttccttggcggtattcgaggataaagttttctggaccgatatcataaatgaggcaattttcagtgccaaccgtctgacaggttccgatgttaatctattggctgaaaacctgctgtctccggaagatatggtcctattccacaatttgactcaaccacgtggcgtcaactggtgtgagcgaactactttaagtaacggcggctgccaatacctttgcttaccggcacctcaaatcaacccacatagtccgaagttcacgtgcgcttgccccgacggtatgctgctcgcacgtgatatgcgcagctgtctaactgaagccgaggcggccgtagcgacgcaggagacctccaccgtgcgcttaaaggtctcctctacggcggttcgcacacagcatactaccaccaggccagtacccgacacgtcgaggctgcctggagccaccccgggcttgacgactgtggagattgttacgatgagccaccaggctcttggtgacgtcgcaggtcggggcaacgagaagaagccaagctcggtgcgcgctctgtccatcgttttgcctattgtcctactggtattcttgtgccttggggtatttctcctctggaaaaattggcgcctaaagaacataaattcgatcaatttcgataatcctgtgtatcagaagaccacagaggatgaggtgcacatatgccataaccaggatggctacagctacccctcgcgacagatggtatcactggaggacgatgtggcg

SEQ ID NO: 16160 - DNA, 2580 bp, Artificial Sequence
  Description of Artificial Sequence: Synthetic coding sequence
atgggcccttggggttggaaactgcgctggacggtcgccctcttgctggccgctgctgggactgcggtgggcgatcgctgcgagagaaacgaattccagtgtcaggatggaaagtgtatttcctacaagtgggtctgtgatggctcggccgaatgccaggatggctccgatgagagccaggaaacctgcctgagtgtgacctgtaagtctggagacttctcctgcggcgggcgtgtgaatcgctgtattcctcagttctggcggtgtgatggccaagtcgactgtgataatggcagtgacgagcagggttgcccaccaaaaacatgttcccaggatgagttccgatgccacgatggcaaatgtataagccgccaatttgtttgtgattctgacagagattgtctggatggatctgacgaagcaagctgccccgttctgacctgcggcccagcttcttttcagtgcaacagctcaacatgtatcccacaactgtgggcctgcgataatgatcctgactgtgaagatggctccgacgaatggcctcagcgctgccgtggcctgtacgttttccaaggtgattcctcaccgtgctccgcattcgagttccattgtctcagtggtgagtgcatccactcctcttggcgatgcgacggggggccagattgtaaggacaaatctgacgaagagaactgtgcagtggccacatgtcgcccggatgagttccagtgcagtgatggcaattgtatacacgggagccggcaatgtgacagagagtacgactgcaaagacatgagtgatgaggtcggctgtgttaatgtgactctgtgcgagggtcctaataaattcaagtgccactccggcgagtgcattactctcgataaggtttgcaatatggctagagactgccgcgactggagcgatgaaccgataaaggagtgtgggacagcagaatgtctggacaacaatggggggtgttcacatgtgtgtaatgatctaaaaatcgggtatgagtgtctgtgcccggatgggtttcaactggtggcccagaggcgctgcgaggatatagatgaatgccaggaccccgacacatgttcccagctgtgtgttaatctggagggcggttataagtgccagtgcgaagagggttttcaacttgatcctcacaccaaggcctgcaaagccgtgggttcaattgcatacctattttttactaaccggcacgaggtgcgtaaaatgacattggatcgcagtgagtacacatctctaattccaaacctccggaacgtcgtggcacttgacacagaagtagcgtcgaaccggatttattggagtgacctctctcagagaatgatatgctccacacaactggaccgggctcatggcgtgtcatcttatgacactgttatctcacgagatattcaggcccccgacggactagccgtggactggatccattccaatatttactggacagattccgtgctcgggaccgtttcggtggccgatacaaagggcgtgaagcgcaaaacccttttcagagagaatggatcaaagcctagggcaattgtcgtggatcccgtgcacggatttatgtattggacagattggggcactcctgctaagattaagaagggtggcctgaatggcgtggacatttatagccttgtcacagagaacatccagtggcctaacgggatcaccctggacctgctttcagggaggctatattgggtcgactcaaagctgcactccataagctcgatagacgtgaatggggggaaccgtaagacaatattggaagacgagaaacggttggcacacccctttagtctcgccgtgttcgaggataaagtgttctggactgacattataaacgaggcaattttttctgctaaccggctgaccggtagtgatgtgaacttgctggccgaaaacctcttaagtcctgaagacatggttctgttccataacctgacacagcccagaggagtgaattggtgcgagcggaccactctctctaacgggggctgccagtacctgtgtctgccagcaccgcagatcaatccccatagtcctaaatttacgtgcgcttgtcccgatgggatgcttctcgcccgagacatgaggagttgcctcactgaggcagaggctgcagtggccacccaggaaacatccaccgtgcggctgaaagtgtctagcaccgcggttaggacccagcacaccactacacgacctgtgccagatactagccgattaccaggggcgacccccggtctgaccactgtggaaatcgtaactatgagtcaccaggccttgggagacgtggctggccgaggaaacgagaaaaagccctcgagcgttagagccctgtcgatagtcctgccaattgtgctcctggtctttttgtgcctgggtgtttttctcctctggaagaattggcgactaaagaatattaattcgattaacttcgacaatccggtgtatcaaaagactacggaggacgaagtacacatttgtcataatcaggacgggtactcttatccttcccggcagatggttagcctggaagatgatgtggcc

SEQ ID NO: 16161 - DNA, 2580 bp, Artificial Sequence
  Description of Artificial Sequence: Synthetic coding sequence
atggggccctggggctggaaacttcggtggaccgtcgcgcttttgctggctgccgcaggtactgcagtgggagatcggtgtgaacgaaatgaattccaatgtcaagacggcaagtgtatttcctacaaatgggtgtgcgatggatcggcagaatgccaggatggttccgatgagtcgcaagagacttgtttgagcgttacgtgtaaatccggcgatttttcatgtggaggacgtgtgaaccgctgtattccgcagttttggaggtgcgacggtcaggtggattgtgacaacggatccgatgagcaagggtgtcctccaaagacctgctcgcaagatgagttccgatgccacgatgggaagtgcatctcacgtcagtttgtgtgtgattcagatcgcgactgtctcgatggaagcgacgaagccagctgtccggttcttacttgcgggccagcatcctttcaatgtaactcttcgacttgtattccccagctgtgggcatgtgataatgatccggattgtgaggatggatcagatgaatggcctcagcgctgtcggggactgtacgtgttccagggtgattcctccccgtgttcagcctttgaatttcactgtcttagcggagagtgcattcacagctcgtggagatgtgatggaggtcctgactgcaaggacaagagcgatgaagagaattgtgcagtggcaacttgccgcccagatgaatttcaatgttcagatggaaactgcattcacggatccagacagtgtgacagagagtacgattgtaaggatatgtcagatgaagttggatgtgtgaacgtgactctttgcgaaggaccgaacaaattcaagtgtcattcaggagaatgtattacgctggataaggtgtgcaatatggcgcgggattgtagagattggtccgatgagcccatcaaggaatgtggtaccgccgaatgtcttgacaacaatggtggttgttcgcacgtctgtaatgacctgaaaattggttacgaatgtctgtgtccagacggctttcaacttgtggcacagcgccgctgtgaagatattgatgagtgtcaagatcccgacacttgtagccagctttgtgtgaatctcgaaggcgggtacaagtgccagtgcgaggagggattccagctggatcctcatacgaaggcatgcaaggcggtgggatcaattgcatatctctttttcaccaaccgccacgaagtccgaaagatgaccctggaccgctcggagtacacttcccttattccaaacctgagaaatgtggtcgcactggacaccgaggtggcatcgaacagaatttactggagcgatctgtcccagaggatgatttgttcgactcagctcgatcgcgctcatggtgtgtcgtcctacgataccgtcatctcgcgcgatattcaagcacctgatggcctggcagtggattggattcactccaacatttactggactgactccgtccttggaactgtctcagtggcagatacgaaaggagtgaagcgcaaaacgctgtttcgtgaaaacggcagcaaaccacgggcaatcgtggtcgaccccgtgcatggatttatgtattggaccgactggggaacccctgcgaaaatcaaaaaggggggactcaatggggttgacatttactcattggtgactgagaacatccaatggcccaacggaattactcttgacctgctgtcgggccggctttactgggtcgattcaaagctccattccatatcgtcgattgacgtgaatggaggtaacaggaaaactattttggaggatgaaaagagacttgcacatcccttttcgctggcagtgttcgaggataaagtgttctggactgatatcatcaatgaagccatcttctcggcaaacagacttaccgggtccgatgtgaaccttctcgccgaaaatctgcttagccccgaggatatggtgctctttcataaccttacgcagcctcggggagtgaactggtgcgaacgtactaccctttcgaatgggggctgtcagtacctttgtctgccagcccctcagatcaacccacattcgcccaagtttacctgcgcctgtcctgacggtatgttgctggccagagacatgcgaagctgtctcaccgaggcagaagcagcagtggctacgcaggaaaccagcactgtccgtcttaaagtgtcgtctactgctgtgagaacccaacacaccactacccggccagtccctgacacttcacgactgcccggagccactccgggacttactactgtcgaaatcgtcacgatgtcccatcaggcactgggggacgttgccggtcgcggaaatgaaaagaagccttcaagcgttagagcactgtcgatcgtgttgccaattgtgctgctcgtattcctgtgcctgggcgtgtttctcctttggaagaattggcgtcttaagaacatcaatagcataaactttgataaccccgtctatcagaaaaccactgaagatgaagtgcacatatgccataatcaagatggttactcgtacccgtccagacagatggtgtccctcgaagatgatgtggca

SEQ ID NO: 16162 - DNA, 2580 bp, Artificial Sequence
  Description of Artificial Sequence: Synthetic coding sequence
atgggcccttggggatggaaactgcggtggacagtggcattgttactcgctgccgcagggacagccgttggtgatcgctgtgagcgcaatgaattccagtgccaggatgggaaatgtatttcttacaagtgggtctgcgacgggtcagcagaatgccaagacggttcagatgaaagtcaggagacctgcctgagtgttacatgtaagtctggtgatttctcgtgtggcggtcgggttaatcggtgtatcccacagttctggaggtgcgatggacaggtggactgcgataatgggtccgacgaacagggatgtcctcccaagacttgctctcaggatgagttcagatgtcacgatgggaaatgcatttctaggcagttcgtgtgtgactcagaccgagattgccttgacggctctgacgaagcttcctgccctgtgttgacttgcgggcccgcgtcttttcaatgtaactcaagcacttgtatcccccagctgtgggcctgcgacaatgacccggactgcgaagacggcagtgacgagtggcctcagcggtgtagagggctgtatgtgtttcagggggactcatctccttgctctgcttttgaattccactgcctgagtggggagtgcatccacagttcttggaggtgtgacgggggccctgattgtaaggacaagtctgacgaagagaactgtgctgtggccacgtgcaggccggacgaatttcagtgtagtgacggaaattgcatccacggaagtcgtcagtgcgatcgagaatacgactgcaaagacatgtccgatgaagtgggctgtgttaatgtcaccctctgtgagggtcctaataaattcaagtgccattccggcgagtgcatcacgctcgataaagtgtgtaatatggccagagattgtcgcgattggtccgacgagccgattaaggagtgcggaacagctgagtgcctcgataacaacgggggctgttctcacgtgtgcaatgacttgaagattggatatgagtgtctgtgtcccgatggttttcaattggtggcacagaggcggtgcgaggacatcgatgaatgccaagatcccgatacatgtagtcagctctgtgtgaacctggagggcggttataagtgccagtgcgaagaggggttccaattagaccctcacacaaaggcttgtaaggcggtgggttctatcgcctacctatttttcactaacagacatgaagtgcggaagatgacgctagatcggtccgaatacacctctctcatcccaaatttgcgtaatgtggtggctctcgatactgaagtagccagcaacagaatttattggtctgacctctcccaacgcatgatctgctctacacagttggacagggcacacggtgtgagctcttatgataccgtcatctcacgcgacatccaggcacctgatggtctcgcagtggactggattcattcaaacatctactggacggactccgtgttgggaaccgtgtctgtagctgatacgaagggggtgaaacgaaagacactgtttagagagaacggctccaaaccgcgggctatcgtcgttgatccagtgcatgggtttatgtactggacagactggggaacacctgccaaaattaaaaaaggcggactgaatggcgttgatatctattccttggttactgagaatatccagtggcccaatggcatcaccctggatttattgagcgggagactctactgggtggactctaaattgcattctatctcttccatcgacgtgaatggcggcaaccgcaagactatcctggaagacgagaagcgccttgctcatccgttctcactggcagtattcgaggataaagtgttctggacagacatcatcaacgaggcaatcttctccgctaacaggctcacgggcagcgatgttaatcttctcgctgagaacctgctctctcctgaggatatggtgcttttccacaacctgacccagccccgtggagtgaactggtgcgagcgtacgacgctgtctaacggcggatgtcagtacctttgcctgcccgcccctcagattaacccacactcccccaagtttacgtgtgcgtgtccagatggaatgctcctggctcgtgacatgcgcagttgccttaccgaggcagaggccgccgtggctactcaggagacatcgactgtccgtctgaaagtgtcatcaacggcagtgcggacgcagcacaccactactaggccagtccctgacacaagtcgcctacccggggcgaccccaggactgacaacggttgagattgtcaccatgtcacatcaggccttaggagacgtcgcaggtcgaggcaacgagaaaaaaccgagctcagttagggccctaagcatcgtcctacctatagtcttgcttgtcttcctttgtcttggggtgtttcttctctggaaaaactggagactcaaaaacattaactccataaatttcgacaacccagtgtaccaaaagactaccgaggacgaagtgcacatttgtcataatcaggatggttactcctacccttctaggcagatggtgagcctggaggatgatgtcgcc

SEQ ID NO: 16163 - DNA, 2580 bp, Artificial Sequence; identical to SEQ ID NO: 16157
  Description of Artificial Sequence: Synthetic coding sequence

SEQ ID NO: 16164 - DNA, 2580 bp, Artificial Sequence
  Description of Artificial Sequence: Synthetic coding sequence
atgggtccatggggatggaagttgagatggaccgtggcactgctcctggccgccgctggtactgccgtcggggatcgctgcgaacgcaatgagttccagtgccaggatggaaagtgcatctcgtacaaatgggtgtgtgacggatcggctgagtgccaggacgggagcgatgaatcgcaagagacttgcctgtcagtcacttgcaaatcgggggacttctcgtgcggaggccgtgtgaacagatgcatcccgcaattctggcggtgcgacgggcaggtggactgcgataacggtagcgacgagcaaggatgcccgccaaagacttgctcacaagatgaattccggtgccacgacgggaaatgcatctcccggcaattcgtgtgcgattcggaccgagactgcctggacggttccgacgaggcatcctgtcccgtgcttacttgtggccccgcctcctttcaatgtaactcatcgacttgcatcccgcagctgtgggcttgcgacaacgaccctgactgtgaggacggatccgacgagtggcctcagcgttgtcgcggactctacgtgtttcagggcgactcaagcccatgcagcgccttcgagtttcactgcctgtctggagaatgcattcattcatcatggcgctgcgacgggggacccgattgtaaggacaagtcagatgaagagaactgcgccgtcgcaacctgccgcccagacgaattccaatgctccgacggcaactgcatccatgggagccgccagtgcgacagggaatacgattgcaaagatatgagcgatgaagtggggtgcgtgaacgtgactctgtgcgaaggacctaacaagttcaaatgccactccggagagtgcatcactctggataaagtatgcaacatggctcgagattgccgcgactggtccgatgagccgatcaaagaatgtgggactgcagagtgcctggacaacaacgggggatgttcccatgtctgcaacgacctcaagatcgggtacgagtgcctctgccctgacggcttccagctcgtggcgcagaggagatgtgaggacattgatgaatgccaagatccagacacctgttcgcagctgtgcgtgaacctggaaggaggttacaagtgccagtgcgaagaaggtttccagctcgacccgcacaccaaggcatgcaaggcggtgggaagcattgcataccttttctttactaatcggcacgaagtccggaagatgacgctggaccgctcggaatacacgtcgttgattcctaatctcagaaatgtggtcgccctggatactgaagtggcgtccaacagaatctactggtcagatctgtcacaacggatgatctgcagcacgcagcttgatagagctcacggagtgagctcctacgacaccgtgatcagcagagacatccaagcaccggacgggttggccgtcgattggatccacagtaacatttactggaccgacagcgtgctcggaactgtgagcgtggcggacactaagggagtgaaacgcaagactttgttccgggagaacgggagcaagccacgggccatcgtggtggacccagtccacggattcatgtactggactgattggggaacgccggcgaagatcaagaagggaggccttaacggtgtggacatctacagccttgtcaccgaaaacatccagtggccaaacggaatcacgctggatctgctgtcgggtagactgtactgggtcgactcgaagttgcatagcatatcctcgatcgatgtcaatgggggtaatcgcaagactatcttggaggatgaaaagcggctcgcgcatcctttttcattggcggtgttcgaagataaggtgttctggaccgacatcatcaacgaagcaatctttagcgcaaaccgcctgacggggtcagacgtgaacttgctggcggaaaatcttctttcacctgaagatatggtcctgttccacaacctgacccagccgcggggcgtgaactggtgtgaacgcaccactctgtccaacggaggctgtcagtacctctgcctgccggccccacaaatcaacccgcactcgccaaaattcacttgcgcatgtccggacggaatgctgcttgcccgcgacatgagatcgtgcctcaccgaggcggaagccgctgtcgccacccaggaaacctccactgtcagacttaaggtgagctcgactgccgtgcgcacccagcacaccactacccgcccggtccctgataccagccgcctcccgggtgccactccgggccttaccaccgtggaaatcgtgaccatgtcgcaccaagccctcggagacgtggccggacggggaaacgagaagaagccaagctccgtgagggcactctccattgtcctgccgatcgtcctgctggtgttcctgtgcctcggggtgtttctcctgtggaaaaactggcggctcaagaacatcaattcaatcaacttcgacaatccagtgtaccaaaagactactgaggatgaagtccatatctgccataaccaggacggatactcctatcccagcagacagatggtgagcctcgaggacgacgtggcg

SEQ ID NO: 16165 - DNA, 2580 bp, Artificial Sequence
  Description of Artificial Sequence: Synthetic coding sequence
atggggccatgggggtggaagctcaggtggaccgttgcgttgctcttggccgccgccgggacagccgttggggatcggtgtgagcgcaacgagtttcagtgccaggatgggaagtgcattagctataaatgggtatgtgacggcagcgccgaatgtcaggatggatccgatgagtcacaggagacttgcctgtctgtcacatgcaagtcgggagatttcagttgcgggggccgcgtgaataggtgtatccctcagttttggcggtgcgacgggcaggtcgattgtgacaatggctccgatgagcaggggtgccctcctaagacctgctcccaggacgaatttcgatgccacgacgggaaatgcattagccggcagtttgtgtgcgacagcgatcgggactgccttgatggtagcgatgaagcctcgtgccccgtgctgacctgtggccccgcctcttttcagtgcaattccagcacctgcatcccacagctttgggcatgcgacaacgatccagactgtgaggatggatcggacgaatggcctcaaaggtgtcggggcctctatgtgttccagggagattcttcaccctgtagtgcgttcgaattccattgcctgtctggcgagtgtatccactcatcgtggcggtgcgatggaggtcccgattgtaaggacaaatccgatgaagaaaattgtgctgtggccacttgtaggcccgatgagtttcagtgcagtgatggaaattgcatacacggttcacgtcagtgtgatcgcgagtacgattgcaaagacatgagcgacgaagtgggatgtgtgaacgtcacattgtgcgaaggaccgaataagtttaaatgtcattccggagagtgcataaccctggataaagtgtgtaacatggcaagggactgccgcgactggagcgacgagcctataaaggagtgtggcactgccgagtgcctggataataatggcggttgctcgcatgtgtgtaacgatctgaaaatcggatatgaatgtttatgccctgacgggtttcaactcgtagcccagcggaggtgcgaagacatcgatgagtgtcaggatcccgatacatgttctcagctatgtgttaatcttgagggtggatataagtgtcaatgcgaggagggctttcagctggacccccatacaaaagcatgcaaggctgttggcagtattgcttacctgttcttcacaaacaggcacgaggtccgtaagatgaccctcgaccggtcagaatacacttcacttattccaaatctgagaaatgtggttgccctggatacggaagttgcgtcaaataggatttattggtccgatttatctcagagaatgatttgttcaacacaactagacagggcccatggcgtgtcttcatatgataccgtgatcagccgcgacatccaggcacccgatggccttgctgttgactggattcactctaatatttactggacagactccgtgctcggaacagtaagtgtggccgatactaagggagtaaagcgcaaaactctgttccgggaaaacggctccaaaccccgggctatagtcgtagacccagttcatggtttcatgtattggacagactggggtacacctgcgaagatcaaaaaggggggcctaaatggagttgatatctactctctggtgacggagaacatacaatggcccaatgggattactctggatctactgtccggcaggctgtactgggtagactcaaagctccattctatcagctctatcgatgtcaatggcgggaatcggaagaccatcctggaagacgaaaaacgtcttgcacatcctttttcattggcagtgtttgaggacaaagtattttggacagacattatcaatgaggctatcttttcagctaatagactgaccggttctgatgtgaacctcctcgccgagaacctccttagtccggaagatatggtgctcttccacaatctcactcagccccggggggtcaattggtgtgaacgcaccacgctttccaacgggggctgccagtacctttgccttcctgcccctcagattaatcctcactctccaaagttcacgtgtgcctgcccagacgggatgttgctggcccgcgacatgcgatcgtgccttaccgaagcggaggccgctgtggctacacaggaaacctctactgttagattgaaggtgtcgtccacagccgttaggacacagcatacgaccacccgccccgtcccggacacaagccggctgccaggagcaactccagggctgaccaccgtagagattgtaaccatgagtcaccaggccctcggggacgtggccggaagggggaacgaaaaaaaaccatcgtccgtgcgcgctctgtcgatcgtactacccattgtactgctggttttcctctgcctgggcgtattcctattgtggaagaactggcgactgaagaatataaactccatcaacttcgataatccagtttatcagaaaacaacagaagacgaagtgcacatctgtcacaatcaagatggatatagttaccctagtagacaaatggtaagcctggaggacgatgtagcc

SEQ ID NO: 16166 - DNA, 2580 bp, Artificial Sequence
  Description of Artificial Sequence: Synthetic coding sequence
atgggaccatggggctggaaacttcgttggaccgtcgcacttctgcttgccgcagcgggaactgccgtgggtgatcggtgcgaacgaaacgaattccaatgtcaagatggcaagtgcattagctacaaatgggtgtgcgatggttcagcggaatgccaagatggatcggatgagtcgcaagagacttgtcttagcgtgacttgcaagagcggagatttttcctgcggtggaagagtgaataggtgcatcccacagttctggcgttgcgacggacaagtcgattgtgataacggatccgacgaacagggttgccctccaaagacctgctctcaagatgagttcagatgtcatgatggaaagtgtatttcaagacagtttgtgtgtgattccgatcgggactgtcttgatggttccgacgaagcctcttgtcctgtgcttacctgtggtcctgcatcctttcaatgtaacagctcaacttgtattccccagctttgggcatgtgataacgatccagattgcgaagatggaagcgatgagtggccgcaacgctgtcgaggtctgtacgtgtttcaaggagactcctccccatgctcggcatttgaatttcattgtctttccggcgagtgtatccacagctcgtggcgctgtgatggaggccctgattgcaaggacaagagcgacgaagaaaattgtgcagtggccacgtgtagaccggatgagtttcagtgtagcgatggaaactgtattcacggatcgagacaatgtgatcgcgaatacgattgtaaagacatgtcggacgaagtgggttgtgtcaacgtgactctgtgtgaaggccccaataagtttaagtgtcattcgggtgaatgcattacccttgacaaggtctgtaacatggcacgagactgccgagattggtctgacgaaccgatcaaggaatgcggtaccgcggaatgtttggataacaacgggggatgttcgcatgtgtgtaatgatcttaagattggatacgaatgtctctgtcccgatggttttcaactcgtggcccaacgaagatgtgaagatatcgatgaatgtcaagatcctgatacctgttcgcaactgtgcgtgaacctggaaggtggctacaaatgccaatgcgaagaaggatttcagcttgatccgcataccaaggcctgtaaggccgtcggaagcatcgcatacctgttcttcaccaaccggcatgaggtgagaaagatgacccttgatcggagtgaatacacttcactcatacctaaccttagaaacgtggttgcccttgatacggaagtggcaagcaaccgcatctactggagcgatctttcccagagaatgatttgctcgactcaactcgaccgagcgcacggggtttcatcctacgataccgtcatttccagggacattcaggcaccagacggactggcggtcgactggattcattccaatatctactggactgactcggtgctcggtactgtgtcagtggcggacactaagggtgtgaagcgcaagacgttgtttcgagagaatggttcgaagccacgggctatagtcgtcgatcctgtccatgggtttatgtactggactgattggggtactccggcaaagattaagaaggggggactgaatggagtggacatttactcccttgtgaccgaaaacattcagtggcctaacgggattaccctggatctgctgtcaggaaggctgtactgggtggatagcaaacttcattccattagcagcattgatgtgaatggtggaaacagaaagaccatcctggaagatgaaaagaggttggcacatcccttttcgctggccgtgttcgaagataaagtcttttggacggacattatcaatgaagcaatcttttccgcaaacagactgacgggttcggacgtcaacctgcttgccgaaaatctgctctccccggaggacatggtgctctttcacaatctcacccaaccacgcggagtgaattggtgtgagagaactactctctcgaatggagggtgccagtatctctgtctgcccgccccgcagataaacccccattcaccaaagtttacttgtgcatgtcctgatggcatgctcctggctagagatatgcgctcctgccttaccgaagcagaagctgccgtggctacccaagaaacctctaccgtgcggctgaaggtgtcctcaactgcagtgcggacccagcatactaccacccgccctgtgccagatacctcgagactgccgggcgccacgccaggacttaccaccgtggagatcgttaccatgtcgcatcaagcacttggtgacgtcgcaggacgcggaaacgaaaagaagccctcgagcgtgagagcactgtcgattgttctgccaattgtcctgttggtattcttgtgtctcggagtgtttctgctgtggaaaaactggagactcaagaacataaacagcatcaattttgacaatcctgtgtaccaaaagactactgaagatgaagtgcacatttgtcacaatcaagacggttacagctacccgagccggcaaatggtcagcctggaggacgacgtggcc

SEQ ID NO: 16167 - DNA, 2580 bp, Artificial Sequence
  Description of Artificial Sequence: Synthetic coding sequence
atgggtccgtggggatggaagctgcgttggactgtcgcgctgctgcttgcagcagcaggcaccgcagttggtgatagatgcgagcgtaacgaatttcagtgtcaagatggaaaatgtatcagctacaagtgggtctgtgatggaagcgcggaatgtcaagacggatcagatgaatcccaggaaacctgtctgtcggtgacttgcaaatcgggtgacttctcgtgtggtgggagagtgaatcgatgcatcccccagttttggcggtgcgacggacaggtggactgcgataatgggtccgatgaacaaggttgtccgcctaaaacctgtagccaggacgagttccgctgtcatgatggcaagtgtattagccgtcaattcgtctgtgactcagacagagactgtcttgacggctcggatgaagcatcctgcccagtgcttacctgcggtccggcatcatttcagtgtaattcctcaacctgcatcccacagctttgggcctgtgataacgatcccgattgcgaagatggaagcgatgagtggccccaaagatgccggggactctacgtgttccaaggagactcgtcaccttgttcagcattcgaatttcactgcctttccggcgagtgtattcactcgtcgtggcgctgcgatggagggccagattgcaaggacaagtccgacgaagagaattgtgcagtcgcgacgtgtagacctgatgagtttcaatgctctgatggaaactgcatacacggttcccggcaatgtgatagagaatacgactgtaaagatatgtccgacgaagttggctgcgtgaacgtgactctttgtgagggcccaaacaagttcaagtgtcattcaggtgaatgtataaccctggacaaggtctgtaatatggcccgtgattgcagagactggtcggacgagcctattaaggagtgtggaaccgcagagtgcctggataacaacgggggatgtagccatgtgtgtaatgacttgaaaatcggctacgaatgtttgtgccctgatgggttccagcttgtggcacagcgacgttgcgaagatattgatgaatgccaggaccccgacacttgtagccaactttgtgtcaatctggaaggtggctacaaatgccaatgtgaggaaggctttcaactcgatcctcatactaaagcgtgtaaagccgtcggcagcatcgcttacttgtttttcaccaacagacatgaggttagaaagatgactttggatagatcggagtacacctcgcttattcctaacctccgcaacgtggtggctcttgacaccgaagtggcctcgaacagaatctactggtccgacctctcacagcgtatgatttgctccacccagctcgatcgggcgcatggagtgtcaagctacgatactgtgatttcgagagatatacaagcacctgacggactggcggtggattggatccattcgaatatctattggacggatagcgtgctcgggactgtgtccgtggcagacactaagggtgtcaagcggaaaacgctgttcagggaaaacgggtcgaagccccgggccattgtggtcgatcctgtgcatggctttatgtactggactgattgggggactccagcaaagataaagaagggagggctgaacggagtcgacatctatagcctggtgaccgagaatatccaatggcctaatggaattacgctcgacctcctgtccggccgactttactgggtcgattctaaacttcactctatctcgtccatagacgtcaacggtggtaatcgtaagaccatcttggaggatgagaagaggcttgcccatcccttttcactggctgtgttcgaagataaggtgttttggactgacattatcaatgaggcaattttctccgccaacagactgaccggttctgacgtgaaccttcttgcagaaaacctcctttcgcccgaagatatggtgctgtttcataatctgactcagccaagaggcgttaactggtgtgaaagaacgaccctgtcgaatggcggctgtcagtacctctgtctcccagcaccgcaaatcaatccgcactcgcctaagttcacctgcgcatgcccagacggaatgctccttgcacgggatatgcggtcgtgtctgactgaagcagaagccgcggtggccacgcaggaaacctcgaccgtgcgccttaaggtcagctccaccgctgtgcgtactcaacacaccactacgcggcccgtcccggacacgagccgtctccccggagccaccccaggcttgaccactgtggagattgtgaccatgtcacaccaagcccttggtgacgtcgcgggaaggggaaacgaaaagaagccatcatccgtgagagctctgtccatcgtcctccctattgtgctgctggtgttcttgtgtcttggggtgttcctgctgtggaaaaactggaggcttaagaacataaacagcattaactttgataaccccgtgtaccaaaaaaccaccgaggatgaagtgcatatatgtcataaccaagacggttacagctacccttcacgccaaatggtttctctggaagatgacgtcgca

SEQ ID NO: 16168 - DNA, 2580 bp, Artificial Sequence
  Description of Artificial Sequence: Synthetic coding sequence
atgggaccttggggttggaagctgcggtggaccgtggcactgttactcgccgcagctggcaccgctgtgggtgatcgctgtgagcggaacgagtttcagtgtcaggatggtaaatgcatttcctacaagtgggtatgcgatgggagcgcagaatgccaggatggatctgacgaatctcaggagacctgcctctctgttacctgcaagagtggtgactttagctgtgggggtcgtgtgaatagatgcatcccacagttttggcgctgcgatggccaggttgattgtgacaacgggagcgacgagcagggctgcccaccgaagacctgctcccaggatgaattcagatgtcatgacgggaagtgtatttctcgtcagttcgtgtgtgactcagacagagattgtttagacggatcagacgaagcctcatgcccggtattgacctgcggccccgcctctttccaatgtaactcctccacctgcattccgcagctttgggcatgcgataatgacccggactgcgaagacgggtctgacgagtggccacagcgttgtcgcggcctctacgtgttccagggagactccagtccctgtagcgcctttgagtttcattgtttgtccggagagtgcatccatagctcctggcggtgcgatggaggcccggactgtaaggataagagtgacgaagagaattgtgcagtagcaacatgcagaccggatgagttccagtgctcagatggcaattgtatccacggttccagacaatgcgatagggaatacgactgtaaggatatgtccgatgaggtcggttgcgtcaatgtcaccctgtgcgaaggtccaaacaaatttaaatgtcatagtggagagtgcataaccttagataaggtatgcaacatggccagggactgtagagattggagcgatgagcccattaaggagtgtggcacggcagagtgtttggacaataatggcggctgctcccacgtatgcaatgatctgaaaataggttacgaatgtctttgtcctgatggcttccagctggtcgcccagaggcgttgtgaggacatagacgagtgtcaggaccccgatacttgcagtcaactctgcgtcaatctggagggtgggtacaagtgccagtgtgaggaaggatttcaactcgatccgcacacgaaggcatgcaaggcagtgggaagtattgcctatttgttcttcaccaataggcacgaggtgcggaagatgacgctcgatcggagcgagtatacaagtcttattccaaatttgaggaatgtggtcgcactcgataccgaagtagcctccaatcggatttattggagcgacctctcgcagcggatgatttgctcgacacagttggatcgggcccatggtgtgtcttcttacgacaccgtgatttcccgcgacatccaggctccagatggattggccgtcgattggattcattcgaacatttattggacagattccgttctcggcacagtttcagtcgccgataccaagggtgtaaaacgtaaaactctgtttcgcgagaacgggtccaagcctcgggccatcgtggtggaccccgtgcacggtttcatgtattggactgattgggggacaccagccaaaatcaagaaaggggggctgaatggcgtggatatttactctttagtgacggagaatattcaatggcctaacggcatcaccctggacctgctcagcggacggctgtattgggttgatagtaagctgcacagcatctcatcaattgatgtcaatggtgggaaccgcaagacgatactggaagacgagaagagactggctcaccccttttcattggcagtattcgaggataaggtattctggactgatatcattaatgaggcaatcttttctgccaacaggctcacagggagcgacgtcaatttattagctgagaacctgctgtcacccgaggatatggtccttttccataatctcacccagccccgtggtgtgaattggtgcgagagaaccaccctgtcaaatgggggctgtcagtacttatgtttacccgccccccagattaacccccacagtcccaagtttacttgtgcatgccctgacggcatgctgttggccagagacatgcgcagctgcttgacagaggcagaagcagcggttgctacacaagagactagcacagttcggctgaaggtatctagcactgccgtgcgaacccagcacacaacaacccggcccgtccccgacacctcgaggctgcccggcgctacgcctgggctgacaaccgttgagatcgtcacaatgtcccatcaggctctcggtgatgttgctggccgaggaaatgaaaaaaagccttccagtgtacgggcactgagtatcgtgctaccaatcgtgctcttagtgtttctgtgcctcggggtgttccttttgtggaaaaactggaggctaaagaacattaattctatcaatttcgacaatcccgtgtatcaaaaaacaacagaggacgaagtacacatttgccataatcaagacgggtacagttatcccagtcgccagatggtctctttggaggacgacgtggca

SEQ ID NO: 16169 - DNA, 2580 bp, Artificial Sequence
  Description of Artificial Sequence: Synthetic coding sequence
atgggaccatggggatggaaattacgatggacagttgctcttttattagcagcagctggtacagctgttggtgacaggtgtgagcgtaatgaatttcaatgtcaagatggaaagtgtataagttataaatgggtttgtgatggttcagcagaatgtcaagatggatcagatgaaagtcaagaaacttgtcttagcgtgacttgtaaaagtggagacttctcttgtggaggtagagttaatagatgtattccacaattttggagatgtgatgggcaagtagattgtgacaatgggtcagatgagcaaggatgtccacctaaaacatgttctcaagatgaatttagatgtcatgatggaaaatgtattagtagacaatttgtatgtgatagtgatagagattgtttagatggaagtgatgaagctagttgtccagttttaacttgtgggccagcaagtttccaatgtaattcaagtacttgtataccacaactttgggcttgtgataatgatccagattgtgaagatggaagtgacgaatggccacaacgatgtagaggtctttatgtttttcaaggagattcatctccatgttcagcatttgaattccattgtttgtctggagaatgtattcattccagttggagatgtgatggaggtcctgattgtaaggataaatctgatgaagaaaattgtgcagtcgcaacttgtagaccagatgaattccaatgttccgatggaaactgtattcatggaagtagacaatgtgatagagaatatgattgtaaggatatgtcagacgaagtaggatgtgtcaatgttacattatgtgaaggacctaataaatttaaatgtcactcaggagaatgtataacattagataaggtttgtaatatggctagggattgtcgagattggtcagatgaaccaattaaagaatgcggaacagctgaatgtcttgataataacggaggatgtagtcatgtgtgtaacgacttaaaaattggatatgaatgtttatgtccagatggatttcaattagttgcacaaagaagatgtgaagatattgacgaatgtcaagatcctgatacttgttcacaactatgtgttaacttggaaggaggatacaaatgtcaatgtgaagaaggtttccaacttgatccacatactaaagcatgtaaagctgtaggatcaatcgcatatttatttttcacaaacagacatgaagtaagaaaaatgacacttgatagatctgaatatacgagtttaataccaaacttacgaaatgtagttgcacttgataccgaagttgcatcgaacagaatatattggtctgatttatcacaaagaatgatttgttcaactcaattggatagagctcatggagtttcatcttatgatactgttatttcaagagacatacaagctccagatggacttgctgttgattggattcattcaaatatctattggacagactctgtcttaggaacagtatctgttgctgatacgaaaggtgtaaaaaggaaaacattatttagagaaaacggaagtaaaccaagagctattgttgttgatcctgttcatggatttatgtattggaccgattggggaacaccagctaaaataaaaaaaggtggacttaatggagttgatatttattcattagttactgaaaatattcaatggccaaatggaattacattagatttattatcaggaagattatattgggttgattcaaaattacattcaatcagttcaattgatgtaaatggaggtaacagaaagactatattagaagatgaaaaacgattagctcatccatttagtttggcagtttttgaagacaaagtattttggacagatattattaatgaagctatctttagtgcaaatcgtctcactggatcagatgttaatcttttagcagaaaatttattgtcaccagaagatatggtactttttcataatcttactcaacctagaggtgttaattggtgtgaaagaactactttatcaaatggaggttgtcaatatttgtgtcttccagctccacaaataaacccacattcaccaaaattcacatgtgcttgtccagatggaatgttattagctagagatatgagatcatgccttactgaagcagaagcagctgttgctactcaagaaacttcaacagtccgattaaaagtaagttcaacagcagttagaacacaacacacaaccacaagaccagttccagacacatcaagattacctggagcaacacctggattaacaaccgttgaaatagttacaatgtctcatcaagcattaggagatgtagctggtagaggaaatgagaaaaaaccatcttctgttagagctttatcaattgtcttaccaattgttcttttagtttttctttgtcttggagttttcttactttggaaaaattggcgtttaaaaaatattaactcaattaattttgataatcctgtttatcaaaaaacaactgaagatgaggttcatatttgtcataatcaagatggatattcatatccatctcgacaaatggtttcattagaagacgatgtagct

SEQ ID NO: 16170 - DNA, 2580 bp, Artificial Sequence
  Description of Artificial Sequence: Synthetic coding sequence
atgggaccttgggggtggaagttgcggtggaccgttgcactgttattggcggctgccggaaccgccgtcggagatcgctgcgaacggaacgagttccagtgccaggacgggaagtgcattagctataagtgggtttgtgacgggagtgcagagtgccaggatgggtccgatgagtcacaggagacatgtctctctgtcacgtgtaaatctggtgacttttcttgcgggggcagggtgaatagatgtatccctcagttttggaggtgcgacggacaggtagactgcgataacggatccgatgagcagggctgcccgcccaaaacttgttcccaagatgaattcaggtgtcacgacggcaaatgcattagtcggcagtttgtgtgcgactctgatcgtgactgcttggacggcagtgacgaggcatcatgcccagtactaacttgtggccctgcatcattccagtgcaattcaagcacatgcatccctcagctatgggcttgtgacaatgaccctgactgcgaggatggctcggatgagtggcctcagcggtgtagagggctctatgtgtttcagggggattcatcgccctgtagcgcattcgagtttcactgcctatcaggcgagtgtatccactctagttggcgctgtgacggcggaccggattgcaaagacaagtctgacgaggagaactgcgccgttgcaacgtgcaggccagatgagtttcagtgctctgacgggaactgcattcatgggtcccgacagtgcgatcgagaatacgactgcaaagatatgagcgacgaggttgggtgtgtgaacgtcaccctctgcgaaggtccaaataagtttaaatgccattccggcgaatgtattactttggacaaggtatgcaacatggcacgcgactgtcgcgactggagcgacgaaccaatcaaggagtgtggaactgccgagtgtttggataataacgggggctgctctcatgtgtgtaacgaccttaaaatcgggtatgagtgtttgtgcccagacggattccagctcgtggctcagcgcagatgcgaggacattgatgagtgtcaagaccccgacacttgctcacagttatgtgtcaaccttgagggaggatacaaatgccaatgtgaggaagggttccagctcgatccacataccaaggcttgcaaggctgtgggttcaattgcttatttgttcttcacaaatcgacacgaagtacggaaaatgaccctggataggagtgagtataccagtctgatcccgaacttaagaaacgtggtggcactcgacacagaagtcgcctcaaaccgcatctactggtccgacttatcccaaagaatgatttgttccacacagttggaccgggcccacggagtttcctcatacgataccgttatcagtcgagatatccaggcccccgacggactggcggttgactggatccatagtaatatttattggactgatagcgtacttggaactgtctcagtcgcagacacaaaaggagttaaacggaaaacactcttcagagagaacgggtctaagccacgggctatcgtcgttgatcccgtacacgggtttatgtattggaccgattggggcaccccagcaaagatcaagaagggtggcctcaatggcgtggatatttacagtctggtcactgaaaatatccagtggcctaacgggattaccctcgacttgttgtcagggaggctctattgggtggatagcaagctgcacagcatcagctcaatcgacgtgaacggcggcaaccggaaaactattttagaggatgagaaacggttggcccacccttttagccttgccgtgttcgaggataaggttttctggacggatatcattaatgaggccattttcagtgctaaccgactgacgggatccgacgtgaacctgctggctgaaaacctgctgtcccccgaggacatggtactgtttcacaatctcacgcagcccagaggtgtgaattggtgcgagcgaactacactctctaatggcggctgtcaatatttgtgcctacctgcaccacagatcaatcctcactcgccaaagtttacgtgcgcctgcccagatggcatgcttctggccagggacatgcgatcctgtttgactgaagccgaagcagctgtagccacacaggagacctccactgtgcgtttgaaggtctcgagtaccgccgtgcgtactcagcatactacgactaggccagtgcctgacacgtcacgtctgcccggcgccacgcctggtctgaccacagtagagatagtgacaatgtcgcaccaggccctcggagacgttgcaggccggggcaatgagaagaaaccgagctctgtcagggctcttagtattgtattgcccatcgtcttacttgtattcctatgcttgggagtctttctcctttggaagaattggaggctgaagaacataaatagcatcaattttgataatccagtataccagaaaacgaccgaggacgaagtgcacatatgccacaatcaggacgggtacagctacccatctcgacagatggtatctctcgaagatgacgtggcc

SEQ ID NO: 16171 - DNA, 2580 bp, Artificial Sequence
  Description of Artificial Sequence: Synthetic coding sequence
atgggaccttgggggtggaaattaaggtggacagtggcccttcttcttgccgccgccggaactgcagtgggggatcgctgtgagcgaaatgaatttcaatgtcaggatggaaaatgcattagttacaaatgggtatgcgacggatccgccgaatgccaggatggaagtgatgagagtcaagagacatgcctatctgtcacatgtaaatctggggatttctcctgcggagggcgcgtgaataggtgcatcccacagttctggagatgcgatggacaggtcgattgtgacaatgggtcagacgaacagggatgtccacctaaaacttgctcgcaggacgaatttcggtgtcacgatggaaagtgtatcagtaggcaattcgtgtgtgattcagatagggactgccttgatgggtccgatgaagcttcctgtccagtactcacatgtgggcctgcctctttccagtgtaattcatctacttgcatccctcagttatgggcctgtgataatgatccagattgcgaggatggatccgatgaatggccccagcgttgtaggggactgtatgtctttcagggagattcctcaccatgctctgccttcgaatttcattgcctttcaggagaatgcattcactcttcctggcggtgtgatgggggacctgattgtaaagacaaatctgatgaagaaaactgcgcagtagcaacttgccgcccagatgaatttcagtgctctgacgggaactgtattcatgggtcccgacagtgtgatcgtgaatatgattgcaaggatatgtcagatgaagtagggtgcgtcaatgtgacactatgtgagggaccaaataaatttaaatgccactctggagagtgtatcactctagataaagtgtgtaatatggctcgcgactgccgggattggtccgatgagcccataaaagaatgtggaacagctgagtgtctagataacaacgggggatgcagtcatgtatgtaacgatcttaaaataggatacgagtgtctctgtcctgatgggttccagctcgtagcacagcggcggtgcgaggatatagatgaatgtcaggaccctgatacatgctcccagctgtgtgtcaatctcgaagggggatataaatgtcagtgtgaagaaggattccagttagacccacacacgaaggcttgcaaagcggtggggtctatcgcgtatttattctttacaaatcgccatgaggtgagaaaaatgacgcttgatcgctctgagtatacatctctgatccccaatcttagaaatgttgttgctcttgacacagaagtagcctctaatagaatttactggagtgatttatcgcagagaatgatctgcagtacacagctcgatcgggcacatggagtgagttcctatgatacagtgatatctcgcgatatacaggcccctgatggactcgctgtggattggatacattcaaatatctactggacagattctgtgctcggaactgtgtcggtggctgacactaaaggggtgaaaagaaaaacactcttcagggaaaatggatcaaaaccccgggctatcgtcgttgatcccgttcacggatttatgtattggactgattgggggacacctgctaaaatcaagaaaggaggactcaacggggtggatatttactcactcgtcacagaaaacatccagtggcccaatgggataacactagatcttctttcagggaggctctattgggtggattcaaaacttcattctatctcctctattgatgtgaatggaggaaatcggaaaactattctcgaagatgaaaaaagactagcacaccctttctccctggccgtatttgaggataaggtcttctggacagatataattaatgaggccatctttagtgccaaccgcctgacagggtccgacgtgaatctgctggcagaaaatctgctaagtcctgaagatatggtgctctttcataatctgacacagccaagaggagtgaactggtgtgaaaggacaactctatctaacggagggtgtcagtatctgtgcctgccagccccgcaaatcaacccacattccccaaaatttacttgtgcttgtcctgatgggatgctgctggcccgggacatgcgatcatgtctaactgaggccgaagcagcagtggccactcaggaaacatctacagtcagacttaaagtctcttcgacagctgtcaggactcagcatacaactactcggcccgtccccgacacttcacggcttccaggggcaacaccaggactgacgactgtcgaaatcgttacaatgtctcatcaggccctgggagatgtggccgggagggggaacgaaaaaaaaccttcatctgtgcgagctctttccatcgtcttgccaatcgttctgctggtgttcctgtgcctcggggtgtttctcctgtggaaaaattggcggctcaaaaacataaattctataaattttgacaaccctgtctatcagaaaacaactgaggatgaggtacatatatgtcataatcaggacggatattcttatccttcccgccagatggtatctctggaagatgatgtagca

SEQ ID NO: 16172 - DNA, 2580 bp, Artificial Sequence
  Description of Artificial Sequence: Synthetic coding sequence
atgggcccgtgggggtggaaactccgatggacagtcgccttgctgctggcggcggcgggaactgcggtcggggatagatgtgagcgcaacgagtttcaatgtcaggacggcaagtgtatttcatacaaatgggtatgcgatggtagcgcggagtgtcaagacggctcggatgaatctcaggagacatgtctctcggtgacttgtaagagtggtgattttagttgcggtgggcgagtcaatcgttgcattccacagttctggcgctgcgacggacaggttgattgtgataatggcagcgacgagcaaggctgcccgcctaagacgtgctcgcaagatgagtttcggtgtcacgatggtaaatgtatctcacgccagtttgtatgcgattcggaccgggactgtctcgatggttctgacgaagcttcgtgccccgtgctcacctgtggtcccgcttcattccagtgtaattctagcacctgcataccccagttgtgggcatgcgataatgatccagattgtgaagatgggtccgacgaatggccccaacgttgccgaggcttgtacgttttccagggagactcatccccatgctcagcctttgagttccactgcctttcaggcgagtgcatccattcttcttggcgttgcgatggcggacctgattgcaaggacaagagcgatgaggaaaattgcgcagtagccacatgtcgcccagacgaattccagtgttcggatggtaattgtatacatggatctaggcaatgcgatcgagagtatgattgtaaggacatgtcggatgaagtcggctgtgttaacgtcacattgtgtgagggacctaataagttcaagtgtcattcaggagagtgcattactttggataaggtttgcaatatggcccgggattgcagagactggtcggacgagcccatcaaggaatgtggtactgcagagtgcctagataacaacggcggatgctcgcatgtctgtaacgatctcaaaatagggtacgagtgtctctgcccagacggattccagcttgtggctcaacggcgatgcgaggacatagatgaatgccaggatcctgacacctgcagccagctgtgtgtgaacctagagggcggatataagtgtcaatgcgaagagggtttccagctcgatccacacactaaggcctgtaaggcagtcgggtcaatcgcgtacctgttttttacgaaccgtcatgaagtccgtaagatgactttggacaggtcggaatacacctctctgatccctaatttacgcaatgtggtggcgctcgacactgaagtcgcatcgaatagaatctattggtcggacctctcgcagcgcatgatttgctccacgcagctcgatcgtgcacatggcgttagctcatatgatacggttatttctcgagatatccaagcaccagacggacttgccgtggattggatccattccaacatttactggactgattcggttctaggcacagtctccgttgcggatacaaagggggtcaagcggaagaccctgtttcgggagaacgggtccaaaccacgggcaattgttgttgatccagtgcatgggttcatgtactggaccgattggggaacccctgctaagattaaaaagggtggtcttaatggagtcgacatctactctcttgttacggagaacattcaatggccgaatgggattaccttggatctcttatccggtagattgtattgggtagatagtaagctacacagcattagttcgatcgatgttaatggtgggaacaggaaaaccatccttgaggatgagaagagacttgctcatcccttctcgttagccgttttcgaggacaaggtcttctggaccgacatcatcaacgaagcaattttttcagctaataggttgacaggctcagacgttaatctcctcgcggaaaatttgttgtctccagaagatatggtcctattccataacctcacccagccccgaggcgttaactggtgcgagaggaccacactgtcgaacggcggttgtcaatacctctgtctgccagcgccccagattaacccgcatagccccaagttcacgtgcgcttgtcctgatggtatgcttctggctcgtgatatgcgaagctgtctgacagaggctgaggctgcagtcgcgacacaggaaacttcaaccgttaggcttaaggttagttccacagccgtcagaacccagcacacgacaactcgaccggtgcccgacaccagcagacttcctggcgctactcctggattgaccactgttgaaatcgtaacgatgtcacaccaagctctcggcgatgtggcaggacgcggaaatgaaaagaagccaagttcagtgagggcgttgagtattgtgcttcccatcgtcctccttgtttttctatgtttaggcgtcttcctgctgtggaaaaactggcggctaaagaacatcaattccattaacttcgataatcccgtatatcaaaaaaccacggaggacgaggtccacatctgtcacaatcaggacgggtatagctacccttctcgccagatggttagccttgaggacgacgtggcg

SEQ ID NO: 16173 - DNA, 2580 bp, Artificial Sequence
  Description of Artificial Sequence: Synthetic coding sequence
atggggccctggggctggaaactgcgttggaccgtcgccctgctcctggccgcggccggcacggccgtgggagaccgttgtgaaagaaacgaattccagtgccaggacggaaaatgtatttcatataaatgggtgtgcgatggtagtgcagaatgccaggacggaagcgatgaaagccaagaaacctgtctgtctgtgacatgtaagagtggtgacttttcctgcggtgggcgagtgaaccggtgcatacctcagttttggcggtgtgatggacaggtcgattgtgacaacggcagcgacgaacagggatgccccccaaagacatgttctcaggatgaatttcgctgtcatgacggaaaatgcatcagccgccaattcgtgtgtgactcggaccgtgactgcttggacggctctgatgaggcatcctgtcctgttctcacttgtgggcccgcctcgttccagtgcaactcctcgacatgcatcccacagttgtgggcctgcgataacgatccagattgcgaggatggatctgacgagtggcctcagcgttgtagaggcctctatgtattccagggcgactcttcgccctgctcagcttttgaattccattgcctctctggcgagtgtatccacagcagttggcgatgtgacggggggccagactgtaaggacaagagtgatgaggagaattgcgcggttgctacctgcaggcccgacgagttccagtgttccgacggcaactgtattcacggttccagacagtgcgatcgagaatacgactgtaaggatatgagcgacgaggtgggatgtgtcaacgtgacgctgtgcgaaggaccaaataaattcaaatgccacagcggagagtgcattaccctggacaaggtgtgtaacatggcccgggactgcagagattggtccgatgaacccattaaggagtgtggcacagcggagtgcttggacaacaacggaggatgctcacatgtgtgtaacgacctcaaaattgggtatgagtgcctgtgccctgacggcttccaactggtcgctcaaaggaggtgtgaggatattgacgaatgtcaggaccctgacacctgttcacagttgtgcgtgaacctcgaagggggctacaagtgtcagtgtgaggagggattccaacttgaccctcacactaaggcctgtaaagctgtggggtccatagcctatctgtttttcacaaatcgccatgaggtgagaaaaatgactttggacagatctgaatatacttccctgatcccaaatctgcggaatgtcgtggccctcgataccgaggttgccagtaatcggatatactggtcagacctgagtcagcgaatgatctgctctactcaattagacagggcccacggcgtttcctcgtacgataccgttatctcaagagatattcaggcccctgacggtttagcagtggactggattcactcaaatatttactggacagattcagtcttgggcacagtgtcagttgcggataccaaaggcgtgaagcgaaagactctattccgagaaaacggctccaagcctcgggcaatcgttgtcgaccctgtgcatgggttcatgtattggactgactggggcacccctgcaaaaataaaaaagggtggcctcaatggggttgatatctattcactggtcaccgagaatatccagtggcccaatgggattacccttgacctgctgagtggacgactttattgggtggactctaagctgcacagcatctcctcaatcgatgtcaacggcggcaaccgaaagacgattttagaagacgaaaaacgcctggcccacccattttctcttgcagtctttgaggacaaggtattttggaccgatatcatcaacgaagctatcttcagcgctaatcgcctgaccgggagtgacgtgaacctcctcgcagagaacctcctctctccagaagacatggtcttattccacaaccttactcagccacgcggggttaactggtgtgaaaggacgaccctgagtaacgggggatgtcaatacctgtgcctgccagcgccacaaattaacccccacagtccaaaattcacatgtgcgtgtcccgatgggatgctgctggctcgggacatgagatcgtgcctcacggaagccgaagccgccgttgctacccaggaaacatctaccgtaagactgaaagtcagttctaccgctgttcgcacacaacacacgacaaccaggccagttcccgacacctcccgccttccaggggcaaccccagggctgaccacagtagagatcgtgactatgagtcaccaggccctgggggacgtggctgggagggggaacgaaaaaaagcctagtagcgtgcgcgccttgtcaattgtgttaccgattgttctgctggtgtttttgtgcctcggcgtgttccttctgtggaaaaactggaggcttaaaaatattaacagcatcaacttcgacaacccggtctatcagaagacaacagaagatgaggttcatatctgtcataatcaggacggatattcctacccctcaagacagatggtgtcgctggaggatgatgtggcg

SEQ ID NO: 16174 - DNA, 2580 bp, Artificial Sequence
  Description of Artificial Sequence: Synthetic coding sequence
atggggccctgggggtggaaactcaggtggacagttgccctactgctagccgcagccggaactgcagtaggagataggtgtgaaaggaatgaattccagtgccaggatgggaaatgcatttcctataaatgggtgtgtgatgggagtgctgaatgtcaggacgggagtgatgaatctcaggaaacttgtctgagtgtcacttgcaaatctggagattttagttgtggggggcgtgttaatcggtgcatcccacagttttggcggtgtgacggacaggttgattgcgacaatggatcggatgagcagggatgccctccaaaaacttgttctcaggatgaatttcggtgtcatgatggaaagtgtatatctcgacagttcgtttgtgacagtgatcgagattgtcttgatgggtctgatgaagcatcttgtcctgtgttaacatgtggaccagcctccttccagtgtaacagtagtacatgcataccccagctctgggcctgtgataacgatcccgattgcgaagatggatctgatgaatggcctcagaggtgccggggactttatgtgtttcagggggattcctctccatgctcagcttttgaattccattgcctctcaggggaatgtatccactctagttggcgctgcgatggggggcctgattgtaaagataaatccgatgaagaaaactgcgccgttgccacatgtcgacctgatgaatttcaatgcagtgatggaaactgcatccatggaagtagacagtgtgaccgggaatatgattgcaaagacatgtcagatgaagtgggatgtgttaatgtcacactgtgtgaaggacccaacaaatttaagtgccactcaggggagtgcataacactggataaggtttgcaacatggccagggattgtcgggattggagtgatgaacctataaaagaatgcggaacagcagaatgtcttgataacaacggggggtgcagtcatgtatgcaacgatttaaaaatcgggtatgagtgtctatgcccagacgggttccagcttgtggcccagcggagatgtgaagacatcgatgaatgtcaggaccccgatacatgctcgcagctgtgtgtcaaccttgaaggaggatataaatgccagtgtgaagaaggatttcagcttgatcctcacactaaagcctgtaaggccgtgggatccattgcatacctattcttcacaaaccgccacgaggtgcgcaaaatgactctagatcgatccgaatacacaagtttgatacccaatctcaggaacgttgtggcccttgatacagaagtggcctccaatcgtatatattggtcagacttaagtcagaggatgatttgcagtactcaacttgacagggcacatggagtatcatcctacgatacagtaatatcccgggatatccaggcccccgatggactcgctgtagattggatccactctaatatttattggacagacagtgtgcttggaacagtatccgtcgctgatacaaaaggagttaaacggaaaacactatttagagaaaatgggtcaaagcctcgggccatcgtagtggatcccgttcatggatttatgtattggacagattgggggacacctgccaaaataaaaaaaggaggactgaatggagtggatatctattcgttagtaacagaaaatatccagtggcccaatggaataacactcgatctgctgagtgggcggctttattgggttgatagtaaattgcactctatctcttctatcgatgtgaacgggggaaatcgcaaaactatcttagaagatgaaaaacgcctcgcccatcccttcagtcttgctgtgttcgaagataaagttttctggactgatataataaacgaggccatattttcagctaaccgcctcactgggtcggatgtaaatctgcttgcagagaatcttctatcacctgaagatatggtcctgttccacaaccttacgcagcctagaggggtgaactggtgtgagcgaacaactttatccaatgggggatgtcagtatctctgcctacccgccccccagatcaacccccattcccccaaatttacatgcgcctgccccgatggaatgctccttgctagagatatgcgcagttgtctaacagaagcggaagccgctgtggctacacaggaaactagtacagtgaggctgaaagtgtcatctactgcggtccggacacaacacactactacacgacccgtccccgatacatcacgactccccggggctactccagggctaactactgttgaaatagtgactatgtcacatcaggccctcggagatgtcgccgggcgaggaaatgaaaaaaaaccttcatctgtcagggcgctttcaatcgtgctaccaatagtgctgcttgtcttcctctgtctcggagtattcctgctttggaaaaactggcgcttgaaaaatatcaattctatcaacttcgacaatcccgtgtatcagaaaactacagaagatgaagtgcatatctgtcataaccaagatggatattcatatccttcacggcaaatggtctccctagaagatgatgtggca

SEQ ID NO: 16175 - DNA, 2580 bp, Artificial Sequence
  Description of Artificial Sequence: Synthetic coding sequence
atggggccttgggggtggaagttgcgatggaccgtggccctgctgctggcggctgccggaactgctgtgggagatcggtgcgaacgcaacgagtttcagtgtcaggatggaaaatgcattagctacaaatgggtctgcgacgggtcggccgaatgccaggatggttccgatgaatcccaggaaacttgtctgagcgtgacttgcaaatcgggcgatttttcatgcggcggccgggtcaaccggtgcattccacagttttggcggtgcgacggacaggtcgactgcgacaacggatccgatgagcagggctgcccaccaaagacctgttcgcaggatgagttccggtgccacgatgggaagtgcatctcccgccagttcgtgtgcgattcagaccgagattgcctcgacggctccgatgaggcttcgtgtccggtcctgacctgcggaccggcttcatttcagtgtaactcttcaacttgcattccccagctgtgggcctgcgataacgatccggactgcgaggacggttccgatgagtggccacaacgctgccggggactctacgtgttccaaggcgactcgtccccgtgtagcgcctttgaattccattgcctgtcgggcgaatgcatccacagctcgtggagatgcgacggcggtcctgattgcaaggataaaagcgacgaggaaaattgtgctgtggcaacgtgccgcccagacgaatttcagtgttccgacggtaattgtattcacggttcccggcagtgcgatcgcgagtatgactgcaaagacatgtctgacgaggtgggctgcgtgaacgtgaccctttgcgaaggacccaacaagttcaagtgccacagtggggaatgtatcaccctggacaaggtttgtaatatggcgcgagactgccgcgattggtcggatgagccgattaaagagtgcggaacggcagagtgcctcgataacaacggtggatgctcacacgtttgcaacgacctgaaaatcggttacgagtgtctttgcccggatggtttccagctggtggcacagcggagatgtgaggacatcgacgaatgtcaggacccggacacttgttcccagctctgtgtgaacctcgaaggaggatacaaatgccagtgcgaggaaggattccagctggatccccacactaaggcatgcaaggccgttggttcaatcgcgtacctgttcttcaccaatcggcacgaagtccgcaagatgactttggaccggtcagaatacacttcgctcattcccaacctcagaaacgtcgtggcgcttgataccgaggtagccagcaaccgcatctactggtcggacctttcacaacggatgatctgcagcacccaactcgatcgcgcgcatggagtttcgagctacgacacggtcatctcccgggacattcaggcgccagacggactggccgtcgactggatccattcaaacatctactggaccgactcggtgctgggaaccgtctccgtggcggacaccaagggtgtcaaacgcaagactctctttagagaaaacggaagcaagcctagagcgatcgtggtcgacccagtgcatggcttcatgtactggacggactgggggaccccggccaagatcaaaaagggaggactgaatggcgtggacatctattcgctggtgactgagaacatccaatggcctaacggcatcactctcgacctcctgtcggggcgtttgtactgggtggattcaaaactgcatagcatatcctccattgacgtgaatggcggtaaccgcaagaccatccttgaggacgagaagcgccttgcacacccattcagccttgccgtgttcgaggacaaggttttctggaccgacatcattaacgaagccatcttctccgcaaaccgcctgaccggctcggatgtgaacctcctggccgaaaatctgctttccccggaggacatggtgttgtttcataacctgactcaacctcggggagtcaactggtgcgagcgcactactctgtctaacggcggatgtcagtacctgtgtttgccggcaccgcaaatcaatcctcactcgccgaagtttacctgtgcctgcccggacggaatgttgctggcccgagacatgagatcgtgtttgactgaggcggaagcggcggtcgccacccaagaaacttcgactgttaggctgaaagtcagctcgaccgcggtgcgcactcaacacaccaccacgcgtccagtgccggatacttcacgcctgccaggtgcaacgccaggactgacgactgtagaaatcgtcaccatgtcccaccaggcactcggtgatgtggccggacgcggtaatgaaaagaaaccgtcatcggtgcgcgctctcagcatcgtgctgcctatcgttttgctcgtgttcctgtgcctgggagttttccttctctggaagaattggaggctcaagaatatcaattccatcaatttcgacaacccggtgtaccaaaagaccaccgaggacgaagtccacatctgccataatcaagacggctacagctatccaagcagacaaatggtaagcctggaagatgacgttgcc

SEQ ID NO: 16176 - DNA, 2580 bp, Artificial Sequence
  Description of Artificial Sequence: Synthetic coding sequence
atggggccgtggggttggaagctgagatggactgtggcactgctgcttgcggcagctggtactgcagtcggtgaccggtgtgagagaaacgaatttcaatgtcaagatggaaagtgtattagctacaagtgggtctgtgacggttcagcagaatgccaggacggcagcgatgaaagtcaagaaacctgtctgtcagtgacgtgtaagtcgggggacttctcctgcggtggcagggtcaaccgctgcattcctcaattttggaggtgcgacggacaagtggattgtgacaacggatcggatgaacaaggctgtcccccaaagacgtgcagccaagacgagttcagatgtcacgatggtaaatgtatctcaaggcaatttgtgtgtgactcggacagagattgtttggacgggagcgatgaagcctcttgtccggtgctcacttgtgggccagcttcctttcagtgtaactccagcacctgtatccctcagctttgggcctgtgataatgaccctgactgtgaggatggatccgatgagtggccacaaaggtgtagaggtttgtacgtgtttcagggtgacagctccccctgctcggcattcgaatttcattgtctttcaggggaatgtattcattcgtcctggagatgtgacgggggacctgactgtaaggataagagtgatgaagagaattgcgccgtggcaacgtgccggcctgatgaatttcagtgttcagatggtaactgcatccatggctcgcgacagtgtgatagagagtacgactgtaaagacatgagcgatgaggtgggttgtgtgaatgtgaccctttgcgaaggacccaacaagttcaagtgtcactcgggcgaatgcattaccttggataaggtttgcaacatggcgagagactgccgtgattggtcagatgaacctatcaaggagtgcgggaccgccgaatgtcttgataacaacggtggttgttcgcatgtgtgcaatgatcttaagattggctacgaatgcctctgccctgatgggtttcaacttgtcgcacaaaggaggtgtgaggatatcgacgagtgtcaggacccagatacttgctcccaactttgtgtgaacctcgaaggtggttacaaatgccagtgtgaagagggcttccaactggatccccataccaaagcatgtaaggcagtgggatcgatcgcctacttgtttttcactaatcgccacgaggtccgaaagatgaccctcgatcgctctgaatacacttcattgatccctaatcttagaaacgtcgtcgcactggataccgaagtcgcatctaatcgaatttactggtcagatttgagccaacgcatgatttgctccactcaacttgatcgtgcacatggcgttagctcgtacgacaccgtcatatcgcgagacatccaagcgccagacggacttgctgtggactggattcattcaaacatctattggaccgacagcgtgctggggacggtgtccgtcgctgatactaaaggggtcaagagaaagactttgttccgagagaacggatcaaagcctagggcgattgtcgtggatccagtgcatgggtttatgtattggacggattggggaacgcctgcaaagattaagaaggggggtcttaatggagtggacatttactcgctggtgactgaaaacatacaatggcctaatgggattacccttgaccttctctccggacgattgtactgggtggattccaagctgcattcgatctcctcgatcgacgtgaatggaggaaaccgaaaaaccattcttgaagatgagaaacgtctggcacatccatttagcctcgccgtgtttgaagataaggtgttttggactgatatcataaacgaagcaatattctccgctaataggctgaccggttcggacgtcaaccttctggcggagaacttgctgagccctgaggatatggtcctctttcacaatctgacccagcctagaggcgtcaactggtgtgaaagaactacgctgtccaacggtgggtgtcagtacctctgccttcccgcaccacagattaatccgcactcgcctaagtttacctgcgcatgccctgatggaatgctcctcgcacgagatatgaggtcgtgtctgaccgaagctgaagccgcagtggcgactcaggaaacctcgactgtgaggcttaaagtgagcagcacggcggtgagaacccagcacaccaccaccagacctgtgccggacacctccaggcttccaggagctaccccaggcctcacgactgtcgagattgtcaccatgtctcaccaagccctgggggacgtggcgggcaggggtaacgaaaagaagccgtcaagcgttcgcgcactcagcattgtgctcccaatagtccttctggtgttcctttgcctgggagtgttccttctgtggaaaaactggcgcttgaaaaacatcaattcgatcaacttcgataacccagtgtaccagaaaactaccgaggacgaggtccacatttgtcataaccaagatggatactcctatccctcccgtcagatggtcagccttgaggacgatgtcgcc

SEQ ID NO: 16177 - DNA, 2580 bp, Artificial Sequence
  Description of Artificial Sequence: Synthetic coding sequence
atgggtccttggggatggaagctccgctggacggtcgccctcttgcttgccgccgccggtactgcagtcggtgaccggtgtgagcggaacgaatttcaatgccaagacgggaagtgtatttcatacaagtgggtgtgtgacggatcagccgaatgtcaggatggttcggatgaatcgcaagaaacgtgcctttcagtcacctgtaaatcgggagacttttcgtgtggaggacgcgtgaacagatgtataccgcaattctggcgttgtgacgggcaagtggattgtgataacggcagcgatgaacaaggatgtccccctaagacctgctcccaagatgaatttagatgtcatgatggaaaatgcattagtcgacagtttgtctgtgacagcgatcgtgattgtcttgatggctccgatgaggcatcttgtccagtgctcacgtgtggcccggcttccttccagtgtaacagctcaacttgtataccccaactgtgggcatgcgataacgatccagattgtgaggacggctcggatgagtggccacaaagatgccggggcttgtacgtgtttcaaggagacagctcgccatgttcggccttcgagtttcactgtctttcgggtgagtgcatccattcgtcatggagatgcgacggtgggcctgattgtaaggacaagagcgatgaagagaattgtgcagtcgcaacctgccgcccggatgaatttcagtgctctgacggtaactgtatccatgggagccgccaatgtgatcgtgaatacgattgcaaagacatgtcagatgaagtaggttgcgtgaatgtgacgctttgcgaaggccctaataagtttaagtgtcattccggtgaatgcattaccctggataaagtttgcaatatggcccgagactgtagggattggtccgatgagcctatcaaggagtgcggcaccgcggaatgtctggacaataacggtggttgctcacatgtctgtaatgacttgaagattggatatgaatgtctttgtcctgatggatttcaactggtggcacagcggcgctgcgaggacattgatgaatgtcaagaccccgacacctgctcgcagctgtgcgtcaacctggaaggtggatacaaatgtcagtgtgaagagggattccaacttgatcctcataccaaggcgtgcaaggcagtgggatcaattgcataccttttcttcactaataggcacgaagtgagaaagatgacgctggataggtcggaatacaccagcctgatcccaaaccttagaaacgtggtcgccttggacactgaagtggcgtcaaatcgcatttactggtccgacttgtctcaacggatgatttgctcgactcagctggatagagcacacggtgtcagttcttacgacaccgtgatctccagagacatccaggcccccgatggcctggccgttgattggatccattccaacatttactggaccgattctgtgctcggaactgtgtccgtcgcagatactaagggtgtgaagcgtaagaccctctttagagagaacggttccaaaccgcgagcaatcgtcgtggatccagtgcatggattcatgtactggaccgactgggggactccagccaagatcaaaaaggggggcctgaatggcgtggacatttactcacttgtgaccgaaaacattcagtggcctaatggaattactcttgatctgctctctggtcgcctgtactgggtcgacagcaaactgcattcgataagctccatcgatgtgaacggtgggaaccgaaagactatccttgaagatgaaaagagactggcacaccctttttctctcgcagtgtttgaagataaagtgttttggaccgatatcataaatgaagctatcttttccgcaaatcgtcttaccgggtctgatgtaaacctcctggcggagaatctgctgtcgcccgaggacatggtcctgtttcacaatcttacgcagccccgaggggtcaactggtgtgaacggactactctcagcaacggcggatgccagtacttgtgcctccctgcacctcaaatcaacccccactcgcccaagttcacctgcgcttgcccagacggcatgcttcttgcaagggatatgagatcgtgtctcaccgaagctgaggcggcggtcgccacccaggaaacctcgactgtgagacttaaagtctcatccaccgcagtgaggacgcagcataccaccacccgcccagtgcctgatacctcacgactccccggagcaactccaggactgaccactgtggaaatagtgactatgtcacaccaggcactgggtgatgtcgcaggtaggggcaacgagaaaaagccaagctccgtgagagcgttgtctattgtgcttcctattgtccttctcgtgtttctgtgtctgggagtgttccttctttggaagaactggcggctcaagaacattaactcaataaacttcgataatccagtataccagaaaacgactgaggatgaggtccatatttgtcataaccaagatggatattcctacccttcgcgccagatggtgtcactggaggatgacgtcgca

SEQ ID NO: 16178 - DNA, 2580 bp, Artificial Sequence
  Description of Artificial Sequence: Synthetic coding sequence
atgggcccttggggatggaagttgcgatggactgttgccttactgttagccgctgctggtactgcagttggcgacagatgcgagcgaaatgaatttcaatgtcaggatggaaagtgcatctcatacaagtgggtttgcgatggttcggctgaatgtcaggatggaagtgatgagtcacaagaaacctgtctctcagtgacctgcaaatcgggcgatttctcttgtggcggtcgagttaatcgatgcattccacaattctggagatgtgatggtcaagttgattgcgacaacggaagcgatgagcagggctgtccccctaagacttgtagccaggacgaatttaggtgtcacgacgggaaatgcatatctaggcaattcgtctgcgactctgatagagactgcctggacggttcagacgaagctagctgtcccgtgctcacctgtggacccgcttcgtttcaatgtaattccagtacttgtatcccgcaactttgggcatgcgataacgatccggattgtgaagacggttcggatgaatggccccaacgatgccgagggttgtacgtgttccaaggtgactcatctccttgttctgccttcgaatttcactgcctcagtggtgagtgcattcattcatcgtggagatgtgatggaggacctgattgcaaagataagtccgatgaagaaaactgtgctgttgcgacatgtcggcctgatgagtttcagtgtagcgatggaaattgcattcacgggtccagacaatgtgatcgcgaatacgattgtaaggatatgtccgacgaggttggatgcgtcaatgtgaccttgtgcgagggtcccaacaagttcaaatgccactctggtgaatgtataactctggataaagtttgcaacatggctagggactgcagagattggtctgatgagcctattaaggaatgtggaacagccgaatgtttagacaataacggtggctgtagtcatgtatgcaatgatcttaagatcggttatgaatgcttatgtcccgatggctttcaacttgttgcccaaagaagatgcgaagacattgatgagtgtcaggatccagatacttgcagtcagctttgcgttaaccttgagggcggttataaatgccagtgtgaggaaggatttcagctagatcctcataccaaagcttgcaaggccgttggatcgattgcgtatctttttttcaccaatagacatgaagtacggaaaatgacactcgatcgtagcgaatatacatcattaattccaaatctccgtaacgtcgttgctcttgatacagaggtggctagtaataggatctattggtcggatttgagccaaaggatgatctgttctacccagctggatcgagcacacggagtttcctcttatgatacagtgatcagtcgggatattcaagcccccgacggcttggctgttgactggatccattcaaatatatattggacagatagcgtacttggtactgtttctgttgctgatactaaaggagtgaaacgtaagactttgtttagggagaatggatcgaaacccagagcgatagttgtcgatcctgtgcacggtttcatgtactggaccgattggggaactccagctaaaattaaaaaaggagggttgaacggcgttgacatctactcgttagtgactgaaaacattcagtggcctaatggtatcactttagatcttctctcaggaaggttgtactgggtggatagcaagcttcactccatcagctctattgatgtcaacggaggaaatcgaaagactattctagaagacgaaaaacgtcttgctcacccattctctctggccgtgttcgaagataaggttttctggactgacataataaatgaggctattttctctgctaaccgactaacgggatctgacgttaatctcctagctgagaatttgcttagcccggaggacatggtgctcttccataacttgactcagcccaggggcgtcaactggtgcgagcgtacgacgctgtctaatggtggttgccagtacctctgtttgcctgcaccacaaattaatccgcacagcccaaagtttacatgcgcttgtccagatggaatgcttttggcgagggatatgagaagttgtttaaccgaggccgaggctgctgttgcgacacaagaaactagcacggtccgtttgaaagtaagttcaactgccgtccgtacgcagcacaccacgaccagaccagtcccagataccagtcgtctccctggtgccacaccggggctaactacggtggagattgttaccatgtcccatcaagcgttgggtgacgttgcaggccgcggcaatgaaaagaaaccttcatctgttcgagctctctcaatcgttctccctatagttctgttggtgtttctttgcctgggtgtcttcttgctttggaaaaactggcgcttgaagaacattaactctattaattttgacaacccagtttatcagaaaaccaccgaagatgaggtccacatatgccataatcaggatggctattcctatccaagccgtcagatggtgtcattagaggacgacgtagca

SEQ ID NO: 16179 - DNA, 2580 bp, Artificial Sequence
  Description of Artificial Sequence: Synthetic coding sequence
atggggccctggggctggaagttgcgctggacagtcgcgttgttactcgctgcagccgggacagcagtgggggaccgttgtgaacggaatgagttccaatgccaggacggaaagtgtatttcatataaatgggtgtgtgatggtagtgctgagtgccaagacggtagcgacgagtcacaagagacttgtctgtctgtgacctgcaaatccggggattttagttgtggcggcagagttaaccggtgtataccacaattctggagatgcgatgggcaagtcgactgcgacaacggttcggatgagcaaggatgcccccctaaaacatgtagccaggatgagtttcggtgtcatgacgggaagtgcatttcgagacagttcgtgtgcgacagcgacagggattgtttggacggctctgatgaagcatcttgcccagtgctgacatgtggtcccgcgagcttccagtgcaactccagtacttgcatccctcaactgtgggcctgtgacaatgatccagactgtgaagacggctctgacgagtggccacagagatgccgcggtctctatgtgttccaaggcgatagttccccctgcagcgcatttgagtttcattgtctcagcggagagtgcatccacagttcgtggcggtgcgatggaggccccgactgcaaggacaagtccgacgaggagaactgtgcagtcgctacatgccggccggatgagtttcagtgcagcgacgggaattgcatccacggatctcggcagtgcgatcgggagtacgattgtaaggatatgagtgatgaggtgggctgtgttaatgtgaccttatgcgagggaccaaacaagtttaaatgccactcaggagaatgcatcacgctggacaaagtctgcaatatggctcgggattgccgagattggagcgacgagcccataaaggagtgtgggacagccgaatgtctcgataacaatggaggctgttcccacgtctgcaatgatctaaagataggctacgaatgcctgtgtcccgacggctttcagctggtagcccagcgccgatgtgaagatatcgatgaatgccaggacccggatacatgcagccagctatgcgtgaacttggagggcggttacaagtgccagtgcgaggaaggttttcaacttgatccccacactaaggcctgtaaagccgtgggcagcatcgcctatctgttcttcaccaaccgtcacgaagtccgaaagatgaccttggacagaagtgagtatacctctctcatccctaacctgcggaatgtcgtggcactggatacagaggtggcctctaaccggatctattggagcgacctgagccagcggatgatctgcagcacacagttggatcgcgctcatggcgtcagcagctatgataccgtgattagccgagacattcaggcccctgatggcctagccgtggattggatccattccaatatctactggaccgattcggtccttggcacagtctctgtggcggacaccaagggggtgaaacgcaaaactctatttcgggagaatggctctaagcccagggccatagtcgtggatcctgtgcatggattcatgtactggacagactggggtactcccgctaagatcaaaaaaggaggtctcaatggcgtggatatttattcactagtgaccgagaacattcagtggccaaacggcattactctagacttgttgagcggtcgactctactgggtggacagcaagctgcattctatctcaagcatcgacgtgaacggagggaatagaaagaccatccttgaagacgaaaaaagattggcacacccttttagcctcgcggtgttcgaggacaaggtgttttggactgacatcatcaacgaagccatttttagtgcaaaccggctgactgggagcgacgtgaatttgttggccgaaaatctcctatccccggaggacatggtgctgtttcacaacctgacccagccaaggggcgtcaattggtgtgagcggactacccttagcaacggcggatgccagtacctgtgcctgccagccccgcagatcaatccacactctcccaaattcacatgcgcatgtcctgatggtatgttacttgccagagacatgaggagctgcctcacagaagcagaggccgccgtggcgactcaggagacatcaactgtacgcttaaaagtatcatctaccgctgtccgcacacagcacacgaccacgcggcccgtgccggacacctctcggctgcccggggccacaccaggcctgaccacagtcgaaatcgtgaccatgtcgcatcaggccctcggagacgtcgccggtcgcggcaacgagaagaagcccagttccgtccgtgccctttcgattgtccttcctatcgttctcctcgtgttcctgtgtctaggcgtgttcctactgtggaagaactggcgactcaaaaacatcaattcgatcaactttgataaccccgtataccagaagacaacagaagacgaggttcacatttgtcacaaccaggatggttacagctacccgtcgcggcagatggttagcctcgaggacgacgtcgct

SEQ ID NO: 16180 - DNA, 2580 bp, Artificial Sequence
  Description of Artificial Sequence: Synthetic coding sequence
atggggccctggggctggaaattgcgttggactgttgcattgctgctggcagctgcaggaactgccgttggagaccgctgcgaaagaaacgagtttcagtgccaggatggaaaatgtatttcttacaaatgggtctgcgatggttccgctgagtgccaggatggatcagatgagagccaggaaacctgtctgagcgttacgtgcaagtctggagactttagttgcggaggccgggtcaaccgatgcatccctcagttttggcgatgtgacgggcaagtagactgtgataatgggagcgatgagcaaggttgcccacctaagacgtgcagccaggacgagtttagatgtcacgatgggaagtgtatatctcggcaatttgtgtgtgacagcgatcgggattgcctggacggaagtgatgaggctagttgtccagtgctgacctgtggccctgccagcttccagtgtaattcttctacatgtatcccgcaactgtgggcctgcgacaatgacccggattgtgaggatgggtcagacgagtggccccagcgatgtcgaggactttacgtgttccaaggcgactctagcccctgtagcgcctttgagtttcactgccttagcggagaatgtatacatagctcctggcgatgcgacggcgggcccgattgtaaagataagagcgacgaggagaactgcgccgtcgcaacttgccgacccgacgagtttcagtgctccgacggtaattgtattcacggctcacgccagtgtgatcgcgaatacgactgtaaagacatgtccgatgaggtgggatgtgttaacgtgaccctctgcgaagggccaaacaagttcaaatgccacagcggtgagtgtattacgctcgacaaggtatgcaacatggcgcgggattgtagagattggtccgatgaaccaataaaagagtgtgggactgctgagtgcctcgataataatggcggatgctctcatgtttgcaatgatctgaagataggctacgaatgcctgtgcccggatggattccagcttgtggcacagcggcggtgcgaggacatagacgagtgtcaggaccccgatacgtgtagccaactctgcgtgaatttggaaggaggctataagtgtcagtgcgaagagggcttccaacttgaccctcataccaaagcctgcaaagcagtggggagtattgcttatctgttctttaccaacaggcatgaggtccggaaaatgaccctggaccggtccgagtatacttcactaattccaaacctgaggaatgtcgtcgcccttgacaccgaagttgcctcaaacagaatctactggagcgatctaagccaaaggatgatctgctctactcagctcgaccgggcgcacggagtttcatcctatgatacagtgattagtcgggatatacaggcccccgacggactggccgtggattggatccactcaaatatttactggaccgattctgtgctgggcacagtgtctgttgcggatactaaaggcgtgaagcggaaaaccctttttcgcgagaatggcagcaagccgagagccatagtcgtggacccagtgcacggcttcatgtactggacggactggggcactccagccaagataaaaaagggagggttgaacggtgtggacatctattctcttgtgaccgaaaatatacagtggccaaatgggatcacccttgacttattatctggcagactgtattgggtcgatagtaagttgcactctatttcgtctattgacgtgaatgggggaaatcgcaaaaccattctcgaagatgaaaaacgccttgcccaccccttttcactggcggtcttcgaggataaggttttttggacggacatcatcaatgaggccatttttagtgctaataggttgaccggaagcgacgttaatctgcttgccgaaaacctcctaagtcccgaggacatggttctgtttcacaatctcacccagccccggggggtgaattggtgtgaaaggaccaccttatccaacggggggtgtcagtacctctgtctccctgctccgcagataaatccccattcccctaagtttacgtgtgcgtgcccggatggcatgttactggctagggatatgcgatcatgcttgaccgaagcagaagccgccgtggcgacacaagaaacttcaacggtccgactgaaggtatcgagtacagccgtgcgtacccaacacaccactacccgcccggttcccgacacttcccgcctccccggcgctacacctggcctgacaactgtggagatcgtcacaatgagccatcaggcgttgggggacgtggcgggcagggggaatgaaaaaaaaccatcgtccgttagagcattatccattgtgctgccaatcgtacttcttgtttttctgtgccttggagtgtttcttttgtggaaaaactggcgcttgaaaaatattaattctattaacttcgataatcccgtctaccagaagacaacagaagatgaggtgcacatctgccacaatcaggatggatactcttacccaagccggcaaatggtgtccttggaggatgatgtggcc

SEQ ID NO: 16181 - DNA, 2580 bp, Artificial Sequence
  Description of Artificial Sequence: Synthetic coding sequence
atgggaccctgggggtggaagctcagatggaccgttgccctgctgctggccgctgcgggaacggcagtgggagacaggtgtgaacgcaatgagttccaatgccaggatggaaaatgcatcagttacaagtgggtctgtgacggttcggcggaatgccaagacggatcggacgagagtcaggaaacctgtctctccgtgacctgcaaatccggtgatttcagctgcggaggaagagtcaataggtgtatcccgcaattctggcgctgtgatgggcaggtcgactgcgacaatggcagcgacgaacaggggtgtccacccaagacgtgctctcaagacgagttcagatgccatgacggcaaatgcattagtcggcagtttgtctgtgattcggatcgcgattgtctggatggatccgatgaggcctcctgtccggtgctgacttgtggaccggcctcatttcaatgcaactcctcaacctgcatcccgcaactgtgggcctgcgacaacgacccagattgcgaggacggcagcgacgagtggccacagagatgcagaggactctatgtgttccagggagactcctcgccgtgctccgccttcgaattccattgcctgagcggcgaatgcatccacagctcatggcgctgcgacggaggaccagactgcaaggacaagagcgatgaagagaattgcgccgttgctacctgtcggcccgacgagttccagtgctcggatggcaattgtatccacggatcgcgtcagtgcgacagggaatacgactgcaaagacatgtccgatgaagtgggatgcgtcaatgtcaccctgtgcgaagggccgaataagttcaagtgccacagcggcgaatgtataactctggataaggtgtgcaacatggctagagactgtcgggattggtccgacgaaccgatcaaggaatgcgggacggcagaatgcctcgacaataacggaggatgttcacacgtgtgtaacgacctcaagatcgggtacgagtgcttgtgcccagatggcttccaattggtcgcccaacgccgctgcgaggacatcgatgagtgtcaggacccggatacgtgctctcagctctgtgtgaatctcgagggcggttacaaatgtcagtgcgaagaaggcttccaacttgatccacataccaaggcgtgcaaagcggtgggatccatcgcgtacctgtttttcacgaaccgccacgaggtgcggaagatgactctggacagatcagaatacacttcactcatcccaaacctgcggaacgtggtggctcttgacaccgaagtggcctcgaaccgtatttactggtccgacctgagccaacggatgatttgctccactcagctcgaccgggcacatggagtctcttcgtacgacactgtcatctcccgcgacatccaggcccctgacggccttgcagtcgattggatacacagcaatatctactggacggatagtgtcttgggaaccgtttccgtggcggacaccaagggcgtcaaacgcaagaccctgttccgcgaaaatggatccaagccgcgagccatcgtggtagatcccgtccatggatttatgtattggactgattggggcactcctgccaaaatcaagaagggtggcctgaatggtgtggacatttactcgctggtgaccgagaacatccagtggccaaacgggatcaccctggatttgctctcaggccggctctactgggtggattccaagctgcacagcatctcgtccatcgacgtgaacggtggcaaccgcaaaactatactcgaagatgaaaagagactggcgcacccgttcagcctggccgtctttgaggacaaggtgttttggactgatatcatcaacgaggcaatcttcagcgctaacaggctgactggttcggacgtgaaccttctcgcggagaacctgctgtcgcctgaggacatggtcttgttccataacctgacccagccacgcggagtcaactggtgcgaacggaccactctgtcaaacggagggtgccagtacctgtgcctgcccgcgccgcagatcaacccgcactcgcccaaattcacttgcgcatgcccggatgggatgctcctcgcacgagacatgagatcctgcctgaccgaggcggaagcagcggtagccacccaagaaactagcaccgttcggcttaaggtgtcgtcaactgccgtgagaactcagcacactactacccgccctgtgccggatacgagccgcctgccgggggccacccctggacttactacggtggagatcgtaaccatgtcccaccaggctctgggagacgtggccggacgaggaaacgaaaagaaaccttcatcagtgagggcactgtcgatcgttctgccgatcgtgttgttggtgttcttgtgcctgggggtttttcttctctggaagaattggcggctcaagaacattaactctatcaactttgacaatccagtctaccaaaaaactaccgaggacgaagtgcatatctgccacaatcaggacggctactcatacccgtcacggcagatggtgtcgctggaggatgacgtggcg

SEQ ID NO: 16182 - DNA, 2580 bp, Artificial Sequence
  Description of Artificial Sequence: Synthetic coding sequence
atgggaccttgggggtggaaactacgctggacagtcgccctgttactagccgcagctgggacagctgttggagaccggtgcgaaagaaacgaattccagtgtcaggatgggaagtgcataagctataagtgggtttgcgatgggtctgctgaatgtcaagacggttccgatgaatctcaggaaacttgtctctcagttacctgtaaatccggtgacttttcatgtggaggtcgggtgaacagatgtataccgcagttttggagatgtgatggccaagttgactgtgataacggctccgacgagcagggctgccctcccaagacctgttcacaggacgagtttcgctgccatgacgggaaatgcataagtcgtcagttcgtgtgtgactccgacagggactgtctggatggcagtgatgaggcatcatgcccggttctgacttgtggtcctgcctcctttcagtgtaactcatctacatgtataccccagctgtgggcatgcgataatgatcccgactgtgaggacgggtccgacgagtggccccagagatgccggggcctgtatgtctttcagggtgacagttctccatgttccgctttcgagttccactgcctgtctggcgaatgtatccactctagctggcggtgtgacggcggccctgactgtaaggacaagagcgatgaagagaattgtgccgtggccacttgcaggcccgatgaatttcagtgctctgatggtaactgcattcacggaagcaggcagtgtgaccgggagtatgactgtaaggatatgtccgacgaggtggggtgcgtgaacgtgactttgtgcgagggtccaaataaattcaagtgccactccggagagtgtatcaccctggataaggtctgcaatatggcccgcgactgccgggactggtctgatgagccaattaaggagtgcggcacagctgagtgcctggataataacggcgggtgtagccacgtgtgcaacgacctgaagataggctacgagtgcctttgcccggacggtttccagctggtggcacagcgacggtgcgaagatatagatgagtgccaagatccagatacttgtagccagctgtgcgtcaatctggaaggagggtacaaatgtcagtgcgaagagggcttccagctagacccacacacaaaggcttgcaaggctgttggcagcatagcatatctttttttcactaaccgtcatgaagttcgaaagatgaccctggaccgaagcgagtacacaagtttaatacccaacctgcgaaatgtggtcgccctggacacagaagttgccagtaacagaatatattggagcgacctgtctcagaggatgatttgctccacccagctcgatcgcgctcacggcgtttcctcctatgacaccgtgattagtcgtgacatacaggcccccgatggcctggctgttgattggatacatagtaacatatactggactgacagtgtcctcggcacagtatccgtggctgacaccaaaggtgtgaagagaaagactctattcagagagaatggcagcaaaccaagagccatagtagttgaccccgtccacggttttatgtactggaccgactggggcactccagctaagattaaaaagggtggtctgaacggcgtggatatctactctctggtgacagagaacatccaatggcccaacgggattacactggaccttctctcaggaaggctttactgggtcgattccaagctgcacagtatctctagcatcgatgtgaatgggggaaataggaaaaccatcttagaagacgaaaaacgattggcacacccattctccctggctgtattcgaagacaaggtcttctggaccgatatcatcaatgaggcaatattctctgctaatcggctgaccggatctgatgtgaacctgctggccgaaaacttgctgagccccgaggacatggttctatttcacaatctaactcaacctcggggcgtgaattggtgcgaacgaaccacccttagcaacggcgggtgtcagtacttatgtctgccagccccacagatcaacccccatagtccaaagtttacctgcgcctgtccagacggtatgttattagcccgggatatgcggtcctgtctcacagaagcagaagccgccgtggctactcaggagaccagcactgtgcgcctaaaagtttcatctactgccgtgcgtacacagcataccacaactcgccccgtcccagatacaagccgactgccaggagccaccccagggttgaccaccgttgagatcgtgaccatgtctcaccaggctctgggagacgtggccggaaggggcaacgaaaagaaaccttccagtgtgcgcgccttgagcatagttttacctattgtgctgctggttttcctgtgtctgggcgtgttcttgttgtggaagaattggagactgaaaaacatcaacagtataaactttgacaaccctgtttatcaaaaaacaacagaagacgaggtccacatctgccataatcaggatggctattcctacccttctcgacagatggtctctctggaggacgacgtggca

SEQ ID NO: 16183 - DNA, 2580 bp, Artificial Sequence
  Description of Artificial Sequence: Synthetic coding sequence
atgggaccatggggatggaaactgagatggaccgtggcgctgctgctggctgcggctgggaccgccgtgggagatcgatgtgaacgcaacgagtttcaatgtcaggacggcaagtgtatctcctataagtgggtgtgtgatgggagcgcagagtgccaggatggctccgacgaatcccaagaaacctgtctttccgtcacctgcaagagcggagacttcagctgcgggggacgcgtgaaccgatgcatccctcagttttggcgctgcgacggtcaggtcgactgcgataacggttccgacgagcagggttgcccaccaaagacgtgctcacaggacgaatttaggtgtcatgatggcaaatgcatcagccgccaatttgtgtgcgacagcgatcgcgactgcctcgatgggtcggatgaagcctcctgtccagtgctgacttgcggacctgcgagctttcagtgcaactcctccacttgcattccccaactttgggcctgtgacaacgatccggattgcgaagatggctcggacgaatggccacagcgatgccgaggactttacgtctttcagggagactccagcccgtgttccgcgttcgagtttcattgcctctcgggcgaatgcatccattcctcctggcgttgcgatggtggaccggattgcaaggacaagagcgatgaggagaactgcgctgtcgccacttgcagaccggatgaattccagtgctcagacggtaactgcattcatggctcacgccaatgcgatcgcgagtacgactgcaaggacatgagtgatgaggtcggatgtgtcaacgtcaccctgtgcgaaggcccgaacaagttcaagtgccattcgggggaatgcatcaccctcgataaggtgtgcaacatggcacgcgactgccgggattggtcggatgagccaatcaaggagtgcggaacggccgaatgcctggataacaacgggggttgctcccacgtgtgtaacgacctcaagatcggatacgaatgcctgtgccccgatggcttccaactcgtggcccagagacggtgtgaggacatcgacgagtgccaggacccggacacttgctcacaactgtgtgtcaaccttgagggtggatacaagtgccagtgcgaagagggcttccagctcgacccacacactaaagcatgcaaggcagtgggttcgatcgcgtatcttttcttcacgaatagacacgaggtgcggaagatgacccttgaccggtcagaatacactagcttgatcccaaatctcagaaacgtggtggccctcgacaccgaagtggccagcaatcgcatctactggtcggacttgtcacaacggatgatctgttccactcaactggatagagcccacggggtgtcatcgtacgacaccgtgatctccagagatatccaggccccggacggtctggcggtggattggatccattcaaacatctactggactgactccgtgctcggaaccgtcagcgtcgccgatactaaaggagtgaaaaggaaaactctgttccgggaaaacgggagcaaaccacgggcaatcgtggttgatcccgtgcacggcttcatgtactggacggactggggaactccagccaagataaagaaagggggactgaacggagtggacatatactctctggtgaccgagaacatccagtggccgaatggaatcaccctggatctgctgagcggtcgcctgtactgggtggactctaagttgcactcgatctccagcatcgatgttaatggaggaaatcggaaaaccatcctggaagatgaaaagagattggcccatccgttcagcctggcagtgttcgaagataaagtgttctggacggacatcattaatgaggcgattttctcagccaacagactgaccggaagcgatgtcaacctcttggccgagaatctcttgtcgcctgaagatatggtcctgtttcacaatctgacccagccacggggagtgaactggtgcgaaagaactactctgtctaacggaggctgccagtacctgtgccttccggccccgcaaatcaatcctcactccccaaaattcacctgcgcgtgtccagatgggatgctccttgcgcgggatatgcggtcatgtctcactgaggccgaagctgccgtggctactcaagagacttcaactgttcggctgaaagtctcgtccactgcagtgaggactcagcacacgacgacgcgcccggtgcctgatactagccgactccctggagccacccccggactcactactgtggaaatcgtgactatgtcccaccaggcactcggagacgtggccggccgggggaatgagaaaaagccaagcagcgtccgcgccctgtcgattgtgcttcccatcgtcctcctggtctttctctgtctcggagtattcctgctgtggaagaactggagactgaagaacatcaacagcatcaatttcgacaatcctgtctaccaaaagactaccgaggatgaagtgcatatctgccataatcaggatggatatagctacccttcacggcagatggtgtctttggaggatgacgtggca

SEQ ID NO: 16184 - DNA, 2580 bp, Artificial Sequence
  Description of Artificial Sequence: Synthetic coding sequence
atggggccgtgggggtggaagttgcggtggaccgtagccctgctgctggcagcagcaggcactgccgtgggcgacagatgcgagcggaatgaatttcagtgccaggatggcaagtgcatcagttacaagtgggtgtgcgatggtagtgccgaatgccaggatgggtcggacgaatctcaggaaacttgcctctctgtgacatgcaaatcaggagatttcagctgcggcggccgtgtcaatcgttgcatccctcaattctggcgttgcgacggacaggtcgattgcgacaacgggtccgacgaacaggggtgccccccaaagacctgctcgcaggatgagtttcgctgccacgacggcaaatgtatctcaagacagttcgtttgcgatagcgatcgggattgtctggacgggtccgacgaggcttcctgtcctgtcctcacgtgcggccccgcgtctttccagtgcaattccagcacatgcatcccacagctctgggcttgcgacaacgatcccgactgcgaggacgggagcgacgaatggccccagaggtgtaggggtttatacgtgttccagggagattctagtccctgcagcgctttcgagtttcactgtttgagcggagaatgtatccatagctcctggaggtgcgatgggggtcccgactgcaaagacaagtccgacgaggagaactgcgcagtcgcgacttgtaggcccgacgaatttcagtgctcagacgggaactgcattcacggaagcaggcagtgcgatcgcgagtatgattgtaaggacatgtctgatgaggtcgggtgtgtaaatgtcaccctgtgcgaaggtccaaataagttcaagtgtcacagtggggaatgcatcacactggataaggtctgcaatatggctagggactgtcgagactggagcgacgaacctattaaagagtgcggaaccgccgaatgtctggacaataatggagggtgttctcacgtgtgcaacgatctaaagataggctacgaatgcctgtgccctgatggattccaactcgttgcccagcggcgctgcgaagatattgacgagtgccaggatccagatacctgttcccagctgtgcgtcaacttagaggggggttacaaatgtcagtgcgaagagggctttcagctcgatcctcataccaaggcctgcaaagcagtgggctcaattgcttacctcttctttacaaaccggcatgaggtgagaaagatgactcttgataggtctgaatacacctccctgattccgaacttgcgaaacgttgtcgcgctggatactgaggtcgccagtaataggatatattggtcagacctgagtcagaggatgatctgtagcactcagctggaccgggcccatggggttagctcatacgataccgttatctccagagatatccaggcgcccgacggattggcggtcgattggatacactccaatatctactggaccgactcagtgctgggtaccgtctctgtggcggatactaagggtgttaagaggaagaccctctttcgagagaatggatctaaaccaagagcaatagttgttgaccctgtgcatggatttatgtattggactgattggggaacgcccgcaaaaatcaaaaaaggaggattgaacggtgtagacatctatagtctagttacggagaacatccagtggcccaatggaattaccctcgacctcctgtcaggacgcctctattgggtggactccaaactgcatagcattagcagtatcgatgtcaacggagggaacagaaagacaatcttggaggatgagaagaggcttgcccatccattttccttagccgtgtttgaggacaaagtcttttggaccgacattatcaacgaggctatatttagcgcgaataggctcactgggtctgatgttaacctgttggcagagaacttgctaagtcccgaagatatggtcctattccacaatttaacccagccaagaggcgtcaactggtgtgagaggactaccctgtcaaacggagggtgtcagtacctgtgcctgcctgctccccagatcaatccccacagccccaagttcacctgtgcatgccctgacgggatgctcctggcgcgcgacatgcgctcctgtctgaccgaagcagaagcggccgtggcaacccaggaaacaagtactgtcaggcttaaagtctccagcaccgccgtgcgcacgcagcacaccaccacaaggcctgttcccgacacctcccggcttcctggggctacccctggtctgaccacagtcgagatagtgactatgtctcaccaggcactgggcgatgtggctggcagaggcaatgagaagaagccttcctcggtacgagccctatctatagtcctgccaatcgtcctgctcgtgttcctgtgccttggtgtgttcctgctgtggaagaactggcgattaaagaatataaacagcattaactttgataacccagtctaccagaaaacaaccgaggatgaggtgcacatttgtcacaaccaggacgggtactcttaccctagtaggcagatggtgtccctggaagatgacgtcgct

SEQ ID NO: 16185 - DNA, 2580 bp, Artificial Sequence
  Description of Artificial Sequence: Synthetic coding sequence
atgggaccttggggatggaaattaaggtggactgttgcgttacttttggcggccgcgggaaccgcggtcggcgaccgctgtgagcgaaatgaatttcaatgccaggatggaaagtgcataagctacaaatgggtttgtgatggatcagcagaatgtcaggatggaagcgacgaatcgcaggagacttgtttgtcagtgacttgcaaaagtggagactttagctgcggaggaagagttaatcgctgtattcctcagttctggaggtgtgatggccaggtggactgcgataacgggtctgatgagcaaggatgcccaccgaaaacgtgttcacaggatgaatttagatgtcatgatggaaagtgcatctctcgccaatttgtctgtgactcggaccgcgattgcctggacggctccgatgaggcaagctgcccggtcctcacgtgtgggcctgcctccttccaatgcaattcatcgacctgcatacctcagttgtgggcctgcgataatgatccagattgtgaggacgggtctgacgagtggcctcagcgttgccgagggctttatgtgttccagggggattcatcaccgtgttcagcgtttgaatttcattgcttatcgggagagtgtatccattcatcatggcgctgcgatggcggaccggattgtaaagataaatcagatgaggagaactgcgcagtcgctacttgcagaccggacgagtttcagtgcagcgacggcaattgtatccacggctcccggcagtgcgacagagaatacgattgtaaagatatgagcgatgaggttggatgcgtcaacgtcacattatgtgagggtcccaacaaatttaaatgccacagtggggagtgcattacacttgataaggtctgcaacatggcgagagactgtcgcgattggagcgatgaaccaattaaagaatgtggtacggcggagtgcctcgacaataatggaggttgttctcatgtatgcaacgatttgaaaatcggttatgaatgtttatgtccggatggctttcaactggtggctcaaagaagatgtgaggatatcgatgaatgccaggatccggatacctgctcgcaattatgtgtcaaccttgaaggggggtataaatgccagtgtgaggagggatttcagcttgatcctcacacgaaggcttgcaaagcagtcggatcaatcgcttaccttttctttacgaatcgccacgaagtacggaaaatgaccttagatcgttctgaatatacgtctcttattccgaatctaagaaatgtggtcgcgctcgatactgaggttgctagtaaccggatatactggtcagatctgtcacagcggatgatctgcagcactcagcttgaccgggcccatggggtttctagctacgatacagtcatcagccgcgatattcaagctccggatggcctcgctgtagattggatccactcgaatatttattggacagattcggtcctgggaacagtctcggtagcagatacaaaaggtgtgaaacgcaagactttgtttcgtgaaaacggctcaaagccacgcgccatcgtggtagatccggtacacggcttcatgtattggacagattggggaacaccggcaaagattaaaaagggtggattgaacggggtggatatttattcccttgtcacggaaaacattcaatggcctaatggaatcacactcgatttacttagtggtcggctttactgggtggattcaaagttgcacagcattagctcaattgacgttaatggcgggaatcggaaaacaatcctagaagacgaaaaaagacttgcgcacccgttttctcttgcggtgtttgaggataaggtattctggacagatatcatcaatgaagctattttctctgccaatcgcttgacgggatccgacgtaaacttgctagcggaaaatttactttctccagaggatatggtactgttccataatctaacacaaccgagaggtgtcaactggtgtgagcggacaacactctcaaatgggggctgccagtatctgtgtttgccggccccgcagataaatcctcatagtccgaagttcacgtgcgcctgtccggatggcatgctcctcgccagagatatgcggagctgtttgacagaggcggaagctgcggttgcgacccaagaaacgagcacggtcagacttaaggtctcttcaacggccgttcggacacagcataccacaacccgcccggttccggatacaagtcgtttgcctggagctacgccggggttaacaactgtcgaaattgttactatgtcccatcaggcattgggcgatgtcgcagggcgagggaatgaaaaaaaaccgtcatctgtccgtgctttaagcattgtgctcccgatagtgttgctggtctttctttgcctcggcgtttttctactctggaagaattggcggcttaaaaacattaactctatcaactttgacaatcctgtgtatcagaagacaacggaagacgaagttcatatatgccataatcaagacggttattcctatccgagcagacaaatggtttctctagaagacgacgttgcc

SEQ ID NO: 16186 - DNA, 2580 bp, Artificial Sequence
  Description of Artificial Sequence: Synthetic coding sequence
atggggccctgggggtggaagctccgctggaccgtcgccctgctgctggcggcagccggcaccgctgtgggagatcgctgtgagcgcaatgagttccagtgtcaagatgggaagtgcatttcgtacaaatgggtttgtgacggtagcgcagaatgtcaggacggatccgatgaatcccaggagacatgcttgagcgtgacctgcaagtctggggatttctcttgtggggggcgagttaaccgatgcattcctcagttctggcggtgtgatgggcaggttgactgtgataatggaagtgatgaacagggttgcccacctaagacctgtagccaggacgagttcaggtgccacgacggtaaatgcatatccagacagttcgtctgcgattcagatagggactgtctcgatggtagtgatgaagcctcttgtcccgtgctgacttgcggccccgcatctttccagtgtaacagctcgacttgcatcccacagctgtgggcctgcgataatgatcctgattgtgaagacggcagcgatgaatggccccagcggtgtagggggctctacgtgttccagggcgacagctctccctgcagtgcgtttgagtttcattgtttgagcggggagtgcatccatagtagttggcgctgcgatggaggccccgactgtaaggataagtccgatgaagaaaattgtgcagtcgcaacttgcaggccagatgagtttcaatgctccgacggcaattgtatccacggaagtaggcaatgtgacagggagtatgactgtaaggacatgtcagatgaggtaggttgcgtgaacgttaccctttgtgaaggcccgaacaagtttaagtgtcacagtggcgaatgcataaccctggacaaggtgtgtaatatggcccgtgattgccgcgactggagtgacgaacccattaaagaatgcggcacagcagaatgtttagacaataatgggggatgctctcacgtatgcaacgacctgaaaatcggttatgaatgtctctgtcccgacgggtttcaactggtagctcagcggaggtgcgaggatattgacgagtgccaggaccccgacacatgctcccagttgtgcgtcaatttggaaggaggctataaatgtcagtgcgaggagggatttcagttggacccacacacaaaagcctgcaaggcggtaggcagtattgcatatctgttcttcaccaacagacatgaggttcgaaagatgactttagatcgatccgagtacaccagcctcatccccaacctccggaacgtagttgcactggataccgaggtggcgagtaaccgaatatactggtccgacctgagccagcggatgatatgtagtacccagttagatagggcccacggggtcagttcatatgacactgtaatcagtcgggacatacaggcccccgacgggctggcagtcgactggatacactctaatatctactggaccgattcggtcctgggaacagtatccgtggccgacactaaaggagttaaacgcaagacgctcttcagggagaacggtagcaaaccccgagctattgtggtggaccccgttcacgggttcatgtactggacagattggggaacccccgctaagattaagaaggggggcttgaatggggtcgatatatacagcctggtgactgagaacatccagtggcccaacggtatcactctcgacctgctgagtggccggctctattgggtggattccaaacttcactctattagctcgatcgacgttaatggaggaaatagaaaaaccattctagaggacgaaaagcgtctggcccacccttttagcctggccgtctttgaggataaggtcttctggacagatatcataaacgaagccattttctccgcaaatcgactgacgggaagcgacgtcaatctgttagccgagaatctcctctcccccgaagacatggtcttatttcacaatctgacccagccaaggggggtaaattggtgcgagaggaccaccctgtctaatggaggttgtcaatacctgtgcctgccagctcctcagataaacccacatagtcctaagtttacctgtgcgtgccctgacgggatgctgctggctagagatatgaggtcctgcctgaccgaggcagaggcagccgtggccacacaggagacctcaacggtgcgcctgaaggtctcttccacagctgtgcggactcagcacaccacaactcgcccggttcccgatacttcaaggttgcccggggcgaccccaggtctcaccaccgtggaaattgtcaccatgagccaccaggccctgggggatgtcgccggtcgaggtaacgaaaagaagccttcatctgttcgggctctctcaatagtcttgcccatagtgcttctcgtcttcctctgcttaggcgtattcctcctgtggaagaactggcgactgaaaaacattaacagcattaactttgacaatcccgtctatcagaagacaactgaagatgaggtgcacatctgtcacaatcaagacggttacagctatccttcgcggcaaatggtttcactagaagatgatgtggca

SEQ ID NO: 16187 - DNA, 2580 bp, Artificial Sequence
  Description of Artificial Sequence: Synthetic coding sequence
atgggaccgtggggctggaaacttagatggaccgtggcattgctcctcgcggccgccggcactgccgtgggagacagatgcgagcggaacgaattccagtgccaagacggcaaatgcatcagctataagtgggtgtgcgacggctcggccgaatgtcaggacggtagcgacgaatcgcaagaaacgtgcctgtcggtgacctgtaagtcaggcgacttctcatgcggcggacgggtgaatcgctgtattccccaattctggagatgcgacggacaggtcgattgtgacaacggatcagacgagcagggatgcccgccgaaaacgtgttcacaagacgaattccggtgccacgacgggaagtgtatctcacgccagtttgtctgcgattccgatcgggattgcctcgacggcagcgacgaggcttcgtgcccggtcctcacttgcggcccggcttcgttccagtgcaactccagcacctgcattccgcagctgtgggcctgcgacaacgatccagattgcgaggatggctctgacgagtggccacagagatgtcgtggactctacgtgttccagggggacagctcaccttgctcggcgtttgaattccattgcctctccggagaatgcatccacagttcctggcgctgtgacggcggcccagactgcaaagacaagtccgatgaagaaaactgtgccgtcgcgacctgccgacctgacgagttccaatgctcggacggtaactgtatccacggcagccggcagtgcgacagagagtacgattgcaaggacatgagcgatgaggtcggctgcgtaaacgtgactctttgcgaagggccgaataagttcaaatgccactccggggaatgcattactctcgacaaggtgtgtaatatggcccgcgattgccgggactggtcggatgagcctatcaaggaatgtggtaccgcggaatgcctggacaataatggaggttgtagtcatgtgtgcaacgacctgaagatcggatacgagtgtctctgtcccgacggatttcagctcgtggcgcaaagaagatgcgaagatatcgacgagtgccaagacccggacacctgctcccaactctgtgtgaacctcgaggggggatacaagtgccagtgcgaagaagggtttcagctggatccccacaccaaagcctgcaaggcggtgggctccatcgcgtacttgttcttcaccaatcgacacgaggtgaggaaaatgaccctggacaggagcgaatacacttcgctgattccgaacctgcgtaatgtggtcgccctcgatacggaggtcgcatcaaatcgcatttactggtccgatttgtcacagcggatgatctgttctacccaactcgaccgcgcccatggagtctcctcatacgacaccgttataagccgggacatccaggcaccagatggacttgctgttgattggatccactctaacatctactggaccgattcggtgctgggaactgtcagcgtggcggataccaagggcgtcaagagaaagacgctgttccgcgaaaatggatctaagccacgggccattgtggtggatccggtccatggattcatgtactggaccgactggggaacccccgccaagatcaagaagggagggctgaacggggtggatatctacagtctcgtgaccgagaacatccaatggccaaacggaatcaccctcgatctgctgtccggacgcctgtactgggtggactctaagctgcactctatctcatccatcgacgtgaatgggggtaatcgcaaaaccatcctcgaagatgagaaaagactggcgcacccgttctccttggccgtctttgaggacaaggtcttttggacggacatcataaacgaagcgatcttctctgcaaaccgcctgactggatcggatgtcaacctcctggccgagaatttgctgtccccagaagatatggtgctgttccataacctgacccagccgcgtggggtaaactggtgcgaacgcaccaccctgtccaacggcggatgccagtatctgtgcctgccagctccgcaaatcaacccacattcacccaaattcacgtgcgcttgccctgacggcatgctcttggcacgggacatgcgctcatgtctgactgaggctgaggcggccgtcgcgacgcaagaaactagcactgtgcgcttgaaggtgtcatcaaccgccgttcggactcagcatactaccactagacctgtgcctgatacttcgagactgccgggagccactccaggtttgactactgtggaaatcgtcaccatgtcgcatcaggctctgggtgatgtggccgggaggggaaacgaaaagaagccctcctcagtccgggcactctcaattgtgcttcctatagtgctgctggtctttctgtgccttggagtgttcctgctctggaagaattggcgattgaagaacatcaattccatcaatttcgacaatccagtgtaccagaaaactaccgaggatgaggtgcacatctgtcacaaccaggacgggtactcatacccgtcccggcagatggtgagcctggaagatgatgtggct

SEQ ID NO: 16188 - DNA, 2580 bp, Artificial Sequence
  Description of Artificial Sequence: Synthetic coding sequence
atggggccgtggggctggaaactgcggtggaccgtcgctctcttgcttgctgccgccggaaccgcggtcggcgacagatgcgaacggaacgagttccagtgccaagatggaaagtgcatctcttacaaatgggtctgtgatgggtcggccgaatgccaagacggatccgacgaaagccaagaaacctgtctgtcagtcacatgcaagtcaggtgatttttcttgtggcgggagggtgaatcgctgtatcccccagttctggcgatgcgatggacaggtggattgtgacaatggtagtgatgagcaggggtgcccgccgaagacgtgttcacaggacgagttccggtgtcatgatggcaagtgcatatcccggcagttcgtctgtgatagtgatcgagattgtctggacggttctgatgaggcaagttgccctgtcttgacttgcggacctgcgagttttcagtgtaactcgagcacgtgcattcctcaactttgggcatgcgacaacgatccggactgcgaggatggcagcgatgagtggccccagcggtgtcggggactctatgtgttccagggcgatagttcaccttgctccgcattcgagtttcactgtctgtcgggcgagtgcatccatagcagctggaggtgcgatggcgggcccgactgcaaggacaagtccgacgaagagaattgtgccgtggccacgtgtaggcccgacgagtttcagtgctctgatggaaattgcatccacggctccagacagtgcgatcgagagtatgattgtaaggatatgagtgacgaagtgggatgtgtgaacgtcacactttgtgaggggcctaataagttcaaatgccacagtggggagtgcatcactctggacaaggtatgcaatatggctagggactgtagggattggagtgacgagcccattaaggaatgtggcactgctgagtgcttagacaacaacggaggatgcagccatgtctgtaacgacttgaagatcgggtatgagtgcctctgtcctgatggattccaactggtggctcagcgcaggtgcgaggatatcgatgagtgtcaggaccccgacacctgttcacagctctgcgtgaatctcgagggaggctacaagtgccagtgtgaggagggcttccagttggacccacataccaaggcatgcaaagccgttggctctatcgcttacctcttctttaccaacaggcacgaggtccgaaagatgacattggatcgttccgaatacacctctttgattccgaaccttaggaatgtggtggccctggacaccgaggtcgctagcaacagaatctactggagcgatctctctcagaggatgatttgttccacccagttggaccgcgcacacggtgtatcaagctatgacaccgtgatcagccgcgacatccaagcacccgatggactagcagtggattggatccactcgaacatctactggactgactcggtgctagggacagtatctgtggcagatacaaagggtgtgaagagaaagactctgtttcgggagaatggcagcaagccgagagcaatcgtggtagatccagtacatgggttcatgtactggaccgactggggcactccagccaagatcaaaaagggcggactgaacggggtggacatttattccctggtgacggagaacattcagtggcccaacggaatcaccctggacttgctatccggtagactgtactgggttgacagcaaactgcatagcatctcatccatcgacgtcaacggcggaaataggaagacaatcctggaagatgagaaaagactcgctcatccgtttagcctagctgtttttgaggacaaagtgttctggaccgatattattaacgaagctattttctcagctaaccggctgaccgggtccgatgtgaatctgctagccgagaatctgttgagccccgaggacatggtcctgttccacaacctgactcaaccccgtggcgtgaattggtgcgaaaggacgacactgagcaatggtggatgccagtacctctgcctgccggcccctcagatcaacccccatagcccaaagttcacgtgtgcctgtccagatggaatgctgctggccagggacatgcgttcgtgcctcaccgaagcagaagccgcagtagctacccaggaaacctctaccgtgaggttaaaagtgtcctctaccgcagttcgcacccagcacacaaccacgcggccggtgcccgatacttctcgactcccaggggctactcccggcctgactactgtggagattgtcaccatgtcgcaccaggctttaggggacgtcgcagggagagggaatgagaaaaaaccttcctcagtgcgagccctctccatcgttctgccgattgtcctgctggtctttctgtgtctcggagtgttcctgctgtggaaaaattggcggctcaagaacatcaactccattaacttcgacaacccagtctatcagaaaaccaccgaggacgaggttcacatctgccataatcaagacgggtactcatatccaagccgccagatggtgtctctggaagacgacgtagct

SEQ ID NO: 16189 - DNA, 2580 bp, Artificial Sequence
  Description of Artificial Sequence: Synthetic coding sequence
atgggcccatgggggtggaagttgcgatggaccgtggcactcttgctggccgcagccggtactgcggtcggagacaggtgcgagcgtaatgaattccaatgtcaagatggaaagtgcatttcttacaaatgggtgtgcgatggatcagcggagtgccaggacggttcagatgaatcacaggaaacttgcctgtcggtcacttgcaaatccggggactttagctgcggaggacgcgtcaatagatgtatcccacaattctggcgctgtgacggacaagtggattgcgataacggctccgacgagcaggggtgcccgcctaagacctgctcccaagatgagttcaggtgccatgatggaaaatgcatttcccggcagttcgtatgcgattcagacagagactgcttggatggatccgacgaggcctcctgccctgtactcacttgtggtccagcgtcctttcagtgtaatagcagcacctgcatcccgcagctgtgggcctgcgataatgatcccgactgtgaagatgggagcgacgagtggccccaacgctgcagaggactgtacgtgtttcagggtgatagctccccgtgctctgccttcgaattccactgcctctccggtgagtgtattcattcaagctggaggtgcgacggcggcccggactgcaaggacaagtccgacgaagagaattgcgcggtcgcaacttgcagaccggacgaatttcagtgttcggacggaaattgcatccacgggagccggcagtgcgaccgggaatacgattgtaaggacatgtccgatgaggtcggatgcgtgaacgtgacgctgtgcgaaggaccaaataagttcaagtgccactcgggagaatgcatcactcttgataaggtgtgcaacatggcccgcgattgtagagattggagcgacgaaccaatcaaagaatgtggtacggcggaatgcctcgacaacaacggaggttgctcgcacgtctgtaacgacctcaagatcggatatgagtgtctgtgcccggatggctttcagctcgtggctcaacgccggtgcgaagatattgatgaatgtcaagacccggacacctgctcacagctgtgtgtcaatctcgagggaggctacaaatgccaatgcgaagagggattccaactcgatccgcacactaaggcctgcaaagccgtgggttcaatagcctacctgttcttcacgaaccgacatgaagtgcggaaaatgaccctggatcggtccgaatatacctcgctgatccctaacctccggaacgttgtggccctcgataccgaggttgcctcgaaccggatctactggtccgacctgagccaacggatgatctgctcgactcaattggacagagcccatggagtgtccagctatgacacggtgatctccagggacatccaagcccctgacggactggctgtcgactggatccattcgaacatctactggactgattccgtcctcggaactgtgtccgtggcggacaccaaaggagtgaagaggaaaactctgtttcgcgagaacgggtcaaaacccagagccatcgtggtggatcccgtgcacggtttcatgtactggactgactggggaacgccggccaagattaagaagggcgggctcaacggagtggacatctacagcctcgtgaccgagaacatccagtggccgaatggaatcacgttggacctgctcagcggacggttgtactgggtggattcaaagttgcactctattagctcaatcgatgttaacggcggaaatcgcaagaccatcctggaagatgagaaacggctcgcccaccctttctcgctcgcagtgttcgaggacaaggtgttctggaccgacatcatcaatgaagctattttctcagctaaccggttgaccggcagcgacgtcaacctgctggcagaaaacctgctgtcgccggaggacatggtgctgttccataacctgacccaacctcggggagtcaactggtgtgaacgcacgaccctttccaatggaggatgtcagtacctgtgcctccctgcaccacagatcaacccacactcgcctaagttcacgtgcgcgtgtcccgacggcatgctgctggcgcgtgatatgaggtcctgtctgaccgaagccgaggccgcagtggctactcaggagacgtcaaccgtcaggctcaaggtatcctcaaccgctgtgcgcacccaacacaccactacccgcccagtgccggacacctcacggctgcccggtgcgactccggggttgaccaccgtcgaaatcgtgacgatgagccaccaagccctgggagacgtcgccggacgcggcaatgaaaagaagccatcatcagtcagagcactgtctatcgttctgccgatagtgctcctggtgtttctctgcttgggagtctttctgctttggaaaaactggaggctgaagaacatcaatagcatcaacttcgacaatccagtttaccagaaaaccaccgaggatgaagtgcacatttgccacaatcaggatggctactcctacccttcgaggcagatggtgtcgcttgaagatgacgtggcg

SEQ ID NO: 16190 - DNA, 2580 bp, Artificial Sequence
  Description of Artificial Sequence: Synthetic coding sequence
atgggcccctggggttggaaattgcgctggacggtggcactgctccttgccgcagcaggcaccgccgtgggagatcggtgcgaacggaacgagtttcaatgtcaggacggcaagtgtatttcgtacaagtgggtgtgtgacggcagtgccgagtgccaagatggatcggatgagtcccaagaaacttgcttgtcggtgacttgcaagagcggagatttttcttgtggcggcagggtcaacaggtgcatccctcagttttggcgatgtgacggacaggtggactgcgataacggtagcgacgagcaaggatgtccgcctaagacttgctcgcaggatgaattccgttgccacgatggaaagtgcatttcccggcagttcgtgtgtgattctgacagggattgtttggatgggagcgatgaagcatcgtgtcccgtgctcacgtgtggtccagcatctttccaatgcaattcatcaacgtgtatcccccaactttgggcatgtgacaatgaccctgattgtgaggacggtagcgatgagtggccacaaaggtgtcgcggtctgtacgtctttcagggagactccagcccatgttccgcctttgagttccattgcctgtcgggtgaatgtatccactcctcctggcggtgtgatggagggcctgattgtaaagacaaaagcgacgaagagaactgtgccgtcgcgacctgtcgacctgatgaatttcaatgttcggatggtaactgtatacatggtagccgacagtgcgatagagaatacgattgtaaggatatgtcagatgaagtgggctgtgtgaacgtcaccctgtgcgaagggccaaataagttcaagtgtcattcgggagagtgtattacccttgataaggtgtgcaacatggcccgtgactgcagagattggtcagatgagcccatcaaggaatgtggaacggcagagtgtctggacaacaacgggggatgttctcacgtgtgtaatgacctcaagattggatacgaatgcctttgtccggacggattccagctcgtggcccaacggagatgtgaggatatcgatgaatgccaggacccggatacctgtagtcaactgtgcgtgaaccttgagggcggatacaaatgtcaatgtgaggaggggtttcagctcgatccccacacgaaggcatgtaaggcagtcggctcaatcgcatacctgtttttcactaaccggcatgaggtccggaaaatgactctggaccgctcagaatacacttcactgatcccaaacctcagaaacgtggtcgcacttgataccgaagtggcatcaaacagaatctattggtccgacctgagccagcggatgatttgctcaacccaacttgacagagcacatggagtgtcatcatacgacactgtcatctcccgcgatatccaggcacccgatggcctggccgtggactggatccactccaacatttactggactgactccgtcctgggaaccgtgtcggtggcagatactaaaggagtgaagcgtaagaccctgtttcgagagaatggatctaagcctagagcaatcgtcgtggatcctgtccacgggtttatgtactggacggattggggaaccccagcaaagatcaaaaaaggagggcttaacggcgtggatatctactcccttgtcactgaaaacatacaatggcccaacggtatcactctcgatcttctgagcggccgtctgtactgggttgattccaaacttcatagcatttcgtcaatcgatgtgaatggaggcaaccgaaagactattctggaagatgaaaagcgtcttgcacatccttttagcctcgcggtattcgaggacaaggtcttttggacggatatcattaacgaggcaatcttttcggctaacaggctgactggatcagatgtcaatcttcttgcagaaaaccttctgtcgcctgaagatatggtccttttccataacctgacccagccaaggggagtgaattggtgtgagaggactaccttgagcaatggaggatgtcaatacctctgtctgccagcgccacagataaatccacattccccaaaattcacttgcgcgtgccctgacggaatgcttctggcgcgcgacatgaggtcgtgtcttacggaagcggaagcagcagtggcaacccaggaaacctccaccgtgcgactcaaggtgtcaagcaccgcagtccggacccagcatactaccaccaggcctgtgccagacacttcaagattgccaggggccactcctggcctcactaccgtcgaaattgtcaccatgtcccatcaggcgctgggtgatgtcgcaggtaggggaaacgagaagaaaccctcgtcggtccgtgcactctcgatcgtgcttcctatcgtgctgcttgtctttctctgcctcggagtgtttcttctgtggaagaattggcggctgaagaacatcaacagcattaactttgataaccctgtgtaccaaaagactaccgaggatgaagttcatatttgtcataaccaggacggttactcctacccgtcgcgtcagatggtgagcctcgaagatgatgtggcg

SEQ ID NO: 16191 - DNA, 2580 bp, Artificial Sequence
  Description of Artificial Sequence: Synthetic coding sequence
atgggcccctggggttggaaacttcggtggaccgtcgccctcctgcttgcggcagcggggactgcagtgggagatcgatgcgagcgcaatgagttccagtgtcaagatggcaagtgcatttcgtacaagtgggtgtgtgacggttcagcagagtgccaggatggtagcgatgaatcccaggaaacttgtctttcggtaacctgtaagtcgggagatttctcatgtggtggaagagttaatagatgcattcctcagttttggcgatgtgatgggcaggtggactgtgacaacgggtcggacgagcaaggatgtccgcccaaaacttgttcacaggacgaatttcggtgccatgatggaaaatgtataagccgccaattcgtgtgtgattccgatcgtgattgtctcgatggcagcgatgaagcctcctgtcccgtgctgacctgtggcccagcctccttccagtgcaactccagcacctgtattccacagttgtgggcttgtgacaatgatccagattgcgaggacggttcagatgaatggccgcaacggtgccgcggtctttacgtgtttcagggtgattcatccccctgttctgcgtttgaatttcattgcctttcgggagagtgtattcactcgtcgtggagatgcgacggagggcctgactgtaaggataagtctgatgaagaaaactgtgcggtcgctacctgcagacctgatgaatttcaatgcagcgatggaaattgcatccatggttcgcgccagtgcgacagagaatatgactgcaaggatatgtcggatgaagtgggatgtgtgaatgtcaccctgtgcgaaggtccaaataagtttaagtgtcactcaggagaatgcatcactctggacaaggtatgtaacatggcgagggattgccgcgactggtcggatgagccaattaaggaatgtggcaccgcagaatgtctggacaacaacgggggttgttcgcacgtgtgcaatgacttgaagattggatacgaatgtctctgccctgatggcttccaactggtggcccaacgtcgttgtgaagatatcgacgaatgtcaggaccctgacacttgctcgcagctctgtgttaaccttgagggaggatacaaatgtcagtgtgaagagggcttccagctggatcctcataccaaagcatgtaaagctgttggttccatcgcctacttgttcttcaccaacagacacgaggtccgtaagatgactcttgatcgaagcgaatacacttccctgatcccaaaccttcgcaacgtggtcgccctggacaccgaggtcgcatcaaataggatttactggtcagatctctcgcaacgtatgatctgttccactcaactggatcgcgcacatggagtgagctcgtacgatactgtgatttcacgtgacatccaagcgccagatgggctggcagtggattggatccattcgaacatttactggacggattcagtgcttgggactgtgtctgtcgcagacaccaaaggagtgaagagaaaaaccttgtttcgcgaaaacggtagcaaaccgagagccattgtggtggaccccgtgcacggatttatgtactggaccgactggggtacccccgcaaagatcaagaagggaggactcaacggagtggatatctattcactggtgactgagaacatacagtggcctaatggtattaccctggatctgctgtcaggtagactctattgggtggactccaagctccactcgatatcctcgatcgacgttaacggtggaaaccgcaagacgattctggaagatgaaaagagacttgcccatccattttcgcttgccgtgtttgaggacaaggtcttttggactgatatcattaacgaggcaatattctcagcaaatagactcactggatcggatgttaacctgctggcggaaaacctgttgtccccagaggacatggtgctgtttcataacctgactcagccgcgaggagtgaattggtgtgagagaaccaccctgagcaacggaggttgtcagtatctttgtctgccagcccctcagatcaacccacattccccaaagttcacctgcgcatgccctgacggcatgcttcttgctcgcgacatgaggtcatgtcttaccgaagccgaggcagcagtggcaactcaggaaacttccacggtcagacttaaggtgtcgagcacggcagtgagaacccaacacaccacgaccaggcctgtgcctgacacctcgaggttgccaggcgcaacccccgggctgaccactgtggagattgtgaccatgagccaccaggcgctgggggatgtggcaggtagagggaatgaaaagaaaccgagcagcgtacgcgcattgtcgatagtcctgcctattgtgctcctggtctttctgtgcctcggcgtgttcctgctctggaagaattggagactcaaaaacataaactctatcaattttgataatcccgtgtaccagaaaaccaccgaggacgaagtccacatttgtcataaccaagatgggtactcatacccatcgcgccaaatggtgtcgcttgaagatgacgtggcg

SEQ ID NO: 16192 - DNA, 2580 bp, Artificial Sequence
  Description of Artificial Sequence: Synthetic coding sequence
atgggaccctggggctggaaacttagatggacggtggcccttttgcttgcagccgcggggacggcagtgggggatcggtgcgaacgaaacgaatttcagtgtcaagatgggaagtgcatttcgtacaagtgggtgtgcgatggttcggcagaatgtcaagacgggtcggatgaaagccaagaaacctgtctcagcgtgacttgtaagagcggcgatttcagctgtgggggaagagtcaatagatgcattccccagttctggcggtgtgatggtcaagtggattgtgataacggctccgacgagcagggttgcccacctaagacttgttcccaagatgagtttcgatgccatgacggtaaatgtatatcgaggcagtttgtgtgtgattcggatcgtgactgcctggatggatcagacgaagcatcatgtcctgtcctcacttgcggtcctgcatcatttcaatgcaacagcagcacctgtatcccacaactgtgggcatgcgataatgatcctgattgcgaggatggctccgatgaatggccacaacgttgccggggactttatgtgtttcagggagattcaagcccatgcagcgcctttgagtttcactgcctgtcaggagaatgtatccattcctcatggaggtgcgacggaggtcctgactgtaaggacaaatcggatgaagagaactgtgccgtcgcaacctgtcgtcctgatgagtttcagtgttccgatgggaattgtattcatggcagcagacaatgtgatcgggaatacgactgtaaggatatgtccgatgaggtcggttgcgtgaatgttaccctctgtgaggggcctaataagttcaagtgtcattcgggagaatgtattaccctggataaggtctgtaacatggcaagagattgccgcgattggtccgacgaacctatcaaggaatgtggcaccgcagagtgtctcgacaataatggcgggtgtagccacgtgtgcaatgatctcaaaattggctacgagtgcttgtgccctgatggatttcaacttgtggcgcagcgcagatgcgaggatatcgatgaatgccaggatcctgatacgtgctcacagctgtgtgtcaacctcgagggtggttacaagtgccagtgcgaggagggttttcaactggacccacatactaaggcatgtaaggcagtgggttctatcgcgtaccttttcttcaccaatagacatgaagtcagaaaaatgacccttgatcgatcagaatacaccagccttatccccaacctgcgtaatgtggtggcgttggacaccgaagtcgcgtcgaatcgaatttactggtccgaccttagccagcgcatgatttgttccactcagctcgatcgggctcatggcgtctcgtcatacgataccgtgatttcacgtgatattcaagcacctgatgggctcgcggtggactggatacactcaaacatttactggaccgactcggtcttgggcactgtgagcgtggccgacaccaaaggtgtcaaacgcaagactctgtttcgagaaaacggatcaaagccaagagcaattgtggtcgatccagtgcatggcttcatgtactggacggattggggtactccggccaagattaagaagggtggattgaatggagtggacatatactcgctcgttactgagaacatacagtggcctaacggtatcaccctcgaccttcttagcggacggctgtattgggtggatagcaaactgcactcgatctcatcgatcgacgtcaacggaggaaacagaaagactattcttgaggacgaaaaacgactcgctcatccgttttcacttgccgtgttcgaggataaggtgttttggacggacatcatcaatgaggccatcttttctgccaatcgcctcaccggatccgacgtgaaccttctggcagaaaatctgctctctccagaggacatggtcctctttcacaacctgacccaaccacgcggcgtgaactggtgtgaacggactactctctcgaacggtggatgtcaatacctgtgtctgcctgcgccacagattaaccctcattcgccgaagttcacttgtgcatgccctgatggtatgttgcttgcacgggatatgcgatcctgcctcaccgaagcagaagcagcagtggcaactcaagagacttcgaccgtgcgactcaaggtgtccagcactgctgttcggactcaacacaccaccaccagaccagtgccggatacgtcgcggttgccaggagcgactcccggactcactactgtggaaattgtcacgatgagccaccaggcactcggagatgtggcagggcgcgggaacgagaagaaaccaagctcagtgagggcactgtcaatagtgcttccaattgtgctgcttgtttttctctgtctgggcgtgttcctgctgtggaagaactggagattgaagaacattaactcgatcaatttcgataaccccgtgtaccaaaagaccacggaggatgaagtgcatatttgtcacaaccaagacgggtactcctacccttcccggcagatggtgagccttgaagatgacgtggca

SEQ ID NO: 16193 - DNA, 2580 bp, Artificial Sequence
  Description of Artificial Sequence: Synthetic coding sequence
atgggaccttggggctggaagctccggtggaccgtggcactgttgttggccgctgccggtacggcagttggcgataggtgcgaaagaaacgaatttcagtgccaggatggtaaatgtatcagttacaagtgggtgtgtgatggcagcgcagagtgccaagacggaagcgatgagtctcaggaaacctgtctgtcagtcacgtgtaaatcgggcgatttttcatgcgggggccgagtgaacaggtgtataccccaattttggaggtgcgacggccaagtggactgcgacaacggatcggacgaacaggggtgcccccccaaaacttgttcccaagatgagtttaggtgccatgatggcaaatgcatctctaggcaatttgtgtgtgactcagatcgggattgccttgacggcagcgatgaagctagctgtcccgtacttacttgcgggcctgcatcttttcagtgcaactcctccacttgcattccacagctgtgggcttgtgataatgacccggattgtgaggacggaagtgacgagtggccacagagatgtagaggcttgtatgttttccagggagacagtagcccgtgtagcgcttttgaattccactgcctctccggagaatgtatccatagttcctggaggtgcgatggtggtcctgattgcaaagataaaagcgacgaagagaactgcgctgtcgctacttgccggcctgatgaatttcagtgtagcgatgggaattgcatccatggcagcagacagtgcgacagagagtatgattgtaaagatatgagcgatgaggttggttgcgtgaatgtcacactctgcgaaggccccaataagttcaaatgccactccggcgagtgcattactttggataaggtttgcaacatggctcgcgattgccgggattggtccgacgaaccaatcaaagaatgtggcactgctgagtgcctggataacaacggagggtgcagccacgtctgcaacgatctgaaaattgggtacgagtgcctgtgccccgatggattccaattggtggctcaacgcaggtgtgaggatatcgacgagtgccaagacccagacacctgtagccagctttgtgtgaatctcgaggggggatataaatgccagtgtgaagagggctttcagctagatccacacactaaagcctgtaaagcagtgggatctattgcctacttgttctttactaacagacacgaggtgcgcaaaatgactctggatcgctctgagtacacatctctgatccctaatctgagaaacgtcgtggcactggataccgaagtggcgagcaacagaatctactggagtgacctcagccaacggatgatctgctctacccaattggaccgggctcatggtgtctctagttacgacaccgtcatcagtcgtgacatacaagctccggacggtctggcagtggattggatccacagtaacatctactggacagactcagtgttgggaacagtgagtgtagccgacactaaaggtgttaagcgaaagacgttgtttagggagaacggttccaagccgcgagctatcgtggtggatccagtgcacggcttcatgtactggacagattggggaactccagcaaagattaagaaaggtgggcttaacggggtggatatctactctcttgtcacagagaatatccaatggccaaacggcatcaccttagaccttctgtctggccggctctactgggttgactctaaactgcacagtatctcatctattgatgtgaatggaggaaacaggaaaacaattctggaagacgagaagaggctcgcccaccccttttcactagccgtgtttgaggataaggtcttttggaccgatatcatcaacgaggctatcttcagtgccaatcgactaacaggtagtgatgtgaacttgctggccgagaacctgctgagtcctgaggacatggtcctttttcacaacctcacacagccgaggggggtcaattggtgtgaaaggaccacactttcgaacggcggctgccagtatttatgtctgcctgccccacaaatcaacccacattcacccaaatttacctgtgcctgcccagacggtatgcttctggctagggatatgagatcatgcctgacagaggcagaggcggctgtggccacccaagagacatccacagtgcgcctcaaagtctctagcaccgctgtgagaacacagcacacaacaacacggccggttccggatactagtagactcccaggggctacaccaggactgactaccgtggagatcgtgaccatgtcccatcaagccttgggggatgtggccggcaggggtaatgagaaaaaaccatccagcgtgcgtgctctttctatcgtactgccgattgtccttttggtctttctgtgtctgggagtgtttctcctgtggaagaattggcgcctgaagaacattaattcaatcaacttcgacaaccccgtgtaccagaaaactacagaagacgaagtccacatttgccataaccaggacgggtactcttaccctagcaggcagatggttagcctcgaggacgacgtggca

SEQ ID NO: 16194 - DNA, 2580 bp, Artificial Sequence
  Description of Artificial Sequence: Synthetic coding sequence
atgggcccgtggggttggaagctgcggtggacggtggctctcctgctcgcggctgcaggaaccgcggtgggtgatcgctgtgaaaggaatgaattccaatgccaagatggaaagtgcatctcttacaaatgggtctgcgacggaagcgccgagtgccaggatggttcggatgagtcccaggaaacttgtttgtcggtgacctgcaaatcgggcgacttctcgtgtgggggaagggtgaacagatgcatcccccaattctggcgctgtgatgggcaagtggattgcgataatggatcggatgaacagggctgtccgcctaagacctgctcacaggatgaatttcgctgccacgacggcaagtgcatctcacgccagttcgtgtgcgattcggatagagactgcctcgacggttccgacgaggcttcctgcccggtgctcacttgtggccctgccagcttccagtgcaattcatccacctgcatcccacaactgtgggcgtgcgacaacgacccagactgcgaagatgggtctgatgagtggcctcagcggtgcagaggactgtacgtgttccagggagactccagcccttgctccgcgttcgagttccattgcctgtctggtgagtgtatccatagctcatggcgctgcgacggaggaccggactgcaaagacaagtccgatgaagaaaattgcgccgtggctacgtgtaggccagacgaatttcaatgttcggacggaaactgcattcacggctcaagacagtgtgaccgcgagtacgattgtaaggatatgagcgatgaggtaggatgtgtgaatgtgaccctgtgcgagggaccaaacaaattcaagtgccactccggcgagtgtatcactctggacaaggtgtgcaacatggcgcgcgattgtcgcgactggtcggatgagccaatcaaggaatgcggaaccgccgagtgcctggataacaacggaggatgttcccatgtgtgcaatgacctcaagatcggatacgaatgcctgtgcccggatggctttcagctggttgcgcagcggcgctgcgaggacatcgacgaatgccaggacccggatacctgttcgcaactctgcgtgaacttggaaggtggatacaagtgccagtgcgaagaaggattccaactggatccgcacaccaaagcatgcaaggcggtggggtcaatcgcctatttgttctttacgaatcggcacgaggtgcggaagatgactctcgacaggtcagaatacaccagcctgatccccaatctcagaaacgtggtggcactcgataccgaagtcgcctcgaataggatctactggagcgatttgagccagcgtatgatttgtagcacccagcttgatcgggcgcacggagtgtcatcctatgataccgtgatcagcagagatattcaagcccccgacgggcttgccgtggattggattcattcgaacatctactggactgattcagttctggggaccgtgtcagtggcagacactaaaggagtgaagcgcaaaaccctgttccgcgagaatggatccaagccacgagcaatcgttgtggacccggtgcacggatttatgtactggaccgactggggcaccccggccaaaatcaagaagggagggctgaacggagtggacatatactcactggtgactgaaaacatccaatggccgaacggcatcactctcgacctgctcagcggacggctctactgggttgattccaagttgcattccatttcgagtatcgatgtcaatggtggaaacagaaagactatcctcgaagatgaaaaaagactggcccacccgtttagcctggcggtgttcgaagataaagtgttctggactgacattatcaacgaagctattttctcagccaatcgcctgactggaagcgacgtcaatctgctggccgagaaccttctgtccccggaggacatggttctgtttcacaacctgactcaaccgcggggagtgaattggtgtgagcgcaccactctgtcaaacggaggatgccagtacctctgtctcccggctccgcagatcaacccacattctccaaaattcacttgcgcctgtccggatggaatgctgctcgcgagggatatgcgctcatgcctgactgaagcggaggcggcggtggctacccaggaaaccagcaccgtgcgcctcaaagtctccagcacggcggtccgcactcagcacaccaccactagaccggtgccggacaccagcaggctcccgggggccactcctgggctgactacggtggaaatcgtcactatgtcccatcaggcattgggagacgtagcaggccgcggcaacgagaagaagccttcgtcggtgcgtgcgctgtctatcgtgctgccgatcgtcctgttggtgttcctctgcctcggtgtgttcctgctgtggaagaattggcgcttgaagaatatcaacagcatcaatttcgacaatccggtctaccagaaaaccactgaagatgaggtgcacatctgccacaaccaagacggatacagctacccgtcaagacagatggtgtccctcgaggatgacgtggcc

SEQ ID NO: 16195 - DNA, 2580 bp, Artificial Sequence
  Description of Artificial Sequence: Synthetic coding sequence
atgggcccctggggttggaagctgcggtggacagtggccctgctactggccgcggccggaaccgcggtgggagacaggtgtgagaggaacgagttccagtgtcaggacggtaagtgcatctcttataaatgggtctgtgacggatccgcagaatgtcaggatgggtctgatgagtcgcaggagacctgtctgtctgtcacctgcaagtccggcgattttagctgcgggggacgggtgaacaggtgcatcccacagttttggcgatgtgatgggcaagtggattgtgataatggctctgatgagcagggctgtcccccaaaaacctgctcacaggatgaattccgctgccacgacggcaagtgtatttcaagacagttcgtttgcgacagtgaccgagactgtctggacggatcagacgaggcatcctgccctgtcctcacatgcggccccgccagcttccagtgcaattcttctacatgcatcccacagctttgggcttgtgacaatgacccagattgcgaggacggaagtgacgagtggccacaaaggtgccgcggtctgtacgtattccagggcgactcttccccatgctctgcgttcgagttccattgtctctcaggcgagtgcatccattccagttggcgctgtgacggtggcccagattgcaaagacaagtccgatgaagagaattgtgcagttgctacatgtcggccagatgaatttcagtgtagtgatggaaactgtatccacgggtctaggcagtgcgaccgagagtacgattgcaaggatatgtctgacgaagtgggttgtgtgaatgtcacactttgcgaaggacccaacaagtttaagtgtcacagtggagagtgtattacactggacaaggtttgtaacatggctagagactgccgggattggtctgacgaaccaataaaggagtgcgggactgctgaatgccttgacaacaacgggggctgcagccacgtttgtaacgaccttaaaataggctatgaatgcctctgccccgacgggtttcagcttgtcgcgcagcgtcgttgcgaggacattgacgaatgtcaggaccccgacacgtgtagtcagctgtgcgtaaacctggaagggggatataaatgtcagtgtgaggagggattccagctggacccccacactaaagcctgcaaagcagtgggcagcatcgcctacttgttctttacgaatcgacacgaggtaagaaagatgacacttgaccgatctgaatacacatcgctcattcctaatctgcggaatgttgttgctctggataccgaagtggccagcaatcgcatctactggagcgacctgtcgcaacgtatgatctgttccacacagctcgatcgcgctcacggggtatctagctatgacacggtgatatcgagggacatccaggccccggacggtctcgcggtggattggatccatagcaatatttactggacagattccgtacttggcacggtgtctgtcgcagacactaagggtgtgaagcgcaaaactctgtttcgggaaaacggatccaagccccgagccattgtggtcgaccctgtacatggctttatgtactggaccgattggggaacacctgccaaaataaaaaaaggcgggttgaatggggtcgacatttacagtctggtcactgagaacatacaatggccaaacggcatcactctggacctgctaagcgggcgcctgtactgggtggactctaaactccattccatctcctcaattgacgtaaatggggggaatcggaaaacaatcctggaagacgagaagcgcttagcccaccccttttctctggcagtttttgaggacaaggtgttttggactgacatcatcaatgaggccatcttctccgcaaatcgcttaacgggatctgatgtaaaccttctcgccgaaaacctgttgagcccagaagatatggtcttgtttcataatctgacccagccccgcggagtgaattggtgcgagcgcacgaccctgtccaatgggggatgccagtacctatgcctacccgccccccagattaatccccattctcctaaattcacttgcgcatgtccagatggaatgttactggcgagagatatgcgcagttgcttgacggaggccgaagcagccgttgccacccaggaaaccagtacagtgcgacttaaagtgtcgtcaactgctgtgcgcacccagcatactactacacgtcccgtacccgatacgtcacgcctgccaggcgctacccccgggctgaccactgtggaaatagtcacaatgtctcatcaggctttaggggacgtagcgggacggggtaacgagaaaaagccttcttctgtgcgcgctcttagtatagttctgcctatagtgctcctggtcttcttgtgccttggggtgtttctgttatggaaaaactggcggttaaagaatattaactcaattaacttcgacaatccagtgtatcagaaaaccaccgaggatgaggtccatatctgtcataatcaggacggatattcctaccccagccgacagatggtcagcttagaggatgacgtggcg

SEQ ID NO: 16196 - DNA, 2580 bp, Artificial Sequence
  Description of Artificial Sequence: Synthetic coding sequence
atggggccctgggggtggaagttgagatggactgtcgcactgctgttagcggcagccggcacagctgtaggtgacagatgtgagcggaacgaattccagtgtcaggatggcaaatgtataagctataaatgggtatgcgacggctccgctgagtgccaagatggaagtgacgaaagccaggagacatgtctttcggtgacatgtaaatccggggactttagctgcggaggcagagtgaatagatgtattcctcaattttggcggtgtgacggtcaggtagattgtgataatggctccgatgagcaagggtgtccccccaagacctgtagccaggatgaatttaggtgccatgatggtaagtgtatatccagacagttcgtttgcgattctgacagagattgtctggatgggtctgacgaagcttcctgccctgtgctgacgtgcggacccgcttcatttcagtgcaattccagcacatgtatacctcagctgtgggcatgcgataacgaccctgattgtgaagacggaagcgacgagtggccacagagatgccgaggtctttacgtgttccagggagattcttctccttgctcagcgtttgagtttcactgcctgtccggcgaatgtattcattcatcatggaggtgcgacggcgggcccgactgtaaggataaatccgatgaggagaattgcgcggtagctacttgcagacctgacgagtttcagtgtagtgacgggaattgtattcacggatctcgtcagtgcgatcgcgagtatgactgcaaagacatgagtgacgaagtagggtgcgtgaatgttacactgtgcgagggcccaaacaagttcaagtgccattcgggggaatgtattacgctcgacaaagtgtgcaatatggctcgagactgcagggactggagcgatgaaccaattaaggaatgtggcaccgccgaatgcctcgacaacaatggcggctgctcgcatgtctgcaacgatctcaaaatcggttacgagtgtctatgcccggacggatttcagttggttgcccagagacggtgcgaagatatcgacgaatgccaagaccccgacacatgcagccagctctgtgtgaacttggagggcggatacaagtgtcagtgtgaggaagggtttcagctggatccccataccaaagcttgcaaagctgtgggatccattgcctatctcttcttcactaatcgccacgaagtgcggaaaatgactctggaccgttcagaatatacctcccttatacctaatctccggaatgtcgtcgcgttagacacagaggtggcaagtaacagaatatactggagtgacctgagccagaggatgatttgttctacccagcttgatcgcgctcacggcgtcagctcatatgacacagtcatcagtcgggatattcaagcaccagatggattagcggtggattggatccactccaacatttattggaccgactcggttcttggtaccgtctcagtcgctgatactaagggcgttaagagaaaaactctttttcgggagaacggcagcaagccccgtgctatcgttgtggacccagtgcatgggtttatgtattggaccgattggggcacacctgctaaaataaaaaaaggtggattgaacggtgtcgacatttatagcctcgtaacggaaaacattcaatggccaaatggcattactctcgacctgttatcaggccgcctgtattgggtggattctaagctccattccataagttcaatcgacgtaaacggcggcaatagaaagaccatcctagaggatgaaaaacgtttagcccacccattttccctcgctgtgttcgaggataaagttttttggacagatatcataaatgaggccatcttctcagcaaacagactcacagggtcggacgtcaatctactagccgagaatctacttagccctgaagatatggtcctgtttcataacttaacccagccccggggagtgaactggtgtgagcgaacaacactgtctaacggcggctgccagtatctttgccttccggcgcctcagataaatccacattcccctaagtttacctgtgcctgtcccgacggcatgctgctggcacgggatatgcggtcttgtctcaccgaggctgaggcagccgttgccacgcaggaaactagtacagttcggctgaaagtctccagtaccgcagtcaggactcagcatactactactcggcccgtcccagatacatctcgcctgcccggagctacgccaggtctgaccactgtggagattgtgaccatgtcccaccaagcattgggggacgtcgcaggacgcggcaatgaaaagaaaccatcaagcgttagggccctctcgatcgtgctgccaatagtgcttctggtcttcctgtgcctgggggttttcctgctttggaagaattggcgccttaagaatatcaattctataaacttcgacaaccctgtataccaaaagaccactgaagatgaggtccatatttgccacaatcaagatggatattcctacccctccaggcagatggtgtctctggaggatgatgtcgct

SEQ ID NO: 16197 - DNA, 2580 bp, Artificial Sequence
  Description of Artificial Sequence: Synthetic coding sequence
atgggtccttggggatggaaactgagatggactgtggcgctgcttcttgccgccgcaggtactgcagtgggggaccgctgtgagaggaacgaattccagtgtcaggacggaaagtgtatctcctacaagtgggtgtgtgatgggtcagcagagtgtcaagatggatccgatgaatcacaggaaacttgtttgtcggtcacctgtaaatccggggatttctcctgcggtggcagagttaatagatgtataccgcagttctggcgatgtgatggacaggtggattgtgataacggatcagacgagcaaggatgccctccgaaaacttgttcccaagacgagtttagatgccacgatggtaagtgcattagcagacagtttgtgtgtgacagcgacagagattgtctcgatggttcggatgaggcttcgtgcccagtcctgacctgtggtccagcgtcatttcaatgtaatagctctacctgtattccccagctctgggcgtgcgataacgaccccgattgtgaggacggctccgacgaatggccacaacggtgccgcggactgtacgtgtttcagggtgattcgtccccttgttccgcgttcgagttccattgtctttcgggagagtgtatccactcgtcgtggcgctgtgatggtggacccgactgtaaggataagtcagatgaggaaaattgcgctgtggccacctgtagacctgatgagtttcagtgctccgacggaaactgtatccatggctcccggcagtgtgatcgggaatacgattgtaaggacatgtcggatgaggtcggctgtgtcaacgtgacgctgtgcgagggacccaataagtttaagtgtcattccggagagtgcatcactctggataaggtgtgtaacatggctcgagactgccgggattggtcggatgaaccaatcaaagagtgtggaactgctgaatgtcttgataacaatggcggttgtagccatgtctgtaatgacctgaagattggatacgaatgtctgtgccctgatggctttcaacttgtggcacagcggcgttgcgaagatatcgacgaatgtcaggatccggatacttgttcgcaactctgcgtgaaccttgaaggaggatacaagtgccagtgtgaagaggggttccaacttgacccacatactaaggcatgtaaagcagtggggagcatagcgtacctgtttttcactaaccgacatgaagtgcgcaaaatgaccctggacaggtcagaatacacctcactgattcccaatcttcgtaatgtggtggcactggatactgaagtggcaagcaaccgcatctactggtcggacctgtcgcagcggatgatttgttcgactcaactggacagagcacatggtgtctcctcctacgataccgtgatatcaagagatattcaggcgcccgatggtcttgcggtcgactggatacatagcaacatttactggactgattccgtgctgggcaccgtctcggtcgccgataccaagggggtcaaacgtaagaccctttttcgggagaacgggtcgaagcctcgtgccatagtggtggaccctgtccatggatttatgtattggactgactggggtacccctgcaaagataaagaagggcggcctcaatggtgttgatatctactcactcgtgaccgaaaacatccaatggccgaatggtattaccctcgatctcctgtcggggagactttactgggtggattcaaaacttcactcgattagctccatcgacgtgaacggtgggaacagaaagaccatattggaagatgaaaaacggctggctcatccattctcgctggccgtgtttgaggacaaggtgttctggaccgacataatcaacgaggccattttctccgccaaccgtttgaccggtagcgacgtgaatctgctggcagaaaatctgctctcccctgaggacatggtcctgttccataaccttacccaaccgaggggtgtcaattggtgcgagcgcaccacgctgtcaaatggtggttgtcagtatctctgccttcctgcaccacaaatcaatccacattcccctaagttcacctgcgcctgtcccgatggcatgctgctcgcacgtgacatgcgatcgtgcctgactgaggcagaagccgccgtggcaactcaagaaaccagcactgtgcgtttgaaggtttcgtcgacggcagtgagaacgcaacataccactacgcgcccggtccctgatacctcccggctccccggcgcaactccaggacttaccaccgtggaaattgttactatgtcccatcaggcgcttggtgacgttgcagggagaggtaacgagaagaagccctcatcggtgagagcactttcaattgtgttgcccatcgtccttctcgtgttcctgtgtctgggagtctttctcctttggaaaaactggcgacttaagaacataaactccatcaatttcgacaacccggtgtaccagaaaacgactgaagatgaagtccacatatgtcacaaccaggatggatactcgtacccctctcggcaaatggtgtcactggaagatgacgtcgca

SEQ ID NO: 16198 - DNA, 2580 bp, Artificial Sequence
  Description of Artificial Sequence: Synthetic coding sequence
atggggccgtggggctggaaactgagatggaccgtcgcgcttctgctggcggcggccggtaccgcagtcggcgaccggtgcgaaaggaatgaattccaatgccaagacggaaaatgcatttcctacaagtgggtgtgcgacggctcagcagagtgtcaggatggatcggatgagagccaggagacttgcttgtctgtgacctgcaagtccggtgacttttcttgcggaggccgcgtgaacagatgcatcccgcagttctggagatgcgatggtcaggtggactgcgataacggaagcgacgaacagggatgccctccgaaaacctgctcgcaagatgaattccgctgccatgacggcaagtgcatcagccgccaattcgtgtgcgattccgacagagactgcctggacggatcggacgaagccagctgccccgtgctgacttgcggcccggcctcctttcagtgtaattcaagcacctgcataccacagctctgggcatgtgacaatgatccggattgtgaagatggctccgacgagtggccacaacgctgccggggattgtacgtctttcagggcgactcgagcccgtgtagcgcgttcgagttccattgtttgtccggagagtgcatccattcgtcttggcggtgcgatggaggaccagactgtaaggacaaatcggatgaggagaattgcgcggtggcgacttgtcgcccggatgagtttcaatgctccgacgggaactgcattcacggcagccgccagtgcgatcgagaatacgactgtaaggatatgtccgacgaggtcggctgcgttaacgtgactctctgcgaaggaccgaacaagttcaagtgccattccggtgaatgtatcactctggacaaggtgtgcaatatggcacgggattgtcgggattggtctgacgagcccatcaaggaatgtggaactgccgaatgcctcgacaacaacggtggttgcagccatgtgtgtaacgacctgaagatcggctacgaatgcctctgcccagacggtttccagctggttgcacagcggagatgcgaagatattgatgagtgccaggatcccgacacgtgtagccagctgtgtgtgaatcttgagggcgggtacaagtgtcagtgtgaggaaggattccaattggacccgcacaccaaagcctgcaaggcggtgggctcgatcgcctacctgttcttcactaatcgccacgaggtgaggaaaatgactctggaccgctcggaatacacctcgctgatcccgaatttgagaaatgtggttgccctggataccgaagtggccagcaatagaatctactggtctgacttgtctcaacgcatgatttgttcaacccagttggaccgggcacacggagtctcctcctacgatactgtgatctcgcgcgacatccaggcaccggacggactggccgtcgattggattcacagcaacatctactggacggattcggttctgggaactgtgtccgtggcagacactaagggagtcaagaggaaaactctcttccgggagaatggctcaaagcccagggccatcgtcgtggatccggtgcatggcttcatgtactggaccgattggggaactcccgccaaaatcaaaaaaggaggactgaacggagtggatatctattcgctcgtgaccgagaatatacagtggccgaacggaatcaccttggatctgctcagcggaaggctgtactgggtcgatagcaagctgcacagtatctcatccatcgacgtgaatggtggcaacagaaaaaccatactggaggacgaaaagcgcctcgcgcaccctttttccctcgcggtgttcgaagataaggtcttttggacggatatcattaacgaagctattttctcagccaaccgcctgaccggttccgatgtgaacctgttggcagagaatcttctctcccctgaggatatggtgctgtttcacaatcttactcaaccacgcggagtgaattggtgtgaaagaaccaccctgtccaacgggggatgccaatacctgtgcctcccggcccctcagatcaacccgcacagcccaaagttcacttgtgcttgccctgatggcatgctcctcgcgagagatatgcgctcgtgtctcactgaagctgaagccgccgtggctactcaggaaacgtcgaccgtgcgcctcaaagtgagctcgaccgctgtgcggacccaacataccactactcggcctgtgcctgatacttcgaggctgcctggagctacgccgggccttacgacggttgaaatcgtcaccatgagccatcaagctctcggagatgtggcgggacggggaaacgaaaagaagccctcctcagtccgggcgctctccatcgtgctccccatcgtgcttctggtgtttttgtgtctgggagtattccttctgtggaagaattggcgcctcaagaacatcaactccatcaacttcgacaacccggtttaccagaaaactaccgaggacgaagtgcacatctgccacaatcaggacggctattcctacccttcacggcaaatggtatccctggaggacgacgtggca

SEQ ID NO: 16199 - DNA, 2580 bp, Artificial Sequence
  Description of Artificial Sequence: Synthetic coding sequence
atggggccgtggggatggaagctgagatggactgttgcactcctgctggcggcagccggaactgctgtgggtgatcgttgcgaaaggaatgagtttcaatgtcaagatggtaaatgtatctcgtacaagtgggtgtgtgacggatcagccgaatgccaagacggatcagacgagtcgcaagaaacctgcctgtccgtcacttgcaagtccggggacttctcctgtggcggacgggtgaatcggtgcattccgcagttttggcggtgcgacggccaggtggactgtgacaacggaagcgacgaacaggggtgtcctccgaaaacttgtagccaagacgagttccggtgtcacgatggtaaatgcatctcgcgccagttcgtgtgcgactcggacagagattgcctcgatggatccgacgaggcttcttgccctgtgctgacctgcggtccggcctcgtttcagtgcaactcgtccacctgcatcccgcaactttgggcctgcgacaatgaccctgactgcgaagatggatccgatgaatggcctcagcgctgtcgcggcctttatgtgttccagggtgattcatccccgtgttcagccttcgagttccactgcctgtcgggcgaatgcatccattcgtcctggcgctgcgacggcggccctgattgcaaagataaatcggatgaagaaaactgtgcggttgcgacgtgtagaccagacgaattccaatgctctgacggtaactgcatccacggatcgagacaatgtgatcgtgaatatgactgtaaggacatgagcgatgaggtcgggtgtgtcaatgtcaccctctgcgaaggtccgaacaaattcaagtgccatagcggagaatgcatcacgctggataaggtctgcaatatggcccgcgattgtcgggattggtctgacgaaccgatcaaagaatgcggaaccgcagaatgcctggacaataacgggggatgctcacacgtctgcaatgatctgaagattgggtacgaatgtctctgcccagacggcttccaactggtggctcagaggagatgcgaggacatagatgagtgccaggaccccgacacttgctcacaactgtgcgtcaatctcgagggaggatacaaatgccagtgtgaggaaggattccagctcgatccacacactaaggcatgtaaagccgtcggttcgattgcctacctctttttcactaatcgacatgaggtgagaaagatgactctcgatcgatcagaatacaccagcctcatcccgaaccttcggaatgttgtggcgctggatacggaagtggcctcaaaccgcatctactggtcggacctctcgcagcggatgatctgctcgactcaattggatcgtgctcatggagtcagctcctacgataccgtgatcagcagagacatccaggcccctgacggcctcgccgtggactggatccattcaaacatctactggaccgactcggtcttgggtaccgtctccgtggcggacaccaaaggagttaagcggaaaaccctttttcgcgagaacgggtcgaaaccgcgcgcgatcgtggtggacccagtgcatggttttatgtactggactgactggggaactccggccaagatcaagaagggaggcctcaatggggtggacatctactctctcgtgactgagaacatccaatggcccaacggcattaccctggacctgctgtcaggacgcctgtactgggtggattcaaagctgcatagcatcagctccatcgacgtgaacggaggcaatcgcaaaacgatactggaggatgagaagcggctggcgcatcctttctccctcgcagtgttcgaggacaaggtgttctggactgatatcatcaacgaggcaattttcagcgcgaataggctcactggctcggatgtgaacctgctggcagagaacctgttgagcccggaggatatggtcctgtttcacaatctgacccagccgcggggcgtcaactggtgcgaaagaacgaccctttcgaacggcggctgccagtacctctgcctgccggctccgcagatcaacccgcactctccaaagttcacttgcgcttgcccggacggaatgcttttggcccgggatatgagatcttgcttgactgaagcggaagccgccgttgcgacgcaggagacttcgactgtgcggctgaaagtctcctccactgcggtgcggacccagcacacgactacccgcccagtgccagacacctcaagacttccgggagctaccccaggcctcaccaccgtcgaaatcgtgaccatgagccaccaggctcttggtgatgtcgctgggcgcgggaacgaaaagaaaccaagctcggtgcgcgcgttgtccatcgtccttccgatcgtcttgttggtgtttctgtgcctcggcgtctttctgctgtggaagaattggcggctcaagaacatcaacagcatcaacttcgacaaccccgtctaccagaaaactacggaggacgaagtgcacatttgccacaatcaggacggatactcctacccgagccgacagatggtgtcactggaggacgacgtggcc

SEQ ID NO: 16200 - DNA, 2580 bp, Artificial Sequence
  Description of Artificial Sequence: Synthetic coding sequence
atggggccatggggatggaagctgcgatggaccgtcgccctgctgctggcagctgcaggaactgccgtgggtgatcggtgcgagcggaacgaattccagtgccaggacggtaaatgtatctcgtacaaatgggtgtgtgacgggtcggcagagtgtcaagacggctcagatgaatcacaggaaacttgcctctccgtcacttgtaagagcggggacttctcttgcggcggtcgcgtgaatagatgcatccctcagttctggcggtgcgacggacaggtggactgcgataatggaagcgacgagcagggctgtcctccgaaaacttgttcgcaggacgagttcaggtgccacgacgggaagtgcatatcccggcaattcgtgtgtgactcggatagagattgcctggacggatcggacgaggcctcctgccccgtgctcacttgtggacccgcgtccttccaatgtaactcctccacttgcatcccgcaattgtgggcctgcgataacgatccggactgcgaagatggtagcgacgagtggcctcaacgctgcaggggcctgtacgtgttccagggtgattcctcaccatgctccgcgtttgaattccattgcctttcgggagagtgcattcatagctcatggagatgcgatggcggaccagattgcaaggacaaatctgacgaggagaactgcgccgtggccacctgtcgcccagacgaatttcagtgttcagatgggaactgtatccatggttcgcgccagtgcgatcgcgaatatgactgcaaggacatgtcggacgaagtgggatgcgtgaacgtcacgctgtgtgagggtcccaacaagttcaagtgccattctggagaatgcatcaccttggataaagtgtgcaatatggcacgcgattgcagagactggtccgacgaaccgataaaagaatgtggcaccgccgaatgtcttgataacaacggaggatgctcccacgtgtgcaacgacctgaagatcgggtacgagtgcctgtgtccagatggcttccagctggttgcgcaacgccgctgcgaggacattgacgaatgccaagacccggatacctgcagccagctctgcgtgaacctggaggggggctacaagtgccaatgcgaggaaggattccagctggacccgcacactaaggcctgcaaggccgtcggatcgatcgcgtacttgttctttaccaacaggcacgaagtgcggaagatgactctggatagatcagaatacaccagccttatccctaacctgcgcaacgtcgtggcgctggataccgaggtggcaagtaatcgcatctactggagcgacctttcccaacgcatgatctgctccacgcaactggatcgcgcccacggcgtgtcgtcgtacgacactgtgatctccagggatattcaagcgcctgacgggctcgccgtcgactggatccacagcaatatctactggaccgactcggtactgggaactgtgtcggtggccgacacgaaaggagtcaagcgcaaaactctgtttcgggaaaacggatccaagccgagggcgattgtcgtcgacccggtgcacggattcatgtactggactgactggggaacgccggccaaaatcaagaagggagggctcaatggtgtggacatctacagcttggttactgaaaacatccagtggccaaacggcataactcttgatctgctgagcggaaggttgtactgggttgactccaaactgcacagcattagctcaatcgacgtcaacggaggcaaccgcaagaccattctggaggatgaaaagagactggcccacccttttagcctggcggtgttcgaggataaggtcttttggactgatatcatcaacgaggcaatcttctccgcgaatcgcctgactggatcagatgtgaacctgctggctgaaaacctgctgtcacctgaggacatggtcttgttccacaatttgacccagccaagaggtgtgaactggtgtgagcggactacccttagtaatggaggctgtcagtatttgtgcctgccggccccgcagattaatccgcacagccctaagttcacgtgcgcatgccccgacggcatgcttttggcaagggacatgcgctcgtgtctcacggaggcagaggccgccgtggctacccaggaaacctccacggtcagactgaaggtttcatcgaccgctgtgcgcacccaacataccaccactaggccggtcccagatacctcccgtctgccgggtgccaccccgggacttactactgtggaaatcgtgaccatgtcgcatcaggccctgggagacgtcgctggacgcggcaacgaaaagaaaccttctagcgtaagggcgctgtccatagtgctcccgattgtcttgctggtctttctttgcctgggcgtctttctgctctggaagaattggcggctcaagaatatcaactcaatcaatttcgacaatcccgtttaccaaaaaaccacggaggatgaagtccacatctgccataaccaggacggatactcgtacccatccagacagatggtgtccctcgaagatgacgtggcc

SEQ ID NO: 16201 - DNA, 2580 bp, Artificial Sequence
  Description of Artificial Sequence: Synthetic coding sequence
atggggccctgggggtggaaactcaggtggacagttgcactgctactcgcagctgccggtaccgctgtgggcgatcgttgtgagcgtaacgagtttcagtgccaggatgggaaatgcataagttacaagtgggtctgcgatggatctgctgagtgtcaagacggttctgatgaatctcaggaaacttgcctctcagtgacatgcaaatcaggtgatttctcatgtgggggccgtgtgaatcgatgtataccccagttctggaggtgcgacggtcaggtggattgcgacaacggtagcgacgagcaggggtgccccccaaaaacttgttcacaagatgaattccgatgccatgacggaaaatgcatctcccggcaatttgtctgcgattccgatcgggactgcctcgatggttctgatgaagcctcttgtcccgtactgacatgtgggccagcctcattccagtgcaacagttcaacctgtattccacaactatgggcctgcgacaatgaccccgattgcgaggatggtagtgatgaatggcctcaacggtgtagagggctgtacgtgttccagggtgattcttccccctgcagtgcatttgaatttcattgtctgtccggggaatgcattcactcctcatggcggtgtgacggcgggcctgactgcaaagacaaatcggacgaggagaattgcgccgtggcgacctgtcggccagatgagttccagtgtagtgacggcaattgcattcacggcagccggcagtgcgatcgcgagtatgactgcaaggacatgtcagacgaagtgggatgcgtgaacgtgaccctgtgcgaaggcccaaataaattcaagtgccactcgggcgagtgcattaccctggataaggtgtgtaatatggcgcgggactgcagggactggtccgacgagcccattaaggagtgtgggaccgcagagtgtctggataacaacggaggctgttcacacgtatgcaatgaccttaagatcggctacgagtgcctctgccccgatggtttccagttggtggcccaaaggcggtgtgaagacattgacgagtgccaggaccctgatacgtgttcacagctttgcgttaatcttgagggcgggtacaagtgtcagtgtgaagagggctttcagctcgacccccacaccaaagcctgcaaagcggtgggatcaattgcctacctcttttttaccaaccgacacgaagtacgcaagatgaccttagataggagcgagtacacatctctcatcccaaatctgcggaacgtagtcgcattggacacagaggtcgcttccaatcgcatttactggtccgatctctcacagaggatgatctgcagtacacagctagacagagcacacggcgtgtcgtcatatgatacagtcatcagtagagatatacaggctccagacggtttggctgtcgattggattcacagtaacatttactggaccgattccgtgctcggtactgtgagcgttgctgacacgaaaggagtgaagcgcaagacccttttccgagagaatggatctaaacctagggccatcgtggtggatcctgttcatggtttcatgtattggaccgactggggcactcccgcgaagatcaagaaaggcgggctgaacggtgtcgacatatatagtctggtaaccgaaaacatacagtggccaaatggaatcactctggacctcctttcagggcgtctgtactgggtcgattcaaagctgcattccatttcaagcatcgacgttaacggcggcaatcggaaaacgatcttggaggacgagaagcggctggcacacccgttttccctcgcagtgtttgaggataaagttttctggacagatataataaatgaagctatcttctccgcaaaccgtctaacaggcagtgatgtgaacctattagctgagaatctgctttctcctgaggacatggtcctgtttcacaatttgacccaaccaaggggtgtgaactggtgcgagaggacaactctgtccaatggcggctgtcagtacctctgccttcccgccccacagattaacccacacagtcccaagttcacgtgcgcttgccccgatgggatgctgttggcacgagacatgcgatcttgcttgaccgaggcagaggccgccgtcgccacccaggaaacaagcacggtaaggctgaaggtttcatccaccgccgtaagaacccagcacaccactaccaggccagtgccggacacaagccgcctgccaggagctacgcccggcctaaccacggtcgaaatcgtgacgatgtctcatcaggccttaggggacgtagctggccgtggaaatgagaagaaacctagtagtgtgagggcgctctccatcgtgcttcctatcgtcctactggtgttcctatgtctaggtgttttcttgctgtggaagaactggcgcctaaagaatatcaattcaatcaacttcgacaaccccgtgtaccagaagaccactgaggatgaggtgcacatctgccataatcaggatggatacagttatccttctcgccaaatggtgtccctcgaagacgatgttgcc

SEQ ID NO: 16202 - DNA, 2580 bp, Artificial Sequence
  Description of Artificial Sequence: Synthetic coding sequence
atgggtccttggggatggaaactgagatggacggtcgccctgcttctggcagccgccgggaccgcagtcggtgaccgctgcgaacgaaacgaatttcagtgccaagatggcaagtgtataagctacaaatgggtgtgtgatggtagcgccgaatgccaggacggaagcgacgagagccaagaaacctgccttagcgttacgtgtaaatcaggagatttctcgtgtggtggaagagtgaaccgctgtattccgcagttttggagatgtgatggccaggttgattgtgataacggcagcgatgagcaaggatgcccccctaagacctgcagccaggatgaatttcggtgtcacgacggaaagtgtatctcgagacaatttgtgtgtgactcggatcgtgactgccttgatggatcggacgaagcgagctgcccggtgttgacctgtggccctgcatcttttcagtgcaatagttcaacctgtattccacaactctgggcatgcgataatgatccagattgcgaggacgggtccgatgaatggccacaacgctgtagaggactctacgtgtttcaaggagattcctctccctgttccgcgttcgaatttcattgtttgtcaggagaatgcatacactcctcatggcgctgtgatggtggacccgattgtaaggataagtccgatgaagaaaactgcgccgtggccacgtgccgtccagatgagttccaatgttcggatggaaattgtattcatgggtccagacaatgtgacagagaatacgattgcaaggatatgtcagatgaagtcggttgtgttaatgtgaccctgtgtgagggacccaataagttcaaatgtcattcgggagaatgtattaccttggataaagtgtgcaatatggcacgggattgccgggattggagcgatgaacctattaaggagtgcgggaccgctgagtgtctggataacaacggaggatgttcacacgtctgcaatgaccttaagataggatacgaatgcttgtgtcccgacggttttcagctcgttgctcaacgtcgatgcgaagatatcgatgagtgtcaggaccccgatacgtgttcgcaactctgtgtgaatctggagggaggctacaagtgccagtgtgaggagggcttccaactggacccacataccaaggcatgtaaagcagtggggtcaattgcatatcttttctttaccaacagacatgaggtcagaaaaatgactcttgatcgctccgagtacacttcactgattcccaacctgcgcaacgtggtcgcgctcgataccgaagtggccagcaacagaatctactggtcggatcttagccaacgcatgatctgctcgacgcagcttgatagagcacacggagtgtcctcctacgataccgtgatctctagggatattcaagcacctgatgggcttgcagtggactggattcactcaaacatttactggactgatagcgttcttggaactgtgtccgtggctgacacgaaaggtgtgaagcgtaagacccttttcagagaaaacgggagcaaaccaagagcgatcgtggtggatccagtccacggttttatgtactggacggattggggcactcccgcgaagattaagaagggtggactcaatggtgtggacatctactcgctggtgactgaaaacatccaatggcctaacggaattactcttgatctgctgtcgggaagattgtactgggtcgattcgaaacttcatagcatttccagcattgatgtgaatggcggcaatcggaaaaccattctggaggatgaaaagagacttgcccatccatttagccttgccgtgtttgaagataaggtgttttggactgacatcataaatgaagcgatcttttcagccaatcgattgactggatccgacgtgaacctgttggctgaaaacctgctctctcctgaggatatggtgctgtttcacaaccttactcagccgaggggagtcaattggtgtgagcggactaccctttcgaacggcggctgtcagtacctttgcttgcctgcccctcagataaaccctcactcgccgaagttcacctgcgcatgtccagacgggatgcttctggcccgggatatgcgctcctgcctcaccgaagcagaggcagcagtcgcgacccaggagacttcaaccgtccgtctgaaagtgtcctcgactgcggtgcgcactcagcatacgaccacgcggcctgtcccagacacttcgaggctgcccggtgcgacgccgggactgacgacggttgaaatagtgaccatgtcccatcaggcacttggagatgtcgcaggcagaggaaacgaaaagaagccctcttcggtgcgcgcactttcaatcgtactgcctatcgtgttgctcgtctttctttgtctgggggtctttcttctctggaagaactggcgcctcaagaatatcaattccatcaatttcgataacccggtgtaccaaaagactacggaagatgaagtgcatatttgtcataaccaagacggttacagctatccgagtcgacagatggtgtccctcgaagatgatgtggct

SEQ ID NO: 16203 - DNA, 2580 bp, Artificial Sequence
  Description of Artificial Sequence: Synthetic coding sequence
atggggccctggggctggaagctccgatggaccgttgcactgttgttggcagcagctggaaccgccgtgggagatagatgcgaacggaatgagttccaatgccaggacggcaagtgcattagctacaaatgggtctgcgacgggtctgcggaatgccaggacggctccgatgagtctcaggagacttgcctgagcgtcacctgcaaatcaggcgacttctcttgcggcgggagggtcaaccgatgtattccccagttctggcggtgcgacggacaagtggactgcgataatggcagcgacgagcaaggatgccctcccaaaacctgctcacaggacgagttccgctgtcatgacggtaagtgcatttctagacagttcgtctgcgacagcgatcgcgattgcctggacgggtctgatgaggctagttgtcccgtgctcacgtgtggccccgcctccttccagtgcaactcctcaacatgtataccgcaactgtgggcatgtgacaacgaccctgactgtgaagatggaagtgatgagtggcctcaacgctgccgcggactgtacgttttccagggtgacagcagcccatgctcagccttcgaatttcattgtttgtccggggagtgcatccactcctcttggcgatgtgatgggggacctgattgcaaggataagagtgatgaagagaactgcgccgtggccacgtgtcggccagacgagtttcagtgttctgacggaaactgcattcatgggagtagacagtgtgatagggaatacgactgtaaggacatgtctgatgaggtcggctgcgtgaatgtaacgctgtgcgaaggccccaataaatttaaatgtcattcaggcgagtgcatcacattggacaaggtgtgcaacatggctcgggactgccgggactggtccgacgaacctatcaaggaatgtggcacagccgaatgcctggataataatggaggctgtagccacgtctgcaacgaccttaagatcgggtacgaatgtttgtgcccagatggatttcagctggtcgctcagcgacggtgcgaggacatcgacgaatgtcaggatcctgacacctgcagtcaactgtgtgtcaatcttgaggggggctacaagtgtcaatgcgaagagggattccagctcgacccgcataccaaagcttgcaaggctgttgggtcaattgcctatttgtttttcacaaaccgacatgaggtacgcaagatgacactggaccggagcgaatataccagcttgatccctaatctcagaaatgtcgtggccctcgacactgaggtggcctccaaccgaatatactggtctgatctgtcccagaggatgatttgctcaacacagctggatcgagcgcatggagtttcttcctacgacactgtgatttctcgcgatattcaagcccccgacgggctggccgtagattggatacattctaatatctattggaccgatagcgtgttgggtaccgtgtctgtggcagacacaaaaggggtcaagcgcaagactctctttcgggagaatgggagtaaacccagagcaatagtggtggatcccgtgcacggatttatgtattggaccgattgggggactccagctaagattaagaaaggcggcttgaatggcgttgacatctactccctggttacggagaacattcaatggcccaacggtatcaccttggatttgttgtccgggagactgtactgggtggattcaaagctgcactctatctcctccatcgacgtcaatggaggcaacaggaaaacaatactcgaagacgaaaaaagactggcacatcccttttcactggcagtgtttgaggataaagtcttttggactgacataatcaatgaggcaattttctccgctaatagacttacaggaagcgatgttaatctgctggccgaaaatctgctgtcacccgaggatatggtcctcttccacaacctgacgcagccaagaggcgtgaattggtgcgaaagaaccaccctgtccaacgggggatgccagtatctgtgccttccagccccccagataaaccctcacagcccgaaattcacctgcgcatgtcctgacggaatgttgttggcccgggacatgcggtcctgcctgacagaggctgaagctgccgtcgctacccaggaaacttcaaccgtgagactgaaggttagtagcaccgcggtcagaactcagcatactacaactcggccagttccagatacaagtcgactgcctggagccaccccgggcctgactaccgtcgagattgttaccatgagtcaccaggccctgggagatgtcgccggccgcgggaacgagaaaaaaccctcatccgtcagagccctgagtatcgtactgcctatagttctgcttgtgtttttgtgccttggggtgttcctcctgtggaaaaactggaggctgaagaacattaacagtataaactttgacaatccagtctatcagaaaactacagaggatgaggtacacatttgtcataatcaggacgggtattcctacccctcccggcaaatggtgtccttggaggacgacgtggct

SEQ ID NO: 16204 - DNA, 2580 bp, Artificial Sequence
  Description of Artificial Sequence: Synthetic coding sequence
atgggaccttggggctggaaactacggtggacagtggcattactgctagctgctgcaggaaccgccgtgggcgatcggtgcgaaagaaatgagttccagtgtcaagacgggaagtgcattagttacaagtgggtgtgtgacggcagcgccgagtgtcaggatgggagcgacgagagccaagaaacgtgtttgagcgtgacatgcaagtccggtgactttagttgcggcggtagggtgaaccggtgtattccacagttctggagatgtgatgggcaggtcgattgtgataatggtagtgatgaacaaggttgtccccccaaaacatgttcccaggacgaatttaggtgccatgatggcaagtgcatttcccgacagtttgtatgtgacagtgaccgcgattgtcttgatggatccgatgaggcctcctgccctgtgctgacatgcggccctgcctcttttcagtgcaactccagtacatgtatcccacaactatgggcctgtgacaacgaccccgactgcgaagacggtagtgacgagtggcctcaaagatgcagaggcctgtatgttttccagggtgactcgtccccttgcagcgcttttgagttccattgcttgagcggcgagtgtatccatagctcttggaggtgcgacggaggtccggactgtaaagacaagagcgatgaggagaactgcgccgttgccacctgccggcctgatgagttccagtgttcagacgggaattgcatacacgggtcaagacaatgtgatcgagagtacgactgtaaagacatgagcgacgaggtagggtgtgtcaacgtcacgctctgtgaggggcctaataaatttaagtgccactcaggcgagtgtatcacactggacaaggtgtgcaacatggctcgggattgtagagactggtctgacgagccaatcaaggagtgtggaaccgcggagtgccttgataacaatggtggatgctcacatgtttgtaacgacctcaaaataggatacgagtgtttgtgtccagacggattccaactggtcgctcaacgccggtgtgaggatatagatgagtgtcaagaccctgatacctgcagccagttgtgcgtgaacctcgagggtggctacaagtgtcaatgcgaagaggggttccaactggatcctcacacaaaagcctgcaaagcggtgggatccatcgcatatttgtttttcacaaatcgccacgaagtcaggaagatgacattggatcggtcagagtacactagcctgatcccaaacctgcggaacgtggtggccttggatactgaagtagcaagtaaccggatttattggtcagacctgtctcagcgcatgatatgcagtacacagctggaccgcgcacatggagtctctagctatgacactgtgatttcaagagatatacaggcgccagacgggcttgctgttgactggattcattcaaatatctattggaccgattcggtcctgggcacagtttctgtggccgacacgaaaggagtgaaacgaaaaacattgtttagggagaatggttccaagcctagggccatcgtcgtggatccagtccacgggttcatgtactggacggattgggggactcctgctaaaattaaaaaagggggtctcaatggggtggacatttattcactggtgactgagaacatccagtggcctaacggaattacactcgatctgcttagcggtcgactctattgggttgactcaaaactgcacagcattagcagtatagacgtgaatggcggaaaccggaagacaattctagaagatgaaaagagactggcccacccattctccctcgcagtattcgaggataaagtgttctggacggacattattaatgaggcgatattttcagctaacaggttgaccggcagcgatgtgaacctgctggccgagaacttgctttcccctgaggacatggtgttgtttcacaacctgacacagccccgtggcgtcaactggtgcgagaggactactctgtccaatggcggctgtcagtacctctgcctgccggccccacagattaacccgcatagtcccaagttcacatgtgcctgtcccgacggaatgctgctggcccgagatatgcggagctgccttaccgaagccgaagccgctgtcgccacgcaagagacctctactgtgaggctgaaggtatcaagcacagccgtgcggactcagcataccacaacccggccagtaccagacacatcgcgcctcccaggggctacgccggggttgacaactgtggaaatcgtaacgatgtctcaccaggcactgggtgacgtcgctggtcgcggcaatgaaaagaagcctagctctgtgcgcgctttgagtatcgtgctcccaatcgtcctcctcgtgttcctctgcttaggggtgtttctgctgtggaagaactggagattgaagaacattaactccatcaacttcgacaatccggtgtaccagaagactactgaagatgaggtgcatatctgccataatcaagatgggtatagctacccttctagacagatggtcagccttgaagatgacgtagct

SEQ ID NO: 16205 - DNA, 2580 bp, Artificial Sequence
  Description of Artificial Sequence: Synthetic coding sequence
atgggaccctggggatggaaactgcggtggaccgtggctctgctgctggcggccgccggcactgcagtcggtgatcgctgcgaacggaatgagtttcagtgtcaggatggcaaatgtattagctacaagtgggtgtgcgacggaagtgctgagtgccaggatggcagtgacgaaagccaggaaacctgcttaagtgtgacatgtaagtccggagatttctcatgcggcggacgtgttaataggtgtattccccagttctggaggtgtgatggtcaggtggactgtgacaatggaagtgatgaacaaggctgtccgccaaagacttgttcacaggatgagtttagatgtcatgatggaaagtgtatctcacgccagttcgtctgcgactctgaccgggactgtttagacgggtctgacgaagctagctgtcccgtgctgacatgcgggcccgcctcgttccaatgtaattcttctacgtgtattccgcagttgtgggcttgcgacaacgatcccgattgcgaagatggcagcgatgagtggcctcagcggtgtcgggggctgtatgtgttccagggcgactcatccccatgctcggctttcgagtttcattgcttgtcaggagaatgcatccatagctcttggcggtgtgacggtggtcccgattgcaaagataagtctgacgaggagaattgcgctgttgcaacttgccgccccgacgaattccagtgtagtgacggtaattgcatccacggctcccgccagtgcgaccgggagtatgactgtaaggacatgtccgatgaggtgggctgtgtcaacgttacactgtgtgaaggccccaacaaattcaagtgccattcgggggagtgtatcaccctggacaaagtgtgcaatatggctcgcgattgtcgggactggagcgatgaacctatcaaggagtgtggcaccgcagagtgcttggacaacaacgggggatgtagtcacgtgtgcaatgatctgaaaattggctatgagtgtttgtgcccagacggattccagttggttgcacaacgacgctgcgaagatatcgatgaatgccaggatcctgacacatgctctcagttgtgcgttaacctcgagggcgggtacaaatgccagtgtgaagaaggattccagctagatccacacaccaaagcctgcaaagccgtgggctctatcgcatatctgttttttacgaaccgccacgaagttcgcaagatgacgctagacaggtcagaatatacaagccttatcccaaacctgcgcaacgtcgttgctctggacaccgaagtggcttctaatcgaatttattggtctgatctctcccaaaggatgatttgcagcactcagcttgacagagcacatggagtgagctcttacgataccgtaattagcagagatatccaggcccctgacggtctcgccgttgactggatacatagcaatatctactggacagacagcgtgctggggactgtatccgttgcggacaccaagggcgtgaagagaaaaacgctgttccgagaaaacggttcaaagcccagggcaatcgttgtagaccctgtacacggtttcatgtactggacagactggggaacccccgcaaagatcaagaaagggggtctcaatggcgtggatatctactccctggtcacagaaaatatccaatggccaaatggcattacgctggacttgctgtcaggacgtctctattgggtcgattctaagctgcattctatttcgtctatagacgtgaacggaggtaacaggaagacaattttggaggacgagaagcgcctggcccacccgttctccctcgctgttttcgaggataaggttttctggaccgatattatcaatgaggcaattttctccgcaaacaggctgacaggctctgatgtgaacctgctggccgaaaacttattgtcccccgaggacatggtgctttttcacaacttgacccaacccagaggggtgaactggtgtgaacgcacgaccctgtctaacggaggatgccagtacttgtgcctgcccgcgccccagataaacccccattcgcccaaattcacttgtgcgtgtcccgatggtatgttacttgcacgcgatatgcgcagttgcctgacggaggcagaggccgccgtggccactcaggagacaagcacggtgcgattgaaggtttcctctacggctgtgcggacgcaacacacaacaacacgacctgttccagacaccagtcgcctgccgggtgctacaccgggactcaccactgtggagatcgtaaccatgtcacatcaggctctcggcgacgtggcaggacgtggcaatgagaagaagccatcctccgtgagagccttaagtattgtgctgcccatagtgctgctcgtattcctgtgccttggggtctttctgttgtggaagaactggcggttaaagaacatcaacagcatcaactttgataacccagtgtaccagaaaacaaccgaggacgaggtgcacatttgccataatcaggatgggtactcatacccctcgcggcagatggtgtccctggaagacgatgtggca

SEQ ID NO: 16206 - DNA, 2580 bp, Artificial Sequence
  Description of Artificial Sequence: Synthetic coding sequence
atgggtccgtggggatggaagctccgctggacggtggccctcctgttggccgcagccgggacggctgtcggagatcgatgcgagcggaatgagttccaatgccaggatgggaagtgcatctcctacaagtgggtgtgcgacggaagcgccgaatgccaagacggatcggatgagtcccaagaaacctgtctgtcggtgacgtgcaaatcaggagacttttcctgtggaggacgggtgaaccggtgtatccctcaattctggcggtgcgacggccaggtggactgtgacaacggatccgacgaacaggggtgcccgccgaaaacctgcagccaggacgagtttcgctgccacgatggcaaatgcatctcgcggcagttcgtttgcgatagcgatcgcgattgtctcgacgggagcgatgaagccagctgcccagtcctgacttgtggcccggcgagcttccagtgcaactcctccacttgcatcccgcaactctgggcgtgtgataacgacccggactgcgaggatggatcggacgagtggcctcagcggtgcaggggactgtacgtgttccagggcgattcatcgccctgctcggccttcgaattccactgcctgtcaggcgagtgcatccactcgtcatggcgctgcgatggcggaccagactgcaaagacaagtcggacgaggagaattgcgcagtggcgacttgccgccctgacgaattccaatgctcggacggaaactgcattcacggaagccggcaatgcgaccgcgaatatgattgcaaggacatgtcggatgaggtcggctgcgttaacgtgaccctttgcgaagggcctaacaagtttaagtgccattcgggagaatgtattaccctggacaaggtgtgcaatatggcccgagactgccgggactggtccgatgaaccgatcaaggaatgtggaaccgctgaatgccttgacaacaacggtgggtgctcacacgtgtgcaatgacctgaagatcggctacgaatgcctctgcccggacggattccaactcgtggcacaacgccgatgcgaagatattgatgaatgtcaagaccctgacacttgctcccagctctgtgtgaatctcgagggaggctataagtgccaatgtgaagaaggattccagctcgatccgcacactaaggcttgcaaggccgtgggttcgatcgcctacctgtttttcacgaataggcatgaagtccggaagatgactctggaccgcagcgaatatacctccctgataccgaacttgcggaatgtggtggctttggataccgaagtggcatctaatcgaatttactggtccgatttgagccagcgcatgatttgctccacccaactggatagggcgcatggagtgtcctcgtacgacactgtgatctcacgcgacattcaggccccagacggacttgctgtggactggatccactcgaacatctactggaccgattccgtgctgggaacggtcagcgtggccgatacgaaaggagtcaagcgtaagaccctcttcagagagaatggatcaaaaccgcgggcgatcgtggtggatccggtacacggatttatgtattggactgattggggcactccggccaaaatcaagaagggaggattgaacggagtggacatctactccctggtgaccgaaaacatccagtggcctaacggaataaccctcgatctgctgagcggcagactgtactgggtcgactcgaagctgcactcgatcagctcgatcgatgtgaatgggggaaaccggaaaactatccttgaggatgagaaaagactggcgcacccgttttcgctggccgtctttgaagataaggtgttctggactgacatcattaatgaggcaatcttctcagcaaaccgcctcaccggcagcgacgtgaacctgctcgccgagaatctcctttcgccggaagatatggtgttgtttcataacctgacccaaccccgcggcgtgaattggtgcgagcgcaccaccttgtcgaatggaggttgtcaatacctgtgcctcccggctcctcaaatcaacccacattctcctaaattcacctgcgcgtgcccggacgggatgctccttgccagagacatgagatcatgcttgacggaggccgaggccgccgtcgcgactcaggagactagcactgtcagactgaaggtgtcgagcactgccgttcggactcagcacacgaccacccgccctgtcccagacacctcccggctgcccggagcgaccccgggcctcaccacggtggagatcgttactatgtcccaccaggcgctcggagacgtggcaggccggggcaacgagaagaagccatccagcgtgcgcgctctctctatcgtgctgccgatcgtgctgctggtgttcctgtgcttgggcgtgttcctgctgtggaagaattggcggctgaagaacatcaattcaattaacttcgacaatcctgtgtaccagaaaaccactgaagatgaagtgcatatttgccacaaccaggatggctactcatacccaagcaggcagatggtgtccctggaagatgatgtggct

SEQ ID NO: 16207 - DNA, 2580 bp, Artificial Sequence
  Description of Artificial Sequence: Synthetic coding sequence
atggggccctggggatggaagctgcgatggactgttgccctgttgctggccgctgccggaacagctgtaggcgatcgctgtgagcggaacgagtttcagtgtcaagacggtaagtgcatcagttataagtgggtatgtgacggatctgccgagtgtcaggacggatccgacgagtcgcaggaaacatgtttatctgtgacgtgcaaatccggagacttttcctgcggcggtcgggttaatcggtgcattccacaattctggcgctgtgacggtcaggtggactgcgataacggaagcgacgaacaaggctgtccccctaaaacctgcagccaggacgaattcaggtgtcacgatggcaagtgcatctcccggcaattcgtgtgcgattcagatcgagactgtctcgacggctcggacgaggcatcttgtccagtgctcacctgcggtccagctagctttcagtgcaattcctcgacttgtatccctcagctctgggcctgcgataacgacccggactgcgaggacggtagtgatgaatggccccagcgttgtcgaggtctatacgtgttccagggcgacagcagcccgtgcagcgccttcgaattccactgcctctccggggagtgcatccactcctcgtggaggtgcgatggggggccagattgcaaagacaagtctgacgaagagaattgcgctgtggctacctgccgcccagacgaatttcagtgtagtgacggaaattgtatccacggcagtcgccagtgtgatcgcgagtacgactgtaaggatatgagcgacgaggtcggctgcgtcaatgtgactctttgtgagggcccaaataagtttaagtgccattcgggagagtgcatcactctcgataaggtctgcaatatggctagagattgccgggactggagcgacgagccgattaaagaatgcggtacagctgagtgccttgataataacggcggttgtagccacgtatgtaacgacctcaagatcggctatgagtgcctgtgccctgacgggtttcagcttgtcgcacaaaggcggtgcgaagacatcgacgagtgccaggacccagatacttgctctcagctgtgcgtgaatctcgagggtggctacaaatgccagtgtgaagaggggtttcagctcgatcctcacactaaagcatgtaaggccgttgggtcgattgcttatttgttttttactaacaggcatgaagtgcgaaagatgactctcgatcgctccgagtatacttccctgatccccaacttgcgcaacgtggtggccctggatacagaggtcgcctctaatcggatctactggtcggatctctctcagagaatgatatgcagcacccaactcgaccgcgctcacggcgtgtcctcctacgatacagtgatatcccgtgatatccaggcgcccgatggtcttgctgttgactggattcattccaatatctactggaccgacagcgttctcggcactgtgagcgtggccgacaccaaaggcgtgaaacgaaagacgttatttcgcgagaacggtagcaagccaagggccatcgtcgttgatcctgtgcatggcttcatgtattggacggattggggcaccccagccaagattaagaaaggagggctgaacggtgtcgatatctacagccttgtcaccgagaacattcagtggcctaatggcatcacacttgatctcctgtcaggcaggctgtactgggtggactctaagcttcattcaattagtagtattgatgtgaacgggggtaacagaaagacgatccttgaggacgagaaaagactggcacacccttttagtttagccgtgttcgaagataaagtcttctggactgatattatcaacgaggcaatctttagcgccaatcgcctcaccggctctgatgtgaacctcctcgccgaaaacctgttaagtcccgaggacatggtgctgttccacaatttgacacagccacgcggagtgaactggtgcgaacgtactaccctcagcaatggggggtgccagtacctatgcttgcccgctccgcaaataaaccctcattcgcctaagttcacctgtgcctgccccgatggcatgctgctggccagggacatgaggagttgtctgaccgaagcggaggctgccgtagccactcaggaaacctccactgtgcggctaaaagtctcttcaacggctgtgagaacccagcacacaaccacaagacccgttcctgacacatcccgcctgccgggtgctaccccgggattaaccactgtggaaatcgtgaccatgtctcaccaggccttgggagacgtggccggtcggggcaacgaaaaaaagccatcttcagtccgcgccctcagtattgttctgcccatcgtgctcttggtgttcctctgcttgggcgtcttcctgctctggaaaaactggagactgaagaatattaactccataaactttgacaatcccgtttaccagaaaacaactgaggacgaggtgcacatttgtcacaaccaagacggctacagctacccctcacgccagatggtgtcactggaggatgatgtagca

SEQ ID NO: 16208 - DNA, 2580 bp, Artificial Sequence
  Description of Artificial Sequence: Synthetic coding sequence
atgggcccgtggggctggaaacttcgatggactgtggcattgctgctcgctgcagcaggtactgctgtgggtgatcgctgcgaacggaacgaatttcagtgtcaagatggcaagtgcatttcatacaaatgggtctgtgacggttcggcagaatgccaagacggatccgacgaatcccaggaaacctgcctctcagtgacctgtaagtcaggcgacttctcctgcggagggcgcgtcaatagatgcattcctcaattttggcggtgtgatggacaggtggactgtgacaacgggtccgatgaacaaggttgtccccctaagacttgttcgcaggacgaatttcgctgtcacgatgggaagtgcatatcaaggcaatttgtctgtgattcggatagagattgtctcgacggctcggacgaggcatcgtgccctgtgctcacttgtggtcctgcatcgttccagtgtaactcctcgacctgtattccacagctttgggcatgtgataacgatccagattgtgaagatggctcagatgaatggccgcagaggtgtcgcggcctctacgtttttcagggtgactcgagcccgtgttcggcgtttgagtttcattgcctgagcggggaatgtatccactcgtcttggaggtgcgatggagggcctgattgcaaagataaatcagacgaagaaaactgtgcagtggctacttgcagaccagatgagttccagtgttcagatggtaactgcattcacggctcgaggcagtgtgatagggagtacgactgtaaggatatgagcgatgaggtcgggtgtgttaacgtgactctctgcgaaggaccaaacaagtttaagtgccactctggtgaatgcatcaccttggataaggtgtgcaacatggccagagattgtcgggattggtccgatgagccaattaaggaatgtggaactgccgagtgtctggacaacaatggaggatgttcgcatgtgtgtaacgacctcaagatcgggtacgagtgcctgtgccccgatggttttcagcttgtggcacaacgcagatgtgaagatatcgatgaatgtcaggaccctgatacctgttcacaactttgtgtcaatctcgagggaggctacaagtgtcaatgcgaggagggtttccagcttgaccctcacactaaggcatgtaaggcagtcggaagcattgcatacttgttctttactaaccgacacgaggttaggaaaatgactctggatcgatcagaatatactagccttatccccaacctcaggaacgtggtggcacttgatactgaagtggcatcgaatagaatttactggtcagatctcagccaacggatgatatgttcgacccagctggatagagcccacggcgtgtcgtcgtacgacaccgtgatcagcagagacatccaagcccccgacggactcgcagtggactggattcatagcaacatatactggactgacagcgtcctggggaccgtgtccgtggcagatactaagggggtcaagcggaaaactctcttccgggaaaacggcagcaagccgagggccattgtggtggatcctgtgcatggattcatgtactggactgattggggtacccccgctaaaatcaagaaaggaggacttaatggtgtggacatttactccctggtgaccgaaaacattcagtggcctaacggaattactctcgatcttctctccggacgtctttactgggtggattcgaagttgcattcgattagctccattgatgtgaatggtggaaaccgtaagaccatactggaggacgaaaagcgccttgcacatcccttctcactggccgtatttgaagataaggtgttttggaccgacattatcaatgaagcgattttctcggcgaaccgactgaccgggagcgatgtcaaccttctcgcagagaacctgctgtcgcccgaggacatggtgctgtttcacaaccttacccagccccggggtgttaactggtgcgagcgcactaccctttcgaatggcggctgccaatacctgtgtctccctgctcctcaaatcaaccctcacagccccaagtttacctgtgcgtgtccagacggtatgctgctcgcgcgtgatatgcgcagctgcctgactgaagccgaagccgcagtcgccactcaagaaacctctaccgtgagactcaaggtgtccagcactgcggtcaggacccaacacaccactactcgaccagtccctgatacgagccggcttcccggagccaccccagggttgacgaccgtcgagatcgtcaccatgagccaccaagccctgggtgatgtggccggcagggggaatgaaaagaagccctccagcgtgagagcactgtcgattgtcctgccaattgtgcttttggtgtttttgtgcctcggtgtgttcctgctttggaagaactggaggttgaagaatatcaacagcatcaattttgataatccagtgtaccaaaagacgaccgaagatgaggtgcatatatgccacaaccaagatggatactcatacccttcaagacagatggtgtcgctcgaagatgacgtggca

SEQ ID NO: 16209 - DNA, 2580 bp, Artificial Sequence
  Description of Artificial Sequence: Synthetic coding sequence
atgggtccttggggatggaagttgagatggacagtagccctccttcttgccgccgccggtaccgctgttggagacaggtgcgaacgcaatgaatttcaatgtcaggacgggaaatgtatttcctataaatgggtgtgtgacggcagcgccgagtgtcaggacggttcagatgaatcacaggagacctgtttgtctgttacctgtaagagcggtgacttctcatgcggtggcagggtgaatcgatgtataccccagttctggaggtgtgatggccaggtggattgcgacaatggcagtgatgaacagggctgtcccccaaaaacctgctcccaggacgaatttaggtgccatgacggcaagtgcatctcccgccagtttgtgtgcgattctgaccgggactgtctggatggctctgatgaggctagctgccccgtgttgacttgtgggcccgcctcattccaatgcaatagcagcacatgcattccacagctgtgggcctgtgacaacgacccagactgtgaggacggttccgacgagtggccccaacgatgccgcggcctctatgtgtttcagggtgacagttcaccatgtagcgcatttgaatttcactgcttgagcggcgaatgtatacactcttcttggagatgtgatggcgggccagactgtaaggataagagcgatgaggaaaactgcgcagtggccacctgtaggccagatgagttccagtgttccgatgggaattgcatccacggctccaggcagtgtgacagagagtatgattgcaaggacatgtcagatgaggtggggtgcgttaatgtgacactctgcgaagggccaaacaaatttaagtgtcacagtggagaatgtatcacactggataaggtgtgcaacatggctcgggattgcagagactggtctgacgagcccattaaggagtgcggcaccgcggaatgcctggacaacaacggcggttgtagccacgtgtgtaatgacctgaaaataggttacgagtgcctgtgccctgatggatttcaactggtcgcccagcgcagatgtgaagacatcgacgagtgccaggatcctgatacctgtagccagctgtgtgtgaatctggagggcggctataagtgccagtgcgaagagggattccagctcgatcctcacacaaaagcttgcaaggcggtcggatccattgcttacctgtttttcactaatagacacgaagtgaggaagatgacattggataggtccgaatatacttctttgatccctaatctgcgcaacgttgttgccctggacaccgaagtggcatctaaccgcatctactggagtgatctgagtcagcggatgatctgcagcactcagctggatcgagctcacggtgtgtccagctatgacactgtcatatctcgagacatacaagccccggacggcttggctgtcgactggattcatagcaacatctattggaccgacagcgtgctggggacagtgtcagttgcagatactaaaggggtgaaacgcaagacacttttccgcgaaaatggaagcaagccgcgcgccattgtggttgatcctgttcatggattcatgtattggactgactggggtactcctgctaagatcaagaaaggaggcctgaatggtgtagacatctacagtctcgtgaccgagaacatccagtggcccaatgggatcacactggaccttttgtctggccggctttattgggtggattcaaagctccacagtatatcctctattgatgtaaacggaggaaatcggaagacaatcctcgaggacgagaaacggctcgcccatcctttcagccttgcagtgttcgaggacaaagtattctggactgacattattaatgaagcgatcttttccgcgaatcgacttactgggtctgacgtgaaccttcttgccgagaatctgttgtcccccgaggacatggtgcttttccacaacctgacccaaccgcggggggtcaactggtgcgaacggacgacactgtcaaacgggggctgccagtacctttgtctcccagcccctcaaataaaccctcactctcccaagtttacttgtgcgtgtcccgacggtatgctcctggcaagggacatgcggtcctgcctgacagaggctgaagccgccgtggctacccaggaaactagcactgtgcgcttgaaagtcagcagcaccgccgttcgcactcagcacactacaactcgccctgtgcctgatacctccaggctcccgggcgcaacaccgggtctgactaccgttgagatagtgactatgtctcaccaggccctgggcgatgtagccgggcgaggcaacgaaaaaaaaccctcctctgtcagggccctgtctatcgttttgccaattgttcttctggtgttcctgtgtctgggagtgttcctgctctggaaaaactggcgactgaaaaatatcaactctatcaacttcgataaccccgtgtatcagaaaaccacggaggatgaggtgcacatctgccataatcaagatggatactcatatcccagcaggcaaatggtgtcccttgaagacgatgttgcc

SEQ ID NO: 16210 - DNA, 2580 bp, Artificial Sequence
  Description of Artificial Sequence: Synthetic coding sequence
atgggtccatggggctggaagctgcgttggaccgttgcactcctcctggcggcggcaggcaccgcggtgggtgaccggtgcgagcggaacgaatttcaatgtcaagatggcaagtgcatttcatacaaatgggtgtgtgatggatcggcagagtgccaggatggatcagacgagtcgcaagaaacttgtctttcagtcacctgcaaaagcggagatttcagctgtgggggcagggtcaatagatgcattccccagttttggagatgtgatggacaagtggactgcgacaatggatcggatgagcaagggtgtcctccaaagacttgctcccaagacgaatttaggtgccatgatggaaagtgtatttccaggcaatttgtgtgtgatagcgatcgcgactgccttgacgggtcggacgaagcatcatgtccagtgcttacttgtggacctgcctcgtttcaatgcaactcctcaacttgcattccgcagttgtgggcgtgcgacaatgatcccgactgcgaggacggaagcgacgaatggccacaaaggtgtcgagggctctacgtgttccagggggactcatcaccttgctccgcattcgaatttcattgtctttccggagagtgcattcactcgagctggaggtgtgacggaggacctgattgtaaggacaagtcggatgaggagaactgtgccgtggccacctgccgacctgatgagtttcaatgctccgatgggaactgtatccatggatcgagacagtgcgaccgcgaatacgattgcaaggatatgagcgacgaagtgggttgtgtcaacgtgactctgtgtgaaggacctaacaagttcaaatgccattcgggagaatgcattactctggataaggtgtgtaatatggcaagagactgtcgtgactggtccgatgagccaattaaggagtgtggtactgcagaatgccttgacaataacggagggtgctcacatgtgtgcaatgacctcaaaatcggttatgaatgcttgtgcccagacggatttcaactggtcgcccagagaagatgcgaggatatcgacgaatgtcaggatcccgacacttgcagccaattgtgtgtcaacctcgagggagggtacaagtgtcaatgtgaggaaggattccaactggatccacataccaaggcttgtaaggccgttgggtcaattgcatacctctttttcactaacagacacgaggtcagaaagatgacccttgatcgctcggagtacacctctcttattcctaatctgcgtaatgtcgtcgcacttgatacggaggtcgcctcgaaccggatctactggtcagatctctcgcaaagaatgatttgttccactcagctggatcgcgcacatggagtgtcgtcttacgataccgtgatttctcgcgacattcaggcaccagacggactcgcagtcgattggattcattccaatatctactggaccgattcagtcctgggaactgtctccgtggcagacactaaaggagtcaagagaaagaccctctttagagaaaatggctccaagcctcgggccattgtcgtggatcccgtgcatggatttatgtactggaccgactggggcaccccggcaaaaatcaaaaaaggtggccttaacggcgtggacatttactccctggttactgaaaacattcaatggccaaacggcattacgctcgaccttttgtcggggcgtctttactgggtggatagcaagctccattccatttcctccattgatgtcaatggcggaaacagaaagactattttggaggatgagaaacgactggcacatccattttcactggctgtgtttgaggacaaggtgttctggactgatatcatcaatgaagcaatattcagcgcaaacaggctgaccggaagcgacgtcaaccttctcgccgaaaaccttctttcacctgaagatatggtgctgtttcataatcttacccaaccgagaggtgtgaactggtgtgaacgcactactctcagcaatggaggttgccagtacctctgccttcctgcaccgcagataaaccctcattcccctaagtttacttgcgcgtgcccagatggaatgcttcttgcccgcgatatgagatcatgtctcaccgaagccgaggcggcagtggccacccaggaaactagcactgtgcggcttaaggtgtccagcaccgcagtgcggacgcaacataccaccactcgccccgtgcccgatacctccagactccccggcgccaccccagggcttaccaccgtggaaatcgtcaccatgtcgcatcaggcacttggcgatgtggcaggtaggggaaatgagaagaaaccttcgtcggtgagagcccttagcatcgtgcttccaattgtcctcctcgtgtttttgtgtttgggggtgtttcttctgtggaaaaactggcggctgaaaaacatcaattccattaacttcgataatcccgtgtaccagaaaaccaccgaagatgaggtgcacatttgtcacaaccaagacggatacagctacccatccagacaaatggtgtcgctggaagatgacgtcgca

SEQ ID NO: 16211 - DNA, 2580 bp, Artificial Sequence
  Description of Artificial Sequence: Synthetic coding sequence
atggggccatggggatggaagctgagatggactgtggccctcctgctggcggcggcaggtacggcggtgggagatcgatgcgagagaaatgaattccagtgccaagacggaaagtgcatatcttacaagtgggtgtgtgatgggtcggcggaatgccaggacgggtcagacgaaagccaggagacttgtctgtctgtcacttgcaagagcggggacttctcgtgtggcggccgcgtgaatcgctgcatccctcagttttggcgctgcgacggacaggtggactgtgataacggaagcgacgaacaaggttgcccgccgaaaacgtgctcgcaagatgagtttcggtgtcatgatggtaagtgcatttcacgccagttcgtctgcgattcagatagagattgcctggacggatcggatgaagcctcctgcccagtgctgacttgtggaccggcatccttccagtgtaatagctcaacctgtatccctcaactgtgggcatgtgataatgatccagattgcgaggacggctccgacgaatggcctcagagatgccgcggactgtacgtgttccagggagatagcagcccctgctccgcattcgaatttcactgccttagcggcgagtgtatccactcgtcctggagatgcgatggaggaccggactgcaaggataaatccgacgaagaaaactgcgcagtagcgacttgtagacccgacgaattccaatgctcagacggaaactgcatccacggctcgagacagtgcgaccgcgagtacgactgcaaagatatgtcagacgaggtgggatgcgtgaatgtgactctctgcgaaggaccgaataagttcaagtgccactcaggagagtgcatcacccttgataaagtctgcaacatggcccgggactgccgggattggtcagacgaaccaatcaaggagtgcgggactgccgagtgcctggataacaatggaggatgctcgcacgtgtgcaacgacttgaagatcggatacgaatgcctctgccccgacggcttccaacttgtggcacagcgccgatgtgaggacattgacgaatgtcaagatcccgatacctgctcgcaactgtgcgtcaacctcgaaggtggctacaaatgccaatgtgaagagggattccagctcgatccgcataccaaggcctgtaaggccgtgggaagcatcgcatacctgtttttcacgaaccgccacgaagtgcggaaaatgactctcgatcgctcggaatacacttccttgatccctaaccttcggaacgtggtggccctcgacacggaggtggcatccaatcggatctactggtcggacctgtcccaaagaatgatttgctccactcagctggaccgcgcccacggagtgagttcgtacgatacggtgatctcaagagatatccaggccccggacggactcgcggtggactggatccattccaacatctattggaccgattcagtcctgggcacggtgtcagtggccgacactaagggagtcaagagaaaaaccctgttccgcgagaacggttcaaagccgcgagcgatcgtggtggatccggtgcatggcttcatgtactggaccgactggggcaccccggcgaagatcaaaaagggaggcctgaatggtgtcgacatatactccctggtgacggagaacatccagtggccaaacggaattaccctggatctcctttcaggccgcctgtactgggtggactcaaagctccactcgatctcgtcgatcgatgtcaacggaggaaaccgcaaaaccatcctcgaggacgaaaagcgtcttgcgcaccccttctccctggccgttttcgaggataaggtgttctggaccgacatcatcaacgaagctatcttttccgcgaatcgcttgaccgggtcggacgtgaacctcttggccgaaaatctgctgagcccggaagatatggtgttgttccacaatctgactcagccgcgcggcgtgaactggtgtgagagaaccactctgtccaacggagggtgtcagtacctgtgcttgccggctccacagattaacccacactctccgaagttcacttgtgcctgtccggatggaatgctcctggcacgcgacatgcgcagctgcctcaccgaagccgaagcggccgtggcgactcaggagacttcgactgtgagactgaaggtgtcctccaccgcagtgaggacccagcacactactacccgcccggtgccggacacctcgaggctgccaggtgccaccccgggactgaccactgtggagatcgtgactatgtcacaccaggcgctgggtgacgtggcaggccggggcaacgaaaagaaaccatccagcgtgcgcgctctgtcaatcgtgctcccgatcgtcctgttggtgttcctctgtttgggagtgttcctcctgtggaagaattggaggctgaaaaacatcaattccatcaacttcgacaaccctgtctaccaaaaaaccactgaagatgaagtccatatatgccataaccaggacggatactcgtaccctagcagacaaatggtgtccctggaggatgacgtcgca

SEQ ID NO: 16212 - DNA, 2580 bp, Artificial Sequence
  Description of Artificial Sequence: Synthetic coding sequence
atgggaccttgggggtggaagctcagatggactgtggcgctgcttttggcagcagcaggaaccgccgtcggtgaccgttgcgagaggaacgagttccagtgccaagatggtaaatgtatcagctacaagtgggtgtgtgatggatccgccgaatgtcaagatggttcggacgaatcccaagagacttgtcttagcgtgacttgtaagtcgggagacttctcgtgtggaggtagggtgaacaggtgcatcccacagttttggcgctgtgatggtcaggtggattgcgacaatggctccgatgaacaagggtgtcccccgaaaacctgttcgcaagatgaatttcgttgtcatgatggaaagtgtatatcgcggcagtttgtgtgtgatagcgaccgcgactgcctggatggctcggacgaagcatcatgcccagtgcttacctgcggaccagcatccttccagtgcaacagctccacctgcattccacaactctgggcctgtgataatgatccagattgtgaagatggttccgatgagtggccacaacgatgccggggcctctacgtgtttcagggtgattcgtcaccctgttcggcatttgaattccattgtcttagcggagaatgtattcactcaagctggcgttgcgatggtggcccagattgcaaggataagtccgatgaggaaaactgtgccgtggcaacttgtagacccgatgaatttcagtgttccgatggaaactgcattcacggtagccgccaatgtgatcgcgaatacgactgcaaagatatgagcgatgaagtcggatgcgtgaatgtcactttgtgcgaaggcccgaacaaattcaagtgtcattcaggcgagtgtataaccctggataaggtgtgcaatatggccagggattgtagggattggtcagatgaacctattaaggaatgtgggaccgcagaatgtcttgacaataacggcgggtgctcccatgtgtgcaatgatcttaagattggctacgaatgtctttgtcccgatggttttcagctcgtcgcacagaggcgctgtgaggacattgacgaatgtcaggaccctgacacttgttcgcaactttgtgtaaacctggaaggtggatataagtgccagtgtgaagaaggttttcaactggatccacatactaaagcgtgcaaggccgtggggtccatcgcataccttttctttactaacaggcacgaagtcagaaaaatgacgctggatcgctccgaatacacgtcgctgattccaaacctgagaaatgtcgtggccctggatactgaagtcgcatccaatcgcatctactggtccgatctgtctcaaagaatgatttgctcgactcagctggacagagcacatggtgtgtcatcctatgataccgtgatttcgcgcgatattcaggcacctgacggccttgcagtcgattggattcattcaaacatttactggacggactccgtcctcggtaccgtgagcgtggcggatacgaagggtgtgaagcgaaaaacccttttcagagagaacggctcaaagcctcgcgccatcgtggtggatccagtccatggcttcatgtactggaccgactgggggaccccagcaaagatcaagaaaggagggctgaacggtgtggacatctactccctcgtcaccgagaatatccagtggccaaatggtatcaccctggatcttctgtccggccggctgtactgggtggattcgaagttgcattccattagctcgatcgacgtgaacggcggaaacagaaagaccattttggaagatgaaaagagacttgcccacccttttagtctggctgtgtttgaagataaggtgttttggactgacattatcaacgaagcgattttctcggcgaatcgtcttaccggatcggatgtgaacctcttggcagagaatctgctgtcgcccgaggatatggtgctgttccataatctgacccagccaagaggcgtcaattggtgtgaaagaacgactctgtcaaacggcggttgtcaatacctttgtctccccgcgcctcaaatcaatcctcattcgccaaagtttacttgcgcatgcccagacggtatgctgctcgctagggatatgaggtcctgccttaccgaagccgaggctgccgtcgccactcaagaaacctcaaccgtgcgtctcaaggtttcctccacggccgtgaggacccaacacactaccactcgcccggtgcctgatacttcgagacttcctggtgcgacccctggacttactaccgtggaaattgtgactatgtcgcaccaagcactgggtgacgtggcggggagaggcaatgaaaagaagccttcctctgtgcgtgcactgtccattgtcctgcctatcgtcctgctggtctttctttgtctgggagtgtttcttctttggaaaaactggcggttgaagaacattaacagcatcaattttgataacccagtgtaccagaaaaccaccgaagatgaggtgcatatctgtcataaccaggatgggtactcgtatccatcccgccagatggtgtcccttgaggatgacgtcgcc

SEQ ID NO: 16213 - DNA, 2580 bp, Artificial Sequence
  Description of Artificial Sequence: Synthetic coding sequence
atgggcccttgggggtggaaacttcgttggaccgtggcattgttgctggctgcagctggaaccgcagtcggtgacagatgtgaacgaaatgagtttcagtgccaggatggaaaatgcatatcttataagtgggtatgcgatggttctgccgagtgccaggatggtagcgacgaatctcaggaaacttgtctgagcgtgacctgtaagagcggcgattttagctgtgggggacgagtcaatcgctgcatcccacagttctggaggtgcgacgggcaggtggattgtgataacggctctgacgaacaggggtgccctccgaagacatgctctcaagacgaatttcgctgccacgatggaaagtgcatcagccgacagttcgtgtgtgatagtgacagggactgcctcgacgggagtgatgaagcttcctgtcctgtgctgacatgcggtcctgcgtcatttcagtgtaattcgtcaacttgcatccctcagctttgggcttgtgataacgacccggactgcgaggacggcagtgacgagtggccacagaggtgccgtggtttatatgttttccagggagatagtagcccgtgctccgcttttgagttccactgcctttccggagaatgcattcactcctcttggcgctgtgatggcggtcccgattgcaaggacaaatctgacgaggagaactgcgctgtagctacctgccggccggatgaatttcagtgttctgatggaaactgtatccacggcagtcgccaatgcgatagagagtacgactgtaaggatatgtctgatgaggtggggtgcgttaacgtaactctgtgcgagggccctaacaagtttaaatgccattctggggagtgtatcacgttagataaggtgtgtaacatggccagagattgtcgtgactggtccgacgagcccatcaaggaatgcggaaccgcagaatgcctagacaataacggaggctgctcgcacgtgtgtaacgaccttaaaatcgggtacgagtgcctatgcccagacggatttcagctcgtagcccagaggcgttgtgaggatattgacgagtgtcaggatcccgatacctgcagccagctgtgtgtcaatcttgaagggggctataagtgtcagtgtgaagaaggattccagttggatccacacacaaaggcttgcaaggctgtgggttcaatcgcttacctgttttttaccaaccgccacgaggtgcgcaagatgacactcgaccggtctgagtacaccagcttaatcccaaatttgaggaatgttgtcgcactagacaccgaggtagccagtaacagaatttactggtcggacctgagtcagaggatgatctgtagcacacagctagacagggctcacggagtgtcttcttatgataccgtgatttctagagacatccaggcccctgatggcctcgccgttgattggatacactccaatatctattggacagactccgtccttggcactgtgtcagtagcagacaccaagggcgtcaagaggaagactctgttcagggagaacggctctaagcctcgggcaattgtggtggaccctgttcatgggttcatgtactggacggattggggaacgcctgccaagattaaaaaaggcggtctcaatggggtggatatttattccctcgtgacagagaatattcaatggcccaacgggatcacactggacctactatctggacgtttgtactgggtggattccaagctccacagtatttcatctatcgacgttaatggcggaaacagaaagacaattctcgaggacgagaaaaggctcgcccatccttttagtctggccgttttcgaggacaaagtcttctggactgatatcatcaatgaagccatcttctccgccaataggctgactgggtccgacgtaaacttactcgcggaaaatctgctaagtcctgaggatatggtgctgttccataatctcactcagcctagaggggtaaattggtgtgagcgaaccacactaagtaacggcggctgccagtacctctgtctgcccgccccacaaatcaaccctcacagtcccaaattcacatgtgcatgtcccgatgggatgctgctcgcacgggacatgcgatcttgcctgacagaagccgaggcagcggtggccacacaggagacgtccaccgtccgactgaaggtctccagtactgccgtacgcacacagcacacaaccacaaggccagttccggatacctctagactgccaggcgccactcctggccttaccaccgtggaaatcgtgactatgtcacatcaggcactcggcgacgtcgcaggtcggggaaatgagaaaaagccatcatctgtccgagctcttagcattgtcctgccgatcgtacttcttgtgttcctatgcctgggcgttttcctcctgtggaagaactggaggctgaagaacataaatagcattaatttcgataacccggtgtatcagaagaccaccgaggatgaggtgcatatctgtcataaccaagatggctacagctacccttcacggcaaatggtgagcttggaggatgacgtcgca

SEQ ID NO: 16214 - DNA, 2580 bp, Artificial Sequence
  Description of Artificial Sequence: Synthetic coding sequence
atggggccctggggatggaagctccgttggacagtcgccttgcttcttgcggccgccggtactgcagttggggaccgatgcgagcgcaacgagtttcaatgccaggatgggaagtgcatcagctacaaatgggtgtgcgatggcagcgctgaatgtcaggatggttctgacgagtcgcaggagacctgtctctcagttacgtgcaagtccggagatttctcttgcggcggccgtgttaaccggtgcattccccaattctggcgctgtgacggtcaggtcgattgtgataacggaagcgacgaacaaggttgtcctccgaagacctgctcccaggacgagtttagatgccatgacggcaagtgcatctcgcgccaattcgtctgcgactcggaccgcgattgtctcgacggctccgatgaggccagttgccctgtgctgacctgcggtcccgcctccttccagtgcaacagctccacttgcatcccccagctctgggcgtgcgacaacgatccagattgcgaagacggtagcgatgagtggcctcagcgttgtcgcggcctctacgtattccaaggtgactcgtcgccctgctcggccttcgaattccattgtctgtctggggagtgcattcattcatcgtggaggtgtgacgggggtcctgattgcaaggacaagtcggacgaagaaaactgtgccgtcgctacctgcagacctgacgaatttcagtgcagcgacggcaactgtatccatggctccagacagtgcgacagggaatatgactgtaaggatatgagcgatgaggtgggctgcgtgaacgtgaccctgtgcgaaggtcccaacaagtttaagtgccactccggtgagtgtataaccctcgataaggtttgtaacatggctcgtgactgccgcgactggtcggacgagcccatcaaagaatgcggtaccgcggagtgtctggataacaacggtggttgctcccacgtctgtaacgaccttaagattggttacgagtgcctctgtccagatggattccagctagtggcccagaggagatgtgaagacattgatgaatgccaggaccccgatacctgcagccaactttgtgtcaacctggagggtggctacaagtgtcagtgcgaggaaggcttccagttagaccctcacaccaaggcctgtaaagcggtgggttccattgcatacctgttcttcaccaacagacacgaagtgcggaaaatgaccttggatcggagtgaatacacgtctctcatcccgaacctgcgcaacgtggtcgccctcgacaccgaggtcgcctctaaccgcatctactggagtgacttgtcgcagaggatgatctgctcaactcagctggatagagcccatggtgtgagctcgtatgacacggttataagccgcgacattcaggctcctgatgggttggccgtcgactggatccactctaatatttactggaccgattccgtactcggaacggttagtgttgctgacaccaagggagtgaagaggaagaccttgttccgtgaaaacggcagcaagccgcgcgctatcgtggtggaccctgtccatggcttcatgtattggacggactggggtacccccgccaagattaaaaaaggggggctcaacggtgttgacatttactcattggtcaccgagaacattcaatggcccaatggtattaccttagacctcttgtccggtcgcctgtactgggtcgactctaagctgcatagcatctccagcatcgacgtcaacggaggtaaccgcaagactatcttggaagatgagaagcgcttggcgcatccgttttccctggctgtgttcgaggacaaggtcttttggactgatatcatcaacgaggctatctttagcgccaaccggctgacgggctctgatgttaacctcctcgccgagaatctgctctcccccgaggacatggtcctgttccataacctgactcaacccaggggtgtcaactggtgcgagaggaccacgttgtccaacggaggctgccagtacctttgcctgcctgcccctcaaattaacccgcacagccccaagtttacctgtgcctgtccagacggcatgctcctggctcgggatatgcgctcgtgtctgaccgaggctgaagctgccgtggccacccaggagacctcgaccgtgcgtctgaaggtgtcgtcgacggccgtgcggacccagcataccaccacgaggccggttccagacacctccagattgccgggtgctacccctggtttgacgaccgtcgagatcgtaaccatgtcgcaccaggccctcggtgatgtagctggcagaggtaacgagaagaaaccttcgtctgttagagccctttcgattgtcctccctattgtgttgctcgtttttctgtgccttggagtattcctcttgtggaaaaactggcgtctcaagaacatcaacagtatcaattttgacaaccctgtctaccaaaaaactaccgaagacgaggtccacatctgccacaaccaggacggatatagctacccctcccgtcagatggtctcccttgaggacgacgtcgct

SEQ ID NO: 16215 - DNA, 2580 bp, Artificial Sequence
  Description of Artificial Sequence: Synthetic coding sequence
atgggtccctggggctggaagctccggtggactgtggccctgctcttggcagccgcgggaaccgctgtgggggatagatgtgaaagaaatgagtttcaatgtcaggatggcaagtgtatcagctacaaatgggtatgtgacgggtccgcagagtgtcaagatggcagcgatgagtcccaggaaacctgtctttccgtgacttgcaaatccggagacttttcgtgtgggggacgtgtgaatcgctgtattccacaattttggagatgcgatggccaggtggactgtgataatggttcggacgagcaaggttgccctcccaagacctgctcgcaagacgaatttagatgccacgatggaaagtgtatatcaaggcaattcgtctgcgattcggaccgcgactgcctcgatggttcagacgaagcctcgtgtccagtcttgacttgcggccccgcgtcctttcagtgtaactcgtcgacgtgcattcctcagttgtgggcctgtgataacgaccccgactgtgaggacggctcagacgagtggccccaacgttgcagagggctttacgtgttccagggtgattcgtctccatgttcggcatttgagttccactgcttgtccggtgagtgtatacattcaagttggcgctgtgatggaggtccggattgtaaagataagtccgatgaggaaaattgcgcagtagctacctgtagacctgacgaatttcagtgcagcgatgggaattgcattcacggatcgagacaatgcgatagagagtacgattgtaaagacatgtcggacgaagtcgggtgtgtgaacgtcaccctgtgtgagggtccgaataagttcaaatgtcattccggcgaatgcatcactctggataaagtgtgcaacatggcaagagattgtcgggattggtcagacgagcctattaaggaatgtggcacggcggaatgcctggacaacaacggaggttgttcccatgtgtgcaacgacctcaagatcggatacgaatgcctgtgccctgacggtttccaactcgtggcacaaaggcgttgtgaagatattgacgagtgccaggatcctgatacgtgtagccagctttgtgtgaatctcgaaggcggatacaagtgccaatgcgaagaggggtttcaacttgatccccacactaaagcatgtaaagcggttgggtcgatcgcatacctcttctttactaacaggcatgaggtgagaaagatgaccctggatcgcagcgaatacacttcgcttatccctaatctgagaaacgtggttgcgctggataccgaagtcgcgtccaacaggatatactggtccgatctgtcacaaagaatgatttgttccacccagctcgacagagcacatggagtttcctcctacgatactgtcatctcgcgtgacatccaggcacctgatggactggcagtggattggatccacagcaacatttactggaccgattcagtgcttggaacggtgtcagtggccgacaccaagggagtgaagagaaagaccctttttcgtgaaaacggctcgaagcctcgggcgattgtggtcgatcctgttcatggattcatgtactggaccgactgggggacgccagcaaagatcaagaaaggcggcctcaacggtgtggatatctactccctggtgacggaaaacattcaatggccgaacggtatcactcttgacctcttgagcggtcggctttactgggttgactccaagctgcattccatatcttccatcgatgtcaatgggggaaacagaaagaccattctcgaggacgaaaagcgactggcccatccattttcccttgcagtgttcgaagataaagtgttttggactgacattatcaacgaggcaatattctccgccaacaggctgaccgggagcgacgtcaatctgctggcagaaaacctgctctcacctgaagatatggtgctgtttcacaacctcactcagccccggggtgtcaactggtgtgaacggaccaccctgtccaatggtggatgccagtacctgtgccttccggcacctcagattaatcctcattcccctaagtttacctgtgcctgtccggatggtatgctgctggccagggatatgcggtcctgccttactgaagccgaggccgcagtggcgacccaagagacttcaactgtccgccttaaggtgtcatccacggcagtgcgtactcaacataccactacccgcccagtccctgacactagtagattgccaggtgcaacgcccggtctgactactgtggagatcgtgaccatgtcacatcaagccctgggtgatgtggcagggcgcggaaatgaaaagaaaccctcaagcgtcagagctttgtccattgtgctgcctattgtgctcctcgtgtttctttgtctcggtgtctttctgctgtggaagaactggcgcctgaagaacattaactccataaactttgacaaccccgtgtaccaaaagactaccgaggatgaagtgcacatctgtcataatcaggacggatattcctatccttcgagacaaatggtttcccttgaagatgacgtcgca

SEQ ID NO: 16216 - DNA, 2580 bp, Artificial Sequence
  Description of Artificial Sequence: Synthetic coding sequence
atgggaccatggggatggaagctgagatggaccgtggctttgctgctggccgcagcgggaactgctgtgggggatcggtgcgagaggaatgaattccaatgtcaggacggaaagtgcatctcgtataagtgggtctgcgacggttccgcggagtgccaagacggatccgacgagtcacaagaaacttgcctttccgtgacctgcaagtctggtgacttcagctgcgggggacgcgtgaacagatgcataccccagttctggcgctgcgatggccaggtggactgtgacaacgggtcggatgagcagggctgcccccctaagacgtgctcgcaagacgagttcagatgtcacgatggaaaatgcatctcaagacaatttgtgtgtgactcggaccgggactgtctggatggttcagatgaggcatcctgtcctgtccttacctgcggtcctgccagcttccagtgcaattcttccacttgcattccccaattgtgggcctgcgataacgatcctgactgcgaagatggcagcgacgagtggccgcaacgctgcagaggattgtatgtattccagggcgacagcagcccgtgctcggctttcgagttccattgcctgtccggggaatgcatccattcctcatggcggtgcgatgggggtccggactgtaaggacaagagcgacgaagaaaattgtgctgtggcaacctgtcggccggatgagtttcagtgctccgacggaaactgtatccacggatcgcgccagtgcgaccgcgaatacgactgtaaagacatgagcgatgaagtgggatgcgtcaacgtcactctctgtgaagggccgaacaagttcaagtgccactccggagaatgcatcacgctggataaagtatgcaatatggctcgagactgcagggattggtcagacgaacccatcaaagagtgcggaaccgcagagtgcctggacaataacggagggtgctcgcatgtgtgcaatgaccttaagatcggttatgagtgcttgtgcccagacggctttcagctggtcgcacagcgccgatgcgaggacattgacgaatgtcaggacccggatacttgctcgcagctctgtgtgaacctcgaggggggttacaaatgtcagtgcgaggaaggttttcagttggacccgcacactaaggcttgcaaggccgttggaagcattgcttacctgttcttcaccaatcggcatgaggtcagaaagatgacgctggaccgctctgagtacacgtcactgatcccaaacctgaggaatgtggtggcgttggacactgaagttgccagcaatcggatctactggtccgatctgtcgcaaagaatgatttgctccacgcaactcgatcgagcacacggagtgtcatcctacgacaccgtgatctcacgcgacatccaggctccagacgggctcgcagtggactggatccattccaacatatactggactgacagcgtcctgggaaccgtctcggtggcggacaccaaaggcgttaagcgcaagaccctgttccgcgagaacggttcgaagcctcgcgccatcgtcgttgatccagtgcacggattcatgtactggacggattggggcacgcccgcgaaaatcaaaaagggcggactgaacggcgtggacatctacagcctggtgaccgagaatattcagtggccgaacggtatcactttggacctcttgtccggcagactgtactgggtcgattcaaaactccactccatctcgtccatcgacgtgaatggaggcaatagaaagaccatcctggaggacgagaagagactggcccaccccttctcactcgcggttttcgaagataaggtcttttggaccgacatcataaatgaagccattttcagcgccaaccgcttgaccggatccgacgttaacctgcttgccgaaaacctgctgagcccggaagatatggtgctgttccacaacctgacccaaccgcgcggggtgaactggtgtgagagaacgactctgtcgaacggcggttgtcagtatttgtgtctgccggcccctcagatcaatcctcactcaccgaagttcacctgtgcatgccccgacggcatgctgcttgcccgcgacatgcggagctgcctgactgaggcagaggcagctgtggcgacccaagaaacttcaacggtgcgcctgaaagtctcaagtaccgcggtccggactcaacacaccactactcggccagtgcctgatacttcgagactcccaggagccaccccgggactcactaccgtggagatcgtgaccatgtcgcatcaggccctcggagatgttgcgggaaggggcaacgagaagaagccgtcgtcggtgcgcgcactgtccattgtcctgcctatcgtgctgttggtctttctctgtcttggagtgttccttctgtggaagaactggcgcctgaagaacatcaattcgatcaactttgataacccggtctaccagaaaaccaccgaagatgaggtccacatctgtcataaccaggatggttactcatacccgagccgacagatggtgtctttggaagatgatgtggca

SEQ ID NO: 16217 - DNA, 2580 bp, Artificial Sequence
  Description of Artificial Sequence: Synthetic coding sequence
atgggcccatggggttggaagctacggtggacagtagcactgctgctggccgctgccgggactgcagtcggcgatcggtgcgagcgcaacgagttccaatgccaggacgggaagtgcatcagctataaatgggtgtgcgacggcagtgccgaatgtcaggacgggtccgatgaatctcaagagacgtgcctaagcgttacctgcaagtccggtgacttttcctgcggcggcagggtgaataggtgtatccctcagttctggcgttgtgacggacaggtggattgtgataacggaagcgatgagcagggctgtccgcccaagacttgctctcaggacgaatttcgttgccacgatggcaagtgcatctctcggcagttcgtgtgcgattcagatagagattgcttagatggcagtgacgaggcctcctgcccagtgctgacatgtggacctgcatctttccagtgtaattcttctacgtgtatccctcaactttgggcttgtgacaacgacccagattgcgaggacggctccgacgagtggccacagagatgccgaggactttacgtattccaaggagattcctccccatgtagcgcttttgagtttcattgcctgagcggagaatgcatccatagcagttggcgctgtgacggggggcctgattgcaaggataaatctgacgaagagaactgtgcggtcgccacgtgccggcccgatgagttccagtgttccgacgggaactgtattcacggctctaggcaatgcgacagggagtatgattgtaaagacatgtcggacgaagtgggctgtgtgaacgtgacgttgtgtgagggtccaaataagttcaaatgtcatagtggcgagtgtattaccttggataaagtttgcaacatggcccgtgattgcagggactggagtgacgaacccattaaggaatgcggaaccgccgagtgcttagacaataacggcggctgtagtcacgtttgtaacgatcttaagatcggatatgagtgcctttgccccgacgggtttcagctggttgcacagcgccggtgtgaagatatagatgaatgtcaggatcccgatacctgcagccagctttgtgtgaacttagaagggggttacaagtgtcagtgtgaggaaggtttccaactcgacccccatacaaaagcgtgcaaggctgtggggagtattgcttacttgttcttcacaaataggcatgaagttcgtaagatgaccctagataggtccgagtacacaagcttaatacctaatcttagaaacgttgttgctctggacaccgaggtggcatcaaatcgtatctattggagcgacctcagtcagcggatgatctgctctacccagttagatagagctcacggtgtgtccagctatgatactgtaatttctcgggatattcaagctccggacggcttggccgtggattggattcatagcaatatctactggactgacagtgtactgggcaccgtgtcggtagcagacaccaaaggggtgaagcggaagacactttttagggaaaacggttcaaagcccagagctattgtggtggaccctgtgcacggtttcatgtattggacagactggggaactcccgctaagatcaaaaaggggggcctcaatggggtggatatctacagcttggtgacagaaaacattcagtggcctaacgggattacgctggatctgctgagcgggagactatattgggtcgattcaaagctccattcaatctccagtatagacgtcaacggcgggaatcgcaagaccattctagaagacgaaaagcgattagctcaccctttcagcctggccgtttttgaagataaggtgttttggactgatattatcaacgaggcaattttttcagctaatcgcctgactggctccgacgtgaatctccttgccgaaaacctgctaagtcctgaggacatggtcctttttcacaaccttacccaaccaagaggcgtcaactggtgcgagagaactaccctgtcaaacggggggtgtcagtacctctgcctacctgcacctcagataaaccctcattcccctaaatttacctgcgcctgtcctgacgggatgctcctggcccgtgatatgcggagctgccttactgaggctgaagcagcggtggccacacaggagacaagtacagtccgcttaaaagtgagctccacagctgtacggacccagcacactaccacccgccccgtgccggacaccagtcgactgccaggtgccacaccagggctgacaactgtagagattgttactatgagccaccaggcccttggcgatgttgccgggcgtggaaatgagaaaaagccctcttccgttcgtgcgcttagcattgtcctgcctatcgtattgctggtatttttgtgtttgggggtcttcctcctctggaagaactggaggcttaaaaatatcaatagtataaacttcgacaatccagtgtaccagaaaactactgaggacgaggtccatatctgtcacaaccaggacgggtacagttatccctctcgacaaatggtcagtctggaggatgacgtggcc

SEQ ID NO: 16218 - DNA, 2580 bp, Artificial Sequence
  Description of Artificial Sequence: Synthetic coding sequence
atgggtccttggggctggaagcttcgctggaccgtcgcactgctgttggccgctgctggcactgccgtcggggatcgttgcgagagaaatgagttccaatgccaggacggtaagtgtatctcctataagtgggtttgtgatgggagcgcagagtgccaagacggtagcgatgagtctcaggaaacctgtctgagcgtcacctgcaagagcggagactttagctgcggcggtagggttaaccgctgcattccgcaattttggcggtgcgatggacaagtcgactgcgataacggctccgacgaacaaggctgccctccgaagacctgctctcaggacgaattcaggtgccatgatggaaaatgcatcagccggcagttcgtgtgtgattcggaccgcgattgccttgatggtagcgatgaagcctcttgccctgtcctgacctgcggaccagcgtcgtttcagtgtaatagctcgacttgtattccgcaactgtgggcctgcgacaacgacccagactgtgaggatggatccgacgaatggcctcagaggtgcaggggtctgtatgtgttccagggggactccagcccttgttctgcctttgaatttcactgcctgagcggggagtgtatccatagcagctggcgctgcgacggaggtccagattgcaaagataaaagcgacgaagagaactgtgcggtggcaacctgccgtcctgatgagtttcagtgtagcgacggtaattgtatccacggtagccgtcaatgcgaccgggaatacgactgtaaggatatgagcgacgaagtcggctgtgtgaatgtgactttatgcgagggccccaacaagtttaagtgccactccggagaatgcattactcttgataaagtgtgtaatatggcccgagactgtcgcgactggagcgacgaaccgattaaggagtgtgggaccaacgcatgcctcgacaacaacgggggttgtagccacgtatgcaacgatttaaaaattggctatgagtgtctgtgccctgatgggtttcaactggttgcgcagcgccgctgtgaggatatcgacgaatgccaggatcctgacacgtgttctcaactctgtgtgaacctcgagggaggttataaatgccagtgtgaggagggcttccaactggaccctcatacgaaggcgtgtaaagccgttggtagcattgcttacttgttcttcaccaaccgccatgaggtcaggaaaatgacactggatcgttctgaatacacctcgctgatccctaatttacgtaatgtagtggccctggacacagaagtcgcgtcaaacaggatctactggtcagatctgtctcagcgtatgatttgcagtacccagttggatagagcccatggcgtaagcagctatgataccgttatctcccgcgatatccaggcacctgatgggctggcggtcgactggatccattctaatatttattggacagactctgtgctgggaacggtcagtgtggccgatactaagggcgtgaagcgtaaaacgttgttccgtgagaatggctccaaacctcgtgcaattgtcgtcgaccctgttcacggttttatgtactggaccgactggggtaccccagctaagattaaaaagggtggcctgaatggcgtggacatctatagcctagttaccgagaacatccaatggcctaacggcattaccttggatctgctgtctggtcgcctgtattgggtcgattctaaattgcatagcataagcagtatcgatgttaatggcggcaatcggaagaccatcctggaggacgagaagcgtttggcccatccattttcattggcagtgtttgaagacaaagtgttctggaccgatatcattaacgaagctatcttcagcgccaataggttaaccggcagcgacgtgaacctgttggcagagaacctgctgagcccagaggacatggtgctgttccacaatctgacacaaccgcgcggcgtcaactggtgtgaacgcactacactgagcaatggcggctgccagtacctgtgcttgccggccccgcagataaacccacacagccctaagtttacatgtgcatgtccggatggaatgctcctggcgagggatatgcgctcatgtctgaccgaagcagaagcggcggtggcgacccaggaaacgtcaaccgttcgcctgaaggtttcttcaaccgcggtgcggactcagcatacgacgaccaggccggtaccggatacaagccgtctgccgggggcaacaccaggtttgaccaccgtggaaatcgtgacgatgagccaccaggctctgggcgacgtcgcgggaaggggtaatgagaaaaagcctagctccgtccgcgccttaagtattgtcttaccaatcgtgttacttgtgtttctttgcctgggcgtgtttctgctgtggaaaaattggaggctgaaaaacataaacagcatcaattttgataatccggtatatcagaaaactacggaagacgaggtgcacatttgtcacaaccaggacggatactcttacccaagtcgccagatggtgagtctggaagacgacgtggca

SEQ ID NO: 16219 - DNA, 2580 bp, Artificial Sequence
  Description of Artificial Sequence: Synthetic coding sequence
atgggcccatggggctggaaactgaggtggacagtggccctgcttttggccgcggccggtactgccgttggggaccgctgcgagcggaacgagttccaatgtcaggatggcaagtgtatttcctataagtgggtgtgcgacggttcagcagaatgccaggatggatccgatgaaagtcaggaaacgtgtctatctgtgacttgtaagagcggagacttctcatgtggaggacgtgtgaaccgatgcattcctcaattttggcggtgcgacggacaggtggattgcgataatggaagtgacgaacagggctgcccacccaaaacctgcagtcaggacgaattccggtgccatgacggaaaatgtatatccaggcagtttgtatgtgactcggatcgcgattgtctcgatggctcagacgaggcatcatgtccagtcttaacttgcgggccagcttcctttcagtgtaattcctccacgtgcatcccacagctctgggcgtgcgataacgatcctgactgcgaagatggctccgacgaatggccgcagcgctgccgcggcttgtacgtgtttcagggggatagctccccatgcagtgcgttcgaattccactgcctgtccggagaatgtattcactcatcctggcgctgcgatggcggccccgactgcaaagataagtcagatgaggaaaattgcgcggttgcgacctgcaggcccgacgagtttcaatgttctgacggaaattgcatccacggttcccgccaatgtgatcgtgagtacgactgcaaggatatgtccgacgaagtgggttgtgtgaacgtcaccctttgtgagggccctaataagttcaaatgtcattctggcgagtgcattactctggacaaagtgtgcaacatggcccgggactgcagagactggtctgacgagccaattaaagagtgcggtacgaacgcctgcctggacaataatggggggtgctcccacgtgtgcaacgacttaaagatcgggtatgagtgcctgtgtccggacgggtttcagcttgttgcacagcgcagatgcgaggatattgatgaatgtcaggaccccgacacctgctcacaattgtgtgtgaatcttgagggcgggtacaagtgtcaatgtgaagaaggctttcagttggatcctcacactaaagcatgtaaggcggttggcagcattgcctatctcttttttactaatcggcatgaggttcgaaagatgacgctcgacagatctgagtacacgagcctgattcctaacctgcgaaacgtggtggctctggatacagaggtcgcctctaacaggatctactggtccgacctctcccagcggatgatatgctcaactcagctcgacagggcccacggggtgtccagttacgacacggtcatctcgcgggacattcaggcacctgatgggctggccgtcgactggatccatagtaatatttactggacagatagcgtactgggcacagtgtccgtggcagacacaaaaggggtcaaaaggaaaaccctgttccgcgaaaatgggagcaagcctcgcgcaatcgtcgttgatcctgtacatggattcatgtattggaccgattggggaactccggcaaagatcaagaaaggagggttaaacggcgtcgatatttattcactggtcactgaaaatatccaatggcccaatggaatcaccttggacctactgtctggccggctttactgggtcgattccaagttgcattccatcagcagtatagacgtcaacggtggcaaccggaagacaatactggaagacgagaaaaggctggctcatcctttcagcttggctgtgtttgaggacaaagttttctggacagacatcataaatgaggcaatattctcagcaaaccgccttactggatccgatgtgaatctgctggccgagaacttactgtcccctgaagatatggtcctttttcacaacctgactcagcccaggggcgtcaactggtgtgagcgcaccactttgagtaacggaggttgccaatatctgtgtcttcctgcacctcagattaatccccattctccaaaatttacctgtgcatgcccagacgggatgctacttgcgcgcgacatgagaagttgcctgactgaggccgaggccgccgtagccacccaggagacgagcaccgtgcggctcaaagtgtcgtctacagctgtccggactcagcataccactacaagacctgtgcccgatacatcgcgcctgcctggcgcaacccccggcctgaccactgttgaaatcgtgaccatgagccatcaggctttgggagacgtggccgggcggggcaacgaaaagaagccctccagcgtgcgcgccttatccatcgtcttgccgatcgtcctgcttgtgtttctgtgcctgggtgtgtttttgttgtggaagaactggcggcttaagaatataaactcgataaacttcgacaaccctgtgtaccagaagactaccgaggacgaagtgcatatttgccacaatcaggacgggtactcctatccgtcccggcagatggtatccctggaggacgatgtggct

SEQ ID NO: 16220 - DNA, 2580 bp, Artificial Sequence
  Description of Artificial Sequence: Synthetic coding sequence
atgggcccctggggatggaaactgcgctggactgtggcattgctcctcgccgcggccggtaccgcggtcggagatagatgtgagaggaacgaatttcagtgtcaagatggaaagtgcatctcctacaagtgggtctgcgatgggtccgctgaatgtcaagacggaagcgatgaatcccaagaaacctgtcttagcgtgacttgtaagtcgggagacttctcctgtggcggaagagtgaaccggtgtatcccccagttttggagatgtgatggccaagtcgattgcgataacggatcggatgaacaaggatgccctccaaagacgtgttcacaagacgagttccgctgtcatgatggcaaatgtatttcgaggcaattcgtctgtgacagcgacagagactgtttggatggttcggatgaagcatcgtgtccagttctcacctgtggtccagcctcgtttcaatgcaactcatcgacctgtatccctcaattgtgggcatgcgataacgaccccgattgtgaagatggttccgacgaatggcctcagagatgtagaggactttacgtgttccagggtgattcctcgccatgctcagcatttgagttccattgcttgtcgggtgaatgtattcattcgtcttggcgatgtgatggaggaccagattgcaaagataagagcgatgaagaaaactgcgcagtcgccacctgccgacctgatgagtttcagtgttcagatggcaactgtattcatggatcgcgtcagtgtgatagagaatacgattgtaaggatatgagcgacgaggtgggctgtgtgaacgtgaccctgtgtgaaggacctaacaaattcaagtgccactccggtgaatgcatcacccttgataaggtgtgcaacatggctcgcgattgccgagattggtccgatgaacctatcaaagaatgtggaactaacgcgtgtctggacaataacggtggatgttcgcacgtgtgtaatgatcttaagattggatatgaatgcttgtgtcctgacgggtttcaacttgtggcgcagcgccgttgtgaagatattgatgagtgccaggatccggatacttgttcgcaactttgtgtgaacctggaaggtggttacaagtgccaatgcgaagagggctttcagttggatcctcatactaaagcatgcaaggccgtcggatccattgcttatctgtttttcaccaacagacatgaagtgagaaagatgactctggatcgcagcgaatatactagccttatccccaatcttcgaaacgtggtggccctcgataccgaagtggcatccaaccgcatttactggtccgatctgagccaacggatgatttgcagcacccaacttgaccgggcacatggagtgagctcctacgataccgtcatctcgcgtgacatacaggcccctgacgggcttgcggtggactggattcattccaacatatactggaccgactccgtccttggaaccgtttcagtggctgacactaagggggtgaagaggaaaaccctctttcgggagaatggctcgaagccacgcgcgattgtggtggatccagttcacggatttatgtactggactgactggggaactccggcaaagattaagaaaggcggtctgaatggtgtcgacatatactcgctggtgaccgagaatatacaatggcctaatggcattaccttggacctgctctcagggcggctgtactgggtcgactccaagctccatagcattagctcgatagacgtcaacggcggtaaccggaaaaccattcttgaagatgagaagcggctggcacacccattctccctggcagtgtttgaggataaagtcttttggacggacataatcaatgaagcgatctttagcgccaatcggctgacgggatcggacgtgaaccttctggctgagaatctgctttcgcctgaagatatggtgctgtttcataatctgactcaacctagaggtgtcaactggtgcgagagaactaccctttccaacggcggttgtcaatacctttgccttcctgcaccacagattaatccccatagccctaaattcacttgtgcttgtcctgatggtatgctgcttgcacgggacatgagatcgtgtcttaccgaggccgaggcagcagtggccactcaagaaaccagtaccgtcagactgaaagtgtcatcaaccgcagtgaggacccaacataccaccacgcgcccggtgcctgatactagcagattgcctggggcaacgcctggacttactaccgtcgaaatcgttactatgagccatcaagcgcttggagatgtggccgggagaggcaacgagaaaaagccatcatctgtccgcgcattgtccatcgtgctgcctatcgtgcttctcgtctttctgtgtcttggtgtctttctgctctggaagaactggcggctcaagaacattaactctatcaatttcgacaaccccgtgtaccaaaagaccaccgaagatgaggtccatatctgtcataatcaagacggatactcgtacccttcccggcaaatggtgtctctcgaagatgatgtggcg

SEQ ID NO: 16221 - DNA, 2580 bp, Artificial Sequence; identical to SEQ ID NO: 16219
  Description of Artificial Sequence: Synthetic coding sequence

SEQ ID NO: 16222 - DNA, 2580 bp, Artificial Sequence
  Description of Artificial Sequence: Synthetic coding sequence
atgggaccctggggttggaagctgcggtggactgtggcactgctcttggccgcagcagggactgccgtgggagatcggtgtgaacggaatgagtttcagtgtcaagacggaaagtgcatctcctacaagtgggtgtgcgatggtagcgcagaatgtcaggatggttcggacgaatcacaggaaacgtgtctctccgtgacctgtaagtccggcgacttttcctgtggaggaagggtgaacagatgtatacctcagttttggcgatgtgacgggcaagtggattgcgataatggatcagacgaacaaggatgcccccctaaaacttgttcgcaggatgaatttaggtgtcatgatggaaaatgtatttcgcggcaattcgtgtgcgattcggatagggattgtctcgacggttccgatgaagcatcctgccctgtgcttacctgtggcccagcatccttccaatgcaatagctccacctgtattccacagctttgggcatgtgacaatgatccagactgcgaggacggctccgatgagtggccacaaagatgtcgggggctgtacgtgttccaaggagattcgtcgccctgtagcgcattcgaatttcattgcctgtcgggcgagtgtatccattcatcgtggcgctgtgatgggggaccagactgtaaagataaaagcgatgaggagaattgtgccgtggcaacttgccgacctgatgagttccaatgttcagatggaaactgtattcatggttcaagacagtgtgatcgtgaatacgattgtaaggatatgtctgatgaagtgggatgtgtgaacgtcactttgtgtgagggtccgaataagtttaagtgccattcaggagaatgcataaccctcgataaagtctgtaatatggcgcgtgattgcagagattggtccgacgaaccgatcaaggagtgtggcaccaacgcctgtctcgacaacaacggaggctgttcccatgtctgcaatgatcttaagattggatacgaatgtctgtgcccggacggatttcaactcgttgcccaacgcagatgcgaagatattgatgaatgtcaagatcctgacacttgctcgcagctgtgtgtcaacctggaaggcggttacaagtgccagtgtgaagagggatttcaacttgatccccataccaaggcatgtaaggcagtcggctcgattgcatacctcttctttaccaaccgccacgaggtcagaaagatgactctcgataggtcagaatacacgtccctgatccctaacctgagaaacgtcgtggctctcgatactgaggtggcgtcgaaccgcatatactggagcgatctgtctcaaagaatgatctgttctactcaacttgatcgcgcacatggagtgtcgtcgtacgataccgtgatttcgagggacattcaagcacctgacggacttgcagtggactggattcattctaacatatactggaccgactccgtgcttggtaccgtgtcagtcgctgacaccaagggtgtaaaaaggaaaaccctcttcagggagaatggttcgaagccaagagcaatagtcgtggatcctgtgcatggttttatgtactggactgattggggaacccctgcaaagattaagaagggaggtctgaacggagtggacatctattccctcgtcacggaaaacattcagtggcctaatgggatcacgcttgacctgctttcgggacgcctttactgggtggattcgaaactgcattcgatctcctcaatcgacgtgaacggcggaaacaggaaaactatattggaagatgaaaaacgactggcccaccctttttccctcgccgtgtttgaggataaggttttttggactgacatcattaacgaagcgatcttttccgcaaacagattgactggatcggacgtgaaccttctcgccgaaaatctgctgtccccagaagatatggtcctctttcacaaccttacccagccacgcggggtcaattggtgcgaacggaccactctctcgaatggggggtgccaatacctgtgtctgcctgcgccacagatcaaccctcatagccctaagttcacctgtgcatgtccagatggaatgctgctcgcccgtgatatgcggtcatgccttaccgaagcagaagcagcagtcgcaacccaggaaacctcgactgtccgccttaaggtcagctccactgctgtgaggacccagcatactaccactagacccgtgccagatacttcacgccttcctggagcaaccccaggtcttaccaccgtcgagatcgtgaccatgtcacatcaagcactcggagacgtggccgggagggggaatgagaagaagccttcaagcgtgagagccctgagcattgtccttccaatagtccttcttgtgtttctgtgtctgggtgtgttccttctgtggaagaattggcgtctgaagaacatcaattcaatcaattttgacaaccctgtgtaccaaaagacgactgaagatgaggtgcacatttgtcataatcaggatgggtactcctacccttccagacagatggtgtccctcgaggacgacgtggcg

SEQ ID NO: 16223 - DNA, 2580 bp, Artificial Sequence
  Description of Artificial Sequence: Synthetic coding sequence
atgggcccatgggggtggaagctgaggtggacggtagcattgctccttgcagccgccggcactgccgtgggcgatagatgcgagcgaaacgaattccagtgccaggatgggaaatgtatttcgtacaaatgggtctgtgacggatcagccgagtgccaagacgggtctgatgaatcacaagagacgtgcctgtcagtaacatgcaagagcggtgatttctcctgcggcggcagggtgaaccgctgtataccccagttctggaggtgtgacggacaagtggattgcgacaatggctctgacgaacaagggtgtcctcctaagacctgctcccaggacgaatttcgctgccatgatgggaagtgcattagccggcagttcgtttgtgattcggacagagattgtctggatggttcagacgaggcatcctgcccggtgctgacttgtggtccagctagtttccagtgcaattcctccacatgtatcccccaactctgggcgtgtgacaatgacccagattgtgaggacggaagcgacgaatggcctcaacgatgccggggcctgtacgtgttccaaggcgactcatccccgtgttcggcctttgagtttcattgtctatcaggcgagtgcatccacagttcgtggaggtgtgacggcggcccagactgtaaggataagagcgacgaagaaaactgcgccgtcgctacttgcaggccggatgaatttcagtgctctgatggaaactgcattcacgggtcgagacagtgcgacagagagtacgattgtaaggacatgtccgatgaagtgggctgcgtaaatgtcacattgtgcgagggaccaaataagttcaaatgccacagtggagaatgtattaccctggacaaggtttgtaatatggctagggattgtcgggactggtccgacgaacctattaaggagtgcgggacaaacgcttgcctcgacaataacggcggatgtagtcacgtctgcaacgacctcaaaattgggtacgagtgtttgtgcccagacgggtttcagctcgtggcccagaggcggtgtgaagatatcgacgaatgccaggatcctgacacctgtagccagctatgtgttaacctggaaggaggttacaagtgtcagtgtgaagagggctttcaactggaccctcacactaaggcctgcaaagccgtggggtctatagcctatctgttctttaccaatcggcacgaggttaggaagatgaccctcgataggtccgagtacacttctctgatcccaaaccttaggaacgtggtggcactggacactgaagtcgcaagcaataggatctactggagtgatcttagtcagcggatgatttgtagtacccagctggaccgggcgcatggcgtctccagctacgatactgtgattagtagggacatccaggctcccgacggactcgccgtggactggatccactcgaatatctactggacagatagcgtgcttggcactgtgagcgtcgccgatactaagggagtgaaacggaagaccttatttcgcgaaaacgggtctaaaccgcgtgctatagtggtcgatccagttcatggatttatgtattggacagactggggcaccccagccaagattaaaaagggcggtctgaatggcgttgacatctattctcttgtcaccgagaacatacaatggcctaatgggattacgttggatctgttgagtggaaggctttattgggttgattccaagttgcactctattagctcaatcgacgtaaacggagggaatcggaagaccatactcgaggacgagaaacgacttgcccatccttttagccttgcagtgttcgaggataaggtgttttggactgacatcataaacgaggccatcttctctgccaacaggttgactgggtccgatgttaacctgctggctgaaaacctgttgtctcccgaggatatggtcctgttccacaacctcacccagccgcgcggggtgaactggtgcgaacgtaccactctgtcaaatggcggatgtcaatatctgtgtctaccagcgccccagattaatccccactctcccaaattcacttgtgcgtgtcctgatggcatgctgctcgcgcgggatatgcgctcttgtctgacagaggccgaagccgcagttgctactcaagaaacatcgaccgtgagactgaaagtgagctccacagcagtgagaacgcagcacactaccacaagacccgtgcccgacacctcacgactcccgggggccacacccggcctcactacagttgagatagtcactatgagtcaccaagctctgggagacgtggcgggacgggggaatgagaaaaagccatccagtgttcgtgcactgtctatagtgctgccaatagtcctgctcgtgttcctgtgtctgggtgtcttcctcctttggaagaattggcgactcaaaaatattaactcaatcaattttgacaatcccgtctatcagaaaacaaccgaggacgaggttcatatctgtcataatcaggatggctactcctacccctccaggcagatggtttccctcgaagacgacgtcgcc

SEQ ID NO: 16224 - DNA, 2580 bp, Artificial Sequence
  Description of Artificial Sequence: Synthetic coding sequence
atgggaccatggggttggaagttgcgttggacggtggccctcctccttgcagcggcggggacggcggtgggtgaccgctgcgagagaaatgaattccagtgccaagatggtaagtgtatctcgtacaagtgggtctgtgatggatccgcagaatgccaggacggctcagacgaatcgcaagagacttgtctgagcgtcacttgcaaatctggagacttttcatgtgggggaagggtgaatcggtgcattccacagttttggcggtgtgacggtcaagtcgattgtgacaatggatccgatgaacaagggtgtccaccaaagacttgttcccaagatgaattcagatgccatgacggaaagtgtatttccagacagttcgtttgtgactctgaccgggattgtcttgatggcagcgacgaagcaagctgtcctgtgcttacgtgtggtcctgccagctttcagtgtaactcgtcgacctgtattccccagctctgggcttgtgataatgatcccgattgtgaagatggctcggatgagtggccacagcgctgtaggggcctttacgtgtttcagggtgactcgagcccatgttcagcattcgagttccattgcctttccggcgagtgtatacattcctcctggaggtgtgatggtggccctgactgtaaagataaatccgacgaggaaaactgcgcggtggccacttgcaggcctgacgaatttcaatgttcagacggcaattgtatccatggatcgcgtcaatgcgatagagaatatgattgtaaggatatgtccgatgaagttggatgtgtgaacgtgactttgtgcgaaggacctaacaagtttaagtgtcatagcggggagtgcataactttggacaaggtgtgcaatatggcaagagactgccgtgattggtccgatgagcccattaaagaatgcggtaccaatgcgtgtctcgacaacaacggtggatgttcgcatgtgtgcaatgacctgaaaattggatacgaatgcctgtgccccgacggatttcagcttgtggcgcagcggcgctgcgaggatatcgatgagtgtcaagatcctgatacgtgtagccagttgtgtgtgaacctcgagggtggatacaagtgtcagtgtgaggaaggattccaacttgacccgcatactaaggcttgtaaagcagtgggaagcattgcttacctctttttcacgaaccggcacgaagtccgcaagatgactctcgacagatcggaatacacgagccttattccgaatctccggaacgtggtggccctggataccgaagtcgcgtcgaacagaatctactggagcgatctgagccagcggatgatatgttcgacgcaactggacagagcacacggagtctcatcctacgacactgtgatcagccgagatattcaagcacccgatggattggcagtggactggattcactcgaatatctactggaccgacagcgtgcttggaactgtgtcggtggcagataccaagggcgtgaagcgaaagaccctttttagagaaaatggctccaaacctcgtgcgattgtcgtggaccccgtccatggtttcatgtactggactgactggggtactcctgcaaagatcaagaaggggggactgaacggtgtggatatctactcccttgtgactgaaaacattcagtggcccaatggtattaccttggacctgctcagcggccgcctgtactgggtggactccaagctccattcgatctcttcgatagacgtgaacggaggtaatcgtaaaactattctcgaggacgaaaagcgtctcgcacatccattttcactggcagtgttcgaagataaggtgttttggactgacattatcaacgaagcgatcttttctgcgaacaggctgactggaagcgatgtcaatttgcttgctgagaacctcctctcgccagaggatatggtattgtttcataacctcacccagcctaggggggtgaactggtgtgaaaggactaccctgtccaacgggggatgtcaatacctctgcctgccagcacctcagattaacccccatagcccaaaattcacttgcgcatgccctgatggaatgcttcttgcaagagatatgcggtcatgtcttaccgaagcagaggcagctgtggcgacccaagaaacctccactgtgcgcctgaaagtgtcatccaccgcagtgagaacgcagcacactacgacccggccagtgccagatacttcgcgcctgccaggagcgactccagggctgaccactgtggagatcgtgactatgtcacatcaggcactgggggacgtcgcgggtagggggaacgaaaagaagccttcgtccgtgagagcactctcgatcgttcttccaatagtgcttctggtgtttctgtgcctcggcgtctttctgctttggaagaactggcgactcaaaaacattaactccattaactttgataacccagtgtaccaaaaaaccaccgaggacgaggtccatatttgtcacaatcaggatggttacagttacccttccagacaaatggtgtcactggaggatgatgtggca

SEQ ID NO: 16225 - DNA, 2580 bp, Artificial Sequence
  Description of Artificial Sequence: Synthetic coding sequence
atgggcccctgggggtggaagcttcgttggacggtagctctgctgctggcagcagcaggcacagctgtcggggatcgctgcgagcggaatgagttccaatgtcaggatggcaagtgcatctcctacaagtgggtgtgcgacgggtccgcggagtgtcaggacggttctgatgagtctcaggaaacatgtctgagtgtgacatgtaagtcaggggacttttcttgcggtggcagagtaaatagatgcatacctcagttctggcgctgcgacggacaggtggattgtgacaacgggagtgatgaacaaggatgtccgccgaaaacatgttcccaggacgaatttcgatgtcacgatggcaagtgcatctctaggcagttcgtgtgcgattccgatcgcgattgcctggacggctccgacgaggcaagttgccctgtgcttacatgcggtccagcctcctttcagtgcaactccagtacttgcattccgcagctctgggcctgtgataatgatccagattgtgaggatggctccgacgagtggcctcagaggtgtagaggcctgtatgtcttccagggggattcttcaccatgttccgcttttgagtttcactgcctgtcaggcgagtgcatacattcatcttggcgatgcgacggcggcccggattgtaaggacaagtctgacgaggaaaattgcgctgttgccacctgtcgacccgatgagttccagtgttcagacggaaactgtatccacggctccagacagtgtgatcgggaatatgattgtaaagacatgagcgatgaagtcggatgcgtcaatgtcactctatgcgagggtcctaacaagtttaaatgccatagcggagaatgcatcaccctcgacaaggtctgcaatatggccagagattgccgggattggtccgatgagccgataaaggagtgtgggaccaacgcgtgcctggacaacaacggcggctgcagtcacgtctgcaacgacttgaaaatcgggtatgaatgtttgtgcccagacggctttcaactcgtcgcacagaggagatgtgaggacatagatgagtgccaggacccagacacctgcagccaactgtgcgtgaacctcgagggtggctataagtgccagtgcgaggaaggttttcagcttgacccccatacaaaagcctgcaaggcagtcggctcaatcgcctatcttttttttactaaccgtcatgaggtccgtaagatgaccctggatcggtcagagtatacctcactgataccaaacttacgcaatgttgtggcacttgacacggaggttgctagtaatcgcatatactggtcagatctgtctcaacgcatgatctgtagtactcagctggaccgtgctcatggagtgtccagctatgacacggtaatcagccgggatatccaggcccccgacgggcttgccgtggactggatccactctaatatctattggaccgactccgttctcggaacagtcagcgtggctgacacgaagggagtgaagaggaaaacactgtttcgggaaaatggctcaaagccacgggctatcgtggtggatcccgtgcatggcttcatgtactggactgactggggaacacctgctaagataaagaagggcgggctgaacggagtcgatatatatagcctagtcactgagaatattcagtggccgaacggaatcactctcgatctgcttagcggtagattgtattgggtggactccaaattgcactctatcagctccatcgacgttaacgggggcaacagaaagaccattttagaggacgaaaagcgactcgctcaccctttcagcctggcagtattcgaggacaaggtgttttggactgatattatcaacgaagcaattttctccgccaacaggttgacaggcagtgacgttaacctcctagccgagaaccttctctcccctgaagatatggtgctgtttcataacctgacccaacccaggggcgtaaactggtgtgaacgcactacgctgagcaatggcgggtgtcaatacctatgcctgccagccccccagataaaccctcattcaccaaaatttacatgcgcctgtcctgatggcatgctcctcgctagagacatgagatcgtgccttaccgaagccgaagcggcagtggctacgcaggagactagcacagttaggttgaaagtctctagcacagctgtcagaacacagcatacaactacccggcccgtccctgatacgtccagattgccaggggccacgccaggcttgaccaccgttgaaattgtgactatgagccaccaggcgctcggagatgtcgccggaagaggcaacgaaaagaaaccttcgtctgttcgagcactcagcatcgttctgcccatcgtgctgctggtgtttctatgcctgggcgtgttcttgttatggaagaattggagactgaagaacatcaactctatcaacttcgacaaccccgtgtatcagaaaacgaccgaagatgaagtccatatctgccataaccaggacggttactcgtacccttccaggcagatggtgagcctggaagatgacgtggca

SEQ ID NO: 16226 - DNA, 2580 bp, Artificial Sequence
  Description of Artificial Sequence: Synthetic coding sequence
atgggaccatggggctggaaactcagatggaccgtggcgcttctgcttgccgcggcaggaactgccgtcggcgaccgctgcgaacgcaacgagttccagtgtcaagacggtaagtgtatctcgtataagtgggtgtgcgatggtagcgctgaatgccaagatggatccgacgaatcccaggagacttgcctgtcggttacttgcaagtctggagatttcagctgcggaggccgcgtgaatcggtgtattccccagttctggagatgcgatggacaggtagactgcgacaacggctccgatgagcaggggtgcccacctaagacctgctcacaagacgagttcagatgccacgacggcaagtgtatctcccgacagtttgtgtgcgactcagaccgggattgcctggacggctcggacgaggcttcctgccccgtgcttacctgtggacctgcgagcttccaatgtaattcctcgacttgtataccccagctgtgggcttgcgacaatgacccggactgcgaagatggatcagacgaatggccgcagaggtgccggggactgtacgtgttccagggtgattcttcaccgtgctccgcttttgaatttcactgcctgtcaggggagtgtattcactcctcatggcgctgcgacggaggacctgactgcaaagataagtccgacgaagagaactgtgccgtggccacctgccggcccgatgaatttcaatgttccgacggaaattgcatccacggaagtcggcagtgcgaccgcgagtacgactgcaaggatatgagtgacgaggtgggctgcgtgaacgtgactctgtgcgaaggtccaaataagttcaaatgccacagcggcgaatgcattactctggataaggtgtgtaatatggcacgggactgccgcgactggtcggatgagccgattaaagaatgcggaactaatgcttgcctggacaacaatgggggctgcagccatgtctgcaacgatctgaaaatcggctatgaatgtttgtgtcctgatggatttcagctggtggctcagcggcgctgtgaagatatcgacgaatgtcaggatcccgatacctgtagccagctctgcgtgaacctcgaaggcggatacaaatgccagtgcgaagaggggtttcagctcgatccgcatactaaggcctgcaaggctgtgggatccatcgcctacctgttctttaccaaccggcatgaagtgcgcaaaatgactctcgacagatccgaatacaccagcctgatcccgaatctgaggaatgtcgtcgcattggacaccgaagtggcgtccaacagaatctactggtcggatttgtcccaaaggatgatctgtagcactcagttggatcgcgctcacggcgtgtcgtcatacgacaccgtgatctcgcgggacattcaagcccccgacggactggcggtggattggatccattcgaacatctactggaccgattcggtccttggaactgtgtcagtggcagataccaaaggcgtgaagagaaagacgctgttccgcgagaatggctcgaaaccaagggcgatcgtggtcgacccagtgcacggattcatgtactggaccgactgggggactcccgcaaagattaagaagggcggactcaatggcgttgatatctactcactggtcactgagaacattcagtggcctaacggtattactttggatctgctcagcgggcgtctctactgggtggactccaagctgcactcaatctcgagcatcgacgtgaacggaggcaaccggaaaactatactggaggacgaaaagcggttggcccatccattctctctcgccgtattcgaggataaggtgttctggactgatatcatcaacgaagccatcttttccgcgaaccgccttaccggaagcgacgtcaacctgctcgctgagaacctcctgtcgccagaggacatggtcctgttccacaatctcacccaacctcgcggggtcaactggtgtgaacgcaccacgctgtccaacggtggctgtcagtacctgtgcctcccggcacctcaaatcaacccgcactctccgaagtttacctgcgcctgtccggacggaatgttgttggcaagagatatgcgctcctgcctgactgaagcggaagccgccgtcgccactcaggagactagcacggtccgcttgaaagtgtcctcgactgcggtcagaactcaacacaccaccacgaggccggtgcctgatacgtcccgcttgcccggggcaactccgggattgaccactgtggaaattgtgactatgtcacatcaagcactcggcgacgtcgcaggacgggggaacgaaaagaagccatcctccgtgcgagccctgtccatcgtgctcccaatcgtcctgcttgtgttcctttgcttgggagtgtttttgctttggaaaaactggcgcctgaagaacatcaattccatcaattttgacaatcctgtctaccaaaaaactacggaggacgaagtccatatctgtcataaccaggacggatactcgtaccctagtcgccagatggttagcctggaggatgatgtggct

SEQ ID NO: 16227 - DNA, 2580 bp, Artificial Sequence
  Description of Artificial Sequence: Synthetic coding sequence
atgggaccctggggctggaaactacggtggacagtagccctgctcctagccgcagcaggaacagcagttggagatcgctgcgaaaggaacgaatttcagtgccaagatgggaagtgcatctcctacaagtgggtatgtgacgggtcagctgagtgtcaggatggaagtgacgaaagccaggagacatgtctgtcagtgacttgcaagtccggagatttctcatgtggcggccgagtcaacagatgtatcccacagttttggcggtgtgatggccaggttgactgcgataacggaagtgatgaacaaggatgtccaccaaaaacgtgttctcaggatgagtttcggtgtcacgacggcaaatgcatttcccgacaattcgtgtgcgactccgatcgagactgcttagacgggagtgatgaagccagttgtcctgtgcttacctgcgggcccgccagtttccagtgtaatagcagcacatgtattccccagttgtgggcgtgcgacaacgatcccgattgcgaagacggatccgacgagtggccccagcggtgccgcggcctatacgtctttcagggggattcatccccttgctcagcctttgagttccattgcctgagcggcgaatgtatccactcttcgtggcggtgtgatggtggacctgattgtaaggacaaaagtgatgaggagaattgtgcggttgccacctgcaggcctgatgaattccaatgctcagatggaaactgtattcacggatcgcggcaatgtgatagagagtatgattgcaaagatatgtctgacgaggtcgggtgtgtgaatgtcaccctgtgcgagggtcccaataagttcaagtgtcacagcggtgagtgcataaccctggataaagtgtgcaatatggcccgagattgcagagactggtccgatgaaccgatcaaggaatgcgggacaaatgcttgcctggacaataatggagggtgcagccatgtgtgcaatgatctgaagatcggctacgagtgcttatgtccagacggctttcagctggtcgctcaaagaaggtgtgaagatatcgacgaatgtcaggatcccgacacttgtagtcagctgtgcgtgaacctcgagggcggatataagtgccagtgtgaggaggggtttcaactcgatccccacactaaggcctgcaaagcagtcgggtccattgcctatctgttcttcacaaaccgacacgaggtcagaaagatgaccctggacaggtccgagtacacttctttaattcctaacctgcgtaacgtggtggccctggatacagaggttgcttctaatcggatttactggagtgacttatcacagaggatgatttgtagcactcaactggatcgagctcatggtgtttcttcttatgataccgtgatatcccgggacatccaggcccccgacgggcttgccgtggattggatccattctaatatttattggaccgactctgtgctcgggacagtgtccgtggctgacacaaagggtgtcaagagaaagaccttgttccgagaaaacggtagcaagccacgggccattgtcgtggatcccgttcacggcttcatgtactggaccgactgggggactcctgcaaagataaaaaagggcggcctgaacggagttgacatctacagtctggtcacagagaacatacaatggccaaacggaatcaccctggatttactgagcgggcggctgtattgggtcgactccaagcttcatagtatcagctccatagacgtgaacggtgggaaccgcaagaccatacttgaggacgaaaagcggttggcgcaccctttttccctggctgtattcgaggacaaagtcttctggaccgatattataaacgaggccattttcagcgccaatcggctgaccggaagcgacgtgaaccttttagccgagaacctgttgagcccagaggatatggttctcttccacaacctgacccagccaagaggggtgaactggtgcgaaagaactaccctgtcaaacggcgggtgtcagtacctgtgcctccctgctcctcagatcaacccgcattcgccgaagttcacttgtgcctgccccgatggcatgctgctcgcacgggacatgcggtcctgcttaactgaggccgaggccgcagtcgctacacaggagacctcaaccgtgcggttaaaagtcagttctactgcagtgcggacccagcatacaacgacacgcccagtgccagacaccagcagacttcccggagctactcctggactgaccaccgtagaaatagtgacaatgtcacaccaggcccttggggacgtggcgggccggggaaatgagaaaaagccttccagtgtccgggcactcagtatcgtcctgcctatcgtcctcctcgtctttttatgcctcggcgtgttcctgttgtggaagaactggcggctgaagaatatcaatagtataaatttcgataatcccgtgtaccagaaaaccacggaggatgaggttcatatctgtcacaaccaggatggatacagctaccctagtagacaaatggtctctctggaagacgatgtggcc

SEQ ID NO: 16228 - DNA, 2580 bp, Artificial Sequence
  Description of Artificial Sequence: Synthetic coding sequence
atgggaccgtggggatggaaactgcgatggaccgtcgcactgttgctggcagcggcaggtacggcggtgggcgaccggtgcgaaaggaacgagttccagtgtcaagatgggaagtgcattagttacaaatgggtctgcgacgggtccgcagaatgtcaggatggctccgatgagtcccaggaaacctgtctgtcggtcacctgcaaatccggagacttctcgtgcggtggacgcgtgaacagatgtatccctcagttctggagatgcgatgggcaagtggattgtgataacggaagcgacgaacaaggatgccctcccaagacttgtagccaagatgagttccgatgccatgacggcaagtgcatctcacggcagttcgtctgcgattcggatagagattgcctggacggatccgacgaagcctcctgcccggttctgacctgcggcccggcgtcgtttcagtgcaactccagcacctgcatcccgcagttgtgggcgtgtgacaatgatccggactgcgaggacggatctgacgaatggccgcagagatgtcggggactctacgtgtttcagggcgattcctccccctgcagcgctttcgagttccactgcctgtcaggggagtgcatccactcgagctggcgctgcgacggaggcccggactgtaaggacaagtctgatgaggaaaattgcgctgtggcaacctgccggccggacgaattccagtgcagcgacggaaattgcatacatggatcccgccaatgcgatcgggaatacgactgcaaggatatgagcgacgaagtcggatgcgtgaacgttactctttgcgagggacctaataagtttaaatgtcattcgggggaatgcatcaccctcgataaggtctgcaatatggcacgcgactgccgcgactggtcagacgaacccatcaaagagtgcggcaccaacgcttgcctcgacaataacggaggatgctcccacgtctgcaacgaccttaaaatcggttacgagtgtctgtgcccggacggattccagctggtcgcccaacgcaggtgcgaggacatcgacgagtgtcaggacccagacacctgctcacaactgtgtgtgaacctggagggcggttacaagtgtcaatgtgaggaagggttccaactcgatccacacactaaggcttgcaaggccgtgggatcgattgcatacttgtttttcactaatcggcacgaagtgcggaaaatgaccttggaccgcagtgaatacacctccctgattccgaatctccggaacgtcgtggctctggacactgaagtcgcctcgaacaggatctactggagcgatctgagccagcgcatgatctgctcgactcagctggatcgggcgcacggtgtgtccagctatgacaccgtcatcagccgggacatccaggcccccgatggactggccgtggattggattcattcgaatatttattggaccgatagcgtgctcggcaccgtatcagtggctgataccaagggagtgaagcgtaagacccttttccgcgaaaacggttccaagccacgggcgatcgtcgtcgacccagtgcatggctttatgtactggacggactggggaactcctgccaaaatcaagaagggaggcctgaacggcgtggatatctacagcctcgtgactgaaaacatccagtggccaaacggaatcactcttgacctcctctcaggcagactgtactgggtggattctaagttgcattcgatttcgtcaatcgacgtgaatggaggaaatcgcaagaccatcctggaggacgaaaaacggctcgcccatccgttctcgttggccgtgttcgaggacaaggtgttttggactgatatcatcaacgaagccatcttctcggcgaatagattgaccggatcggacgtcaacctgctggccgagaacctgctctcaccggaggacatggtcctgttccataatctgactcagccgaggggggtgaactggtgcgaacgcactacgctgtcgaacgggggttgccaatacctttgccttcctgccccacagatcaaccctcactcgccaaagttcacctgtgcttgtcccgatgggatgctgctcgccagagatatgagatcgtgtctcaccgaagccgaggcagccgtggctacgcaggaaacttccactgtgcgtctcaaggtatcaagcactgcagttagaactcagcacaccactactcgcccggtgccggacactagccgcctccctggtgcgactccaggcctgacgaccgtggagatcgtcacgatgtcccaccaggcgctgggagacgtcgccggccgcggaaatgaaaagaaaccaagctcggtgagggcgctgtcaatcgtgctgccgattgtgcttttggtgtttctctgcctgggagtgttcctgctctggaaaaactggcggctgaagaacatcaactccatcaacttcgataaccctgtttaccaaaagaccaccgaagatgaagtgcacatctgccacaatcaagacggctactcatacccatcacgccaaatggtgtccctcgaggacgacgtggcc

SEQ ID NO: 16229 - DNA, 2580 bp, Artificial Sequence
  Description of Artificial Sequence: Synthetic coding sequence
atggggccatggggatggaagctgcgatggaccgtggctctgttgctagccgccgcggggactgctgtgggagacagatgcgaacggaacgagtttcagtgccaggatggcaagtgcatctcctacaagtgggtgtgcgatggttcagctgagtgccaggatgggagcgacgaatcccaggaaacctgcctctccgtcacttgcaagtccggggatttctcctgtggtggcagagttaacagatgcatacctcaattttggcggtgtgacggacaagtggattgtgacaatggctctgatgagcagggttgcccccccaagacttgtagccaagatgaatttcgatgccacgacggcaaatgcatttcgcggcagttcgtttgtgattcggacagagactgcctggacgggtctgatgaagcgagctgtcctgtcctaacctgcggccccgcatcctttcagtgcaatagctccacctgcataccacaattgtgggcatgtgataatgatcccgactgtgaagacggatccgatgaatggccacagcgttgtagggggctgtatgtctttcagggtgacagtagcccgtgttcggcctttgagttccactgtctgtctggcgaatgtatccactcatcctggcggtgcgacggaggaccagattgtaaggacaaatccgacgaggagaattgtgctgtggccacctgccgcccggacgaattccaatgctcagacggcaactgcatccatggatcccgtcaatgtgatagggagtacgattgcaaagatatgagcgacgaagtgggatgcgtgaatgtaaccctttgcgaaggccccaacaaattcaagtgccatagcggagaatgcatcactctcgataaggtgtgcaacatggcccgggattgtagagactggagcgacgagccaatcaaggaatgtggaacaaatgcctgtctggataataacggaggatgctcacatgtctgcaatgatctgaaaattggctacgaatgcctctgcccagacggctttcaactggtggcgcagagaagatgcgaggatattgacgagtgccaagatcctgacacctgctcacagttgtgcgtcaaccttgagggcgggtataagtgtcaatgtgaagaggggtttcagctggatccccacactaaagcctgcaaagcggttgggtccatcgcatacctcttctttactaatcgacacgaagtccgcaaaatgacactcgaccggagtgaatatacaagcctgattcctaatctacgaaatgtggttgcactcgatacggaggttgcatctaaccgcatatattggtccgatttgtcccaaaggatgatctgcagcacgcaactggatcgggctcatggtgtgtcatcctacgacacagtcatctccagggacatccaagccccggatggccttgccgtggactggatacatagcaacatttattggactgattccgtactagggacggtgtctgttgcagacaccaagggggtaaagcgaaaaaccctattccgagagaatgggtctaagcctagggcgatcgtggtcgaccctgtacacgggttcatgtactggactgactggggtaccccagccaagatcaagaaggggggactcaacggcgtcgacatctatagcctagttaccgaaaacatacagtggcctaatgggataactcttgacctgttgtctggtagactgtactgggtggacagtaagctccattctataagctccatagatgtgaatggcggcaaccggaagactatcctcgaggacgaaaagcggttggcccatccctttagtctcgctgttttcgaggacaaggttttctggactgacatcattaacgaagcgattttttcagccaatcgcctgacggggtccgatgtgaaccttttggctgaaaacctcctttctcctgaagatatggtactctttcacaatctgacgcagcctagaggcgtcaattggtgtgaacgtaccaccttaagcaacgggggatgccagtatctgtgcttacctgcaccgcaaatcaacccacactcacccaagttcacctgcgcttgtccagacggaatgctgttggctcgagacatgcgtagttgcctgacggaggccgaagcggccgtggcaacccaggaaactagcactgtccgcctcaaggtcagcagcaccgcagtgagaacacagcatacgaccactcgaccagtgcccgatacgtcgcggttacctggggccacaccgggtctgaccacggtggagattgtgacaatgtcccaccaagccctcggtgatgtggctggtcgcggtaatgagaagaaaccatctagcgttagggccttgagcattgtactccctattgtactcctggtgttcctgtgtctcggggtttttctactttggaagaactggcggttgaagaatattaattccattaactttgacaatcccgtgtatcagaaaaccactgaagatgaagtccacatttgtcataaccaggacggttattcctacccatcccggcagatggtgtcgctggaggacgacgtcgct

SEQ ID NO: 16230 - DNA, 2580 bp, Artificial Sequence
  Description of Artificial Sequence: Synthetic coding sequence
atgggtccctggggttggaagctcaggtggaccgtggcactgctccttgccgccgcgggtactgccgtgggtgatcgctgtgaaagaaacgaatttcagtgccaggacggaaagtgtatctcatataagtgggtctgcgacggaagcgctgaatgtcaagatggttcagacgaatcacaggagacctgcctcagcgtgacttgcaaaagtggtgacttcagttgtggaggtagggtaaaccgctgtattccacagttttggagatgcgatggacaggtggattgcgacaatggatctgatgagcaaggttgcccccccaaaacgtgctcccaggatgaattccgctgccacgacggtaagtgtatcagtaggcagttcgtgtgtgactccgaccgcgactgtctcgacggctctgacgaggcctcttgtccggttctgacatgtggccctgcttctttccagtgtaattcatctacctgcattccccaactctgggcctgtgacaacgatccagactgtgaggatggcagcgatgagtggcctcagagatgcagaggactctacgtattccaaggagactcctccccgtgcagtgcatttgaatttcactgcctgtccggcgaatgtattcattcttcttggaggtgcgacggtggcccagattgcaaagacaaatccgacgaggaaaattgtgccgtcgcaacgtgccgccctgatgaatttcagtgctcagatggcaactgcatccacggaagtaggcagtgcgacagggaatacgactgcaaggacatgagcgatgaggtcggctgcgttaatgtaacattgtgtgaaggtcctaacaagtttaaatgccacagtggcgaatgtatcaccctggacaaagtttgtaacatggcgcgcgactgcagagattggtccgacgagcctataaaagagtgcggcaccaatgcctgcctggataataacggaggttgtagccatgtgtgtaatgacctgaagatcggatacgagtgcctgtgtcccgacggttttcagctcgtcgcccagcgccgctgtgaagacatcgatgaatgccaagaccctgatacgtgctcacaactctgtgtgaacttggagggtggttacaaatgccaatgtgaggaaggcttccagttggacccccacactaaagcctgtaaggccgtgggctcaatcgcttacttgttctttactaatagacatgaggtgaggaagatgacactcgaccgcagcgagtacacgtccttgatacccaatctgaggaatgtcgtcgctctcgacactgaagtggcatcaaaccgcatatactggtccgatctgagccaaagaatgatttgcagtacgcaactggaccgcgctcacggagtgtcaagctacgatacagtcattagccgcgatattcaagcacctgacggcctggccgtggactggattcattctaacatttattggaccgacagcgtgctcggcacggtcagtgtggccgatacaaagggtgtgaagagaaagacgcttttcagagagaacggctcaaagccacgcgctatcgttgtggaccccgtgcatggcttcatgtactggaccgactggggcacacccgccaagatcaaaaagggaggactcaatggcgtggacatttactctctggtgactgagaacatccaatggcctaatggcataaccctggatctcctttccggaagactgtattgggttgattctaaactgcactcaatcagcagcatcgacgtcaacggtggtaacaggaagactattctcgaggacgaaaaaagactcgcgcaccccttcagcctcgctgtcttcgaagataaggtattttggaccgatatcatcaacgaggctatcttttccgccaaccgcttgacaggttcagatgtgaacctgctggcagagaacctgctgtcccctgaggacatggtcctgttccacaacctgacccaacctagaggtgtgaattggtgcgaaaggaccacccttagcaatggaggctgtcagtacctgtgcctgcctgcccctcagatcaacccccattcacctaagtttacgtgcgcctgcccagacggtatgctgttggcaagggatatgagatcatgcctgactgaggctgaagcagccgtggccacgcaggagacctccaccgtacgcctgaaggtttctagcaccgcagtgaggacacagcataccactactaggcctgtcccagacaccagtagattgcctggagccacgcccggccttactactgtggagattgtgacaatgtcccatcaagccctgggagacgtggccggcagaggtaatgaaaagaagccttcttccgtgagggccctgagtattgtattgccgatcgttctgttggtgtttctgtgccttggcgtgttcctcttgtggaagaactggagactgaagaacatcaacagtattaacttcgataacccggtctaccagaaaaccaccgaggacgaagtgcacatttgccataaccaggatggatacagctacccctctagacaaatggtctcacttgaagacgatgtagcc

SEQ ID NO: 16231 - DNA, 2580 bp, Artificial Sequence
  Description of Artificial Sequence: Synthetic coding sequence
atgggtccttggggatggaaactgcggtggactgtggcactgctgctcgctgcggctgggacggcagtgggggatagatgtgagcgcaatgaatttcagtgccaggacggaaagtgtatctcatacaaatgggtctgtgatggctctgcggaatgccaagacggaagcgacgagtctcaggagacatgtctttctgtcacctgtaagagcggcgacttcagctgtggcggtagagtcaaccgctgtattccacagttttggcgatgtgatggccaggtagattgcgacaacggttctgacgaacaaggttgtccaccaaagacatgttcccaggacgaattcaggtgtcacgacggaaaatgtatttcacggcagttcgtatgtgatagtgatagggattgcctggacggcagtgacgaggctagctgtcctgtgctgacttgtggccccgccagctttcaatgtaattcatccacctgcatcccacagttgtgggcatgcgacaatgatcctgactgtgaggatggatccgatgagtggccacagagatgtcggggactgtacgtgtttcagggcgactccagcccttgttctgcattcgagtttcactgtctgtcaggagagtgcatacatagttcatggaggtgtgatggaggtccagactgcaaagataaatccgacgaggagaattgcgcagtagccacttgccgccccgacgaattccagtgtagtgacgggaactgtattcatggctcaagacagtgtgaccgcgagtatgattgcaaggatatgagtgatgaggtcggctgcgttaatgtcacactctgcgagggacccaacaaatttaagtgtcattccggcgagtgtatcacgctcgataaagtgtgtaatatggcccgagactgccgggattggagtgacgagcctattaaggagtgcggaactaatgcttgtctggacaataatggtggctgtagtcacgtatgtaatgatctgaaaatcggttatgagtgtctgtgccccgacggttttcagctggtggcacagcggaggtgcgaggacatcgacgagtgccaagatcctgatacatgcagccaattgtgcgtcaatctggaaggtggctacaagtgccaatgtgaagaggggttccagcttgacccccataccaaggcctgcaaagccgtgggctctatcgcctatctcttctttacaaatcggcacgaggtgcggaagatgactttggatcggtctgagtacactagcctgattcccaatctccgaaatgtggtagcacttgatactgaagtggcgagtaatcgcatctattggtctgacctgtcccaacgcatgatttgtagcacgcagttggatcgcgcgcacggcgtctcatcctatgataccgtgataagccgagatatccaagctcctgatggtctggcagtagactggatccatagcaacatttattggaccgactcagtcttggggaccgtgtcagtggctgataccaagggagtgaagaggaagactctgttccgagagaacggctcaaaaccaagagccatcgtcgtcgatcctgtgcacgggtttatgtactggacagattgggggaccccagcaaagattaagaagggggggctgaacggggtcgacatctatagcctcgtaacagaaaacatccagtggccaaacggaattaccctggatctcctgtctggtcgactttattgggtagattctaagttgcacagcatcagctcaatcgatgtcaacggcggtaacaggaagactatcctggaagatgagaaacgcctcgcacatcccttcagtcttgcagttttcgaagataaggtgttttggaccgacattataaacgaggccatcttcagtgcgaacagacttactggctcagacgtgaatctcttggccgagaacctgctgtctcctgaggacatggtgctcttccacaacctcactcagccgagaggtgtaaactggtgcgaaaggacaaccctgagcaacgggggctgtcaatatctgtgtctgccagctccccagatcaacccacattcccccaagttcacctgcgcctgccccgacggtatgctcctggctagagatatgaggtcttgcctgacagaggcagaagccgccgttgcaacgcaggagacctccaccgtgcggctgaaagtatcatccaccgccgtaagaactcagcacactactaccagaccggtccccgacacctccaggctgccaggagccacacctgggctgacaaccgtggaaatcgtgacaatgagccatcaagctctgggggacgtcgccgggagagggaacgagaaaaaaccctcctccgtgcgagccctgagcatagtgttgcccattgtgttgctggtgtttttgtgtctgggagtctttttgctctggaagaactggcggctgaagaatatcaatagtatcaacttcgacaaccccgtctaccagaagaccacagaagacgaggttcatatctgtcacaatcaggacggttatagctatccctctagacagatggtgagcttggaggacgatgtggct

SEQ ID NO: 16232 - DNA, 2580 bp, Artificial Sequence
  Description of Artificial Sequence: Synthetic coding sequence
atgggaccgtggggctggaaattgcggtggaccgtggccctgctgcttgcggcagcgggaaccgcggtgggcgaccggtgtgagaggaatgaattccaatgccaggatggaaaatgcatctcgtacaagtgggtgtgtgacggatccgccgaatgccaagatggaagcgacgaatcgcaggagacttgtttgtcggtgacttgtaagtcgggcgacttctcgtgcggcgggcgcgtcaaccggtgcatcccccagttttggcggtgcgacgggcaagtggactgtgataacggtagcgacgagcaaggctgcccacccaagacttgctcgcaagacgagtttaggtgccacgatggcaagtgcatctcgagacaattcgtgtgtgatagcgaccgcgactgcctggatggctcagacgaggcttcctgcccagtgcttacttgtggcccagccagcttccaatgcaattcctctacctgcatcccgcaactctgggcgtgcgacaacgacccggactgcgaagatggatccgatgaatggccccagcggtgcaggggtctgtacgtgttccaaggagactcctcgccatgctcggcattcgagttccattgtctttccggcgagtgtatccactcatcgtggcgctgtgacggaggaccggattgtaaggacaagagcgacgaggaaaactgcgccgttgcgacttgtcggccggatgaattccagtgttccgatgggaactgcatccacggctcgaggcaatgcgaccgcgagtacgattgtaaggatatgtcggatgaagtgggatgcgtgaatgtgaccctgtgcgaaggtcctaacaagttcaaatgtcattcaggagaatgtattacccttgataaagtgtgcaacatggctcgtgattgtcgggattggtcggacgaacccatcaaagaatgcggcaccaacgcctgtctcgacaacaacggaggatgttcacatgtgtgcaacgacctgaaaatcggctacgagtgcctgtgcccagacggattccaactggttgcccagcgccgctgcgaggatattgacgaatgtcaggacccggatacttgctcccaactgtgtgtcaatctcgagggcggttacaagtgtcagtgcgaggaaggcttccagctggaccctcataccaaagcctgcaaggctgtcggctccatcgcatacctcttctttactaaccggcacgaggtcagaaagatgacccttgataggtcagagtatacttccctgatcccaaacctcagaaacgtggtggcactggatactgaggtggcgagcaatagaatctattggagcgatctgtcccagcgcatgatctgttcgactcagctcgatcgcgcccacggagtgtcctcttacgacactgtgatttcccgtgatatccaggcgccagatggactcgccgtcgactggatacactccaacatctattggactgactccgtgctgggcactgtgagcgtggccgataccaagggagtgaagcgtaagaccctgttccgggaaaatggctccaagccacgggctatcgtggtcgacccggtgcacggattcatgtactggaccgactggggaacgccggcgaagatcaagaaaggagggcttaacggagtggacatctactcgcttgtcaccgagaacatccagtggccaaatggtattacgctggatctgctgtcaggacgcctgtactgggtagattcgaagctgcattcgatttcatccatcgacgtgaacgggggcaaccgcaagaccatcctggaggatgagaaaagactcgcacaccccttctcactggcagtgtttgaggataaggtgttctggaccgacatcatcaacgaagccatcttttctgcgaacaggttgactggtagcgatgtgaacctgctggccgaaaatctgctttcacccgaggacatggtgctgttccacaatctgactcaaccgaggggagtcaattggtgcgaacggacgaccttgagcaacggaggttgtcaatacctctgccttccggcaccgcagattaatcctcactcgccgaagttcacctgcgcttgtccggatggaatgctgcttgcaagggacatgcggagctgtctgaccgaggccgaagcagccgtggcgacgcaggaaacttcgactgtgcggctgaaggtgtcaagtaccgctgtgcgcactcaacataccacgacccgcccggttcctgacactagccggctccccggagctactccaggactcaccacggtggaaatcgtgaccatgtcccaccaggctctgggcgatgtggccggacgcggcaacgaaaagaaaccttcatcagtgagagccctgtccatcgtgcttccgatcgtcctcctcgtgttcctttgcctgggagtctttctcctctggaagaactggagactgaagaatatcaattcaattaactttgacaacccggtgtaccagaaaaccaccgaggacgaagtgcatatctgccacaaccaggatggctactcgtacccatcccgccaaatggtgtcactggaggacgatgtggcc

SEQ ID NO: 16233 - DNA, 2580 bp, Artificial Sequence
  Description of Artificial Sequence: Synthetic coding sequence
atggggccgtggggctggaaacttagatggacagttgctctcttgcttgctgccgcgggtacggctgtgggggataggtgtgaaaggaacgaattccaatgtcaggacggaaagtgcatcagttataagtgggtctgcgacggttcagctgaatgccaggacggaagtgacgaaagccaggaaacctgcctttccgttacttgcaagagcggagacttcagctgcggaggcagggtgaaccgctgcatcccacagttttggcgatgtgacggccaagtggactgcgacaacggcagcgacgagcagggctgccctcctaaaacttgttctcaggatgaatttagatgccacgatggcaagtgcatcagcagacagtttgtatgcgactccgatagagattgccttgatggctcagacgaagcaagttgcccggtgttgacctgtggtcctgccagcttccaatgcaactctagcacatgcatcccacagctgtgggcatgcgacaacgatcccgattgtgaggatggcagtgacgagtggccccagaggtgtaggggactatacgtgtttcagggagacagctctccatgtagcgctttcgaattccattgtttgtctggtgagtgtatccatagctcgtggagatgcgatggtggaccggattgcaaagataaaagcgatgaggagaactgtgctgttgccacatgcagaccagatgagtttcagtgctctgacggtaactgtatccacggttcaaggcagtgtgatcgcgagtatgattgtaaagatatgtctgatgaagtgggatgtgtcaacgttaccctgtgtgagggccccaataagtttaaatgccattcaggcgagtgtatcaccctggataaagtttgtaatatggcacgtgattgtagggactggtccgatgaacccattaaggagtgtggcaccaacgcatgcttggacaacaacggaggctgctctcacgtatgtaacgaccttaagatcggttatgaatgtctgtgccccgacggcttccagcttgtcgctcagaggaggtgtgaggacatcgatgagtgccaggatccagatacatgcagccagctgtgcgttaacttggagggagggtacaaatgtcagtgtgaggaaggatttcaactcgaccctcacacaaaggcttgcaaagctgtcggaagcatcgcctacctgttcttcactaataggcacgaagtcaggaaaatgacattggatagaagtgagtacaccagtctgatcccaaatctgaggaacgttgtggcactggacacagaggtcgcaagtaacagaatttactggagtgatctgagccaaaggatgatatgctctacccagctggatagggcccatggggtgtcatcatacgacacggttatatcccgcgacattcaagccccggatgggcttgcggtagactggatccactctaacatctactggactgatagcgttctgggcacagtaagcgtggccgatacaaagggagtgaagaggaagaccctgtttagagagaatggaagcaagcctcgggcgatcgtagtggacccggtgcatgggttcatgtactggaccgactggggcacaccagcgaagataaagaagggcggacttaacggcgtggacatttacagtctggtgaccgagaatattcaatggcccaacggcataacgctcgatctcctgagcggaaggttgtattgggtggacagtaagctgcattctatatccagcattgatgttaacggcggaaatcgcaagaccattctggaagacgagaaaaggctcgctcatccttttagcctcgctgtgtttgaagacaaggtgttttggacagacatcatcaacgaggcgatctttagcgcgaaccgactcaccggatccgacgtgaacctcttggccgagaatttgttgtctcctgaggatatggtcctgttccataacttgacccaaccacggggcgtcaattggtgtgagcgcacaaccctgagcaacgggggctgccagtatctgtgtcttcctgctcctcaaattaatccacactcacccaagttcacgtgtgcctgccccgatggcatgctcttggcaagggatatgaggagctgccttacagaggcagaagccgcagtagccacacaagagacaagcaccgtcaggctgaaggtgtcatcgaccgcggtgagaacccagcatactactactaggcctgtcccagacacaagcaggctccccggggctaccccggggttaacaacagtggagatcgtcaccatgtcacaccaagctttgggcgacgtggcgggaaggggcaacgaaaagaagccaagctccgttcgtgcactgagcatcgtgcttcctatcgtgctgttggtttttctttgcctgggcgttttcctgctgtggaagaactggagactgaagaacattaacagcatcaacttcgacaaccccgtgtatcaaaaaacaaccgaagatgaagtgcatatctgtcacaaccaggacggttactcataccccagcaggcaaatggtttccctggaggacgacgttgcc

SEQ ID NO: 16234 - DNA, 2580 bp, Artificial Sequence
  Description of Artificial Sequence: Synthetic coding sequence
atgggcccgtgggggtggaagctccggtggactgtggcactcttgcttgccgccgcaggaacggccgtgggagatcggtgtgaacgcaacgagttccaatgccaggatggaaagtgcatatcctacaaatgggtctgcgatggtagcgccgagtgccaagatggctcagatgagtcccaggaaacctgcctctcggtgacgtgcaagtcgggtgacttctcgtgcggcgggcgggttaacaggtgtattccgcagttttggcgctgtgacggccaggtggattgcgacaacggatcggacgaacagggttgcccaccaaagacctgttcccaggatgagttcagatgtcatgacggcaagtgcatttcccggcaatttgtctgcgactcggatcgtgactgcctggacggctcggatgaagccagctgtccggtactgacctgcggccctgcctcgttccagtgcaactcatccacctgtatcccccagctgtgggcctgcgataacgacccggactgcgaggacggatcagacgaatggcctcaacgctgcagaggactgtacgtgttccagggagattcctctccttgctccgcctttgaattccactgcctgtcgggggaatgcatccatagctcatggagatgcgacggcggcccggactgcaaagacaagtcagatgaagagaactgtgctgtggctacttgtaggccagacgaattccagtgttcggacggaaattgtatccacggctcccgacagtgcgatcgtgaatacgattgtaaggacatgtccgacgaggtgggttgtgtgaacgtgactctctgcgagggaccgaataagtttaagtgccatagcggagaatgcataaccctggacaaagtctgtaacatggcgcgcgactgtcgggattggtcagatgagccgatcaaggagtgcggcaccaacgcgtgcctggataacaacggaggctgtagccacgtgtgcaacgaccttaagatcgggtacgagtgcttgtgcccggatggattccaactggtggcgcaacgccgctgtgaagatattgatgagtgccaggatcctgatacttgctcgcagctgtgcgtgaatctcgaagggggctacaagtgtcaatgcgaggagggattccaactcgacccgcacactaaagcctgcaaagccgtgggatcgatcgcttacctgtttttcacgaacagacatgaggtccggaagatgactctggaccggtcggagtacacttccttgatcccgaacctgcgcaacgtggtcgcgctggacactgaagtggcgtccaacaggatctactggagcgatttgtcgcagcgcatgatctgttcaactcagctggacagagctcacggagtgtcctcgtacgatactgtgatctcgagagatattcaggccccagatggcctggccgtcgactggattcattccaatatctactggactgatagcgtgctgggaaccgtgtcggtggccgacactaagggagtgaagcgcaagactttgttcagagaaaatggatccaagccgagagcaatcgtcgtggatcccgtccatggatttatgtactggaccgactggggcactcccgcgaagatcaagaaaggaggcctcaatggtgttgacatctactcgctggtgaccgagaatatccagtggccgaatggaataaccctggatctgctgtcaggtcgtctgtactgggtggattcgaaactgcactccatttcgagcatcgacgtgaatggaggtaaccggaaaactatcctggaggacgaaaagcgtctcgctcatcctttctccctcgccgtgttcgaggataaagtgttctggaccgacatcatcaacgaggcgatcttctcagccaacagactgacgggctccgacgtcaacctgctggcagaaaacctcctctcgccggaggacatggtgctcttccacaatctgacgcaaccacggggagtgaattggtgcgaaagaacgaccctctcaaacgggggatgccagtacctctgcctcccggcacctcagatcaacccacactcgccgaagttcacttgcgcttgtccggatggaatgctcctcgcccgggacatgagaagctgtttgaccgaggctgaggctgcagttgcgacccaggaaaccagcactgtgcgcctgaaggtgtcatcaactgcagtccggactcagcacaccaccacgcgcccggtgcctgacactagccgcctgccaggggctactcctggactgaccacggtcgagatcgtcactatgtcgcatcaggccttgggagacgtggcgggaagaggaaacgagaagaaaccctcgtcagtcagagcgcttagcatcgtgctcccgatcgtgctgctggtgttcctgtgccttggcgtctttctgctctggaagaattggcggctgaaaaacatcaacagcatcaattttgacaatcccgtctatcaaaagactaccgaggatgaagtgcacatttgccacaatcaggatggatactcctatccatcacgacagatggtatcactggaagatgacgtggcc

SEQ ID NO: 16235 - DNA, 2580 bp, Artificial Sequence
  Description of Artificial Sequence: Synthetic coding sequence
atgggaccatggggatggaaactccgctggacggtggctctgctgctcgctgcggccggtacggccgtgggggaccggtgcgaaaggaacgaattccaatgccaggacggaaagtgcattagctacaagtgggtgtgcgacgggtcggccgagtgccaagacggatctgatgaatcacaggaaacctgtttgtcagtgacctgcaagtccggggatttcagctgcggagggcgagtgaacagatgtatcccgcagttctggagatgcgatggacaggtggactgcgacaatggatccgacgagcaaggctgcccacctaagacgtgttcacaagatgaatttaggtgccacgatggtaagtgcatcagccgccagtttgtttgcgactcggatcgagactgcctggatggatcagacgaagctagctgccctgtgctgacttgcggaccggccagcttccagtgcaactcgtccacctgcatcccgcagctgtgggcatgtgataatgacccagactgcgaggacggatccgatgagtggccacaacggtgccggggcctgtacgttttccagggcgactcgagtccgtgctcggccttcgaattccactgcctctctggagagtgcatccattcatcctggcgctgcgacggcggaccggattgcaaagacaagtccgatgaagaaaactgcgcggtcgcgacttgccgccccgatgaattccagtgctcagacggcaattgcatccatggatcgagacagtgcgaccgtgagtacgattgcaaggatatgtcagacgaagtggggtgcgtgaacgttactctgtgtgagggaccgaacaagttcaagtgccattccggagaatgtattactctcgacaaggtgtgcaatatggcccgcgattgcagagattggtcagacgaacctattaaggaatgcggaaccaacgcttgcctggataacaacggaggctgctcgcacgtttgcaacgacctgaagatcggatatgaatgtctgtgccctgatggcttccagctcgtggcacagcgccgctgcgaggacatcgacgagtgccaggatcccgacacctgttcgcaactgtgcgtgaatcttgaggggggatacaagtgccaatgcgaggagggattccagctggacccacacactaaggcttgcaaggctgtgggatcaatcgcttacctcttctttaccaaccgccatgaagtccgaaagatgaccctggatcggtctgaatacacctcgctcattccgaatctgcgcaatgtggtggccctggatactgaggtggcctcgaatcgcatctactggagcgacctctcgcagaggatgatctgcagcactcaactggatagagcccatggagtttcctcctacgatactgtcatctcacgggacatccaagcgcctgacggccttgcggtggactggatccactccaacatctactggactgattccgtgctcggtaccgtgtccgtggccgacaccaagggtgtgaagcgcaagactttgtttcgcgagaatggaagcaagccaagagccattgtagtcgatcctgtccatggattcatgtactggactgactgggggaccccggcaaaaatcaagaagggcggactcaacggcgtcgacatctactcgctcgtgactgaaaacatccaatggcccaacggaatcaccctggacctcctcagcggccgactttactgggtggactcaaagctccactcaatttcgagcatcgatgtgaacggtggaaaccgcaaaaccatcttggaagatgaaaagagacttgcccacccattcagcctggccgtgttcgaagataaggtgttctggaccgatatcatcaacgaagcaatcttctccgccaatcgcctgacgggatctgacgtcaatctgttggccgagaatttgctgtcgccggaggacatggtgttgtttcataatctgactcaaccaagaggggtgaactggtgcgaaagaaccactttgtcaaacggcggatgccagtacttgtgcctgcctgcgcctcaaatcaacccgcactcccctaagttcacctgcgcgtgtccagatggcatgctgctggcccgggacatgcggtcctgcctgacggaagcggaggctgccgtggccacccaagagactagcactgtgaggctgaaagtgagctccactgccgtgagaacgcaacacacgactactcggccggtccctgacacttcgagactgccgggagcaaccccaggcctgaccactgtggaaatcgtgaccatgtcccaccaggctctcggagacgtcgcaggacggggcaacgagaagaaaccgtcgagcgtgcgcgcactcagcatcgtcttgccaattgttctgctggtgttcctttgccttggagtgttcctgctctggaagaactggcgcctgaagaacatcaattcgattaacttcgacaatccagtctatcagaaaaccaccgaggacgaagtccatatctgtcataatcaagacggttactcgtatccgtcccggcagatggtgtcactggaggacgatgtggct

SEQ ID NO: 16236 - DNA, 2580 bp, Artificial Sequence
  Description of Artificial Sequence: Synthetic coding sequence
atgggcccttggggatggaagctgaggtggactgtggccttgctactggcggcagccggcacggctgtcggcgatagatgtgagaggaacgagttccagtgccaggatggtaaatgcatctcttacaaatgggtttgtgacggcagtgcagagtgtcaagacgggtctgatgagagtcaggagacgtgcctgtcggtgacatgtaagtccggagattttagctgtgggggccgcgtcaatcgctgtataccacagttctggagatgcgacgggcaagttgattgcgataacgggagcgacgagcagggctgtcccccaaagacttgtagccaggacgaatttagatgtcatgacggaaaatgtatctccagacaatttgtctgcgattcagaccgcgattgtcttgatggatcagatgaagctagctgccccgtgctgacttgcgggcccgcttctttccagtgcaattctagcacctgtatccctcagctgtgggcttgtgacaacgaccctgattgcgaggacggctccgatgagtggccgcagcggtgcaggggactgtacgtgttccagggagactcaagtccctgttctgctttcgaatttcactgcttgtccggggagtgcatccatagcagttggagatgtgatggcggacccgattgcaaggacaaatccgacgaggaaaattgcgctgtcgccacctgtagaccagatgagttccaatgctccgatgggaattgcatccatggttctaggcagtgtgatcgggaatatgattgcaaagatatgagcgatgaagttggatgcgtcaacgtgaccctctgtgaagggccaaacaaatttaagtgccattctggcgaatgcataactctcgataaagtatgcaatatggcaagagactgtagagattggtccgatgagccaatcaaggaatgtggaacgaacgcgtgccttgataataatggggggtgttctcacgtgtgtaacgacctcaagatcggatacgagtgtctctgtcctgacggttttcagttggtcgctcagcgccggtgcgaggatatcgacgagtgccaggatccggatacgtgtagtcaactttgcgttaatttagagggtggttacaagtgtcagtgcgaggaaggtttccagctcgatcctcatacaaaggcgtgtaaggcagttggatcaattgcatatctgttcttcaccaatcgtcacgaggtgcggaaaatgacactggaccgctcagaatacacatcccttattcccaacctgcggaacgtcgtggcactggacactgaagtagcgtctaatcgcatctattggagtgacttgtcacaacgaatgatctgcagtacccagctggatcgcgctcacggggtgtcttcctacgataccgtcatctcccgtgatattcaggcacctgacggcctggctgtcgactggatccactccaatatatactggaccgacagcgtgctgggcaccgtgtctgtagcggatacaaagggtgtcaaacgcaagacactgttcagggagaatggcagcaaacctagggctattgtggtggatccagtccacgggtttatgtattggactgactggggtacccctgcgaaaatcaagaagggcggactcaacggagtggatatatatagtctggtgactgagaatattcagtggcctaatgggatcaccctggacctgctgagcggtaggttgtactgggtagacagcaaacttcactccatctcatcaatcgacgtcaatggcggcaaccgaaagactatcctggaggacgagaagcggcttgcccatcccttctctcttgccgtgttcgaggacaaggtgttctggaccgacatcatcaacgaggcaatcttcagtgcaaacagattaacaggctccgacgtgaacttactcgccgagaacctgctctcgccggaggatatggtattgtttcataatctgactcagccgaggggcgtcaattggtgcgagcggactacactgtctaatggtggatgccagtatctgtgtttgcccgcccctcagataaatccccattcgcctaagtttacgtgtgcatgcccagacgggatgctattggcacgcgatatgcggtcgtgtctcaccgaggcggaagccgccgtggccacccaggaaactagcaccgtacggctgaaagtttcttctactgctgtaagaacacaacacaccaccacgagacctgttccagacacaagcaggctgccgggggcgactccaggcctgacaaccgttgagatcgtgactatgtcccatcaggcactcggcgatgtggctggaaggggcaatgagaagaaaccctcaagcgtaagagcactcagcattgtgcttccgatcgttttactggtgttcctatgcctgggggtttttttgctgtggaaaaattggcggctgaaaaatattaactccatcaacttcgataatcctgtataccagaagaccaccgaagatgaagtacatatctgccacaaccaagatggatatagctacccatctcgacaaatggtgagcctggaagatgatgtagct

SEQ ID NO: 16237 - DNA, 2580 bp, Artificial Sequence
  Description of Artificial Sequence: Synthetic coding sequence
atgggaccctggggctggaaacttagatggaccgtggcccttcttttggccgccgctggtaccgctgtcggagaccgctgcgaacgtaacgaattccagtgccaagacggtaagtgtatctcttataagtgggtgtgtgacgggtccgcagagtgtcaagacggtagcgatgagtctcaggaaacatgtctgtcggtcacgtgcaagtccggcgatttctcctgcggaggtcgtgtgaaccgctgcattccccagttctggcgctgtgacggtcaggtcgactgcgataacggaagtgatgagcagggttgtcctcccaagacatgctcccaggacgagttccggtgccatgatggtaagtgcatttcccgccagttcgtttgcgattcagaccgcgactgtctcgacggcagcgatgaggcctcgtgccccgtcctgacctgcggtccggcctcgtttcagtgcaactcttccacgtgcatccctcaactctgggcttgtgacaacgaccctgattgcgaggatggcagcgacgaatggccccaacgctgtcgtggactctacgtcttccagggtgacagttccccctgtagcgcgttcgaattccattgtctgtcaggcgaatgcattcatagtagttggcgctgcgacggaggacccgactgcaaggataagtccgacgaggagaactgcgcggtggccacgtgtaggccggatgagttccaatgcagtgacggaaattgtatccatgggtctagacagtgtgatagagagtacgactgcaaggacatgtctgacgaggttggctgcgtgaacgtcactctctgcgagggccccaacaagttcaagtgccacagtggcgagtgcatcacccttgataaggtgtgcaatatggcccgagattgccgtgactggtctgatgagcccatcaaggaatgcggaacgaacgcatgtttggacaacaacgggggctgttcgcacgtttgtaacgatctcaagatcggctatgagtgcctgtgtccggatggtttccagctggttgcgcagcgccggtgtgaagatatcgacgaatgccaggatcccgatacttgctcccagctttgcgtgaaccttgagggcggttataagtgtcagtgtgaggagggtttccagctcgatccccataccaaagcgtgcaaggctgtgggttcaattgcctacctgtttttcaccaatcgtcacgaggtccgcaagatgaccctcgaccgctccgagtatacctcgttgatccccaacttgcgcaacgtggtggcgcttgacaccgaggtcgcttctaaccgtatttactggagtgatctgagccagagaatgatctgctccacacagctggaccgtgctcacggtgtctcttcctacgacaccgttatctcgcgggacatccaggcacccgacggactagcggtcgactggatccattcaaatatctactggactgactcggtcctggggactgtgagcgtcgcggacaccaagggcgtgaaacgcaaaaccctgtttcgggagaacggttccaaaccgcgcgccatcgtggtcgaccccgtccacggattcatgtactggaccgattggggcacgcccgccaagatcaagaagggtgggctgaacggcgtggatatctactcactggtcacggagaacatccagtggcccaacggcatcacactcgacttgctcagcggcaggttgtactgggtcgattccaagctccattctatctccagcattgacgtcaacggcggcaatcggaagaccattctggaagacgagaagcgactcgcccacccttttagcctagcagtctttgaggacaaagttttctggaccgatattatcaatgaggccattttctccgccaatcgcctcacaggatccgacgttaacctgttagctgaaaacctgctgagtcccgaagatatggtccttttccacaacctcacgcaacctcgcggtgttaattggtgcgagcggaccactctgtcgaatggtgggtgccaatacctgtgtctccccgccccacaaatcaatccccactctcccaagttcacgtgcgcttgccccgatggaatgctgctcgcgcgcgatatgcgctcctgtctgacggaggcggaggcggcggttgccacccaggagacttcaactgttagactgaaggtttcgtcaacggctgtccgcacacaacacacaacaacgagacccgtgcctgacacgtcacgtctcccgggtgccacccctggactcactactgtcgagattgtcacgatgtcgcaccaggctcttggcgatgtggccggacgtggcaatgagaagaagccgagcagcgttcgagccctgtctatcgttctgcccatcgtactcctggtgttcctatgcctgggagtctttttgttgtggaaaaattggcgactcaagaacataaactccattaacttcgacaatcccgtctaccaaaagaccacagaagacgaagttcacatctgccacaatcaggacggctacagctacccgtcgcgccagatggtctctctcgaggatgatgtggcc

SEQ ID NO: 16238 - DNA, 2580 bp, Artificial Sequence
  Description of Artificial Sequence: Synthetic coding sequence
atgggtccttggggatggaagctccggtggaccgtcgcactcctgctcgcagccgccggtactgcagtaggggatcgctgcgaaagaaatgaattccaatgccaagatggtaagtgcattagctacaaatgggtctgtgatggatcggccgagtgccaagacgggtcagatgagtcccaggagacgtgcctgtcagtgacctgtaagtcgggtgatttttcctgtggggggcgggtgaatcgatgtattccacaattttggcggtgcgacgggcaggtggactgtgacaatggtagcgatgaacaggggtgtccacctaagacctgcagccaggacgaatttagatgtcacgacggaaaatgcatttcaagacaattcgtgtgtgattcggatcgggattgtctggatggctcggacgaggcttcctgccctgtgctcacctgtggtccagcctcctttcaatgtaattcgagcacttgtataccacaactgtgggcctgtgacaacgaccctgattgtgaggacggatcggatgagtggccacagcggtgtcggggtttgtacgtattccaaggagattcaagcccttgttccgcatttgagttccactgtctgtcgggggaatgcatccactcgagctggcgatgtgacggtggcccggactgtaaggacaagtctgacgaggaaaactgtgcagtcgccacctgtagaccggatgagtttcaatgctcggacggaaactgcatacacggatccaggcaatgtgacagagagtacgattgcaaggacatgtcggacgaagtggggtgcgttaatgtcaccctgtgcgaaggccctaacaaattcaagtgccattccggagaatgcatcacccttgataaggtgtgtaacatggcgagagattgtcgtgactggtcggatgagcctataaaggagtgtggaaccaacgcatgcctggataacaacgggggttgctcacatgtctgcaacgatctgaaaataggatacgagtgtctctgtccagatggattccagcttgtggcccaaaggcgatgtgaagatatcgatgaatgtcaagatccagatacttgttcccagttgtgcgtcaatctcgagggaggctataagtgtcaatgtgaagaaggatttcaactcgatcctcataccaaggcgtgtaaggccgtgggttccatcgcatacttgtttttcaccaatagacacgaagtccgtaagatgactcttgaccgctcagaatacacttccctgatccctaatcttcgtaatgtggtcgcgctcgatactgaagtcgcatccaacagaatctactggagcgacctttcccagcgtatgatttgtagtacccaattggatcgggcgcatggagtgtcctcctacgatactgtgatcagccgtgatattcaagcgccagatggtcttgccgtggactggattcactccaacatttactggactgactccgtgctcggcaccgtgtccgtggctgatactaaaggggtcaagagaaaaactctgttcagggaaaatggttccaaaccaagagccattgtggtcgaccccgtgcacggttttatgtactggaccgactggggaactccagcgaagatcaaaaagggtggactgaacggcgtcgacatttactcacttgtcaccgaaaacatccagtggccaaatgggataacgctggatctgctttcgggacggctttattgggtggatagcaagctgcattccatctcctcaatcgacgtgaatgggggcaacagaaagactatactcgaggacgagaaacggctcgcgcatccttttagcctggcggtttttgaggataaggtcttttggaccgacatcatcaacgaggcaatcttttcggcaaacagattgaccggcagcgatgtcaacctccttgctgaaaacttgctgtcacctgaggacatggtcctcttccataaccttactcagcctcgaggtgtgaactggtgtgaacgcaccactctgagcaatggtggttgccagtacctgtgcctccctgccccgcagatcaacccacattcgcctaagtttacctgtgcgtgcccggatggtatgcttctggctagagatatgcgctcatgtctgaccgaggcagaggcagccgtggcgactcaggaaacctcaacggtgcgtctcaaggtgtcgtctaccgcagtccgtacccagcatactacgactcgacctgtgccagacacttcccggcttcccggcgcaaccccaggacttacgaccgtcgaaattgtgaccatgagccaccaggcactcggtgatgtggcaggacggggaaatgaaaagaagccatcctccgtgcgtgcactcagcattgtgctgcccatagtccttcttgttttcctttgtcttggagtgtttctcctttggaaaaactggcgcctcaagaatatcaactcaataaacttcgataacccagtgtaccaaaagaccaccgaagatgaagtccatatctgtcataaccaagatggctactcgtacccttccagacaaatggtgtcactcgaagatgatgtggct

SEQ ID NO: 16239 - DNA, 2580 bp, Artificial Sequence
  Description of Artificial Sequence: Synthetic coding sequence
atgggcccctggggctggaagctgaggtggacagtggctctcctcctggccgccgccgggactgcagtaggcgaccgctgtgaaagaaatgagtttcagtgtcaggacggcaagtgcatatcttataaatgggtttgtgatggaagtgccgagtgtcaggacgggagtgatgaaagccaggagacttgcctgtctgtgacctgtaagtccggggatttctcttgcggcggccgggtgaatcgctgcatacctcaattctggcgctgcgacggccaagtggactgtgacaacgggagcgatgagcagggctgccctcccaaaacatgctcccaggacgagtttagatgtcatgacgggaaatgcatctccaggcagtttgtgtgcgactccgatcgcgactgcctggacgggtctgacgaagccagttgccccgtcctgacttgtggcccggctagtttccagtgcaactctagcacctgcattccacagctatgggcctgtgacaatgaccctgactgcgaggatggcagcgacgagtggcctcagcgctgccgcggattatacgtgtttcagggcgatagttctccttgcagtgcctttgaatttcactgcctctctggtgagtgtatacacagctcttggaggtgcgatggcggacccgactgcaaggacaaaagtgatgaagagaactgcgcagtggcaacatgcagacccgacgagttccagtgctccgatggcaactgcatccatgggtctcgccagtgcgatagagagtacgactgtaaggacatgtctgatgaagtcggctgcgtcaatgtcaccctgtgcgaggggcctaacaaatttaaatgtcatagcggagagtgtattacattggacaaagtttgcaacatggctcgggactgcagagattggtccgacgagcctataaaggagtgtggcaccaatgcctgtctagacaacaacggaggctgctcccatgtgtgtaacgatctgaagatcggatacgaatgcctatgcccagatgggtttcaactggtggcacagcggagatgtgaagacatagacgagtgccaggacccagacacttgtagccagctgtgcgtcaacctggagggcggttataaatgtcaatgcgaggaaggatttcagttagatcctcacaccaaggcatgtaaagcagtgggctctatcgcctacctttttttcaccaataggcatgaagtacggaagatgaccctggaccgcagcgagtatactagtctcatacctaacctgcgcaatgtggtggctctggacaccgaagtggctagcaatagaatttattggagtgacctgtcacagaggatgatttgctctactcagctggaccgtgcccacggagtgagtagttacgacacagtcatcagtcgggacatccaggcccctgacggtttggccgttgattggattcatagcaacatttattggaccgacagtgtcctgggaaccgtctctgttgccgataccaaaggtgtgaagcggaagactctgtttagagagaatggcagcaaaccacgcgccatagtggtcgaccccgttcatggttttatgtactggactgactggggtactcctgccaaaattaaaaagggggggctgaatggggtcgacatatatagcctggttactgagaacattcaatggccaaacggcatcacacttgatctcctctctggaaggctatattgggtggacagcaagttacactccataagcagcattgatgtcaacggcggcaaccggaaaaccatcctggaagacgagaagcggcttgctcacccttttagtttagccgtgtttgaggataaagtgttttggactgacatcataaatgaggctatcttcagcgccaaccgcctcactggcagcgacgttaatctgttagctgagaacctccttagtccagaagacatggtgctctttcacaatcttactcaaccaaggggggtcaactggtgcgagcggaccaccctgtcaaacggcggctgccagtacctgtgcctgcctgcacctcagattaacccacactctccaaagttcacctgcgcatgtcctgacggtatgctactggccagggatatgagatcctgtctcacagaggccgaggccgctgtggcaacacaagaaacttccaccgtccgcctcaaagtgtctagtactgcagttagaacccagcataccacaacccggcctgttccagacaccagcagactaccaggcgcaacacccggcctgacaactgtcgaaatagttaccatgagccaccaggctctcggcgatgttgctgggagaggaaatgaaaagaaaccctcctccgttcgtgctctgtctatcgtgctcccaattgtgctgctcgtgttcctgtgcctgggtgtgtttctgttgtggaagaactggagactgaaaaatataaatagcatcaatttcgataaccctgtctatcaaaaaactacagaggacgaagtccacatctgtcacaaccaggacggttatagctatccctccagacagatggtctccctcgaagatgacgtggcc

SEQ ID NO: 16240 - DNA, 2580 bp, Artificial Sequence
  Description of Artificial Sequence: Synthetic coding sequence
atgggaccttggggatggaagctgcggtggactgtggctctgctgctggctgcggccggaactgctgtgggagatagatgtgagcgcaacgaattccagtgtcaggatgggaagtgcatttcctacaaatgggtttgcgacggctcagcggaatgccaagacggaagcgacgaaagccaggaaacgtgcttgagcgtgacctgcaaatccggagacttcagttgtgggggaagggtgaaccgctgcatcccgcagttctggcgttgcgacggccaagttgactgtgataatggatcagatgagcaaggatgtccgccgaaaacgtgctcacaagatgaatttcgatgccacgacggcaagtgtatttcccgccagttcgtgtgcgattccgatagagactgccttgacggatcggacgaggcttcatgcccggtcttgacttgcggtccagcatcattccagtgcaattcatccacctgcatccctcaactctgggcctgcgataatgacccggactgtgaggatggctcggacgagtggccgcaaagatgcaggggactgtacgtgttccaaggcgactcatccccgtgcagcgccttcgaatttcattgcctgtcgggcgaatgcatccattcctcttggcgctgcgacggcggacctgactgcaaggacaagtctgacgaggagaactgcgcagtggcgacctgccgacccgatgaatttcaatgctccgacggaaactgcatccacggttcgcgccagtgcgaccgcgagtacgactgtaaggatatgtcggatgaggtgggatgcgtcaacgtcaccctctgcgaaggccccaacaagtttaagtgccactccggagaatgcattactctcgacaaagtttgcaatatggctcgcgactgtcgcgattggtctgacgagccgattaaagagtgcggaactaacgcctgcctggacaataacgggggatgcagccacgtctgcaatgacctcaagatcggatacgagtgcctgtgcccggacggatttcaactcgtggcgcagcgtagatgcgaggatatcgatgaatgtcaggacccagatacttgctcccagctgtgcgtgaaccttgaagggggatacaaatgtcagtgcgaggaagggttccaactggacccgcacaccaaggcttgcaaggcggtcggatcaatcgcctatctgttctttactaaccgccacgaagtgcggaagatgaccctggaccggtccgaatacactagcctgatccccaacttgcggaacgtcgtggctcttgacaccgaagtggcctctaaccgcatctattggtccgatctgtcccaacgcatgatttgctcgacccagctggaccgcgcccacggggtgtcgtcgtacgacaccgtcatctcgcgggacatccaggccccggacggcctcgcggtggattggatacattccaacatctactggactgattccgtcctgggaacggtgtccgtcgcagataccaaaggagtcaagagaaagaccctctttcgagagaacggctcaaagccccgggccatcgtggttgacccggtgcatggatttatgtactggactgactggggcaccccggccaaaatcaaaaagggtggcctgaacggagtggacatctacagcctggtgaccgaaaacatacaatggccgaatggtatcactctcgatctgttgtcaggccggctgtattgggtggactcgaagctgcactcgatttcgtccatcgatgtcaatggcggtaatcggaaaactatcctggaggatgagaagagactggcccatccattctcccttgcggtgttcgaggacaaggtgttttggaccgacatcattaacgaggccatcttttcggccaatagactgactggctcggacgtgaacctcttggcggaaaatctgctttctccggaggacatggtcctgtttcacaatctcacccagcctaggggagtgaactggtgtgagagaaccactctgagcaacggaggatgccagtacctctgcctgccggctcctcaaatcaaccctcatagcccgaagttcacttgcgcatgcccagacggaatgctgctggctagggacatgcgtagctgtctgactgaagcggaagcggcggttgccacccaggagacttcaaccgtcagactgaaagtgagctcaaccgccgtgagaacccagcatacgactactcggcctgtgccggataccagcaggcttccgggagccaccccggggctgaccaccgtggagatcgtcacgatgtcacaccaagccctgggagatgtcgccggccggggcaacgagaaaaagccgagctccgtgcgcgcgctgtcgattgtgctcccgatcgtgttgctcgtctttctgtgcttgggcgtgttcctcttgtggaagaactggcggctcaagaatatcaactcgatcaacttcgataacccagtgtaccaaaagactaccgaggacgaggtgcatatctgtcataatcaggacggatacagctatccgtcgcgccagatggtgtccctggaggacgatgtcgct

SEQ ID NO: 16241 - DNA, 2580 bp, Artificial Sequence
  Description of Artificial Sequence: Synthetic coding sequence
atggggccttggggctggaaacttcgttggaccgtggcacttctgcttgccgcagcaggcaccgccgtcggtgataggtgtgagcgcaacgaattccagtgtcaggatggaaagtgtatttcgtacaaatgggtctgcgatgggagcgcagaatgtcaagatggctcggatgaatcccaggaaacttgcctttccgtcacgtgtaaatcgggtgatttctcatgtggagggcgagtgaacagatgtattccacaattttggagatgtgacggacaagtggattgcgacaacggttcagatgaacagggctgtccccccaagacttgttcacaagatgaatttaggtgccatgatggtaagtgtatctcaaggcaatttgtgtgtgatagcgacagagattgtctggatggttcagatgaggctagctgcccagtcctgacttgtgggccggcatccttccagtgcaatagctcgacttgtatcccacagctttgggcatgtgataacgatccagattgtgaagatggatcggatgaatggccacagcgctgtaggggactttacgtgtttcagggagactcatcaccctgtagcgccttcgagtttcattgtttgtcgggagaatgcattcacagcagctggcggtgtgatggaggtcccgattgtaaggataaatcggacgaggagaactgcgccgtcgcaacttgtaggcctgatgaattccagtgcagcgatggaaactgcattcatggatcccgccaatgcgatcgcgagtacgattgtaaagatatgtccgatgaagtgggctgtgtgaacgtgaccctgtgtgagggtccaaacaaattcaagtgccattcgggcgagtgcatcaccctcgataaggtgtgtaacatggcgcgcgactgccgcgactggtcggatgagccaattaaggagtgtggtactaatgcctgtttggacaacaacggaggttgcagccatgtgtgtaatgatttgaagatcggctacgagtgtctctgtcctgatggctttcaactggtggcacagaggagatgcgaagatattgacgagtgccaggatcccgacacgtgctcgcagctgtgtgtgaatctggaaggagggtacaagtgtcaatgtgaggagggatttcaacttgatcctcacacgaaggcctgcaaggcggtgggatcaattgcatatctgtttttcactaatcgacacgaggtccgtaaaatgacccttgaccggagcgagtacacttccctgatccctaatcttagaaatgtcgtggcactcgataccgaagtcgcatctaatcggatttactggtccgatctctctcaaagaatgatctgctcaacccagctggatagggcacatggtgtttcatcgtacgataccgtgattagccgggatattcaagcacctgacggccttgcagtcgattggatccactcaaacatttactggactgactccgtgctcggaaccgtgtccgtcgcagatactaagggtgtcaaaaggaaaaccctctttcgtgaaaacggctctaagccaagagcaattgtcgtggacccagtgcatgggttcatgtactggaccgactggggaactcctgccaaaatcaagaagggagggctcaatggagtggacatttacagcctcgttaccgaaaacattcagtggccgaacggtataaccctggacctgctctcgggcagattgtactgggtggattccaagttgcatagcatttcatccattgatgtcaacggcggcaaccgaaaaacgattctggaagatgaaaagcgtctggctcatcctttttctctggcagtctttgaagataaagtgttttggactgacatcataaatgaggcaatctttagcgcaaaccgactcaccgggagcgacgtgaatcttctcgcagaaaacctgctttcccccgaggatatggtgcttttccacaatctcacgcaacccagaggtgttaactggtgcgagagaacgactctgtccaacggtggatgtcaatacctttgtctgccagcaccacaaatcaacccgcacagcccaaagtttacctgtgcatgtccggatggtatgttgctcgcacgggatatgagatcctgtcttaccgaggccgaagcagcagtggcgacccaagagacttccactgtgaggctgaaagtgtccagcactgccgttcggactcagcatactaccaccagacctgtgcctgacacttcccgtctcccaggagcaactcctggtctgacgaccgtggaaattgttaccatgtcccatcaggcactgggtgatgtggcaggacgcggaaacgagaaaaagccttcgagcgtgcgtgcactgtccatagtgcttccaattgtcctcctggtgtttctttgtctcggggtgtttctcctttggaagaactggcgtcttaagaacataaacagcattaacttcgataatcccgtctaccagaaaaccactgaagatgaagtgcatatctgccataaccaggatggctactcgtacccatcccggcaaatggtgtcactcgaagatgacgtggcg

SEQ ID NO: 16242 - DNA, 2580 bp, Artificial Sequence
  Description of Artificial Sequence: Synthetic coding sequence
atgggtccttgggggtggaaacttcgctggaccgtggcattgctcctggcagcggcaggcaccgcagtcggtgatcgctgtgaacgtaacgaattccaatgccaagacggcaagtgcatctcttacaagtgggtgtgtgatggaagcgcggaatgtcaagatggatcggacgaatcacaagaaacctgtttgtcagtgacgtgtaagagcggggacttctcatgcggaggacgtgtgaacagatgtatccctcagttttggagatgtgatggacaggtggactgcgacaacggatcggatgaacaggggtgtccgcccaagacctgctcccaagatgagtttcggtgccatgacggcaaatgtatctctcggcagttcgtctgtgattccgatagagactgtctggacggttctgacgaagcatcgtgccccgtccttacttgcggacccgcatcgttccagtgtaattcctccacttgtattcctcagctttgggcctgcgataatgatccggactgtgaggacggatcagatgagtggccgcagaggtgccgtggcctttacgtgttccaaggtgattcgtcgccgtgttcggcttttgagtttcactgccttagcggcgaatgtattcactcgtcatggcgctgtgacggcgggcctgattgtaaggataagagcgatgaggaaaattgtgcagtggcaacctgtcgaccagatgaatttcagtgctcggatggcaactgcattcatggatcgcgccagtgtgatagagaatacgattgtaaagacatgtcagatgaggtgggctgtgtcaacgttactctctgcgaaggaccaaataagtttaagtgccatagcggagagtgcataaccctcgataaagtgtgcaacatggccagagattgtcgcgattggtcagacgaacctattaaggaatgtggtactaacgcctgcctcgataacaacggtggatgctcgcatgtgtgtaatgatttgaaaattggttacgaatgtctgtgccccgacggatttcaactggtggcacagagacggtgcgaggatattgatgagtgtcaagaccccgatacctgttcacaactctgtgtgaatctcgaaggcggttacaaatgccagtgtgaagaaggttttcagctcgatccccatacgaaggcgtgtaaggccgtgggtagcatcgcatacctgttcttcacgaatagacatgaggtgcggaagatgactctggatcgatccgaatacaccagcctcataccgaatctgcgcaacgtggtcgcccttgatactgaggtcgcttctaacaggatctactggtccgatctttcgcagaggatgatatgttccacccagcttgacagagcgcatggagtgtcgagctacgataccgtgatctcacgggatatacaggcaccagatggtctggccgttgattggatacacagcaatatctactggactgactcggtgcttggaactgtgtcagtggctgacaccaagggagtgaagaggaaaaccctcttccgagaaaacggttcgaaaccccgcgcaatcgtggtggatccagtccacgggtttatgtattggaccgactggggaactccagccaagattaagaaaggaggtttgaacggggtggacatttactctcttgttactgagaacattcaatggcctaatggcataactctcgaccttctcagcggaaggctgtattgggtggattcgaagctccactcgatttcttccatcgacgtgaatggcgggaatagaaagactattcttgaggacgaaaaacgtctggcgcatccgtttagcctcgcagtctttgaggacaaagtcttttggacggatatcattaatgaggcgatcttttcggcaaacagacttactggtagcgatgtgaaccttcttgcggagaacctgctttccccggaggacatggttctctttcacaacctgactcagccacgcggggtgaactggtgcgaaagaaccactctttcgaatggaggatgtcaatacctttgtctgcctgcaccacagattaacccacatagccctaagtttacctgtgcctgtcctgatggtatgctgctggcacgtgatatgcgttcctgtttgactgaggccgaagcggcagtcgcaactcaggaaactagcactgtcagactgaaggtgtcgagcactgcagtcagaacccagcacactacgacccgaccagtccccgacacgtcacggttgccaggtgctaccccaggtctgaccactgtggaaatcgtgactatgagccaccaagctcttggagatgtggcaggccgcgggaacgaaaagaaacctagcagcgtccgcgccctctccatcgtgctccctatcgtcctgcttgtctttctctgcttgggagtgttcttgttgtggaagaattggcgtctgaagaacatcaacagcattaacttcgacaaccctgtgtaccaaaagaccactgaagatgaagtgcatatctgtcacaaccaagatgggtactcctacccatcacggcagatggtgtcccttgaggacgatgtggcc

SEQ ID NO: 16243 - DNA, 2580 bp, Artificial Sequence
  Description of Artificial Sequence: Synthetic coding sequence
atgggtccttggggatggaagctgcggtggaccgtggccctcctgcttgccgccgcgggtactgcggtgggagatagatgtgagagaaacgaatttcagtgtcaagatggaaagtgcatcagctacaagtgggtctgcgacggatcggccgaatgccaagacggatccgatgagtcgcaggaaacttgcctgtcagttacttgcaagtcgggcgatttctcgtgtggaggaagagtgaatcgctgcattccgcagttctggagatgcgacgggcaggtggactgcgataacggaagcgatgagcagggctgcccgccaaaaacttgttcgcaagatgagttccgctgtcatgacgggaagtgcatctctcgccaattcgtctgcgactcagatcgcgattgtctggatggctcagacgaagccagctgccccgtgctcacttgtggaccagcatcattccagtgcaattcctcaacgtgcatcccccagctttgggcgtgtgacaatgatccagattgcgaggatggttcggatgaatggcctcaacggtgcaggggcctctacgtgttccagggggattcctcgccgtgttccgcattcgagttccattgcctcagcggagaatgcatccatagctcttggcgctgtgatggaggtcccgattgcaaggataaatcggacgaagaaaactgcgccgtggcaacttgccgccctgatgaattccaatgttcggacggaaattgcatccacggatcccgccagtgcgacagggaatatgactgcaaggacatgtcagatgaggtcggttgcgtcaacgtgactctgtgcgagggtcctaataagttcaagtgtcattccggcgaatgcatcaccctggataaggtgtgtaacatggctagagactgcagagattggtcggatgaaccgattaaggaatgcggaactaacgcatgcctcgacaacaacggcggatgctcccacgtgtgtaatgacctcaaaattggatacgagtgcctgtgcccggacggattccagttggtcgcccagagacgctgcgaggacatcgacgagtgtcaggacccggatacttgctcgcagctgtgtgtgaatctcgagggcgggtataagtgccagtgcgaggaaggcttccagctcgacccacatactaaggcttgcaaggcggtgggctccatcgcatacttgtttttcactaacagacacgaggtccggaagatgaccttggaccggtcagagtacacctctctgatccccaacctgcgcaatgtggttgcacttgatacggaggtggcgagcaataggatctactggtcagatctgtcacagcgcatgatttgcagcactcagctggaccgggcacacggagtgagctcctacgataccgtcattagcagggatatccaagcacccgacggactggctgtggattggatccactcgaacatctattggacggattcggtcctcggtaccgtgtcggtggccgacaccaaaggtgtcaagcgcaagaccttgttccgggagaacggaagcaagccgagggcgatcgtcgtggacccagtgcacggattcatgtactggacggactggggcaccccagccaagatcaagaagggcggattgaacggagtcgacatatactcacttgtgactgaaaacattcaatggccaaacgggatcactctggacctcttgtcaggacggctttactgggtggattcaaaattgcactcgatctcctcaattgacgtcaacggaggaaacagaaagaccatcctcgaggacgaaaagagactggcacatccatttagcctcgcggtgttcgaggacaaagtgttctggactgacatcatcaacgaggcgattttctcggcgaaccgtctcactgggtcagatgtcaacttgctggccgagaatctgctgagcccggaggacatggtgctgtttcataatctgacccagccgcggggggtcaactggtgcgaacgcactacgctctcaaacggaggctgtcagtacctgtgtctcccagccccgcagatcaatcctcattcgccaaaattcacctgcgcctgccctgacggcatgctccttgcccgagatatgaggtcctgcctgaccgaggccgaggccgctgtggcaactcaggaaacctcgaccgtgcgactgaaagtctcctcaactgccgtgcgcacccagcacactactaccaggccggtgccggacacttcccgcctgcccggagctacgccgggactgactaccgtggagatcgtgactatgtctcaccaggcactcggtgatgtcgctggtcggggtaacgaaaagaagccgtcaagcgtgcgggcgcttagcatcgtgctcccgatcgttctgctggtgttcctgtgcttgggggtctttctgctgtggaaaaactggcggttgaagaacatcaattccatcaatttcgataatcctgtgtaccagaaaaccaccgaggacgaagtccatatctgtcacaatcaggatgggtattcgtacccatctaggcaaatggtgtcccttgaggatgacgtcgcg

SEQ ID NO: 16244 - DNA, 2580 bp, Artificial Sequence
  Description of Artificial Sequence: Synthetic coding sequence
atggggccctggggctggaaactgcgctggacagtggccctcttgcttgcagcggcagggacagccgtcggggatcggtgtgagcgaaatgagtttcagtgccaggatggaaagtgcatcagctataaatgggtgtgtgacggaagtgctgagtgtcaggacggctccgacgagtcccaggaaacttgcttgtcagtgacctgtaagtcgggggatttctcttgcggggggcgggtcaatcggtgcatcccccagttttggaggtgcgacggccaggttgattgcgacaacggaagcgatgagcagggctgcccacccaaaacatgttcacaggatgaatttcggtgtcacgacggaaagtgtatctcccggcagttcgtatgtgatagcgatagggattgcctagacgggtcagatgaggcctcttgccctgttctgacatgcggacccgcctcattccagtgcaacagtagtacctgtattccccagctgtgggcctgtgataatgatccagactgtgaggacgggtctgacgagtggccgcagcgctgtcggggattatatgtgtttcagggagacagtagcccctgcagcgcgttcgagtttcactgcctcagtggcgaatgcattcacagtagttggagatgcgacgggggacccgactgcaaggacaagagcgatgaagagaactgcgcggtcgcaacatgccgtccagacgagttccagtgctcagacggcaactgtatccatgggtctaggcagtgtgatcgtgagtacgactgcaaggacatgtcagacgaagttgggtgtgtcaatgtgaccttatgcgagggaccaaacaagtttaaatgtcatagcggggagtgcatcaccctggacaaggtctgcaacatggcacgtgactgtagagattggtctgacgagccaatcaaggaatgcggaacaaacgcttgtttggataataatggtggctgctcccacgtgtgtaacgatttaaaaatcggttacgaatgcctgtgtcccgatggctttcagctcgtagcccagcggaggtgcgaagatattgacgagtgccaggacccagatacctgttcccagctatgcgttaacctggaaggaggttacaaatgccagtgcgaggaagggttccagctggatccgcatacgaaggcgtgcaaagccgtggggagcatcgcatatctgttcttcacaaacaggcatgaggtcagaaaaatgactttggatcgctctgagtacacgagtttgatccccaacctgcgaaatgtcgtcgcactagatacagaggttgcaagcaatagaatctactggagtgatctgtcacagaggatgatttgtagcacccagcttgaccgagcccacggcgttagttcttatgatacggtgatatctagggacatacaggcgccggacgggctggcagtggattggatccatagcaacatatattggacagactcggttctcggcacagtctccgtcgccgacaccaagggcgtgaagagaaaaactcttttccgcgaaaatggaagtaagccccgtgctatagttgtggatcccgtacatggttttatgtactggactgattgggggacccccgccaagatcaaaaaaggcggactgaatggagtagacatttattccctcgtgacagagaacatccagtggcccaatggtatcactctcgacctgctgtctggccgactgtactgggtagatagcaagctgcacagcatttcctccatcgatgtcaacggcgggaacagaaagacgattttggaagacgagaagaggcttgcccacccgttttccctggcagtgtttgaagataaagtgttttggaccgatatcatcaatgaagccatcttttctgccaacagactaaccggtagcgacgtaaacctgctcgccgaaaacctgctgtcacccgaggacatggtcttgttccacaatttaacgcagccccgcggcgtcaattggtgcgagcggactacattgagtaacggaggatgccagtatttgtgcctcccggcaccgcagattaacccccatagtccgaagtttacatgcgcttgccctgatggtatgctactggcacgggacatgcgttcttgtctgaccgaagccgaggcagccgtggccacacaggagacctctacagtgagactgaaggtgtcgtccaccgcggtgcggacacagcacacaaccacacgccctgtccccgacacctcaaggctgccaggggccacaccagggctcacaaccgtcgagatagtcaccatgtctcatcaggccctgggcgacgtagcagggaggggtaatgagaagaaaccctcaagcgtcagagcactgtcaattgtcctgccaattgttctgctggtttttctgtgcttgggcgtgtttctgctgtggaagaattggcgcctgaagaacatcaattcaatcaatttcgataatccagtgtatcagaaaaccaccgaggacgaggttcatatctgccacaaccaggacggttactcctacccgtcccgccagatggttagcttagaggatgacgtggct

SEQ ID NO: 16245 - DNA, 2580 bp, Artificial Sequence
  Description of Artificial Sequence: Synthetic coding sequence
atggggccatggggatggaaacttcgctggaccgtggcactccttcttgccgctgcaggaaccgcagtcggagatcgatgtgagagaaacgagttccagtgtcaggatggaaagtgtatttcgtataagtgggtgtgtgatggctcagctgaatgtcaagatggttcggatgaatctcaagaaacgtgtctgtcagttacctgtaaatctggagatttctcgtgcggtggaagagtaaacagatgcatcccacaattttggagatgcgacggacaggtggactgtgataacggatccgacgagcaaggttgccctcccaaaacctgctcccaggacgagtttagatgccacgacggaaagtgtatctcgagacagtttgtgtgtgacagcgatcgggattgtctcgacggctcagatgaagcaagctgccctgtgcttacctgcggtcctgcatcctttcaatgcaacagctcgacctgtattccacagctttgggcctgtgataacgaccccgactgtgaagatggatcagacgaatggccgcagcgttgccggggactctacgtgttccaaggcgattcatcaccctgcagcgctttcgagttccattgtttgagcggtgaatgcatccattcctcctggaggtgcgatggcggtcctgactgtaaagataaatcggacgaagagaattgtgcagtggccacctgccgacctgacgaattccagtgcagcgatggcaattgtatacatggatcgagacagtgcgaccgtgaatacgattgcaaggatatgtccgacgaagtcggatgcgtgaacgtgactctctgtgaaggcccgaataagttcaagtgtcatagcggggaatgcatcactctggataaggtgtgtaatatggcaagagactgccgcgactggtctgatgagcctataaaggaatgtggaaccaacgcctgtctcgataacaacggtgggtgctcccatgtgtgtaacgacctcaaaattggctacgaatgcctctgtcctgatggatttcagctggtggcgcagcgaagatgtgaggatattgatgagtgccaggaccctgacacctgttcccaactttgtgtgaacctggaaggaggctacaaatgtcaatgtgaggaaggattccaacttgatcctcataccaaggcatgtaaggcagtgggcagcatcgcctacctgtttttcactaacagacatgaggtgagaaagatgactcttgatcggtcagaatacacttcgcttataccaaatctgagaaacgtcgtggctctggatactgaagtggcatccaataggatttactggtcggaccttagccagcggatgatttgctccacccaactcgatagagcccatggcgtgtcgagctacgacaccgttatttcacgggatattcaagcccctgatgggcttgccgtggactggatccattctaacatatactggactgattcggtcctgggtaccgtgtcagtggccgataccaaaggcgtcaagcgtaagaccctttttcgcgagaacggatccaagccacgagcaattgtggtggatcctgtgcacggattcatgtactggacggattggggcacccccgcgaagatcaagaaaggtggtcttaatggtgtggacatctattcgctcgtcaccgaaaacatccagtggccgaacggtattacgttggatctgctgtcgggacgcctgtactgggtggatagcaaacttcactcaatttccagcatcgatgtgaacgggggaaaccgcaagaccattcttgaagatgagaagcgtctggcacaccctttttccctcgcagtgtttgaagataaagtgttttggaccgacattatcaacgaagccattttctcggcaaaccgcctcacgggcagcgatgtgaatttgttggccgagaatctgctcagtccggaagatatggtcctgtttcacaatctgactcagcccagaggtgttaactggtgtgagcgcaccaccctttccaacggcggctgccagtacttgtgccttcctgccccccaaatcaatccgcacagcccgaaattcacctgtgcatgtccagatggtatgctgctggcacgtgatatgaggtcctgccttaccgaagcggaagcagccgtggccacccaggaaacctcgactgtcagactgaaagtctcctccaccgcggtgcggactcaacacaccaccacgaggcctgtccctgatacttcccggcttcccggagcaactcctggattgactactgtcgaaattgtgaccatgagccaccaggcactcggtgacgtggcaggacggggtaacgaaaagaagccctctagcgtgagagccttgtctatcgtactcccaattgtgcttcttgtgtttttgtgcctgggcgtgttccttctgtggaaaaactggcgacttaagaacataaactcgatcaattttgacaacccggtttaccaaaaaacgactgaagatgaggtgcatatttgccataatcaagatggatacagctacccttcacgacagatggtcagcctcgaagatgatgtcgca

SEQ ID NO: 16246 - DNA, 2580 bp, Artificial Sequence
  Description of Artificial Sequence: Synthetic coding sequence
atggggccatgggggtggaagctcaggtggaccgtggcactgctattagctgccgccggaactgctgtgggagatcggtgtgaacgcaatgagttccaatgccaggacggcaaatgcatctcctacaaatgggtttgcgacggttctgccgaatgtcaggatggaagcgacgaaagccaggagacttgcctttccgttacatgtaaaagtggcgacttttcctgcggcggccgcgtgaacagatgcataccccagttctggcgttgcgacgggcaggttgactgtgataacggatctgatgaacagggctgtccacctaagacctgctctcaggacgaattcaggtgtcacgatggcaaatgcatttcgcggcagtttgtctgcgattctgaccgcgactgcttagacggttctgacgaggcatcctgtccagtcttgacttgtggcccagcaagttttcagtgcaactcatcgacatgcattcctcagctctgggcatgtgataacgacccagactgcgaggacggttccgatgagtggccacagaggtgtagagggctgtacgtgttccagggggactcttctccatgctccgcattcgagttccattgcctttccggagagtgtatacactcaagttggcggtgtgatgggggccccgattgtaaggacaagtctgacgaggaaaactgcgctgtggcgacctgcagaccggatgaatttcagtgcagcgacggtaattgtatccacggaagtcgccagtgcgatagagagtacgactgtaaagacatgtccgatgaggttggctgcgtgaatgttacactgtgtgaaggacctaacaagttcaaatgtcactctggagaatgtataaccctcgacaaggtttgcaacatggccagagactgtcgggattggtctgacgaacctatcaaggagtgcggaacgaatgcttgcttggataacaatggcggatgttcccatgtgtgcaatgatctcaaaatcgggtacgagtgtctgtgccccgacgggtttcagctagtggcccagcgcagatgtgaggatatcgatgaatgtcaggaccctgatacctgttcccagctgtgtgtgaacctcgagggcgggtataagtgccagtgcgaagaggggttccagctggatccccacaccaaggcatgtaaggcagtgggctctatagcctatctgttcttcacaaatcgccacgaggtgagaaagatgactctggaccggtccgagtacacctccttaataccgaacttgcggaacgtggtggcgctcgataccgaagtcgcttcaaacaggatctactggagcgatctttctcagaggatgatttgcagtacgcagcttgatcgtgctcatggcgttagctcgtatgataccgtcatctcgagggacatccaggccccagacggattggcggtggactggatccattcaaatatttattggaccgatagcgttttggggaccgtgtcagtggccgatactaagggcgtaaagcggaagaccctatttagggaaaatggctcaaaaccccgcgccatcgtggtggaccccgtccacggattcatgtattggacggactgggggacacccgccaagatcaaaaagggagggttgaatggcgttgacatttattctctggtgacagagaatatacagtggccaaacggaatcacccttgaccttcttagcggcaggctctattgggtggattccaaattacacagtatctcatcaatagacgtcaacgggggaaatagaaagacaatcctcgaagacgagaagcgcttggctcaccccttttcgctcgcagtcttcgaagataaagttttttggacagatataataaacgaagccattttttctgccaaccgattaaccggaagcgatgttaatcttctggccgagaacctgctgtcccctgaagacatggtcttgttccataatctgactcagcctaggggggtcaattggtgcgagaggacaacccttagcaacgggggctgtcagtacctgtgtttgccagccccgcagatcaatcctcactcccctaaatttacttgcgcctgccccgacggcatgctgctggctagagatatgagatcctgcctgaccgaagcggaggcggcggtcgcgacccaggaaacatcaactgtgaggctgaaagtttcatccaccgcagtgcggacccaacacacaaccacgagaccagtcccagatacatctcggctgccaggggccacacccgggctgacaacagtcgaaatagtcaccatgagccaccaggccctgggggacgtcgccggcagaggaaacgagaagaagccttcctctgtgcgggccctgtctatcgtgctgcctatcgtactgctggtgttcttgtgtttgggagtctttctcttgtggaaaaattggcgactcaagaatattaacagcattaactttgataatcccgtatatcagaagactactgaggacgaggtacacatttgtcataatcaggatggctattcatatccctcacgccagatggtgtccctggaggacgatgtcgca

SEQ ID NO: 16247 - DNA, 2580 bp, Artificial Sequence
  Description of Artificial Sequence: Synthetic coding sequence
atgggaccttggggctggaaacttcgctggaccgtggcccttcttttggctgcagctggaaccgcagtgggcgatcgttgcgaaagaaatgagtttcaatgtcaggatggtaaatgtattagctacaagtgggtgtgcgatggatccgcggaatgtcaagatgggtcggatgaatcccaggagacttgtctgagcgtcacgtgtaagtcaggagatttttcgtgtggaggaagagtgaaccgatgcattcctcagttttggcgctgcgatggacaggtcgattgtgacaacggttcggatgagcagggttgtcctcctaagacctgtagccaagatgagttccgatgccacgatggtaagtgcatatcgagacaatttgtgtgtgactcagatcgggactgtcttgatggaagcgatgaagcgtcatgccctgtcctgacctgcggaccagcatcctttcaatgtaattcgagcacctgcatcccacaactctgggcatgtgacaacgatcccgattgtgaagatggtagcgatgaatggccacagcgctgtcgcggtctttacgtctttcagggagattcctcaccatgttcggcatttgagtttcactgtcttagcggagaatgcatccactcgtcgtggcggtgcgacggaggaccggattgtaaggacaaatccgatgaagaaaattgcgcggtcgctacttgtcgaccggatgaattccagtgtagcgatggaaactgcatccatggttcaaggcagtgtgacagagaatacgattgcaaggatatgagcgatgaggtgggctgtgtgaatgtaaccctttgtgaaggacctaacaagtttaagtgccattcgggcgaatgcattactcttgacaaggtttgcaatatggcacgtgattgtcgtgactggtcggacgaaccaattaaggagtgcggaaccaacgcatgcctggataacaacggagggtgctcacacgtctgcaacgatcttaagattggatacgaatgtttgtgccccgacggattccaactggtggcgcagcggcgatgtgaagatatcgatgagtgtcaagaccctgacacttgctcccagctgtgcgtcaacctcgaaggaggatacaagtgtcagtgcgaggaaggctttcaactcgatcctcatactaaggcatgtaaagcagtgggttcaatagcatacttgtttttcaccaaccgacatgaagtgagaaaaatgacccttgatcgatcggaatatacctcgctgatcccaaaccttaggaacgtggtggcactcgatactgaagtggcttccaacaggatttactggtcagatctgtcgcagcgcatgatttgctccactcaactggaccgcgcacatggagtgtcctcgtacgatactgtgatctcccgcgacatccaggcccctgacggtcttgcggtcgactggatccattcgaatatctactggaccgattccgtgctggggactgtgtcggtggccgatactaagggcgtgaagagaaagaccctttttagggaaaacggttcgaaaccgagagcgattgtggtcgacccagtgcatggctttatgtactggaccgactgggggaccccagccaagataaagaaaggtggactgaatggagtggacatctactcactcgtcacggagaacattcaatggccaaacgggatcactcttgacctgctttcgggcagactgtactgggtggatagcaagctccattccattagttcaattgacgtaaacgggggtaatcgaaaaactatacttgaagatgagaagcgactcgcacatccctttagcctggcagtgtttgaggataaggtgttttggactgacataatcaacgaagccattttctccgcaaacagactgaccgggagcgacgtgaatttgcttgctgaaaacttgctgtcaccagaggatatggtgctgtttcataacctgacccagccccgtggtgttaactggtgtgagcgaactaccctgtcgaatggaggttgccaatacttgtgcctgcctgcgccacagatcaaccctcattccccaaagttcacttgcgcttgcccggatggaatgctgctcgcacgggatatgcgcagctgtctgaccgaggccgaagcagctgtggctacccaagaaaccagcactgtgcgccttaaggtcagctccacggccgtgaggactcagcatacgactaccagaccagtccccgatacttcgagactgccaggtgccacccccggtctgactaccgtcgagattgtgacgatgagccaccaagcacttggagacgtggcaggaagagggaacgaaaagaagccatcgagtgtgcgtgcattgtccatagtcctccctattgtcctgctggtgtttctttgtctcggagtgtttctgctctggaagaattggcggctcaagaacattaactccatcaacttcgacaatccggtctaccagaaaactactgaggatgaggtccatatctgtcataaccaggacgggtattcatacccgtcccgtcaaatggttagcctggaggacgatgtggca

SEQ ID NO: 16248 - DNA, 2580 bp, Artificial Sequence
  Description of Artificial Sequence: Synthetic coding sequence
atggggccttggggatggaagcttagatggacagtggctctcctattggctgccgctggaaccgctgttggagaccgttgcgaacggaacgagtttcagtgtcaggatggcaagtgtatctcttataagtgggtatgtgacggcagcgccgagtgtcaggacgggagcgatgagagccaggaaacatgcctatccgtcacctgcaaatcgggcgatttttcttgtggtggacgagtgaaccgctgtattccacagttctggcggtgcgacggtcaagtggactgtgataatggaagcgacgagcaggggtgtccccccaagacttgctctcaagacgagttccgctgccatgacgggaagtgcatttcccgtcaattcgtatgcgattcagacagggactgtctggatggatccgatgaggccagttgccctgtgctgacctgcggacccgcatccttccagtgcaactcaagcacttgcatccctcagctgtgggcctgcgacaacgaccccgattgtgaagatggttccgatgagtggccgcagcgctgtcgaggactgtatgtctttcagggtgattccagcccgtgttccgctttcgaatttcattgcctgtcaggcgaatgtattcactcctcctggcgctgtgacggcggccccgattgtaaagataagtcagatgaagagaactgcgccgttgccacttgccgcccagacgaatttcaatgttcagacggaaactgtattcacggcagcagacagtgcgatcgcgagtatgattgtaaagacatgtctgacgaggtgggttgtgttaatgtcactctctgtgagggccctaataagttcaaatgccactctggagaatgtataacactcgataaggtatgtaacatggcgcgagattgtagggattggagcgacgagccaattaaagaatgtgggaccaatgcctgtttagataacaacggggggtgttcccacgtctgcaatgatcttaaaataggatatgaatgtctgtgccctgacgggtttcagctggttgcccagaggaggtgcgaagacatcgatgaatgccaggatcctgatacctgttctcagctgtgtgtcaatctggaagggggatacaaatgtcagtgcgaagaaggcttccaattggatcctcataccaaagcgtgcaaggctgtgggatccatcgcctacttatttttcacaaaccgccatgaggttcgcaagatgacactagatcgttccgaatatacctctctgatccccaacctccgcaatgtcgtcgcgctggataccgaggttgcaagtaatcgcatatactggtctgatctaagccagaggatgatttgttcaacgcagctagaccgggcacatggcgtgagttcctacgacaccgtgatcagtagagacattcaagcaccagacggcctggccgttgattggattcatagcaacatctattggacagattctgttctcggaaccgtttcagtagcagatacaaagggcgtcaaacggaaaactctgttccgtgaaaatggatcaaaaccacgcgccatcgtggtggaccccgtgcacgggttcatgtactggaccgactggggcactcccgccaagatcaagaaaggcgggctgaacggggtggacatctattcactcgtgaccgaaaacatacagtggccaaatggaatcaccctggatttgctgtcgggtcggttgtattgggtggattccaagctgcatagcatttccagtattgatgtgaacggtgggaatagaaagacaattcttgaggacgagaagcggctggcacacccttttagcctcgccgtgttcgaggataaggttttttggaccgatatcatcaatgaggccatcttcagcgctaacagactgactggaagtgatgtgaatctccttgcagaaaatttgctgagccctgaagatatggttctctttcataacttgacccaaccaagaggcgtgaattggtgtgagcggaccaccttgagtaacggagggtgtcagtacctgtgccttcccgccccacagatcaatccgcactcacccaagttcacttgcgcatgccctgacggcatgctcctggcgcgtgacatgagatcctgtctcactgaagccgaggctgccgtagctacccaggagacatcaacagttcgactgaaggtgtctagcacggccgtgcggactcagcataccaccaccaggccagttcccgacacttctcggttgcccggcgccacacccggactgaccacagtggaaatcgtcacaatgagtcaccaggcactgggagacgtggctggcagagggaacgagaagaagccttcttctgtccgggccctatccattgtgctgcctattgtcctgctggtgttcctttgtctgggggttttcctcctgtggaagaattggagactaaaaaatataaactccattaattttgataacccagtatatcaaaaaaccactgaggacgaggttcatatttgtcataatcaggacggatactcatacccatctcggcaaatggtgagcctagaggatgatgtggct

SEQ ID NO: 16249 - DNA, 2580 bp, Artificial Sequence
  Description of Artificial Sequence: Synthetic coding sequence
atgggtccttggggctggaaactgagatggactgtggcattgcttttggctgccgccggaactgccgttggcgaccggtgtgaacgtaatgagttccaatgtcaggacgggaagtgcattagctataagtgggtttgtgacggcagtgctgaatgtcaggatggctctgacgagagtcaagaaacctgtctctctgtgacttgcaaatccggagacttcagttgtgggggcagagtgaaccggtgtattccacagttttggagatgtgacggccaggtagattgcgataacggcagcgacgagcaggggtgtccaccaaagacgtgttcccaagacgagttcaggtgccatgacgggaagtgcattagccgacagttcgtctgtgactcagatagggactgtctagacggctccgacgaggcatcctgccctgtactgacatgtgggcctgccagctttcagtgcaacagtagcacctgcatcccacagctttgggcctgcgacaacgatcccgattgcgaggatgggagtgacgaatggccccaaagatgcagaggactgtacgtcttccagggcgacagtagtccttgctcagcctttgagttccactgtctgagcggcgaatgtatccactcctcatggagatgcgacggcggtccggactgtaaggacaaaagcgatgaggagaattgtgcagtcgcaacttgtaggcctgatgagttccagtgtagcgacggaaactgcattcacggttcccgacagtgcgatagggagtatgactgcaaggatatgtccgatgaggttggttgcgtgaacgttacactgtgcgagggcccgaataagtttaaatgccattcaggagagtgtataaccctggataaggtgtgcaatatggcccgtgactgccgtgattggagtgatgaacctattaaggaatgcggtaccaacgcctgtctggacaacaacggagggtgtagtcatgtctgcaacgatttgaagattggttatgagtgcctgtgccccgacgggtttcagctggttgctcaacgccggtgtgaggatatcgatgaatgccaggatcccgatacttgtagccagctttgtgtcaatcttgagggcggatacaagtgtcagtgcgaggaaggttttcaactcgatccgcacaccaaagcctgtaaggcggtgggcagcattgcttacctgttcttcaccaaccgacacgaggtacgcaaaatgaccctcgaccgaagtgagtacacctccctgatcccaaatctgagaaacgttgttgcactcgacacggaggtggctagcaatcggatttattggagcgacctctcacaacgcatgatatgtagtacccagttggacagagcccatggcgtcagttcgtacgacactgtgatatcccgcgacatccaggctccagatgggctggccgttgactggatacattcgaacatatattggactgatagcgtgctcggtacagtctccgtagccgacacgaagggcgtcaaacggaagaccctatttagagagaacggctctaaaccacgcgcgattgttgttgatccggtgcatgggttcatgtattggacggattggggaacccccgccaagatcaaaaaggggggcttgaatggagtcgatatttactctctagtgacagaaaacatacaatggcctaacgggattacactcgacctgctctccggccggctgtattgggtcgactccaaacttcacagcatctcttctatcgacgtcaacggtggtaataggaagactatcctggaggacgagaagcgtctagcacacccattttcccttgctgtgtttgaagataaagtattctggactgatataattaacgaggccatttttagcgccaacaggctgaccgggtccgacgtgaatttgctggccgagaacttgttgagtccagaagatatggtgcttttccataatttgacccagcctagaggggtcaactggtgcgagcgcaccacgctgtcaaatggtggctgccagtatctgtgtttgcctgccccacagatcaatcctcactcccctaaatttacctgtgcttgccctgacggaatgctcctggcgcgagatatgcggagctgcctaactgaggccgaagccgctgtggccacccaggagacctcaacagtgaggctgaaagtgtcatccaccgccgtgcgcacacagcacactaccaccagacccgtgcccgacaccagcagattacctggcgctactcctggcttgaccacagtggagatagtaacaatgagccaccaggccctgggcgatgtagccggcagagggaatgagaaaaagccttcctcagtgcgggccctctctattgtactcccaatagtcctgctcgtttttctctgtttaggggtgttcttgctgtggaagaactggaggctcaagaatattaattccatcaacttcgataacccagtgtaccaaaagaccacagaggatgaggtgcatatttgccacaaccaagacggttattcctatccttcgagacagatggttagccttgaggatgacgtggcc

SEQ ID NO: 16250 - DNA, 2580 bp, Artificial Sequence
  Description of Artificial Sequence: Synthetic coding sequence
atggggccgtgggggtggaagttgagatggacggtagccctgctgctggctgctgcaggaacagctgtaggagataggtgcgaaaggaatgagtttcagtgccaggatggcaagtgcatttcctataagtgggtgtgcgatggcagtgccgagtgtcaggacggcagtgacgaatctcaggagacttgtctctctgttacttgcaaaagcggagacttcagttgtggcggacgagttaatagatgcataccacagttctggagatgtgacggccaggtggactgcgacaatggaagcgacgaacagggctgcccaccaaaaacgtgcagccaggacgagtttcgttgccacgacggcaagtgtatcagcagacagtttgtgtgcgattccgaccgggactgtcttgacgggagcgacgaggcttcctgccctgtgctaacatgtggccctgctagcttccagtgtaactcctccacatgcatcccacaattatgggcctgtgacaatgaccctgactgcgaggatgggtccgatgagtggcctcagcggtgccgcggattatacgtgttccagggcgactcatccccctgttccgccttcgaatttcactgcttaagcggggagtgcattcactcaagctggcgctgtgacggggggccggattgcaaggacaaatccgacgaggaaaactgtgcagttgctacttgccggcctgacgaattccagtgctccgatgggaactgtatccatggttcgagacaatgtgatagagaatacgattgcaaggacatgtcagatgaggtgggatgcgtgaacgtcaccttatgcgaaggaccaaataaatttaagtgtcacagcggggagtgcatcactttggacaaagtctgcaatatggcgagggactgccgggattggagcgacgaacctataaaagagtgcggcacgaatgcatgtctcgataacaatggggggtgtagccacgtctgcaatgatttaaagataggttacgaatgtttgtgtcctgatggattccagctggtggcacagcgtcggtgtgaggacatcgacgagtgtcaggatccggacacatgctcacagctgtgtgtaaacctggagggagggtataagtgccagtgcgaggagggattccaattagatccgcataccaaggcctgcaaagctgttgggtctattgcctaccttttttttacgaaccgccacgaagttcgcaagatgacattggatcgatccgaatatacaagccttattcccaacttacgcaacgtagtggctctggacacagaagtagcctcgaataggatctactggtccgacctcagccaacgaatgatttgcagtacacaacttgaccgcgcccacggggtaagctcttacgacacagtgatatcacgggatatacaggcacctgatggactagcggtagattggatccatagcaacatttattggaccgattctgttctggggacagtttcggttgccgacaccaaaggagttaagagaaagactttgttccgtgaaaatggatccaagccccgggcgatcgtcgtggatcctgtgcacggatttatgtattggacagattggggcacccctgccaagatcaaaaagggaggtctgaacggtgtggacatatactcactggttaccgaaaatattcaatggcctaatggcatcacgctcgacctattaagcggtcgcctatactgggttgattccaagctccactcgatcagctccatcgatgtaaacggcggaaatcggaaaaccattctagaagacgagaaacgcttagcccacccattcagtctggctgtgttcgaagataaagtgttttggaccgatatcatcaatgaagcgatcttcagtgcaaataggctcacggggtctgacgtcaacctgcttgccgaaaaccttctgagtccagaggacatggtcctgttccacaacctaactcagccccggggagtcaattggtgcgaacgtactacattgtctaatggcgggtgtcagtatctgtgtctgccagcgcctcagattaatcctcactctccaaagttcacatgcgcctgccccgatggtatgctgttggcccgtgacatgcgctcttgtcttacagaggccgaggccgctgtggccacacaggagacctccacagtccggcttaaggtctccagtacagctgtgagaactcagcacacaacaaccagaccggtgccagacacctctaggctccccggagctactccaggactaactacagtggaaattgtgacgatgagccatcaagctcttggagacgtggctgggcgtggaaatgagaagaaaccatcgtcggttagagccctctctattgtactacctatcgtcctgctcgtcttcttgtgcctcggagtgttcttactttggaagaactggaggcttaaaaacattaacagcattaactttgacaatcccgtctaccagaaaaccactgaagacgaagtgcatatctgtcacaaccaggatgggtattcctacccctccaggcaaatggtgtccctggaagacgacgttgct

SEQ ID NO: 16251 - DNA, 2580 bp, Artificial Sequence
  Description of Artificial Sequence: Synthetic coding sequence
atgggaccgtggggatggaaacttaggtggacagttgcacttctgttagccgcagcaggaactgctgttggagatcgttgcgaacgaaatgaatttcaatgtcaagatggaaagtgtatttcatataaatgggtgtgtgacggatcagccgaatgccaggatggctccgatgagtcacaggaaacatgtttgagtgtgacctgtaagtcaggagatttctcttgcggaggaagagttaacaggtgcatcccccaattttggagatgcgatggacaagtcgattgtgataatggatctgacgagcaaggatgtccaccaaagacttgctcccaggacgaatttcggtgtcatgacggaaaatgtattagtcgccaatttgtttgcgattcggaccgtgattgcctcgacggaagtgacgaggcatcatgtcccgttttgacgtgtggaccagcgagtttccagtgcaatagttccacatgtattcctcaattgtgggcttgcgataacgatccggactgcgaggatggttctgatgaatggccgcagcgatgtcgaggactatacgtattccagggtgatagctcgccatgctcagccttcgaatttcactgtttaagtggagaatgtattcatagttcatggcgatgcgatggaggaccagattgcaaagacaagtccgatgaggagaactgcgccgttgcaacgtgtcgaccggacgaatttcagtgttcagacggaaactgtatccatggatcacgacaatgtgaccgagaatacgattgcaaagatatgtccgatgaggtgggctgtgtgaatgttaccctctgtgaaggaccaaacaagttcaaatgccatagtggggaatgtattacgttggacaaggtttgcaacatggcaagagattgccgagattggtctgatgaaccgatcaaagagtgtggcacaaacgcttgtctggataacaacggaggttgttcgcatgtttgcaacgacttgaagataggctatgaatgcctctgtcctgatggatttcaacttgtcgctcaaagacgttgcgaggatatcgacgagtgccaggacccagatacatgttcacaactttgtgtcaacttggaaggaggatataagtgtcagtgtgaggaaggattccagttggacccacatacaaaagcttgtaaggcagtcggtagtattgcatacctattttttaccaatcgtcatgaagtgcgaaagatgacgctggatagaagtgaatacacatcccttattccgaatttgcgtaatgtagttgctcttgatactgaggtggcttcaaaccgcatctattggtcagacctctcacaacggatgatctgtagtacacaattggaccgtgctcatggtgttagctcatacgatactgttattagccgggatattcaggctccagacggattggcagtagactggatccattctaatatttattggaccgattccgttctaggaacagttagcgtcgcagatacaaaaggagtcaagagaaagactctttttcgagagaatggctcaaagccccgagctattgtagttgatccagtgcatggatttatgtactggactgattggggcacaccagctaaaatcaagaagggaggcttgaatggagttgacatttacagtttggttacagagaacattcaatggcctaatggaataactctggatcttctttcaggaaggctgtattgggtggattcgaaactccatagtatttcttctatcgacgttaatggaggaaatcgaaaaactattctcgaagatgaaaaaagacttgctcacccattctcccttgctgtgtttgaagacaaggttttttggacagatattattaacgaagcaatcttttcagcgaatcgcttgactggctctgatgtgaatttactggcggaaaatctgctttcgccagaagatatggtactttttcacaatctcacccagccacgtggagtcaattggtgcgagcgaacaacactgtcaaatggtgggtgtcaatatttgtgcttgcccgcccctcaaattaatcctcactctccgaagtttacatgtgcctgtccagatggaatgctcctggcccgtgatatgaggagttgccttactgaagcagaagctgcggtggcaacacaagagacgtcaactgtcagattaaaagtttcaagcacagctgttcgaacccagcatactactacgaggccagttccagatacttcacgtttgccgggagcgaccccaggtcttacgactgtcgagatagttacgatgtcccatcaggctttaggagatgtcgccggacgcggaaatgaaaaaaaaccatcatcagtgcgtgccctgagtatcgtgctgccaattgtcctactggttttcctgtgtctaggtgtatttttattgtggaaaaattggcgtctcaaaaatattaattcgattaattttgataatcctgtttaccaaaaaacgacggaggatgaggtgcatatctgccacaatcaagacggctactcatacccatcgaggcaaatggtttctttagaagacgatgtcgct

SEQ ID NO: 16252 - DNA, 2580 bp, Artificial Sequence
  Description of Artificial Sequence: Synthetic coding sequence
atgggaccttggggatggaagctgagatggaccgttgccctgctgctcgccgcagctgggactgctgtgggcgataggtgtgagagaaatgaatttcaatgtcaggacggtaagtgcatttcatacaagtgggtgtgtgacggaagcgccgaatgccaagatggtagcgatgagtcccaggaaacttgtcttagcgtcacttgtaagtctggagattttagctgtggaggacgggtcaatcggtgtatccctcaattctggcgatgtgacggtcaggtcgattgcgataacggttccgacgaacaggggtgccctcctaagacctgctcgcaagatgagttccgatgccacgatggtaaatgtatctcgagacagtttgtctgcgatagcgacagagattgtttggacggatcagatgaggccagctgccccgtcttgacttgtggaccagcttcctttcaatgtaacagcagcacttgtataccacaactgtgggcatgtgataacgatcctgattgtgaggatggatccgatgaatggccccaacgctgccgcggactctacgtgtttcagggcgattcgtcaccttgttccgcattcgaattccattgcctctccggcgaatgtattcactcttcctggcgttgcgacggtggcccagactgtaaggataaatcggacgaggaaaactgcgcagtggcaacttgtcgacccgatgagtttcagtgtagcgatggtaactgtattcacgggtcacgccagtgcgaccgggagtacgactgtaaggacatgtccgatgaggtggggtgcgtgaatgtcaccctgtgtgaagggcctaacaagtttaagtgtcattcgggagaatgtattacgctggataaagtgtgtaacatggcccgggactgccgcgattggtccgatgaaccgatcaaggaatgtggaactaatgcatgcctggataacaatggggggtgtagccatgtgtgtaacgatctgaaaattggatacgaatgtctctgccctgatggatttcagcttgtggcgcagagacggtgtgaggacattgatgaatgtcaggatccagatacttgctcgcagctgtgcgtgaacctggaaggcggttataagtgccaatgcgaagaaggttttcaactggatcctcataccaaggcatgtaaggcagtggggtcgatcgcctaccttttctttaccaaccgccacgaagtgagaaagatgactcttgacagatcagaatacacctcactgatccctaacttgcggaacgtggttgcgctcgatactgaagtggcatccaaccgcatctactggagcgacctgtcgcaacgaatgatctgctcgacgcaactggacagagcccatggggtatcgtcctacgacacggttatatctagggatattcaagcaccagatggactggcagtcgattggattcattcgaacatttactggactgattccgtcctgggaactgtgtccgtggccgacactaaaggagtgaagagaaaaaccctgttcagagagaatgggtcgaagcctcgggcaatcgtggtggatccagtccatgggtttatgtactggacggactggggcactccagccaagattaagaagggtggactcaacggcgtggatatctactcccttgttactgagaacattcagtggcctaacggtatcaccctggacctgctttccggaaggctctattgggtcgactcaaagctgcattcgatcagctcgattgacgtgaacgggggcaataggaaaacgatactggaagatgaaaagagacttgcacaccccttttcccttgcggtgttcgaagataaggtgttctggactgacattatcaacgaggccattttctcggcaaatcgcctgaccggctccgatgtcaacctgcttgcagagaacttgttgtcccccgaggatatggtgctgttccataacctgacccagccacgtggggtgaactggtgtgaaaggactactctctcaaacggtggctgtcagtacttgtgtctgccagcacctcagattaatcctcattcgcccaagttcacctgtgcgtgcccagatggaatgcttctcgccagagatatgcgctcttgtcttactgaagcagaagcagcggtggccactcaggaaacctctaccgtgcgcctgaaagtttcgtcgactgccgtgcggacgcaacacactaccaccagaccggtgcctgatactagccggctgcctggtgctactcctgggctgacgaccgtggagatcgttactatgtcacaccaggcactcggtgacgtggcaggtaggggaaatgaaaagaagccttcctcggttcgtgcactctcgatcgtgcttcccattgtccttcttgtttttctgtgtctgggcgtgttcctcctttggaagaactggaggttgaagaacattaactcgattaacttcgacaacccagtgtaccaaaagacgaccgaggacgaagttcacatctgtcataatcaggatggttactcctacccctcgcggcaaatggtcagcctggaggacgatgtggca

SEQ ID NO: 16253 - DNA, 2580 bp, Artificial Sequence
  Description of Artificial Sequence: Synthetic coding sequence
atgggcccctgggggtggaagctgcggtggaccgtggccttattgcttgcagctgctggaacagcagtgggagatagatgcgagcgaaacgagttccagtgccaggacggtaaatgcatttcctataagtgggtgtgcgatggaagtgccgaatgccaggatgggtctgacgagagccaggagacatgtctgtccgtgacctgtaaatccggtgatttctcctgcggcggaagagtgaatcggtgcattccgcagttctggcgttgcgacggtcaagtggactgtgataatggtagtgatgagcaaggctgcccccccaaaacctgctcccaagacgaatttcgctgccatgatggaaaatgtatctcaaggcaattcgtgtgtgacagtgatagggactgccttgacgggtccgacgaagccagctgccctgtgttgacctgcggccccgcatctttccaatgcaactccagcacctgtatcccacaactgtgggcttgtgacaatgaccctgattgcgaagatggatcagatgaatggccacagaggtgtcgtgggctgtatgtgtttcaaggagatagcagcccttgctccgctttcgaatttcattgcctgagcggcgaatgtatccacagcagttggcgatgtgatggaggacctgactgtaaagataagtcagacgaggaaaactgcgctgtcgcaacatgtagaccagacgagttccaatgctccgatggaaactgtatccacgggagccgccagtgtgacagggaatacgactgcaaagacatgtcagatgaagtgggatgtgtcaacgtcaccctgtgcgaggggcccaataaattcaagtgccacagtggagagtgcatcacacttgacaaggtgtgcaatatggctagggattgtagggactggagcgacgaaccgataaaagagtgcgggactaatgcatgccttgacaacaacggtggatgttcccatgtgtgtaacgatctcaaaattgggtacgagtgcctgtgtcccgacggatttcaactggtggcccagcgcaggtgcgaagacatagacgagtgccaggatcctgacacttgtagccaactctgcgtgaacctggagggaggctataagtgccagtgcgaggagggatttcagcttgacccacatacaaaggcttgtaaagcagtcggctccatcgcatatctgttttttaccaaccgccacgaggtcagaaaaatgacactagataggtcagaatatacctctttgattcccaacctccggaacgtggtcgcactggacaccgaggtcgcctcaaacaggatttattggagcgacctgtcacaaaggatgatttgttctacgcagctggacagagcccacggcgtaagttcttacgacacagtcattagcagagatatccaagcaccggacggtctggcagttgactggatccatagcaacatttactggactgacagcgtgctgggaacggtgtcagtcgcagacaccaagggggtgaaacggaaaaccttgttccgcgagaacggatctaaacccagggcgatcgtggtggatccggtacacggatttatgtattggacagattggggcacccccgccaagatcaaaaaaggcgggcttaacggcgtggacatatatagtttggtaaccgagaacatccagtggccgaatggcatcacattggacctcctcagcgggaggctttactgggtggactctaagctgcatagcatctcttctattgatgtgaatggcgggaaccggaaaactattctggaggacgagaagagactcgcacacccattcagcctggccgtcttcgaagataaggttttttggaccgatattattaacgaagccatcttttctgctaataggctcaccggatcagatgtcaatctcctggctgagaacctgctgagtccagaagacatggtgctgttccataatcttacacaacctaggggcgtcaactggtgcgagagaacaacacttagcaacggaggctgccaatacctgtgtctccccgctccccagataaacccccactcgccaaaatttacttgcgcttgtccagatggaatgctgctggcaagggatatgagatcgtgcctaactgaggcagaagcggctgtggctacacaggagactagcacagtgcggttgaaggtgtcctcaaccgctgttaggactcagcacaccactacaaggccagttccggatacctcacgtctacccggagccactccaggtctgaccaccgttgagatcgtaactatgagccatcaggctcttggcgatgttgccggccgaggtaacgaaaaaaaacccagctcagtgagagcattgagcattgtgttaccaatcgtcctgttagtctttctttgtttgggcgtctttcttttgtggaagaactggagactcaaaaatatcaattccatcaactttgacaatcccgtttatcaaaaaaccaccgaggacgaagtccatatctgccacaatcaagacggatactcctacccaagcagacagatggtgagcttggaagatgacgttgcg

SEQ ID NO: 16254 - DNA, 2580 bp, Artificial Sequence
  Description of Artificial Sequence: Synthetic coding sequence
atgggcccttggggatggaaactgaggtggaccgttgccttgcttcttgccgcagccgggaccgccgtgggagaccgttgcgagcgtaacgaattccagtgccaggatgggaaatgtatatcttataaatgggtgtgcgatggcagcgcagaatgccaggacgggagtgatgaatcacaggaaacttgtctgtccgtcacctgtaagtcgggcgatttttcctgtggtgggagggtgaaccggtgtattccccagttctggcgctgcgatggccaggtggactgtgataacggctctgacgagcagggctgtcctcctaagacctgttcccaggacgagtttagatgtcacgatgggaagtgcattagcaggcagttcgtctgcgattctgaccgtgattgcctggatgggtcagatgaggccagctgtcctgtattgacttgtggtccagcctcctttcagtgtaatagttctacctgtattccccagctgtgggcttgtgacaacgatcctgactgcgaggacggttctgatgagtggccccaacgatgtagaggcctgtatgttttccagggtgacagctctccctgctcagcctttgagttccactgcctatccggggaatgtatccactcttcatggagatgcgacggggggccagactgcaaagacaagagcgacgaggagaactgcgctgtggccacttgcaggccagatgaattccaatgctcagatggcaactgcattcacggtagccggcagtgcgaccgcgagtatgactgtaaggacatgagtgatgaggttgggtgtgtcaatgtaactttgtgcgagggtccgaacaagttcaagtgtcatagtggagagtgtatcacactggataaggtctgcaatatggcccgagactgtagggattggtcagatgaacccatcaaagagtgtggtacgaatgcgtgcctggataacaacggagggtgcagtcacgtgtgtaacgacctcaaaatcggatatgaatgcctttgtcccgatgggttccaactggtggcccagaggaggtgtgaagacattgacgagtgccaggaccctgatacttgcagtcagctgtgtgtgaacctggagggaggttataagtgccagtgtgaggaaggattccaattggacccacatacaaaagcatgcaaggcggtaggatcgatagcttatctgttcttcacgaaccgccacgaggtgcggaaaatgacactagatcggagcgagtatacatccctaatcccgaacctgaggaatgtcgtagcattagacacagaagtcgctagtaatcggatctattggtccgatctgtctcagcggatgatctgcagcacgcagctcgatcgggctcacggggtgtcttcctacgataccgtgatctctcgcgacatccaggccccggacggactggccgtcgactggattcactcgaatatctattggaccgacagcgtgctaggtacagtcagcgtggctgacaccaagggcgtgaaaagaaaaacactatttcgggagaacggatctaagcccagagctattgtcgttgatccagtccatggcttcatgtattggactgactggggcaccccagccaaaatcaagaaaggggggctcaatggtgttgatatatatagcttggtgactgaaaacattcaatggccaaacggaatcacactcgacctgctatccggaagactgtattgggtggactcaaaactgcatagcataagtagcatcgatgtcaacgggggcaacagaaaaactatattggaagatgagaaacgcttggcccaccctttcagcctggcggtctttgaggataaggtgttttggactgacattataaacgaggctatcttctccgcaaatagactcactggatctgacgtgaacctgctagccgaaaacctcctttcacccgaagatatggtcctctttcataacttaacacagccccgaggtgtgaattggtgtgagcggaccaccctgtccaacggcggatgccagtacctgtgtctgcccgcaccccaaattaacccacatagtcccaagtttacttgtgcatgccctgacgggatgcttctggccagagatatgagaagctgtcttactgaggcagaggccgccgttgcgacccaggagacttccactgtgcgtctgaaggtcagttctacagccgtgcggacccaacataccactacccgaccagtacctgatacatctcggttgccaggcgcgacccccggcctaaccactgtggaaatcgtcactatgtcacaccaggctcttggagatgtggctggtagaggaaacgagaaaaagccctcgagtgtgagggctctgtctattgtgcttcctatagtcttgctggtcttcttatgcttgggcgtgttcctgctgtggaagaattggaggctgaaaaatatcaactctattaacttcgacaatcctgtgtatcagaagacaacagaagacgaggtgcacatatgccacaaccaggacggttatagttatcctagtcgccagatggtgtcgttagaggatgatgtcgcc

SEQ ID NO: 16255 - DNA, 2580 bp, Artificial Sequence
  Description of Artificial Sequence: Synthetic coding sequence
atgggcccttggggatggaaacttcggtggacggtggcactgctgctcgcagccgcgggaactgccgtcggggaccggtgcgaacgcaatgaattccaatgccaagatggaaagtgtatcagttacaagtgggtgtgcgacgggagcgcggaatgtcaggatggaagtgacgagagccaggaaacttgcctttcagtcacgtgtaaatcaggcgacttcagctgcggtggccgagtcaacaggtgcatcccgcagttctggcggtgcgacgggcaggtggattgtgacaacggcagcgacgagcagggttgtcctcctaagacgtgctcgcaggacgaattcaggtgccatgatggaaaatgcatcagccggcagttcgtctgtgactccgaccgggattgcctggacggctccgacgaggcaagctgcccagtgttgacttgtggaccggcctccttccaatgcaacagctccacttgcatcccccagctgtgggcgtgcgacaacgatcctgactgcgaggatggttcagatgagtggccgcagcgctgccgcggactgtatgtgttccagggggatagttcgccatgttccgccttcgaattccattgcttgtccggagaatgtattcactcgtcctggcgctgcgacggaggaccagattgcaaggacaaatcggacgaggaaaattgcgctgtggctacctgccggcccgacgaattccagtgctccgacggaaattgcatccacggatcgcgccaatgcgatagagaatacgactgcaaggatatgtctgacgaagtgggatgcgtgaacgtgactctgtgcgagggtccgaataagttcaagtgtcactccggagagtgcatcacgctggacaaggtgtgtaacatggcgagagattgtagagactggagcgacgaacctatcaaagagtgcggcactaacgcatgcttggacaataatggcggatgttctcacgtctgcaatgatctgaaaatcggttacgagtgtctctgcccagacggcttccagctggtcgcgcagcgccgctgcgaggatatagacgaatgtcaggacccagacacctgttcgcaactctgtgtgaacctcgaaggaggctacaagtgccaatgcgaagagggctttcagctcgatccgcataccaaggcgtgcaaggcagtgggtagtatcgcctacctgtttttcactaaccggcatgaagtgcgcaaaatgactctggacagaagcgagtacacctccctgatcccgaacctgcggaacgtggtcgccctggacaccgaggttgcatccaataggatctactggtcggacctgagccagagaatgatctgctccacccaattggatagagcgcatggagtctcctcctacgatactgtgatctcgagggatatccaagctccagacggactcgctgtcgactggattcactcgaacatctactggactgattcggtgcttggcaccgtgtccgtggcagataccaagggcgtaaagcggaaaactctcttccgcgaaaacgggtcgaagccgcgcgccattgttgtggacccagtccacgggttcatgtactggaccgactggggaaccccagccaagatcaaaaaaggcggattgaatggagtggacatctacagccttgtcaccgaaaacatccaatggccgaatggaatcactctggatcttctctcagggcgcctgtactgggtggactcgaaactccactcgatttcctcaatcgacgtgaacggtggcaaccgcaagaccatcctcgaggacgaaaagcgcctggcacatccgtttagccttgccgtgtttgaggataaggtgttctggaccgacatcattaacgaggccatctttagcgccaataggctgactggatcggatgttaatcttctggcggaaaaccttctgtcacctgaggacatggtcctctttcataatcttacccagccgcgcggtgtgaactggtgcgaacgaaccactctctcgaatgggggatgccagtacctctgcctgccggcgccacagatcaacccgcatagcccaaagtttacttgcgcttgcccggacggtatgctgttggctcgggatatgcgctcttgcctgactgaagccgaggccgcggtggcgactcaagaaacctccacggtgcggctgaaggtatcatcaaccgccgttagaactcaacacactaccacccgccccgtgccggacacctcacggttgccaggagccacccccggactgaccaccgtggaaattgtgactatgtcacaccaggcactcggagatgtggccgggcggggaaacgaaaagaagccgtcatccgtcagggctctgagcattgtgctccctatagtgctgctggttttcttgtgcctgggagtgttcctgctgtggaagaactggcgactgaagaacatcaactcgatcaacttcgacaaccccgtctatcagaaaaccacggaggacgaagttcacatctgccacaatcaagacggctactcgtaccctagtagacagatggtatcgctcgaggatgatgtcgcc

SEQ ID NO: 16256 - DNA, 2580 bp, Artificial Sequence
  Description of Artificial Sequence: Synthetic coding sequence
atgggaccttgggggtggaagttgaggtggacggtagcacttctcttagcagctgctggaaccgctgtgggggatagatgcgagcgtaatgagtttcagtgtcaggacggcaagtgcatctcatacaagtgggtctgtgacgggagcgcagagtgccaagatggctcagacgagtcccaggagacgtgtttatctgtgacttgtaagagtggtgacttttcctgcggcgggcgcgtcaatcgatgtattcctcagttctggaggtgcgacggtcaggttgactgcgataacgggtcggacgagcagggatgtcccccaaaaacttgttcacaggatgaattccggtgccacgatggaaagtgcatcagccgtcagttcgtgtgtgactcagaccgcgactgtctggatgggtcagacgaagcatcatgccccgtcttgacttgtggaccagctagtttccagtgcaactccagcacatgtattccccagctatgggcctgcgataacgatccagattgcgaggatggatccgatgagtggccccaaaggtgcaggggcctgtatgtgttccaaggagactctagcccttgtagtgcattcgagttccattgcttgagtggggagtgcattcatagcagctggcgatgcgacggcggtcctgactgtaaggacaaatccgatgaggagaactgcgcagtagccacgtgccggccagatgagtttcagtgctccgatggaaactgtatacatggaagccggcaatgtgatcgggaatacgattgtaaggatatgtctgacgaggtgggttgtgtgaatgtgactctctgcgaaggcccaaataagttcaaatgccatagcggcgaatgcatcacattggacaaagtctgtaatatggcccgagactgccgagactggagtgatgagcccattaaggaatgcggcaccaacgcatgcctggacaacaacggagggtgttctcatgtgtgtaacgacttaaagatcggttatgaatgtttgtgccccgatggcttccagttggtggcccagcgccgatgtgaggatatcgatgaatgtcaggaccctgatacctgcagccagctgtgcgttaatctagaaggtggatacaaatgccagtgtgaggaaggctttcaattggacccacacacgaaagcatgcaaagcagttgggtcaattgcgtatctgtttttcacgaatcggcatgaggttagaaagatgacgctggaccgaagcgagtacacaagcttaatcccgaatttgcgcaacgttgtcgcgctggatacagaggtcgcatccaataggatttactggtctgacctgagtcagaggatgatctgcagcacacagttggaccgcgctcacggagtttccagctacgacacggtgatctcgagagacatacaagctcctgatggcctagctgtcgattggatccattctaatatttactggactgacagtgtgctcggaacagtctcggtggctgacaccaagggggtcaaacgcaaaaccctcttccgcgaaaacggctctaagccaagggctatcgtggtggaccccgtccatggcttcatgtactggaccgattggggcacccctgccaaaattaagaaggggggcctgaacggggtggacatttactccttagtgactgagaatattcagtggcctaatggcattacgttggacctgctgtctgggcggctatactgggtggacagcaagctgcatagcatcagcagcatcgatgtgaatggtggaaatcggaaaacaatcttggaggatgaaaagcgcttggcacacccgttcagtctcgccgtgtttgaagacaaggtgttttggacggacattatcaatgaggccattttctcagccaacaggttgactggtagtgacgtgaatctcctcgccgagaacttgctttcacctgaagacatggtccttttccacaatcttacccagccccgcggagtgaactggtgcgagagaactaccctcagtaatggtggctgtcagtatctttgcctacccgcaccacaaataaaccctcatagtcccaaatttacctgcgcttgccctgacgggatgttattggctagggacatgcgcagctgtttgacagaagctgaggcagccgtcgctacacaggagactagtactgtgcggctgaaagtcagcagcactgcggtgagaacccagcacaccacaacacggccagtaccagatacaagtaggctccccggcgccactcctggtctgaccaccgtggaaatcgtcaccatgtcccaccaggcactgggagatgtggcaggccgcggtaacgagaagaaacccagtagcgttagggccctgagcatagtgctgcccatcgttttactggtgtttctgtgtttgggcgtttttctcctgtggaaaaattggaggctcaaaaatatcaattctatcaatttcgataaccccgtgtatcagaagacaacagaggacgaggtccacatttgtcacaatcaagatgggtactcatacccctcacgacagatggtctccttagaagacgacgtggct

SEQ ID NO: 16257 - DNA, 2580 bp, Artificial Sequence
  Description of Artificial Sequence: Synthetic coding sequence
atgggcccatggggatggaaactgagatggacggtcgccctcctgctagctgccgccggcactgctgtgggggaccggtgtgagcggaacgaattccagtgccaggatggcaaatgtatatcctataagtgggtgtgcgacggcagtgctgagtgccaagacgggagcgacgagtctcaagagacctgtctaagtgtcacctgcaagagcggcgatttcagctgtggcggccgagtgaaccgctgcataccacaattctggcggtgcgatgggcaggtcgactgcgacaacggatccgatgaacagggatgcccaccaaagacctgttcccaggatgaattcaggtgtcatgatggtaaatgcatttcgagacagtttgtgtgtgactctgatcgagactgcctcgatggctccgacgaggcatcctgccccgtgctgacatgtgggcccgcatcctttcaatgcaatagtagcacttgtatacctcagctgtgggcatgcgataacgacccagattgtgaggacgggagcgatgaatggccgcagaggtgtaggggactgtacgtgttccaaggagatagctccccctgctccgccttcgagttccactgtctcagtggggagtgtatccactcgagctggaggtgcgacggcggtcccgactgtaaggacaaatcggatgaggagaattgcgcggtggccacctgtagacccgacgaattccagtgctccgatgggaactgtatacacgggtcgcgacagtgtgaccgggagtatgactgcaaggacatgtctgacgaagtggggtgcgttaacgtgactctgtgcgagggtcctaacaagttcaagtgccacagcggcgaatgcattacgctggacaaagtatgcaatatggcgagagattgtcgagactggtccgacgagcccatcaaggagtgcggcactaatgcctgtctagataataatggcgggtgttcccatgtctgcaatgatctcaaaattggctatgaatgtttgtgtcccgatggatttcagttggtggcccaaagaaggtgtgaagacattgatgagtgtcaggatccagacacatgttcccaactctgtgtgaatttggagggcgggtataagtgtcagtgtgaggagggcttccagctcgacccccacacgaaggcttgcaaagccgtcggcagtatcgcctacctgttttttacgaaccgtcacgaagttagaaagatgacactagaccgctcagagtacacttccctgattcctaatttacgtaacgtagtagctctggacacggaagttgcttccaacaggatctattggagtgacctgtcccagaggatgatatgttccacccagctcgaccgtgcccacggggtgtcctcatatgacacagtaatatcccgggacattcaggccccagatggcctggccgtcgattggattcactcaaacatatactggactgactcggtgcttggcaccgtgtctgtggcagataccaagggagtgaagcgaaaaaccctgtttagggagaatggatcaaaacccagggccatcgtcgttgaccctgtgcatgggttcatgtactggacagactggggcacacccgctaaaatcaaaaaagggggcttaaacggagtggacatctactccctcgtgaccgagaacatacagtggcctaacggtataacacttgacctattatctgggaggctctattgggtggattctaaactgcactctatttccagcatcgatgtcaacgggggaaacaggaaaaccatcctggaagatgaaaagcggttggcccaccctttttctctcgctgtgttcgaggacaaggtattctggactgatattatcaacgaggccatctttagcgcaaatcgcctgaccggatctgatgtgaatcttctggcagagaatctgctctcccccgaggatatggtgctctttcataacttaacacagccgcgcggtgttaactggtgcgagcggacaactctgtctaacgggggctgtcagtatctttgtctgccggcaccacagatcaacccgcactcccctaagttcacgtgcgcatgtcccgatgggatgttgctcgcccgggacatgcgctcctgcctcaccgaggccgaagctgcagttgctactcaggagacctcgacagtgagacttaaagtcagcagcacagccgtgcgcacccagcacacaacaactagacccgtgcctgacacttctcgactcccaggtgcaacgcccggcctgacaactgtcgagatagtgaccatgagtcaccaggcccttggggacgtcgccggacgggggaacgaaaagaagccctctagcgtcagggcactgtcaatcgttctgccaatcgtgctgctggtgtttctgtgcctgggcgtcttcctattatggaagaactggcgcctgaagaacatcaactctataaattttgacaaccccgtctaccagaagacgacagaggacgaggttcatatctgccacaatcaggatggctattcttatccctctaggcagatggtgagcctcgaggacgacgtggcc

SEQ ID NO: 16258 - DNA, 2580 bp, Artificial Sequence
  Description of Artificial Sequence: Synthetic coding sequence
atgggaccctgggggtggaagctgcgctggacagttgctcttctactggctgctgctggaactgcagtgggagaccggtgtgaacgaaacgagtttcaatgccaagacggcaaatgcatatcctacaaatgggtttgtgacggctccgccgagtgccaagacgggtcagacgaaagtcaggaaacatgcctaagcgtgacatgcaagtcaggggatttcagctgcgggggccgagtaaaccgctgtattccacaattctggaggtgcgacgggcaggtggattgcgacaacggatccgatgagcaaggatgtccccccaaaacatgctctcaggacgagttcaggtgccatgacggcaagtgcatctcgcgacagtttgtctgcgactccgatagggactgcttggatgggtcagacgaggcttcctgtcctgttttgacttgtggaccagcctcgtttcagtgcaacagttcaacttgtataccccagctatgggcctgtgacaacgatccggattgcgaagatggcagcgacgaatggccccagaggtgcagaggcctatatgttttccaaggagactcctccccttgctccgcttttgagtttcactgcctgagcggggaatgtatccattccagctggagatgcgacggtggtcctgactgtaaggacaaaagcgatgaagaaaactgtgccgttgctacgtgccgccccgacgaatttcaatgcagtgatggaaattgtatccatggctcacgccagtgcgatcgagagtatgattgcaaggatatgtctgatgaggtggggtgcgtgaacgtaactctgtgcgagggccccaacaagtttaagtgccatagcggggagtgtatcacgcttgataaggtatgtaacatggcccgagactgccgagactggagcgatgaacctattaaagaatgcggtactaacgcctgcctcgacaacaacggaggctgtagccatgtgtgtaatgacctgaagatcggctacgagtgtctgtgtcctgacggattccagttggtggctcagcgacgatgcgaagatatagatgagtgccaagaccccgacacttgtagccagctctgcgtcaatttggaaggggggtataagtgccagtgtgaagaaggctttcagctggatccccacacaaaagcttgtaaggccgtgggatccatcgcgtatctgttcttcaccaacaggcacgaagtcaggaagatgaccctcgatcggtctgagtacacctcacttattccaaacctgaggaacgtggtagccttagataccgaggttgcctcaaatcggatatattggagtgacctgtctcagagaatgatctgctcaactcagctcgacagagcacacggtgtttccagttatgacaccgtgatctcgagagacatccaagcccccgatggcctggccgtggactggattcactcgaatatctactggacagactcggtgctggggacggttagtgtggccgacaccaagggtgtgaaacgaaagaccttgtttagggagaatggctcaaaaccacgggccatagttgtcgatcctgttcatggattcatgtactggaccgactgggggacgccggcgaagataaaaaagggcgggctgaacggcgtggacatctactctctggtcactgaaaatatacagtggccaaacggaatcaccctggatctgttgagcggccgactctattgggtggatagtaaactccattccattagttcaattgacgtcaatggaggaaacaggaaaaccatcctggaggatgagaagcgactagcccatcccttcagcctagcggtgtttgaagataaggtgttttggactgacatcattaatgaggctattttttccgccaaccgactgaccgggagcgatgtcaatttgctggccgaaaacttgctgagtcccgaagatatggtactgttccacaacctcacccagcctcgtggagttaactggtgtgaaaggactaccctgtccaacggtggttgccagtatctgtgcctccccgcaccccagataaacccccactctcccaaatttacttgcgcatgcccagacggtatgcttctggcaagggacatgaggtcttgtctgaccgaggccgaggcggccgttgccacacaagaaacctctaccgtgcgactgaaagtctcctccacggcagtgcgaactcagcatactacaacaaggcctgtccccgacacaagccgactgccaggcgcaacccccgggttgacgactgttgagattgtcaccatgtctcaccaggccttgggggacgttgccggaagaggcaacgaaaagaaaccaagctccgtccgagctctgtcgattgtgttaccaatagtgctcctggtgtttttgtgcttgggcgtttttctgctgtggaagaattggcggctgaaaaacataaatagcataaacttcgacaatccggtgtaccagaagaccacagaagacgaagttcacatctgccacaatcaagacggatattcctaccctagccggcagatggtctcgttggaggacgacgtggca

SEQ ID NO: 16259 - DNA, 2580 bp, Artificial Sequence
  Description of Artificial Sequence: Synthetic coding sequence
atgggcccttggggctggaagctgcgctggacggtggcgctgctgttggcggcagccggtacggctgtgggggacagatgtgagcgcaacgagttccagtgtcaggacggaaagtgtatctcgtacaaatgggtctgcgacggaagcgctgaatgccaggatggcagtgatgaatcacaggaaacctgcctcagtgtcacttgtaagagcggcgacttcagctgcgggggacgcgtgaacagatgcattcctcagttttggcgttgcgacggacaggtggattgcgataacggcagcgatgagcaaggatgcccgccgaaaacgtgtagccaggatgagttcagatgccacgacgggaaatgcatctcaaggcagttcgtgtgcgactcggaccgcgactgtctcgatggctccgatgaagcaagctgccctgtattgacctgcggaccagcatcctttcaatgcaactcgtccacctgcatccctcaactgtgggcctgcgacaacgatccggattgtgaggacggatccgacgaatggccccagcggtgtaggggactttacgtgttccagggggactcgtccccgtgctcagcattcgaattccactgcttgtcaggagagtgcatccacagttcatggcgctgcgatggaggtccggactgcaaggataagtcggatgaagagaattgcgccgtggccacctgcagaccggacgagtttcaatgctccgacggcaattgcatccacggttcccggcagtgcgatcgagagtacgattgcaaggacatgtccgacgaggtgggatgtgtcaatgtcaccctctgtgagggtccgaataagttcaaatgccattcgggtgaatgtatcactctcgataaagtttgcaacatggcccgcgactgccgcgattggtcagacgaacctatcaaggaatgcggaaccaacgcttgcctggataacaacggagggtgttcccatgtctgcaacgacctgaagattggatatgaatgtttgtgccccgacggattccagctcgtcgcccaacgcaggtgtgaggatatcgacgagtgccaggacccagacacctgttcccagctctgcgtgaacttggaaggaggatacaagtgccaatgtgaagaaggatttcaactcgacccgcacaccaaagcctgtaaggcggtggggtccatcgcttatctctttttcactaaccggcatgaggtccggaagatgaccctggatcgcagcgaatacaccagcctcattccgaacctcaggaacgtcgtggcactggataccgaggtggcttccaaccggatctactggtcggacctctctcaacggatgatctgttctacccaattggaccgcgcgcatggcgtgtcgtcgtatgacacggtgatcagccgtgatattcaggcacctgacgggctggcggtggactggatccactcgaacatttactggaccgatagtgtgttgggaactgtctcggtagccgatactaagggagttaaacgtaagactctcttccgggaaaatgggtcgaaaccgcgggccatcgtggttgatcccgtgcatgggtttatgtactggactgactggggcacccccgccaagatcaaaaagggagggctgaatggagtcgacatttactctctcgtcactgagaatatccagtggccaaacggcattactctcgacctgctgtcgggtcggctgtactgggtggattccaaactgcattctatttcgagcatcgacgtgaacggtgggaatcgcaagactatcctggaagatgagaaacggcttgcccacccgttcagtctggccgtgtttgaggacaaagtcttttggactgacataatcaacgaagccatcttctcagccaatagacttaccggaagcgacgtgaatcttctggccgaaaatcttctgtccccggaagatatggtgttgttccacaatctcacccagccgcgaggcgtcaactggtgtgaacgcactaccctgagcaacggaggctgccaatacctgtgcctgcctgcgccgcaaatcaacccacacagcccaaagttcacttgcgcatgcccagatggaatgctgctggcccgggacatgcggtcctgcctgaccgaagctgaagcggccgtggcgacccaggaaacttctaccgtcagactgaaggtgtcctccactgcggtgcggacgcagcatactaccactagaccagtgcctgacacttcgcggctgccaggagccaccccgggtctgacgactgtggaaatcgttactatgtcacaccaggctctgggcgacgtggcaggtagaggaaatgagaagaagccctcctcagttcgcgcgctgtccatcgtgctgccgatcgtgctgcttgttttcctctgcttgggagtgttcctcctctggaagaactggcgcctgaagaacatcaactccatcaatttcgacaacccagtgtaccaaaagacgactgaggacgaggtacacatctgtcataatcaggacggttactcctacccatcgcgccaaatggtgagcctggaggatgatgtcgca

SEQ ID NO: 16260 - DNA, 2580 bp, Artificial Sequence
  Description of Artificial Sequence: Synthetic coding sequence
atgggaccgtggggctggaagctgcgctggactgtggccctccttttggcggctgctggaactgccgtgggggaccggtgcgaaagaaacgaatttcaatgccaagacggaaaatgcatctcgtacaaatgggtgtgcgatggatccgcagaatgccaggacggctcagatgagtcacaagaaacctgcctgagcgtgacctgcaagtcgggagacttctcgtgcggcggtcgcgttaataggtgcatcccgcaattctggcggtgtgatggacaggtcgattgcgacaacggctcggacgaacagggttgcccgccaaagacgtgttcacaagacgaatttcgctgccatgacggcaagtgcatctcgcggcagtttgtctgcgatagcgacagagattgtcttgacgggtccgacgaagcatcgtgcccggttctgacctgcgggccagcctcattccagtgcaattccagcacctgtattccgcaactgtgggcttgcgataacgaccccgattgtgaagatggaagcgacgaatggcctcagagatgcaggggcctgtacgtctttcagggcgactcctccccgtgctcggcgttcgaatttcactgcctttcgggagagtgtattcattcctcgtggcggtgcgacggaggacctgattgtaaggataagtcggacgaggaaaattgcgcggtggcgacctgccggcctgatgaattccagtgcagcgatggaaactgcatccacggatcgcgccagtgtgacagggagtacgactgcaaggatatgtctgatgaagtgggatgcgtgaatgtgaccttgtgcgaaggcccaaataagttcaaatgccattccggagaatgtatcaccctcgacaaggtgtgcaacatggccagggactgtcgggattggagcgatgagccgatcaaagagtgcggaaccaatgcttgtctggacaataacggaggatgctcgcacgtgtgcaacgacttgaaaatcggctacgagtgcttgtgcccggacggatttcagctcgtggcccagcggcgctgcgaggatatcgacgaatgccaagacccggacacctgcagccaactgtgcgtgaacctggaaggcggttacaagtgccaatgcgaagaaggatttcaactggacccacatactaaggcctgtaaggccgtgggctcaattgcgtacctgttcttcactaaccggcacgaagtgagaaaaatgaccttggatcgctcagagtacaccagcctcatcccgaacctgcgcaatgtcgtggccctcgacaccgaagtggcatcgaataggatctactggtccgacttgtcgcagagaatgatttgtagcacgcagctggatagagcacacggagtctcatcatacgacactgtgatttcccgggacatccaggccccggatggccttgctgtagactggatccactccaacatctattggactgactcagttctgggaactgtgtcggtggctgacaccaagggcgtcaaacgcaagaccctgttcagagagaacgggagcaagccacgggcgatcgtggtggatccagtgcacggtttcatgtactggactgattggggaactccggcgaagatcaaaaagggaggcctgaatggagtggatatctactcactcgtgactgagaacatccagtggccaaacggcatcaccttggacctgctgtccggtaggctctactgggtggactccaagctgcactcaatcagctcgatcgacgtgaacggaggtaaccgaaagacgatcttggaggacgaaaagaggctcgcccacccattcagcctcgccgttttcgaagataaagtgttctggaccgacatcattaatgaggccatcttctcagccaacaggctcacgggatctgatgtgaacctgcttgctgagaatttgctgtcacccgaggatatggtgctgtttcacaatctgacccagcctcggggagtgaattggtgcgaacggactactctctccaatggcggatgccagtacctgtgcctgccggctccccagatcaatccccatagccctaagttcacgtgcgcgtgtccggacggaatgctgcttgccagggatatgcgctcgtgcctcactgaagcggaggcagccgtggctactcaggagacgtcgaccgtcagattgaaagtatcttcaactgcagtgcggacccagcacaccaccacccggccggtgccagatacctcccggctgccgggtgcaaccccgggactgactacggtggaaatcgtgactatgtcgcaccaagcactcggggatgttgccgggaggggaaacgaaaagaaacctagctccgtgcgggcactgtcgatcgtgcttccaattgtgctgctggtgttcctgtgcctgggggtgttcttgctttggaagaattggcgcctgaaaaacattaactcgatcaattttgacaatccagtgtatcaaaagaccaccgaggatgaagtgcacatctgccacaaccaggacggctactcctacccttcgagacagatggtgtcccttgaggatgatgtggcc

SEQ ID NO: 16261 - DNA, 2580 bp, Artificial Sequence
  Description of Artificial Sequence: Synthetic coding sequence
atgggcccgtggggatggaagctgagatggaccgtggcactgctcttagctgcggccggaacagccgtcggagataggtgtgagagaaatgaattccaatgccaagatggaaaatgcatttcgtacaagtgggtgtgcgatggatcagcggaatgccaagatgggtccgacgaatctcaggaaacttgccttagtgtcacatgtaagtctggcgacttttcctgcggaggccgcgtgaaccggtgcataccccagttctggcgctgtgacggacaggtggactgcgataacggaagtgacgaacagggatgtccgcctaaaacctgtagccaggacgaattcagatgtcacgacggcaaatgcataagcagacagttcgtatgcgactcggaccgcgactgtctggatggatcggatgaagcatcctgccctgtgctgacatgcggccctgcaagtttccaatgcaattcaagcacctgcattccccaattgtgggcatgtgacaatgacccagactgtgaggacgggtcggatgagtggccgcagcgatgtcgtggcctgtatgtgtttcagggcgattcatcgccatgctccgcctttgagtttcactgtctttcaggcgagtgcattcattcttcatggaggtgcgacggaggacccgactgtaaggacaagtccgacgaggagaactgcgcagtggcaacctgtaggcctgatgaatttcaatgtagcgacggcaattgtattcatggcagtaggcaatgtgatagggaatacgactgcaaggacatgtctgacgaggtcgggtgtgtcaatgtaacactctgtgagggccccaataagtttaaatgtcactcaggcgagtgcatcacactggacaaggtgtgcaacatggcgcgcgactgccgggactggagtgacgaacctatcaaggaatgtgggactaacgcatgcctggacaataacggcggatgttcacacgtctgcaacgatttgaagatcgggtatgaatgtctctgccccgacgggttccagcttgtggctcagagacggtgtgaggacatcgacgagtgtcaggatccggatacgtgctcccagctttgcgtcaatctagagggcggctataaatgtcagtgtgaggaggggttccagctcgaccctcataccaaggcttgtaaagctgtgggtagcatagcttacctgttcttcactaacagacatgaggtaagaaagatgactctggacagatctgagtacaccagcttgataccgaacttgcgaaacgtcgtggctctggacaccgaggtggcctctaatcgcatttactggtcagacctgagccagagaatgatttgttcaacccagctcgaccgggcccatggcgtgtcatcctacgacactgtgatatcaagggacatacaagcgccagatggattggccgtggactggatccactcaaacatttattggaccgatagtgttctgggcacagtttccgtggcagacaccaagggagtgaagcgaaagacactgttccgggagaacgggagcaagccacgagccattgtggtggaccccgtgcatgggttcatgtactggacagattggggaactcctgctaagattaagaagggaggcttgaatggcgtagatatttactccctggtgaccgagaatatccagtggccaaacggaatcaccttggacctgctgtccggtagactttactgggtggattcgaagcttcatagtatttctagcattgatgtgaacggaggcaatagaaagaccattctggaagacgaaaaacgccttgctcatcctttttctctcgccgtcttcgaggataaggtattctggacagatataattaatgaggccatattctcagccaaccgtttgaccggaagtgatgtcaacctgcttgctgaaaatctgctatccccggaggacatggtgctgttccacaatctgactcagccacgaggagtgaactggtgcgagcgcaccaccctgtccaacggtgggtgccagtacctctgtctgcccgctcctcaaatcaacccccatagccctaagttcacttgcgcctgccctgacgggatgctcctggcacgggatatgaggagttgtctgacagaagccgaggccgcggtcgccactcaagagacgtctaccgtgaggctcaaggtcagctcaaccgccgtccggacgcagcacactacaacccggcctgtgccggatacatctagacttcctggtgcgacccccggcctgacaacagtcgagattgtgactatgagtcaccaagctctcggtgatgtggccggaagaggaaatgagaaaaaaccctcttccgttagagccctaagcattgtgttgccgatagtgctgctagtctttttgtgcctgggtgtattcttattatggaagaattggcgcctgaaaaatattaattccatcaactttgacaacccagtataccaaaaaaccactgaagatgaggtccacatttgtcataaccaggacgggtatagctacccctcaagacaaatggtgtctctggaagatgacgttgcc

SEQ ID NO: 16262 - DNA, 2580 bp, Artificial Sequence
  Description of Artificial Sequence: Synthetic coding sequence
atgggaccttggggatggaaattaagatggactgttgcattattactcgcagcagcaggaacagctgtcggggatagatgtgaaagaaatgaatttcaatgtcaggacggaaaatgtatttcatataaatgggtttgtgatggatcagcagaatgtcaggatggaagtgacgaaagtcaggaaacatgcttgtctgtaacgtgtaaatcaggagattttagttgtggagggagagttaatcgttgtattcctcaattttggagatgtgatggacaagtagattgtgacaatggatctgatgaacaaggatgtccaccaaaaacttgttctcaagatgaatttagatgtcatgatggaaaatgtatttctagacaatttgtttgtgatagtgatagagattgtttagatggatcagatgaagcatcttgtccagttttaacatgtggaccagcatctttccaatgtaattcttcaacttgtattccacaattatgggcttgtgataacgatcctgattgtgaagatggttcagatgaatggccacaaagatgtagaggtttatatgttttccaaggagattcatcaccatgttcagccttcgaattccattgtctttcaggagaatgtatacattcatcatggcgttgtgacggaggacctgactgtaaggataaatcagatgaagaaaattgtgctgttgcaacttgtagaccagacgagtttcaatgttcagatggaaactgtattcatggatcaagacaatgtgatcgtgaatatgattgtaaggatatgagtgatgaagttggatgtgttaatgtaacattatgtgaaggtcctaataaatttaagtgtcattcaggagaatgtattacattagataaagtttgtaatatggctagagattgtagagattggtcagacgaaccaataaaggaatgtgggacaaatgcatgtttagataataatggaggttgtagtcatgtatgtaatgatttaaaaattggatatgaatgtttatgtccagatggatttcaacttgtagctcaaagaagatgtgaagatatagatgaatgtcaagatcctgatacctgttcacaattatgcgttaatttagaaggtggatataaatgtcaatgtgaagaaggttttcaattagatccacatactaaagcatgtaaagcagtaggatcaattgcttatttattctttacaaacagacatgaagttagaaaaatgacattagatagatcagaatatactagtcttatcccaaatttgagaaatgtagttgctcttgatacagaagtcgcttctaatagaatatattggtcagatctttcacaaagaatgatttgttcaacacaattagatagagctcatggagttagtagttatgatactgttatttctagagatatacaagcaccagatggattagcagttgattggattcattctaatatctattggacagatagcgttcttggaactgtatcagttgcagacacaaaaggagttaaaagaaaaacacttttcagagaaaacggaagtaaaccaagagctattgtagttgatcctgttcatggatttatgtattggacagattggggaacacctgcaaaaattaaaaaaggaggattaaatggagttgatatttattccttagttacagaaaacattcaatggccaaatggaattacattagatttattgagtggtagactttattgggttgattctaaattgcattctatttcatcaattgatgtaaatggtggaaatcgaaaaactattcttgaagatgaaaagcgtctcgcacatccattttcattggcagtatttgaagataaagttttttggactgatattattaacgaagcaattttctctgccaatagacttacaggtagtgatgttaatttattagctgaaaatcttcttagtccagaagacatggtattatttcataatttaactcaaccaagaggagttaattggtgtgaaagaacaacacttagtaatggaggttgtcaatatctttgcttaccagcaccacaaattaatccacattctccaaagtttacatgcgcatgtccagatggaatgttattagctagagatatgagaagttgtcttactgaggctgaagctgcagtagccacacaagaaacttcaactgttagattaaaagtttcatcaacagcagttagaacacaacacacaacaacaagaccagtaccagatacttcacgtctaccaggagcaacaccaggattaaccactgttgaaattgttactatgagtcatcaagctttgggagatgtcgctggaagaggaaatgaaaaaaaaccatctagtgttagagctttatccattgttttacctattgtattattggtttttttatgtttaggagtttttcttttatggaagaattggagattaaaaaatataaattctataaatttcgataatccagtctatcaaaaaacaacagaagatgaagttcatatatgtcataatcaagatggatattcttatcctagtagacaaatggttagtcttgaagatgatgttgca

SEQ ID NO: 16263 - DNA, 2580 bp, Artificial Sequence
  Description of Artificial Sequence: Synthetic coding sequence
atgggtccctggggatggaagttaagatggaccgtggcccttctgctcgccgctgccgggaccgctgtgggagacaggtgtgagagaaacgagttccagtgtcaagatgggaagtgtatatcgtataagtgggtatgcgacgggtctgcggagtgccaggacggttcggacgagagccaggaaacttgcttgtccgttacatgtaaatctggagacttctcctgcggcggccgggtgaatcggtgcataccccaattttggcggtgcgacggccaggtggactgtgacaatggctcggacgaacaggggtgtccgccaaagacttgttcacaggacgaattcaggtgtcacgatggtaagtgtatcagccgccagttcgtgtgcgattctgatcgggactgcctggatgggagtgatgaggcctcgtgccccgtattaacttgcggaccggccagcttccagtgtaatagttccacctgcattccacagctctgggcatgtgataacgacccggattgcgaggacgggtcagatgaatggccccaaagatgccggggactgtacgtgtttcagggcgacagtagtccatgtagtgcatttgagtttcactgtctgagtggagagtgcatccatagctcgtggcgctgcgacggcgggccggactgtaaagataaaagcgacgaagagaactgcgctgttgccacgtgccgccctgatgagttccagtgcagcgatgggaactgtattcacggctcgcgtcagtgcgatcgagagtatgactgtaaagacatgtctgatgaggtagggtgcgtgaatgtaacactgtgtgagggaccgaataaatttaaatgtcattctggggaatgcatcaccctggataaggtatgtaacatggcacgggattgtagggattggtccgatgagcccatcaaggagtgtggcacaaatgcttgcctcgacaataatggcgggtgcagccatgtgtgtaatgatcttaagattgggtatgagtgtttgtgcccggacggcttccagctggtcgctcagaggcggtgcgaggatatagatgaatgccaggatcccgacacttgttcgcaactgtgcgtgaatctagaggggggatacaagtgtcaatgtgaggagggctttcagctggacccccacaccaaggcttgtaaagccgtgggtagtatagcctatctgttcttcaccaaccggcacgaggtccggaaaatgacactggataggagtgaatacacgagcctcatcccaaatcttcgcaatgtggttgcgctagatacggaagttgccagcaacaggatatattggtctgatctgtctcagcggatgatctgttcaacccagcttgaccgcgcacacggcgttagttcatatgataccgttattagccgagacatccaagcccctgacggtcttgccgtagactggatccacagtaacatttactggacggactccgtactgggaaccgtttcagtggctgataccaagggcgtcaagcggaaaacactttttcgcgagaatggaagcaaaccaagggcaattgtggtagatccggtgcatgggtttatgtactggacagactggggaaccccagcgaaaatcaaaaagggcggcctgaatggtgtggatatatatagcctcgttaccgagaatatccagtggccaaacggcatcactcttgatctgctttcgggacggttgtattgggtggactctaagctccactccatatcctcaatcgacgtaaatggggggaatcgcaagactattctagaagatgagaaacgtctagcccatcccttctctctggctgtcttcgaagataaagtcttctggaccgatattatcaatgaggccatctttagcgccaacagactcaccgggtcagacgtgaacctgctcgctgagaacttgctgagtcctgaggatatggttctctttcacaacttgacccagcctcgaggagtaaattggtgtgaaagaaccacgctttccaatggtggctgccagtacctctgtctcccagctccacaaattaatccccatagtcctaagttcacctgcgcttgtcccgacgggatgctgctagctcgggatatgaggtcatgcctaaccgaggctgaggccgccgtagccacccaggagacatcaaccgtgcggctgaaagtgagttctaccgcagtccgaacacagcacactactaccagacccgtgccagacacctctagactgccgggggctacaccaggtctgacaaccgtggaaattgtgacaatgtcccatcaagcgttaggggatgttgccggacggggcaatgagaagaaaccctcatccgtgcgcgccctctccattgtcttgcccattgtcttattagtattcctgtgtctaggcgtttttctgttatggaaaaattggagactaaaaaacatcaacagtattaattttgacaacccggtttatcagaagacaaccgaggacgaggtccatatctgccataatcaagatggttactcataccctagccgccagatggtgtcactggaggacgatgtggcc

SEQ ID NO: 16264 - DNA, 2580 bp, Artificial Sequence
  Description of Artificial Sequence: Synthetic coding sequence
atgggcccgtggggatggaaacttcggtggacagtcgctcttttgctcgcagctgcaggcacggccgtaggagacaggtgcgagagaaatgaattccagtgtcaggacgggaaatgcatttcatataagtgggtgtgcgacggctccgctgagtgtcaagacggatcggacgagagccaggagacgtgcctgagcgttacttgcaagtcgggagacttttcatgtgggggacgcgtgaaccggtgcattccccagttctggcggtgcgacggtcaggtggattgcgataatggttctgatgagcagggttgcccgccgaagacctgttcccaggatgagttccggtgccatgatggaaaatgtataagcaggcagttcgtttgcgactcagatcgggattgtcttgacgggtccgatgaagccagctgccccgtgttgacatgcggcccggccagtttccagtgcaattcctcaacatgcattccccagttgtgggcctgtgacaacgaccccgactgcgaagacgggtcagacgaatggccccagaggtgtaggggcctttacgtgttccagggtgattcttctccttgctccgccttcgagttccactgcctgtctggcgaatgcatacattcttcctggcgttgcgacggcggccctgactgcaaagacaaatctgacgaggagaactgcgccgttgcaacttgcagaccggacgaattccaatgttccgatggcaactgtattcacggtagcagacaatgtgaccgcgaatacgactgtaaggacatgtcggacgaagtcggctgcgtcaacgtgactctgtgtgagggcccaaataagtttaagtgccacagtggggagtgtatcacgctggataaagtgtgtaatatggccagggattgtcgcgattggtcagatgagcccataaaggaatgtggaacgaatgcttgcctggataacaatggcggatgtagtcatgtgtgtaacgatttgaaaattgggtacgagtgtctgtgtcctgacgggtttcagcttgtggcccagcggaggtgcgaggacatagatgagtgtcaggaccctgatacttgctcgcaactgtgcgtgaatctagaaggcgggtataagtgtcaatgtgaagagggctttcaattggaccctcatacaaaggcctgcaaggcggtgggaagcatcgcttacctgttttttactaaccggcacgaggtgagaaagatgacactggaccggagcgagtacaccagtcttattccgaacctgaggaacgtggtcgcccttgatacggaggtggcctctaatcggatctattggtccgatctatctcaacgcatgatttgcagtacccagttggatcgcgcacacggcgtgagttcgtacgacacggtgatctcgagagacatacaggccccagatggactagccgtggattggatacacagcaacatctactggacagatagcgttctggggaccgtgtctgtcgccgatacaaaaggcgtgaagagaaagacgcttttccgggagaatggctctaaaccacgggctatagttgtggacccagtccatggcttcatgtactggaccgattggggaacacccgcgaagatcaagaagggaggcctcaacggggtggatatatactccctggtgactgaaaatatacagtggccaaatggcattaccctggacctcttatcaggtagactgtattgggtcgactcaaagctgcactccatttctagcattgatgtgaatggtggcaaccgtaagactattctcgaagacgagaagagactggcacatcctttctcacttgcggttttcgaggacaaagtcttctggacagacatcatcaatgaagctattttctccgctaatagattaacaggttccgacgttaacctgttggccgaaaatctgctgtcacctgaggacatggtgcttttccacaaccttacccagcctcgcggtgtcaactggtgcgagcggaccaccttgtcgaatggaggatgtcaatatctctgtttaccagccccacagatcaatccacacagccctaagtttacgtgcgcatgtccagatgggatgctactcgcacgagatatgagatcttgtttgacggaagctgaggctgctgtggcgacccaagaaacaagcaccgtgcgtctgaaagtgtccagtacggccgtgcgcacacaacatacaactacacgtcctgttcctgacacaagcagactccctggggccacacctggactgaccaccgtagaaatcgtgacaatgagccatcaggcgctgggcgatgttgccggacgtgggaacgaaaagaaacctagctccgtccgtgccttgagcatcgtgttacctatagttctgctggtgtttctatgtttgggcgtattcctgctttggaagaattggcgcctgaagaacattaactctattaactttgacaacccagtgtaccagaaaactactgaggacgaagtccacatttgtcacaatcaggacggatacagctacccatcgcgccagatggtgtctctggaagacgacgtggct

SEQ ID NO: 16265 - DNA, 2580 bp, Artificial Sequence
  Description of Artificial Sequence: Synthetic coding sequence
atggggccctggggatggaagttgcggtggacagttgccctgcttctggctgcggcggggacggccgtgggcgaccggtgtgaacgaaatgagttccagtgccaggacggaaaatgtattagctataagtgggtatgcgatgggagtgctgaatgccaggacgggagtgacgagtctcaggagacatgtcttagtgtgacctgtaaaagtggcgatttcagctgtgggggccgcgtgaataggtgcatccctcagttctggcgatgcgatggacaggttgattgcgataatggatccgacgagcaggggtgtcctcccaaaacatgcagccaagacgagtttagatgccatgacggcaagtgtattagtcgccaattcgtgtgtgactcagatagggattgtcttgatggctctgatgaagcctcctgccctgtgttgacatgtggaccggcgtcattccagtgcaactcctctacctgcatacctcagctgtgggcttgtgataacgatcctgattgtgaggacggatcagacgagtggccgcagcggtgtcgcgggctgtatgtctttcagggagactcctcaccgtgctccgctttcgaattccactgtttgtctggcgagtgtatccactcatcatggcgatgcgatggaggccctgattgtaaagataagagcgacgaagagaactgcgccgtggccacctgtagacctgatgaattccaatgttccgacggcaattgtattcatggtagtcggcagtgcgacagggaatacgactgcaaggacatgtcagacgaggtgggatgtgttaacgtaaccctgtgcgagggccctaataagtttaaatgtcactcaggagaatgtatcactctggataaagtgtgtaacatggctagagactgcagagactggagtgacgaaccgataaaggagtgcggcacgaatgcgtgtctggacaacaatggtggctgttctcacgtgtgtaacgacctgaagatcgggtacgagtgtctgtgtcctgatggctttcagttggtagcacagcggcggtgtgaggacatcgacgagtgccaggaccccgacacttgctctcaattgtgcgtaaaccttgagggggggtacaagtgccagtgtgaggaaggcttccagctcgatccccacactaaggcttgtaaggccgtgggcagtattgcttacctgttttttaccaaccgacatgaggtccgcaagatgaccctggaccgaagcgagtatacatccttgatcccaaatctccggaacgtggtggctttggatacagaagtggcttccaaccgaatctattggagtgatctcagtcagagaatgatttgctcaactcagcttgatagagcccatggggtgtcttcctatgataccgtcatttccagggacatccaagccccagatggcttggccgtcgattggatccatagtaacatatactggacagattccgtgctcggaacagtatctgtggcggacacaaaaggtgtgaaacggaaaaccctgttccgggaaaacggatccaagcctcgcgcaattgttgtcgatccagtgcatggctttatgtactggaccgattggggtacccccgccaagattaagaaggggggactgaacggagtcgacatttatagcctggttaccgagaatatccagtggcccaatgggattaccctcgacctgctgagcggacggctctactgggtagactcaaaactgcatagcattagtagcatcgatgtgaacggagggaaccggaaaaccattcttgaagacgagaaacgactcgcccacccgtttagtcttgccgtgtttgaagataaggtcttctggaccgatatcattaatgaagctattttcagcgctaacagacttactggaagcgacgtgaatctgttggcagagaatctgctgtctcccgaggacatggtcctctttcacaatctcacacagccccgaggagtgaactggtgtgaaaggaccactctcagtaatggtggttgccagtacctctgcctgccagccccacagattaacccccattcccctaaattcacctgcgcttgccccgatggtatgttgctggcccgggatatgaggagctgtctgaccgaggcagaagccgcagtggctactcaggagacaagcaccgtacggcttaaggttagttccaccgcggtcaggacccaacacacaactactaggcctgtaccagataccagtcggcttccaggagccacacccggccttactacagtagagatcgttacaatgagtcaccaggcgcttggtgacgttgccggaagggggaatgagaaaaaaccctcctccgtgcgcgcactcagtatcgtcctccctatagtgctcctggtgttcctgtgtctgggagtcttccttctgtggaaaaattggcgcctgaagaatatcaactccatcaactttgataacccagtgtatcagaagactacggaggatgaggtgcacatctgccacaatcaggacgggtatagttacccatccagacagatggtgagcctggaggacgatgtagct

SEQ ID NO: 16266 - DNA, 2580 bp, Artificial Sequence
  Description of Artificial Sequence: Synthetic coding sequence
atgggtccctggggctggaagctccgctggaccgtggcactcctcctggcagctgccggaacagcagtcggagaccgctgtgagagaaacgagttccagtgccaggacggtaagtgtatctcctacaagtgggtgtgcgatggaagtgctgaatgtcaggacggtagcgacgagagccaggagacttgcctgagtgtgacctgtaaatctggagacttctcctgcggcggccgcgtcaataggtgcataccacaattctggaggtgcgacggacaggtcgattgcgacaatggatcagatgaacagggatgtccacctaagacttgtagtcaagacgaattcagatgtcatgacggtaagtgtatttccagacaattcgtctgcgatagcgacagagattgtctggacggctctgacgaagcttcctgtccagtacttacctgcggcccagcatcttttcaatgtaactcttcaacttgcatccctcagctgtgggcctgcgataacgatcctgattgcgaggatggtagcgatgagtggcctcaaaggtgccgcggtctgtacgtatttcagggagactctagcccctgctcagcctttgaattccactgtctctccggcgagtgtattcatagctcctggaggtgcgatggaggtcccgactgtaaggacaagtcagacgaggagaattgcgccgtagctacctgccgccctgatgaattccagtgttccgacggcaactgcattcatggttccaggcagtgtgatagagagtacgactgcaaggacatgagcgatgaggtcggttgcgtcaatgtgaccctgtgcgaaggcccaaacaagttcaaatgtcacagcggcgagtgtatcacactcgataaggtctgtaatatggccagagactgcagagactggtcagacgagcctattaaggagtgcggcacaaacgcctgcctggacaacaacggcggttgcagccacgtgtgtaatgatctgaaaattggttatgagtgcctctgtcctgacggattccaattggttgctcagaggcgttgcgaagacattgacgagtgtcaagatccagacacatgctctcagttgtgcgtgaacttggagggcggctataagtgtcaatgcgaagagggttttcaacttgatcctcataccaaggcatgcaaggctgtcggcagtattgcatacctgttcttcacaaaccgccacgaggttcgcaagatgaccctcgaccgttctgagtacaccagtttgatccccaacctgagaaatgtggtggctctcgataccgaggtagctagtaacaggatctactggagtgacctgtctcagcgtatgatttgttccactcaactcgatcgcgcccacggcgttagtagctatgataccgtcatctctcgtgacattcaggcccctgacggcctggccgtcgactggatccactcaaacatctactggaccgattcagttctgggtaccgtaagtgtcgccgacaccaaaggtgtgaaacgcaagactctttttagggagaatggaagcaagccccgtgcaatcgtcgtggatcccgtacacggtttcatgtattggactgactggggaactcccgcaaagatcaaaaaaggcggtctgaacggagtcgatatctacagtctcgtgacagagaatattcaatggcccaacggtatcacactcgatctgctgagtggacgcctgtactgggtggactccaagctgcacagtatcagcagtattgacgtgaacggcggcaaccgtaaaacaattctcgaagatgaaaagcgcttggctcacccattcagcctcgctgtctttgaagacaaagtgttctggacagatatcatcaacgaagctatcttttcagccaatcgtctgaccggttccgacgtgaatctcctggcagagaaccttctgtcccccgaggacatggtcctgttccacaacctgacacaaccaagaggagtcaactggtgcgaaaggaccaccctgtctaatggcggctgtcagtacctgtgccttcctgctcctcaaatcaatccacactctcctaaattcacctgcgcatgccccgatggaatgttgcttgcccgtgatatgaggtcatgtctgaccgaagccgaggccgctgtggctacccaggagacatccaccgtgcgcctgaaggtctccagcactgctgtgagaacccaacatactacaacccgtcctgttcctgacacatccaggctgcctggtgcaacacctggactcactacagtagagatagtcacaatgagccatcaggcactcggcgatgtagctggacgtggtaatgagaaaaagcccagctccgtgcgcgccctttctatcgtgctgccaatcgtgctcctggttttcctgtgcctcggcgtcttcctgctttggaaaaattggcgtttgaagaatattaactctataaatttcgacaatcccgtttaccagaagaccacagaggatgaggtacacatatgccacaatcaagatggttattcttacccaagtcgtcagatggtgtcactcgaggacgatgtagca

SEQ ID NO: 16267 - DNA, 2580 bp, Artificial Sequence
  Description of Artificial Sequence: Synthetic coding sequence
atgggaccttgggggtggaaactccgatggactgttgctctgttgctcgctgcagctgggacagcagttggggatcggtgcgaacggaacgaattccagtgtcaggatgggaaatgcatatcatacaagtgggtctgtgatgggagtgctgaatgtcaggatgggagtgatgaatcccaagaaacttgtctgtctgtgacttgtaaaagtggagacttttcttgcggaggacgcgtcaacagatgcatcccacagttttggaggtgtgatggacaggttgattgtgataatgggagtgatgagcagggatgcccacctaagacatgctcccaagatgaatttaggtgccatgatgggaaatgcatctctaggcaatttgtgtgcgacagtgatcgagattgtttggacggatctgatgaagcttcttgtcccgtgctcacatgtgggcctgcatccttccagtgcaattcctcaacttgcatcccccagctttgggcttgtgacaatgatcccgattgtgaggacggatctgatgagtggccacagcgctgtcggggattgtatgtttttcagggggattccagtccttgctctgctttcgaatttcactgcttatctggagaatgcatacacagttcttggaggtgtgacgggggacctgattgcaaagataaatctgacgaagaaaactgtgctgttgcaacatgtagaccagatgaattccagtgtagtgatgggaactgcattcacggatcgcggcagtgcgaccgagagtacgattgtaaggatatgtctgatgaagttgggtgcgttaatgtcacactgtgtgaagggcctaacaaattcaagtgtcactctggagagtgtatcactctcgataaagtttgcaatatggctagagattgtcgcgattggtcagatgaacctataaaagagtgtggaactaatgcttgcttagacaacaatggggggtgttctcatgtgtgtaacgatctaaagatagggtatgaatgcttatgtcctgatgggttccagttagttgctcagcggcgttgtgaggatatagatgaatgtcaggaccccgatacatgtagtcaattgtgtgtcaacctcgaaggggggtacaaatgccagtgtgaagagggatttcagctcgatcctcacactaaagcctgcaaagccgtggggtccatcgcctatctcttttttactaatagacatgaagtgaggaaaatgacactcgatcggtctgaatacacttcattaatacccaacctaaggaatgttgttgctcttgatactgaagtcgctagtaacaggatctattggagtgatctgtcacagaggatgatctgttcaacacagttggatcgggctcatggagtgtcatcatatgatactgtgatctctcgggatatccaagccccagatggactcgctgtggattggatacatagtaacatttactggacagatagtgtactcggaacagtctccgtggcggatacgaaaggagttaaaagaaaaactctctttcgggagaatgggtcaaaaccccgggcgatcgtggttgatcctgttcacggattcatgtattggacagattgggggacacctgccaaaatcaagaaagggggactcaatggagtcgatatttatagtctggtcactgaaaacatacaatggcccaacggaataacactcgatcttctttcagggaggctctattgggtcgattctaaactccactctatctcatccattgatgtgaatgggggaaatagaaaaacaatcctcgaagacgaaaagcggcttgctcaccctttctcactcgcggtgttcgaagataaagtattttggacagacataataaacgaagccatcttcagtgctaatcggttgactgggtctgacgtgaacttattagctgaaaacttgctcagtccagaagatatggtgctattccacaacctgactcaaccacggggagtgaactggtgtgaacggactacattatcaaatggagggtgccagtatctctgcctgcccgcgcctcaaatcaacccccatagtcctaaattcacgtgtgcctgcccagatggaatgctgttagcacgagatatgagatcctgtctgacagaagccgaggccgccgtagcgactcaggaaactagtacagtaaggctcaaagtgtcatccactgctgtgcgcactcagcacacaacaactcgaccagtacccgatacaagtcggctgcccggggcaacacccgggctaactactgtagaaattgtgactatgtcacatcaggctctgggagatgtagctggacgggggaacgagaagaaacctagttcggtgagggctctttccatagttctccctatcgttctcctcgtgtttctgtgtttaggagtatttttactgtggaaaaattggaggctaaaaaacataaacagtattaacttcgacaatccagtctatcagaagacaacagaagacgaagtccatatctgtcataaccaggatggatattcttatcccagtcggcagatggtctccctcgaggatgatgttgca

SEQ ID NO: 16268 - DNA, 2580 bp, Artificial Sequence
  Description of Artificial Sequence: Synthetic coding sequence
atggggccctggggctggaagttgcgttggaccgtagcacttctgctcgccgcagcaggcactgctgtaggagaccgatgcgagcgaaacgaattccagtgtcaggatggcaagtgtatcagctacaagtgggtgtgcgacggatccgctgaatgccaggatgggtctgacgagtctcaggagacatgtctttccgtgacctgtaagagcggtgacttttcgtgtggagggcgggttaacagatgtattccacagttctggcggtgtgacgggcaggttgattgcgacaatggatcagacgagcagggttgcccacccaaaacctgcagccaagatgaatttaggtgccacgatggtaagtgtatttcacgccagtttgtctgcgattcggatcgagactgcttagacggctcagatgaggcatcatgtcctgtgttaacatgtggccctgcttcatttcagtgcaattctagcacctgcatcccccagctctgggcttgtgacaacgatcctgattgtgaggatgggtcagatgagtggcctcagcgatgcaggggcctttacgtcttccagggcgatagttcgccctgctcggcattcgagtttcattgcctgagtggagagtgcatccactctagctggcgatgcgacggcgggcctgattgcaaagacaagtcagacgaagagaactgtgctgtggccacctgcagacctgatgagtttcaatgctcagacggaaattgcatccacgggagtcggcaatgcgaccgtgagtacgactgcaaagatatgagtgacgaagtgggatgcgtgaatgtcaccctatgcgaaggcccgaacaagttcaagtgtcactctggagaatgtatcaccctcgataaagtgtgtaatatggctagagattgtcgagattggtcggacgaacctatcaaagagtgcgggaccaatgcctgcctcgataataatggggggtgttctcacgtctgcaatgatttaaagattggctatgagtgcctgtgccccgacggctttcaacttgtagcacagaggcggtgcgaagacatcgacgagtgtcaggaccctgacacatgttctcagctctgtgtgaacttggaaggcgggtataaatgtcagtgtgaggagggctttcaacttgacccacataccaaggcgtgcaaagcagtcgggtccatcgcctatctgttcttcaccaaccggcacgaggtaagaaagatgacactcgaccgatccgagtatacatctttgattcccaatcttcgcaacgttgtggctctcgatacggaagtggcatccaaccggatatattggtcagacctgtcgcagcgtatgatctgtagtacccagcttgaccgggcccacggcgtcagctcatatgatactgtgatcagccgggatattcaggcccccgatggtctcgctgtcgactggatacactctaatatatattggacggattccgtgcttgggactgtctcagttgcggacacaaagggagtgaagcgcaagacactctttagagagaacggctccaagccccgcgctattgtggtggaccctgtacatggctttatgtattggacagactggggcacgcccgctaaaattaagaaggggggactcaacggagtggatatctactcgctcgtgacggagaacatccagtggcccaacggcattactctggacctgttgagcggacggctctactgggttgactctaaacttcattcgatttcttctattgacgttaacggtggtaaccgtaaaacgatcctcgaggatgagaaacggctagcccacccgttttctcttgccgttttcgaggataaagtgttttggacagacatcatcaatgaggcaatttttagcgcaaatcgcctaaccgggtctgacgtgaacttgctggccgaaaatctgcttagccctgaggatatggtgctattccataacctcacgcagccccgcggcgtgaactggtgtgaaagaactaccttgagcaacgggggctgccagtacctgtgtctgcccgcaccacaaattaatccacatagcccaaaattcacttgcgcctgtccggatggcatgctcctcgctcgggacatgcgcagctgtctcactgaggctgaggcagcggtcgcgacacaggaaacctctaccgtgagactcaaggtaagttccaccgcagtgcgaactcagcatacaacgacaaggcccgtgccagatacttcccggctgccgggagcaacacctgggctgacaactgtggaaatcgtgacaatgagccatcaggcactgggtgacgtggcggggcggggtaatgaaaagaagccctcttcagtgcgagcactttccatcgtgttgccgatcgtgcttctggtttttttatgtctaggcgtctttctgctctggaaaaattggcggctgaagaatattaatagtatcaatttcgacaatccagtctatcaaaaaacaacggaagacgaggtgcacatctgtcacaatcaagatggctactcttatccatcaaggcaaatggtgagcctggaagatgatgtcgcc

SEQ ID NO: 16269 - DNA, 2580 bp, Artificial Sequence
  Description of Artificial Sequence: Synthetic coding sequence
atgggaccttggggatggaaactgcgatggactgttgcactcttgcttgccgctgcgggtaccgcagtgggagatcggtgcgagagaaacgaatttcagtgtcaggatggaaagtgcatttcgtacaagtgggtttgtgatggttccgccgaatgtcaagacggttccgacgaatcccaagagacttgcctgtcggtgacgtgcaagagcggcgacttttcatgcggcggaagagtgaacagatgtattccccaattctggaggtgtgacggacaggtggattgtgataacgggtccgacgaacaaggttgccccccaaagacgtgttcacaagatgagtttagatgtcacgatggcaagtgtatctcgcgacagttcgtgtgtgatagcgatcgcgactgtctggatggttcggatgaggcctcgtgccctgtcctcacgtgtggacctgcgtcgttccagtgtaattcctcgacctgtattccccagctgtgggcttgtgacaacgaccccgattgcgaagatggatcggacgaatggcctcagcgctgtcgcggactgtacgtgttccaaggggacagcagcccatgctcagcgtttgagtttcactgtctctccggcgaatgtatccactcgtcctggcggtgtgatggtggccctgactgtaaggataagtcggacgaggagaactgtgcagtcgcaacttgtagacccgacgagtttcagtgttcggacggaaactgtattcacggttccagacaatgtgatcgagaatacgattgtaaagatatgtcagacgaagtgggttgtgtgaacgtgaccctgtgtgaaggaccaaataagtttaagtgccatagcggagaatgcatcactctggataaggtgtgtaatatggcaagagactgccgagactggtccgatgaaccaatcaaggaatgcggaacgaacgcctgccttgacaacaacggaggttgctcgcacgtgtgtaacgatttgaaaatcggatacgagtgtctttgtccagacggttttcaacttgtcgcacaaagaaggtgtgaagatatcgatgaatgccaagatcctgatacctgtagccaactgtgtgtgaatctggaggggggctacaagtgccaatgtgaagaaggttttcagctcgatcctcatactaaggcatgcaaggcagtgggttcaattgcatacctgtttttcaccaatcgccacgaggtccgaaagatgactttggatcgctccgaatacaccagcctcattcctaaccttcgcaacgtcgtggccttggataccgaagtcgcatccaaccgaatttactggtccgatctttcgcaacgcatgatttgctcgactcagcttgatagggcacatggggtgtcctcatacgataccgtgatctcgcgagacattcaggcgcccgacggactggcagtggactggattcactcgaacatttactggaccgattctgtcctgggtaccgtttccgtcgcagataccaagggtgtgaaacgtaaaacgctctttcgcgaaaacggttcaaagccgcgggcaattgttgtcgatcctgtgcatggctttatgtactggactgattggggcactcctgctaagataaagaaaggaggtcttaatggagttgacatttactcgcttgtgactgagaatattcagtggccgaatggaataacgctcgatcttctgtcagggagactgtattgggtggattcaaagctccatagcatttcgtctatcgacgtgaacgggggtaatagaaagaccatcttggaagatgaaaaaagacttgcacatcctttttctctggcagtgttcgaagataaagtgttctggaccgatatcatcaacgaggctatcttttctgccaaccggttgactggtagcgacgtgaacttgctggcagaaaatctgctttcaccggaggatatggtgctcttccataatctcacccaaccaagaggggtcaactggtgtgagaggactactctctcgaatggtggatgccagtatctttgccttccagcaccccagataaatccacatagcccaaagttcacttgtgcgtgtccggatggcatgcttctggctcgggatatgcgtagctgcctgactgaagcagaggcagcagtggcgactcaagaaacttcaactgtgaggctgaaagtgtcatcgacggcagtgcgaactcaacataccactactaggcctgttcctgacacgtcgagattgccaggcgcgactcccgggcttaccactgtcgagatagtcaccatgtcgcatcaagcattgggcgacgtggcaggacgcggtaatgagaaaaaaccatcttccgtccgcgccctctccatagtcctgcctattgtgttgctcgtctttctgtgcctgggcgtctttctgctgtggaagaactggcggctgaaaaacattaactccatcaacttcgataaccctgtgtaccagaaaaccaccgaggacgaggtccacatatgccacaatcaagacggttacagctacccctctcgccaaatggtgtcacttgaagatgacgtggcg

SEQ ID NO: 16270 - DNA, 2580 bp, Artificial Sequence
  Description of Artificial Sequence: Synthetic coding sequence
atgggtccatggggttggaagctgcgctggactgtggccctgctgcttgccgccgctggcaccgccgtcggcgaccggtgcgagcgcaacgaattccagtgccaggacggaaagtgcatctcgtataagtgggtgtgcgacggcagcgccgagtgtcaggacggatcggacgaatcgcaggaaacctgcttgtcggtgacctgcaagagcggtgacttctcgtgcggcggacgggtgaacaggtgtatacctcaattctggcggtgtgacggacaagtcgactgcgacaatggctcggacgagcaaggatgcccccctaagacctgctcccaggatgaatttagatgccacgacggcaagtgcatttcacgccaatttgtctgcgactccgacagagattgcctcgatggatccgacgaagcgtcctgcccggtcctgacttgcggcccagcctctttccaatgcaacagctcaacgtgtatccctcagctctgggcatgcgacaacgacccggactgtgaggacggaagcgacgagtggccacaacgctgccgggggctgtacgtgttccaaggagattcctcgccttgtagcgcgttcgaattccactgtcttagtggcgagtgtattcatagctcgtggaggtgtgacggcggaccggactgcaaggacaagtctgatgaggaaaattgcgccgtggcgacttgccggccggacgagttccagtgttcggatggtaactgcatccatggctcaagacagtgcgaccgcgagtacgactgtaaggatatgtcagatgaagtgggatgcgtcaatgtcaccctctgcgagggaccaaacaagtttaagtgccacagcggagagtgtatcactcttgacaaggtgtgtaatatggcccgggactgccgcgactggagcgatgagccaattaaggaatgtggcactaacgcatgtcttgacaacaatggaggatgttcgcatgtgtgcaacgatctgaaaatcggttacgaatgcctgtgcccggacggatttcagctggtggcgcagcgccggtgtgaagatatcgatgaatgccaagacccggacacctgttcccaactctgtgtgaatctggaaggggggtacaaatgccaatgtgaggagggattccagctggatccgcacaccaaggcgtgcaaggcagttggatcgattgcgtacctgttctttactaataggcatgaggtcagaaagatgactctggaccggagcgagtacactagcctgatcccaaatctgcgcaatgtggtggccttggacacggaggttgcgtcgaatcggatctactggtcggacctctcacagcgcatgatctgctcgacccaactggaccgggcccatggtgtgtccagctacgataccgtgatcagcagggacatacaagctccagatgggctcgctgtggactggattcattcaaacatctactggacggattccgtgctcggaaccgtgtcggtcgctgacactaagggagtgaaacgtaagactctgttcagggaaaacggatcaaagccacgcgcaatcgtggtggaccccgttcatgggttcatgtactggaccgactggggaaccccggcgaaaatcaaaaagggcggcctcaatggtgtggacatctacagtctcgttactgaaaacatacagtggcccaacggaatcaccctcgatctcttgtctggacggctttactgggtagattccaagctgcactcgatcagcagcatcgacgtgaatggcggaaaccgcaaaaccatcctggaggatgaaaaacgcctggcccacccattttccctcgctgtgttcgaggataaggtgttctggactgacatcatcaacgaagccatcttctcggcgaatcgcctgacgggctccgatgtcaatttgttggccgagaacttgctgtcgccagaggatatggtgctgttccacaatctgacccagccacgcggagtcaactggtgcgaacgcaccaccctgtcaaacggcggctgccagtacttgtgcttgccggccccgcaaatcaacccgcacagcccgaagtttacgtgcgcatgtccggacggaatgctcctcgcccgcgatatgcgctcgtgtctcacggaggccgaagcagccgtggcgacgcaggaaacttcgactgtgagactgaaggtgtcatcgactgccgttcgcacccagcacactactacgcgtcccgtccctgatacttcgcggctgccgggcgcaaccccgggactgaccaccgtggaaatcgtgaccatgtcccaccaggcgctgggagatgtggcaggaagaggaaacgagaaaaagccatcgtcagtccgcgcactgtccatcgtgctgccaattgtcctgctcgtgtttctgtgcctgggagtctttctgctgtggaagaactggaggctcaagaatatcaattccatcaatttcgacaaccctgtgtaccaaaagactacggaggacgaagtccacatctgtcacaatcaagacggatactcgtacccaagccggcaaatggtgtcgctggaagatgatgtggcg

SEQ ID NO: 16271 - DNA, 2580 bp, Artificial Sequence
  Description of Artificial Sequence: Synthetic coding sequence
atgggtccttggggctggaaacttcggtggacagtcgctttacttctggcggctgctggcacggcggttggagataggtgtgagcgcaacgaatttcagtgccaggatggcaaatgtatttcctataaatgggtatgcgacggctctgcggaatgccaggatggatctgatgaatcacaagaaacatgtttaagtgtgacatgcaaatcaggagacttctcatgcggcggcagggtaaatagatgcatcccgcagttttggaggtgcgatgggcaagtagattgcgataatggatctgacgaacaaggatgccctccgaagacttgttcgcaggacgaatttcgttgtcatgacggcaaatgcatttccagacaatttgtgtgtgattctgatagggattgtttggatggttcagacgaagcaagctgtccggtattgacctgcggccctgcatcatttcaatgcaatagctctacctgcattccgcagctctgggcttgtgacaacgatccagattgtgaagatgggtctgatgagtggccgcagcgctgcagaggtctttacgtttttcagggggacagctccccttgttctgcctttgaattccattgcctgagtggcgaatgcatccatagcagctggcggtgcgacggcggcccggactgcaaagataaaagcgatgaagagaactgcgcagttgccacatgtaggccggatgagtttcagtgctctgatggcaattgcatccatggcagccgtcaatgtgatcgtgaatatgattgtaaagatatgtcagatgaagtcggatgcgttaatgtcacattatgcgagggcccgaataaatttaaatgtcattctggtgaatgcattacactcgacaaagtttgtaacatggcaagggattgtagagattggtcggacgaaccaatcaaagaatgtggaactaacgcttgccttgacaacaatggaggatgtagtcatgtttgcaacgatttaaagatcggatacgaatgtttgtgtccggacgggtttcagcttgtagctcagcgccgctgtgaagacattgatgagtgccaggatccagatacttgcagccaactgtgcgttaatctcgaaggcgggtataagtgccagtgcgaagaaggctttcaattagaccctcataccaaagcttgtaaagcagtcggtagcattgcctacttatttttcacaaaccgtcacgaggtccgaaaaatgacactggaccgctccgaatatacgagcttaattcctaatttgcggaacgttgtggcactggataccgaggtcgctagcaaccgtatttattggtccgacttaagccagcgtatgatttgtagtacacaattggacagagctcatggcgttagctcatatgacacggtcatatccagggatatccaggctccagacggattagcagtagattggatccattcaaatatctattggacggactcagtgcttggcactgtatctgttgccgatacgaaaggggttaaacgcaaaaccctttttcgggaaaatgggagcaaacctcgcgcgattgttgtggatccagttcacggttttatgtattggactgattggggtacaccagctaaaatcaagaaaggaggccttaacggggtggacatctactccctggtgacagagaacattcagtggcctaacggaatcactctggatcttttatccggtcgcctttattgggttgatagcaagcttcattcaatctccagcattgacgtaaacggagggaatcgcaaaacaattctcgaagacgagaaacgacttgcgcatccattttcacttgctgtctttgaggataaggttttttggacagatatcattaacgaagccattttcagcgcgaatcgacttaccggctctgatgtgaatttgctggcagaaaatctcctgagtcccgaagatatggttttgtttcacaatttaactcaacctagaggtgtcaattggtgcgaaagaacaaccctaagtaatggcggctgccaatacctttgtttgccggccccccaaatcaacccgcattcccccaaatttacatgtgcctgtccggatggtatgcttttagcccgcgacatgcggtcttgcttgacggaagcagaagcggcagtggctacacaggaaacatctacagttagattgaaggtctcctctacagcggttaggacacagcatacgaccacgcgcccagtcccggacacctcgcggctaccgggagcgacccctggtttgacaacagtcgaaattgttactatgtctcatcaggccctcggagatgtggctgggcgtggcaatgaaaaaaagcctagttcggtcagggcactctctatcgttttgccgattgtcttactggtgtttttatgcctaggggtctttctgctttggaaaaattggagattgaaaaatataaattctattaactttgataatccggtgtatcaaaaaacaacagaggatgaggtgcatatatgccataatcaagacgggtactcctatccaagccgccaaatggtgtcattggaggatgatgtcgct

SEQ ID NO: 16272 - DNA, 2580 bp, Artificial Sequence
  Description of Artificial Sequence: Synthetic coding sequence
atgggcccgtggggctggaaactgaggtggacagttgcactgctcttagctgctgctggcacggccgtgggcgaccggtgcgaaaggaatgaattccagtgccaggacggaaaatgcataagctataaatgggtgtgcgacggctcggctgaatgccaggatggaagtgatgagagtcaggaaacctgcctttcagtgacgtgtaaaagcggcgacttcagctgcggaggaagggtaaaccgctgtatcccacaattttggaggtgtgatggtcaagtcgattgcgacaacgggtctgacgagcagggatgccctcccaaaacgtgctcccaggatgagtttagatgccacgacggcaagtgcatttccagacagttcgtgtgtgactccgatcgggattgccttgacggctccgacgaagcatcctgccccgtcctgacctgtgggcctgctagtttccagtgtaacagttccacctgcatccctcagctttgggcctgtgataacgatcctgattgcgaggatggctcagacgaatggccacagcggtgcaggggcctgtacgttttccaaggggatagctcaccctgtagcgcttttgagttccactgtttatctggtgagtgcatccattcgtcctggaggtgcgacggtggacccgactgcaaagacaagagtgacgaagagaactgtgcagtcgctacctgccggcctgacgagttccaatgtagtgatggaaattgcatacatggctcaagacagtgtgaccgggagtacgattgtaaagacatgagtgacgaggtggggtgcgtgaatgtgactctgtgcgaaggtcctaataagtttaagtgtcattccggagagtgtattacacttgacaaggtatgcaacatggctcgagactgccgagattggagcgacgagcccatcaaggagtgcggcacaaatgcctgtctcgataataatggggggtgctcacacgtatgcaacgacctcaaaatcggctatgagtgtttgtgcccagacggttttcagctggtcgcccagcggcggtgtgaagacatagatgaatgccaagatcccgatacctgctcccaactttgcgtgaatctcgagggaggatataagtgccagtgcgaagagggttttcaactcgacccccacaccaaagcctgcaaagctgtggggtctatcgcctacctattctttaccaacaggcatgaagttcgtaaaatgaccctcgatcgcagtgagtacacatctttgattcccaacttgcgaaacgttgtcgcactcgatactgaggtcgcctctaaccgaatatactggtctgacctctcccagcgaatgatttgcagcacacagctggaccgcgcgcatggcgtgtccagctacgatacagtgatcagcagggacatccaagctccggatggactggctgtggactggatccatagcaacatttactggaccgactcggtgctggggactgtttcagtcgcagacaccaagggggtgaagcgcaagaccttgtttagggagaatggcagcaaacccagagcaattgttgtagatcccgtgcatggatttatgtattggactgattggggcactccggccaaaatcaaaaaaggtggcctcaatggggtggatatttactcactggtaacagagaacatccagtggcccaatgggattacactggatctactatcggggaggctctactgggtggacagcaagctacatagcatatcctccatcgacgtcaacggggggaatcgtaagacgatcctggaagacgagaagcggctggctcaccctttcagtttggccgtgttcgaggacaaagtgttctggactgacattatcaatgaagcaattttcagcgcaaatcgtttaaccgggtctgacgtgaatttgttggcagaaaacttgctgagcccagaggatatggttctgttccacaaccttacgcagccgaggggagtcaactggtgcgagaggacaaccctctctaacggcggctgccagtatttgtgtctgcccgcccctcagatcaacccacattccccgaagtttacctgcgcctgcccagacggcatgctcctagccagggatatgagaagctgccttactgaagccgaggcggcggtggcgacgcaggagacatctaccgtgcgcctcaaggtttctagcaccgctgtgcgtacccaacacaccactacaagacctgtaccagacacctcccgcctaccgggagcaaccccaggtctgaccactgtggaaatcgtaaccatgtcccatcaggccctaggtgacgtggccgggagaggtaacgaaaaaaagcctagtagcgtgcgagcactgtctatagtgcttcccattgtactgcttgtttttctatgtctcggggtctttctactttggaagaattggagattgaaaaatataaattctattaatttcgataatcccgtgtatcagaagacaaccgaagacgaagtgcatatctgccataatcaggatggatactcgtaccctagtcggcagatggtgtccctcgaagatgatgtggcc

SEQ ID NO: 16273 - DNA, 2580 bp, Artificial Sequence
  Description of Artificial Sequence: Synthetic coding sequence
atgggaccctgggggtggaaactgagatggactgtagctctacttctcgccgcagctgggacagctgttggagatcgctgcgagaggaacgaatttcagtgtcaggatggaaaatgtatctcatataaatgggtgtgtgacgggtccgcagaatgccaggatggaagtgatgaatctcaggaaacatgcctttccgtgacttgcaaatccggggatttttcctgtggaggaagggtgaacaggtgtataccccagttttggaggtgtgatgggcaggtcgattgtgacaatggatcagatgaacaggggtgtcctcctaaaacttgctcccaggatgaatttaggtgtcacgatgggaaatgtatttcccggcagttcgtatgtgattcagatagggactgcttggatggatccgatgaagcctcttgtccagtgctcacttgtgggcccgcctcttttcaatgtaatagttccacttgcatcccccagctatgggcctgtgataacgatcccgattgcgaggacggaagtgatgaatggcctcagcgatgtcgggggctttacgtatttcagggagattctagtccctgctctgcatttgaattccactgtttatccggagaatgtattcattcatcatggcgctgtgatgggggacccgattgcaaagataaatcagatgaagaaaattgcgcagtggccacttgtcggccagatgagttccagtgttccgatggaaattgcattcacgggagtaggcagtgtgatagagaatatgattgcaaagatatgtcggacgaggttggatgtgtaaatgtgactctctgtgaaggaccaaataaattcaagtgtcactctggagaatgcattactttggacaaagtatgcaatatggctcgtgattgcagagattggtctgatgaaccaataaaagaatgtgggacaaacgcttgtctcgataacaacgggggatgctctcatgtttgcaacgacctaaaaatcgggtatgaatgcctctgcccagacggattccagttggtggcccagcggagatgcgaagacatcgatgaatgccaggatcctgatacttgctcccagctttgcgtcaatctcgagggagggtataaatgccagtgtgaagaaggattccagctggaccctcatactaaagcttgtaaagccgtgggatcaatcgcctacttatttttcacaaatcggcacgaagtgcgaaaaatgactctagataggtcggagtatacatcactcatccccaacctccggaacgttgtagccttagatactgaggtagcctccaaccggatctattggtccgatctgtcacagagaatgatatgctctacacagcttgatcgggcacatggagtgtcttcttatgacacagttatttctagagatatacaggctccagatggactcgcagtagattggattcactctaacatctattggacggattctgtcctgggaacagtgtctgtagcagatacaaaaggagtgaaaaggaaaactctcttccgggaaaatggatccaaacctagggccattgtcgtggatcctgtccacgggttcatgtactggacagactgggggacaccagctaagatcaaaaaagggggacttaacggggtggatatatattcactcgtgacagaaaatattcagtggccaaatgggataacactggacctactatcggggcgcctttactgggtggatagtaaactacactcaatctcttcaatcgatgtcaacggagggaaccgaaagacaatacttgaagatgaaaaacggctggcacatccattttcattagctgttttcgaagataaagtattttggactgacatcatcaacgaagcaatcttctctgcaaaccggcttactgggagtgatgtgaatctgctcgcagagaatttgctttcccctgaagatatggtgctcttccacaaccttactcagccacggggggtaaattggtgtgaacgcactacgctcagtaatgggggatgtcagtatctgtgtcttcctgcacctcagatcaacccccattcgcccaaatttacttgtgcctgtccagatggaatgctgttggcccgggatatgaggtcttgtctgactgaagccgaagcggctgtagcaacacaagagacatccactgttaggctcaaggtcagtagtacagcagtaagaactcagcatactacaacacgcccggtgcctgatacatctagacttccaggggcaactcctggactaactacagttgaaattgtgactatgtcccatcaggcactgggagatgttgctgggcgcggaaacgaaaaaaaaccctctagtgtccgagctctatctatagtactacccattgtcctcctagtattcctttgtcttggagtctttcttctctggaaaaattggagattgaagaacattaactcaattaactttgataaccccgtgtaccagaaaactacagaagatgaagtgcatatctgtcacaaccaggatggatactcatatccttcacggcagatggtgtctttagaggatgatgtggcc

SEQ ID NO: 16274 - DNA, 2580 bp, Artificial Sequence
  Description of Artificial Sequence: Synthetic coding sequence
atgggaccctggggatggaaactgcgctggaccgtggctctgctgctggccgccgccggcactgcggtgggggatcggtgtgaaagaaatgaattccagtgccaggacggaaagtgcattagctataagtgggtgtgcgatggtagtgcagagtgtcaggatgggtccgatgaatctcaggagacttgtctgagcgtgacttgtaagtcaggcgatttttcctgcggaggacgggttaaccgttgcataccacagttttggagatgtgacggccaggtggattgcgacaatgggagcgacgagcagggttgtcccccaaaaacatgctcccaggacgagttcagatgccatgacgggaagtgcatttctagacagttcgtctgcgactccgaccgagattgtctggatgggagtgacgaagcatcatgtcccgtcttaacatgcggacctgcctcttttcagtgcaacagctctacatgtatacctcagttgtgggcatgtgataatgatcctgactgtgaggacggtagcgacgagtggcctcagaggtgtagaggcctctacgtgtttcagggcgactcttcaccatgcagtgcttttgagttccattgcctctccggggaatgtattcacagttcctggcgctgcgacggggggccagactgcaaagataaatccgacgaagaaaattgcgctgtggctacatgccggccagatgaatttcagtgcagcgatggaaattgtattcacggctcccgccaatgtgatcgcgaatacgattgcaaggacatgagcgatgaggtcggatgcgtcaatgtgaccttatgcgaaggtcctaacaagttcaaatgccactcaggagagtgcatcaccctggataaagtttgtaatatggcgagagactgccgtgattggtccgacgagcctatcaaagagtgcggcacgaatgcttgcctggataataatggagggtgttcacacgtctgtaatgatctgaaaataggctacgagtgtttgtgtcctgatggtttccaactagtggcccagcgcaggtgcgaggacattgatgaatgtcaggatccagatacatgctcacaactgtgcgtgaatttagaaggcggttataagtgccagtgcgaagaaggcttccagctcgatccgcacacaaaggcctgcaaggcggtggggagtatcgcctatcttttctttacgaaccggcatgaagtcagaaagatgactctggaccgctccgagtacacatccctcatcccgaacctgagaaacgtggtggcactcgatacggaggtggcttctaatagaatctactggagtgacttgtcccaaagaatgatctgtagcacccagcttgatcgtgcccatggcgtgagctcgtatgacaccgtgatctcacgggacatccaggcacccgatggattggctgtggattggatacattcaaatatttactggacagattccgtgctggggaccgttagtgtggcagatacaaaaggggtgaagagaaagaccctcttcagagaaaatgggtctaaaccgagagctatcgtggtagaccctgtgcacgggttcatgtattggaccgattggggaacaccggccaaaatcaaaaagggcgggttgaacggtgtggatatttactccctggtgactgaaaacattcagtggcctaatggcatcaccctggatctgttgtcaggccgcctctactgggttgactctaagctgcactcgataagttcgatcgacgtgaacgggggcaaccgaaagacaattctggaagacgagaagcgtttggcccatcccttctccctcgctgtgttcgaggataaggtgttttggactgatattattaatgaagctatattttccgctaatcggctgacaggcagcgatgttaacctcttagcggagaatctgttatcacccgaggacatggttctgtttcacaatctgacacaaccccggggtgttaactggtgtgagcgcacaacgctaagtaacggcggctgtcagtacctctgccttccagcgccccagattaatcctcactccccgaagttcacatgcgcgtgccccgatggcatgctattggcgcgagacatgcgatcttgtctgaccgaagctgaagcggccgtggcaacccaggagacctccactgttcggttaaaagtgagttccacagccgtgcgaacccagcataccaccacccgccctgtgcccgataccagcaggctacccggtgctacccccgggttgactaccgtggagatcgtgaccatgagccaccaggcgctcggtgacgtggccggacggggcaatgagaagaagccttccagtgtgcgagctctctcaattgttctgccaatcgttttgctagtgttcctctgcctcggggtatttcttttgtggaagaactggcggctcaagaatatcaattcgattaattttgataacccagtgtatcagaagactacagaagacgaggtacacatctgccacaatcaggacggatattcatacccgagcaggcaaatggtgtctctggaggacgacgttgcc

SEQ ID NO: 16275 - DNA, 2580 bp, Artificial Sequence
  Description of Artificial Sequence: Synthetic coding sequence
atgggaccttggggatggaaactgcgttggacagtggctttgctccttgccgctgccggaactgcagtaggcgatcgttgtgagcgcaatgaattccaatgccaggacggtaagtgcatctcctacaaatgggtctgtgacggctctgcggagtgccaagacggatctgatgagagccaggaaacatgcctgtctgtgacttgcaagtccggcgacttttcatgcggaggtcgtgttaatagatgtattccccaattctggagatgtgacggacaggtcgattgtgataatgggtcagatgaacagggttgtcctcctaaaacctgttctcaggatgaatttcggtgtcacgatgggaaatgcattagcagacaattcgtatgtgattcagacagagactgccttgatggttccgatgaagcaagttgcccggtcctgacttgcggtccggcttcatttcagtgcaatagttccacatgtatccctcagctgtgggcgtgtgacaatgaccctgattgtgaagatggtagtgatgaatggccgcagcgctgccgcgggctgtacgttttccagggagactcttccccctgctcagccttcgaattccattgcctctctggtgaatgcatccacagctcgtggcgatgtgacggaggacctgattgcaaagacaagtcggatgaggagaattgcgcagtggctacatgtcgcccagacgagttccagtgctctgatggtaattgcatacacggatctcgtcagtgtgatcgagaatacgactgcaaagatatgtcggatgaggtgggctgtgtgaatgttaccctgtgcgagggtccaaacaagtttaagtgtcactcaggtgagtgtatcaccttggataaggtgtgtaacatggcgcgcgactgtcgtgattggtcggacgaaccgatcaaggaatgcggaactaatgcatgccttgataataatggtggatgtagccatgtttgtaacgatcttaagattggctatgagtgcctgtgtcccgatgggtttcaattagttgcgcagcgccgctgcgaggatatcgacgaatgccaggatcctgacacctgcagccagctatgtgtgaacctggaaggcgggtacaagtgccagtgcgaagaaggttttcaattggaccctcatacaaaagcttgtaaagcggtggggtcgatcgcgtacctgttctttaccaatcgccacgaggtgcggaagatgactctcgatcgcagcgagtacacaagcctcattcctaacttgcgtaatgtagttgccctcgacaccgaggttgcatccaaccgcatctactggtccgatttgtcccagcggatgatctgctcaactcagttggatcgagcccacggtgtctcaagctatgacactgttatttctcgggatatacaagcccctgacgggctagcagtggactggatccattctaatatctattggactgatagtgtacttggtacggtttctgtggccgacacaaagggagtcaagcgaaaaacattattccgagaaaacggatctaaaccaagggccattgtggttgacccggtgcacggtttcatgtattggactgactggggtacgccggcgaaaattaagaagggtggcctcaacggtgtggacatatattcgctggttaccgagaatatccagtggcctaacggcatcacactggatctcctttcgggtcgcttgtattgggtggactccaaactgcatagcatatctagtattgatgtgaacggtggaaaccgtaaaaccattctcgaggatgagaaacggctagcccaccctttcagcttagctgtgttcgaggataaagtgttttggacagatataatcaatgaggccatattttccgcgaatcggctcaccggttccgatgtcaatctcttggctgaaaatcttctttcgcctgaggacatggtccttttccacaatcttacacagcccaggggggtgaactggtgcgaacgcaccacacttagtaacggcggctgccaatatctctgtctcccagcgccccaaattaatccgcatagtccaaaatttacctgtgcttgccccgacggcatgctactcgcacgagatatgcggagttgtttaacagaagcagaggccgccgtcgctactcaggagacaagtacggtccgtcttaaggtcagttccacggcagtacggacacagcatacgactacccgtcccgtgccagacacgagcaggctgcctggtgccacgccaggtctaacaacggtcgagatcgtgactatgtcgcatcaagccctaggagacgtcgcaggcagaggtaatgaaaagaagcctagctctgttagggctttgtccatcgtcctccccattgtactcttagtcttcttatgcctaggagttttcctgctttggaagaactggagactgaagaacatcaacagtatcaattttgacaatcctgtctatcagaagacgactgaggatgaggtacacatctgccataaccaggacggctattcttatccaagccggcagatggttagtctcgaagatgatgtcgct

SEQ ID NO: 16276 - DNA, 2580 bp, Artificial Sequence
  Description of Artificial Sequence: Synthetic coding sequence
atgggaccctggggttggaaactgcgttggacagtcgctcttctcctcgctgccgctgggaccgcagtcggcgaccgatgtgagagaaatgagttccagtgtcaagatggcaagtgtatcagttacaagtgggtctgtgacggtagtgctgaatgtcaggatggctcagacgaatcacaggagacatgcctatctgtcacgtgtaagtctggcgatttctcctgcggcggtagagtcaaccgctgcatcccccaattttggcgatgcgatggccaggtcgattgtgacaacgggtctgacgagcaggggtgtccccctaaaacatgtagccaggacgagttcagatgccacgatggaaaatgcatctcacgacaatttgtctgtgactccgatcgtgactgccttgatggatccgatgaggccagctgccctgtactgacctgcggtcctgcttccttccagtgtaacagctctacgtgtatcccccagctttgggcatgtgataacgacccagactgcgaggacggctctgacgagtggcctcagcgctgccgaggtctttatgtttttcaaggggatagctcaccttgctccgcctttgaattccactgcctgagcggggagtgtattcatagctcctggaggtgtgacggggggccggattgcaaggacaaaagcgacgaagaaaactgtgccgttgcgacctgccgccctgacgaatttcagtgtagcgacggcaattgcatacatggttctcggcagtgtgatagagagtatgactgtaaggacatgagcgatgaggtaggctgcgtcaacgtcacactgtgcgaaggccctaataagttcaagtgtcattctggcgagtgcataacactggacaaagtgtgcaatatggcccgggattgccgggattggagcgacgagcctatcaaagaatgtgggacaaacgcttgcctcgacaataatggcggatgcagccacgtttgcaacgaccttaaaatcggatacgagtgcttgtgcccagacgggttccagttagtcgcccagcgtaggtgtgaagatattgatgagtgccaggatccagacacctgttctcagctgtgcgtgaacctcgagggcggttataagtgccaatgtgaagaagggtttcagctcgacccccacacaaaagcatgcaaagccgtgggctccatcgcatacctcttcttcacaaaccgacacgaagtcaggaagatgacactggaccgatccgagtacaccagtctcatccctaacctgcgaaatgtggtggctctagacacagaagtggcgtccaaccgcatctattggtccgacctctctcagagaatgatctgctctactcagctagaccgagcacacggagtgagttcatatgatacagtcattagcagagatatacaggccccggacggccttgctgtggactggatacactcaaacatctattggaccgattccgtactcggaaccgtgtctgtagcagacaccaagggagtgaaacgtaagaccctgttccgggagaacggctcaaaaccaagggctattgtggtcgaccctgtgcatggcttcatgtattggaccgactgggggacccctgcaaagatcaagaaaggcggattgaacggcgtggatatctactcactcgtgaccgagaacattcagtggcctaatggtatcacattggatctgttgagtggtcggttgtactgggtagactccaagctgcattcaatctcatccatcgatgtcaacggtggtaatcgcaagacgatacttgaagacgagaaaaggcttgctcacccgttctctctggcagtgttcgaagacaaagtgttctggacagatatcatcaacgaagcaatcttctcagcaaatcggctgacaggatctgacgtgaatttgctcgcagagaatctgctgagccccgaggacatggtcctgttccataacctgacccagccccggggtgtgaattggtgtgagcgcactactctgtcaaacggaggatgtcagtacctgtgtctgccagctccccagatcaacccgcacagcccaaagttcacctgcgcgtgccccgatgggatgctgctcgccagggatatgcggtcttgcttgactgaggcggaagcggccgtggcgacgcaggagacctcaaccgtcagactgaaggtgagctccacagccgtgagaactcagcatacgacaacgcgaccagttccagatacctcccggctgcctggagcgacacccggcctaactaccgtggaaatcgtgaccatgtcacaccaggcactgggagacgtggccggccggggcaacgaaaagaagcccagcagcgtgcgggcactgagcatcgttcttcccattgtgctgctggttttcctatgtttaggtgtgtttctgctgtggaagaactggcgccttaaaaatatcaatagcatcaatttcgacaaccctgtgtaccagaagactaccgaggatgaagtgcacatctgccataatcaggacggctactcttacccatcaaggcagatggtaagtctcgaggacgacgtggca

SEQ ID NO: 16277 - DNA, 2580 bp, Artificial Sequence
  Description of Artificial Sequence: Synthetic coding sequence
atggggccctggggatggaagctccggtggactgtggccctcctcctggccgcagctgggacagccgtcggagacaggtgtgaacgcaatgagtttcagtgccaggacggaaagtgcataagctataagtgggtgtgcgatggatcagctgagtgccaggacgggtccgacgagagccaggagacatgcctgtccgtgacctgcaagtctggtgatttcagttgcggtggtagagtcaatcgatgcatcccacagttttggcgctgtgacggtcaggtcgactgcgacaatggcagtgatgagcagggctgtccacctaagacgtgttctcaggacgaatttcgctgccacgatggaaagtgcatatcaaggcagttcgtgtgcgactcagacagggactgtttagacgggtcagacgaggcttcctgtccggtgctaacttgtggccctgcttcctttcagtgcaactcaagcacctgcattcctcaactatgggcctgcgacaacgatccagactgtgaggacggttcagatgagtggccacagaggtgtaggggactgtacgtcttccaaggggacagctccccctgctctgccttcgagtttcactgtctctcaggtgaatgtatccattcaagttggaggtgtgacggcgggcccgactgcaaggataaatcagacgaagaaaattgcgcagttgccacttgccggcccgatgagttccaatgcagtgacggcaattgcatacacgggtctcggcaatgcgatagagaatatgattgtaaggacatgagtgatgaggtgggttgcgtaaacgtaacactgtgtgagggtcccaataagtttaaatgtcattctggagagtgcatcacgctagacaaggtgtgcaatatggcaagggattgccgtgactggtccgacgaacctatcaaagagtgcgggacgaatgcatgtctggataataatggcggctgctcccatgtctgcaacgatctcaagatcggctatgaatgcctgtgccctgacggatttcaactggtcgcccagcgaagatgcgaggatatcgatgaatgccaagacccagatacctgctcacaactttgtgtcaacctggaaggtggctataagtgccagtgtgaggaaggcttccaattagacccccacaccaaggcttgcaaggccgtcggtagcatcgcctatttgtttttcaccaatcgccacgaggttagaaaaatgacattagaccgcagcgaatatacttctctaatacccaacttgcggaatgtggtggccctcgacaccgaggtggcaagtaatagaatctactggtcagatctgtcccagcggatgatatgtagcacacagctcgaccgggcgcacggcgtgtcatcctacgatactgtcatctctcgggacatccaggccccagacggtcttgcagtggactggattcatagcaacatctactggaccgattccgttttgggtaccgtatccgttgcggataccaagggggtgaaacggaagaccctgttccgcgagaatggttcaaagccaagagctattgtcgttgacccagtacacgggtttatgtattggacggactggggcacccccgccaagataaagaagggcggtctcaacggggtggatatatatagtctggttaccgagaacattcagtggccaaatggcataacactggacctgctgtcaggcagactgtattgggtcgactccaagttgcattcgatttcaagtatcgatgtgaacggtggcaaccgcaagaccattctcgaagacgaaaaacgccttgcccatcccttttcacttgcggtgtttgaggacaaggtattttggactgacataattaatgaagcaattttctccgccaacagactgacgggctcggacgtgaacttgctcgcagagaacttgctatcacccgaggatatggtgctgttccacaacttaacacaaccccgcggggtaaactggtgtgaaagaactaccttatccaacggcgggtgccagtacctctgcctgcctgcccctcagattaatccgcactccccaaaatttacatgcgcctgccctgatgggatgctgcttgccagagatatgcgcagctgtctgacagaagccgaggctgcggtggcgacccaagaaacatcaaccgtgcgcctgaaagtgtcgtctactgcagtccgcacacagcacactacgacacgaccggtaccagatacatcgcgactgcctggagctaccccaggtctcactaccgtggagatagtgactatgtcacatcaggctctcggtgacgtcgcgggacgcggcaacgaaaaaaagccttcctcggttagagcactatccatcgtcttgcctattgtgctgctggtgttcctttgtctgggggtgttcctgctctggaagaattggagactgaaaaacatcaattcaattaatttcgataacccagtgtatcagaagaccaccgaagacgaggtgcatatctgccataaccaggacggttattcgtaccccagcagacagatggtctcccttgaggacgacgtagct

SEQ ID NO: 16278 - DNA, 2580 bp, Artificial Sequence
  Description of Artificial Sequence: Synthetic coding sequence
atgggtccttggggatggaaacttcggtggacagtggcattgctgctcgccgccgccggcacagccgtcggagatcgctgtgagaggaatgagtttcaatgccaggatggaaagtgtatatcctacaagtgggtgtgtgatggttcggctgaatgccaggacgggtctgatgagagtcaggaaacttgtctgtccgtgacttgtaagtcaggcgattttagctgtggcgggcgcgtgaatagatgcattccacagttctggcgatgtgacggccaggtggattgcgacaacggcagtgatgaacagggttgtcccccaaagacctgtagccaggatgaattcaggtgtcatgacgggaagtgcattagccggcagtttgtgtgcgacagcgatagagactgtttggacgggtccgacgaggcttcctgtcctgtgcttacatgcggccccgcctcgtttcagtgtaattcgtcgacctgtatacctcagctctgggcttgcgacaacgaccccgattgcgaggacgggtccgacgagtggccacagcgttgtcgcggcttgtatgttttccagggagattcatcaccttgttccgcatttgaattccattgtttgagcggcgagtgtatccatagtagctggcgatgtgatggcggtcccgattgtaaggataagagcgacgaggaaaattgcgcggttgccacatgccgaccagatgagtttcagtgtagtgacggcaactgcatccatggaagtcgccagtgcgatcgtgagtatgattgtaaggacatgtccgatgaggttggttgtgttaacgttacactgtgtgagggaccaaacaagttcaaatgccactcgggagagtgcatcactctggacaaggtatgtaatatggcccgcgattgtagagactggagcgatgagcccatcaaggagtgcggaacaaacgcctgtctggacaacaacggaggatgcagtcatgtgtgcaatgatctgaaaatcggctacgagtgtctgtgtcctgatggcttccagctcgtggcccaaagaaggtgcgaggatatcgacgaatgtcaagacccagacacttgcagtcagttgtgtgtaaacctcgagggaggatacaagtgtcagtgcgaggaaggcttccagctcgacccacatacaaaggcatgcaaggcagtggggtcaatcgcctacctgttcttcaccaacaggcatgaggtgagaaaaatgacactggataggtccgaatatacatcccttattcctaatctgaggaacgtcgtggcactggatacagaggttgcaagtaacaggatctattggtcagacttaagccagcgcatgatctgcagcacccagctcgatcgcgcccatggggtctccagctatgacacagtgatctccagggacatccaggcccccgacggcctggccgtggattggattcactccaatatctattggacagattcggtgctgggaactgtgtcagtcgccgatactaagggcgtgaagcgcaagacactgtttcgcgagaatgggtccaagccgcgggctattgtggtcgaccctgtgcacggcttcatgtactggacagactggggtactcccgccaaaattaagaaggggggactgaatggcgtcgacatctactcattagtaactgaaaacatccaatggcctaatgggataaccctagatctcctgagtggcaggctttactgggtggacagcaaacttcattcaatttcttctatagacgtaaatggtggcaataggaagaccattttggaagacgagaagaggctcgcccaccccttctccctggccgtcttcgaagataaggtgttctggactgatataatcaacgaagcaattttcagtgcaaaccgactgacaggatctgatgtgaacctcctggccgagaaccttctgtcaccggaggatatggtacttttccataatctgacccagcctagaggagtgaattggtgtgagagaacaacgctcagcaacggtgggtgtcagtacctgtgtctgccagcaccccagatcaatccgcatagccccaaattcacgtgtgcatgccctgacggaatgttactggcgagggacatgcgcagctgtttgaccgaagctgaggccgccgtggccactcaggagacctctaccgtgaggttgaaggtgtcatccacagccgtgagaactcagcacactacaacccggcccgtacctgacaccagccgactgcctggagcaacccccggcttgacaaccgtggagattgtaaccatgtctcaccaggccctgggggatgtggctggtagaggcaatgagaagaagccctcatccgtgcgggccctctcaattgtgttgccaatagtgctcttggtcttcctgtgcctcggcgtgttccttctgtggaaaaattggcgactcaagaacatcaattccattaactttgataaccctgtctaccagaaaaccaccgaagatgaggtgcacatttgccacaaccaggatggctactcttacccttcccggcagatggtgtcgctggaagacgacgtggcc

SEQ ID NO: 16279 - DNA, 2580 bp, Artificial Sequence
  Description of Artificial Sequence: Synthetic coding sequence
atgggaccttggggctggaagctcagatggacggtcgctctcctcctcgcagcagccggaaccgcagtcggggataggtgtgagaggaatgaattccagtgtcaggatggaaagtgtattagctacaagtgggtgtgtgacggatcggctgaatgccaagatggctccgatgaatcgcaagaaacttgtctctcggtcacctgtaagtccggcgatttttcgtgtgggggccgggtcaatcgttgtattccacaattctggagatgcgacggacaagtggattgtgacaacggttcggacgaacaaggatgtcccccaaagacttgcagccaagacgagttccgatgccatgatggaaaatgtatatccagacaatttgtgtgtgactcagatcgtgactgtcttgatggttcagatgaggccagctgccctgtgcttacttgcgggccggcatcctttcaatgtaactcgtcgacctgtatacctcagctttgggcatgtgacaatgatcccgattgcgaggatgggtccgatgagtggcctcagagatgtagaggactctacgtttttcaaggcgatagctccccgtgctcggcttttgaatttcactgtctttccggagagtgcatccattcctcatggcgctgtgacgggggccctgactgtaaggacaagtcagacgaggaaaattgcgcagtggcaacttgccgaccggatgaattccaatgctcggatggaaattgtatccatggtagcagacagtgtgatcgcgagtacgactgtaaagatatgtcggatgaagtgggatgcgtcaacgttactctgtgcgaaggtccaaacaagttcaaatgccactcgggcgaatgcattactcttgataaggtctgtaacatggccagagattgtcgagactggtccgacgagccgattaaggaatgtggtactaacgcatgtctggacaataatgggggctgtagccatgtgtgcaacgatctcaagattggttacgaatgcctttgtccagatggattccaactggtggcacaacgaagatgcgaggacattgacgaatgtcaagatcctgatacttgctcccaactgtgcgtgaacctggagggcggctataagtgccagtgtgaagaaggtttccaactggaccctcatactaaggcatgtaaggccgtgggtagcatcgcatacctcttcttcaccaaccgacacgaagttcggaagatgactcttgatcgttcggaatacacctctctgatccctaatttgagaaatgtcgtggcacttgataccgaagtggcaagcaaccggatctactggtccgacctttcgcagcgtatgatttgctccacgcagctcgaccgggcacatggtgtgtcgtcgtacgatactgtcatctcacgggacattcaggctcctgacggactcgccgtggattggattcatagcaacatttactggactgactcggtgctgggaacggtgtcagtggctgacaccaagggcgtgaagcggaaaaccctctttcgggaaaacgggtcgaagccgcgggctatcgtggtggacccagtccatggattcatgtattggaccgactggggaactccagccaaaatcaaaaaaggtgggctgaatggggttgatatctacagtctcgtgaccgagaatatacaatggcctaatggaataacccttgatctgctctccggaaggctgtactgggttgattccaaactccatagcattagctcaattgatgtgaatggcggtaaccgcaagactatcctcgaagatgaaaagagacttgcacatccattcagccttgccgtatttgaggacaaagtgttctggactgacattatcaacgaggcgatcttttcggcaaaccggcttaccggttcggatgtgaacctgcttgcagaaaacttgctgtccccggaagatatggtcttgtttcataatcttactcagccacggggagtgaactggtgcgaaaggactactctgtccaatggaggctgccagtacctgtgccttcccgcacctcagatcaacccacattcccccaagttcacttgcgcgtgtccagacggaatgctgctggcaagggatatgaggagctgcctgactgaagcagaggcagccgtggcaactcaagaaacttcgaccgtgaggctcaaggtgagctcgactgcagtgagaactcaacataccaccacccgcccagtgcccgatacttcgcgccttccaggagccactccagggctcaccactgtggaaattgtgaccatgtcgcatcaagcgctcggagacgttgcgggaagaggtaacgagaagaaaccatccagcgtgagagcactctcgatcgtccttcctattgtgcttttggtgtttctctgccttggagtgttcctcctgtggaagaactggagactcaaaaacatcaacagcataaactttgacaaccctgtgtaccaaaaaacgaccgaagatgaagttcacatctgccacaaccaggatggttacagctacccttcgcggcagatggtgtctcttgaggacgacgtcgcg

SEQ ID NO: 16280 - DNA, 2580 bp, Artificial Sequence
  Description of Artificial Sequence: Synthetic coding sequence
atgggaccctgggggtggaaattgcggtggaccgtcgccctgctgcttgcagcagccggtaccgccgtgggagatagatgcgaacggaatgagttccaatgccaagatggtaagtgcatctcgtacaaatgggtctgcgacggctcagcggagtgtcaagacggctccgatgagagccaggagacttgcctttcggtcacgtgtaaatcgggtgatttctcgtgcggaggacgggtgaatagatgtatcccccaattctggaggtgtgatggtcaggtcgactgtgacaacggttctgacgagcaaggttgcccaccaaagacttgtagccaggatgaatttagatgtcatgacggtaaatgtatctcacgacagtttgtgtgtgattccgaccgcgactgtctggatggatcggacgaagcatcctgcccagttctgacctgtggacctgcttcgtttcaatgtaactcatcgacttgcatcccgcaactttgggcctgcgacaacgatcctgattgtgaagatggttcagatgagtggccccagcgttgtagaggactgtatgtgtttcagggcgactcctccccatgctcggcattcgaatttcattgcctgtcgggagagtgcatccactcgtcctggagatgtgacggaggtcctgactgtaaagataagagcgatgaagaaaattgtgctgttgcaacttgcagaccggacgaatttcaatgctcggacggaaattgtatacatggatccagacagtgcgatcgagaatatgattgcaaggacatgtcagacgaagtgggatgtgtcaacgtcaccctgtgtgagggacctaataagtttaagtgtcactcgggagaatgcattacgctggacaaagtatgtaacatggcacgcgactgtcgcgattggtcggatgaaccaatcaaagaatgtgggactaatgcgtgtctggacaataacgggggttgtagccacgtctgtaatgatctgaagataggatacgagtgtctgtgtccagacggcttccaattggtggcacaacggcggtgtgaggacattgacgaatgccaagaccctgatacgtgttctcaactctgtgtgaacctcgaaggaggctacaaatgtcaatgcgaggaaggatttcaacttgatcctcacaccaaagcatgtaaggcagtgggttcgatcgcatacctcttcttcactaacagacatgaggtgagaaaaatgaccctcgaccggtccgaatacacttcgctgattcctaatctgcgcaatgtggtcgcgctggataccgaggtcgcttccaacagaatttactggtcagatctttctcaaagaatgatttgctccacccaactggatagggcgcacggagtgtcctcctacgatactgtgatcagtcgtgatatccaggccccagacggtctggcagttgattggattcattcaaatatctactggaccgattcggtgttgggtactgtcagcgtggcagatactaaaggcgtcaaaagaaagacccttttccgggagaacggtagcaagcctcgggcaatcgtggtcgatcctgtgcatggatttatgtactggactgattggggtactcctgcaaagatcaaaaaaggaggcctcaacggcgtggatatctactcgctggtgaccgagaatattcagtggccgaacggcattactctggaccttctgtccggtaggctgtactgggtggacagcaagctccatagcatttcttcaattgatgtgaacggtggtaaccgaaagactatcctggaagatgaaaagagattggcccatcccttttcacttgcggtctttgaggacaaggtgttttggaccgacatcattaatgaagcaatcttctccgccaaccggctgacgggctcagatgtgaaccttctggcggagaacctgctgtctccggaagatatggtcctctttcacaatcttactcaaccacgaggagtcaactggtgtgagagaacgaccctgtcaaacggaggttgtcagtacctttgtctgccagcacctcagatcaatccgcattccccaaagtttacctgtgcctgtcctgatggaatgttgctggcacgcgatatgcgctcgtgtcttacggaagcagaagccgcagtggctacccaggagacttcaaccgtccgacttaaggtgtcctccactgcggtgcgtacgcagcatactaccacgcgtcctgtgccagacacctcgcgcctgccgggggcaactcccggcttgactactgtcgaaattgtgaccatgtcccatcaggctctgggagatgtggcaggccggggaaacgagaaaaagccatcctcggtgcgtgcgctgtccatcgtcttgccaatcgtcctcttggtgttcctttgcctgggagtgttccttctctggaagaattggagactcaagaacattaactccattaactttgataacccggtgtaccaaaagacgaccgaagatgaagtgcacatctgtcacaaccaagatggctactcatacccctcgcgacagatggtgtcgctggaagatgatgtggca

SEQ ID NO: 16281 - DNA, 2580 bp, Artificial Sequence
  Description of Artificial Sequence: Synthetic coding sequence
atgggtccgtggggatggaaacttcgctggactgtggctctgctgctcgcggcagcagggaccgccgtgggagacagatgtgaacgcaacgaattccagtgtcaagatgggaagtgtatttcatacaagtgggtctgcgatggatccgcagaatgtcaagacggcagcgacgagtcgcaggaaacttgtctctcagtgacttgtaagagcggagatttttcctgtggcggacgggtgaaccgatgtatcccgcagttttggcgatgtgatgggcaggtggattgcgataacggatccgatgaacagggctgcccgccaaaaacctgtagccaagatgagttcaggtgtcatgatggaaagtgtatttcgaggcagtttgtgtgtgattctgaccgcgactgtctcgatggaagcgacgaggcctcctgtcctgtgctgacttgcggcccggcaagtttccagtgtaacagcagcacttgcattccccaactttgggcatgtgacaatgatccagattgcgaagatggttccgacgaatggcctcaaagatgtagaggactttacgtgtttcaaggtgactcgtccccttgttccgcgtttgaatttcattgtcttagtggagagtgtatccactcgtcctggcgctgtgatggaggtccagattgtaaagacaagtccgatgaagagaactgtgcagtggccacttgccgacccgatgagtttcaatgttctgatggaaactgcatccacggttcacgccaatgcgatagagaatacgactgtaaggacatgtcagatgaagtcggctgcgtcaacgtgacgctctgcgagggtcctaataagttcaagtgccattcaggagagtgcattactctggataaggtgtgtaatatggcaagggattgtagggattggtcggatgagcctataaaggaatgtggcaccaatgcctgccttgacaacaatggcggatgcagtcatgtttgtaatgacctgaaaattggttacgaatgcctgtgcccagatgggtttcaattggtcgcccaacgccgctgtgaggacatcgacgagtgccaggatcccgacacgtgctcacaactgtgcgtgaacctggaaggtgggtacaagtgccagtgcgaagaaggatttcagcttgatcctcatactaaagcatgcaaggcagtgggctcgattgcatacttgttctttaccaatcggcacgaagtgcgtaaaatgacgctggacagatcggaatacacctccctcattcctaaccttagaaatgtggtggcacttgatactgaagtggccagcaacagaatttactggtccgatctttcacagcgtatgatatgtagcacccaactggacagagcacatggggtatcgtcatatgatacggtgatttcgagggacatccaggctccggatggacttgcggtcgattggattcacagcaacatttactggaccgactctgtgcttggtacggtgtcggtggcagataccaaaggcgtcaagcgtaagacgcttttcagagagaatgggtccaagcctcgagcaattgtggttgacccagtccatgggttcatgtactggactgactggggaactcccgctaagattaagaagggtggtcttaatggagtggacatctacagcctggtgaccgagaacatccaatggcctaatggcatcaccctcgatcttctttctgggagattgtactgggtagatagcaaactccactcgatctcatcaattgacgtgaacgggggtaatcgcaagactatactcgaagatgaaaaaaggttggcccatccattctcccttgcggtgtttgaggataaggtcttttggaccgatatcataaacgaagcgatcttttcggcaaaccggcttactggatcagatgtcaacctgctggcagaaaatcttctctcgcccgaggatatggtgctgtttcacaaccttactcaaccacgaggagtcaactggtgcgagaggaccacgctttccaacggtggttgtcaatacctctgtctgcctgcaccccagataaacccacattcgccaaagttcacctgtgcatgccctgatggcatgttgctggcaagggacatgcggtcgtgtctgaccgaagcggaagcggccgtggcaacccaggaaacttcgaccgtcagactgaaggtgagcagcactgctgtcaggacccagcataccactacccgtcccgtccctgacacctcgagactgcctggtgccacccctggtcttactaccgttgaaatcgtgactatgtcgcatcaggcccttggagatgtggctggacgcgggaatgaaaagaaaccaagttcggtgagagcgctgtcgattgtgcttccaatcgtcctccttgtgttcctttgtctgggcgtgtttttgctctggaagaattggcgcctcaaaaacattaacagcatcaatttcgacaaccctgtataccaaaagaccactgaagatgaggtgcatatttgtcacaaccaagacgggtactcctatccatcccgtcaaatggtatcgctggaggatgacgttgca

SEQ ID NO: 16282 - DNA, 2580 bp, Artificial Sequence
  Description of Artificial Sequence: Synthetic coding sequence
atgggcccatggggctggaagctccggtggactgtcgccctgctgctcgccgcagccggtaccgcagttggggatagatgcgaacgcaatgagtttcaatgtcaggatggcaagtgtataagctacaagtgggtgtgcgacgggtcagccgaatgccaggacggctctgacgagtcgcaggagacatgcctgtccgtgacgtgcaagtcgggcgatttttcctgtggtggacgggttaatcgctgtattccacagttctggcggtgtgacgggcaagtggactgtgataatgggtctgatgagcagggctgtcctccaaaaacttgttcgcaggacgaattcagatgccacgatggcaagtgcataagtaggcagttcgtatgcgacagcgatagggactgcttggacggaagcgacgaagcctcttgtcctgtgttgacatgtggaccagctagtttccagtgtaactcatctacctgcatccctcagctgtgggcctgcgacaacgaccccgactgcgaggatggtagcgacgaatggcctcagcgctgtcggggtctttacgtttttcagggggattcgagcccatgctctgcttttgagtttcattgcctgtctggagaatgcattcatagcagctggaggtgcgacggcggccccgattgtaaagacaagtctgacgaagaaaattgtgctgtggctacttgcagacctgacgaatttcagtgctctgatggcaattgtattcatggcagtcggcagtgcgatagggaatatgattgtaaggatatgtctgacgaggtgggttgtgttaatgtgacgctgtgtgaggggcccaacaaattcaagtgccacagcggggagtgcatcaccctcgacaaagtgtgcaatatggcgcgtgactgcagggactggagcgacgaacctataaaggagtgcggcaccaatgcatgcttagataacaacggtggctgtagccatgtttgcaacgatctgaaaatcggatatgagtgcctctgccccgacggcttccaattagttgcgcagcggaggtgtgaagacatcgatgagtgccaggacccggacacgtgctcgcagctgtgtgtgaatttggaaggaggctacaagtgccagtgcgaggaaggcttccagctggaccctcatacaaaagcctgtaaggctgttgggtccatcgcatatttattctttaccaatcggcacgaagtcaggaagatgaccttggaccggtctgaatacaccagcttgatcccaaatttaaggaatgtcgtggctttggataccgaggtagcttccaatagaatctactggtcggacctctcccagaggatgatttgttctacccagctggatcgtgcccatggcgtgagctcttatgataccgtgatcagccgcgatatccaagcacctgatgggctggcggtggactggatacactccaacatctattggactgacagtgtgcttggcaccgttagtgtcgccgatactaaaggggtaaaaagaaaaaccttgttccgagaaaacggatctaaacccagggcgattgtggtggaccctgttcatggattcatgtactggacagactggggaactcccgccaagattaagaagggggggttaaacggcgtggacatttattcactcgtgactgagaatatccagtggcccaatggtatcacgctagatctgctctcgggtcggctttactgggttgactcaaagctgcattccatctcatctatcgatgttaacggcggaaatcgaaagaccatcctggaagacgagaagcgtctggcacatccattttccttagcagtattcgaagacaaggtgttctggactgacattattaacgaggctatctttagtgcaaaccgtttgactggctccgacgtgaacctgctggccgaaaacctgctaagcccggaagacatggtgttattccacaacctgacccagccgcggggagtcaactggtgtgagcgaacaaccctctctaacggcggctgtcaatatctatgcttgcctgcgcctcagataaacccacacagcccaaagtttacttgtgcatgcccagatgggatgctgctagccagagatatgcggtcctgcctgacagaggccgaagccgctgtggcaactcaggagacgagcacagtgcgactgaaggttagtagcaccgcagtgagaactcagcacaccaccactcgtcctgtaccagatacttctcgattacctggtgcaacaccgggactaactaccgtcgagatcgttacaatgtctcaccaggctctgggagatgtagctggcagaggaaatgagaagaagcccagcagcgtacgcgcgttgtctattgtgctccctatcgtgctactggtattcctctgcctcggagtttttttactttggaagaactggcgactgaagaacataaattccatcaattttgacaacccggtttaccagaagacaacagaggatgaagtacacatatgtcacaaccaggacggctacagctatccatctagacagatggtttccctcgaagacgatgtggca

SEQ ID NO: 16283 - DNA, 2580 bp, Artificial Sequence
  Description of Artificial Sequence: Synthetic coding sequence
atggggccgtggggatggaagctgcggtggaccgtggctctcctcctggccgcggccggaaccgctgtcggtgaccggtgtgaaagaaacgaattccagtgtcaagatggaaaatgcatctcctacaagtgggtgtgcgatggatccgccgaatgccaggacggatcggacgagtcccaagaaacttgcctgtcggtgacgtgtaagtcaggagatttctcgtgcggagggagggtgaacagatgtatcccccagttctggagatgtgacggccaggtggactgtgacaacgggtcagacgaacaggggtgcccgccgaaaacttgttcccaagatgaattcaggtgtcacgacggcaagtgcatctcacgccagttcgtctgcgactcggaccgggactgcctggacgggtcggacgaggcttcctgcccggtgctgacgtgtggacccgcgtcgttccagtgcaattcctcgacttgtattccgcagctgtgggcctgcgacaacgacccggactgcgaggacggctcagacgaatggccccaacgctgccgaggcctgtacgtgttccaaggcgattcatccccgtgttccgccttcgaattccattgcttgagcggggaatgcatccactcgagctggcggtgtgacggcggtcccgattgcaaggacaaatcggacgaagaaaactgtgcggtggcaacgtgtcggccggacgaatttcagtgttctgatggaaactgcatccacggcagccggcaatgcgaccgggagtacgattgtaaggacatgagcgacgaagtcggatgcgtgaacgtcaccctgtgtgaaggtcctaacaagttcaaatgccacagcggcgagtgcatcacccttgataaagtgtgcaacatggccagagactgccgcgattggtcggacgagccgatcaaagaatgcggaaccaatgcgtgcctggacaacaatgggggatgttcacatgtctgcaatgacctcaagatcggttatgagtgcctgtgtccggacgggttccagttggtggcccaaaggcggtgcgaagatattgacgagtgtcaggaccccgacacttgctcccagctgtgtgtgaaccttgaaggcggatacaagtgccaatgcgaagagggcttccagctggatccgcacaccaaagcgtgtaaggctgtgggaagcatcgcctacctcttcttcactaaccggcacgaggtgcggaagatgactctggataggtcagaatatacgtcgctgatccccaatttgcggaacgtcgtggcgctggatacggaagtcgccagcaaccgcatctactggtcggatctttcgcagagaatgatctgctccacccaactggatcgcgcacatggggtcagctcgtacgacaccgtgatcagccgcgatatccaggctccagatggactggcggtggattggatccattcaaacatttactggactgactctgtgcttggaaccgtgagcgtggctgacaccaagggagtgaagcgcaagactttgttccgcgaaaacgggagcaagccgcgagcgatcgtggtggatccggtgcacggcttcatgtactggacggactggggcaccccggcaaagatcaagaaagggggtctgaacggagttgacatctactccctggtgaccgagaatatccaatggccgaacggcatcactctcgatctgctgtcaggtaggctgtactgggtcgactcgaagctgcattcgatcagctcaatcgatgtcaacggaggaaaccgcaagaccatcctcgaagatgaaaagcggctggcgcacccattctcgctcgccgtgtttgaggacaaggtcttttggaccgacattatcaacgaggcgatcttttcggccaaccgcctcacgggaagcgatgtgaacctgctggccgaaaatctcctctcaccggaggacatggtcttgttccataacctgacccagccgagaggtgttaactggtgcgaacggaccacgctttctaatgggggatgccagtacctgtgcctccctgcgccacagatcaatcctcatagcccgaagtttacttgcgcctgccccgacggaatgttgctcgccagagacatgcgctcgtgcctcactgaagccgaggcggcggtcgcaacccaggaaacttcgaccgtgcggctgaaggtgtcctccactgcagtgcgcacccaacataccactaccagaccggtgccagatacctcgagacttcctggggccactcccggactgaccaccgtggagatcgtcactatgtcgcaccaggcgctcggtgacgtggcaggaagagggaacgagaagaaaccgtcctcagtgcgggctctgtccattgtgctgcctatcgtgctgctcgttttcctgtgcctcggcgtctttctgctgtggaagaattggcgactgaagaacatcaatagcatcaacttcgacaatcctgtctaccaaaagaccaccgaggatgaggtccacatctgtcataaccaagacggctactcctacccatcccgccaaatggtgtcgctggaagatgatgtggcc

SEQ ID NO: 16284 - DNA, 2580 bp, Artificial Sequence
  Description of Artificial Sequence: Synthetic coding sequence
atggggccatggggatggaagctgcggtggactgtggccctgctgctggcagcggctggtactgcggtcggagacagatgcgaacggaacgaattccagtgtcaagacggaaagtgcatcagctacaaatgggtctgcgatggatccgccgaatgccaagacggttcggacgaatcacaggagacttgcctgtctgtgacttgtaagtccggagatttctcgtgcggcggacgcgtcaaccgctgcatcccgcagttctggcgctgtgacggtcaagtggactgcgataacgggtccgacgagcagggctgcccgcctaagacttgttcgcaggacgagtttcggtgtcacgacggcaagtgtatttcccgccagtttgtgtgcgactccgaccgcgactgcctcgacggatcggatgaagcgtcatgcccagtgctcacttgcggaccagcctccttccagtgcaactcttcgacttgcatcccccaactgtgggcctgcgataacgacccggattgcgaagacggatctgacgaatggccacagcgctgcaggggcctgtacgtgttccaaggcgactcgtcaccgtgctccgcttttgaattccactgcctgtcgggagaatgcatccatagcagctggagatgcgacggcggacccgattgcaaggacaaaagcgacgaagaaaattgcgccgtggccacttgccgcccggatgagttccaatgctcggatggaaattgcatccacgggagccggcaatgcgacagagagtacgattgcaaagatatgagcgacgaggtcggatgcgtgaatgtgaccctttgcgaagggcctaacaagttcaagtgccactcgggggaatgcatcactctggacaaagtgtgcaacatggcacgagactgccgggactggtcggatgagccaatcaaggagtgtggaactaacgcttgcttggacaacaacggcggttgttcacatgtgtgtaacgatctcaagatcggatacgagtgtctgtgcccggacgggttccagctggtggcgcaacggcggtgcgaggacatcgatgaatgccaagatcctgatacctgctcgcagctgtgcgtcaatctggaaggtggttacaagtgccagtgcgaggaagggttccaacttgacccgcacaccaaggcttgcaaagccgtcggaagcatcgcttatctgttctttaccaaccgccacgaagtgaggaaaatgaccctggacagaagcgagtacacctccctgatccctaatctgcggaacgtggtcgcgctcgacaccgaagtggccagcaaccggatctactggtctgacctgagccaacgaatgatttgcagcacccagttggaccgggcccatggtgtgtcgagctacgacacggtgatcagccgggacattcaggcgccggacggcctggctgtcgattggatccatagcaacatttactggaccgactcagtgctcggaactgttagcgttgctgacaccaagggagtgaagcggaaaactctcttcagagagaacggtagtaagccaagagctatcgtcgtagatccggtgcacggtttcatgtattggacggattggggaacgcccgcgaagatcaagaagggaggactcaatggagtggatatctacagccttgtcaccgagaacatccagtggccgaacggaatcaccctggacttgctgtccgggagactttactgggtggactcgaagctgcactcgatctccagcatcgacgtgaatgggggaaatagaaagaccatcctcgaggacgagaagcggctcgctcatcccttttcgctcgctgttttcgaggacaaggtgttttggacggacatcatcaacgaggccatcttttccgctaatcgcctgaccgggtcggatgtcaacctgctggcggaaaatctgctttcccctgaagacatggtgcttttccataacctcacgcagccccgcggagtcaactggtgcgagcgcactactttgtcaaacggagggtgccagtacttgtgtctcccggctccgcagatcaacccacacagccccaaattcacctgtgcatgccccgatggaatgctgctcgcccgggacatgcggtcctgcctcactgaagcggaggctgcggtcgcaacccaagagacttcgaccgtgcggcttaaagtgtcgtcgactgccgtccgcacccagcatactaccacgcggccggtgcctgacaccagccgcctcccaggcgcgactccaggactgacgacggtcgagatcgtgaccatgagccaccaggcactcggcgatgtggccgggcgcggaaatgagaaaaagccatcgtccgtgcgggccctttccatcgtgctgccgatcgtccttttggtcttcctctgcctcggggtcttcctcctgtggaagaactggcgcctgaagaacatcaacagcatcaacttcgataatcctgtctaccagaagactacggaagacgaggttcacatctgccataatcaggacggatacagctacccatcacggcaaatggtgtcccttgaagatgacgtggca

SEQ ID NO: 16285 - DNA, 2580 bp, Artificial Sequence
  Description of Artificial Sequence: Synthetic coding sequence
atgggtccatggggctggaaactgagatggaccgtagccctgctcctggcggccgcaggaacggcggtcggagatcgatgcgagaggaatgagttccagtgtcaggacggcaagtgtatatcgtacaagtgggtctgtgacgggtcagccgaatgtcaggatggttcggatgagtcgcaggagacgtgtctgtccgtcacttgcaagtcaggagatttctcatgtggaggacgggtgaacagatgcattccgcagttctggcggtgtgatgggcaagtcgattgtgacaacggatcggacgaacaagggtgcccgccaaagacctgttcgcaggacgaattcagatgccacgatggtaagtgtatctcgcggcagttcgtgtgcgattccgaccgggattgcctggatggatcagacgaggcgtcgtgccctgtgctgacctgcgggcctgcctcgttccaatgtaattcgtcgacctgtatcccccagctctgggcctgcgacaatgatcctgactgcgaagatggttcagacgagtggccccagagatgtaggggactgtacgtgtttcagggagacagctcgccttgtagcgcattcgagtttcattgccttagcggagaatgcatccattcatcctggcgctgcgacgggggaccggactgtaaggacaagtccgacgaagagaattgcgccgtcgcgacttgccggccggacgaattccagtgctcggacggtaactgtattcatgggtcccggcagtgcgaccgcgagtacgactgcaaagacatgtccgacgaggtcggctgcgtgaatgtgaccctctgcgaaggcccgaacaagttcaagtgccatagcggggagtgcatcacccttgataaagtctgcaacatggcccgcgattgccgcgattggtcggacgaaccgatcaaagagtgcggaactaacgcatgtctggacaacaatggaggatgctcgcatgtctgtaacgacttgaagattggctacgagtgcctgtgcccggatggattccaactggtggcccagcggcgctgtgaagatatcgacgaatgccaggacccagacacttgctcgcaactctgtgtgaacctggaaggagggtacaagtgccagtgcgaggaaggattccagcttgatccgcacactaaggcctgcaaagcggtgggatcaatcgcttacctgttctttaccaatagacacgaggtcaggaagatgactttggatcgcagcgagtacacgtccctgatccctaaccttcggaacgtggtcgccctggataccgaagtggcgtccaacagaatctactggtcggatctgtcgcagcgcatgatctgctctactcaactggaccgggcccacggagtgtcgagctacgacaccgtcatctcgagggacatccaagctccagacggactcgccgtcgattggatccactccaatatctactggaccgattcagtgctggggaccgtctccgtggcagacactaagggagtcaagagaaagacgttgtttagggagaatggttccaagccgcgcgccatcgtggtcgatcccgtgcatgggttcatgtactggaccgactggggaaccccggctaagatcaaaaaggggggactcaacggcgtggacatatacagcctcgtgactgagaatatacagtggcccaacgggattacgctggacctccttagcggaaggctgtactgggtcgactccaagctgcactcgatctcatcaattgacgtgaacggaggcaaccgcaagacgattctggaggacgagaagcggctcgcacatccgttctcgctcgccgtgttcgaagataaggtgttctggaccgatatcatcaacgaagctattttctccgccaaccgcctgactggatccgatgtgaacctgttggcggaaaacttgctgagcccagaggatatggtgctgttccacaacttgactcagccaaggggagtgaactggtgcgaaaggactaccctgagcaacggcgggtgccaatacctgtgccttcccgcgccccaaatcaatccgcactccccgaagttcacttgcgcttgccctgatggaatgcttctcgccagagatatgaggtcgtgcctgaccgaagcggaggcagccgtggccacccaggaaactagcacggtgcggctgaaagtctcgagcacggctgtgcggactcaacataccactactcgccctgtgccggacacctcccggttgccaggcgcgactcccggactgaccactgtggaaatcgtgaccatgtcacaccaggctttgggagatgtggcaggacgcggcaatgagaagaagccgtcgagcgttagagcattgagcatcgtcttgccgattgtcctcctcgtctttctgtgcctgggagtgttcctgctgtggaaaaactggcgcctgaagaacatcaactccatcaactttgacaaccccgtgtaccaaaaaactaccgaagatgaagtgcacatctgtcacaaccaggatggctactcgtaccctagccggcagatggtgtccttggaagatgatgtggcg

SEQ ID NO: 16286 - DNA, 2580 bp, Artificial Sequence
  Description of Artificial Sequence: Synthetic coding sequence
atgggtccttggggatggaaactccgctggacagtcgctctactgctggccgccgcaggaactgccgttggtgaccgctgcgaacgcaacgagtttcagtgccaggatggcaagtgcatctcttacaaatgggtgtgcgatgggtcggcagaatgtcaggacggtagcgacgaatcccaagaaacatgcctgtccgtcacctgcaaaagcggcgatttcagttgcggcggtagagtgaatagatgtattccgcagttctggagatgcgatgggcaagtggactgtgacaatgggagtgatgaacaggggtgcccgcccaagacatgtagtcaggacgaattcaggtgtcacgacggcaaatgcatctctaggcagttcgtctgtgatagcgatcgggattgtcttgatggatctgatgaggcctcatgtccagtattgacttgcggacctgcttctttccaatgtaactcatccacttgcatacctcagctgtgggcttgtgacaatgatcctgattgcgaggatggcagcgatgagtggcctcaacggtgtcgtggcctctacgtattccaaggggacagctccccctgtagtgccttcgagtttcactgcttaagtggcgagtgtatccatagtagctggagatgtgatggcggtccggattgcaaggacaagtctgatgaggagaattgcgctgttgctacgtgtcgccccgacgaatttcagtgcagcgatggcaactgcatccatggcagcagacagtgcgacagagagtacgactgcaaagacatgagcgacgaagtgggttgtgtgaatgtgaccctatgcgagggccccaataaattcaagtgtcactccggggagtgtataacactagataaggtttgcaacatggcccgcgactgtcgtgattggagtgacgaacctatcaaagagtgcggaacaaacgcatgcctggataacaatggcggctgtagtcatgtgtgcaacgatttgaagattggctatgaatgcctatgccctgatggctttcagttggtggctcagcgcagatgcgaggacatcgatgaatgtcaggaccccgacacctgctcacagctgtgcgttaatcttgagggcgggtataagtgccagtgtgaggagggcttccagctcgatccacacaccaaggcatgtaaggctgtggggtcaatcgcctatcttttctttaccaaccgccacgaggttcggaaaatgacactggaccgcagcgagtatacatcactgatcccgaacttgaggaatgtggtcgccttagataccgaggtcgcttctaacaggatctattggtcagacctttctcagaggatgatctgctctacacagcttgaccgggcgcacggagtcagttcctatgacaccgtcataagccgcgacatccaggctccagatggtctcgccgttgactggattcattcaaacatctactggaccgatagtgtgctgggcacagtcagcgtggctgacacgaagggcgttaaaaggaaaaccctgtttcgggaaaatgggtctaagccccgagccattgtggtggatccagtgcacggctttatgtactggacagattggggtactcctgctaagattaaaaaaggaggacttaatggggtagacatctatagcctggtaaccgaaaacatccaatggcccaatgggataactctagacctcctgagcgggagactgtactgggtagacagtaaacttcactcaatttcctccatagacgtgaacggcgggaatcgaaagactatattagaagacgagaagcggctggcacatccattcagcttggctgtctttgaagacaaggtattctggaccgacattatcaatgaggcaatatttagcgctaatcgcttgacagggtctgacgtaaatctccttgccgagaatctcctgtcccctgaagacatggtcttgttccacaatctgacccaacctaggggtgtgaactggtgtgagagaactacactaagtaatggtggatgtcagtatctctgcctgcctgcgcctcagatcaacccgcattcccctaagtttacatgtgcatgcccagacgggatgttgcttgcacgcgatatgcggtcttgtcttactgaggcagaggcggctgtggccacacaggagactagtaccgtgcgtttaaaagtaagctctaccgcagtccgcacccagcatacaacgacacgtccagtcccggatacatctcggctgcctggcgccacacccggtcttaccaccgtcgaaattgtcacaatgagtcatcaggcgcttggggacgtggctgggaggggcaatgaaaagaaacccagttccgtgagagcgttgagcattgtgctgcccattgtcctgctagtgtttttatgtttgggcgtgttcctgctgtggaaaaactggcgactgaagaacataaactccattaactttgacaatcctgtatatcaaaagaccacggaagacgaggtccatatctgtcataaccaggacggctactcctacccatccagacagatggtttccttggaagacgatgttgcc

SEQ ID NO: 16287 - DNA, 2580 bp, Artificial Sequence
  Description of Artificial Sequence: Synthetic coding sequence
atgggtccttggggctggaaactgaggtggaccgtcgcattactgctggcagctgccgggactgcggttggagaccgttgcgaacgcaacgagttccagtgtcaggatgggaagtgcatcagctacaagtgggtatgcgacggttccgccgaatgccaggacgggtccgacgagagtcaggaaacttgtctgtctgtaacatgcaagtccggggatttctcgtgcggaggccgggtgaatcgctgtatcccgcaattttggagatgtgacgggcaggtagattgcgacaacggcagtgacgagcagggttgcccgcctaaaacctgctcacaagacgaattccgatgtcacgacgggaagtgtatcagtcggcagtttgtgtgcgacagtgacagagattgtcttgatggatcagatgaagcttcctgtcccgtacttacttgtggaccggcctcattccagtgcaatagtagcacatgcatcccccagctgtgggcctgtgataacgacccagattgtgaagatggcagcgatgaatggccccagcgctgcagaggtttgtacgtgtttcagggagactcatctccctgttccgccttcgagttccattgccttagtggtgagtgcatacattcaagctggcgatgcgacggcggccccgattgtaaggataaaagcgacgaggagaactgcgccgtcgcaacttgccggccggacgagttccagtgttcagacgggaactgtattcacggttcccgccagtgtgaccgagagtacgattgtaaggatatgtccgatgaagtgggctgcgtgaatgtgaccttgtgtgagggccccaacaaattcaagtgccattcaggtgagtgtattaccctcgacaaggtgtgcaacatggctcgcgactgtcgggactggtcggacgagccgattaaggagtgtgggaccaacgcctgcctggataataacggcggctgctctcacgtgtgcaacgacctgaaaattggctatgagtgcctctgccctgatggctttcaactcgtggcacagcggaggtgcgaagacatcgatgaatgtcaggacccagacacttgtagccagctgtgcgttaatctagaaggaggctacaagtgccagtgtgaggagggttttcaactggacccgcataccaaagcctgcaaagccgtcggcagcatcgcgtacctgttctttactaatagacacgaagtcaggaagatgaccctggatagaagtgagtacacaagtctcatcccaaatctgcggaatgtggtggccctggacaccgaggtagcaagtaatagaatatactggtctgacttatcacagcggatgatatgcagtacccagttggatcgtgcccatggagtttcttcttacgacacggtgatatctcgggatatacaggctcctgatggactggcggttgactggattcattccaatatctattggactgatagtgtgctcggcactgtaagtgttgccgacaccaaaggggtgaagaggaaaacgttattcagagagaatgggtctaagccaagggctatagtcgtggatcctgtgcatggcttcatgtactggaccgactggggcaccccggcaaagatcaagaagggcggcctgaacggagtggacatttatagcctcgtgacagaaaacatacagtggccaaacggcattacattagacctcctctcaggcaggttgtactgggtggactcaaagttacactctataagttcaattgatgtgaatggtggaaatagaaagaccattctggaagacgagaagcggctggcccatcctttttcccttgctgtcttcgaagacaaagtgttctggacggacatcattaatgaagctatcttttcagctaaccggctaaccgggtcagatgtgaacctgctggccgagaacctgctctcgcctgaagatatggttctctttcataacctcacccagccccggggcgtgaattggtgtgaacgcacaaccctctcaaacggggggtgccagtatctttgtcttcccgcacctcaaatcaatcctcactctccgaagtttacatgcgcttgccccgacggcatgcttctcgctagagatatgcgttcctgcctgacagaagctgaggccgccgtggccacacaggagacaagtaccgttcgactcaaggtgtcctccacggctgtccgtacccagcatacaacgacaaggcctgtgcctgacacatcccgtctccctggggccactcccgggcttaccacagttgagatcgtgactatgagccaccaagcccttggtgatgtcgctggtcggggtaatgagaaaaagccctccagcgtgcgtgctctgagcatcgtgctgccaatcgtcttgctggtctttctgtgcctcggcgtgttcttactatggaaaaactggcggctcaagaacataaactcaataaactttgataaccccgtataccagaagaccacggaggatgaagtccacatttgtcataaccaggatggatattcgtatccttctaggcagatggtgtctctggaagatgacgttgcc

SEQ ID NO: 16288 - DNA, 2580 bp, Artificial Sequence
  Description of Artificial Sequence: Synthetic coding sequence
atgggaccttggggatggaagctgagatggaccgtggctcttctgctggctgcagccggaaccgctgtcggtgataggtgtgaacgcaatgagtttcagtgccaagatggaaaatgtatctcgtacaaatgggtgtgtgacggatccgccgaatgccaggatggaagcgatgaatcacaggaaacgtgtttgtccgtgacgtgtaaatccggagatttttcctgtggcggacgcgtgaacaggtgcattcctcagttctggagatgcgatgggcaggtcgattgtgataatggaagcgacgagcagggatgcccccctaagacctgttcccaggatgaatttagatgtcacgacggtaaatgcatttcgcgccaattcgtgtgcgattcggatcgagattgcctcgatggatcagacgaggcgagctgccctgtgctcacttgtggaccagcgtcgttccagtgtaactcgtcgacctgtataccgcaactgtgggcatgtgataacgatcctgattgtgaagatgggtcagatgaatggccccaaaggtgcaggggactttacgtgtttcaaggtgattcgtccccttgttcggccttcgagttccattgtctgtcgggggaatgtattcactcgagctggcgttgtgatggggggccagactgcaaagacaagagcgatgaagaaaattgtgcagtggcgacttgtcgccctgacgaatttcaatgtagcgatggtaactgtatccatggctcccgccaatgtgatcgagagtacgattgcaaagatatgagtgatgaagtgggatgcgtgaacgtgaccctgtgtgaaggtcctaacaagttcaaatgtcattcaggagaatgcattacccttgacaaggtgtgtaacatggccagagattgtcgggattggtcagatgagcctataaaggagtgtggaaccaatgcatgtctggataacaacggtggttgtagccatgtctgtaatgatcttaagattggttacgaatgcctttgcccagatggctttcaactggtcgcacagaggagatgtgaggatatcgacgaatgtcaagatccagatacctgttcgcaactctgcgtgaacctggaaggtggctacaagtgccagtgtgaagaaggttttcagctggatccccataccaaagcctgcaaggcagtgggctccattgcgtatctcttcttcactaataggcatgaagtccgcaagatgaccctggacaggagcgagtacacttcgcttattcctaatctcagaaacgtggtcgcactcgataccgaggtggcatctaacagaatttactggtcggacctgtcacagcgaatgatttgttcgactcagcttgacagagcacatggtgtgtcaagctacgataccgttatctcacgggacattcaagccccagacggattggccgtggattggatacactcgaacatctactggactgacagcgtgcttgggaccgtgtccgtcgcagacactaagggtgtcaagcgcaagaccctttttcgggagaacggttctaagccaagggcaatcgttgtggatccagtgcacggattcatgtactggaccgattggggaacccccgcgaaaatcaaaaagggtggccttaacggtgtcgatatctactcgctggtcactgaaaacattcaatggccaaatggtattacgctggacctgttgtccgggcggctgtactgggtggactctaagctgcattcaatcagctccattgatgtcaatggaggtaatagaaagactatacttgaggacgagaaaaggcttgctcaccctttcagccttgccgtgtttgaagataaggtgttttggactgacattatcaacgaggcgattttcagcgcaaaccggctcaccggatccgatgtgaatctgctcgcggagaacttgctgtcccctgaagatatggtcttgtttcacaatctgacccaaccccgaggggtgaactggtgcgaacgcaccacccttagcaacggaggttgtcagtacctctgcctgcccgccccccagattaatccccacagccccaagttcacctgcgcgtgcccagatgggatgcttttggcaagagatatgcgctcatgtcttaccgaagcagaagcggcagtggcgacccaggaaacttcaactgtgaggctgaaagtctcaagcactgctgtgaggacccaacataccaccaccagaccagtgcctgatacgtcacggctgccgggggcaacccctggacttacgaccgtggaaattgtgaccatgtcgcaccaagcactgggcgacgtggccggacgcggaaacgaaaagaaaccttcgtcggtgcgtgccctgtcaatcgtgcttcctattgtgcttcttgtgttcctgtgtcttggggtgtttctcctctggaagaactggagactgaaaaacattaactcgatcaactttgataacccagtctatcaaaagaccacggaggatgaagtccatatctgtcataaccaagatggatactcgtacccctcacgacaaatggtgtcactggaggacgacgtcgct

SEQ ID NO: 16289 - DNA, 2580 bp, Artificial Sequence
  Description of Artificial Sequence: Synthetic coding sequence
atgggaccatggggatggaaactccgctggaccgtggcactgcttcttgcagcagcgggaactgctgtgggtgatagatgcgaacgtaatgagttccaatgtcaagacggtaagtgcatttcgtacaagtgggtctgcgatggatcggcagaatgtcaagatgggtcagacgaaagccaagaaacctgcttgtccgtcacttgtaagtccggagacttctcgtgtggaggtcgggtcaatcgctgcattcctcagttctggaggtgtgatggacaagtggactgtgataacggttccgacgaacagggttgtcctcccaagacctgttcccaagatgaatttaggtgtcacgacgggaagtgtatcagcaggcaatttgtgtgcgattcggatcgggattgtttggatggctccgatgaagccagctgcccggtgctcacttgtggtccagcaagttttcaatgtaactcgtcgacttgtatacctcaactctgggcatgtgacaatgaccctgattgtgaggacggcagtgacgagtggccgcagcgctgcaggggactgtacgtctttcagggcgactcgtcgccctgttcggcatttgagttccattgtttgtcaggagagtgtatccactcctcatggagatgtgatggaggaccagattgtaaagacaagtccgacgaggaaaactgcgcggtggctacctgtcgcccagatgagtttcagtgttcggacggtaattgtattcatggtagcagacagtgtgatcgagaatacgattgcaaggatatgtcggacgaggtgggttgcgtgaatgtgactctctgtgaaggcccaaataagtttaagtgccattcgggtgagtgcatcactcttgataaggtgtgcaacatggcacgcgactgccgcgattggtccgacgaacctatcaaagaatgtggtaccaatgcgtgtctggataacaacgggggttgtagccatgtctgcaatgacctgaagatcggctacgaatgtctgtgtccagacggatttcaacttgtcgcacaacggcggtgtgaagatattgatgaatgtcaggaccctgacacctgtagccaattgtgcgtgaacctcgaaggggggtataagtgtcaatgtgaagaagggtttcagctcgatccacataccaaggcttgcaaagcagtgggatcgattgcctatctgttctttactaatcgacacgaagtgcgaaagatgaccctggacaggtccgagtacacctcgttgattccaaatttgagaaacgtcgtggccctggatactgaggtggcctctaatcgcatttactggtccgatctttcgcagagaatgatttgctccactcagctcgatagagcccatggagtgtcaagctacgataccgtgatcagcagggatatccaggcccccgacggacttgcagtggactggatacattctaacatttactggactgatagcgtcctgggcaccgtgtcggtggcggacaccaagggtgtcaaacggaaaactttgtttcgcgagaacggatcgaaacccagagcaattgtcgtggatcctgtgcacgggttcatgtattggactgactggggaactccagcaaaaatcaagaagggcggtttgaacggagtcgatatctacagcctggtgacggagaacattcaatggcccaatggcattaccctggatcttctctcaggacggctttactgggtcgattcaaaactgcactcgatttcctccatcgatgtgaacggcggaaatagaaagaccatccttgaagatgaaaagagacttgctcatccgttttcgttggccgtgttcgaagataaggtgttctggactgacatcattaatgaagcaatcttttctgcaaatagactgactggctccgacgtgaacctgctggcagaaaatctgctcagccccgaagatatggtcctctttcacaacctcacgcagccaagaggagtcaactggtgtgaacgcaccaccctgtccaatggcggttgtcaatacctttgcctgcctgccccgcagatcaatccgcattcgcccaaattcacctgtgcctgtccagatggcatgctccttgcgagagacatgagaagttgtttgactgaagcagaggctgccgttgctacgcaagagactagcaccgtgcgcctcaaggtgtcgtccactgccgtgaggacccagcatactaccacccggccagtgccagatacttcgcggctgccgggcgcaacgccaggactgaccactgtggagattgtgaccatgagccaccaagcacttggagatgttgcagggcgcggtaatgagaagaaaccttcatcggtgcgcgcactgtccatcgtgttgcctatcgtgcttctggtgtttctgtgtctgggggtctttcttctgtggaagaattggcgccttaagaacatcaacagcatcaattttgataaccccgtgtaccaaaagactaccgaagatgaagtgcatatctgccataaccaagatggatactcctacccttccaggcagatggtatccctggaagatgacgttgca

SEQ ID NO: 16290 - DNA, 2580 bp, Artificial Sequence
  Description of Artificial Sequence: Synthetic coding sequence
atgggaccgtggggatggaagctgcgctggaccgtggccctgctgctcgccgcggccgggactgcagtgggtgaccggtgcgagcgcaacgagttccagtgccaagacgggaagtgcatttcgtacaagtgggtctgcgacggtagcgcagagtgccaggacggttccgatgagtcacaggaaacctgcctttcagtgacgtgcaagagcggagactttagctgcggcggaagggtcaataggtgcatcccgcagttctggcggtgcgatggacaagtggattgcgacaatggatcagatgagcaagggtgccccccaaaaacttgctcacaagacgaattccggtgccatgacggaaagtgcatctcgagacagttcgtgtgcgactctgaccgcgactgtctcgatgggtccgacgaagcgagctgtccagtgctgacttgcggacccgcttcgttccagtgcaactcctcgacttgcattccgcaactgtgggcgtgtgacaatgacccagactgtgaggacggatcagatgaatggccgcaacggtgccggggtctgtacgtgtttcagggtgattcgtcgccttgctcggcattcgaattccactgcctgtcgggagagtgcatccattcatcgtggagatgtgacgggggaccagattgtaaggacaaatccgatgaggaaaactgcgcggtggccacctgccggccggatgaattccagtgctcagacggaaactgcatccacggatcccggcaatgcgaccgtgaatatgattgtaaggatatgtccgacgaggtcggatgcgtgaatgtcactctgtgtgagggacccaacaaattcaaatgccattcaggcgagtgtatcacccttgacaaggtttgtaacatggctcgcgattgcagagactggtcagatgaaccaattaaggagtgtggaaccaacgcctgtctggacaataatggaggctgctcgcatgtttgtaacgatctcaagatcggatacgaatgcctgtgccccgatggcttccagttggtcgctcaacggcggtgcgaggatatcgacgagtgccaggatccggacacctgcagccaactctgcgtcaatctcgagggtggctacaagtgccagtgcgaagaaggcttccagctggacccgcataccaaggcttgcaaggcggtgggatccatcgcgtacttgttcttcactaacagacacgaggttaggaagatgactctggatagaagcgagtacacctcactgatcccaaacctcaggaacgtggttgcactggataccgaagtcgcctcgaatcgaatctactggtcggacctcagccaaagaatgatttgctccactcagctggatagagcccatggagtctccagctacgacactgtcatcagccgcgacatccaggcaccggatggactggccgtggactggatccactcgaacatttactggactgactcagtattgggtactgtgtctgtggcggacactaagggagtgaagcgaaagactttgttccgggagaacggatcgaaaccaagggcaatcgtggtcgacccggtgcacggcttcatgtactggactgattggggaaccccggccaagatcaaaaagggcggactgaacggagttgacatctactcacttgtgactgaaaacatacagtggccaaacggaatcaccttggatctgctgtccggaaggctctactgggtcgactcgaagctgcatagcatctcttcaatagacgtcaacggtggcaacagaaagaccattctcgaggacgaaaaacgcctcgcgcacccgttttcgctggctgtgttcgaggacaaggtgttctggactgacatcatcaacgaggccatcttttcggccaatcggctcaccggatcggacgtcaatctcctggccgaaaacctcctttcgccagaggacatggtcctgttccataaccttacccaaccaaggggagttaactggtgcgaacgcaccaccctcagcaacggagggtgtcagtacctctgcctcccagctccacagattaatccacacagccctaagttcacctgtgcatgtccggacggcatgctccttgcacgggacatgcggagctgtctcactgaggcggaagcagctgtcgcgacccaggaaaccagcaccgtccgcctcaaagtgtcatcaactgctgtgcgcacccaacacaccactacccggccggtgccggatacctcgcgcctgccgggcgccactcctggactgaccaccgtggaaatcgtcactatgtcccatcaagcgctgggggatgtggcaggacggggtaatgagaagaaaccttcgtcggtgcgggccctgtcaatcgtcctgccgatcgtgctcctggtgttcctgtgcttgggagtgttcctgctttggaagaactggcggctgaagaacataaacagcatcaatttcgataaccctgtgtaccaaaagacgaccgaggacgaagtccacatttgccacaatcaagacggatactcataccctagccgccagatggtttcgcttgaggacgacgtggcc

SEQ ID NO: 16291 - DNA, 2580 bp, Artificial Sequence
  Description of Artificial Sequence: Synthetic coding sequence
atgggcccttggggctggaagctgcggtggacagtggctctgctgctggctgcggctggaactgcggtgggagacagatgtgagaggaatgagtttcaatgccaagacggcaaatgcatctcttataaatgggtgtgtgacgggtcggccgaatgtcaggatggctccgacgaatctcaggagacctgcctcagcgtgacttgtaagagtggggattttagttgcggagggcgagtgaaccgctgtatcccccagttctggagatgtgacggccaagtggactgcgacaatggaagtgacgaacaggggtgccctccaaagacctgttcccaggacgagtttcggtgccacgatggaaagtgcatcagcaggcagtttgtatgcgattccgaccgcgactgtctggacggctccgacgaggcatcgtgcccggtgttgacttgcggacctgcttcattccagtgtaattctagtacctgtatcccccaactgtgggcttgcgacaacgacccagactgcgaggacggctccgacgaatggccccagcgctgtaggggcctgtacgtgtttcagggcgacagttcaccatgcagcgcctttgagttccactgcctgagtggcgaatgcattcatagctcatggagatgcgacgggggacccgattgcaaagataagagtgatgaagaaaattgtgccgtcgccacctgcaggcccgacgaatttcagtgcagcgacggaaactgtatccacgggtcaaggcaatgtgacagagagtatgattgtaaggatatgtccgatgaggtggggtgtgtgaacgtgacactttgcgaggggccgaacaagttcaagtgtcattcaggcgagtgtatcactttagataaggtatgcaatatggcacgcgactgtcgagattggtctgacgagcccataaaagaatgcggcacgaatgcttgtctagacaacaatggcgggtgctctcacgtgtgtaacgatctaaagatcggctacgaatgcctgtgtcccgacggcttccagctggtagcccagcgcaggtgcgaagacattgacgaatgtcaagacccggacacttgttcccaactgtgtgtcaatctggaggggggatataaatgccagtgtgaggaagggttccagctggatccccacacaaaggcctgcaaggccgtggggtctatcgcctaccttttcttcaccaacaggcacgaagtccgaaagatgaccctggacaggtctgaatacactagcttaattccaaatttgagaaacgtggtggcgctcgacacagaagtagccagcaaccggatctactggtcggacctgagccaacggatgatttgctcaacacagctggacagggcacatggtgtatctagctacgatactgtaatctctcgcgacattcaggcccccgacgggctcgccgtcgattggatccactccaatatttattggaccgactcagtgcttggtaccgtctccgtggcagacactaagggcgtgaaacgcaagactttgtttcgcgagaatgggtccaagccccgagctatcgtggttgaccccgttcatggttttatgtactggacagattggggcaccccagctaagattaagaagggcggattgaacggggttgatatctattcactcgttactgaaaatatccagtggcctaatggcattaccctggatctgttgagtggtcggttgtactgggtcgacagcaagctgcattcaatttcctctattgatgtcaatggaggcaatcgaaaaaccatactcgaggatgagaagcgcctggctcacccattctcgttggccgtgttcgaggataaggttttttggaccgatatcattaacgaagccatcttttcagccaatagactgacaggatcagacgtgaacctgctggccgaaaaccttttatcccccgaagatatggttctgttccacaacttgacgcagccacgtggggtgaattggtgcgagcggaccacgctatccaatggcggatgccagtacctctgcctgcctgcccctcagatcaacccgcattctccaaaatttacatgtgcgtgccccgacggcatgctactggctagggatatgcggagctgtttaaccgaagccgaggctgccgtcgccacacaggaaactagcacagtcagattgaaagtctcgtcaactgcggtccgtactcagcacacgaccacaaggccagtgcccgacacgagccgccttcctggagccactccgggtctgactacggttgagatcgtgactatgagtcatcaggccctaggtgatgttgccggccgggggaacgaaaagaagccctctagcgttcgcgcgcttagcatcgtcctgcccattgtgcttctggtgtttctgtgtctcggtgtcttcctcctgtggaaaaactggaggctgaagaatattaatagtattaacttcgataatccagtttaccagaagaccactgaagacgaggtgcacatctgtcacaatcaggatggatacagctatccctctcggcaaatggtctcactggaggacgatgtagca

SEQ ID NO: 16292 - DNA, 2580 bp, Artificial Sequence
  Description of Artificial Sequence: Synthetic coding sequence
atgggtccgtggggttggaaattacgatggacggtagcgctattattagcggcggcgggtacggcggttggtgatcgttgtgaacgaaatgaatttcaatgtcaagatggtaaatgtatatcgtataaatgggtttgtgatggttcggcggaatgtcaagatggttcggatgaatcgcaagaaacgtgtctatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgatgtcgaggtttatatgtatttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggtagcgacgtgtcgtccggatgaatttcaatgttcggatggtaattgtatacatggttcgcgtcaatgtgatcgagaatatgattgtaaagatatgtcggatgaagttggttgtgttaatgttacgctatgtgaaggtccgaataaatttaaatgtcattcgggtgaatgtataacgttagataaagtatgtaatatggcgcgtgattgtcgagattggtcggatgaaccgataaaagaatgtggtacgaatgcgtgtttagataataatggtggttgttcgcatgtatgtaatgatttaaaaataggttatgaatgtctatgtccggatggttttcaattagtagcgcaacgtcgatgtgaagatatagatgaatgtcaagatccggatacgtgttcgcaactatgtgttaatttagaaggtggttataaatgtcaatgtgaagaaggttttcaactagatccgcatacgaaagcgtgtaaagcggttggttcgatagcgtatttattttttacgaatcgacatgaagttcgaaaaatgacgttagatcgttcggaatatacgtcgttaataccgaatttacgaaatgttgttgcgttagatacggaagtagcgtcgaatcgaatatattggtcggatttatcgcaacgtatgatatgttcgacgcaactagatcgtgcgcatggtgtttcgtcgtatgatacggtaatatcgcgagatatacaagcgccggatggtttagcggtagattggatacattcgaatatatattggacggattcggttctaggtacggtatcggtagcggatacgaaaggtgttaaacgaaaaacgctatttcgagaaaatggttcgaaaccgcgagcgatagtagtagatccggttcatggttttatgtattggacggattggggtacgccggcgaaaataaaaaaaggtggtttaaatggtgttgatatatattcgttagtaacggaaaatatacaatggccgaatggtataacgttagatctactatcgggtcgactatattgggttgattcgaaattacattcgatatcgtcgatagatgtaaatggtggtaatcgaaaaacgatactagaagatgaaaaacgactagcgcatccgttttcgctagcggtatttgaagataaagtattttggacggatataataaatgaagcgatattttcggcgaatcgattaacgggttcggatgtaaatttactagcggaaaatttattatcgccggaagatatggttctatttcataatttaacgcaaccgcgtggtgttaattggtgtgaacgaacgacgttatcgaatggtggttgtcaatatctatgtctaccggcgccgcaaataaatccgcattcgccgaaatttacgtgtgcgtgtccggatggtatgttattagcgcgagatatgcgttcgtgtctaacggaagcggaagcggcggtagcgacgcaagaaacgtcgacggtacgtttaaaagtatcgtcgacggcggttcgtacgcaacatacgacgacgcgaccggtaccggatacgtcgcgactaccgggtgcgacgccgggtttaacgacggttgaaatagttacgatgtcgcatcaagcgttaggtgatgttgcgggtcgtggtaatgaaaaaaaaccgtcgtcggttcgtgcgttatcgatagtactaccgatagtactactagtatttttatgtttaggtgtatttctattatggaaaaattggcgattaaaaaatataaattcgataaattttgataatccggtttatcaaaaaacgacggaagatgaagtacatatatgtcataatcaagatggttattcgtatccgtcgcgtcaaatggtatcgttagaagatgatgtagcg

SEQ ID NO: 16293 - DNA, 2580 bp, Artificial Sequence
  Description of Artificial Sequence: Synthetic coding sequence
atgggtccgtggggatggaagttgagatggacggtcgcactgttgctggcagccgccggcaccgctgtcggagacaggtgcgaacgcaacgagtttcagtgccaggacggtaaatgcatatcgtacaaatgggtgtgcgatggaagcgccgaatgccaagatggcagcgacgagtcgcaggaaacgtgcttgtccgttacgtgcaagtccggcgatttcagctgcggtggccgtgtgaatcgatgcatacctcagttctggcgctgtgatggccaggtcgattgcgacaatggctccgatgaacaaggctgtcctccgaagacatgctcgcaggatgagttccgctgccatgacggtaagtgcatcagccgccaattcgtgtgtgactccgatcgtgactgcctggatggctcggacgaggcctcatgtccagttctgacctgcggcccagcgtccttccagtgtaactcgagtacatgcattccgcagctgtgggcttgtgacaacgatcccgactgcgaggacggaagtgacgagtggccgcaacggtgccgcggattgtatgttttccagggcgatagtagtccatgttcggcattcgagttccactgcttgtcgggtgagtgcatccacagctcatggaggtgtgatggaggtccggattgcaaggacaaatccgatgaagagaactgcgcagtggcaacttgccgtccagacgagttccaatgctcagacggcaattgtatccatggatcacgtcagtgcgatcgggagtatgactgtaaggatatgagtgacgaggtgggttgtgtgaatgtcaccctgtgcgagggtccaaacaagttcaaatgtcactctggtgagtgcatcaccctggacaaagtttgcaacatggcgcgcgattgcagggattggagcgacgagccgatcaaagagtgcggaaccaatgcctgtctcgacaataatggcggctgttcgcatgtgtgcaacgacctcaagatcggatatgagtgcttgtgcccggacggctttcaattggttgcccagcgacgctgtgaagacatcgacgaatgccaggatcctgatacgtgcagccagttgtgtgtaaaccttgaggggggttacaagtgccaatgtgaggaggggttccaacttgaccctcacacaaaagcctgcaaagcagtcggttcgattgcctatttgtttttcacgaaccgtcacgaggtgcgaaaaatgacccttgacaggagtgaatacacaagtctgatacccaacctgaggaatgtggtggctctggatactgaggtggcctcgaatcgcatctattggtcggatttgagccagaggatgatatgctcaacgcagctggatcgagcccacggcgtgagctcgtatgataccgtgataagcagggatattcaggctcccgatgggctggctgtcgattggatccacagtaacatttactggaccgattccgttcttggcactgtgagcgtggcggataccaagggtgttaagcgtaagacgctatttcgcgaaaacgggtcgaagccccgtgccatcgttgtggacccagtgcatggatttatgtattggacggattggggtacccccgcgaagatcaaaaaagggggtctcaacggcgtcgatatctactcgctagtcacagaaaatatccagtggccgaacgggatcacactcgatcttctgtcgggccggctttactgggtggattcgaagctgcacagcatttcctccatcgatgtaaatggcggcaataggaaaaccatcttggaggatgaaaaaagactggcgcatccattttcattggcggtgtttgaggataaagtcttctggacggacatcataaacgaggcaatcttctcggcgaatcggctcactgggtccgatgtaaacctgctcgcggagaacttgctttcaccggaagatatggtgctcttccataatttgacccaaccccggggagtgaactggtgcgagcgcactaccctgtccaacggcggatgccagtacttgtgcctgcctgccccccagattaatccacacagccccaagttcacgtgcgcctgccccgacggcatgttgctggcccgcgatatgcggtcgtgcttaacggaggccgaggcagctgtcgcgacgcaggagaccagcacggtacgcctaaaggtgagtagcactgccgtcaggacccagcacaccaccactcgacccgtcccggatacatctcgcctgccgggtgctacccccggactaacgaccgtcgagatagttaccatgtcgcatcaagctctgggcgacgttgctggccgggggaacgagaaaaagccatccagcgtgcgtgccctgtcgatcgtactgccaatcgtgctgctggtcttcctatgtctaggcgtgttccttctgtggaagaactggcgcctgaagaacatcaatagtattaacttcgataatccggtttatcagaagacaacggaggatgaagtgcatatctgccataatcaggatggctactcgtacccctcgcgtcagatggtttcacttgaggacgatgtggcc

SEQ ID NO: 16294 - DNA, 2580 bp, Artificial Sequence
  Description of Artificial Sequence: Synthetic coding sequence
atgggaccatggggctggaaattgagatggaccgtggccctgctgctggccgcagctggaactgcagtgggcgataggtgtgaaaggaatgaattccagtgtcaggacggaaaatgcatttcatacaaatgggtgtgtgacggctcagccgaatgtcaagacggatccgacgagtcgcaagaaacctgtctttccgtcacttgtaagtcgggtgatttctcctgcggaggaagagtgaaccgctgcatcccgcaattctggcggtgtgatggtcaagtcgattgtgacaacggttccgatgaacaggggtgcccgcctaaaacctgtagccaggatgagtttcgctgccacgatggcaaatgcatttcgcgccaatttgtctgcgactccgatcgggattgccttgacgggtcggacgaagcgtcatgtccggtcctgacctgcgggccagcatccttccagtgcaactcgtcgacctgtatcccccaactctgggcgtgtgacaatgaccctgactgtgaagatggatcggacgaatggccgcagagatgtcgcgggctctacgtgttccagggagactcaagcccctgtagcgcctttgaattccactgcctctcaggagagtgcatccactcctcatggcggtgcgatggaggaccggactgtaaagataaaagcgatgaggagaattgcgctgtggcgacctgtcggcccgacgaatttcaatgtagcgatgggaattgcatccacggatcgagacagtgcgaccgcgaatacgattgcaaggatatgtcagatgaagtgggatgcgtgaacgtgaccctgtgcgaggggccaaataagttcaagtgccatagcggcgagtgcatcactctggataaggtctgcaacatggcacgggactgtcgcgactggagcgacgaaccgatcaaggagtgtgggactaatgcatgtctcgataacaacgggggctgtagccatgtgtgcaatgacctgaaaatcgggtacgaatgtctctgccctgatggattccaactggtcgcgcagaggaggtgtgaggacattgatgaatgccaggacccggacacctgctcccagctgtgcgtgaacctggagggcggatacaagtgtcagtgcgaagagggatttcaattggacccgcacaccaaagcctgtaaggccgttggttcaatcgcctaccttttctttaccaacagacatgaggtccggaagatgaccctcgaccggtcggaatacacctcactgatcccgaatctccgcaatgtggtggcgctggatactgaggtggccagcaataggatttactggtccgacctctcccagcggatgatctgcagcactcaacttgatcgggcccatggagtctcatcatacgataccgtcatctcgcgggatatccaggcccctgatggactggcggtcgactggatccatagcaacatctattggaccgactcagtgctgggaaccgtgtccgtcgcggacacgaagggtgtgaaaagaaagaccctcttcagagagaacggttcgaagccgcgggcgatcgtggtggaccctgtccacggattcatgtactggactgattggggcactccagccaaaatcaagaaggggggactgaacggagtggacatctacagccttgtgaccgaaaacatccaatggcccaacggaatcaccctcgacttgctctcgggtcggctgtactgggtggactctaagctccactcaatttcctccatcgatgtcaatggggggaaccgcaagaccatcctcgaggacgagaagcggttggcccatcctttctcactggctgtctttgaagataaggtgttttggactgatatcatcaatgaggcgatcttctcggccaaccggcttactggatcggatgtgaacctcctggcagaaaacctcttgtcccccgaagatatggtgctgttccataacctgacccagccgcgcggagtcaattggtgtgagcgcaccactctttccaacggagggtgccaatacctgtgcctgccagccccgcagattaatccacactctccaaagttcacttgcgcatgcccggatggaatgttgctcgcccgggacatgcgctcatgcctcactgaagcagaggccgcagtcgcgacccaggagacttccacggtgcggctgaaggtaagctcgactgcagtacgcacccagcacaccaccacgcggccagtcccggacacgtcaagactcccgggcgctactccgggactgaccaccgtcgaaatcgtgaccatgagccaccaggctttgggagacgtcgcggggcgtggcaacgagaagaaaccttcgtccgtcagggcactgtcgatcgtgctgccgattgtgttgctcgtgttcctgtgcctcggcgtgttcctgctgtggaagaactggcgcctgaagaacattaactcaattaactttgataatccggtgtaccaaaagaccacggaggatgaagtgcatatctgccacaaccaagacgggtactcgtatccgtcgaggcagatggtgtctctggaggacgacgtagcc

SEQ ID NO: 16295 - DNA, 2580 bp, Artificial Sequence
  Description of Artificial Sequence: Synthetic coding sequence
atgggaccatggggatggaagttgaggtggactgtcgcgcttttgttggctgctgctgggacggctgtgggggacaggtgcgaaagaaacgaattccaatgccaagatgggaagtgcatatcttacaagtgggtttgtgatggaagcgccgagtgtcaagacgggagcgatgaaagccaagaaacctgcctttcggttacctgtaaatccggagattttagttgcggcggaagagtaaacagatgtataccgcaattctggcgttgtgacggacaagttgactgtgataacggctcagacgagcaaggctgtcctccaaagacctgttcgcaagacgagtttcggtgccatgacggtaaatgcatttcgaggcaatttgtatgcgacagcgatagagattgtcttgacggtagtgacgaagcttcttgcccagtactgacatgtgggcccgcgtccttccaatgtaattcatcaacgtgcatcccccaactttgggcttgcgataacgatcctgactgtgaagacggttctgacgaatggccacaacggtgtcggggattatatgtgttccaaggtgattcatcaccgtgctctgcttttgagtttcattgcctttcgggcgaatgtatacatagtagttggagatgtgacggaggaccagactgcaaagataaatctgatgaggagaattgcgcggttgccacttgccggcctgatgagttccaatgttctgatggaaactgtattcacggttcacgtcaatgcgaccgtgagtatgactgtaaggatatgagcgatgaggtgggctgtgttaacgtcactctctgtgagggaccaaataaattcaaatgtcactcaggagaatgcattaccctggataaggtgtgtaatatggcacgtgactgtagggattggtcagatgagcccatcaaagagtgtggtaccaatgcgtgcttggataataatggtggttgctcgcatgtttgcaacgatttaaagatcggttatgagtgtttatgtccggatggtttccagttggtcgcccaacgaagatgtgaggacatagatgaatgccaagatcccgatacgtgctcacaattatgcgttaacctggagggaggttacaagtgccaatgtgaagaggggtttcagctcgaccctcacactaaagcatgcaaagctgtgggtagcattgcctacctgttcttcacaaatagacacgaggttaggaaaatgactttagatcgttcagaatatactagcttgattccaaacctcaggaacgtggttgcgctggatacagaagtggcttctaatcgcatttattggagcgatttgagccaaagaatgatctgttcgacacaacttgatcgtgcccatggagtatcgtcttacgacactgttatttcacgtgacatacaagcccctgatggcctggcagttgactggattcatagtaacatatactggacggatagcgtcctgggcactgtttcggttgctgacaccaagggtgtaaagcgcaagaccctttttagggaaaacgggagtaagccgagggctatagttgttgatccagttcatggtttcatgtattggaccgattggggcactcccgcaaagatcaagaaaggtgggttgaatggtgttgatatatacagcttggttaccgagaacatacagtggcctaacggtatcacccttgatctgctttccggcaggttgtactgggtagattcgaagctgcatagtatctcgagtattgatgtaaatggaggtaaccgtaagaccattctggaagatgagaagcgtttggctcatcctttttccctcgctgtttttgaggataaagtgttttggacagatataataaatgaggctattttctccgccaatcgtttgacaggatcggatgtgaatctcctcgctgaaaatcttttatctccagaagatatggtgttgtttcacaatcttactcaacctaggggagttaactggtgcgaacgtactactctgagcaacggtggatgccagtatttgtgcttaccagccccacaaattaatcctcactctcccaagttcacgtgcgcctgtcctgacggtatgttactagctagggacatgcgctcttgcctgacagaagccgaggcggcagtggctactcaagagacatctaccgttaggttaaaggtaagtagtaccgcagtacgcactcaacatactacaaccagaccagtgcccgatacttcccggttgcctggagctacaccaggtcttaccactgtcgaaatcgttacaatgtctcaccaggcccttggggacgttgcaggaaggggaaacgaaaagaagccgtctagtgttcgtgcgctctctattgtgttgcctattgtgttgctcgtttttctctgcttgggagtttttcttctctggaagaactggaggctaaagaacattaattctattaattttgacaacccagtctatcaaaagaccacggaagatgaggtgcatatttgtcataatcaagatggatactcttatccctcccgacagatggtttcccttgaggacgacgtcgca

SEQ ID NO: 16296 - DNA, 2580 bp, Artificial Sequence
  Description of Artificial Sequence: Synthetic coding sequence
atgggaccttggggttggaaattgaggtggactgtggcccttctgctggcagcagcaggaacggccgtgggagataggtgcgaacgcaatgaatttcaatgtcaagatggtaaatgtattagctacaagtgggtctgtgacggttcagccgagtgtcaagacggatccgatgagtcgcaagaaacctgtctcagcgtgacctgtaaatcaggggacttttcgtgcggaggacgtgtgaatagatgcatccctcagttttggagatgtgacgggcaggtggattgcgacaatggaagcgacgaacaaggctgcccaccaaaaacttgttcgcaagatgaattcagatgtcacgacggaaagtgtatatcccggcaatttgtctgtgattcagatcgggattgtctggacgggtccgatgaagcctcgtgtcctgtgctgacttgtggacctgcatctttccagtgtaattctagcacctgcattcctcaactttgggcgtgtgataatgaccccgattgtgaggatggttcggacgaatggccacagcgatgccgcggactctacgtgtttcagggtgactccagcccttgttccgcgtttgagttccactgcctgtccggagagtgtatacatagctcctggaggtgtgatgggggccctgattgcaaggataagtccgatgaggaaaactgtgccgtggcaacctgtagacctgatgaattccaatgtagcgatgggaactgtatccacggaagccggcagtgcgatcgcgagtacgactgcaaagatatgagcgatgaggtgggatgtgttaacgtgaccctctgcgaaggaccaaacaagttcaagtgtcattcgggcgagtgtatcacgttggataaggtgtgcaacatggccagagattgtcgtgattggagcgatgaacctattaaggaatgcgggaccaacgcgtgtctggacaacaacggtggatgctcgcatgtgtgcaacgaccttaagattggttacgaatgtttgtgccctgatgggttccagcttgttgcacagagaagatgtgaggacattgatgaatgtcaggatccagacacctgttcgcaactgtgcgtgaatctggagggaggttacaagtgtcagtgtgaagagggctttcaattggacccccacaccaaagcatgcaaagccgtgggtagcattgcatatctgttctttaccaacagacacgaggtgagaaaaatgacgctggatcgatcagaatacacctccctgattcctaaccttcggaacgtggtagccctggatactgaagtggcgtcgaacagaatttactggtcggatctgagccaaaggatgatttgttcgacgcaactggacagagctcatggagtgagcagctacgacaccgtgatctcaagagatatacaggcccctgatggactggcggtcgactggattcattcaaacatttactggaccgactcagtgctgggcaccgtgagcgtggccgacaccaaaggagtcaagcgtaagaccctcttccgcgaaaacggatcgaagccccgcgcaatcgtggtcgatcctgtgcatggtttcatgtactggactgattggggaactccagccaagattaagaaaggcggactcaacggtgtagacatatactcgctcgtcaccgagaacattcagtggccaaacggaatcacccttgacctgctttccggaagattgtactgggtggatagcaaactgcattccatctcctcgattgacgtcaacggtggaaaccggaaaacgattctggaagatgaaaagcgtctggcacatccctttagcttggctgtctttgaagataaagttttctggaccgatatcattaacgaagcgatctttagcgccaaccgacttactggatcggatgtgaaccttctggccgaaaacctcctctcccctgaagatatggtcctgtttcataatctcacccaacctagaggtgttaattggtgtgaacgtactactctgagcaatggaggctgtcagtacctttgcctgccagcacctcagataaatccacattcgccaaagtttacctgtgcgtgcccggacggaatgcttctggcaagagatatgcggtcgtgcctgactgaagcagaagcagcggtcgcaactcaggaaacctcaaccgtgaggcttaaagtgtccagcaccgcagtgagaactcaacataccactactagacctgtgcctgacacttccagattgccaggcgcaactcccggcttgactaccgtggaaattgtcactatgtctcatcaagcccttggagacgtggcagggcgcgggaatgagaagaaaccatcctcggtgcgggcactgtcaatcgtgttgcctattgtgctgctggtgttcctttgtctgggtgtctttcttctgtggaagaattggcggcttaagaacataaactccattaacttcgataaccctgtgtaccagaaaacgaccgaggacgaagtgcacatctgtcacaaccaagatggttacagctacccatcgagacagatggtgtcacttgaggatgacgtggcc

SEQ ID NO: 16297 - DNA, 2580 bp, Artificial Sequence
  Description of Artificial Sequence: Synthetic coding sequence
atgggtccctggggatggaagctgagatggaccgtggccttgctcctagcagcagccgggaccgcggtgggcgataggtgcgagagaaatgaattccagtgccaggatggaaaatgcatcagctacaagtgggtctgcgacgggtcagctgaatgccaggacggcagtgacgagagccaagagacctgcctttccgtgacatgcaaatccggagactttagttgtgggggaagagttaacagatgcattcctcagttctggcgctgtgatgggcaggttgactgtgacaacggaagcgacgaacaagggtgccctcctaagacctgtagccaggacgagttccgctgccacgatggcaagtgcattagtagacagttcgtgtgtgactcagatcgggattgtttggacggcagtgatgaggcctcgtgtccagtgctcacctgcggtccagcttctttccagtgcaatagctccacctgtatcccccagctttgggcttgcgacaacgacccagactgtgaagatggatcagatgagtggcctcaaaggtgccgtggactctacgtgttccaaggggatagctcaccctgctcagctttcgagttccattgcctaagcggtgagtgtatacactcatcttggcgttgcgatggtggtcctgattgtaaggacaaatccgacgaagagaattgtgccgtggcgacttgtcgcccagatgagttccagtgcagcgatggtaattgcattcacggctcaaggcagtgcgaccgcgagtatgactgtaaagacatgagcgatgaggtgggatgcgtgaatgtgactctctgtgaaggccccaataagtttaaatgtcatagcggggaatgcatcacccttgataaggtgtgtaacatggctcgggattgtcgggattggtctgacgaacctatcaaggagtgtggaacaaatgcttgtctcgataataacggcgggtgttcacacgtgtgcaatgatctgaagataggttacgagtgcttgtgcccagacggattccagctggtggcgcagagacggtgtgaggacattgatgaatgccaggacccagatacatgttcccagctctgtgtgaatctcgaggggggttataaatgccagtgtgaagaggggtttcagctagatcctcacaccaaagcatgtaaggccgttgggtccatcgcttatcttttcttcactaatcgccacgaagtgagaaagatgacattagaccggtcagagtatacatccctgattcccaatctccgtaacgtggtggcactggataccgaggtagccagtaatagaatttattggtctgacctgtcccagagaatgatctgctcgacgcagctggacagggcccacggagtgtctagttatgacacggtgatcagccgcgatatccaggctccagatggtctcgccgtggactggatccattcaaatatatactggaccgattccgtgctgggaactgtgtctgtggccgacaccaaaggggtgaaacgcaagaccttatttcgagagaatgggagcaagcccagggctatagtagtggatccagtgcacggattcatgtattggacagactggggtacgcccgccaagatcaagaagggcggcttaaatggagtcgacatctatagcctcgttactgaaaatatacagtggcctaatgggattacactggatttgctctccgggcggctctattgggtggacagtaagttgcattctatttcatcaatcgacgtcaatggcggcaatcggaaaaccattttggaggatgagaagagactggctcatccattctctctcgcagtgtttgaggataaggtattttggaccgacataatcaatgaggccatcttcagcgcaaaccggcttactgggtccgacgtcaaccttttagccgagaacttgctgtcccccgaagacatggtgttgttccacaatcttacacaacctcgcggggtcaactggtgtgagcggacaacactgagcaatgggggctgtcagtacctgtgcctcccagcgccgcagatcaacccacacagtcccaagttcacatgtgcctgcccagatggcatgttacttgcccgcgatatgcggtcctgcctcactgaggccgaggctgctgtcgcgacacaagaaactagtactgtgaggctaaaagtgtcttctacagccgttaggacgcagcacactactacccgaccggtgccggataccagcaggctacccggtgcaactccagggctgaccacagtggagattgtgacaatgagccaccaagctctcggggatgttgcaggcagggggaacgagaagaaaccgtcttctgtacgggctttgtcaattgtcttgcccatcgtgcttctggtgttcttgtgtctgggcgtcttcctcttgtggaaaaactggaggctgaaaaacatcaactcaatcaacttcgataacccagtgtatcaaaaaactaccgaggacgaggtgcacatttgtcacaatcaggatggctacagttacccatccagacagatggtctctcttgaagacgacgtggct

SEQ ID NO: 16298 - DNA, 2580 bp, Artificial Sequence
  Description of Artificial Sequence: Synthetic coding sequence
atgggtccgtggggctggaagctgcgctggaccgtcgcacttctgctcgcagccgcgggaactgctgttggagatagatgtgaaagaaacgagttccagtgtcaagacggtaaatgtatctcgtacaagtgggtgtgtgatggatccgccgagtgccaagatggtagcgatgaatcccaagaaacctgtttgtcagtgacttgtaagagcggcgacttttcatgcgggggccgagtgaaccgctgtatccctcaattctggcggtgtgatggacaagtcgattgcgacaatggttcggatgagcaggggtgtcctcctaaaacctgctcccaggatgaatttcggtgccacgacggaaagtgtatctctcgacaattcgtgtgtgattcggaccgggattgcctggatggaagtgatgaggcatcctgtccagtgcttacgtgcgggcctgcatcatttcaatgcaattccagcacctgtattccccagctttgggcatgtgataacgaccctgactgtgaggacggatcagacgaatggccgcagcggtgcagaggtctttacgtgtttcaaggtgatagctcaccctgcagcgcctttgaatttcactgtctttcgggagagtgcattcattcctcctggagatgtgacggtggtccggattgtaaagataagtcggacgaggaaaattgtgcagtggcaacctgcagacctgatgaatttcaatgttctgatggaaactgtatccacggatccagacagtgcgatagagaatacgactgtaaggatatgagcgatgaagtgggatgtgtgaacgtcactctttgcgagggaccaaacaaattcaagtgccattcaggagaatgtatcaccctcgacaaggtgtgtaacatggcgcgagattgtcgcgattggtccgatgagcctatcaaagagtgtggtaccaacgcctgtctggacaataacggtgggtgttcccatgtgtgcaacgatctgaaaattggatatgagtgcctttgtcctgacggatttcagctcgtggcccaacgtaggtgcgaggatatagatgagtgccaggatcctgatacctgttcacaactgtgtgtcaaccttgaaggcggatacaagtgccagtgtgaagagggatttcagttggacccgcatactaaggcctgtaaggcggtgggttcaatcgcctaccttttctttaccaacagacatgaagtgaggaagatgactcttgatagatctgaatacacgtcccttattcctaacctgcgcaatgtggtggcactggacaccgaggtggcttcaaaccgcatatactggagcgatttgtcacaacggatgatttgctccacccagctggatcgggcgcatggcgtgagctcctacgacaccgtgatctcacgcgacattcaggcaccggacggactggcggtcgactggatccactccaacatttactggaccgattccgttcttggtaccgtgtcggtcgcagataccaaaggagttaagcgcaagactctgtttagagaaaacggatcgaagccgcgagctattgtggtcgatcctgtgcatggatttatgtactggactgactgggggacccctgcaaagatcaaaaagggtggtctgaacggtgtggacatctactctctggtcactgaaaacattcagtggcctaacgggattacccttgatttgttgtcggggcgcctctactgggttgacagcaagctgcactccatctcatcaatagatgtgaacggaggaaacagaaagaccatcctggaggacgaaaagcggttggcacatcctttttcgctcgcggtgtttgaggacaaagtgttttggaccgacattatcaatgaagcgatattcagtgcaaacaggcttactgggtccgacgtgaaccttctggcagaaaacctcctgtcgcctgaggatatggtgctgttccataacctcacccaaccccggggagtgaattggtgcgaacggactaccctgagcaacgggggatgtcagtacctctgcctgccagcaccccagattaatccgcattcacctaagtttacgtgtgcatgtcctgacgggatgctgctggcaagagatatgcggtcgtgtctgaccgaagcagaagccgcagtggccacccaagaaactagcaccgtgcgtcttaaagtgtcatccaccgccgtgcgaacccagcacactactacccggcctgtgcctgatacgtcgcgtctgcctggagccaccccaggtcttaccacggtggaaattgtcactatgtcgcatcaagccctgggagatgtggcaggtcggggaaacgaaaagaagccctcgtccgtgcgcgcccttagcatcgtgctccctattgtcctccttgtctttctgtgtttgggagtgtttcttctgtggaaaaactggcgactcaagaacattaacagcattaacttcgacaacccagtctaccagaaaactactgaagatgaggtgcatatctgtcataaccaagatggctactcgtatccaagccggcagatggtgtcactcgaagatgatgtggca

SEQ ID NO: 16299 - DNA, 2580 bp, Artificial Sequence
  Description of Artificial Sequence: Synthetic coding sequence
atgggtccgtggggttggaagctgaggtggactgtggccctgctcctcgcagccgcagggacagcagtaggtgatcggtgtgagcggaacgagtttcagtgccaggatggaaagtgtatcagttataagtgggtatgcgatggcagcgcagagtgtcaggacgggtccgacgaaagccaggaaacttgcctctcagtaacttgtaagtctggagacttcagttgcggcggacgggtgaataggtgcatccctcagttctggcgatgcgatggacaagtggattgtgacaacggatccgatgagcagggatgtcctccaaagacatgctctcaggacgagttccgatgtcacgatggaaaatgtatcagtcgacagttcgtctgcgatagcgacagggattgtctcgacggctccgatgaggcatcttgcccagtcctgacctgtggtcccgccagctttcagtgcaatagtagcacctgcataccacagctgtgggcttgtgataacgaccccgattgcgaggacggctccgatgagtggccccagcggtgccgcgggctctacgtgttccaaggggattctagcccctgcagcgcgtttgagttccattgcctgtccggggagtgcatccacagttcatggaggtgcgatggcggtcctgactgcaaggataagagcgatgaggaaaactgcgccgtcgcgacctgtaggcctgatgagttccagtgcagcgacggtaactgtatccacggatccaggcagtgcgacagggagtacgactgtaaagatatgtccgatgaggtagggtgcgtaaacgtcaccttgtgcgagggcccaaacaagttcaaatgccacagtggagaatgcatcaccttggataaagtgtgtaacatggcgcgcgactgtcgcgattggtcagatgagccaattaaagaatgcgggaccaacgcttgtctggataataacggcggctgtagccacgtctgcaatgatctgaagatcggctacgagtgtctctgtcccgacgggttccagctcgtggcccaaagaaggtgtgaagatatagacgagtgtcaggacccagatacctgtagtcaactctgcgtgaacctggagggcggatataaatgtcagtgcgaagaaggctttcagctggatcctcacaccaaagcctgcaaggccgttggtagtattgcctacctttttttcaccaatcggcacgaagtgcggaagatgaccttggacaggagcgaatacacatcactgatccctaaccttcggaatgtagtggcactcgacacggaagtagcgagtaaccgaatttattggtctgacctgagccagcgcatgatttgtagtacccagttggaccgagcccacggggtcagcagctatgacacagtgatatcccgcgacatacaggcccctgacgggcttgcggtagattggatacactccaacatctactggaccgatagcgtattgggcaccgtaagtgtggccgatacgaagggagtgaaacggaaaaccctcttccgggagaacggctccaagccaagagcgattgtggtggatcctgttcatggattcatgtactggaccgactgggggactcctgctaagattaaaaagggaggattgaacggtgtggacatctactctctggttacggagaatattcagtggcccaatggcattacgctggacttgctgtctgggaggctttattgggtggactctaagctgcatagcattagttctatcgacgtgaacggggggaataggaaaaccatactcgaggacgaaaagcgcctggcccatccattcagtctcgctgtgttcgaggacaaggtcttctggactgatattataaatgaagcaatcttttccgccaacagactgacaggtagcgatgtcaacctcctggccgagaatctcttgagccctgaagacatggtgctttttcacaacctgactcagcctcgcggggtgaattggtgcgagcggactacgctttccaatggcggatgtcagtacctctgcctcccagcgccccagatcaacccgcactcccctaagtttacttgcgcctgcccagacggcatgctgctggctcgcgatatgagaagctgtctgaccgaggcggaggcagccgtcgccacccaagaaacgagcaccgtaaggctgaaggtctcatccacagcagttcgcacgcaacataccacaaccagacctgttcctgacacctctcgcctgccaggcgcgacccccggccttaccacagttgaaatcgtcaccatgtcacaccaggctctgggagacgttgccggcagggggaatgaaaagaagccgtctagtgtgagagctctgagcatagtgctgccaatcgtgctcctcgtgttcctgtgcctcggagtctttttgctttggaagaactggcggcttaagaacattaatagcatcaattttgataacccagtctaccaaaaaacaaccgaagatgaggttcacatatgtcataaccaagacggttacagctacccttcacgccagatggtgtcactggaagacgacgtcgct

SEQ ID NO: 16300 - DNA, 2580 bp, Artificial Sequence
  Description of Artificial Sequence: Synthetic coding sequence
atgggaccctggggatggaaacttcgctggaccgtggccctcttgctggctgcggctggaaccgctgtgggtgatcgatgtgaacgtaacgagtttcagtgtcaggacgggaagtgcatctcttacaaatgggtctgcgacggctcggcagagtgccaagatggctccgatgaatcccaagagacttgtctgtcggtcacttgcaaatcaggtgatttctcctgcggagggcgggtgaatcgctgcatcccgcagttctggcggtgcgatggccaagtggactgcgacaacggcagtgatgagcagggctgcccgccaaaaacgtgcagccaagacgaattccggtgtcatgacggaaagtgcatttcgcgccagttcgtctgcgattccgacagagattgcttggacggctcagatgaagccagctgccccgttcttacctgcggtcctgcgagcttccaatgtaatagctcaacttgcatccctcaactgtgggcgtgcgacaatgacccggactgtgaagatgggtcagatgagtggccccagcgctgtcggggcctgtacgtgtttcagggagacagctcgccatgctccgcttttgagttccactgtctcagcggcgagtgtatccactcgtcatggcgctgtgacggaggccctgactgcaaggacaagagcgacgaagaaaattgcgccgtagcaacttgccggcctgatgagtttcaatgttcagacgggaactgcatccatgggtcgcgacaatgtgatcgggaatacgattgcaaggacatgtctgacgaagtgggatgtgtcaacgtgacgttgtgtgaaggacctaacaaattcaaatgccattcaggcgaatgtatcacgctggacaaagtgtgcaacatggcgagggactgccgggactggtccgacgagccgatcaaagaatgcggaactaatgcgtgcctggacaataatggcggttgttcacatgtctgcaacgacctgaagatcggatatgaatgcctgtgcccggacgggttccagctggttgcccagagacgctgtgaggacattgacgagtgtcaagacccagacacctgttcccagctttgcgtgaacctcgagggtggatacaagtgccagtgtgaagagggattccagctggacccccataccaaggcctgcaaggcggtgggatcaatcgcatatcttttcttcactaaccggcacgaggtgcggaagatgacgttggaccgctccgaatacacgagcctgatcccgaacctgcgtaacgtggtcgctctggataccgaagtggcctcgaaccgcatctactggagcgacctgtcccagagaatgatctgctcgactcaactggatagagcccatggggtgagcagctatgataccgtgatctcgcgggacattcaggccccggacggactggcggtcgattggatacacagcaacatctactggactgactccgtcctggggaccgtgagcgtggccgacactaagggagtgaaacgcaagaccctgtttagagagaatggcagcaagccgagagcgatcgtagtcgaccctgtccacggatttatgtactggacggactggggaactccggcaaagatcaaaaagggaggcctcaatggggtggacatttactcgttggttactgaaaacattcagtggccaaacggcatcaccctggatctgctcagcgggcgcctttactgggtggactccaagctgcactccatctctagcatcgatgtgaatggcgggaacagaaagactatcctcgaggacgagaagcggcttgcccatccgttctcactggccgtgttcgaagataaggtgttctggacggacataatcaatgaagctatcttttctgccaaccggctgaccggctccgacgtgaatctgctggccgaaaacctgctctcaccggaagatatggtgttgttccacaacctgacccaaccgagaggggtgaattggtgcgaacgcactaccctcagtaatgggggctgccagtacctgtgtctgccagcccctcagatcaacccccactcgccaaagttcacctgcgcctgcccggatggaatgcttcttgccagagatatgcggtcatgtctcaccgaggcagaagccgcggtcgcaactcaggaaacttcgaccgtcaggcttaaggtgagctcgaccgctgtcagaactcagcacactacgactcggccagtgccagacacctcgcgactgccaggagcaacccccgggctcactaccgtcgaaatcgtgaccatgtcccaccaggccctgggtgatgttgccggaagaggaaatgagaagaaaccttcgtccgttcgggcgctctccatcgtcctgccgattgtcctcctggttttcctctgtctcggagtgttcctcctgtggaagaactggcgcttgaagaacataaactcgatcaatttcgataacccggtgtatcagaaaactaccgaagatgaggtgcacatctgccataaccaggacgggtactcatacccttcaagacaaatggtgtcgcttgaagatgatgtggct

SEQ ID NO: 16301 - DNA, 2580 bp, Artificial Sequence
  Description of Artificial Sequence: Synthetic coding sequence
atggggccttggggctggaagctgagatggactgtcgctctgctgctggctgcggcggggactgccgtcggtgacagatgcgaaagaaacgaattccagtgccaggacggtaaatgtatctcgtacaagtgggtctgcgatgggtcagcggagtgccaggatggcagcgacgagagccaggagacttgtctgtcggtcacttgtaagagtggcgacttctcctgtggaggccgagtcaaccggtgcatcccccaattttggagatgcgacggtcaggtggactgtgacaacggatccgacgaacagggttgtcccccaaagacctgttcccaggacgaattccggtgtcacgacgggaagtgtatttcacggcaattcgtctgcgatagcgatagagattgcctggacggatcggacgaggcttcctgccctgtgctgacctgcggaccagcgtcctttcagtgcaattcctccacttgcatcccccagctgtgggcctgtgacaacgatccagactgcgaagatgggtcggacgagtggccacaaaggtgccggggcctctacgtgtttcagggagattcgtcgccgtgttcggccttcgaattccattgcttgtccggtgaatgcatccattcctcatggaggtgcgacggaggaccggattgtaaagataagtccgacgaggagaattgcgcggtggcgacttgccggcccgatgaattccagtgttcggacgggaattgtattcacggctcccgccagtgcgatcgcgagtacgattgcaaggatatgtcggatgaggtgggatgtgtgaacgtgaccctctgcgaaggcccaaacaagttcaaatgtcactcgggggagtgcattacccttgacaaggtgtgcaacatggcccgcgattgcagggactggtcggatgaaccgatcaaggagtgcggaacgaatgcctgcctggacaataatggaggctgctctcacgtgtgtaacgatctcaagatcggttacgaatgcctttgtccagacggtttccagttggtcgcccaacgacgatgcgaggacatcgatgaatgtcaagacccggacacctgcagccagctgtgcgttaacctcgaaggaggctacaagtgtcagtgcgaggagggctttcagctcgatccgcacaccaaagcctgtaaggcagtgggatcaattgcataccttttcttcactaatcggcatgaagtgcggaagatgaccctcgaccggagcgaatacacctccctgatcccgaacttgcggaacgtggtggccctcgacactgaggtcgcctcaaatcgaatctactggtctgatctgtcccaacgcatgatctgctccacccagctggatagggcgcacggtgtgtcctcttacgacacggtgatctcgcgcgatatccaggcgccagacggactggcagtggattggatccactcgaacatctactggaccgattcagtgctcggcacggtgtccgtggcggatactaaaggagtgaagcgtaagaccctgttccgggaaaatggatcgaagccacgcgccatcgtcgtggacccggtccacggcttcatgtactggaccgactggggaaccccggcgaaaatcaagaagggcggactcaacggagtggacatttactcacttgtgactgagaacatccagtggccgaacggtatcactctcgacttgctttccggacgcctgtactgggtggatagcaaactccattcaatctcgagcatcgatgtcaacggaggaaacagaaagactattctggaggacgaaaagcggctggcccacccgttctcattggccgtctttgaggacaaagtgttctggaccgacatcataaacgaagcgatcttctccgccaatcggctcactgggtccgatgtgaacctccttgcagagaacctgttgtcaccggaagatatggtactcttccacaatctgacccaaccgcggggagtcaattggtgcgagaggaccactctgtccaacggaggctgccagtacctctgcctgccggctccgcagatcaacccacacagcccgaaattcacttgcgcttgccctgacggaatgctcctggcgagagatatgaggagctgccttactgaagcagaggcagccgtcgcgacccaggaaacctcaactgtccgccttaaagtctcctcgaccgcagtgagaactcaacacactaccaccagaccggtcccagacacttcacgcctgccgggagcgactcctggactcactaccgtggagatcgtgaccatgtcgcatcaggcactcggcgacgtcgcaggcagaggcaacgaaaagaaaccctcttcagtgcgggccttgagcatcgtgctgccaatcgtcctgctcgtgtttttgtgcctgggagtgttcctcctgtggaagaactggcgcctcaagaatatcaacagcattaactttgataacccggtgtaccaaaagactaccgaagatgaggtgcacatctgccacaaccaggacggatactcatacccttcccgccagatggtttccctggaagatgatgtcgcc

SEQ ID NO: 16302 - DNA, 2580 bp, Artificial Sequence
  Description of Artificial Sequence: Synthetic coding sequence
atgggcccttggggctggaaactgcggtggacagtggcattgctgctagccgcagctggaactgccgtgggagatagatgcgaacgaaatgaattccagtgccaggatgggaagtgtatctcctataagtgggtgtgtgatggtagcgcggaatgtcaggacggatccgacgagtctcaggagacttgcctgagtgtgacttgcaagagcggagacttctcatgtggaggcagggtgaacagatgcattccccagttttggcggtgtgatgggcaggtagactgcgacaacgggtccgacgagcaaggctgcccacccaagacttgtagtcaggatgagtttcggtgccacgatggcaaatgtataagccggcagttcgtgtgtgactccgacagggattgcctggacggctctgatgaggctagctgccctgtcctaacttgtgggcccgcaagcttccagtgtaattccagcacgtgtatcccccagctgtgggcttgtgataacgaccccgattgcgaggatggaagtgacgaatggccccagcggtgcaggggcctctatgtgtttcaaggagacagttccccctgcagtgctttcgagtttcactgtctctctggggagtgcattcactccagctggcgctgtgatggtggacccgattgcaaagacaaaagtgacgaagagaactgcgcggtcgcgacctgccgcccagacgaattccagtgttcagatggaaattgcattcacggctcgaggcagtgcgacagagaatacgattgcaaggacatgagcgacgaagtcggctgcgtgaacgtcactctgtgcgaaggacccaataagttcaaatgtcatagcggggagtgtatcacccttgacaaggtttgcaacatggctcgggattgccgcgattggagcgacgaacccattaaagagtgtggtactaatgcctgtcttgacaataatggaggttgcagtcacgtgtgcaatgatttgaaaatcggttacgagtgtttatgtcccgacggatttcagctggtggctcagaggagatgcgaggacatcgatgaatgccaggaccctgacacttgcagtcagttgtgcgtgaatctggagggaggttacaagtgccagtgcgaggaaggtttccagctggatccacacacgaaagcttgcaaggcggtagggagtattgcgtacctctttttcactaaccggcacgaggtgagaaaaatgacactcgatcggagtgaatacacgtctctgataccaaatttgaggaacgttgtggccttagacactgaggttgctagcaaccgcatttattggtccgatctttcacagcgcatgatctgcagtacccaacttgaccgggcccatggcgtctcctcttacgacacagtaatctcaagggatatacaggcccccgacggcctcgctgtggactggattcactccaatatctactggacggactccgttctcggcactgtgtctgtcgcggatacgaagggggtaaaacgcaagacgctattcagagagaacggatcgaagccgcgggccatagtggtcgaccctgtgcacgggttcatgtactggactgactggggaacccctgccaaaatcaagaagggtggtcttaatggtgtggacatttatagcttggttacggagaatatccagtggccaaacggcatcactcttgatctgttgtctgggcgcctatattgggtcgattccaagctccattcgatctcctccatagacgtgaatggaggaaatcggaaaactatcctcgaagatgaaaagcgcctggctcaccctttttccttggccgtgtttgaggataaggtattctggaccgatatcattaatgaggctatttttagcgcaaacaggcttactgggtcagatgtgaatttgctggcagagaatcttttgtctccagaggacatggtactcttccacaatctgacccagcctcggggagtgaattggtgcgagcgcacgaccttgtccaacggcggctgccaatacctctgcttacccgctcctcagatcaatccacacagcccaaaattcacctgtgcttgtccggatggtatgctcctcgcacgggacatgcgtagctgtctaactgaagcagaggctgccgtcgccacccaagagacctccacagttaggctgaaagttagcagtaccgccgtcagaacacagcataccacaacacgaccagtgcccgatacttcaagacttccaggggccacccccggactaacaacagttgagatagttacaatgtcacaccaagccctgggtgacgtggccggccgcggtaatgagaaaaagcctagttccgttcgggcactgtccatagtcctcccaattgtgctactggtgttcctgtgtcttggcgtgtttcttctgtggaagaattggaggcttaaaaacattaatagcattaactttgacaacccagtctatcagaaaactacggaagatgaggtgcacatttgccacaaccaggacggatactcttaccctagccgccagatggtctctcttgaagacgacgtggcc

SEQ ID NO: 16303 - DNA, 2580 bp, Artificial Sequence
  Description of Artificial Sequence: Synthetic coding sequence
atgggcccatggggttggaagttacgatggaccgtggcgctgctgctcgcagccgccggcactgcagtaggagataggtgcgaaaggaacgaattccaatgtcaggacggcaagtgcatttcatataaatgggtgtgtgacgggagtgctgagtgccaggacggctccgatgagagccaggagacatgtctgtcagtgacctgcaaatcgggagattttagctgcggtggcagagttaaccgatgtatcccacagttctggcgatgtgacggccaggtggattgtgacaacggttcagatgagcagggatgccctccgaaaacctgttcccaggatgagttcaggtgccacgatgggaagtgcataagtcgccaattcgtgtgtgactccgaccgcgattgcttagacggcagcgatgaggcatcctgccctgtgctgacttgtggacccgccagttttcaatgcaattcttcgacttgtattccacagctgtgggcctgcgacaatgatccagattgtgaggatgggtcggatgagtggccacagcgatgtcgaggactatacgtctttcaaggcgacagctcaccctgttccgctttcgaatttcattgcctctcgggtgaatgtattcatagctcctggcgctgcgacggcgggcccgactgtaaggacaagtcagacgaggaaaattgtgcagtcgcaacttgcaggcccgacgagttccagtgctccgacggcaactgcattcacgggtcacggcagtgtgatcgagagtacgactgcaaggacatgtccgatgaagtcggctgcgtgaatgtgactttgtgcgagggccccaacaaatttaagtgtcacagtggcgaatgcattaccctggacaaagtctgcaacatggcaagggactgtcgagactggtcagatgaaccaataaaagaatgcggaaccaatgcatgcttggataacaatggggggtgcagccacgtgtgtaatgacctcaaaatcggatatgaatgcctctgtccagatggtttccagctggtggcacagaggaggtgcgaagatattgacgagtgccaggacccagacacttgctcccaactgtgcgttaacctggaaggcggatacaaatgtcagtgtgaagagggcttccagctagatccgcacaccaaggcttgcaaggcagtgggctcaatcgcttacctctttttcacaaaccgtcatgaggtccggaagatgacactggacaggagcgaatatacctcattgattcctaatctgagaaacgtcgtggctctcgacacagaagtcgcaagcaatcggatctactggtccgatctttctcagcgaatgatatgtagtacgcagctggatagagcacacggtgtgtcctcctatgatacggtgatatcccgagacatccaagcgcccgatggccttgccgtggattggattcactctaacatctactggacagactccgtcctggggacggtttctgtcgcagacactaagggtgttaaaagaaagaccctcttcagagagaacgggagtaaacccagagcgattgttgtcgatcccgtccatggcttcatgtattggaccgactggggcacgccagccaagattaaaaaaggcggattgaatggtgtagatatttattccctggttaccgagaacattcagtggcccaacggcataactctggacctacttagtgggagactttattgggtcgactctaagctgcacagcattagtagcatagacgtcaacggaggtaacagaaaaacaatcttagaagatgaaaagaggctggcccacccattcagcctcgcggtgttcgaagacaaggtcttttggaccgacatcattaatgaagcgattttttctgccaatagactcacgggctcagacgtgaacctcctggctgagaatcttctatcccctgaggacatggtgctcttccacaacctaactcagccgaggggtgtgaattggtgcgaacgtacaacgctcagcaatggcggatgccagtatctttgtttgcccgcgccacagatcaatccacattcacccaagtttacctgtgcttgtcctgatggaatgctcctagcaagggacatgcggtcttgcctgacagaagccgaagccgctgtggctactcaggaaacctctactgtgagattgaaggtctcatccaccgctgttaggacacaacacacaacaacgcggccggtgccagacacaagcagactccccggagctacgcccgggcttacgactgtagagatcgtgaccatgtctcaccaagctctgggagatgtggcgggcagagggaacgaaaagaagcccagcagtgtaagagcgttgagtattgtcctgcccatcgtgctgttagtttttctctgcctgggagtcttcctgctgtggaaaaattggaggcttaaaaatattaatagtataaacttcgataaccccgtgtaccagaaaactacggaagacgaagtccacatctgtcacaaccaggacggatacagctacccctcaagacagatggtatccctcgaagatgatgtcgcc

SEQ ID NO: 16304 - DNA, 2580 bp, Artificial Sequence
  Description of Artificial Sequence: Synthetic coding sequence
atgggaccatgggggtggaagctgaggtggaccgtcgccctcctgcttgccgcggcggggactgcggtgggtgaccggtgtgagcgcaacgaatttcaatgccaggacggaaagtgtatctcgtacaagtgggtctgcgacggatccgcggaatgccaagacggaagcgacgaatcccaagaaacgtgtttgagcgtgacctgtaagtcgggagacttttcatgcgggggtagagtgaaccgctgtatcccacagttttggaggtgcgacggacaggtcgattgtgacaacggttcggacgaacaaggttgcccacctaagacctgttcgcaggacgaattcagatgccacgacgggaagtgtatctcacggcaattcgtttgcgactcagatagagactgcctcgacggatccgatgaggcctcgtgtcccgtgctcacttgcggaccggcttcattccaatgtaactcgtccacctgcatcccgcaactgtgggcgtgcgataacgacccagactgtgaagatggttctgatgagtggcctcagcgctgcagaggcctttacgtctttcagggcgactccagcccctgctcggcctttgagttccactgtctgtcgggtgagtgcatccattcgtcatggcggtgcgatgggggtccggactgtaaggacaagtcggatgaggagaattgcgccgtggcgacctgccgcccagatgagttccaatgctcggacgggaactgcattcatgggtcgcgccagtgcgaccgcgaatacgattgtaaggatatgtccgacgaagtgggctgtgtcaacgtgaccttgtgtgaaggcccaaacaaattcaagtgccatagcggagagtgcatcactctcgacaaagtgtgcaatatggctcgggactgccgggactggagcgacgaaccgattaaagagtgcggaactaatgcgtgccttgataacaacggaggctgcagccacgtttgcaacgacctgaaaattgggtacgagtgtctgtgtccggatggattccagctggtcgctcaacggcggtgcgaggacattgacgagtgtcaggatcccgacacctgctcgcagctgtgcgtgaacttggaaggaggatacaaatgtcaatgtgaagaaggtttccagctggacccccatactaaggcatgcaaagcagtcgggagtatcgcgtacttgtttttcaccaacagacatgaggtccggaaaatgaccctggaccggtcggagtacacctccctcatccctaacctgaggaacgttgtggcccttgatactgaggtcgcatccaatcgtatctactggagcgaccttagccaacggatgatttgctctacccagctggacagagcgcacggcgtgtcatcgtacgataccgtgatctccagagatatccaggccccggacggattggccgtggactggattcatagcaatatctactggaccgactcggtcctggggaccgtgtctgtggcggatactaagggagtgaagcgcaagactctcttcagagaaaacggatcgaaaccgcgcgctatcgtcgtggaccctgtgcacggcttcatgtactggactgattgggggactccggcgaagatcaagaaaggggggctcaacggagtcgatatctactccctggtgaccgagaacattcaatggccgaacggtatcactctggatctgcttagcggccgcctctactgggtcgactcgaagctccatagcatctcctccatcgatgtgaacgggggaaatagaaagactatcctggaggacgaaaagcggctcgcccatccgttctcgctggccgttttcgaagataaagtgttctggactgacatcatcaacgaagccatcttcagcgcaaaccgccttactggttcggacgtgaacctgctggcggaaaacctgctctcgcctgaagatatggtcctctttcataatctgacgcaaccaaggggagtgaactggtgcgagagaaccactctgtctaacggcggatgccagtacctgtgcctgccagctccgcaaatcaacccgcattccccgaagttcacttgcgcttgcccggacggaatgctgctggcccgggacatgcgctcgtgcctgactgaggccgaggcggctgtggccacgcaggaaacctccaccgtgcgcctgaaggtgtcgtcgaccgcagtgagaacccagcacaccaccacgcgccccgttcccgacaccagccggctgccgggtgcaaccccgggtctgactactgtggagatcgtcactatgtcccatcaggctctgggagacgtggccggaaggggaaacgagaagaaaccttcgtccgtgagggcactgtcaattgtgctccctatcgtgctcctggtgttcctctgcctgggagtgtttttgctttggaagaattggcgccttaagaatatcaattccatcaattttgataaccccgtgtatcaaaaaactactgaggacgaggtgcacatctgccacaaccaagatggctactcctacccatcccgccagatggtgtcgcttgaagatgatgttgcc

SEQ ID NO: 16305 - DNA, 2580 bp, Artificial Sequence
  Description of Artificial Sequence: Synthetic coding sequence
atgggtccatggggctggaagctccggtggaccgtggccctgctcctggcagccgccgggaccgccgtcggagatagatgcgaaaggaacgagttccagtgtcaagatggcaagtgtattagttacaagtgggtgtgcgacggatccgcagagtgtcaagacggctcagacgaaagccaggagacttgccttagcgtgacctgcaagtctggagactttagctgcggaggaagagtcaaccgctgcatcccacagttctggcggtgcgatggccaagttgactgtgataacggaagtgacgagcagggatgccccccaaagacttgctctcaggacgaattcaggtgtcatgacggaaagtgcatctcaagacagttcgtctgcgatagtgaccgcgattgtctggatggcagtgacgaggcaagctgcccagtgcttacatgcggcccagcttctttccagtgcaattccagcacctgcattcctcagctctgggcttgtgacaacgatcccgactgcgaagatggaagtgatgagtggccccagcggtgtaggggcctgtacgttttccagggcgactcgagcccatgtagcgcctttgagtttcactgtctgtccggtgagtgcattcactcttcctggcgatgcgacggcggccccgattgcaaagataagtctgatgaggagaattgcgctgtggctacatgtcgccctgatgagtttcagtgctctgacgggaattgtatccacggaagtagacagtgtgaccgggaatacgactgtaaggacatgagcgacgaagtcgggtgtgtgaatgtgacgctgtgcgaaggtcctaataagttcaagtgtcacagcggagagtgcatcacactcgataaggtctgcaacatggcacgtgattgcagagattggtccgacgagccgatcaaagagtgcggtactaacgaatgcctggataataacggaggatgtagtcacgtgtgcaatgatctgaagattggcgccgagtgcctgtgtccggacgggttccagctcgtggcgcagaggaggtgtgaggacattgacgaatgccaggaccctgatacctgttcacaactatgcgtgaacttggaaggcggttataaatgtcaatgtgaggaggggtttcagctggatcctcacaccaaggcctgcaaagccgtcggatctatcgcatatctctttttcaccaaccgccatgaagtaaggaagatgacactcgataggagtgaatatacaagtctgatcccgaatctgagaaacgtagtcgccctggacaccgaagtggcatccaatcggatatactggtctgatctgtctcagcgcatgatctgcagcactcagttggacagggctcacggcgtatctagctacgacacagtaatctcacgcgatattcaagcgcccgatggcttggcagttgactggatccacagtaacatctactggaccgattccgtgttgggaacagtgtcagtggccgacaccaaaggagtgaaaaggaagacattattccgcgagaatggcagcaagccaagagcgattgtggtggacccggtgcatggattcatgtactggaccgactggggaactcctgcaaaaattaagaagggtggcctgaatggcgtggatatctacagtctggtgacggagaacatccagtggcccaatggtattacgctggatctgctaagtggaaggctgtactgggttgatagcaagctgcactctatctccagcatcgacgtcaacggaggaaatcggaaaacaattttggaggatgagaagcgcttggcccatcccttcagcctggcagtgttcgaagataaggtgttctggacggatatcattaacgaagcgatcttcagcgccaacagactcactggcagcgatgtgaatttgctcgccgagaatctcttgtccccagaagatatggtcctgttccataacctgacacagccacgcggggtaaactggtgtgagagaaccacactctccaacggcggttgccagtatctgtgcttgcctgcccctcaaattaacccacacagtccaaagtttacctgtgcctgcccagatgggatgctgcttgcccgggatatgagaagctgcctgaccgaggcagaagccgcagtagcgacccaggagacaagtaccgtgagactgaaagtgtcatcaacagccgtccgcacacagcataccaccactagacctgtccccgatacaagtaggctgcctggagccacccccgggctgaccacagtcgagatcgtgactatgtctcaccaggcactgggagacgttgctggacgcggtaatgagaagaagccctcttctgtgagggctcttagcatagtcttgccgatcgttctgttggtgtttctctgtctgggtgtgttcctcttatggaaaaactggaggctgaagaatataaacagcattaatttcgacaacccagtctatcagaagacaactgaggacgaagtgcacatttgccataaccaagacgggtacagttacccaagcaggcaaatggtatctctcgaagacgacgttgcc

SEQ ID NO: 16306 - DNA, 2580 bp, Artificial Sequence
  Description of Artificial Sequence: Synthetic coding sequence
atgggcccatgggggtggaagctcaggtggaccgtggcactgctgctggctgcagccggcacggctgtgggcgatagatgtgaacggaatgaatttcagtgccaggatgggaagtgtatcagctacaagtgggtgtgcgacggatcagcggaatgccaagacggcagcgacgaatcgcaggagacttgcttgtccgtcacctgcaagtccggtgacttttcgtgcggaggtcgagtcaatcggtgtatcccacaattctggcgctgcgatggtcaggttgattgcgacaacggatccgatgaacaaggatgcccgccaaaaacttgctcacaggatgaatttcggtgtcatgacgggaaatgcatctcacggcagttcgtgtgtgacagcgatcgggattgtctcgatggctctgacgaggcatcgtgtccggtcctcacctgcgggcccgcgtcattccagtgcaactcctccacctgtattcctcagctttgggcctgcgataacgatcccgattgtgaggacggttctgacgaatggccacaacggtgcaggggcctgtacgtgttccagggagactcctcaccgtgttccgcattcgaattccattgcctgtcaggcgagtgcatccactcctcctggagatgtgacggaggccctgactgcaaagacaaatccgacgaggagaattgcgctgttgcgacttgtaggccagatgaattccagtgctcggatggcaactgcatccacggttcgaggcagtgcgaccgcgagtacgattgcaaggacatgtcggatgaggtgggatgcgtgaatgtgaccctctgcgaaggcccgaataagttcaagtgccattccggagaatgcataacgctggacaaagtgtgcaacatggcgcgggattgccgggactggtccgacgaaccaatcaaggagtgcggaaccaatgagtgcctggataacaacggggggtgttcacacgtgtgcaacgacttgaaaatcggagcagaatgcttgtgtccagacgggttccaactggtcgcgcaacgccggtgtgaagatatcgatgaatgccaggatccggatacctgttcccagctgtgcgtgaacctcgaggggggctacaagtgtcaatgcgaggaaggattccaactcgacccacataccaaggcgtgtaaggcggtgggctccatcgcctacctgttctttactaatagacacgaggtgcggaagatgaccctggaccgatcagagtacacctcactgatccctaatctgcggaacgtggtcgcactggataccgaggtcgcttccaaccgcatatactggagcgacctctctcagcgcatgatctgctcgactcagctggaccgggcgcacggagtctccagctacgacactgtgatttccagagacattcaggcaccggacggtcttgccgtggattggatccacagcaatatctactggacggactcggttctgggcactgtgtcagtggcggacaccaaaggagtgaagcggaaaaccttgtttagagaaaatggatctaagcctcgggcgatcgtggtggatccagtccatggattcatgtactggactgactggggaactccagcgaagatcaaaaagggcggcctgaatggagtggacatttactcgctggttactgagaacattcagtggccgaacggtatcactttggatctgctgtcggggagactgtattgggtggactccaagctccatagcatctcgtcgattgacgtgaatggaggcaatagaaagactatcctggaggatgaaaagcgcctggcccacccgttctccctggcagtctttgaagataaggttttctggaccgacatcatcaacgaagcgatcttctcggccaatcggctgactggaagcgacgtgaacctccttgcagaaaacttgctgagccctgaggatatggtgctgttccacaatctgacccagccgcgtggtgtcaactggtgcgaaagaaccaccctgtcgaatggaggctgccaatacctctgcttgcctgccccccaaatcaatcctcacagtcccaagttcacttgcgcctgtcctgacggcatgctgctcgctcgagacatgcgctcgtgcctgaccgaagcagaagccgccgtggccacccaggaaacctcgactgtccggctcaaagtctcgtccaccgcagtgagaacccagcacactactacgcggccggttcctgacactagccggctcccgggggcgactcctgggctcaccactgtggaaatcgtgacgatgtcgcatcaagccctgggagacgtggctggtcgcggtaatgagaaaaagccgtcctcggtgcgcgcgctgtcaatcgtgttgccgatcgtcttgttggtgttcctttgtctgggggtctttcttctgtggaaaaactggcggctgaagaatatcaattcgatcaactttgacaatccagtctaccaaaagactaccgaggacgaggtgcatatctgccataatcaggacggctactcctacccgtcccgacagatggtgtcgctcgaagatgatgtggca

SEQ ID NO: 16307 - DNA, 2580 bp, Artificial Sequence
  Description of Artificial Sequence: Synthetic coding sequence
atggggccctggggctggaagctgagatggaccgtggcgctgctgttggctgcagcaggcactgccgtgggtgatcgctgcgaacggaacgagtttcagtgccaagacgggaaatgtatctcctataaatgggtgtgtgacggttccgccgagtgccaggatggttcggacgagtcgcaggagacatgcctgagcgtcacctgcaaaagtggtgatttctcctgtggaggtcgggttaaccgttgtatcccacagttctggcgatgcgacgggcaggtcgactgcgacaatggttcagacgaacaaggatgcccacccaagacttgttctcaagatgaatttcggtgtcatgacggcaagtgtatttcccgacaattcgtgtgcgattctgacagggactgtttagacggctccgatgaggcttcctgccctgtactgacgtgcgggcccgcgagctttcaatgtaactccagcacttgtattccccagctctgggcatgcgacaatgaccccgattgtgaggacggcagcgacgaatggccccagagatgcagaggactgtatgtcttccagggagattcgagtccgtgttctgcctttgagtttcattgcctttctggcgaatgtatccattcatcgtggaggtgtgacggcgggcccgactgtaaagataaatccgacgaggaaaattgcgccgtggccacatgtcgcccggatgagtttcaatgtagcgacggtaattgtatacacgggagccggcagtgcgatcgggagtacgactgcaaagacatgagcgacgaggtgggatgcgtgaatgtgactctctgtgagggcccaaataagtttaagtgccacagtggagaatgtattactctggataaggtgtgtaacatggctagagactgcagggattggagcgacgagccaatcaaggaatgtggcaccaatgaatgtctggacaacaacggtggctgcagccatgtatgcaacgacctcaaaattggggccgagtgcctgtgccctgacgggtttcagctcgtggcccagagacgttgtgaggatatcgacgaatgtcaggacccagacacctgttctcaactttgcgtgaatctcgagggcggatataagtgccagtgcgaagagggatttcagctcgacccacacactaaggcctgtaaggctgtgggaagcatcgcatatttgtttttcactaataggcatgaggtacgcaagatgaccctcgataggtctgaatatacaagcttgatccccaacttaagaaacgtagtggccctggacaccgaggttgcaagtaaccggatatactggtctgacttaagccagcggatgatatgtagcactcagctggatagagcgcatggggtgagctcctatgataccgtcatcagccgtgacatacaggctccggacgggctggccgtggactggattcattctaacatttactggaccgattcggtcctgggtactgtgtccgtagccgacaccaagggcgtgaaaaggaaaacgcttttcagagaaaatggttccaagcctagggccatcgtagtcgaccctgtgcatgggttcatgtactggaccgactgggggacgccggctaaaattaaaaaaggcgggctgaatggtgtagacatctacagtctggtgaccgaaaacatccagtggccgaatggaattaccctggatctgctgagcgggaggctgtactgggtggactccaagttgcactccatctccagtatagacgtcaatggcgggaatcgaaagactatcctggaggacgagaagaggctggcccatccttttagcctggcagtgtttgaagacaaagtcttttggactgatattatcaatgaagcaatattttctgccaaccgtctcacgggtagcgacgttaatctcctcgctgagaacttgctgagccccgaagatatggtgctgttccacaacctgactcagccccgcggggtcaactggtgcgaaaggacgacactgtcaaatgggggatgccagtatctgtgcctgccggcacctcaaataaatccccatagtcctaaattcacctgcgcctgcccggatggcatgctactggcaagagacatgcgctcatgtctgacagaagctgaagctgccgtcgccacccaggagacctctactgtgagactaaaggtgagttcaactgcggtccggacccagcacactactacacggcccgtgccagacacaagcagacttcccggagcgactccggggctaacaaccgtggagatcgtgaccatgagccaccaagccctgggcgacgtggcaggccgcgggaacgagaaaaagccaagttccgttagggctctgtctatcgtgcttcctattgttttgttggtcttcttatgcctgggcgttttcctcctctggaagaactggagactgaaaaacataaattcaatcaatttcgacaatcctgtatatcaaaaaactactgaggatgaagtgcatatctgccacaatcaggatggatattcgtaccctagtcggcaaatggtgtctctcgaagacgatgtcgcc

SEQ ID NO: 16308 - DNA, 2580 bp, Artificial Sequence
  Description of Artificial Sequence: Synthetic coding sequence
atggggccgtggggttggaaacttagatggactgttgcccttctcctggcggcagcaggcaccgccgtcggagatcggtgtgaacgcaacgagttccagtgccaggacgggaagtgcatctcgtacaagtgggtctgcgacggttccgcggaatgtcaagatgggagcgacgagtcccaagaaacctgtctttcagtcacgtgcaagtccggtgatttttcctgcggcgggagggtcaatcggtgtattcctcaattttggcgctgtgatggacaagtcgattgtgacaatggatcggatgaacagggctgtccacctaagacttgttcccaagatgagtttaggtgccatgatggaaagtgtattagcagacaattcgtctgtgattcggacagagattgtctggacgggtcagatgaagcctcgtgtcccgtcctcacttgtgggccagcgtcgtttcagtgcaatagctccacctgcattccgcaactctgggcatgtgataatgatcccgattgcgaagatggttccgacgagtggccgcaacggtgtcgcggactgtacgtgtttcaaggagatagcagcccatgctcagcctttgaattccattgtctgtcaggagagtgtatacattccagctggcgatgtgatggggggccagactgtaaggataagagcgatgaagaaaactgcgcagtggcaacttgtcggccggatgaatttcaatgttctgatggtaactgtatccacggctcgcggcaatgcgatcgcgaatatgattgtaaggacatgtccgatgaggtgggatgtgtcaatgtgacgctttgcgagggtcctaacaagtttaagtgtcattcgggcgaatgtattaccttggacaaggtctgcaatatggctcgcgattgtagagattggtcggacgaaccaattaaggaatgcggcaccaatgagtgtctcgataacaatggtggttgttcccatgtctgcaatgatttgaaaataggggcagagtgtctctgccccgacggattccagctcgtggcccaacgacggtgtgaagatatagacgagtgccaggaccccgatacttgctcccaactgtgcgtgaaccttgaagggggatacaagtgccagtgtgaggaaggctttcaactggatccccacaccaaagcatgcaaggccgtgggctccatcgcttacctgttcttcactaatagacacgaagtcagaaaaatgaccctggatcggtccgaatacacctcccttattcccaatctgcgaaatgtggtggcgctcgataccgaggtcgcatccaaccgtatatactggtccgatctttcacagagaatgatctgctccactcaacttgacagagcgcatggagtgtcctcatacgataccgtcatttcacgcgatattcaggcacctgacggactggctgtggattggatccactcgaacatatactggacggacagcgtgcttggaacggtgtcggtcgcagacaccaaaggagtgaagcggaaaacgctgttccgggaaaacggtagcaagccaagagccatcgtcgtggacccagtgcacgggttcatgtattggactgattggggcaccccagcaaagattaagaagggaggcctgaatggggtggatatctactccctcgtgactgaaaacatccaatggcctaatggaattaccctggaccttttgtccggccggctttactgggtggatagcaaactccactcgattagctcaattgatgttaatgggggtaaccgtaagacgattctggaagatgagaagcgactggcccatccgttttcactcgctgtgtttgaagataaggtgttttggactgacatcatcaacgaagcaatattcagcgccaaccgactgaccggaagcgatgtgaatctcctggccgagaacctgttgtcgccagaagatatggtgctgttccataacctgactcaacctaggggagtgaactggtgtgagcgcaccactcttagcaacggaggctgccagtatctgtgcctgcctgcaccacagatcaaccctcatagcccaaaattcacttgtgcctgcccggatggaatgcttttggcacgcgacatgaggtcttgcctgaccgaagcagaagcagcggtggcaactcaggagacttccaccgttcgactgaaagtgtcgtcaaccgcagtgaggacccagcatactactaccagacccgtgcctgatacctcgcgacttccgggagccaccccagggctcacgacggtcgagattgtgaccatgagccatcaagcgctcggtgatgtcgcaggcaggggaaacgagaagaagccaagctccgtgcgcgcactcagcattgtcctgcctatagtgctgcttgtgtttctgtgtttgggagtgtttctgctgtggaaaaactggagactgaaaaacatcaattcaatcaacttcgacaaccccgtgtaccaaaagactaccgaggatgaagttcacatttgccataaccaagatggatactcgtacccctccagacagatggtgtcccttgaagatgatgtcgca

SEQ ID NO: 16309 - DNA, 2580 bp, Artificial Sequence
  Description of Artificial Sequence: Synthetic coding sequence
atgggcccttggggatggaagctccggtggaccgttgcactgctgcttgctgcggccggaaccgcggtgggagaccggtgtgaacgcaatgagtttcagtgccaggatggcaagtgtatttcttacaaatgggtgtgcgacgggtctgctgaatgccaggatggctccgacgagagccaggagacctgcttgagcgtgacatgtaagagtggtgatttttcctgtggagggagggtaaaccggtgtattcctcagttttggcggtgcgacggtcaagtggattgcgacaacggtagcgacgagcagggttgcccgcctaagacctgttctcaggacgagtttaggtgccacgacggcaaatgcattagtcggcagtttgtatgcgactccgaccgcgattgcctggatggctctgacgaggcttcctgccccgttctcacctgcggaccggccagctttcagtgcaatagtagcacctgtatcccacagctgtgggcctgcgataacgaccctgattgtgaagacgggtccgacgagtggcctcagcgttgtcgcggtttgtatgtgtttcagggcgacagtagcccttgttcggcctttgagtttcactgtttaagtggagagtgtatccacagtagctggcggtgcgatggcggtcctgactgtaaggacaagtctgatgaggagaattgcgccgtcgccacctgtcggcccgacgaattccagtgttcagacggaaactgcatccatgggagccgacagtgcgatagagagtacgattgtaaagacatgtcggacgaagttggttgtgtaaacgtgacattatgcgaaggacccaacaagtttaagtgtcatagcggggagtgtatcaccctggacaaagtgtgcaacatggctcgcgattgtcgtgactggagcgacgagccaatcaaggagtgtggaacaaacgagtgtctagataacaacggcggttgctcacatgtgtgcaatgatctcaaaatcggagcggagtgtctgtgccccgatggcttccaattggtggcacaaaggcggtgcgaggatattgacgagtgtcaggaccccgacacctgcagtcaactgtgcgtgaatctggaaggcggctacaagtgccagtgcgaagaggggtttcaattagaccctcacactaaggcctgcaaggccgtgggttcaattgcttacctattttttacaaatagacatgaggtgagaaaaatgacgctcgatcgctcggagtatacctctctgattcccaatttgcggaacgtggtcgccttggacaccgaggtcgccagtaatagaatctattggtccgacctcagccagcgcatgatctgcagcacacagttggaccgagcgcacggcgtgtcttcttatgatacagtgatctctcgcgatatccaggccccggatggactcgccgtggactggatccacagcaacatctactggacagactccgtgctgggaacagtttccgtagccgatactaaaggagtcaagagaaagacactgttccgcgagaatggcagcaagccccgcgccatagtggtagacccggtgcatggattcatgtactggaccgactgggggacgccggctaaaatcaaaaaagggggactcaatggtgtggatatctatagccttgtcacagagaacatccagtggccaaatggaattaccttagacctgctttccggaaggctttattgggtggactccaagctgcactcaataagcagtattgacgtcaacggaggtaacaggaagactattctggaggatgagaagaggctcgcgcaccccttctctcttgccgttttcgaggacaaggtgttttggactgacatcattaatgaggcaatattctccgctaacagactgaccgggtccgatgtgaaccttctcgctgagaacctcttaagtcctgaagacatggttttatttcacaacctcacacagcctcgcggggtgaactggtgtgaaagaaccacgttaagcaatggaggttgccagtatttgtgtttgccagccccacaaatcaatccacattcacccaaatttacttgcgcatgtccagacggaatgctccttgcgagggacatgcgctcctgcttaacggaagctgaggccgccgtcgccacccaagagacatccaccgtcaggctgaaggtgagcagtacggcagtgaggacccagcataccaccacccgtcctgtgcccgatactagtcggctccccggggccaccccaggactgaccacggtggaaatagttactatgagccaccaggccctcggagatgtggctggacggggaaatgaaaagaagccctctagcgtccgcgcactctcaattgtgctgcccatcgtgctcttggtgtttctgtgcctcggcgttttcctgctttggaaaaattggaggctgaagaatatcaattccatcaatttcgacaatcccgtgtaccagaaaaccactgaagatgaagttcatatttgtcacaaccaagatggctactcctacccttccaggcaaatggtctctttggaggacgatgttgct

SEQ ID NO: 16310 - DNA, 2580 bp, Artificial Sequence
  Description of Artificial Sequence: Synthetic coding sequence
atgggcccttggggatggaagctgagatggaccgtcgcccttctgcttgccgccgctggaactgccgttggagaccgctgcgagcgcaacgaatttcagtgccaggacggcaaatgcattagctacaagtgggtttgcgacggtagtgctgagtgccaggacggctctgatgagtcccaggagacttgcctctctgtgacttgcaagtccggtgactttagttgcggcggtagagtaaacagatgtatcccacagttttggcgctgcgacggccaagtggactgcgataacggtagcgacgaacagggctgcccccctaagacatgctcccaggatgagttccgttgccacgacggaaaatgcatttccagacaattcgtctgtgatagcgaccgcgactgcttggacggttctgatgaagcatcttgtcctgtgttgacatgcggacctgcttccttccaatgtaactcttctacctgtattccacaactgtgggcatgtgataacgatcctgactgcgaggatggctcagacgaatggccccaaaggtgcaggggtctctatgtgtttcagggagattcttccccatgctctgctttcgaatttcattgtctctccggcgagtgcattcatagctcctggcgttgcgatggcggtcccgattgtaaggacaagtccgacgaggagaactgcgctgtggctacttgccgtccagatgagttccagtgcagcgatggaaactgcatccacggatcccgtcagtgtgacagagaatacgactgtaaagatatgtcagatgaagtcggatgcgtgaatgtgaccctgtgtgagggacctaacaagtttaaatgccacagtggagaatgcatcacactcgacaaggtttgcaacatggcccgtgattgcagagactggtccgacgaacctattaaggagtgcggaaccaatgagtgcctcgacaacaacggcggatgctcacatgtctgtaatgatttgaagatcggtgccgaatgcctgtgtcctgacggctttcaactggtggcacagcgtaggtgcgaggacatcgacgagtgtcaagatccagacacttgctcccagctttgtgtgaatctcgagggaggatataagtgtcagtgtgaggaaggatttcagctcgaccctcatacaaaggcctgcaaggccgtgggatccatcgcctatctcttcttcaccaaccgccacgaagtcaggaagatgacacttgacagatcagagtacacatctctcatccccaacctcagaaacgtggttgcactcgacaccgaggtggccagcaataggatttactggtccgatctgtctcaacgtatgatatgttctactcagctggacagggcacacggcgtgtcctcttacgatacagtgatcagcagggatatccaagctcccgacggccttgcagtcgactggatccacagtaacatctactggactgactctgtgctcggcactgtctctgtcgcagatactaagggagttaagagaaaaaccctctttagggagaatggttctaagccaagagccattgtggtggatcccgtgcacggtttcatgtactggactgactggggaaccccagctaaaattaagaaaggaggcctgaatggtgtggacatctattcactggtaactgagaatatccagtggcctaatggaattacactcgacctcttgagtggcagactgtactgggtcgacagtaaattgcactctatatccagtatcgacgtcaacggcggaaacagaaagaccattttggaggacgaaaagcgcctcgcacaccccttttccctcgccgttttcgaagacaaagtcttttggaccgatatcataaacgaggctattttcagcgctaacaggcttaccggttccgatgtcaatctgctggctgaaaatttgctgagtcctgaggatatggtgctcttccataacttgacccagccacgtggtgttaactggtgcgagcgtaccaccctgtcaaacggtggctgtcagtacctttgcctgcccgcaccacaaattaatcctcacagtcccaaattcacatgtgcatgtcctgacggcatgctgctggcaagggacatgagaagttgtctgaccgaggctgaggctgcagttgccacacaggaaaccagcactgtccgcctcaaagtaagttcaaccgccgtgcgtacccagcacactactaccagaccagtgcccgatacttctcgcctccccggtgctacacccggcctcaccactgtggagattgtcacaatgtcccatcaggccttgggagacgtagctggtaggggaaatgagaagaagcccagctctgtcagagcactcagcatcgttcttcccatcgtcttgctggtctttctgtgcctgggagtctttctgctttggaagaactggcgtcttaaaaacattaactctatcaactttgacaacccagtttaccagaagacaacagaagacgaggtgcatatctgccataaccaggacggctactcctacccatccaggcaaatggtgagcctggaagatgacgtcgct

SEQ ID NO: 16311 - DNA, 2580 bp, Artificial Sequence
  Description of Artificial Sequence: Synthetic coding sequence
atgggcccgtgggggtggaagctccggtggactgtggccctgctccttgccgccgcaggaaccgcggtgggggaccggtgtgagcgcaacgaatttcaatgtcaggacggaaagtgcatcagctacaagtgggtgtgcgatggctcggcggaatgccaagacggctctgatgaaagccaggagacttgccttagcgtgacctgcaagtcaggagatttctcgtgtggagggcgcgtgaacagatgtatcccgcagttctggagatgcgatggtcaggtggactgcgataacggatccgacgaacaaggatgccctcctaagacctgctcacaggatgaattccgctgtcatgacgggaagtgcatctcaagacagttcgtctgtgactccgatcgcgattgccttgacggttcggatgaagcgtcctgccccgtgctcacgtgcggaccggcgagctttcagtgcaattcgtccacctgcattccgcaactgtgggcatgtgataatgatccagattgcgaggacggctcggacgagtggcctcagcggtgccggggcctgtacgtgttccagggcgattcctctccgtgctccgccttcgaattccattgcctgtctggggaatgtatccattcgtcatggcgctgtgacggtggaccagactgtaaggataaatcggacgaggaaaactgtgcggtggcgacttgccggccggatgagttccagtgcagcgacggcaactgcatccacggctccaggcaatgtgaccgggagtacgactgcaaggatatgtcggacgaagtggggtgcgtgaatgtcaccctgtgcgaaggccctaacaagtttaaatgccactcaggagagtgcatcactctggacaaggtttgcaatatggctcgagattgcagagattggtcagacgaaccgatcaaagagtgcggaaccaacgaatgcctcgataataacggcggttgttcacatgtgtgtaacgacctgaagataggcgcagagtgcttgtgccctgatggatttcaactcgtcgctcagcgcaggtgcgaggacatcgatgagtgccaggaccctgacacttgtagtcagttgtgcgtgaacttggagggaggatacaagtgccagtgcgaagaaggatttcagctggacccacacaccaaagcatgcaaagcggtgggatccatcgcttacctgttcttcacgaaccgccatgaggtgcgcaagatgacccttgatcgctccgagtatacgtcactcattccgaacctgcggaatgtggtggcactggataccgaagtcgccagcaataggatctattggagcgacctgagccagcgtatgatttgctccactcaattggacagggcccacggagtatccagctacgacactgtgatcagccgcgacatccaggcccctgacgggctggcagtggactggatccacagcaatatctactggacggattcggtgctcgggactgtctcggtggcggacaccaagggagttaaacggaaaaccctcttccgggaaaatggctcaaagccacgggccattgtcgtggacccggtccacggattcatgtactggaccgattggggaaccccagccaagatcaagaaaggaggactgaatggcgtggacatctacagcctggttaccgaaaacatccaatggccgaacggaatcactctcgacctcctctcgggacgactgtactgggtcgactcaaagttgcattctatctcaagcattgacgtgaacggaggaaacagaaagactatccttgaggatgaaaagaggctcgcccatccgttcagcctggccgtgttcgaggacaaagtcttttggaccgacatcatcaacgaagccatcttctccgctaatcgcctcacgggttcggacgtcaacctgctggccgagaacctgctgtcgccagaggacatggtgctgttccacaacctgactcaaccgcggggagtcaactggtgtgagaggactaccctgtcgaatggtggatgtcagtacctgtgcctgccagctccgcaaatcaacccccattccccaaaatttacttgcgcatgccccgatggaatgctgctggcgcgcgacatgcgctcctgcctcactgaagcagaggccgccgtcgcgacccaagaaacctccactgtcagactgaaggtgtcatcgactgctgtccggacccaacacaccaccacccggccggttccggataccagtagattgcccggcgcaaccccggggctgactactgtggaaattgtgactatgtcgcaccaggccttgggcgacgtggcgggtcgcggtaacgaaaagaagccatcgtcggtcagagccctttccatcgtgctcccgatcgtcctgctcgtgttcctttgtctgggagtgttcctgctctggaaaaactggagactgaagaatatcaacagcattaatttcgataaccccgtgtaccaaaagacgactgaagatgaagtgcacatctgccacaatcaggacggctactcctacccatcgcgccagatggtgtccctcgaggacgacgtcgct

SEQ ID NO: 16312 - DNA, 2580 bp, Artificial Sequence
  Description of Artificial Sequence: Synthetic coding sequence
atgggcccttgggggtggaaactccgctggacagtcgcactgctcttggcagccgctggtactgctgtgggcgatagatgcgagcggaacgaatttcaatgtcaggatggcaagtgtatttcttacaagtgggtgtgtgacggaagcgctgaatgtcaggatggctccgacgaatcgcaggagacgtgcttgtcggtgacttgcaaaagtggggatttttcctgtggaggtcgtgtcaatcgctgcattccacagttctggcgatgcgacgggcaggttgattgcgataacgggtcggacgaacagggatgcccgcctaaaacatgctctcaggacgagttccggtgccacgacggtaagtgtatcagccgccagtttgtctgcgattcggatagagactgcctcgacgggtcagacgaggcctcctgtcctgtgctgacctgtggaccagccagtttccaatgtaattcctcaacttgcattccccaactgtgggcttgcgataacgatcctgactgcgaggacggctctgatgagtggccccagcgctgccgtggcctctacgtctttcagggggattccagtccatgcagtgcctttgaattccactgtttgagcggggagtgcatccatagttcctggagatgtgacggcgggccagactgtaaggacaagtctgatgaggagaattgtgctgttgccacgtgccgccctgacgaattccagtgttctgacggtaattgcatccacggcagtagacaatgcgatcgggaatatgattgcaaggatatgagtgatgaggtcgggtgtgtgaacgtcacgctgtgcgagggtccaaataaatttaaatgtcattccggcgagtgtattactctggacaaagtgtgcaatatggccagggactgcagggattggtccgacgagccaataaaagaatgcggcactaatgaatgcctggataataacggcggctgttctcatgtgtgtaatgacctgaagatcggcgccgagtgcctgtgtccagacggattccagcttgtggctcaaagacggtgtgaagatatcgatgagtgtcaggacccagatacatgctcacaactttgtgtgaatttggagggcggttataaatgtcaatgcgaagaaggcttccagctcgatccccacaccaaagcctgcaaggccgtgggctccatcgcctacttgttcttcaccaatagacacgaggtgagaaaaatgactctcgatagatctgagtataccagcctcattccgaatctgcggaacgtcgtcgcgttggacacagaggtagccagtaatagaatatattggtcagacttgagtcagaggatgatttgcagtacccagcttgatagagcgcatggagtgagctcctatgacaccgtaatctcacgggacatccaggcgcccgacggtttagccgtggattggatacactctaatatctattggactgatagcgtgttggggacagtgagtgtcgccgatacaaagggggttaagcgaaaaaccctatttcgcgagaacgggagtaagcctagggccatagtagtagatcctgttcacggttttatgtactggaccgactggggaacccctgccaagatcaagaagggagggcttaacggtgtcgacatttactcacttgtcacagaaaacatccaatggccaaatggcatcacgctggacctgctaagcggcaggctgtactgggtggattccaaactccactccatttccagcatagacgtgaatggagggaacagaaaaaccatcctggaagatgagaaacgccttgcacacccgttctcattagcagtctttgaagacaaggttttttggactgacattattaatgaagccatcttttccgccaaccgacttaccggaagcgatgttaacctgcttgcggagaatcttctgagccccgaagacatggtactcttccacaacctgactcagccccgaggggtcaattggtgtgaaaggaccacccttagtaatggaggctgtcagtatctctgcctgccagccccccaaatcaatccacattccccaaagttcacctgcgcatgtcccgatgggatgctcttggctcgggatatgcggagttgcctgaccgaggccgaagcagctgtggctacccaggagacgtcgaccgttaggctgaaggtgtctagtacagccgtgaggacacaacacacaacaacaagaccagtgccagatacatctagattacctggggctacaccaggcttaaccacggtcgaaatcgtgaccatgtcacaccaggctctcggcgacgttgcaggacgcggcaacgaaaaaaagccaagttccgtcagggccctgagcatagtgctgcccattgtgctgcttgtgtttctgtgcctgggcgttttcctgctgtggaaaaactggaggctcaagaatatcaactctattaactttgacaacccagtataccagaagactacagaggatgaagtgcacatctgtcataatcaggacggttactcttatcctagccgccagatggtgagcctggaagatgatgtggct

SEQ ID NO: 16313 - DNA, 2580 bp, Artificial Sequence
  Description of Artificial Sequence: Synthetic coding sequence
atgggcccttggggatggaagctccgctggaccgtggccctcctgctcgccgcggctggcaccgccgtgggtgacagatgtgaacggaatgagttccaatgtcaagacggtaagtgcatttcatacaagtgggtgtgcgacgggtcagccgaatgtcaagatggcagcgacgaatcacaggagacgtgtctgtcggtgacctgcaaatcaggcgatttttcctgcggaggacgcgttaaccgctgcattccgcagttctggagatgtgatggccaagtcgactgcgacaacggatcggacgagcaggggtgcccgccgaaaacgtgctcgcaagacgaattccgctgccacgacggaaaatgcatcagcagacagtttgtctgtgattcggaccgggattgcttggatggttccgacgaggcaagttgccctgtgctcacctgtgggccggcatccttccagtgcaactccagcacctgcatcccgcagctgtgggcgtgtgacaacgacccggattgtgaggatggatcggatgagtggccgcaacgttgtcggggattgtacgtgttccaaggcgacagctccccttgctcagctttcgagtttcactgcctctcgggcgagtgcatccattcgtcgtggcgctgcgatggcggcccggactgtaaagataagtccgatgaggagaattgcgcggtggcaacttgtcggccggatgagttccagtgttccgacggaaactgcatccatgggtcccgccagtgcgaccgggaatacgactgcaaggatatgtcagacgaagtcggttgcgtcaatgtgaccctgtgcgagggacccaataagttcaagtgtcactctggagagtgtatcactcttgataaggtgtgcaacatggccagagattgccgcgattggagcgacgaacctattaaggagtgcggaaccaacgagtgcctcgacaataatggaggatgctctcatgtgtgcaacgatctcaagatcggtgccgaatgtctttgtccagacggatttcaactcgttgcgcagagacgctgtgaggacatcgatgaatgccaagatccggacacttgttctcaactgtgtgtgaacttggagggagggtacaaatgccagtgtgaggagggctttcaactggacccacacaccaaagcgtgcaaggcagtggggtccatcgcttatctgttcttcacgaataggcacgaggtgagaaagatgactctggatcgcagtgagtatacgtccctgatcccaaatctgcgcaacgtcgtggctctggacaccgaggtcgcttcaaaccgaatctactggtcggatctctcccagcgtatgatctgctctacccaactcgatagggcccatggagtctcaagctacgacaccgtgatttcccgcgacatccaggcgcccgacggactggccgtcgactggatccactccaacatctattggacggactccgtccttggaactgtcagcgtggcggacactaaaggagtcaagcggaaaaccctgtttcgggaaaacggatccaagcctagagccatcgtggtggaccctgtgcatgggtttatgtactggaccgattggggaaccccagcgaagatcaagaaaggcgggctcaacggagtggacatctactcactggttaccgagaacatccagtggcctaacgggattactctggatctcctgtcaggccgcctgtactgggtggactcgaagctccattcaatctcgtcaatcgatgtgaacggcggcaaccgcaagactatcctggaggacgaaaaacggctggcacaccctttctccctggccgtgtttgaggacaaagtgttctggactgatatcatcaatgaagcgatcttcagcgctaaccggctgaccggatccgatgtgaatctgctcgctgaaaaccttctgtccccagaagatatggtcctgttccacaacctgacccaacctaggggagttaattggtgtgagcgcaccaccctctcaaacggcggttgccagtacctctgtctcccggccccgcagatcaacccgcactccccgaaattcacctgcgcatgcccggacggaatgctgctggccagagacatgcgctcatgcctgaccgaggctgaagctgcagtggccactcaggaaacttcaacggtccggctgaaggtttcgagcactgctgtccggacccaacacactactactcgcccagtgccggacacgtcaagacttccgggagcaactccgggcctgactactgtcgagatcgtgaccatgtcacaccaagccctgggcgacgtggcaggtaggggcaatgaaaagaaaccgtcctccgtgcgggcgctgagcatcgtcctccctatcgtgcttctggtgttcctctgtctgggagtgttcctcttgtggaaaaactggcgcctgaagaacatcaattctatcaacttcgataacccggtgtaccagaaaaccaccgaggacgaagttcatatctgtcacaatcaggacggatacagctacccgtcgcggcagatggtgtcactggaagatgacgtcgca

SEQ ID NO: 16314 - DNA, 2580 bp, Artificial Sequence
  Description of Artificial Sequence: Synthetic coding sequence
atggggccgtggggttggaagctgcggtggaccgttgcactgctgctcgcggcggctgggactgcagtgggagatcgttgtgagcggaacgagttccagtgtcaggacggcaaatgtatttcttataagtgggtatgtgacggtagcgccgaatgtcaggatggctccgatgaaagtcaggaaacatgcctgtcagttacatgtaagagtggggatttctcttgtggggggcgtgttaatcggtgcatacctcaattttggcggtgcgacggacaggtcgattgcgacaacgggagcgacgagcagggatgtccccccaagacttgttctcaggatgagttcaggtgtcacgacggcaagtgcatttcccgccagttcgtttgcgattccgatcgagactgcttggacggctcagatgaagcgagctgtcctgtgctcacctgcgggccggcttcattccagtgtaactcgagcacctgtattccccagctctgggcgtgcgacaacgatcccgactgtgaagacgggagtgacgagtggccccagcgttgcaggggcctttacgtatttcaaggcgattcatctccttgttctgccttcgaatttcattgtcttagtggtgagtgcatccattcatcttggcggtgtgacgggggccccgactgtaaggacaagagtgatgaggagaattgtgcggtggccacctgtcggcccgacgagttccaatgtagcgatggaaattgtatccacgggagcaggcagtgtgacagagaatatgactgcaaggacatgagtgatgaggttggatgtgttaacgtcacgctttgcgaaggtcccaacaaatttaaatgccattccggcgaatgcattacactcgataaggtgtgtaatatggctcgggactgccgggactggtctgacgaacccattaaagagtgcggtactaatgagtgtttggacaacaacggaggttgctcgcacgtgtgtaatgacctcaaaatcggcgctgaatgtctttgtcccgacggcttccagctggttgcacagaggcgatgtgaggatattgatgagtgccaggatccggacacctgttcccaactttgcgtcaacctggagggaggctacaagtgccaatgcgaagaaggttttcagctcgatcctcataccaaggcttgcaaggcggtaggtagtattgcatacctgttctttactaatcgccacgaggtgagaaaaatgacacttgacagatcagagtacacctctctcattcctaatctgcgcaacgtggtggctctggatacagaagtcgccagcaacaggatctactggtctgacctgtcgcagagaatgatctgctcgactcagcttgaccgtgctcacggggttagctcctacgacacagtcatctcacgagatatccaggcccccgacggtttagctgtggattggattcacagcaacatctactggaccgacagcgtattaggaacggttagcgttgctgacactaagggtgtgaagagaaagacccttttccgcgagaacgggagtaagcccagggccatcgtggtcgatcctgttcatggattcatgtactggacagattggggaacccccgccaagatcaaaaagggcggactgaatggggtggatatctattccctggtgacggagaatatccaatggcctaatgggatcactctggacctcctctcaggccgcctctactgggtagacagtaagctacactcaatctcatctatcgatgtgaacgggggtaatcgaaagaccatactcgaagatgaaaagagactagcccacccattttctctggctgtgtttgaagacaaggtgttctggacagatatcattaacgaagctatctttagcgcgaatcggttgactggatcagacgtcaatctcctggcggagaatttgctgtcgccggaggatatggtactcttccacaaccttacacagcctagaggtgtcaattggtgcgaacggaccaccctttccaatggcggctgccagtacctttgcctgcctgccccccagatcaatccacattccccaaaatttacctgcgcctgtcctgatgggatgctgctcgcaagagacatgaggagctgtttaaccgaagcagaggctgccgtggcgacacaggagacgagcacggtaagactcaaggtttcgagtactgccgtgaggacgcaacatacgacaacacggcccgtccctgatactagccggcttcctggggcaacaccaggactgaccaccgtcgagattgtgacgatgtcacatcaggccctaggggacgtcgccggcagggggaacgagaagaagcccagttccgtgcgggcactttcaatagtgctccctatcgtgctactagtgtttctctgtttgggtgtgtttctgctgtggaaaaactggcgactgaagaacataaactcaatcaattttgataaccccgtctaccagaaaacaaccgaagacgaggttcacatttgccacaatcaggacgggtattcgtacccgagcagacagatggtctccctagaagacgacgtggca

SEQ ID NO: 16315 - DNA, 2580 bp, Artificial Sequence
  Description of Artificial Sequence: Synthetic coding sequence
atgggtccgtggggctggaagctccggtggaccgtggctcttcttcttgccgcagccggaactgcggtgggagacaggtgtgaaaggaacgaattccaatgtcaagatggtaaatgtatttcctacaaatgggtctgcgatggcagcgctgaatgtcaagacggatcagatgagtcacaggaaacctgcttgtcagtcacctgtaaatcaggtgatttttcttgcgggggtagggttaatcgctgtatccctcagttttggagatgcgatgggcaagtggattgtgataatggcagcgatgaacaaggttgtcccccgaaaacttgctcgcaagacgagttccgctgtcatgacggaaaatgtatctcgcgtcagttcgtctgtgattccgatagagactgcctggacggatcggatgaggcgtcatgtcctgttctcacttgtgggcctgcttcatttcagtgtaactcgtcgacttgtattccacaactttgggcatgtgacaatgatccggattgcgaagatgggagcgatgagtggccacaaagatgtagaggactttatgtgtttcagggggactcatctccttgcagcgcattcgaatttcactgtctttcaggagagtgcatccactcgagctggcgctgcgacggtggcccagactgtaaagataaaagcgatgaggaaaactgtgcagtggctacttgtcgccctgacgagttccaatgctccgatggaaattgcatccatggatcgagacagtgcgaccgggaatacgactgcaaggatatgagcgatgaagtcggatgtgtcaacgtgactctgtgtgagggccctaacaagtttaagtgccattccggagagtgtattactctcgataaggtttgtaatatggcccgggactgtagggactggtccgacgagcccattaaggaatgtggtactaacgaatgcctcgacaataatggaggttgttcgcatgtgtgtaacgaccttaagattggggcggagtgcctttgtccagacggttttcagctggtggcacaacggaggtgcgaagatattgatgaatgccaggatcctgatacctgctcgcagctttgcgtgaacctcgagggcgggtacaagtgtcaatgtgaagagggatttcagctggatccacataccaaggcatgcaaggccgtggggtcgattgcttacctgtttttcacgaacaggcatgaagtgcgcaagatgacgcttgatcgctcagaatacacgtcgctcattcctaatttgaggaacgtagtcgcacttgatactgaagtggcttccaaccgaatctattggtccgatctctcccaacgaatgatctgctcaactcaacttgatcgggcacatggagtgtcatcgtacgataccgtgatctcacgcgatatccaagcacccgatgggctggcagtggattggattcacagcaatatctactggactgactccgtccttggtaccgtgtccgtcgccgacaccaagggtgtcaagagaaagactctgtttcgcgaaaatggaagcaagccccgagcgattgtggtggatcctgtgcacggatttatgtactggacggattggggtacccctgccaaaatcaagaagggtggactgaatggcgtcgacatatacagcctggtaaccgaaaacatacaatggccgaacggaattaccctggatttgctctcgggcaggctctactgggtggattcgaagctgcatagcattagttcgattgacgtgaacggtgggaaccgtaagaccatactggaggatgagaagcgacttgctcatcctttctccttggcggtttttgaagataaggtgttctggacggacatcattaatgaagcaatcttctccgcaaacagactcacgggatcggacgtcaaccttttggccgaaaatctcctttccccagaagatatggtcttgttccataatctcactcagccgcggggtgtgaattggtgtgaacgaacgaccctgtcaaacggcggatgtcaatacctttgccttccagctccacagattaatccacacagccctaagttcacttgtgcgtgccctgatggaatgcttcttgcaagggatatgcggtcgtgtctgactgaagcagaagccgccgtggcaacccaggagacttccactgtccgcctcaaagtgtcatcaaccgcggtccgaacccagcacaccaccactagacctgtcccagatacctcacggctgccaggagcaacccctgggctgaccaccgtggagattgtgacgatgtcgcaccaggcactgggagatgtggccgggaggggaaacgagaaaaagccttcctccgtacgcgccctgtctatagtgctgcctatcgtccttctcgtgtttctttgtcttggagtgtttctgttgtggaagaattggcgactgaaaaacatcaactcaattaactttgacaacccggtgtaccagaaaacgaccgaggacgaggtccatatctgtcataaccaggacggatactcctaccccagccgtcaaatggtgtcgctcgaggacgatgtggca

SEQ ID NO: 16316 - DNA, 2580 bp, Artificial Sequence
  Description of Artificial Sequence: Synthetic coding sequence
atggggccgtgggggtggaaactgcgctggaccgtggctctgctcctcgctgctgcaggcactgcagttggggacaggtgtgagagaaacgaatttcagtgtcaggatgggaagtgcattagttataaatgggtctgcgacggatcggccgaatgtcaggacgggagtgacgagtctcaggagacttgcctgtctgtgacctgcaaatccggcgatttctcatgtgggggacgcgtaaataggtgcatcccacagttctggagatgtgatgggcaggtggactgtgacaacggttccgacgaacagggctgccctcccaaaacgtgctctcaggacgaattcaggtgccacgacgggaaatgtatttctcgccagttcgtgtgtgactcagatcgggattgcctggacgggagcgacgaggcatcttgcccagtcctcacctgcggtcctgcctccttccagtgcaatagttcaacctgcatcccgcagttatgggcctgtgataacgaccccgactgtgaggacggctcggacgagtggccccagaggtgccgggggctgtacgtgttccagggggatagctcgccatgctctgctttcgaattccactgtctctccggagagtgtatccacagctcctggaggtgtgatggtggtcccgactgcaaggataagagcgacgaggagaactgtgctgtggcaacatgccgtcctgacgagttccagtgttctgatggcaattgcatacacggcagtaggcagtgtgacagggagtacgactgcaaagatatgagcgatgaggtcggctgcgtcaatgtgacactgtgtgagggcccgaacaagttcaaatgccattctggggaatgcatcacactggacaaagtgtgcaatatggccagagactgcagggattggtccgatgagcccattaaagagtgcggaaccaatgagtgtctcgataataatgggggttgctcacacgtgtgcaatgacctgaaaattggcgctgagtgcctgtgcccggacgggttccagttagttgcccagcgcagatgcgaagacattgacgaatgtcaggatccagatacatgttcccaactgtgtgtgaacctggagggagggtataaatgccagtgcgaggagggcttccagttggatccacacacaaaggcatgtaaggctgttggaagtatcgcctaccttttttttaccaaccgccacgaagtgagaaagatgactcttgaccgatccgagtatacctcactgattcctaatctgcgaaacgtagtggctctcgacaccgaagtggcatcaaaccgtatctactggagtgatctgtctcagcggatgatttgttcaacacagttggaccgcgcccacggagtttccagctacgacaccgtgattagtcgcgacatccaggcacccgatggtctcgcagttgactggattcactcgaatatctattggacggacagtgtgttggggacagtgtcagtggcggacaccaagggcgtgaagcggaagactttgttccgagagaacgggagcaagccgcgggcaatcgtcgtagatcccgtccatgggtttatgtattggaccgattggggtacaccagccaagattaaaaagggcggcctgaacggcgtggacatctactcccttgttacagaaaatattcagtggcccaacggaatcaccctcgacctactgagcgggcgcctgtattgggtggactccaagctccactcgatctcttccatcgacgtgaacgggggaaacaggaagaccattctcgaagatgagaagagactcgcccatcccttttcccttgcagtttttgaagacaaggtgttttggaccgatatcattaacgaggccatctttagtgctaatagactgaccggctccgatgttaacctgctggcggagaatctgctgtctccagaggacatggtactgttccataatttgacacagcccagaggcgtcaattggtgtgaacgtacgacgctgtctaacggcggctgccagtacctgtgtctacccgctccgcagatcaatcctcatagcccaaaatttacctgtgcatgccctgacggcatgttgctagctagggacatgagatcctgtctgactgaggctgaggcagccgtggctacccaggagacttctacggttcgattaaaggttagctctaccgccgttagaacccagcataccactactcgtccagtgcctgacacatcccggttgcctggagcaactccggggctgactactgtcgagattgtgacaatgagccaccaggccttgggagacgtggccggtaggggaaatgagaaaaagccatcctctgtgagagctctcagcattgtgcttccaatcgtgctgctcgttttcctatgtctcggcgtgttcttactctggaaaaattggaggctgaagaacataaacagtattaacttcgataatcctgtctatcagaaaaccacagaggacgaggtacacatctgccacaatcaagatgggtattcctacccatccagacagatggtgtccttggaagacgatgtggct

SEQ ID NO: 16317 - DNA, 2580 bp, Artificial Sequence
  Description of Artificial Sequence: Synthetic coding sequence
atgggtccctggggatggaagcttcgctggactgtcgccttgctgttggctgccgcaggaaccgctgtgggcgataggtgcgagcgcaatgaattccaatgtcaagacggaaaatgtattagctataagtgggtctgtgatggaagtgcggagtgtcaggatggaagcgacgagtcccaggaaacctgcctttctgtaacctgcaaaagcggagatttcagctgcggaggtagagtgaacaggtgcataccacagttttggagatgcgatggccaagtagattgcgacaatggctccgacgagcaaggttgccctccaaaaacctgctcccaggatgaattccgctgtcacgacggtaagtgcatatcacgccaattcgtttgcgatagcgacagagactgtcttgatggatccgacgaagcgtcatgtcccgtgctgacttgtggcccggcgtcttttcagtgcaatagttcaacatgcatcccacaactttgggcatgtgacaacgatccagactgcgaggatggttcagacgaatggccccaacgctgcaggggtctgtacgtattccaaggtgatagttctccttgctcagccttcgaatttcactgtctctctggtgaatgtatacactcctcttggagatgtgacggcggtccagattgcaaggacaaaagcgatgaggagaactgcgcggttgcaacctgccgcccagacgagtttcagtgctccgacggcaactgcattcacggctcaagacagtgtgacagagaatatgattgtaaggacatgagtgatgaggtaggctgcgttaacgttaccctgtgcgaaggtcctaacaaattcaagtgtcactctggcgagtgcattaccctcgataaagtttgcaacatggccagggattgcagggactggagtgacgagcccattaaagagtgcggcactaacgagtgcctggacaacaatggcggatgttcccatgtgtgtaacgacctgaagattggagctgagtgtctctgtcccgatggttttcaactggtcgctcagcgccgctgcgaagacatcgatgagtgtcaggaccccgatacatgctcccagctgtgtgtaaacctcgaaggtggatacaagtgtcaatgcgaggaaggcttccaactcgacccgcacactaaagcctgcaaagctgtgggatcaatcgcttacttgtttttcaccaaccgccacgaggtcaggaagatgaccctggacaggtctgaatacaccagcctgatccccaacctgcgcaacgtcgttgctctggatacggaagttgcatccaataggatttattggagcgatctctcccagagaatgatctgttctactcagctggaccgcgcccacggagtcagtagctacgatactgtcattagtagggatattcaggcgccagatggccttgcagtagattggatccacagcaacatttactggacggactcagttctcggtacagtgtccgtcgccgatactaaaggagttaaacgcaaaactttgtttagagagaacggttctaagcccagggccattgttgtcgaccctgttcacggattcatgtactggacggattggggcactcccgccaagatcaagaagggaggattgaacggagtggatatctacagcctggtcacggagaatatccaatggcccaacggaatcacgctcgacctcctttccggcaggctgtattgggtagatagcaagctgcactccatttctagcatcgatgtcaacggcggtaaccgcaagacgattctcgaagatgagaagcgccttgcccaccctttctccttggccgttttcgaggacaaggtgttttggactgatattatcaacgaagcaatattctccgccaatagactgactggctccgatgtgaatctgctggccgagaacctgctgtctccagaggatatggttctctttcacaacttgacccaacctagaggtgtgaattggtgcgagagaacaaccctgtcaaacggcggttgtcagtatctgtgtctccccgctccacaaattaacccacactccccgaagttcacatgtgcttgtccggatggaatgctgctggcaagagacatgcgcagttgcttgacagaggcggaggcagccgttgccactcaggaaactagcaccgtcagactcaaagtctcatccactgcagtaagaacgcagcacacgaccacccgcccggtcccagacaccagccgcttgcctggcgcgacccctggcctgaccactgtcgaaatcgtgactatgtcccaccaagctctgggagacgtggccggtagaggcaacgaaaagaagccctcttcagtgagagcgctgtctatcgtcctgcccatcgtcctcttggtcttcctttgccttggcgtattcctgctctggaagaactggaggctcaagaacatcaattcaatcaactttgacaaccccgtgtaccagaagactactgaagacgaggttcacatttgtcacaaccaggatggatactcctacccatcaaggcagatggtgagcttggaagacgatgtcgct

SEQ ID NO: 16318 - DNA, 2580 bp, Artificial Sequence
  Description of Artificial Sequence: Synthetic coding sequence
atgggtccttggggctggaaactgaggtggacagtcgctcttctgctggccgcagccggtaccgctgtgggcgacagatgcgagaggaatgaatttcagtgtcaggacggaaaatgcatctcctacaaatgggtgtgcgacggctccgccgaatgtcaggatgggtctgacgagtcacaagaaacttgtctgagcgtgacatgcaagtccggagatttctcctgcggtgggcgggtcaaccggtgcatccctcagttttggagatgtgacgggcaagtcgactgtgacaatggaagcgacgaacaggggtgccctcccaagacctgctcccaggatgagttcagatgccacgatggaaagtgcatctcacgccagtttgtttgtgatagcgatcgggattgtcttgacggctcggacgaggcctcttgccccgttcttacatgcggacctgcctctttccaatgtaactcgtctacttgcattcctcagctctgggcctgcgacaatgatccggattgcgaagacggcagcgacgaatggccccagcggtgccgcggtctatacgtctttcagggcgattcatccccatgctccgccttcgaattccactgcctgagcggagagtgcattcattcttcatggcgatgcgacggcggccccgactgcaaagacaagtcagacgaggagaattgcgctgtcgctacttgtaggcctgacgaatttcagtgttccgatgggaactgtatccatgggtctagacagtgcgatagagagtacgactgcaaggatatgagcgacgaggtggggtgtgtaaacgtcactctgtgcgaagggccaaacaagtttaaatgccattcgggagagtgtattactttagacaaagtctgcaacatggcgcgagattgtagggactggtctgacgagcctataaaagagtgtgggactaatgaatgtctcgacaacaacggagggtgtagccacgtgtgtaacgatcttaagatcggggctgaatgtctctgtcccgacgggttccagctcgtggcgcagcgaaggtgcgaggacatcgacgagtgccaagatccagacacctgttcccagctgtgtgttaatctggaggggggatataaatgccagtgtgaagaagggtttcagctcgacccgcataccaaagcctgcaaggctgtcggctcgatcgcttatctgttctttactaacaggcatgaggtgcgcaagatgaccctggacaggtctgaatataccagcctgatcccgaacctgcgcaacgtagtcgctctggacaccgaagtggcaagcaatagaatttattggagtgatctgtctcagcgaatgatctgttcaacccagctcgaccgcgcccatggggtctcttcatatgacaccgtcatctctcgagacattcaggcacccgacggcctcgcagtggactggattcattccaacatatactggactgacagtgtccttggcactgtgagcgtggctgataccaagggtgtgaagcggaagactctctttagggaaaatgggtccaaacctcgggcaatcgtggtggacccagtgcatggctttatgtactggactgattgggggaccccggcaaagatcaagaaaggaggtctgaacggcgtggatatatattccctggtcacagagaatattcagtggcccaacggaattactctggatctcttatcaggccgattgtattgggtggactctaagctgcactcaatttcttcaatcgacgtgaacggcggaaacagaaagaccatcttagaagatgagaaacgtttggcccatccctttagcctggccgtgttcgaggacaaggtgttttggaccgatatcattaatgaggccattttctccgcgaatcgcctgactggaagcgatgtcaaccttctggctgaaaacctcttatcgcctgaggatatggtcctgttccacaatctgacccagccccggggagtgaactggtgtgaacggacaactctatccaacggtggctgtcagtatctctgtctccccgctccccagattaaccctcactccccaaagttcacgtgtgcttgcccagatggcatgctcctggccagggacatgcgctcttgcctcacagaggccgaggcagctgtcgcaacccaggagacgtctactgtccgccttaaagtgtcttctacagcggtacgcacccagcacactaccacacgccccgtgcccgatacatcaaggcttcctggcgccacccccggtctcaccaccgtcgaaatcgtgaccatgtcccaccaggccttgggagatgttgctgggcgtgggaatgaaaagaaaccctcttccgtgcgggcgttgagcatagtacttcccatcgtgttgctcgtgttcctatgcctcggcgtgttcctgctctggaagaactggagactgaaaaacattaactcaatcaatttcgacaatccagtgtaccaaaagaccacagaggatgaggtgcacatctgccataatcaggatggttacagctacccttcaaggcagatggttagcctagaggatgacgtggct

SEQ ID NO: 16319 - DNA, 2580 bp, Artificial Sequence
  Description of Artificial Sequence: Synthetic coding sequence
atgggtccttggggctggaagctgaggtggactgtggccctccttctagctgctgccgggaccgccgtgggggaccgatgcgagagaaatgagtttcagtgtcaggatggcaaatgcataagttataagtgggtgtgtgacggcagtgcagaatgccaggatgggtctgatgagagtcaggagacttgcctgtctgtcacctgtaaatctggcgacttttcctgcggcggacgggttaatcgctgcattccacagttctggaggtgtgacggccaggtggattgcgacaacggcagtgacgaacaaggctgtcctcctaagacctgttcacaggatgaatttcggtgccatgacggcaagtgtatctcccgacagttcgtctgcgactcagatcgagattgtctagatggttctgacgaggccagctgccctgtgctgacatgcggcccagcttcattccagtgcaactctagcacatgcattccacagctgtgggcttgcgacaatgacccagactgtgaggacggcagcgacgagtggccacagcgctgccgcggcttgtacgtcttccagggggactcttctccatgctccgcctttgagtttcattgcctctctggggagtgcattcattccagctggcgatgcgatggcggcccagattgcaaggacaagtcagatgaggaaaactgcgccgtcgccacctgcaggcccgacgaatttcagtgcagtgacggcaactgcattcacggctctcgccagtgcgatagggagtacgattgcaaagatatgagtgacgaggtcgggtgtgtgaacgtcactttgtgcgagggccccaataagtttaagtgtcacagtggcgagtgtatcaccctggataaggtgtgtaatatggctagagattgtcgcgactggtctgacgagcccatcaaagaatgcggcacaaacgagtgcctggacaacaacgggggatgctcacacgtctgtaatgacctcaaaatcggcgccgaatgcctgtgcccagacggttttcagctggtcgcccagagacgatgcgaagacattgatgaatgccaagacccagatacctgcagtcaactctgtgttaatctggaaggagggtataaatgtcagtgtgaagaagggtttcagttggacccccataccaaggcctgtaaggcagtcggatctattgcctacctattcttcacaaatcgtcatgaagtgcgcaagatgaccctggacaggagtgagtatacaagtctgattccaaacctacgcaatgtggtggccttagataccgaagtggccagcaatcgcatctactggtccgacctatctcagcgcatgatttgtagtactcagctggacagggctcacggcgtgagtagttacgataccgtcatttccagagatatccaggcccctgacgggctcgctgtggattggattcactctaatatttactggacagactccgtgctaggcaccgtttctgtggcagacacaaaaggcgtcaagaggaaaaccctgtttagagagaatggttccaaaccccgcgctattgtcgtggatccagttcacgggttcatgtactggactgattggggcacccctgctaagattaaaaaaggtggcctgaatggcgtggatatttatagcttagtgaccgagaacatccagtggcctaatggaattacactggacctgctgtctgggcggctgtactgggtcgatagcaagctgcattcaataagctcaatagacgtcaatgggggcaatagaaaaacaatattagaagatgagaagcgccttgcccaccctttttccctcgctgtgtttgaggataaggtgttctggaccgatataataaacgaagctatcttctccgccaacagactgacagggtccgacgtgaacctgctggccgaaaatctgctgtctcctgaggacatggtgctgtttcacaatctgacccaaccccgaggcgtgaactggtgcgaaaggaccacactctccaacgggggctgccagtatctatgtttacccgccccccaaatcaatcctcacagccccaaattcacttgcgcttgccccgacggcatgctgctggctagagatatgcggtcctgtctgactgaagctgaagctgccgtcgctacccaggagactagtaccgtgagactgaaggtgagctctactgcagtgcggactcagcacactacaaccaggcccgtccctgatacctctcgcctgcctggggcaacccccggactaaccacagtggagatcgtgacaatgagccatcaagctctgggggatgttgccgggcgggggaacgaaaagaaaccatcatccgtgcgggccctgtcaatcgttttaccaatcgttttattggtattcctatgcctgggagtgtttctcctgtggaagaattggagactgaaaaatattaatagcatcaactttgacaaccctgtgtatcagaagacaactgaagatgaagtgcatatttgccataaccaagacggctactcatatccttccaggcaaatggtttctctcgaggatgatgtcgcc

SEQ ID NO: 16320 - DNA, 2580 bp, Artificial Sequence
  Description of Artificial Sequence: Synthetic coding sequence
atgggtccatgggggtggaagttgagatggaccgtcgcacttcttcttgccgcagccggcactgctgtcggtgatagatgcgaacggaatgaattccagtgtcaggatgggaaatgcattagctacaaatgggtgtgcgatggctcagcggaatgtcaggatggttccgatgagtcgcaagaaacctgcctgtccgtcacctgtaagtccggggatttctcgtgtggagggagagtgaacagatgcatacctcagttttggcgttgtgatggacaggtcgattgtgacaacggaagcgacgaacaagggtgcccccctaagacctgttcacaggatgaatttagatgtcacgatggtaagtgtattagccggcaattcgtgtgtgactcggatcgcgactgtctcgatggttcggacgaagcatcctgtcctgtgcttacttgtggacctgcgtcgtttcagtgtaactcctccacttgtataccccagctctgggcatgcgacaatgatccagattgcgaggatggctccgatgagtggcctcaacgctgccgagggctttacgtgttccagggcgattcgtccccctgctccgcctttgaatttcactgcctttccggcgagtgcatccattcgtcctggagatgcgatggtgggccggattgtaaggataagtccgacgaagaaaactgcgcagtggcaacgtgtcgcccagacgagttccagtgcagcgatggaaactgtattcatggctcgagacaatgtgaccgcgaatacgactgtaaagatatgtcggacgaagtgggatgcgtgaatgtcaccctgtgtgagggccccaacaagttcaaatgtcatagcggtgaatgtataactctggacaaggtgtgcaacatggccagagattgcagagattggtccgatgaaccgatcaaagaatgcggcaccaacgaatgtcttgacaacaatggtggttgttcacacgtttgcaatgatcttaagattggtgcagaatgtctgtgcccagacggatttcaacttgtggcccaaaggagatgcgaggacatcgacgagtgtcaagatcctgatacgtgtagccagctttgtgtcaatctcgaaggcggatacaagtgccaatgtgaggaaggattccaacttgacccccataccaaagcatgcaaggcagtgggatcgattgcctacttgtttttcaccaaccgccacgaagtgcgaaaaatgacgcttgataggtcagaatacacgtcgttgatcccaaacctgcggaatgtggtagcgctggacactgaagtggcctcgaataggatctactggtccgacctgtcccaaaggatgatttgctccactcaactggatagagcccacggagtctcgtcctatgataccgtgatatccagggatatacaggcgccggatggcctggccgtcgattggattcactccaacatatactggacggactctgtgcttggaaccgtgtcggtggcagacactaagggagtcaagagaaaaacgctgtttagagaaaacggctccaaaccacgcgcgattgtggtggatccagtgcacggatttatgtactggacggattgggggactccagctaagatcaaaaagggcggactcaatggtgtggacatttactctctggtcaccgaaaacatacaatggcctaacgggataacgctggatctgctctccggaaggctgtattgggtggacagcaagctgcactcgatttcctctatcgatgtgaacggtggtaacagaaagactatcttggaggatgaaaaacgactggctcatcctttcagcctggcagtgtttgaggataaggttttctggaccgacattatcaacgaagcaatcttttcggcaaatcggctcaccggatcggatgtgaaccttctggcagaaaacttgctttctcccgaggacatggtgctgttccataacctgacccagcctcgtggtgtgaattggtgtgagcgtactactctttcgaacggcggctgtcagtacttgtgccttcctgcccctcaaatcaacccacactcgcctaaattcacttgtgcatgtcctgacggcatgctgcttgccagagatatgagatcgtgtctgactgaagcagaggccgccgtcgccacccaggagactagcaccgtcagactgaaagtgtcgtcaacggcggtgcggacccagcatactactaccagaccagtcccagataccagccgactgccaggggccacccccgggctcaccactgtcgagatcgtcactatgtcccatcaagcacttggtgacgtggccggccgagggaacgagaaaaaaccctcatcggtccgcgcgctgagcattgtcctccctatcgtgctccttgtgtttctttgtcttggagtctttcttctttggaagaattggcggctgaagaacatcaatagcataaactttgacaatccagtctaccaaaagaccactgaggacgaagtccacatttgtcataatcaggatggatactcgtacccaagccggcagatggtcagtctcgaggacgacgtggcg

SEQ ID NO: 16321 - DNA, 2580 bp, Artificial Sequence
  Description of Artificial Sequence: Synthetic coding sequence
atgggtccctggggctggaagcttcgctggaccgtcgccttgctacttgccgcagcaggcacggcagtgggagaccggtgtgagcgaaatgaattccagtgtcaggatgggaaatgtatctcctacaagtgggtgtgcgatggaagcgcggagtgccaggacggaagcgacgagagtcaggagacatgcctgtcagtaacctgcaaatcgggagactttagctgcggtggccgtgtaaaccgatgcataccccaattctggcgctgcgatggacaggtggattgcgataatggcagcgatgagcagggatgtcccccaaagacttgctcgcaggatgaattcaggtgtcatgatggcaagtgcatatcacgccagttcgtgtgcgactcagatcgtgactgcttggacgggagtgatgaagcttcctgccctgtgctaacatgcggcccggctagttttcagtgcaacagttcaacttgtatcccgcagctgtgggcttgtgataacgatccggactgcgaggatgggtcagatgagtggccacagcgctgcaggggtttgtatgtgtttcagggcgattcgagtccgtgctcggccttcgagttccactgtctgtccggcgagtgcatccattcatcctggcgttgcgacggaggacccgactgcaaagacaagagcgacgaggagaactgcgctgtggcaacgtgccgccccgacgagtttcagtgcagtgacggaaactgtatccacgggagccgtcagtgcgacagagaatatgattgcaaagacatgtcggacgaggtgggatgcgtgaacgtgacgctgtgcgaggggcctaacaaatttaaatgtcacagtggtgagtgcataacgctggacaaagtctgtaatatggcccgcgattgtcgcgactggagcgatgagccaatcaaggagtgcggcaccaacgagtgccttgacaataacggtggatgctcccacgtctgcaacgacctgaagatcggcgccgagtgcctgtgccccgacggctttcagctggtggcccaaaggaggtgcgaggatattgacgagtgccaggaccccgacacatgtagccagctgtgtgtcaacctcgaaggcggctacaaatgccagtgtgaggagggattccagttggatccgcataccaaggcgtgcaaggcagtgggctcaatagcctatctcttctttaccaatcgacatgaggtccgcaagatgacacttgaccgtagtgaatacacatcgctaatcccgaatctgcgcaatgtggtggctctagacacagaggtagccagtaataggatttattggtcggatttgagtcagaggatgatctgcagcacacagctggatagagcgcacggcgttagtagctatgacactgtcatcagccgagacatccaggcgcctgatggattggcagtggactggatccattctaacatttattggaccgacagtgtgctgggtaccgtgtccgtggctgacaccaagggcgtcaagcgcaaaaccctattcagggagaacggctcgaagccccgagcaatcgtggtggatcccgttcatggcttcatgtactggacagattggggtacgcccgcgaagattaagaagggcggcctaaacggggtagatatatattccttggttaccgaaaacatacagtggccgaatggaataacattggatttgctgtccggacgcctgtactgggtggatagtaaactgcactccatttcctctattgatgttaatgggggaaacagaaagaccatcttggaagatgaaaagcgcttggcgcaccccttcagcctcgccgtctttgaggacaaggtattctggaccgatataatcaatgaagctatcttcagtgccaaccggttgacaggttcagacgtgaacctgctggccgaaaaccttctatctccagaggacatggtcttgttccacaatcttactcagccacgtggcgtgaattggtgtgagcgaacgacactgagtaatggtggatgccagtatctgtgcttgccggccccacagattaacccgcacagcccgaagttcacctgcgcctgccccgatggtatgctgctggcccgagatatgcgctcgtgcctcacagaggcggaggccgcagttgccacccaagagacgtccactgttcgcctgaaggtcagttcaaccgctgtccgaactcagcacactaccacgcgacccgtccccgatacatcacggcttcctggtgccacccccggcctgacaacggtcgaaatagtgactatgagccatcaggccctgggagatgtcgcaggccggggcaatgagaagaagccctcatccgtcagggctctgagtatcgttctgccgatcgtgctgctggtgtttctatgccttggcgttttcctcctgtggaagaattggagattaaagaatataaacagcattaactttgataatcctgtgtaccagaaaacgaccgaagatgaagtgcatatctgccataaccaggatggctactcctacccatctcgccagatggtgtcattggaagatgacgtcgca

SEQ ID NO: 16322 - DNA, 2580 bp, Artificial Sequence
  Description of Artificial Sequence: Synthetic coding sequence
atgggtccctggggatggaaactccggtggaccgtggcactcctgttggcggccgcaggaaccgctgtgggtgatcggtgcgaacgcaacgagtttcaatgccaggatggaaaatgcatttcatacaagtgggtgtgtgacggttcagccgagtgtcaagacggatcggatgaatcacaagagacttgtctttccgtgacctgtaagtccggggactttagctgtgggggtcgggtcaacagatgcattccgcagttttggcgatgtgatggtcaggtcgattgtgacaatggctcagatgagcaggggtgtcccccaaagacctgttcacaagatgaatttagatgtcacgatggtaagtgcatctcacgccaattcgtgtgcgattctgatcgtgattgtctggacggatcggacgaagcatcgtgtccagtgcttacctgtggccctgcatcgttccagtgcaactcgagcacctgtatcccacaactctgggcctgcgataacgatcccgactgtgaggatgggtctgatgaatggccgcagcgatgtcgcggactgtacgtgttccaaggagatagcagcccctgctcggcctttgagtttcattgtctgtcgggagaatgtatccattcctcgtggcgatgcgatggcggcccggattgcaaagataaatcggatgaggagaactgtgcagttgcaacctgtaggccagacgaatttcagtgttccgatggaaactgcatacacggcagccgccagtgcgacagagagtacgactgtaaagacatgtcggatgaagtggggtgtgtgaacgtgaccttgtgtgaagggccgaacaagtttaagtgtcacagcggggaatgtatcaccctggacaaggtctgtaatatggcacgcgactgtagagactggtccgacgaaccaattaaggagtgtgggactaatgagtgcctcgacaacaatggcggttgttcccatgtgtgcaacgatttgaagataggcgcagaatgcttgtgtcccgatggctttcagctggtcgcgcaacgaagatgcgaggatattgatgaatgccaggatccagatacttgtagccaactttgcgtgaatttggaaggcgggtacaagtgtcagtgcgaagaaggattccaactggatcctcataccaaggcctgcaaagcagtgggatccattgcatatctgttctttactaaccggcatgaagtgagaaagatgacgctggatcgctcggagtatacgtcactgattcccaacctgcgcaacgttgtggcactggacactgaggtggcgtcgaacagaatctactggtccgacctttcgcagcggatgatttgtagcactcaactggatagagcgcatggagtgtcgagctacgatactgtcatctccagagacatccaagcaccggatggactcgctgtggattggattcattccaacatttactggactgattccgtgcttggaactgtgtcggtggccgataccaagggtgtcaaacgaaagacccttttcagggaaaatggctcgaagcctcgagcaatcgtggtggacccggtgcacggttttatgtactggactgactggggcacccctgccaagattaagaagggaggtcttaacggagttgacatatactcgctcgtgacggaaaacatccaatggcctaacggaattaccctcgatttgctttcgggacgtctttactgggtggactccaaactgcactccatctcgagcatcgatgtcaacggtgggaaccgaaaaactatccttgaagatgaaaagaggcttgcacatcctttcagcctcgcggtgtttgaagataaagtgttctggaccgacatcataaacgaagctatattctccgcgaataggttgactggctcggacgtcaatcttctcgccgaaaacttgttgagccccgaggacatggttctcttccataacctcactcagcctcgtggagttaattggtgtgaaagaaccaccttgtcaaatggaggttgtcaatacctgtgtctgcctgccccacagattaaccctcattccccaaagttcacgtgtgcgtgtcccgacgggatgcttcttgcacgtgacatgcgctcctgtctgaccgaagcggaggcagccgtggcaactcaagagacgtcaactgtccgcctcaaggtttcatcgacggcagtgcgcacccaacacactaccacccgaccggtgcctgatactagccgcctcccaggcgccaccccgggtctgaccaccgtcgagattgtgacgatgtcacatcaggctctgggagatgtggcagggcgaggaaatgaaaagaagccatcctctgtgcgcgctctttccattgtgcttcctattgtcttgcttgtgtttctttgtcttggggtgtttctgctgtggaagaactggcggctgaagaacattaactcgatcaattttgacaaccctgtctaccagaaaaccactgaggacgaagtgcacatttgtcataaccaggacggatactcatatccgtcgcgccaaatggtttcgctggaggatgacgtggca

SEQ ID NO: 16323 - DNA, 2580 bp, Artificial Sequence
  Description of Artificial Sequence: Synthetic coding sequence
atgggaccttggggatggaagcttcggtggacggtagctctgctactagcagcagccggtaccgccgtgggcgaccgctgcgagaggaatgagtttcagtgtcaagatggcaaatgtatctcatacaaatgggtgtgcgacggcagcgcagagtgtcaggatggatctgacgagtcacaggagacttgcttatcagtcacttgtaaaagtggcgactttagctgtggaggacgggtcaataggtgcatcccccagttttggagatgcgatggacaggttgactgtgacaacggatccgatgaacagggatgtccccccaagacgtgctctcaagacgagtttcggtgccatgatgggaagtgtatttcacgccagtttgtatgtgatagcgatcgcgattgtctcgacggatctgacgaggcctcttgccccgtgctaacctgtggccctgcttctttccagtgtaactcttccacatgtataccccaactctgggcgtgtgacaatgacccagattgcgaggacgggtctgacgaatggccacagaggtgtaggggcctctatgtgtttcagggagattcaagtccttgctccgcctttgaattccactgcctttctggagaatgtattcatagttcatggcgatgtgatggcggtccagattgcaaggataagtccgatgaagagaactgcgccgtcgcgacctgcaggcctgatgagtttcagtgctctgacggtaattgtattcacggatcccgccagtgcgatcgggagtacgactgcaaggatatgtctgatgaagtgggatgtgtgaatgtcaccctatgtgagggtcccaataaattcaagtgccacagcggagaatgtatcacacttgataaagtttgtaacatggccagggattgtcgtgactggagtgatgaacccataaaggaatgcggtacaaacgaatgcctggacaacaacggcgggtgttcacacgtgtgcaatgacctgaagataggagcagagtgcctgtgcccagatggatttcagctcgtggctcagagacgttgtgaggacatcgacgaatgccaagatccagacacatgttctcagctatgtgttaatctcgagggaggctataagtgtcaatgtgaggaaggcttccagctggatccacatacgaaggcctgcaaggctgtgggatccatcgcatatctcttttttaccaatcggcatgaagttcgtaagatgaccctcgaccgttctgagtatacatcgttgataccgaatctcagaaacgtcgtggcactcgacaccgaagtcgcttcaaatcgaatttactggagcgacttgagtcaacgcatgatatgttctacacaactggacagagcacacggtgtcagctcttacgacacggtgatctctcgtgacatccaggcgcccgatggcctcgccgtggactggattcactctaatatttactggactgactctgtgctgggcaccgtctctgtggccgacaccaagggggtaaaaaggaaaacgcttttcagggaaaatggcagtaaacccagggccatcgtggtggatccagtccacggcttcatgtattggacggactggggaacaccggcaaagatcaaaaaaggaggtctaaacggagtggacatttattctcttgtcacagaaaacattcaatggccaaatggcattacgctggatctgctgtctggcagactttattgggtcgacagcaaactacactccattagctccatcgacgtgaacggcggcaatagaaaaacgatcctcgaagatgagaaaaggttggcccatcctttctccctcgctgtatttgaggacaaggtgttctggacggatattataaatgaggccattttctctgctaacaggttaaccggttctgatgtgaacctgcttgcagagaacctcttgtcccctgaggatatggtgctattccacaacctgactcagcctcggggtgttaattggtgtgagcggaccacgttatccaacggggggtgccagtatttgtgtctgccagctcctcagattaacccacattcccctaaattcacttgtgcctgcccggatgggatgctgttagcacgggatatgagatcctgtcttaccgaagcggaagcggcagttgccactcaggaaacctccacggtgaggctgaaagtttcctcgactgccgtgcgtacccagcacaccaccacgcggcctgtgccagatacttcccgattaccaggggcgacacccgggctgaccacagtggagatcgtgaccatgagccatcaagccttaggcgacgtcgccgggaggggcaatgaaaagaagccctccagcgtgcgggcattgtccattgttttaccaatcgtcttgctagtgttcctgtgtttaggggtatttctgctgtggaaaaattggcgcttgaagaacataaatagcattaacttcgacaaccccgtgtatcagaaaactactgaagacgaagttcacatatgtcataatcaggacggctactcctacccatcccggcagatggtgagccttgaggacgacgttgca

SEQ ID NO: 16324 - DNA, 2580 bp, Artificial Sequence
  Description of Artificial Sequence: Synthetic coding sequence
atgggaccgtggggttggaaactgcggtggactgttgcactgttgctggccgcagccggaactgcagtgggggaccgctgcgaaaggaacgaatttcaatgccaggacggaaagtgcatttcgtacaaatgggtgtgcgacggaagtgccgaatgccaagatggatcggacgagtcacaggaaacctgtctgtcggtgacctgcaaatcgggtgacttttcatgcggcggtagggtcaatcgttgtatcccccaattctggcggtgtgacggacaagtggattgtgataacgggtccgacgagcagggatgcccgccaaagacctgctcccaggacgagttccgctgccacgacgggaagtgcatcagccgccagtttgtgtgcgacagcgaccgcgactgcctcgatgggagcgacgaagcaagctgtccagtgctgacttgcggtccggccagcttccagtgcaactcttcgacttgtattccacagctttgggcgtgcgacaacgatccagattgcgaagatggatcagacgaatggccgcagaggtgtcgcggactgtacgtctttcagggggactcgtccccgtgcagcgcctttgaattccattgcttgtccggcgaatgcatccattcatcgtggcggtgcgatggaggccctgattgcaaagacaagtccgacgaggagaactgtgccgtggccacctgtagaccagatgagttccagtgctcagacggaaactgcatccatggcagccggcagtgcgacagagagtacgactgtaaggacatgagcgatgaagtgggttgcgtcaacgtgactctctgcgaggggcccaataagttcaagtgccattcgggagaatgcattactctggacaaggtctgcaacatggccagagattgcagagactggtcagacgagccgattaaggagtgtggcactaacgagtgcctcgataacaatggaggatgctcccacgtgtgcaacgacctgaaaatcggggctgagtgcctgtgccctgacggattccaactcgtggcccagcgccggtgcgaggacatcgacgagtgtcaagaccctgacacctgctcccaactctgcgtgaacctcgagggagggtacaagtgccagtgcgaggaggggttccagctggacccccatacgaaagcctgcaaagccgtcggaagcatcgcgtaccttttcttcaccaaccggcacgaggtgaggaaaatgactctggaccggtcggaatacacgtcactcattccgaacctcaggaatgtcgtggctctcgataccgaggtcgcgtcaaatcggatctactggtcagatctttcccaacgcatgatctgttcaactcagcttgaccgcgctcatggcgtgtcatcctacgacaccgtgattagccgcgatatccaggctccggatggtctggctgtggattggatccactcgaacatctactggactgactcggtgctcgggactgtgtccgtggccgacactaagggagtcaagcgaaagactctgttcagagaaaacgggtcgaagccacgcgccatcgtggtcgatccagtccatggcttcatgtactggaccgactggggcactccggccaagatcaagaaaggaggacttaacggcgtggatatctattcgctcgtcactgagaacatccaatggccgaatggtatcaccctggatctgctctcgggacggctctactgggtggatagcaagctccacagcatctcctctattgacgtgaacggcggtaatcgaaagactatactcgaggatgaaaaaagactcgcccatccattctccctcgcagtgtttgaggacaaggtcttttggaccgatatcattaatgaagccatctttagcgcaaatcgcctgaccggctccgatgtgaacctgctggccgaaaatctcttgtcgccagaagatatggtgctctttcataaccttacccagccgcggggagtgaactggtgtgagcggactaccctttcaaatggtggatgtcagtacctctgccttcctgcgccgcagatcaacccccactccccaaagttcacttgcgcctgcccggatgggatgctgctcgcccgcgatatgcgctcgtgtctgaccgaggccgaagcagccgtggcgactcaggagacgtccacggtgagactcaaggtgtccagcaccgccgtcagaacccagcacactaccacccgcccagtgccggacacgtctcggcttccaggcgcgaccccgggccttaccactgtcgaaatcgtgactatgagccaccaagccctcggtgatgtcgcgggacgcggtaacgagaagaaaccgtcctcggtccgagccttgtccatcgtcctgccgatcgttctcctggtgttcctgtgcctcggtgtgttcttgctgtggaagaattggcggttgaaaaacatcaattccatcaacttcgacaatccggtgtaccagaaaactacggaggatgaagtgcatatctgccacaaccaagatggatactcgtacccttcgcgacagatggtcagcctcgaggacgatgtggca

SEQ ID NO: 16325 - DNA, 2580 bp, Artificial Sequence
  Description of Artificial Sequence: Synthetic coding sequence
atgggaccttgggggtggaagctgcgttggaccgtcgcacttcttcttgccgctgcaggcactgcagtgggcgatcgctgtgagagaaacgaattccaatgtcaggatggaaaatgtatttcgtacaagtgggtgtgtgatggaagcgccgaatgccaggacggttccgacgaatcacaagagacttgtctttccgtcacgtgtaagtcaggtgatttcagctgcggcgggagggtgaaccgttgtattccccaattttggcgatgtgacggccaagtggactgtgacaatggatcggatgaacaaggatgtcctccaaagacttgcagccaggatgagtttagatgtcatgatggaaaatgcatttccagacagtttgtctgtgactcagaccgggattgtcttgatggctcggacgaagcctcatgtccggtgctcacgtgtggacccgcgtcttttcaatgcaacagctcgacttgcattcctcagctctgggcgtgcgataacgatcctgattgtgaggatggatccgatgaatggccccagcgctgtcgcggactgtacgtgtttcagggagactcaagcccatgttcggcattcgaattccactgtctgagcggggaatgtattcatagcagctggcggtgcgatggaggacctgactgtaaggataagtccgacgaagaaaactgtgcagtggcaacctgtcgccctgatgaatttcagtgtagcgatggaaactgtattcatggttcacgtcaatgtgaccgggagtatgattgtaaggatatgtctgatgaagtcgggtgtgttaatgtgactctctgtgagggacctaacaagtttaagtgtcactcaggggagtgcattactttggataaggtttgcaatatggcacgcgactgtcgcgattggtccgatgaaccaattaaggaatgcggaactaacgagtgtctggataacaatgggggatgttcgcatgtgtgtaatgacctcaaaatcggggcggaatgcctttgcccagacggttttcaacttgtggcacaaaggcgctgcgaagatattgatgaatgccaagatcccgacacgtgctcgcaactctgtgtgaacctcgaaggcggatacaagtgccagtgcgaagaaggttttcaactggacccacataccaaggcatgcaaggcagtggggagcattgcataccttttctttactaatagacatgaagtccggaaaatgacgcttgacagatcagagtatacttcgttgattcccaacttgaggaatgtggtggcactggataccgaggtcgcttcaaacaggatttactggtctgatttgtcgcagcggatgatctgttccacccagcttgatagggcccacggagtctcttcctacgatactgtgatttcgcgcgacattcaagcacctgacggactcgcagtcgattggatacattcgaatatctactggactgattcagtgctgggaaccgtgtcggtggcagacaccaagggtgtcaaaagaaagactctgtttcgggaaaatggaagcaaacctcgagcaatagtggtggacccggtgcacggatttatgtactggaccgattggggaaccccggcaaagataaagaagggcggtctgaacggtgtggacatctactccctggtcaccgaaaacattcaatggcctaacggaatcaccctggatcttctgagcggtagactttactgggtggatagcaagctccactcgatctcgtcaattgatgtcaatgggggaaatcgtaagaccatattggaggacgagaagcgacttgctcatcctttctccctggcagtctttgaagataaggtcttttggactgatatcattaacgaagcaatcttttcagcaaataggctgactggatcagatgtcaatctgctggccgaaaatctgttgtccccagaagatatggtcctcttccataaccttacccagcctagaggagtgaactggtgtgagaggacgacgctgtcgaacggtggatgccagtacctgtgtctccctgcgccacagattaaccctcactcccctaaattcacttgtgcctgtcctgatggcatgctgctggcacgtgatatgcgatcttgccttaccgaagctgaggcggctgtcgcaactcaggaaacctctactgtgagactcaaggtgtcctcgactgcagtccggactcaacacaccacgacccgacctgtccctgacacctcgcgcctgcccggagcaactccagggcttactacggtggaaattgtgaccatgagccatcaggcgttgggggacgtcgcaggtcgtggtaacgagaagaaaccttcatcggtgcgagcgcttagcattgtgcttccgattgtgctgctggtgttcctttgtctgggcgtgtttctgctttggaagaattggcggcttaagaacattaactccatcaactttgataaccccgtgtaccagaaaaccactgaggacgaagttcatatctgtcataaccaggacggatactcgtacccatcgcggcagatggtgtcactggaagatgacgtcgcg

SEQ ID NO: 16326 - DNA, 2580 bp, Artificial Sequence
  Description of Artificial Sequence: Synthetic coding sequence
atggggccatggggatggaagctccgttggaccgtggctctgcttctggccgcagccggcactgctgtgggcgacaggtgcgagagaaacgagttccagtgtcaggacggtaagtgtatcagctacaaatgggtctgtgatggcagcgccgaatgccaagatggtagtgacgaatcccaagaaacgtgtctgtctgtgacctgcaagagcggagacttttcttgcggtggtcgtgttaaccgctgcataccgcaattctggcgctgtgacgggcaggtggactgtgacaacgggagcgatgagcaggggtgtcccccaaaaacctgcagccaggatgaatttaggtgccatgacggcaaatgcatcagccgccagttcgtctgcgacagcgaccgggattgcctggatggcagtgacgaggcatcgtgtcctgtactgacatgtggaccggctagcttccagtgcaacagctctacctgtataccccagctgtgggcctgcgacaatgatcccgattgcgaggacggttcagacgagtggcctcagcgatgtagaggcctctacgtttttcagggggactcaagtccctgcagtgcctttgaattccattgcctgtcaggagagtgcatccactcaagttggaggtgcgacgggggtcctgattgtaaggacaagagcgacgaagagaattgcgccgtagctacttgtcggccagatgagttccaatgcagtgatgggaactgtattcacggctcacggcagtgtgacagggaatatgattgtaaggatatgtccgacgaagttggttgcgtcaacgttaccctctgcgagggccctaacaaattcaagtgccacagcggagaatgtatcactctggacaaggtgtgcaatatggcgcgggactgccgcgattggtccgatgagccaataaaagaatgtggcaccaatgaatgtctggacaataacggtggctgcagtcatgtctgcaacgacctgaaaatcggagccgaatgtctgtgcccagatggttttcagctggtggcacagcgccggtgcgaggacatcgacgaatgtcaggatcccgatacctgcagtcaactgtgtgtcaatctggaggggggttataagtgtcagtgcgaggagggattccagttggacccccatactaaagcttgcaaggcagtcgggagcatcgcgtacctgtttttcacgaacagacacgaggtgcggaaaatgacacttgaccgctcagagtatacctccttaatccctaatctcaggaacgtggtggccctggataccgaagtggccagtaaccgcatctactggtcagacttaagccagagaatgatttgctctacgcaactggatcgcgcacatggtgtttcctcctacgacacggtcatatcccgtgacattcaagcacccgacggattagccgtagactggatccactctaacatttactggacggattcagtgctgggtacagtgtctgtcgcagatactaaaggcgtgaagagaaaaaccctgtttcgagagaacgggagtaagcctcgcgcaatcgtggtcgaccccgtccacggctttatgtattggacagactggggcacccccgccaagataaagaagggtggtctgaatggcgtggatatttattctcttgtgactgagaatattcagtggccgaacggaatcactctggatctgctgagtggacgtttgtattgggtagatagcaagctgcactcaatatcctccatagatgtaaatggaggaaatagaaagacaatcctcgaggacgaaaagaggcttgctcatcctttttccctggctgtgttcgaagacaaagtattctggacggatataattaacgaggccatcttcagcgcaaaccgcctgaccggtagcgacgtaaacctgctggccgagaatttgctctctcctgaggatatggtgttgttccataacctgactcagcctcggggcgttaattggtgtgagcgcaccacattgtccaacggcgggtgccagtacctttgcctccccgctcctcagataaacccacattcacctaaattcacgtgcgcgtgcccggatggcatgctgttggcacgagacatgaggagctgtttgaccgaagccgaagcagcggtagccacccaggagacatcaaccgtgcgcctgaaggtttcttccaccgctgtccgaacccagcacaccactacaaggccagtcccagacacttcaagactgccaggtgccacccctggcctgaccacagtggagatcgtcactatgtcgcaccaagcgctaggcgacgtagctggcagaggtaatgagaaaaaaccctcatctgttcgggcgctgtcaattgtcttacccatcgtgcttctggtctttttatgtctcggcgtgttcctattgtggaaaaactggaggctcaaaaatataaacagcataaattttgataacccagtctaccagaagacaacagaggatgaggtgcacatctgtcataatcaggacggctacagctacccatctcgccagatggtaagtctggaggacgatgtggcc

SEQ ID NO: 16327 - DNA, 2580 bp, Artificial Sequence
  Description of Artificial Sequence: Synthetic coding sequence
atgggcccatggggctggaagctcagatggaccgttgccctactcctggctgcggccgggactgctgtgggcgaccggtgcgaacgaaacgagtttcagtgtcaagacggaaaatgcattagctacaagtgggtctgcgacggatccgcagagtgccaggatggcagcgatgaatcccaggagacttgcttatccgttacctgcaagtctggagattttagttgcggcggaagggtgaacagatgcatcccacagttttggaggtgcgatgggcaagtggattgtgataacgggagcgacgaacagggatgtcctcccaaaacttgcagccaagacgaattccgctgtcacgacggaaagtgcatcagtcgtcaattcgtctgtgatagtgaccgcgactgtcttgatgggtccgatgaagcttcttgcccagtcttgacatgcggtccagctagctttcagtgcaactcgtctacttgtatcccacagctgtgggcttgtgataatgatccagactgtgaggatggaagcgatgaatggcctcaaaggtgccgcggactctacgtgttccagggagatagtagcccttgctccgccttcgagtttcattgccttagcggagagtgcatccactcgagctggcgctgtgatggcggacccgattgcaaggataaaagcgatgaagaaaactgcgcggtcgcgacctgccgaccagacgaattccaatgttctgacggcaactgtatccatggatcgaggcaatgcgatagggagtacgattgcaaggatatgagcgatgaggtgggatgtgtgaacgtgaccctctgtgagggaccaaataaattcaaatgtcatagtggagaatgcatcacacttgacaaggtgtgtaacatggccagggactgccgcgactggtctgacgagccgatcaaggaatgcggaaccaacgaatgcctcgacaacaacggaggatgctctcacgtctgtaacgacttgaaaattggagccgagtgcctctgccctgatgggttccagctggtggcccagagacggtgtgaagatatcgacgaatgccaagacccagacacctgcagtcaactgtgcgtcaatctggagggggggtacaagtgtcagtgcgaggaaggcttccagcttgatccccatacaaaggcttgtaaagccgtgggaagcattgcttacctgttcttcaccaatagacatgaggtgagaaaaatgaccttggataggtcagaatacacctcactgatacctaacctgcgcaacgtggtggctctggacaccgaagttgcatctaaccgcatttactggtcagacctctctcagcggatgatatgcagcacacagctggacagagcacacggtgtatccagctacgacaccgtgattagcagagatattcaggcacctgacggcctggccgtcgactggatccacagcaacatctattggacggactctgtcctgggtaccgtctctgtcgctgatacaaagggcgtcaaaaggaagacactgttcagggagaacggcagcaaaccacgagccatagtagtcgacccagtccatgggtttatgtactggaccgattggggtactcccgcaaagatcaaaaagggcggcctgaacggcgtcgacatctacagccttgtgaccgagaacattcaatggccaaatgggattacccttgatctgctgtctggaagactatactgggtggattctaagttgcattcaatctcaagcatcgacgtgaacggcggaaaccgcaagaccattcttgaagatgaaaagcgcctcgcacaccccttctccctcgcagttttcgaggataaagtattctggaccgatatcattaacgaggctatcttttccgcaaaccgattgacgggcagcgacgttaacctgttggcagaaaaccttctgtcccctgaggacatggttctgtttcacaaccttacacaacctagaggcgtcaattggtgtgaaaggactactttaagcaacggcggatgccaatatctgtgtctgccagctccccagatcaacccgcatagtcctaaattcacatgcgcttgtcccgacgggatgctgcttgctcgcgatatgcgatcttgcttaaccgaggccgaagccgctgtagccacccaagaaacctcgaccgttagacttaaagtttcctctacagctgtgagaacccaacacaccaccaccaggccagtgcctgatacaagccgcctccctggtgccacacccggccttaccactgtagaaatcgtcacaatgtcccaccaagcactgggagatgtggccggccgtggtaacgaaaagaagcccagtagtgtgcgcgcgctctctattgtgctgccaattgttcttttggtgtttttgtgcctgggagtgtttctgctctggaagaactggaggctcaaaaacatcaacagcataaactttgataaccctgtgtaccaaaagacaaccgaagacgaggtccacatttgtcacaaccaggacggctacagttaccccagtaggcagatggtctcactggaagatgacgtggcc

SEQ ID NO: 16328 - DNA, 2580 bp, Artificial Sequence
  Description of Artificial Sequence: Synthetic coding sequence
atgggcccctggggatggaaactgcgctggaccgtagccctgttgctggcagcagccggaacagccgttggcgaccgttgtgaaaggaacgagtttcaatgccaggacggaaagtgtatatcatacaagtgggtgtgtgacgggtccgccgagtgtcaggatggcagcgatgagtcccaggagacatgcctttccgtgacttgcaagtctggcgatttctcctgcgggggtcgtgtcaaccgatgtatcccccagttctggcggtgtgatgggcaggttgattgcgacaatggttcggatgagcagggttgtcctccaaagacctgctctcaagatgagttccggtgccacgatggaaagtgcatatcacgccagttcgtttgcgattcggatagggactgtcttgatggctcggatgaggcaagctgtccagtgctgacatgtggacctgcttcttttcagtgtaacagctcaacttgcatcccccagctctgggcgtgtgataatgatccggattgcgaggatggctccgacgagtggccacagagatgcagaggcctttatgtgttccaaggtgacagttccccttgcagcgcctttgagttccactgcttatccggcgagtgtattcacagcagctggcgttgcgacggagggccggattgtaaagataaatcggatgaagagaactgcgcggtggcgacctgccggcccgatgagtttcagtgttcagatggaaattgcatccacggaagtcggcagtgtgatagggagtatgactgtaaggatatgtctgatgaggtcggctgcgtcaacgttaccctctgtgagggacctaacaagtttaaatgccactctggggagtgtattaccttggacaaagtatgcaacatggcacgagactgtagggactggtcagacgaaccaatcaaggaatgcggaaccaatgagtgtcttgataacaacggcggctgttcccatgtttgcaatgacttaaagatcggcgccgaatgtctttgccccgatggttttcagctcgttgcccagcgccggtgcgaggacatcgacgaatgtcaagacccagacacctgttcacagttatgtgtcaatctggaggggggttacaaatgccagtgcgaggaaggctttcagctggatccacacacaaaagcttgcaaagcggttgggtcaattgcgtatctctttttcaccaatcggcacgaagtccgcaaaatgaccttggatagatccgaatatacaagcctgataccaaatctgaggaatgtggtcgcacttgatacagaggtggcgagtaatagaatttattggagcgatctgagccagcgtatgatctgttcaacccaactggatagagcccatggggtttcttcgtacgacacagtgatatctcgggacattcaggcacccgacggtctcgcagtcgattggatacacagcaacatatattggacagactcggttctggggacagtcagcgtcgcagatactaagggcgtaaagcgcaagactctgtttcgggagaatggtagcaagccgagagctatcgtggttgatccggtgcacggtttcatgtattggactgattggggaacgccagccaagattaagaaagggggcctgaatggtgtggatatttactccctggttacagagaatatccagtggccaaacggaatcaccctcgatctgctgtccggtcgactctattgggtggatagcaaactccactcgatctcatctattgacgtcaacggtggaaatcggaaaaccattctcgaagatgaaaagaggcttgcccaccctttcagccttgctgtgtttgaggacaaagtgttttggacagacatcatcaatgaggccattttctctgccaatcgcttgaccgggagcgatgtgaacttgctggctgaaaatttactgtcacctgaggatatggtgctctttcataatttgacccagcctcgtggcgtaaactggtgtgaaagaacaaccttatcaaatgggggctgtcagtacctatgccttccagcgccacaaattaatccacacagccctaagtttacctgtgcgtgccctgatgggatgctgctagctcgagatatgcggagctgtttgaccgaggcagaagccgccgtagcgacgcaggagacgtccactgttcggctgaaagtgagtagtaccgccgtgagaacccaacataccactacacgccctgttcctgacacttctaggctgcctggcgcgacgccgggtcttaccaccgtagagatagtcacgatgagtcaccaggcactgggcgatgtcgcgggacggggaaacgaaaagaagcccagtagtgttcgtgctctgagcatcgtcttacccatcgtactgctagtgtttctatgtctcggagtattcctgctgtggaaaaactggcggctcaagaacatcaatagtattaacttcgataatccagtgtaccagaaaactactgaggacgaggtgcatatttgtcacaaccaggatggatacagctatccttccagacagatggtgtccctggaagatgacgtggct

SEQ ID NO: 16329 - DNA, 2580 bp, Artificial Sequence
  Description of Artificial Sequence: Synthetic coding sequence
atggggccatggggctggaaacttcgatggaccgtcgcccttcttctggctgcagctggtaccgcagtgggagatcgatgtgaaagaaacgaatttcaatgtcaggatggtaagtgtatctcatacaagtgggtgtgcgatggctccgctgaatgtcaagatgggtccgacgagtcacaagaaacctgcctttccgtgacctgtaaatcaggagacttttcatgtgggggccgagtgaataggtgtattccgcaattttggcggtgtgatggacaagtggattgcgataacggttcggacgaacaaggatgtcctcctaagacttgcagccaggacgaatttcggtgtcatgatggaaaatgtatttcacgccagtttgtgtgtgacagcgatcgcgattgtcttgatggtagcgatgaagctagctgccccgtgctgacctgtggacctgcatcatttcaatgcaactcgtcaacctgtattccacagctttgggcatgcgacaacgatccagattgtgaagatggctccgatgagtggcctcagcggtgtaggggcctttacgtctttcaaggcgattcgtcgccatgcagcgcgttcgagtttcactgtctgtccggggaatgcatccattcctcatggaggtgcgatggagggccggattgtaaagataagtccgatgaggagaattgtgcagtcgcaacttgtcggcctgacgagtttcagtgttctgatggaaactgtatccatggttcacggcaatgtgacagggaatacgactgtaaggacatgagcgatgaggtgggatgtgtcaatgttactctgtgcgaaggacccaacaagttcaagtgtcattccggtgagtgcatcaccttggacaaggtgtgtaacatggcccgggattgtcgcgactggtcggacgagcctattaaggaatgcggcacgaatgagtgccttgataacaatgggggctgttcccacgtgtgcaatgatctgaagattggggccgaatgtttgtgccctgacggatttcaactggtggcacagagaagatgtgaggatattgacgagtgtcaagatcctgatacttgcagccaactgtgtgtgaacttggaaggtggatacaaatgccaatgcgaagaaggtttccaactcgatcctcataccaaggcctgcaaggcagtgggctccatcgcatacctcttctttactaaccgacatgaagtgagaaagatgacccttgatcgttcagagtacacctcgctgatccctaaccttcgcaacgtggtggcactggatacggaagtggcatcgaatcgcatttactggtccgatctttctcaaagaatgatttgctcgactcaacttgacagggcacacggcgtgtccagctacgacaccgtcatatctcgggacattcaagcccctgacggtctggcggtggattggattcacagcaatatctactggaccgactcggtcctgggtacggtttcagttgctgataccaagggagtgaagcgtaagaccctttttcgggagaacgggagcaaacccagggcaatcgtcgtggacccggtgcatgggttcatgtactggaccgattggggaaccccagccaagattaagaagggaggactgaacggggtcgacatatactcactcgtcaccgaaaacatccagtggccaaacggaataactctggatcttctttccggtaggctttactgggttgactccaaactgcattccatttcttcgattgatgtgaatggtgggaaccgcaagaccatccttgaggacgagaaacggctggcacatccattctcgctggccgtttttgaagataaagtcttttggaccgacatcataaatgaggcgattttctctgcaaaccgccttaccggatccgatgtgaatctgctggcagaaaacctgctttccccagaagatatggtgcttttccataatcttactcagccgagaggtgtgaattggtgcgaaaggaccactctgagcaatggaggatgtcagtacctgtgtttgcctgcacctcaaatcaaccctcattcgcctaagttcacctgtgcttgtccggatggtatgctgttggcgagagacatgaggtcgtgccttaccgaagccgaggcagctgtggcaacccaggaaacttcaactgtgcggctgaaggtatcgtccaccgctgtcaggactcagcatactaccacgcggccagtgcctgacacctcacgcctgcctggagcaaccccaggattgactaccgtggagattgtgaccatgagccaccaggcactgggggacgtcgcgggaaggggtaacgagaagaaaccatcctccgtgcgcgcactgtcaatagtcctgccaattgtgttgctggtctttctttgcctcggggtctttctgctctggaagaattggagacttaagaacattaacagcatcaacttcgataatcccgtgtaccaaaagacgaccgaagatgaagtccatatctgtcataatcaggatggatactcatatccttcccgccaaatggtttcgcttgaggacgatgtggcc

SEQ ID NO: 16330 - DNA, 2580 bp, Artificial Sequence
  Description of Artificial Sequence: Synthetic coding sequence
atgggaccatggggttggaaattaaggtggactgttgctcttttattagctgcagcaggaactgcagttggtgatcgatgtgaaaggaatgaattccaatgtcaagatggtaaatgtattagttataaatgggtgtgtgatggatctgcagaatgtcaagatggaagtgatgaatcacaagagacatgtctttctgttacatgtaaaagtggagatttttcatgtggaggacgagtaaacagatgtattcctcaattctggcgttgtgatggtcaagtagattgtgataacggatctgatgaacaaggatgcccacctaaaacttgttcacaagatgaatttcgttgtcatgatggtaagtgtatttcaagacaatttgtttgtgattctgatagagattgtcttgatggttcagatgaagctagttgtccagtattaacctgtggaccagcatcattccaatgtaattcatctacatgtattccacaattatgggcatgtgataacgatccagattgtgaagatggttctgatgaatggccacaacgatgtagaggtttatatgttttccaaggagactcaagtccttgttcggcttttgaatttcattgtctatccggtgaatgtattcattcatcttggagatgtgatggaggaccagattgtaaggataaatcagatgaagaaaattgtgcagtagctacttgtcgtccagatgaattccaatgtagtgacggaaattgtatccacggatcaagacaatgtgatagagaatacgactgtaaagatatgtcagatgaagttggatgtgtgaatgttacattgtgtgagggaccaaataaattcaaatgtcactctggagaatgtattactttagataaggtttgtaatatggcaagagattgtagagattggagtgatgaaccaataaaagaatgtggaacaaatgagtgtttagacaataatggaggatgttctcatgtttgtaatgatttaaagataggtgctgaatgtttatgccctgatggttttcaacttgttgcacaacgaagatgtgaagacattgatgaatgtcaagatcctgatacctgtagccaattatgtgttaatttagaaggtggatataagtgtcaatgtgaagaaggatttcaattggatcctcatactaaagcatgtaaggcagtcggaagtatagcttatctttttttcacaaatagacatgaagttagaaagatgacacttgatagatctgaatatacatctcttatacctaatcttagaaatgttgtagcattagatactgaagtagcttccaatagaatatattggtcggatttatcacagagaatgatttgttctacccaattagatcgtgctcatggagtttcctcatatgacacagtaattagtagagacattcaagcaccagatggattagctgtagattggatacactcaaatatttattggactgattctgtattaggaacagttagtgtggctgatactaaaggagttaaaagaaaaacactttttagagaaaatggatctaaaccacgagcaattgtagtggatcctgtacatggttttatgtattggacagactggggtacacctgctaaaattaaaaaaggaggacttaatggagttgatatttattcattagtaactgaaaatattcaatggccaaatggtattacgcttgatcttctttcaggacgtttatattgggttgattctaaacttcatagtatttctagtattgatgtaaatggtggaaatagaaaaactattttagaggatgaaaaaagattagcccatccatttagtttagctgttttcgaagataaggttttctggactgatattattaatgaagcaattttttcagctaatcgtcttacaggatcagatgttaatcttttagctgaaaatttattatcgcctgaagatatggttttgtttcataatcttactcaaccaagaggagtaaactggtgtgaaagaactactctttcaaatggtggatgtcaatatttgtgtttgccagcaccacaaattaatccacattcacctaaatttacttgtgcatgtccagatgggatgttgttagcaagagacatgagatcatgtctaactgaagcagaagctgctgttgctacacaagaaacttctacagttagacttaaagtttcttcaactgcagttagaactcaacatacaactacaagaccagttcctgatacatcaagattaccaggagctacaccaggacttacaactgttgaaattgttacaatgtcacaccaagctttaggtgatgttgcaggacgtggaaatgaaaaaaaaccatcttctgttagagcattatctattgttttaccaatagttttattagtattcttatgtttaggagttttcttactttggaagaattggagacttaaaaatattaatagtattaattttgacaacccagtttatcaaaaaacaacagaagatgaagttcatatctgtcataaccaagatggatactcatatccatctagacagatggtatctttagaagatgacgtagca

SEQ ID NO: 16331 - DNA, 2580 bp, Artificial Sequence
  Description of Artificial Sequence: Synthetic coding sequence
atggggccttgggggtggaaactgcgctggacagtggctctcctactggctgctgcaggtacggccgtaggcgatagatgcgaacgcaacgagtttcaatgccaggacgggaagtgtatttcttacaagtgggtctgcgacggatccgctgaatgccaagatggctcggatgaatcacaggaaacctgcctgtcggtgacatgcaagtcaggcgacttctcttgtggcggcagggtaaaccgatgcataccccaattctggcggtgtgatggtcaggtcgactgcgacaacggcagcgatgagcagggatgcccaccgaaaacctgtagccaggatgagtttcggtgtcatgatgggaagtgcatctcaaggcagttcgtgtgcgacagcgaccgtgactgcttagacgggtctgatgaggcgtcttgtccagttctgacctgcggccctgcatcatttcagtgcaacagcagtacgtgtatccctcagctgtgggcctgtgataacgatcccgattgtgaggacggaagtgacgagtggccacagcggtgtagaggcctgtatgtgtttcaaggagactcgtcaccttgctctgcctttgagtttcattgccttagcggggaatgcatacacagcagctggcggtgtgacggcggacctgactgtaaggacaaatcagatgaggagaactgcgcagtggcgacctgcagacccgatgaatttcagtgtagtgatggcaactgcatccacggctcacgacaatgcgaccgggaatatgactgcaaggatatgagcgatgaagttggatgcgttaacgttactttgtgcgagggccctaataagtttaagtgtcactcaggcgagtgtatcacactggacaaggtgtgtaacatggctagagattgccgagattggagtgacgagccgatcaaggagtgtggcaccaacgagtgtctagataacaacgggggttgcagtcacgtgtgtaacgacctgaagattggggccgaatgtctgtgccccgatggcttccagctggtcgcccaaaggcgctgcgaggacattgatgaatgccaggacccagatacctgttcccaattgtgcgttaacctcgagggaggctacaaatgtcagtgcgaggaaggttttcagctggatccccacacaaaggcttgtaaggcagtgggcagcattgcttacctcttctttactaaccgacacgaagttagaaaaatgacattagatagaagcgaatatacgtccctgatccctaacttgaggaatgtggtggccctggatactgaagtagcttcaaaccgtatctactggtctgatctgtcacagaggatgatttgcagcactcaactggacagggcccatggcgtatcctcatatgacactgtgatcagccgcgacatacaagcacccgacgggcttgcggtggattggatacatagcaatatctactggaccgattcagttctcggtaccgttagcgttgcagataccaagggagtgaagagaaagactctgttccgtgagaacgggtctaagcctcgggctattgtggtggaccctgtgcacggctttatgtattggacagactggggcacacccgcgaaaattaagaaaggtggtttgaacggtgtggacatctattcccttgtgacggaaaacatacagtggcccaacggcatcacccttgacctattatccggtaggctctactgggttgacagtaagcttcatagtataagcagcatcgatgtgaacggcggcaaccgtaagaccattctggaagacgaaaaacgccttgctcatcccttctctctggccgtgtttgaagataaagtcttctggactgatataatcaacgaagcaattttcagtgccaaccgcctgacagggtcagacgtaaacctgctggctgaaaacctgctgagcccagaggatatggtgctgttccacaatctcacacaacctcgcggagtaaattggtgcgaaagaacgaccctttctaacggcggctgccagtatttgtgcttgcctgctccccaaattaacccacactcacctaaattcacttgtgcatgcccggatgggatgttgctggcccgggacatgcggagctgtctcactgaggccgaggccgcagtggccacacaggaaaccagcaccgtcaggttgaaagtatcctcaactgccgttagaacccagcacacaacgacaaggccagttccggacacatcccgcctacctggggccactcccggcctgacaactgttgagattgtgacaatgtctcaccaagcgctcggtgacgtcgccgggaggggcaacgagaaaaaaccttcctcagtgcgggctttatcgatagttttgcccatcgtgcttctggtgtttctgtgtctcggggtgttcctcctttggaagaattggagactcaagaatatcaactcaataaatttcgataaccctgtctatcagaagacaacagaggacgaagttcacatctgtcacaatcaggacggctactcttaccccagtcgccagatggtttcattggaagacgacgtcgcc

SEQ ID NO: 16332 - DNA, 2580 bp, Artificial Sequence
  Description of Artificial Sequence: Synthetic coding sequence
atgggaccgtggggctggaagctccgctggactgtcgcgctgctgctggcagcggctggaaccgccgtgggggatcgttgtgagcgaaacgaattccaatgccaggacggcaagtgcatttcctataagtgggtgtgcgacggttccgccgagtgccaagacggatcggatgaatcgcaggagacttgcctttccgtgacttgtaagtcgggagacttcagctgcggaggccgggtcaatcggtgcattccacagttttggcggtgcgacggtcaagtggactgcgataacggatccgacgagcagggctgcccgccgaaaacttgctcgcaggacgaatttcgctgccacgatggtaaatgcatctcgcggcaatttgtgtgcgactcggacagggactgcctggacggatcggacgaagcctcgtgccctgtgcttacctgcggcccggcatcatttcaatgcaactcctcgacctgcatccctcaactgtgggcctgcgataatgatccggattgcgaggatggaagcgacgaatggccgcaacggtgtcgggggttgtacgtgttccagggagattcatcgccctgttcggccttcgagttccattgtctgtcaggtgaatgtattcactcatcgtggcgctgcgacggaggcccggattgtaaggataaatcagatgaggaaaattgtgcggtggccacttgtcgccccgatgagttccaatgctccgacggaaactgcattcacggaagccggcagtgtgaccgcgaatacgactgcaaagacatgtcggacgaagtgggatgcgtgaatgtgactctgtgcgaagggccgaacaagttcaagtgccattcaggggaatgcatcactctggacaaagtgtgcaacatggcccgggattgtcgggactggtcggatgaaccaatcaaggaatgcgggaccaatgaatgcctggataacaacggggggtgctcacacgtgtgtaacgacctcaagatcggtgcggaatgcctgtgccctgatggtttccagctggtggcccaacgccggtgcgaagatattgatgaatgtcaagatccagacacctgctcccagctgtgtgtgaacctggagggaggatacaagtgccagtgtgaggaaggttttcagctcgacccgcacaccaaggcctgtaaggccgtgggatccatcgcttacctcttcttcaccaatcggcacgaggtccggaagatgactttggacagatccgaatacaccagcttgatcccgaacctcaggaacgtcgtggcgctggatactgaggtcgcatcaaacagaatttactggtcggatctctcacagcggatgatctgctccactcagctcgaccgggcgcacggggtgtcgagctacgacaccgtgatctcccgcgacatccaggctccagacggactcgctgtcgactggatccattcgaacatctactggactgattccgtcctggggaccgtttcggtcgccgacaccaagggagtgaagcggaaaactctcttccgggaaaatgggagcaaaccgcgggccatcgtggtggatccagtgcacggattcatgtactggaccgactggggcactcctgcgaagatcaagaaggggggactgaacggagttgatatctactccctcgtcaccgaaaacattcagtggcccaatggaataactctggacttgctctcaggcagactctactgggtggactcgaagctgcactccatcagctccatcgacgtgaatggcggaaaccgcaagactattttggaggatgagaaacggctggcacacccgttttctctggcggtgttcgaagataaagtgttttggacggacattatcaacgaagccatcttcagcgccaatagactgaccgggagcgatgtgaacctcctcgccgaaaacctgctgagcccggaagatatggtgctcttccataacctgacccaacctcggggagtcaactggtgtgaacgaaccaccctgtcgaacggaggatgccagtacctctgtttgccagccccgcagatcaacccgcactcgccgaagttcacttgcgcatgtcctgacggaatgctgctggcccgcgacatgcgctcgtgcctgacggaagcggaggccgccgtggcaacccaagagactagcactgtgagactgaaagtctcaagcaccgcggtgaggactcagcacaccaccactagacctgtgcccgacacctccagactccccggagccacgccgggactgactactgtggaaatcgtcacgatgtcgcaccaagcactgggagacgtggcgggcagaggcaacgagaaaaaaccatcgtcagtccgcgccctctccatcgtcctcccgatcgtgctgctcgtgttcttgtgcttgggcgtgttcctgctgtggaaaaactggcgccttaagaacatcaattccatcaattttgacaacccggtgtatcaaaagaccactgaggatgaagtacatatctgccataaccaagacggatactcgtacccatccagacaaatggtgtcgctcgaggacgatgttgcc

SEQ ID NO: 16333 - DNA, 2580 bp, Artificial Sequence
  Description of Artificial Sequence: Synthetic coding sequence
atgggtccttgggggtggaaactgcgctggacagtcgccttgctgctcgccgctgcgggcacagccgtgggggatcgatgtgaaagaaatgaatttcagtgccaggacgggaaatgcattagttataaatgggtctgtgatggatccgctgagtgccaggacggatcagatgagtcccaagaaacatgtctcagtgtcacctgcaagtcgggggactttagctgcggcggaagagtgaatagatgcattccccagttctggagatgtgatggccaggttgactgtgacaatggcagcgacgagcagggctgtcccccaaagacctgttcacaggatgaattcagatgccacgatggcaagtgtatctctaggcaatttgtgtgcgactctgaccgtgactgtctggacggatccgatgaagcatcctgccccgtgcttacgtgtggcccggcgagcttccaatgcaattcctctacttgcatcccacagctgtgggcctgcgacaatgaccccgattgtgaggacggttcggatgagtggccacagagatgtcgcggactctatgtatttcaaggggatagtagcccctgttctgcattcgaattccactgtttgagcggcgaatgcatccatagctcctggcgatgcgacggggggcctgactgtaaagacaagtctgacgaagagaattgcgccgtggctacatgtcggccggacgagttccagtgctcagatggcaattgcatacatggaagccggcagtgtgatcgggagtacgactgcaaggatatgtcagacgaggtaggatgtgtgaatgtgacactctgcgaaggccccaacaagttcaaatgtcacagcggtgagtgtataaccctggataaggtgtgtaatatggcccgcgattgtcgcgattggagcgatgagcctatcaaggagtgtggtacaaacgaatgcttggacaataacggaggttgctcacatgtgtgtaatgacctgaaaataggcgccgagtgtctttgcccagacggtttccagttggttgctcaacgtcgatgcgaagacatcgacgagtgccaagacccggacacctgtagccagctgtgtgttaatctcgagggtggttacaaatgtcagtgcgaagagggctttcaacttgacccacacaccaaagcctgcaaggcagttggatcaatcgcatacctgttctttactaaccgacacgaggtgcgaaagatgacgctggaccgatccgagtataccagtctgattcctaacctcagaaatgtggtggcccttgacaccgaggtagcgtctaaccgtatctattggagcgatctgtcccagcgcatgatatgctccacacagttggatagagcccacggtgtctcaagttatgacacagtgatcagcagggacatacaagcaccggacggactggctgttgactggatccattccaacatctattggacagactctgtcctcggcactgtcagcgtggccgacacaaagggtgtaaaacggaagacgctcttccgggaaaacgggtccaaaccccgggcaatcgtggtcgacccggtgcacggctttatgtactggacagactggggaacaccggccaagattaagaaaggcggcttgaatggtgtggacatatactccctggtaacggagaacatccagtggccgaacggcataaccctcgacctgctctcaggcaggctctactgggtggactctaaactgcatagtatctcatcaattgatgtgaacggcgggaatagaaagaccatactggaagatgagaaacgactagcgcatcctttctcgcttgccgtgtttgaggacaaagtcttctggactgacattattaatgaggctatcttctccgctaaccggctcaccggatccgatgttaacctactggccgagaacttactgtcacccgaagacatggtactctttcacaacctgactcagcctcggggcgtgaattggtgcgaaaggactaccttgagtaacggaggttgccagtacttgtgtctccccgccccccagatcaatccccattcccctaaatttacatgtgcttgtcccgacgggatgttactcgcaagagatatgcgtagttgcttgacagaggccgaggctgcagtagcaacgcaggagactagcacggtcagattgaaggtctcgtctacggccgttaggacccagcacactaccacaagaccagtgccggatacaagcagattaccaggggctacccccggcctcactaccgtcgagatagtaacaatgtcacatcaggccttgggcgatgtagcaggcagaggcaatgaaaaaaagccatccagcgtgcgagcactctcaatcgtgctccctatcgttctcctcgtttttctgtgcttgggagtttttctgctttggaaaaattggcgactaaaaaacatcaactcgattaatttcgataaccctgtgtatcagaagacaactgaagacgaggtgcacatctgccacaaccaggacggctattcctacccctcgcggcagatggtaagtttagaggatgacgtcgct

SEQ ID NO: 16334 - DNA, 2580 bp, Artificial Sequence
  Description of Artificial Sequence: Synthetic coding sequence
atgggcccctggggatggaaattacgttggacagttgcgctgctgcttgccgccgcgggtaccgcggttggcgaccggtgtgaaaggaatgagttccagtgtcaagacggaaaatgtatcagctacaaatgggtctgcgatggatccgcggagtgccaggacggaagcgatgaatcccaggaaacctgtctaagcgtgacatgcaaaagtggagatttttcatgcggcggacgggtcaaccgctgcattccacagttttggcggtgcgatgggcaagtcgactgtgacaatggctctgatgagcagggttgccctccaaagacctgtagccaggacgaattccgctgccatgacggaaagtgtatctcaaggcagttcgtgtgcgatagtgacagggattgcctggatgggtcggacgaggcttcctgcccggtgcttacttgtggccccgctagctttcagtgcaatagtagcacgtgcattccacaactgtgggcatgtgataacgatccagactgcgaggatggatctgatgagtggccccagcggtgtcgcggactgtatgtgtttcagggtgactccagtccctgctccgccttcgaatttcactgtctgagtggagaatgtatccactcgagttggagatgtgatggggggcctgattgcaaagacaagagtgatgaggagaattgtgcagttgcaacttgccggcctgacgaatttcaatgcagtgacggaaactgcatccatggcagccggcagtgcgatcgggagtacgattgtaaagatatgtcagatgaagtggggtgcgttaacgtgaccctttgtgagggccctaacaagtttaagtgccatagtggggagtgcatcactctggataaagtctgtaatatggcaagagattgtcgtgattggtcagatgagccaatcaaagaatgtgggaccaacgaatgcctggacaataacggcggatgctcgcatgtctgtaatgacctgaagattggtgctgaatgtttgtgtccagatggcttccagctagtggcccaacggcggtgcgaggatatagacgagtgccaggacccagatacctgttctcagctgtgcgttaacctcgaggggggctacaagtgtcagtgcgaggagggatttcagcttgatccgcacactaaagcttgtaaagcggtcggatccatcgcatatttgtttttcacgaacaggcatgaagtccgcaagatgaccctggatagatccgagtatactagtcttatacctaatctgcgaaatgttgtagcgctcgacacggaagtggcctctaatcgcatctattggagcgatttgtctcaacgcatgatttgttccacccagttggatagggcacacggggtcagctcatatgacaccgtgatctcccgggacatccaggctccggacggattggctgttgactggattcacagtaacatttactggaccgactccgtcctagggacggtgagtgtggcggacactaaaggcgtgaaacggaaaaccctgttccgcgaaaatgggagcaaaccccgcgctatcgtggtagacccagtgcacggttttatgtactggactgactggggcacaccagccaagattaaaaaaggtggtctgaatggggtggatatttattccttagtgaccgaaaatattcagtggcccaatggaatcaccctggatcttctgagcggtaggctctactgggtggactcaaaactgcactcaatttcctccatagacgtgaatggtggtaaccgcaagactattcttgaggatgagaagagacttgcacaccctttttcccttgcagtttttgaggacaaggttttttggacagacataattaatgaggctatattttccgctaacagactcacagggagcgacgttaacctcttggcagagaatttgctgagtcctgaggatatggtgctctttcacaacttgacacaaccaagaggagtgaattggtgcgagaggactacgctcagcaacggaggctgtcagtacctttgcctaccagccccacaaattaatccccattcccctaagttcacctgcgcttgtccagatggaatgcttcttgcccgggacatgagatcttgcctcaccgaagccgaagcagccgtagctacccaggagacgtctactgtgagacttaaagtctctagtactgccgtgcgcacccagcacacgacgacacggcctgtcccagatacgtctaggttacctggtgctacacctggcctgacaacagtcgagattgttaccatgagccatcaagcccttggggatgtggcaggcaggggtaacgaaaagaagcctagtagcgtgagggcgctctccattgttcttccaatagttctgctggtgttcctgtgcctcggtgtattcctgctatggaaaaactggcgattgaagaatatcaactccatcaattttgataatcccgtgtaccagaagacaactgaagacgaagtccacatctgtcataatcaggacggctattcctatccctccagacagatggtgtctctggaagatgacgtggct

SEQ ID NO: 16335 - DNA, 2580 bp, Artificial Sequence
  Description of Artificial Sequence: Synthetic coding sequence
atggggccctggggatggaagttgcggtggaccgtggcattgctcctggcagccgcaggaaccgccgtgggagatagatgtgaacgcaacgaattccaatgtcaggacggcaagtgtatttcctacaagtgggtgtgtgatgggtcggcggagtgtcaggacggatccgatgagagccaagagacttgcctgtcggtcacctgtaaatccggagatttctcgtgtggtggtcgcgtgaataggtgtattcctcagttctggcggtgtgatggacaagtcgattgcgataatggatcggatgaacaaggatgccctccgaaaacctgcagccaggacgagtttagatgtcatgatggcaagtgtatctccagacagtttgtctgtgattcagatcgggattgtctggatgggtccgacgaagcgtcgtgccctgtgcttacttgtggccccgcttcctttcaatgcaactcctcgacctgcattccccaactgtgggcatgcgacaatgatcccgattgcgaggacggatcggatgagtggccgcaaagatgccgcggactttatgtgtttcaaggtgattcctcaccatgctcggcgtttgaatttcactgtctgtccggagaatgtattcatagcagctggcgctgtgatggaggaccagattgtaaagacaagtcggacgaggagaactgtgcggtcgctacgtgtagaccggatgaatttcaatgtagtgatggcaactgtatacatggttcccgtcaatgcgatcgagaatacgattgtaaggacatgtcagatgaggttggatgcgtgaacgtcactctctgcgagggtcctaacaagtttaagtgccattccggagagtgcattaccctcgataaggtgtgtaacatggccagggattgtcgggattggtccgatgagccaatcaaggagtgcggaacgaacgaatgtctggacaacaatggcggatgttcacacgtttgcaacgatctgaagattggcgcggaatgcctgtgcccagatggattccagctcgtggcacagagacgatgtgaagatatcgacgaatgtcaagatccagacacgtgttcccagctctgtgtgaaccttgagggtggttacaagtgccaatgcgaagaaggatttcagctcgacccacacactaaggcatgtaaagcggtcggttccatcgcatatctctttttcacgaaccgacatgaggtccgaaagatgacgctcgacaggtcggaatacaccagcttgataccaaaccttagaaatgttgtggctcttgacactgaagtggcctcgaaccgaatctactggagcgacctttcccagagaatgatttgctcaacccagctggatcgggctcatggtgtgtcctcctatgataccgtcatttcgcgggatattcaagcacctgatgggcttgcagtcgactggattcacagcaacatttactggactgactcagtgcttggaaccgtgagcgtggctgatactaaaggtgtcaagcggaaaaccctttttagagaaaacgggtcaaaacctagggcgatcgtggtggatcctgtgcatggttttatgtactggaccgattggggcacccctgccaagattaagaagggtggacttaatggcgtggacatatactcgcttgtgactgagaacattcagtggccaaacggcataactctggatttgctttcgggaagattgtactgggtggactcgaagttgcatagcatttcttcgattgacgtcaacggaggcaatcggaaaaccattctggaagatgagaagaggcttgcccatccgttttcactcgcagtctttgaagataaggtcttttggactgatatcattaacgaggccatcttctccgcaaacaggcttactgggtcagacgtgaatctcctggccgagaacctgttgtcgccagaagatatggtcctgtttcacaaccttactcagccaagaggtgtgaactggtgtgaacgcactaccctttccaacggcggctgccaatacctgtgccttcctgcaccgcagattaatccccattcaccaaagttcacctgcgcctgtccggatggaatgcttctggcacgagatatgcgctcgtgtttgaccgaagccgaagccgccgtggcgactcaggaaacttccactgtgcggttgaaggtgtcgagcactgcggtgcggacgcaacacactaccactcggcccgtgcctgacacttccagactcccgggggcaaccccaggtctgactaccgtcgagattgtcactatgtcgcaccaggcactgggcgacgtggccggacgcggcaacgaaaagaaaccttcatcggttcgtgccctgagcattgtgctgcctatcgtgcttcttgtctttctttgtctgggggtgttccttctgtggaagaattggcggctgaaaaacatcaactcgatcaattttgataacccggtctaccaaaagaccacggaagatgaggtgcatatatgtcacaatcaggatggttactcgtacccctcacggcaaatggtgtcgctggaagatgacgtggca

SEQ ID NO: 16336 - DNA, 2580 bp, Artificial Sequence
  Description of Artificial Sequence: Synthetic coding sequence
atgggaccgtggggctggaagttgcgctggacggtggcccttcttctcgccgccgcaggtactgccgtcggggaccgctgcgagcggaatgagttccaatgccaagacggaaagtgtatctcgtataagtgggtgtgcgacgggagcgctgaatgccaagatgggtcagacgagtcccaggaaacttgcctgagcgtgacttgcaagagcggagatttctcgtgtggtggtcgggtgaataggtgcatccctcagttctggagatgcgacgggcaggtggactgcgataatggaagcgacgagcaaggctgcccgcccaagacttgctcacaagacgagttcagatgccacgacggcaaatgcatatcacggcagttcgtgtgtgattcagacagagattgcctggacggatcagacgaagcatcctgcccggtgctgacttgcgggccggcttccttccagtgtaatagctcaacttgcatcccgcagctgtgggcgtgtgacaatgatcctgactgcgaagatggatccgacgaatggccgcaacggtgcagaggactctacgtgtttcagggagattcaagcccctgctcggcctttgagttccattgtctgtcaggtgaatgcatccactcttcgtggcgctgcgacggtggacccgactgcaaggacaaatccgatgaagaaaactgcgccgtggccacctgccgcccggacgagtttcagtgttcagacggcaactgcattcatggaagccgacagtgcgatcgcgaatacgattgcaaagatatgagcgatgaagtgggatgcgtcaacgtcaccctgtgtgaaggacccaataagttcaagtgccatagcggagagtgtatcactctggacaaggtctgcaacatggctagagactgtcgcgattggagcgatgaaccgattaaggaatgcggaactaacgaatgtctggataacaacggagggtgttcccatgtgtgcaacgatctgaaaatcggagctgaatgcctgtgtccagacggattccaactcgtggcgcagcgccggtgcgaggatatcgatgaatgccaggacccagacacctgttcacaactgtgcgtcaacctcgagggaggctacaaatgccagtgtgaagagggtttccagctggacccacataccaaggcgtgcaaagcggtcggctcgatcgcctacttgttctttacgaaccgacacgaagtcagaaagatgaccctggaccgctcagagtataccagccttatcccgaatctgagaaatgtggtcgcactggataccgaagtcgcctccaatcgcatatactggtcagaccttagccaacggatgatctgttcgacccagctggaccgggctcacggagtgagctcctacgacaccgttatctcgagggacatccaagcgccggatggattggcggtggactggatccactccaacatatactggaccgactcagtgctgggaaccgtgtccgtggccgatactaagggagttaagcgcaagaccctgttccgggaaaacgggagcaagccaagagcgatagtggtggacccggtccacggttttatgtactggactgattggggaactccagcaaagattaagaagggcggactcaacggcgtggacatttacagcctggtgactgagaatatccaatggccgaacggaatcactctggatctgctttcggggcggctctattgggtggattcaaagctgcactcgatctcttcaatcgatgtgaatgggggtaataggaaaactatcctcgaggacgaaaaacgcctcgcccatcctttctccttggcagtctttgaggacaaagtgttctggaccgacatcataaacgaagctatcttttcggcaaaccggctgaccggctccgacgtgaacttgctggcggagaacctcctttcgccagaggacatggtcctcttccacaatctgactcagccacgcggcgtcaattggtgcgagaggaccactctctccaacgggggctgccagtacctttgtctccccgctcctcagatcaacccacactcgcctaagttcacctgtgcgtgccctgatggaatgctgttggcgagagacatgcggtcctgcctgaccgaggcagaggctgccgtggcaacgcaagaaacctcaacggtgaggttgaaagtctcgtcgactgccgtgaggacccagcacaccactacccggcctgttcccgataccagccgactgccgggagccactcctggactgaccactgtcgaaattgtgaccatgtcccatcaggccttgggcgatgtcgccgggagaggaaatgagaagaagccgtcgtcggtgcgcgccctgtccatcgtcctgccgatcgtgcttctcgttttcctgtgcctgggcgtctttctcctctggaagaattggcgcctcaagaacattaactcgatcaacttcgacaaccctgtgtaccagaaaacgacggaggatgaagtgcacatctgccacaaccaggacgggtactcgtacccatcccgacagatggtgtccctcgaagatgacgtggct

SEQ ID NO: 16337 - DNA, 2580 bp, Artificial Sequence
  Description of Artificial Sequence: Synthetic coding sequence
atgggaccatgggggtggaaacttcgatggaccgtggcactcctgctggccgccgcggggaccgcggtgggagacaggtgcgagcgaaacgagtttcagtgccaggacggcaagtgtatctcctacaagtgggtctgcgacggctcggcagaatgtcaagacgggtcagatgagtcccaggaaacctgcctgtccgtgacttgcaagagcggagacttctcctgcggagggcgggtcaaccgctgcattccgcagttctggaggtgcgatggacaagtggactgtgacaacggatctgacgagcaggggtgcccgccgaaaacctgctcccaagatgaatttcgctgccatgacggtaagtgcatctccaggcaatttgtgtgtgactccgaccgggactgcctggacggatcggacgaagcctcctgcccagtgctgacttgtggcccggcgagcttccaatgcaattcgtcgacctgcatcccgcagttgtgggcttgcgacaacgacccagactgcgaggatggatccgacgaatggcctcagagatgcagaggactctacgtgtttcagggagacagctcgccgtgctcggcattcgagtttcactgcctgtcgggagagtgcatccactcgtcatggagatgcgacggcggacctgattgcaaggacaagtcggatgaggagaattgcgccgtggccacctgtcggccagatgaatttcagtgttcggacggaaattgcatccacggctcgcgccagtgcgaccgcgagtacgattgcaaagacatgagcgatgaagtgggatgtgttaacgtgaccctgtgcgagggtccgaacaagttcaagtgccattcaggggaatgtatcacgctggataaggtgtgtaacatggctagggactgtcgggattggagcgatgaacccatcaaggaatgcggaactaacgaatgccttgataacaacggcggctgtagccacgtctgcaacgatctgaagatcggagctgagtgcctctgcccggacggttttcagctggtggcacaacgccggtgcgaggacatcgatgaatgtcaggaccctgacacttgctcacagctgtgtgtgaacctggaaggcggttacaaatgccagtgtgaagaggggttccagctcgatccacacacgaaggcctgcaaggccgtgggctccattgcctacttgtttttcaccaatcgccacgaggttagaaagatgactctcgacagatccgagtacacttccttgatccctaatctccggaacgtggtggccctcgataccgaggtggcgagcaaccgtatctactggtccgacctctcacaacgcatgatctgctcaacccagctcgaccgggcgcatggagtgtcatcatacgacaccgtcatctcaagggacatccaagctccagatggactggcggtcgactggatccactcgaatatctactggaccgattcagtgcttggcacggtcagcgtggcggataccaagggggtgaagcggaaaactctcttcagagaaaacggaagtaaacctcgggccatcgtggtggacccggtgcatggatttatgtactggaccgactggggaacgccggccaaaatcaaaaaggggggcctgaacggagtcgatatctattcactggtgaccgagaatatccagtggcctaacggcataaccctcgatctgctgtcaggacgcctgtattgggttgattcaaagttgcactccatttcgtccatcgatgtgaacggaggtaataggaaaaccattctggaagatgaaaaaaggcttgctcacccgttttcattggccgtgtttgaggacaaggtgttctggactgacataatcaacgaagcaatcttttccgctaatcggctgaccggaagcgacgtcaatcttctggcggaaaacctgctgagcccggaggacatggtcctgttccacaaccttacccagccgcgcggagtcaactggtgcgaacggactactctgtccaatggaggatgccaatacctttgcttgccggcaccgcaaatcaacccccacagcccaaaattcacctgcgcgtgcccagacggaatgctgctggcaagagatatgcgctcctgtctgaccgaggctgaagccgcggtggcaactcaggagactagcaccgtgcggcttaaggtgtcctccaccgcagtgagaacccagcacaccaccactcgccctgtgccggatacctcgcggcttccaggagctactccaggcctcacgacggtggagatcgtgaccatgtcgcatcaagccctgggagacgtcgccggaagaggaaatgagaagaaaccgagctccgtgagagccctgagcatcgtgctgccgattgtcctcctggtctttctttgccttggcgtctttctcctctggaagaactggcggctgaagaacatcaactccatcaactttgataatccggtctaccaaaagactaccgaggacgaagtgcacatttgccacaaccaagacggttactcctacccgtcccggcaaatggtttcgctggaagatgatgttgca

SEQ ID NO: 16338 - DNA, 2580 bp, Artificial Sequence
  Description of Artificial Sequence: Synthetic coding sequence
atgggaccctgggggtggaagctgcgatggacggtggccttgctgcttgccgcagccggcactgccgttggcgacaggtgcgagagaaacgagttccagtgtcaggacggcaagtgcatttcctacaagtgggtgtgcgatggttccgctgagtgccaggatggctcggatgagagtcaggaaacttgtcttagtgtaacttgtaagtctggcgacttttcctgcggaggccgagtgaatcgctgcattccccagttttggcggtgcgatggccaggttgattgtgacaacggatccgacgagcagggctgtcccccaaagacctgctcacaggacgagttccgatgtcacgacggcaaatgtatatccaggcagtttgtgtgcgactcagaccgggattgtctggacggctccgacgaagcgtcctgccccgtgctgacctgcggccccgccagctttcagtgcaattcctccacctgtattccacagttatgggcctgcgataatgatccggactgcgaggatggttcggacgaatggcctcagaggtgcaggggactgtatgtgttccagggcgatagctctccctgtagtgcatttgagtttcactgcttaagcggggagtgtatccacagttcctggcgctgcgatgggggtcctgactgtaaagataaatctgatgaggagaattgcgccgtcgctacctgccgcccagacgagttccagtgcagtgatggaaattgtatccacgggtctaggcagtgcgaccgagagtacgactgcaaagatatgagcgatgaggtgggctgtgtgaacgtgacactgtgcgaaggacccaacaagtttaagtgccattccggagaatgcatcaccctggataaagtatgcaacatggctagggattgtcgcgactggtcggatgagcccattaaagaatgcggtacgaacgagtgtttagataacaacggaggctgtagtcacgtgtgtaacgacctgaagataggggccgaatgcctctgccctgacggtttccagctggtcgctcagaggaggtgtgaagatatcgacgaatgtcaggatcccgacacatgttcccagttatgcgtgaacctcgagggaggatataagtgtcagtgcgaagaggggtttcagttagatccccataccaaagcgtgcaaggctgtaggaagcattgcttatctgttctttaccaatagacatgaagtcaggaagatgacgcttgacagatctgaatatacctctctgatccccaacctcaggaacgtcgtggctctcgatacagaggttgcatctaacaggatctactggagcgacctgtcccagcgcatgatctgtagtacgcaactggaccgtgcgcatggagtgtccagctacgacactgtcatcagccgcgacatccaagcccccgatggattggcagttgactggatccattccaacatctactggactgattccgtgctgggcactgtgagcgttgcagataccaagggtgttaagcgtaagaccctgtttcgtgaaaacggtagcaagccgcgggccatcgtagtggaccctgtacacggctttatgtattggacagattggggaaccccagccaagataaaaaaaggtgggttgaacggtgttgacatttatagcctggttacggagaatatccagtggccaaacgggatcacccttgacctgctgtccggccgcctatactgggtggattccaagctccactcaatttcttccatcgacgttaacggaggcaaccgtaaaaccattctggaggacgagaaaagattagcccaccctttcagcctcgctgtgtttgaggataaggtgttctggaccgacattattaatgaagccatcttttcggccaatagactcacaggtagcgacgtgaaccttctggctgagaaccttctaagccctgaagatatggttcttttccataacctgacccagcctagaggtgtaaattggtgcgagaggactactctctctaatggtggctgtcagtatctatgcctacctgcaccacagatcaatccccattccccaaaatttacctgcgcatgcccggatggaatgctgcttgcacgcgacatgcggtcatgcctgacggaggctgaggccgccgtggccacacaggagacaagcaccgtgaggctgaaagtgagctcgactgcagtcaggacccaacacaccactacccgcccagtacctgatacctccagactgccaggtgctactccgggtcttacaaccgtcgagattgtgacaatgtcccatcaggccttgggtgacgttgcgggcaggggaaacgaaaagaagccttccagcgtgagagcgctgtccatcgtgctgcccatcgtactcctggtgtttctgtgtctaggagtgttcctcttatggaaaaactggcgattgaagaatataaatagtatcaattttgataacccggtgtaccaaaaaacaaccgaagacgaagtccatatttgccataaccaggacggctatagctatcctagtaggcagatggtcagcttggaggatgatgttgct

SEQ ID NO: 16339 - DNA, 2580 bp, Artificial Sequence
  Description of Artificial Sequence: Synthetic coding sequence
atggggccctggggttggaagctccgatggaccgtcgctctgctgctggcagccgctggcaccgccgtgggtgaccgctgtgaaaggaatgagttccagtgccaagatggaaagtgcatcagttacaagtgggtctgtgatggctcggccgagtgtcaagacggcagcgatgagagccaagagacttgcttatcagttacatgcaagtccggagacttcagttgcggcggcagagtcaatcggtgcattcctcagttctggaggtgtgacgggcaggtggactgcgataacggctctgatgagcaggggtgtccgccaaagacctgttcgcaggacgaattcaggtgtcacgatggtaaatgcatcagccgacagtttgtctgtgactctgacagggactgtctggatggcagcgacgaggccagttgtcccgtactgacctgtgggccagccagcttccagtgcaacagtagcacctgtatcccacagttgtgggcctgtgacaacgaccccgactgcgaagacgggagtgacgaatggcctcagcgctgtagaggcctttacgtatttcagggcgatagcagcccatgttcagcttttgagttccactgcttgtcaggcgagtgcatccactcctcatggagatgtgatggtggaccagactgcaaggataaatcggacgaggaaaattgtgctgtcgcaacctgcaggccggacgagttccagtgctccgacgggaactgtatacacggctctcggcagtgcgacagagagtatgattgcaaagatatgtccgatgaagtaggctgtgtaaatgtaaccttgtgcgaggggccaaacaagtttaagtgccactctggtgagtgcatcactctagacaaagtgtgtaatatggctagagactgcagggattggtctgatgaacccatcaaagagtgtgggacaaatgaatgcctggacaacaatggcggctgcagccatgtgtgcaatgacttgaagattggtgccgagtgtttatgcccggatgggtttcagctcgtggcccagcgtcgttgcgaagacatcgatgagtgtcaggatcccgacacatgtagccagctatgcgtaaacctggaagggggctacaagtgtcagtgcgaggaggggttccaacttgatccacacaccaaagcatgcaaggccgtgggatcaattgcctacttgtttttcaccaaccggcacgaggtgcggaagatgacactggatcggtctgaatatacctcactgatacctaatctaaggaacgtggtggcgctggacactgaagtggccagcaaccggatctactggtcagacctcagccagagaatgatatgtagcacccagctagacagggcacacggagtttcttcatatgacactgtaatttcccgggacattcaggccccagatggcctggcggtggactggatccacagtaacatatactggaccgatagtgtgctaggaaccgtttccgtggccgatactaaaggagtgaaaaggaagactttgttccgggaaaatggaagcaagccgcgagcgattgtggttgacccagttcacggcttcatgtattggaccgattggggcaccccggccaagatcaagaagggaggcttgaacggcgttgatatctacagtttggtgaccgagaatatacagtggcctaacggaatcacactggacctcctcagcggcagactgtattgggttgatagcaagctacattctatctcaagtatcgacgtcaacgggggcaaccggaaaacaatcttggaggacgagaagcggctcgcccaccctttttcactagccgtctttgaagacaaggtgttttggactgatatcattaacgaggccatattttccgcgaatcggctgactggcagtgatgtgaatctgctcgcggagaacctgctgagccctgaagacatggttctatttcataacctcacacaaccccgaggggtcaactggtgcgagaggacaacactgagcaacggcggatgtcagtacctgtgcctgccagctccccagatcaaccctcactcgccgaaattcacctgcgcttgcccagatgggatgctcctcgctagggatatgaggtcctgtctgactgaagcagaagccgctgttgccacacaagaaacctctactgtcagactgaaggtttccagcaccgccgtccggactcagcacactacaactcgtccagttccagacacgtcccgcttaccaggagcaaccccgggcctgaccacggttgaaattgtgactatgagccatcaggccttgggggatgtagctggacgcgggaatgaaaaaaaaccatcttccgtgcgggctttatctatcgtgctacctatcgtgctcctggtgtttctctgtctgggagtctttctcctctggaagaattggagattgaaaaatatcaattcaatcaattttgataaccctgtctaccagaagacaactgaggacgaagtccacatctgtcacaatcaggacggctactcctatcctagcagacagatggtcagcctagaggatgacgtcgcc

SEQ ID NO: 16340 - DNA, 2580 bp, Artificial Sequence
  Description of Artificial Sequence: Synthetic coding sequence
atgggaccatggggttggaaattgaggtggaccgttgccctactgcttgctgccgcgggaactgccgtgggagatcgctgtgaaaggaacgagttccagtgtcaggacgggaagtgcatctcctacaagtgggtgtgtgatgggagcgctgaatgtcaagacggctccgatgaaagccaggaaacgtgccttagtgtgacatgcaaatctggcgacttcagctgtggggggagagtgaatagatgtataccacagttttggaggtgcgacggccaggtggattgtgacaacgggtccgacgagcagggttgcccgcctaagacgtgttctcaggacgagtttcgttgtcatgacggaaaatgtattagccgtcaatttgtctgtgacagtgaccgggactgccttgatgggtccgatgaggcaagctgcccggttttgacttgtgggcccgcctctttccagtgcaactcgtccacatgtattcctcaactttgggcctgcgataatgacccggactgcgaagacggaagcgacgagtggcctcagcgatgtcgggggttatatgttttccagggcgatagctcaccttgtagcgccttcgagttccattgtctcagcggagaatgtattcactccagttggagatgtgacggagggcccgactgtaaggacaagagcgacgaggaaaactgcgctgtggcaacatgcagacccgatgagtttcagtgtagcgacggtaactgtatccacggttccagacagtgcgatcgcgaatatgactgcaaggacatgagtgatgaagtcgggtgcgtgaacgtgacgttgtgtgagggcccaaataagtttaaatgtcactccggagagtgtatcacacttgacaaagtatgcaatatggcacgggactgtagagattggtctgatgaacccatcaaggagtgtggaactaacgaatgcctggataataacgggggctgttctcacgtttgcaacgatctaaagattggcgcagaatgcctatgccctgacggattccaactggtggcacaacggcgctgtgaagatatagacgagtgccaggatccagacacctgcagccagctgtgcgtgaacctcgagggtgggtacaagtgtcaatgtgaagaggggttccagctggacccccatacaaaggcttgcaaagccgtcggctctatcgcctatctctttttcaccaacaggcacgaagtgagaaaaatgacgctggatcgctcagaatacacgtccctcattcctaacctgcgaaatgttgtggcactcgatacggaggttgcgtcaaataggatttattggtcagacctgtcccagaggatgatctgtagcactcagcttgatcgggcccacggagtaagttcttatgatacagtgatcagccgggacatccaagctccagatgggcttgccgttgactggatccattccaatatctactggacggattcagtgttgggaaccgtgtctgttgcagacacaaaaggtgtgaagaggaaaaccttgttcagggaaaacggctcgaagcctcgagccatcgttgtggaccccgtccatggttttatgtactggaccgattggggcacacctgccaagatcaagaaaggaggactcaacggagtagacatctattccctcgtgaccgaaaacattcagtggccgaatggcatcaccctggatctgctctccggccgcctgtactgggtggattccaaactgcattcaatttcttccattgacgtcaacggtgggaaccgaaaaactatcctcgaggacgagaaacggctggcccatcctttctccctagctgtgtttgaggacaaagtgttctggaccgacatcattaacgaagcaatattttctgccaatcgcctgaccggttccgacgtgaatcttttggcagaaaatctgctgagcccagaggacatggtgttgttccataacctcacacagcctaggggcgttaactggtgtgagcgcaccactctgtccaatggcggctgccaatatttatgtcttcctgccccacagatcaacccacactctccgaaattcacctgtgcttgtccagacggaatgctcctcgctagggatatgagatcctgtctgacagaggcagaggccgcggttgccacacaggagacatctaccgtacgtttgaaagtcagcagcacagcagtgcggacacagcacacaaccacccgacctgtgcccgacaccagtaggttacccggagctactccgggcctaaccactgttgagattgtaaccatgtctcatcaggccctcggcgatgtcgctgggagagggaatgagaaaaaaccaagcagtgttcgggccctatcaatcgtcctgccaatcgtgctgctggtttttctatgtcttggagtgttcctcttatggaagaactggcggcttaaaaatattaacagtatcaatttcgacaacccggtgtaccaaaagacaacagaagatgaggtgcacatttgtcataatcaagatggatactcgtacccaagcaggcagatggtatcgcttgaggatgatgtggcc

SEQ ID NO: 16341 - DNA, 2580 bp, Artificial Sequence
  Description of Artificial Sequence: Synthetic coding sequence
atggggccgtggggatggaaactcaggtggacggtcgcccttctgttggcggcagcgggaactgccgtgggtgacaggtgtgaacgcaatgagttccagtgccaagatggaaagtgcatctcttataagtgggtctgcgacggctcggcagagtgtcaagacggatcggacgagtcgcaagaaacgtgtctgtcagtcacctgtaagtccggagacttcagctgtggaggcagggtgaatcgctgtatcccccagttctggcgatgcgacggccaagtggactgcgacaacggaagcgacgaacagggctgcccacctaagacctgtagccaggatgagttccgctgtcacgatggaaaatgtatctcacggcagttcgtctgcgacagcgatcgggattgtctcgatggttcggacgaggcgtcctgccccgtcctgacctgcgggccggcatcgttccagtgcaactcaagcacctgcatccctcaactttgggcatgtgataatgacccggactgcgaagatggctcagatgagtggccgcaacgttgccggggcttgtacgtgttccagggagactcgagcccctgctcagcgttcgaatttcactgcctgtccggcgagtgcattcatagctcatggagatgcgacggcggacctgactgcaaggataaatcggacgaagaaaattgcgcagtggccacctgccgcccagatgaatttcagtgctccgacggcaattgcattcatggatcgcgccagtgcgatcgggagtacgactgtaaagacatgtcagacgaggtgggatgcgtgaacgtgaccctgtgcgaaggccctaataagttcaagtgccattcgggtgaatgcatcactctcgataaggtctgtaacatggcccgcgactgtcgcgattggagcgatgaaccgatcaaggaatgcggtactaacgaatgcctggacaataatgggggctgctcccacgtgtgcaacgacctgaagatcggagccgagtgcctttgcccggacggatttcaacttgtggcacagagaaggtgcgaggacatcgacgagtgccaagatccggacacttgttcccagctgtgtgtcaacctggagggcggttacaaatgtcaatgcgaggagggcttccaactggatccacataccaaggcgtgcaaagccgtcggaagcattgcgtaccttttctttacgaaccggcatgaagtgcgcaagatgactcttgatcggtccgagtacacctccctgatcccaaacctgcggaacgtcgtggccctggacactgaagtcgcaagcaatcgcatctactggtccgacctgtcgcaacggatgatatgctccacccaattggacagagcgcacggggtatccagctacgacaccgttatttcgcgcgatattcaggcaccggacggactggccgtggactggatccactcgaacatctactggactgactcagtcctcggtactgtgtcagtggccgatactaaaggagtcaagcgcaaaacgctctttcgtgagaatggaagcaagccgcgcgcgattgtggtggaccccgtccacggatttatgtactggaccgattggggaaccccggccaagataaagaaaggcgggctgaacggcgtggacatctacagcctggtgaccgagaatatccaatggcctaacggaattaccctggaccttctgtcgggaagattgtactgggtggactcaaagctgcactctatctcatcgatcgacgtgaacggaggtaaccgcaagaccatcctggaagatgaaaagcgactggcacacccgttcagcctcgcggtgttcgaagataaggtgttttggaccgacatcatcaacgaagcaattttcagtgcgaatcgcctgactggttctgacgtgaacctcttggcggaaaacctcctgtccccggaagatatggtgctgttccacaacctcactcagccgagaggagtgaactggtgtgagagaaccaccctgtcaaacggaggatgtcagtacctttgcctgccagcccctcagatcaacccccattccccaaagtttacgtgtgcttgtcctgatggaatgctgctcgcccgggatatgcggagctgcctgaccgaggccgaagcagccgtcgcgactcaggaaacgtcaactgtgcgcctgaaggtttcgtcgactgccgtgcggacccagcacactactacccgcccggtgccggatacctccaggctgccgggagctaccccaggcctgactaccgtggaaattgtcactatgtcccaccaagccctgggagacgtggcggggaggggcaatgagaaaaagccttcgtccgtgcgggccctgtcgatcgtgctgccaatcgtgctgctggtgttcctgtgcttgggagtctttctcctgtggaagaattggcggctgaagaacattaacagcatcaattttgacaacccggtgtaccagaaaactactgaggatgaggtgcatatctgccacaatcaagacggatactcgtacccctcccgccagatggtgtcgctggaggacgatgtggct

SEQ ID NO: 16342 - DNA, 2580 bp, Artificial Sequence
  Description of Artificial Sequence: Synthetic coding sequence
atgggaccgtggggatggaagttgcgttggactgtcgccctcctgttggctgccgccggtactgccgtcggtgaccgctgcgagcgaaacgagttccagtgccaggatggtaagtgcatcagctacaagtgggtttgtgatggaagcgcggagtgtcaggatggatctgatgagtctcaggagacctgcttgtccgtcacctgcaagtccggtgacttctcctgcggtggccgtgtgaaccggtgcatcccgcagttctggcgttgcgatggtcaggtggactgcgacaacggttccgacgagcagggatgcccgcccaagacgtgctcacaggacgagttccgctgccacgacggcaaatgtatcagccgtcagttcgtgtgcgactctgatcgcgattgtttggacggctctgacgaggcttcgtgcccggttctcacgtgcgggcctgcctccttccaatgcaacagctctacctgtattccccagttgtgggcctgcgacaatgaccccgattgcgaggacggtagtgacgagtggccccaacgctgtcgaggtctctatgtcttccagggcgattccagcccttgctccgccttcgagtttcattgtctcagcggtgagtgcattcacagctcctggcgttgtgacggtggtcccgactgcaaggataagtctgatgaggaaaactgcgccgtcgcgacatgcagaccagacgaatttcaatgctcggatggtaactgcatccacggttcccgccaatgtgaccgcgagtacgactgcaaggatatgagtgacgaggttggctgcgtgaacgttacactctgtgagggtcctaataaattcaagtgtcactccggcgaatgcatcaccttggacaaggtctgtaacatggcgagggattgcagggactggagcgatgagcccattaaggagtgcggcaccaacgagtgtctcgataacaacggtggctgctctcacgtctgcaacgacctcaagatcggtgcagagtgcctgtgcccggatggtttccagctcgtcgcccagcgccgatgcgaggatatcgatgagtgccaagatcccgatacttgctctcagctctgcgttaatctagaaggtggttacaagtgtcagtgcgaggaaggtttccagctggacccccacacgaaggcttgcaaagcggttggttcaatcgcttaccttttcttcaccaatcgccacgaggtaagaaagatgacattggatagatccgagtataccagcctcatcccgaatctgaggaacgtcgtggctcttgataccgaagttgctagtaaccggatttactggtctgacctcagtcagcggatgatctgcagcacccagctggacagagcccatggtgtcagcagctacgacactgtcatttctcgtgacatccaggcccctgatggacttgccgtcgattggatccactcgaatatctactggaccgattccgttctgggcaccgtcagtgtcgcggacacaaagggagttaagagaaagactcttttccgtgagaacgggtccaagccccgagccatcgtggtcgatccggtccacggctttatgtattggaccgattggggaacccctgctaagatcaagaagggcgggctgaacggcgtcgatatctattctctcgtcaccgagaacatccaatggcccaacggtatcactcttgacttactttcgggtcgtctctactgggttgattctaagctgcattctatctccagcattgacgttaacggtggtaatcggaagactatcctggaggatgagaaacgtctcgcccatcctttctccctggcagtgtttgaagacaaggtgttttggacggacatcatcaacgaagcaattttctcggctaatcgtctgaccggctctgacgtcaaccttctcgccgaaaatctcctgtcgcccgaggatatggtgttgttccacaacctcacccagcctcgaggagttaactggtgcgagagaacgacgttgtctaatggtgggtgccagtacctctgccttcctgcccctcagatcaacccgcactccccgaagttcacctgtgcttgtcctgatggtatgctgctcgcccgagatatgcgttcctgcttgacagaggccgaggctgcggtcgcgactcaggagacctccaccgtaagactgaaggtctccagtacagccgtccgcacccagcacaccactacccgtccggtccctgatacttcccgcctacctggggcaacgcctggactgacaaccgttgagatcgtcactatgtcccatcaggcccttggagacgtcgctggaagaggcaacgagaagaagccgtcctcagtgcgcgccctaagcatcgtgttgcctatcgtcttgctcgtgttcttgtgcctcggggtgtttcttctgtggaagaactggcgcctgaagaacattaactcaattaacttcgataatcccgtctatcaaaagaccaccgaggacgaggttcacatctgtcataaccaggatggttacagttatccgagtcgccagatggtctcgttggaagacgacgtcgcg

SEQ ID NO: 16343 - DNA, 2580 bp, Artificial Sequence
  Description of Artificial Sequence: Synthetic coding sequence
atgggtccctggggctggaagctgcggtggacggtagcactcctcctggccgcagcaggaaccgcagtgggcgaccggtgcgaacggaacgagtttcagtgtcaagatggaaaatgcatttcgtacaaatgggtctgcgacgggtcggcggagtgccaggacggatctgatgaatcacaggagacttgtctttccgtcacttgcaagtccggagatttctcgtgcggaggacgcgttaatagatgtatcccccaattttggcgttgcgatggacaggtggactgcgacaatggctcagatgaacaggggtgtcctccaaagacttgttcacaagatgaattccgctgccatgatggcaagtgcatctcaaggcagttcgtgtgcgattcggatagagactgcctggacggaagcgatgaggcttcgtgcccggtgctgacttgtggcccagcctcgttccagtgcaattcgtccacttgtatccctcaattgtgggcgtgcgataatgatccagactgcgaggacggctccgatgagtggccccaacgctgcagaggactctacgtgttccagggagactctagcccgtgctccgccttcgaatttcattgcctcagcggagaatgcattcattcgagctggcggtgcgacggaggccctgattgcaaggacaaatccgacgaggaaaactgcgctgtggccacttgccgcccggacgagtttcaatgctcagacgggaactgcatccatgggtcgcggcagtgcgatcgcgaatacgactgtaaggatatgtccgatgaagtgggatgcgtgaatgtcaccctgtgcgaaggaccgaacaaattcaagtgccactccggagagtgcataaccttggataaagtatgcaacatggctcgggactgcagggactggtccgacgaacccatcaaggaatgtggaactaacgaatgtctggacaataacggaggatgcagccacgtctgtaacgatctgaagatcggcgctgagtgcctgtgtccggatgggttccagcttgtagcccaaaggcggtgcgaggacatcgacgaatgccaagaccctgacacctgttcccagctttgcgtcaacctggaaggaggatacaagtgtcaatgcgaggaaggattccagctggacccacacaccaaggcatgtaaagccgtgggaagtatcgcgtacctgttcttcaccaaccggcacgaagttcggaagatgaccttggacaggagcgaatacacttccctgatcccaaacctgcgcaatgtggtggccctggatactgaggttgcctcgaataggatttactggtccgatctgtctcagcgcatgatctgtagcacccagttggaccgggctcatggcgtgtcatcctacgacactgtcatatctcgcgacatccaagcgccggacggactggcggtggattggatccactcgaatatctactggaccgactccgtgcttgggacggtttcagtggccgacaccaaaggtgtgaagcgcaagaccctctttagagaaaacggctcgaagccacgcgctatcgtcgtcgacccggttcatggcttcatgtactggacggactggggtactcccgcgaagatcaagaaggggggcctgaatggagtggatatctatagccttgtgactgaaaacatccaatggccgaacggaataacgctggacctgctgtcgggccgtctctactgggtcgactcaaagctgcacagcatctcgtcaattgatgtcaatggaggtaatcgcaaaaccatcctcgaggacgagaaacggctggcccacccattttccctggccgtgtttgaggataaggtgttttggaccgacattatcaacgaagcgatcttttccgccaatcgactcactgggtcggacgtgaaccttctggccgagaaccttctctcaccggaggacatggtgctgttccacaatctcacccagccgagaggtgtgaactggtgtgaacgtaccactctgtcgaacggcggatgccaatacctttgcctgccggctccacagatcaacccgcactctccgaaattcacctgtgcatgcccagacggaatgctgttggcccgcgatatgaggtcttgtctgacggaggccgaggccgctgtggcaacccaggaaacttccaccgtcagattgaaggtgagctcaacggcagtccgaacccagcacactactacccggcccgtcccggatactagccgcctgccgggagccactcccggactgactacggtggaaatcgtcaccatgtcacatcaggcccttggagacgtggcaggtcgcggaaacgagaagaagccctcatccgtgagagccctgtcgatcgtgctcccgatcgtgttgcttgtgttcctctgcctcggcgtgttcctgttgtggaagaactggcggctgaagaacatcaactcgattaactttgataaccctgtctaccagaaaaccactgaggacgaggtccacatctgtcacaatcaggacggttatagctacccgtcccgccaaatggtttccttggaagatgatgtggcg

SEQ ID NO: 16344 - DNA, 2580 bp, Artificial Sequence
  Description of Artificial Sequence: Synthetic coding sequence
atggggccgtgggggtggaaacttcgatggaccgttgcactgctgttggcggctgcggggactgcggtcggggatcggtgtgagagaaacgaattccaatgccaggacggaaagtgcatctcgtacaagtgggtctgcgacggatccgccgaatgccaggatggctccgatgagagtcaggaaacttgcctgtcggtgacttgcaagagcggggacttttcttgtggaggacgcgtgaaccgatgtatcccacaattctggcggtgcgatggtcaagttgactgcgacaatggatccgacgaacagggatgccctcctaagacgtgctcacaagatgaatttcggtgccacgatggcaagtgtatctcgcgccagttcgtgtgtgatagcgatcgggactgcctcgacggctccgacgaggcttcatgcccggtgctgacctgcggaccggcctcgttccagtgcaattcctccacgtgcatcccgcaattgtgggcgtgtgacaatgatcccgattgcgaggacgggtcagatgaatggccgcaacgctgccggggactgtacgtgttccagggggattcctcgccgtgtagcgcattcgagttccattgcctctcaggcgaatgcatccactcgagctggagatgcgacggtggaccggactgtaaggataagtcggacgaggaaaactgtgctgtggccacgtgccgccctgatgagttccagtgctcagacggcaattgcatccatggatccaggcaatgtgacagggagtacgattgcaaggacatgtcggacgaagtcggctgcgtgaacgtgactctttgcgagggacctaataagtttaagtgccactcgggagagtgcatcaccctcgacaaggtgtgcaatatggcgcgcgactgccgggactggtcagacgagccaatcaaggaatgtggcactaatgaatgcctcgacaacaatggaggatgttcgcacgtttgcaatgatctcaaaatcggcgctgaatgtttgtgcccagacggttttcagttggtggcgcagcgccgatgcgaagacatcgatgaatgccaagacccggatacttgctcacagctctgtgtgaatttggaaggaggctacaagtgccaatgcgaggaaggattccaactggatccgcataccaaagcctgcaaggccgtgggatcaatcgcatatctgttcttcaccaaccggcacgaagtgcgcaagatgaccctggaccgctccgaatacacctccctcatccctaacctccgcaatgtcgtggccctggacaccgaagtggcctccaaccggatctattggtccgatctgtcccagcggatgatctgtagcacccagttggatagggctcacggagtgtcgtcttacgacaccgtcatctcgcgcgatatccaggcgccggatggactggcggtggactggatccatagcaacatctactggaccgattcggtgctcggtactgtgtcagtggccgatactaagggagtaaagcgcaagaccttgtttcgcgaaaacggatccaaaccgcgggccatcgtcgtggaccctgtgcatggctttatgtactggactgattggggtacgccggccaaaatcaagaagggtggcctgaacggcgtggacatatactcgttggtgaccgaaaacatccagtggcctaacggcattactctggatctcctctcgggcaggctgtactgggtggattcgaaactgcactcgatctcatccatcgacgtgaacggaggaaacagaaagaccatccttgaagacgagaaacgcctcgcccacccgttttccctcgcagtgtttgaggataaagtcttttggaccgacatcatcaacgaagccatcttctccgcaaatcggctgactgggtcggacgtgaacctgctcgccgagaacctgctgtcgccggaagatatggtgctcttccacaacctcacccaaccgagaggcgtgaactggtgcgaacggaccactctctcgaatggcggatgccagtacctttgtctgccggcccctcagatcaatccccacagcccaaaattcacctgcgcctgcccggacggaatgcttcttgcgagagatatgcgcagctgcttgacggaagcggaggctgcggtcgccactcaagaaacttcgaccgtgcggttgaaggtgagctccactgccgtccgcacgcagcacaccactactcggccagtgcccgacacttctcgtttgccaggcgcgactcccggcctgactacggttgagatcgtgactatgtcccaccaagccctgggagacgtggcaggaagaggaaacgaaaagaaaccatcctccgtgcgggcgctctccatcgtcctgcctatcgtgctgctggtttttctgtgcctgggagtgttcctgctgtggaagaattggagactcaagaacatcaattcgatcaatttcgacaaccccgtgtaccaaaagactaccgaagacgaggtgcacatctgccacaaccaggatggctactcgtacccttccagacaaatggtttcactcgaggatgacgttgcg

SEQ ID NO: 16345 - DNA, 2580 bp, Artificial Sequence
  Description of Artificial Sequence: Synthetic coding sequence
atgggcccttgggggtggaagctccgatggactgtggcattactgctggctgccgctgggaccgctgtgggcgatcgatgtgagagaaatgaatttcagtgccaagacggcaagtgcattagttacaaatgggtatgcgacggttccgcagaatgtcaggatggctctgacgagagtcaagagacctgtctgtcagtgacttgtaagtctggagatttctcctgcggaggtagagttaacaggtgcattccgcagttctggcgatgtgacggccaggttgactgcgacaatggatccgacgagcagggctgtcccccaaagacctgtagccaggatgaatttcgctgccatgatggaaaatgtattagccgccagtttgtttgcgacagcgatcgtgattgtctggatggctccgatgaagcaagctgccctgtgttgacatgcggcccggcttccttccagtgcaactcctcaacctgtattccccagctatgggcgtgcgataatgatccagattgtgaggatgggtccgacgagtggcctcaacgctgccgagggctgtatgtcttccagggcgactcttccccctgttctgcttttgagtttcactgtctgtctggagagtgcatacatagctcttggcgttgtgacgggggcccggactgtaaggataagagcgatgaggagaattgtgctgttgctacctgtcgcccagacgagttccaatgcagcgacggaaactgcattcacgggtcgcgccagtgtgacagagaatacgactgcaaggacatgtcggatgaagtgggatgcgtgaatgtgaccctttgtgaaggccctaacaagttcaaatgtcactcgggcgaatgcattactttggacaaagtgtgcaatatggctagagactgccgggattggtccgacgaaccgattaaggagtgcggaaccaatgagtgcctcgacaataacggcggttgctcccacgtctgtaatgatcttaagataggagcagagtgtttatgccccgacggatttcagttggtggcacagcgtagatgcgaggacatcgacgagtgtcaggaccctgacacttgctctcaactgtgcgtcaacttagaaggtggttacaaatgccagtgtgaagaaggatttcagctcgatcctcataccaaggcttgtaaggccgtgggatccattgcttatctgttctttaccaacagacacgaagtgcgtaagatgacactggatcgctctgaatacactagcttgatccctaatctgcgcaacgtggtggctctcgacactgaggtggccagcaaccgcatctattggagtgacctgagccagagaatgatctgctcgactcagctcgatcgtgcccatggagttagctcttatgacacagtcatctcacgggatatacaagccccggacgggctcgcagttgattggatccactcaaacatctactggaccgattcagtgttgggaacagtgtccgtggccgataccaagggagttaaacggaaaaccctgtttagggagaatggctcgaagcccagggcgatagtcgtggaccccgttcacgggttcatgtactggaccgattggggcacacccgctaaaattaagaagggtggcctcaatggcgtggacatttacagtctggtgacagagaacatacagtggcccaacggaatcactctggacttactcagtggcaggctttactgggtcgattccaaattgcattccatatcaagcattgatgtgaacggaggcaaccgcaagaccatactagaagatgagaaacggctggcacaccctttttctctcgcagtgttcgaggacaaagtattctggaccgatataattaacgaggcaatcttttccgccaacagactgacgggatcggatgttaacttgttggcggaaaacctgctgtccccggaggatatggtgctatttcacaacctgacacagcctcgcggcgtcaattggtgcgaacggacaaccctttcaaatggtggatgccagtatctctgcctgcccgctccacaaatcaacccccactcaccgaaatttacttgcgcatgcccagacggaatgttactggccagggacatgagaagctgtctgacagaggctgaggctgctgtcgcgacacaggagacctccaccgttcgcctcaaggtaagctctacagcggtgcgcactcagcatacaacaactcgaccagtgcccgatacctcgcgattgcccggcgctacccctggcttaacaactgtagagatcgtgacaatgtcccaccaggctttgggcgatgtcgctgggcggggcaacgagaaaaaaccttcttctgtccgagctctctcaattgtattgcctattgtgctgctggtgttcttgtgtctcggggtcttcctgctgtggaaaaactggaggctgaaaaacataaactccattaatttcgataatcccgtctaccagaaaacaaccgaggatgaagtgcatatctgccacaatcaagacggctactcttacccctccaggcagatggtttctctggaggacgacgttgct

SEQ ID NO: 16346 - DNA, 2580 bp, Artificial Sequence
  Description of Artificial Sequence: Synthetic coding sequence
atggggccctggggatggaagctgaggtggactgtcgctctgcttcttgcggcagccgggacagcggtcggcgatcggtgtgagcgcaacgagttccagtgccaggatgggaagtgtattagctataagtgggtgtgtgacgggtccgccgagtgccaggacggcagcgatgaatcacaagagacgtgcctaagtgttacctgcaagagcggcgactttagctgtgggggtcgcgtgaaccggtgcataccacagttctggcggtgcgacggccaagttgattgtgacaatggcagtgatgaacagggatgccctccaaaaacatgtagccaggacgagtttcgatgccacgacggcaagtgcatttcgcgccagtttgtttgcgactcagaccgcgactgtctggatggcagtgacgaagccagctgccccgttctgacttgcggccccgcatcctttcaatgtaattccagtacttgtatccctcagctgtgggcgtgcgacaacgacccggattgcgaggatggaagcgatgaatggccccagcggtgtaggggcctctacgttttccagggagactcaagcccgtgtagtgcattcgagtttcactgccttagtggagaatgcatccacagtagttggagatgtgacgggggtcccgactgtaaggacaagtcagatgaagaaaattgtgctgtcgccacgtgccggccagacgagtttcagtgcagtgatgggaattgcatccacggaagcaggcaatgcgatagggaatatgattgtaaagatatgtctgacgaggtgggttgtgtaaatgtgactctttgcgaaggcccaaataagtttaaatgtcattcaggcgaatgtatcaccctggacaaggtctgtaacatggctcgcgactgtcgcgactggagcgacgagccaattaaggagtgtggtaccaatgaatgcctcgataataatggtgggtgttcccacgtctgcaatgatctgaagattggagcggagtgcctgtgcccagacggttttcagctggtggcccagcggagatgtgaagacatagatgagtgccaggatccagatacctgttcacaactctgtgtgaatctggagggggggtataagtgtcagtgcgaggaaggcttccagctggatccacacacaaaggcctgtaaggccgtgggctcgatagcctacctcttcttcaccaaccgtcatgaagtgagaaaaatgaccttggatcggagtgagtacacatcactcattccaaacctccgaaacgtggtggccctggatacggaggttgcttccaaccgcatttattggagcgacctaagccagcggatgatatgttcgacgcaactggatagagctcatggcgtaagctcttacgacacagtgatttccagggatatacaagcgccggacggattggccgtggactggatccactcaaatatctattggacagacagcgtgctgggcacagtgagcgttgcagacaccaaaggagtgaagagaaaaacattattccgcgagaacgggtcaaagcccagggcaattgtagtggatcctgttcatggattcatgtactggaccgactggggaacacctgcaaagataaagaagggtggtcttaacggagtggacatctactccttggtcacggagaacatccaatggcccaacggcattaccttggacctgctttctggacgcctgtattgggttgactcaaagctgcacagtatctcttcgattgacgtgaatgggggcaatcggaagacgattctggaagacgagaaacgtttggcacaccctttctcattagcggtgttcgaagacaaagttttctggacagacattatcaatgaggccatttttagcgcaaaccgacttactggctctgatgtaaacttgctggccgaaaacctccttagtcctgaagatatggtactgttccataatctgacccagccgagaggggtcaactggtgcgaacgcacaacattgtccaatggcggatgtcagtacctctgcctgccggccccccagattaatcctcactctccaaagttcacctgcgcttgccctgatggaatgcttctagctagggatatgcgatcctgtctcaccgaagccgaagctgctgtggccactcaagaaacgagcactgtccgtctgaaggtgagctctacagcagtgcgtacacagcacaccacaacccgccctgtgcccgacacgtcccggctaccgggagcaacaccagggttgaccactgtggaaattgtgaccatgtcccaccaggctctcggcgatgtggctgggcggggaaatgaaaagaagccctcttctgtacgggcgctgtccattgttctgcccattgtcctcctcgtgtttctgtgcctcggcgtgtttctgctctggaagaattggaggctaaagaacataaacagtattaattttgacaaccctgtctaccagaagaccaccgaggatgaggtccacatctgccataatcaggacggatattcataccccagccgacagatggtgtctctggaggacgacgtggct

SEQ ID NO: 16347 - DNA, 2580 bp, Artificial Sequence
  Description of Artificial Sequence: Synthetic coding sequence
atggggccgtggggttggaaactccggtggaccgtcgccctgctgctggccgcggcaggaactgccgtgggagacaggtgcgaacggaacgagttccaatgccaggacggaaagtgtatttcctacaagtgggtgtgcgacggatccgcagaatgccaagatggtagcgacgaaagccaggaaacgtgcctctccgttacctgcaagtcgggagatttctcatgtggagggcgagtgaatcggtgtatcccccaattttggagatgcgatggacaggtcgactgcgacaacggctccgatgagcaaggatgccctcccaaaacgtgctcgcaagatgagttccggtgccatgatggaaaatgcattagccgccagtttgtgtgcgacagcgaccgggactgcctggacggctcggacgaagcctcatgtcccgtgttgacctgtggcccggcgtccttccagtgcaactcgtcaacctgcatcccgcaactgtgggcctgcgacaacgacccggattgcgaggatgggagcgacgagtggccccagcgctgccgcggactctacgtgttccagggagacagctcgccgtgttcggccttcgaattccactgcctgtcgggcgaatgcatccacagctcctggaggtgcgatgggggaccagactgcaaggataaatccgacgaagagaactgcgccgtggccacctgtagaccagatgagttccaatgttcagacggtaactgcatccacggctcacgccaatgtgaccgcgaatacgattgcaaagacatgtcggatgaggtgggatgcgtcaatgtgactctgtgcgagggccctaacaaattcaaatgccattccggtgaatgcatcaccctggacaaggtgtgcaatatggcacgggactgtagggactggagcgacgaaccaatcaaggaatgcggaactaacgaatgtctcgataacaacggaggatgcagccacgtgtgtaacgatctgaagatcggcgcggagtgcttgtgtcctgatggattccaactggtggcccagagacgctgcgaggacattgacgaatgtcaggatccagatacctgctcccagctgtgcgtaaatctcgaggggggatataagtgccagtgcgaggaaggcttccagctcgatccgcatacgaaagcatgcaaggccgtgggaagcattgcctatctgttcttcaccaaccggcacgaagtgcgcaagatgaccctcgacaggagcgagtacacctccctgatcccgaacctgcggaacgtggtggcactcgatactgaagtcgccagcaaccgcatctactggagcgacctgtcccaacggatgatctgttccacccagctggatagagctcatggcgtctcgagctacgacactgtgatctcgcgcgacatacaggcccctgatggtttggccgttgattggatccactccaacatttactggaccgactcggtgctgggtaccgtgtcggttgccgatactaagggggtgaagcgcaagaccttgttcagagaaaacggaagtaaaccgcgcgccattgtggtggatccggtccacgggttcatgtactggactgactggggcacccccgcgaagatcaaaaaaggaggactgaatggagtggatatctacagcctcgtgactgagaatatccaatggcctaatggaatcaccctggatctcctctcaggacgcttgtactgggtggatagcaagctccactcgatctcgtcgatcgatgtcaatggaggaaaccgaaaaacgatccttgaagatgagaagagattggcgcatccattctctttggctgtgttcgaggacaaagtcttttggactgacatcatcaacgaagctatcttttcggcgaacagactcactgggtctgacgtgaatcttctggcggaaaacctcctctcaccagaggatatggtgctcttccacaatctgacccagcctcggggtgtgaattggtgtgaaaggacgactctgagcaacggtggatgtcagtacctctgtctccctgccccgcagatcaatccgcactcccccaaattcacttgcgcgtgccctgacggcatgctgctggcccgcgacatgcgctcctgcctcactgaagccgaagcagcggtcgcgacccaggagacttccaccgtgcgactcaaagtctcaagcaccgccgtgcgcactcaacacaccactactcggccggttcctgacacctcccgcctgccgggcgctaccccgggactgaccactgtggaaatcgtgacgatgtcccaccaggcgctgggagacgtggctggacgtggaaacgagaagaagccatcttccgtgagagcactgagcatcgtgctccccatcgtgctcctggtctttctgtgcctcggagtgtttctgctctggaagaactggagactgaagaacatcaacagcattaacttcgacaacccagtgtatcaaaagaccactgaagatgaagtccacatctgccacaatcaggatggatactcgtacccgtcacgccagatggtgtcactcgaggacgatgtggcc

SEQ ID NO: 16348 - DNA, 2580 bp, Artificial Sequence
  Description of Artificial Sequence: Synthetic coding sequence
atggggccgtggggctggaagcttcggtggacagtggcactgcttctggctgccgcaggaactgccgtgggcgatcgctgcgaacggaacgagttccagtgccaggacggaaagtgtatcagctataagtgggtgtgtgatggtagcgccgaatgtcaagatggatccgatgagagccaggaaacatgcctctcagtcacttgcaagagtggagacttttcttgcggaggtcgggtgaaccgctgcatcccacagttctggcgatgtgacggtcaggtcgattgtgacaatggatctgatgagcagggatgtcctcctaagacctgttctcaggatgagttccggtgccacgacggtaagtgcatctcacggcagtttgtgtgtgactctgaccgagattgtcttgacggatcagatgaggcaagctgtcccgtcttgacttgcggccccgctagcttccagtgcaattcatcaacatgtataccccagctgtgggcctgtgacaacgaccctgattgtgaagacgggtccgacgaatggcctcaaaggtgccgggggttatacgtgttccagggcgactccagcccttgctccgcttttgagttccactgtctgtctggcgagtgcatccactcgtcctggaggtgcgacggaggcccagactgcaaagataaatcagatgaggaaaattgcgccgtggccacctgtagaccggatgagttccaatgttcagatggcaattgtattcatggcagcaggcagtgcgacagggaatacgactgcaaagacatgagcgacgaagtgggctgcgtgaatgtgacgctgtgcgaaggccctaacaagtttaaatgccattccggggagtgtattactcttgataaggtttgcaacatggcccgggattgtcgagactggagcgatgagcccatcaaagagtgtggcaccaatgagtgtctggacaataacgggggatgctctcatgtgtgcaatgacctgaaaatcggggctgaatgcttgtgcccagatgggttccaactcgtcgcgcagaggaggtgtgaagatatagacgagtgccaggaccctgatacttgctcccaactatgcgttaacctggaagggggctacaaatgccagtgtgaggaaggtttccaactcgatccccataccaaggcctgtaaagctgtcggcagcatcgcttatttgttctttaccaacagacacgaagtgcgtaagatgaccttggatcgctccgaatacactagcttaattccaaacctccgcaacgtggtggccctggataccgaggttgcttctaaccgcatttactggtctgatttatcccagagaatgatctgctcaacacagcttgacagggcccacggggtctcaagctacgacactgttatctcacgcgacattcaagctcccgatggcttggccgtggactggatacactcaaacatctattggactgactcagtactggggacggtctccgtggcagatacgaagggagtgaaacgcaagaccttattccgggagaatggcagcaagcctcgtgccatcgtggtggaccccgtacacgggtttatgtactggactgactggggtacacccgctaagatcaagaaaggcgggctgaatggggtcgatatctactctcttgtcactgagaacatccagtggcccaatgggatcacgcttgaccttctgtcagggaggctgtactgggtagattccaaactgcatagcatcagttccattgacgtgaacggcggtaatcgaaagaccattttagaggacgaaaagaggctcgcccaccccttttctctggctgtctttgaggacaaggtgttctggacagatatcatcaacgaagctatcttctctgctaacaggctgacaggcagtgatgtgaatctgcttgctgagaacctgcttagcccggaggatatggtgctgtttcacaacctcacgcaacctcgaggcgtgaactggtgcgaaaggacaacgctgtcgaacgggggctgccagtacttatgtctgcccgcccctcaaatcaaccctcattcccccaagtttacctgcgcctgtcccgacggtatgttgttggcacgcgacatgcgctcatgccttactgaggcagaggccgccgtggccacccaggagactagcacagttcgactgaaggtgtcatctacagcggttaggacccagcacacgaccacgagacccgttcctgacacctcaagattacccggtgccacacctggcctcaccaccgtagaaatcgtcacaatgagtcaccaggcccttggcgatgtcgccgggcgcgggaacgagaaaaaaccatccagtgtgagggctctgtccattgtgctgccaatagtccttctagtgttcctttgcctcggggtgttcctcctgtggaagaactggaggctcaaaaatattaactctatcaattttgacaatccagtgtaccagaagacaactgaggacgaggtgcacatctgtcacaatcaggatgggtactcatacccttctagacagatggtctcactcgaagacgacgtggct
